United States Patent 9,782,462 (MODIFIED POLYNUCLEOTIDES FOR THE PRODUCTION OF PROTEINS ASSOCIATED WITH HUMAN DISEASE) - sequence listing, part 110

SEQ ID NO: 214278 - DNA, 2250 bp, Artificial Sequence
  Description of Artificial Sequence: Synthetic coding sequence
atggcgcacagaaaactcgagagtgtaggctctggaatgcttgatcatcgggtgcgcccaggaccagttccgcattctcaggaaccggagagcgaagacatggagctcccgttagaggggtacgttcccgagggcttggagcttgccgcactgagacccgaatccccagctccagaggaacaggaatgccataatcattccccagatggagactcatccagcgattatgtgaacaacacatccgaggaggaagactatgatgaggggttaccagaggaagaagagggtattacgtattatataagatactgcccggaagacgactcctacctcgaggggatggactgtaacggggaagagtacctggctcacagcgcacacccagtcgacaccgacgagtgccaggaggcagtcgaggaatggacggactccgccggtccacatccccatggccatgaggcagaaggatcacaagattatcctgacggtcagctgccaatccctgaggatgagccatccgtattagaagcgcatgaccaggaggaggatgggcactattgcgccagcaaggagggctatcaggattattaccccgaggaggcaaacgggaacactggagcatctccctatcgactcagaaggggggacggggacctggaagatcaagaagaggacatagatcagatcgttgccgagataaagatgtcgctgagcatgacttcaatcacctcggcctcggaggcgagtccagagcacggcccagagcctggcccagaagacagtgtcgaagcatgtcctcccattaaggccagttgttctccttcccgtcatgaagcgagacccaaatcccttaacctgcttcccgaagccaaacacccaggagaccctcagcgaggctttaagcccaaaacacgtaccccggaagaacgcctgaagtggccccatgaacaagtgtgtaacggtttagagcagccaagaaaacaacagagaagcgacctgaacggacccgtggacaataacaacatacccgagactaagaaagtcgcctcatttcccagtttcgtcgcagttcctgggccttgcgagcccgaggacctgattgatggaattatattcgccgctaattacttggggagcacacagctgctctccgaaaggaacccctctaaaaacatccggatgatgcaggcccaggaagcagtgagtagggtgaagcgcatgcagaaggccgcaaaaatcaagaagaaggccaattccgagggggacgcccagaccctgacagaggtggatttgttcatttctactcagagaatcaaggtgttgaacgccgatactcaagaaactatgatggaccatgcactgagaaccattagctacatcgccgatatcggcaatatcgtggtcttaatggccagacgcagaatgccccgttcagcaagccaggactgtatcgagactacgcccggagctcaggaaggtaaaaagcagtacaaaatgatctgccacgtgttcgaatcggaagatgcccagctgatcgctcagtccatagggcaggcattcagcgtggcttaccaggagtttctacgcgctaatggtattaaccccgaggacttgtctcagaaggaatactctgacattatcaatacccaggagatgtacaacgatgatttgattcacttcagtaactccgagaattgcaaagagttgcagctggaaaaacacaaaggtgaaatactgggagttgtggtagtggaatccggatggggaagcatcctacccaccgttatccttgcgaatatgatgaatgggggacctgccgctcgttctggcaaattgtctatcggcgaccagattatgtctatcaacggcactagccttgtcggactacctctcgcgacatgtcagggcattattaaggggctcaaaaatcagacgcaagtcaaactgaatattgtctcctgccctcccgtaacaaccgtcctcatcaagcgaccggatctgaaataccagctcggttttagtgttcagaacggcattatctgttctctaatgcggggtggcatagctgagcgtgggggagttagagtggggcataggataatcgagattaatggccagagcgtggtggcaactgcccatgagaagattgtgcaggcgctgtctaactcagttggcgagatacatatgaaaacaatgcccgctgcaatgtttcgactgctcaccgggcaggaaacaccactttatatttag

SEQ ID NO: 214279 - DNA, 2214 bp, Artificial Sequence
  Description of Artificial Sequence: Synthetic coding sequence
atggcccaccgcaagctggagtctgtgggctcgggaatgcttgaccaccgtgttagaccaggacctgtgccgcactctcaggaaccagagtctgaagacatggaattgcctcttgaggggtatgtgcccgaaggattggagctggctgctctgcgacctgagtcccccgcacctgaggaacaggaatgtcacaatcattcacctgacggggattcatcttctgattacgtgaataatacctcagaagaggaagattacgacgaggggcttcctgaagaagaggaaggtatcacctactatatcagatattgtccagaggatgatagttatctggagggcatggattgtaatggggaggagtacctggcccactctgcgcatcccgtcgacactgatgagtgtcaggaagccgttgaggaatggactgactccgccggacctcacccccacggtcacgaggcagaaggcagtcaggattacccagacggccaactgcccatccccgaagacgagcctagcgtcttagaagcacacgaccaggaggaggacggccattactgcgctagcaaagagggatatcaagattattatccagaggaggcaaacggcaacactggagcttccccctaccgtctcagacgcggagatggcgatctggaagaccaggaagaggacatcgaccagatcgtagcagaaattaagatgagcctgagcatgaccagtataactagtgccagtgaagcctcccccgaacatggacccgagccagggccagaagactcagtggaggcctgtccccctatcaaagcctcttgcagccctagcagacacgaggcgaggccaaaatcccttaacttgctccctgaagcaaaacacccaggcgatccacagcgtggattcaagccaaaaaccagaacccctgaggagagactcaagtggccccatgaacaggtatgtaacggcctggaacagccccgaaaacagcagcgcagtgacctcaacgggcctgttgataacaacaacattcccgaaacaaaaaaggttgcaagcttccccagcttcgtcgcggtacccggtccatgcgaacctgaggatctgatcgatggcattatctttgcggctaactatctgggctccactcagctgctttcagaacgcaacccgagtaaaaatatcaggatgatgcaggctcaagaggccgtttctagggttaagaattcagaaggtgacgcacagacactgactgaggtggacctcttcatatccacacaacgcatcaaggtgctcaacgctgacactcaggagacaatgatggaccacgccctgagaaccatatcgtacatagctgatattggaaatattgtggtattgatggcccgacgcaggatgcctcgaagcgcatctcaagactgcattgaaaccactcccggagctcaagagggcaagaagcagtacaagatgatctgccacgtgttcgaaagcgaagatgcccagctaatcgcacagtctattggtcaggctttcagtgtcgcttatcaggaatttctgcgagcaaatggtatcaatcctgaggatttgagccaaaaggagtattcagacattatcaatactcaggagatgtataacgatgaccttatccacttctctaacagcgagaattgcaaagagctccagctggagaagcacaaaggcgaaatccttggcgtcgtggtcgtagaatctggctgggggtccatactgcctaccgttatcctggctaacatgatgaatggaggtcccgctgccaggagcgggaaactgtccattggggaccagatcatgtccatcaacggtacttccctcgtgggactgcccctcgcaacttgccaagggataattaagggcctgaaaaatcagacgcaggtgaaactgaacatcgtgagctgtccccctgtgaccacggtgctaattaaacggcctgatctgaagtatcagctgggcttcagtgtgcagaacggtatcatatgtagcctcatgagagggggtattgcagagcggggaggagtaagagtgggtcacaggatcatcgagatcaatggacagtcagtcgtggccactgcgcacgagaagattgtgcaggccttgtccaattctgttggtgagatccacatgaagacgatgccggcagctatgttccgactgttaactggacaagaaacccccctttatatctag

SEQ ID NO: 214280 - DNA, 795 bp, Artificial Sequence
  Description of Artificial Sequence: Synthetic coding sequence
atggcgcatcgtaagctcgagtccgtcggtagcggcatgctcgatcatagggtgcgtccgggacctgtgccacattcccaggagcctgagtcagaagacatggaattgccgctggaggggtacgtacctgaaggattagaattggcggcactcaggccagaatcccccgctcccgaggagcaggagtgccataatcactccccagacggagacagctcttccgattacgtgaataacacatccgaggaggaagattatgacgaaggattgccagaggaggaagaagggatcacgtattatattaggtattgtccggaagacgactcttacctggagggaatggactgtaatggcgaggaatacctcgctcactctgcacatccggtcgataccgatgaatgtcaggaagctgtagaagagtggacagactcagccggacctcatcctcacgggcacgaggctgagggatctcaagactatccagacggccagctgccaattccagaagacgagccgtccgtgttggaggcgcacgaccaagaggaggatggccattactgcgctagtaaagagggctatcaggattactaccctgaagaggcgaacggcaacaccggtgcttccccttacaggttgcgcaggggagacggggatttagaggaccaggaggaggatattgatcagattgttgctgagatcaaaatgtctctctcaatgacctcaattactagcgcgtctgaggccagccccgagcacgggccagaacctgggccagaggattccgtcgaggcctag

SEQ ID NO: 214281 - DNA, 2250 bp, Artificial Sequence
  Description of Artificial Sequence: Synthetic coding sequence
atggcccacagaaaattagagtcagttggctctggtatgctggatcacagggtaagacctgggcctgtgccccattcccaagaaccagagagtgaagatatggagctgccacttgaagggtacgtgccggagggcttagagctggccgcattaagaccagagtcccctgccccagaagagcaggagtgccacaatcacagccccgacggcgatagctcctccgactacgtgaacaataccagtgaagaggaggactatgatgagggactacccgaggaagaagagggtatcacctactacattagatactgtccagaggatgacagttacttggagggcatggactgcaacggagaggaatatctggcccacagcgctcaccctgttgatacagacgagtgccaggaggccgtcgaggagtggaccgattctgcaggaccacatccacacggccatgaggccgagggaagccaggattatccagatggtcagctgcctatcccagaggacgagccaagcgtgttggaggcacacgaccaagaagaggatgggcattactgtgcctctaaggagggatatcaagattactatccagaagaggctaatggcaataccggggcaagcccctatcggttgcgcagaggtgacggcgacctagaagaccaggaggaagacattgaccagatcgtagcagagatcaaaatgagtctctcaatgacgtccattacctccgcttcagaagcctctcccgagcatggccctgagccgggacccgaagacagtgtcgaggcatgcccacctatcaaagcttcttgttccccctcgcgacacgaagcccgtcccaagagcctgaatctccttcccgaggcaaagcatccaggcgacccacagaggggcttcaagcctaaaacgcggacgcctgaagaaaggctcaagtggccccatgagcaggtctgcaacggactggagcaacctagaaagcaacagcggtcggacctcaatgggcctgttgacaataataacattcccgaaaccaagaaggtggcatctttcccgtctttcgtggccgtccctggcccttgcgagcccgaagaccttatagacgggatcatcttcgccgcaaattacctagggtctacccaactactcagcgagcggaacccctccaagaatattaggatgatgcaggcccaagaggccgtctctcgggtaaagagaatgcagaaagccgcaaaaattaaaaaaaaagcaaactccgagggcgatgcacagaccctcactgaagtggacctgtttatctccacccagcgaatcaaagtactgaacgctgatacacaggaaacaatgatggatcacgccctgcggaccatttcctatattgctgacattggaaatatcgtggtgctgatggctagacggagaatgccaagatccgccagtcaggactgtatcgaaactactccaggtgctcaggaggggaaaaagcaatacaagatgatatgtcatgtgttcgagagtgaagacgcccagctgatcgctcagtctatcggacaggccttcagcgtcgcttaccaggaattcttgcgggcaaacggcattaatcctgaagatttgagccaaaaggagtactcagatatcatcaatactcaagaaatgtacaatgatgatcttatacacttttccaactccgagaactgtaaagagctacagcttgaaaagcacaaaggggagatattaggggtggtcgtggtagagagtggctggggttccatcctgccaactgtgatactggcaaacatgatgaatggaggacccgctgcaagaagcggaaagctctctatcggagatcagataatgtccatcaacggaaccagcctcgtaggcctgcctctggctacctgtcagggaattattaaagggctgaaaaaccaaactcaagtgaagctcaatatcgtgagctgtccacctgtcacaactgtacttataaaaaggcctgatctgaaataccaactcggattctctgtacagaacggaatcatctgcagtctgatgaggggaggcatcgccgagagggggggagtgcgcgtgggccacagaatcatagagatcaatggccagtctgtcgttgccaccgcccatgaaaagattgtgcaggccctgagcaattctgtgggagagattcacatgaaaacgatgcctgccgcaatgttcagactcctgacgggccaagagacacccctctatatctag

SEQ ID NO: 214282 - DNA, 213 bp, Artificial Sequence
  Description of Artificial Sequence: Synthetic coding sequence
atggcccatcgtaagttggagagcgtgggcagcggaatgctggatcatcgggtccggcctgggccagtgccgcactcccaggagcccgagagcgaggacatggagctgcctcttgaagggtatgtgccggagggtttagagctggcagcacttaggcccgagagccccgcacccgaagagcaggaatgccataatcatagcccagacgggtag

SEQ ID NO: 214283 - DNA, 15 bp, Artificial Sequence
  Description of Artificial Sequence: Synthetic coding sequence
atggctcacagatag

SEQ ID NO: 214284 - DNA, 339 bp, Artificial Sequence
  Description of Artificial Sequence: Synthetic coding sequence
atggcccaccggaagctggagtccgtgggcagcggaatgctggatcatcgggttcggcctggcccagtgccccacagccaagagccggaaagtgaagacatggaattgcccctagagggctacgttcctgaagggttagagctagcagctctgaggcccgagtcgcctgccccagaagagcaggagtgtcataaccattcccctgacggagatagctcatcagactatgttaataataccagtgaggaggaggactacgacgagggcctacccgaggaagaagaaggtattacctactatattcggtactgccccgaggatgattcatatttggaatag

SEQ ID NO: 214285 - DNA, 2250 bp, Artificial Sequence
  Description of Artificial Sequence: Synthetic coding sequence
atggcccaccggaagttggaaagcgtgggcagcggcatgctcgatcacagagtccgcccaggacccgtgccccatagccaggagccagaatctgaggacatggagctccctctcgaggggtatgtacccgagggcctggagctcgccgctctgaggcccgaaagccccgctcccgaagaacaggagtgtcacaatcacagccctgatggggattcgtcaagcgattatgtgaacaatacttcagaggaagaggactacgatgagggcctgcctgaggaggaagagggaatcacctattacatccgttattgtcccgaggacgacagctatctcgaggggatggactgtaacggagaggagtacctagcacacagcgcgcaccccgtggataccgacgaatgtcaggaggctgtagaggagtggacagattccgcaggaccgcaccctcacggccacgaggctgaggggtctcaggattacccagacggtcaactgcccatacctgaggacgagccatcagtgcttgaggctcacgatcaggaggaggatggtcattactgtgcctctaaagagggataccaagattactatcctgaagaagccaacggcaacaccggagcctccccctaccgccttaggcggggtgatggagacttggaggatcaggaagaggacattgaccagattgtagcagagatcaaaatgtccctcagtatgacctcaatcactagtgcatctgaggccagcccagaacatggtcccgaacccggaccagaagactctgtcgaggcatgcccaccaataaaggcctcctgttcacctagcaggcacgaagcccgtccgaagagcctcaatctgcttcccgaggccaagcaccccggagacccacaacgcggattcaaacccaagacaaggacccctgaagaaaggctgaagtggccgcatgaacaggtatgtaacgggctcgaacaacctagaaagcagcaaagaagcgatttaaacggccctgttgacaataacaatattcccgagaccaaaaaggttgcatctttcccatcttttgttgccgtgcccggtccctgtgagcctgaggacctgatcgatggtatcatcttcgcagcaaattacctgggctccacccagttgctcagcgaacggaatccgtcaaaaaatattcgtatgatgcaggcacaagaagctgtgtcaagagttaaaagaatgcagaaagcggctaaaattaagaagaaagcaaatagcgaaggtgatgctcagactctgaccgaagttgacctgttcatctccactcaacgcatcaaggtgctaaacgcagatacccaagagactatgatggaccatgcgctgaggacaatcagttacatagcagacatcggcaatatagtagttctcatggctcgcagacggatgcccaggtcagcctcacaggactgtatcgaaaccacccctggtgcccaggaggggaagaaacagtacaagatgatctgccatgtatttgaatctgaagacgcccaactgattgcccagtcaatcggacaggctttcagtgtggcataccaggagtttctgcgagccaatggaatcaaccctgaggacctctctcagaaagaatactcggatatcattaacacacaagagatgtacaacgacgatctgatccatttcagcaacagcgagaactgcaaagagctacaattagaaaagcataagggagagattttgggtgttgtggtagtcgaatctgggtgggggtctatccttcctacagtcatccttgctaacatgatgaatggcggtccagccgcaagaagtgggaaactctcaattggcgaccagattatgtcaatcaacgggacgtcgctggtggggcttcctcttgcaacttgtcagggcataatcaaaggcctgaagaatcagactcaagtgaaactgaatatcgtatcctgcccacccgtaactactgtgttaattaagaggccagacctgaagtatcagttgggcttcagcgtccagaatgggataatatgttccctgatgagggggggaatcgctgagagaggtggcgtcagagtcggccaccggatcatcgaaatcaatgggcagagtgttgtggcgactgcccatgagaaaatagtgcaggccttgagcaacagcgtgggggaaattcatatgaaaactatgcctgccgctatgtttaggctgctgaccggtcaggagacacccctctatatttag

SEQ ID NO: 214286 - DNA, 2127 bp, Artificial Sequence
  Description of Artificial Sequence: Synthetic coding sequence
atgtccgttccaagctcgctctctcagagcgccatcaacgctaattcacatggtgggccagccctgtcactgccactgccactgcatgctgcacataaccagctgttgaacgctaagttacaagccacagctgttgggccaaaagacctacgcagtgccatgggtgagggcggaggcccagagccaggacccgctaatgcgaagtggttgaaggagggacaaaaccagctgcggagagcagctaccgcacacagagatcaaaatcgcaatgtcacgttgacactggcggaggaggcatcccaggagcccgagatggctcccttgggcccaaaaggcctcatccacctgtactctgagctggaactgtctgcccacaacgctgctaatcgaggcctccgcggaccaggcctcataatcagcacccaagagcaagggcctgatgagggggaagaaaaggccgcaggtgaagccgaggaagaggaggaagacgacgatgacgaggaggaggaagaagacttatcctctcctcccggattacccgaacccctcgagtccgtagaagcccctccacgccctcaggccctcacagatgggccacgagaacactccaagtccgcctccctgctgttcggcatgcggaattctgcggcttccgacgaggacagcagctgggctacactatctcaggggagtcccagttacggaagccccgaggacacggattccttctggaatccaaacgcatttgagactgactctgacctaccggctgggtggatgcgtgtgcaagacaccagcggcacctattactggcacattccaaccggtacgactcaatgggaaccccctggccgagcctctccatcccaggggagttccccccaggaagaatcccagcttacctggaccggctttgcccatggggaagggtttgaggatggagaattctggaaggatgaacccagcgacgaggcccctatggagctggggttgaaggagcccgaagaaggaacgctgacctttccagcccagagcctgtcccccgagccactgccccaggaagaagaaaagctgcctccaaggaacaccaaccctggtattaagtgcttcgccgtcaggtcccttgggtgggtggagatgaccgaggaagaactggcgcctgggaggagttccgtggctgtgaataactgcatccgtcagctctcctatcataagaataatttgcacgaccctatgtcaggtgggtggggagagggaaaggatctactgctccagcttgaggacgagactcttaagttggtcgagccacagtctcaggcccttctgcatgcacagcctattatctcgatccgcgtatggggtgttggtcgcgattccggacgcgattttgcatacgtggccagggacaaacttacacaaatgcttaagtgccatgtgttcaggtgcgaggcgccagcaaagaacatcgcaacttcactacacgagatatgcagtaaaatcatggcagaacgcaggaacgccaggtgcctcgtgaacggtcttagtctagatcactctaagctggtcgacgtgccctttcaggtagagttccctgccccaaaaaacgaattagtgcagaagtttcaagtgtactatctgggcaatgtgccagtcgccaaacctgtcggcgttgacgtgattaacggcgcactcgaatcagtgttgtcctctagttctagggagcagtggactccatctcacgtgtcagtggcacccgctaccttaacgatcctccaccagcaaacagaagccgttctgggcgagtgccgggtacgcttcctgagcttcctggccgtcggcagagacgttcatacctttgcgtttataatggctgcgggtccagcaagcttttgttgtcatatgttttggtgtgagccaaacgccgctagcctgagcgaggccgtccaggccgcttgcatgcttagataccagaaatgtcttgacgccagatcacaggctagcacatcatgtttaccggctcctccggctgagagcgtcgcacggcgagttggctggaccgtccggagaggggtgcagagcctgtgggggtctttgaaacctaaaaggcttggggcacacactccgtag

SEQ ID NO: 214287 - DNA, 2127 bp, Artificial Sequence
  Description of Artificial Sequence: Synthetic coding sequence
atgtctgtgcctagcagcctttcccagtctgccatcaatgccaattcacatggcggtcccgctcttagcttgcccctaccactccacgctgcacataaccagctcttaaatgccaagctccaagccaccgcggtaggcccaaaggacttacgatctgccatgggggagggaggcggacctgagcctgggccagctaacgccaagtggctgaaggaaggacagaatcaactgagacgagccgctacggctcacagggaccagaatcggaacgtgactcttactcttgccgaagaggcctcacaggagccggagatggccccactcgggcctaagggcttgatacacctttatagcgaactggaactgagtgcccacaacgcagctaatagggggctgaggggtccaggcctgatcattagcacccaggagcaggggccagacgagggcgaggagaaagcggcaggtgaggctgaagaagaagaggaggacgacgatgacgaggaggaagaagaggacctttctagcccgcctgggctgcctgagcctctcgaatcggtggaagcccctcccagacctcaggcactgaccgatggaccgagagaacattctaagagtgcaagcctgctgttcggtatgagaaactccgctgcaagtgacgaggattcatcctgggccacactaagtcaaggcagcccaagctacgggagccctgaagatacagactcattctggaacccaaatgcctttgaaacagactctgatctcccggctggttggatgcgcgtgcaggacaccagtgggacatactactggcacatacctaccggcacaacacaatgggagccgccagggcgagcctccccctcccaaggtagctcacctcaagaggaaagccagctgacatggactggctttgcccacggagagggttttgaggatggggagttttggaaggacgagccctctgacgaggcccctatggagctcggccttaaagagcctgaggagggtacgctcacttttcctgcccagtctctttcaccagagcctctcccacaagaagaagagaaactgccccctcgcaacaccaaccctggcatcaaatgttttgctgttagatcccttggttgggtggagatgacagaggaggaactcgccccagggagaagcagcgtggccgtgaacaactgcattcgccagctatcctaccataaaaataacctgcacgatccaatgagcgggggttggggtgaagggaaggatctactgcttcagctcgaggatgagacactgaagcttgtggagcctcagtcacaagcactgctccacgcacaaccaatcatcagtattcgcgtgtggggtgtcggcagggactccggcagagacttcgcttacgtagccagggacaagctgactcagatgctgaagtgccacgtcttccgctgcgaagcaccggcaaagaatatcgccacttccttacacgagatttgctccaaaatcatggcagagaggcgtaatgcaagatgcctggtgaatggcctatcactggatcactcgaagctggtggatgtgccgttccaagtggaattccccgctcctaaaaatgagttggtgcaaaaattccaggtgtattatctggggaacgttcctgtggccaaacctgtgggcgtagatgtgattaatggcgctttggagtctgtcctgagctctagctcacgcgaacaatggaccccttcacacgtgagcgtggcacccgctaccctgacaattttgcaccagcagacagaggctgttcttggggaatgtagggttagatttctctccttcctggctgtggggcgtgacgtccacaccttcgcattcattatggctgccggaccagcctcattttgctgtcacatgttttggtgcgagccaaacgcggcatcactgtccgaggcagttcaggctgcgtgcatgcttagataccaaaagtgcctggacgccaggagtcaggcttcaacgtcttgcctcccggctcccccagccgagtcagtcgccagaagggtaggctggactgtccggaggggagtccagagtctgtgggggtcgcttaaacctaagagactgggagcacacacaccctag

SEQ ID NO: 214288 - DNA, 2133 bp, Artificial Sequence
  Description of Artificial Sequence: Synthetic coding sequence
atgagcgtaccctcttctctgtcacaaagcgccattaacgcaaactctcatggcggacctgccctgtctcttcccctgccgttacacgccgctcacaaccaacttctaaatgctaagctccaggctacagcagtgggtccaaaggacctccgcagtgcaatgggagagggaggtgggcctgaacccggacccgctaacgctaaatggctgaaggaagggcagaatcaactcagaagagccgctacagcccatcgggaccagaatcgcaatgttaccctgacgcttgcagaggaggcttcacaggaacccgagatggccccactagggccaaagggcttgatacacctgtactctgagttggagctgtctgcccacaacgccgctaaccgcggtctccggggacctgggctgattattagtactcaggagcagggacccgacgagggggaggagaaggccgcaggcgaggctgaggaggaggaggaggatgatgatgatgaagaagaggaggaggatctgtcatcaccgccaggcctgcctgaaccccttgagtccgtcgaagcgccaccaagaccacaggctctgacagacggaccgagagagcatagcaaatctgcctccttactcttcggcatgcgcaactccgcggcttctgacgaggactcctcttgggctacccttagccagggttcaccgtcatatgggtcccccgaggacactgacagtttctggaaccccaatgcattcgagacagactccgacctgccggcagggtggatgcgggtgcaagacactagtggtacctattactggcatattcccacgggaaccacccagtgggaaccacctgggagagctagtccatcacagggctcttcacctcaggaagaatcgcagctcacctggaccggtttcgcgcatggagaaggctttgaggacggagaattctggaaggatgaaccatcagatgaggcgccaatggaactggggctcaaagaaccagaggagggcacccttacgttccctgcgcagagcctgtctccagaaccactgcctcaagaagaggagaagcttcctcccagaaacaccaacccaggaatcaaatgcttcgccgtcagatccctgggatgggtagaaatgaccgaggaggagctcgcacctggaagaagttcagtggcagtaaacaactgcatccgccagctgtcctaccataaaaataacctgcatgatcctatgtccggaggctggggcgagggcaaggatttgctgctacaactagaggatgaaactcttaaattggttgagccacagtcacaggccctcctgcatgcacagccaatcatctcaatacgggtctggggcgtgggcagggactcagggtccaaccgtgattttgcttacgttgcacgggataaactcacccagatgctgaaatgtcatgtgttccgctgtgaagcaccagcaaaaaatattgccacttccctgcacgaaatttgcagcaaaatcatggccgagaggcggaatgctcggtgcctagtaaacggtctgagtcttgaccacagcaaactggtagacgtgccctttcaggtggagtttccagccccaaaaaatgagctagtgcagaaattccaggtatactatcttggaaacgtgcctgtcgctaaacctgttggtgtcgacgtgatcaacggtgcattggaaagtgtgttgtctagcagcagtcgcgagcagtggacaccctcacatgtctccgtcgcaccggctacgttgaccatactgcatcaacagacagaggctgtcctaggcgaatgtcgcgtgcgatttttgtcctttctcgctgtgggccgagacgtgcatacctttgccttcataatggcagcaggacctgccagtttctgctgccacatgttttggtgcgaacccaatgcagcatctctgtctgaggccgtacaagccgcatgcatgcttcgctaccagaagtgcctggatgccaggagtcaagcctctacgtcctgcctccccgctcccccagcagagtccgtagctagacgggtgggatggacagtgagaaggggggtccagagcttgtgggggagtctcaaaccaaagaggttaggagctcataccccatag

SEQ ID NO: 214289 - DNA, 1356 bp, Artificial Sequence
  Description of Artificial Sequence: Synthetic coding sequence
atgcgggtacaggacaccagcggtacgtattattggcacatccccactggaaccacccagtgggaaccaccgggacgagcaagtccaagccagggctcttctccgcaggaagaaagccaattaacatggactggattcgcccacggagaagggtttgaagatggtgagttttggaaggatgaacccagcgatgaggcccctatggagctcggccttaaggagccagaggaaggtacattaacctttcccgcacaatctcttagccccgagcccctaccccaagaggaggaaaagttgcccccaagaaacacaaacccaggaattaaatgttttgctgttcgaagcctcggatgggtagagatgaccgaggaagaattagcaccaggacgctcatccgtggccgtcaacaactgtatcaggcagctgagttaccacaagaataatttacacgaccctatgtctggtggttggggcgagggcaaagacctgttgctgcagctcgaagacgagaccctcaagctggtggagccccaaagccaggctctgttacatgcacaaccgatcatatcgattcgcgtctggggtgtcggtagagactccggatcgaaccgggacttcgcttacgtggccagagataagctgacgcagatgctcaaatgtcatgtgttccgttgtgaggctccggctaagaacatagccacatcgctccacgaaatctgttctaagatcatggccgagcggaggaatgcaagatgcctggtgaatgggctgtcactggatcattccaaactggtggacgttccttttcaggtggagtttcccgcacctaagaacgaactggttcagaaatttcaggtgtattatctgggaaacgttccagttgcaaagcctgtcggagtggacgtcattaatggcgcactggaaagcgtgctttcaagcagcagtcgggagcaatggacccctagtcacgtgtcagtggcccctgccacgctgaccatactccaccaacagactgaggccgtactgggagaatgtcgcgtgcgattcctgagcttcctggcagtagggagggatgtgcacactttcgcattcatcatggccgcaggtccagcttccttctgctgccatatgttctggtgcgaacccaacgcagcctccctgtcagaggccgttcaagcggcttgcatgctccggtatcagaaatgtttagatgctcggagccaggcctcaaccagctgtctgcccgctccgcctgcggagtcagtcgctagaagggtaggctggactgtaaggagaggcgtgcagtctctctgggggagtctgaaacccaaaaggttgggagctcataccccatag

SEQ ID NO: 214290 - DNA, 1680 bp, Artificial Sequence
  Description of Artificial Sequence: Synthetic coding sequence
atgtcagtgcctagctcattatcccagtctgccatcaatgccaatagccatggaggtcctgctctctcactgcccttaccattacatgccgcacacaaccagctgctgaacgcaaagctgcaggccacagctgtagggccaaaggatcttcattccaagtcagcttccctgctgtttggaatgcgcaacagcgctgcatccgatgaagactcttcctgggccaccctttctcaaggcagcccaagctatggatccccggaagacactgattcattttggaatcccaatgctttcgagaccgatagcgatcttccggctggctggatgcgggtccaggacaccagcggaacatattactggcacatccccacgggaaccacccagtgggaaccccctgggcgtgcttccccatcccaaggcagctctcctcaagaagagtcacagctgacatggactggtttcgcccatggggaaggtttcgaggacggcgagttctggaaggacgaaccatcagatgaagcacccatggagctggggctgaaagagcctgaggagggcacgctaacattcccagctcaaagcctctcccctgagccactccctcaggaggaggaaaagctccctccccgtaatacgaaccctggaataaagtgttttgcagttcgtagtctcgggtgggtggagatgaccgaggaggagctcgcacccggtcgttcttccgttgccgttaacaactgtatcagacagcttagctatcacaagaacaatctgcatgatcctatgagcgggggttggggcgaaggcaaagacctcctgttacaacttgaggacgagactttaaaattagtcgagccacagtcacaggctcttttacacgctcagcctataattagcatccgggtgtggggtgtgggtagagattcgggcagcaaccgggactttgcctacgtggcccgagacaaactgacccagatgttaaaatgtcatgtatttcggtgcgaagcgcctgccaagaacatcgctacatctctgcacgagatttgctcaaagattatggctgagcgtaggaacgccaggtgcctggtcaacggcttgtccctcgatcactccaagctggtcgatgtacccttccaagtcgaattccccgctcctaaaaatgagctggtccaaaagttccaagtctattacctcggtaatgtgcctgttgctaagcccgtgggggtggacgtcatcaatggagctctggagtctgttttgagcagctcatctcgcgaacaatggacgccatcccacgtctcagtggccccagccacgttgacgatcctgcatcagcaaacagaagcagttcttggcgagtgtcgtgttagattcctgtcattcttggcggttgggcgagatgtccatactttcgctttcataatggccgctggcccagccagcttttgctgccacatgttctggtgcgagccaaatgcagctagcctgagcgaggcagtgcaggcagcgtgcatgctgcggtaccagaagtgcttggatgccagaagccaggcctcaacgtcttgtttacccgcaccacccgctgaatctgttgccaggcgagtcgggtggaccgtgcggcgaggcgtgcaatccctgtgggggagtttaaagcctaaaaggttgggagcccacacaccgtag

SEQ ID NO: 214291 - DNA, 1428 bp, Artificial Sequence
  Description of Artificial Sequence: Synthetic coding sequence
atgacacagatgagagactccttttggaatccgaacgcttttgagacagacagcgacctcccagccggttggatgcgtgtacaagatacttccgggacctattactggcatattcccactggcaccactcagtgggaaccacctggaagagcgagcccgagccagggatctagtccccaggaagagtcccagctaacgtggaccggattcgcccacggtgaaggattcgaagacggcgagttctggaaagatgaaccgtccgatgaggcgccaatggagctaggcctcaaggagcccgaagagggaactctgacctttcctgcccaaagtctgtcacctgagccgctcccacaggaagaggaaaaattaccaccacgcaacacgaatccagggatcaaatgtttcgccgtaaggtccctgggatgggtggaaatgacagaagaagagctggcgcctggtcgctcctctgtcgccgttaataactgtatccgccagctgagctaccacaagaataatctgcatgaccccatgtcgggcggttggggggagggaaaagacctactgctgcagcttgaagacgaaacgctaaagctggtggagccccagtcacaggccctgctgcatgcccagccaattatatctatacgagtgtggggtgtagggcgagattctggatccaaccgcgatttcgcttatgtggccagagataagctcacccagatgttaaaatgtcacgtcttcaggtgcgaagcccctgctaaaaatattgctaccagtcttcatgagatatgctccaagattatggcagaaaggcgcaatgcgcgttgcctggtgaatggactcagccttgaccactccaaactggtggacgtccccttccaagtggaattcccggcacccaagaatgaactggttcagaaatttcaagtgtattatttaggcaacgtgcccgttgccaagcccgtgggggtggacgtgattaacggggcactggagtctgttctcagcagctccagccgggagcagtggaccccgtcccatgtatcggtggcacccgctaccctgaccattttacaccagcaaactgaagcagtgctgggcgaatgcagagtacgattccttagtttcttggcagtgggtcgcgacgttcacacattcgcttttattatggcagcgggtccagcaagtttctgctgtcacatgttttggtgtgagccaaatgcggcaagtttatcagaggccgtgcaggccgcatgcatgctgagatatcagaaatgccttgatgccaggagccaggccagtacctcatgcttgcctgctcctccagccgagtccgtggcaaggagggtggggtggaccgtcagaagaggtgtccaaagcttatgggggtccctaaaaccgaaaaggcttggggctcataccccctag

SEQ ID NO: 214292 - DNA, 2277 bp, Artificial Sequence
  Description of Artificial Sequence: Synthetic coding sequence
atgagcgaggtgcttcccgcagactctggtgtggatactctggctgtatttatggccagttcgggaactactgacgttacgaatcggaactcacccgcaaccccccctaacactcttaaccttcgctcaagtcataacgaattgctgaatgccgagatcaagcacaccgaaaccaagaactctactcctcctaaatgccgtaagaagtatgcgctcaccaatatccaggctgcgatgggccttagtgaccctgccgctcagcctctgttgggaaatggcagtgccaacatcaagctggttaaaaacggagagaaccagttgaggaaagctgccgaacagggccaacaggacccaaacaaaaatcttagccctaccgccgttatcaacattacctctgagaaattggagggaaaggaacctcaccctcaggatagctcctcctgcgagatcctgcctagccagccccgtagaacgaagagcttccttaattattacgctgacctggagacttccgccagagagctggagcaaaaccgagggaaccaccacggtaccgctgaggaaaaatcacaacccgtacagggccaggcgtctaccatcataggtaatggcgacttgctgctgcagaagcccaaccgtccgcagtcttctcccgaggacggacaggtggccacagtcagtagctctccggaaacgaaaaaggaccaccctaagacaggggcaaagactgactgcgctctgcaccgcatacagaacttggccccaagtgatgaggagagctcctggaccacattatcacaggattccgccagcccatcttccccggatgagacggacatttggtctgatcactcctttcaaaccgaccccgaccttccacctggttggaagagggtctccgatatcgccggtacctattactggcacattcctaccggaactacacaatgggaacgccctgtaagcattccagcggacctccagggctcccggaagggctctcttagctccgttacccccagcccaactcctgagaacgagaagcagccgtggtccgattttgccgttctaaatggcggaaaaataaacagcgatatctggaaagatctgcacgccgctaccgtcaacccagacccaagtctgaaggagtttgagggcgcaaccctgcggtatgcatccctcaagctgagaaacgctccccaccctgacgacgacgactcctgcagcataaactccgaccccgaagccaaatgctttgcagtgaggtcactgggatgggttgagatggcagaagaggaccttgcgccagggaagtcatctgtggctgtgaataactgcatccgtcagctctcatactgcaagaacgacattagagacaccgtcgggatctggggcgagggtaaggatatgtatctgatcctggaaaacgacatgctgtcactagtggatccaatggatagatcagtcttacactcccagcctatcgttagcattcgagtctggggagtgggtagggacaatggcagagatttcgcttatgttgccagggacaaagacacaagaatcctaaaatgccatgttttccgctgtgacacgcccgctaaggccatcgctactagcctccacgagatctgttcaaagattatggccgagcgcaaaaatgcgaaagccctggcctgttctagcctccaagagcgggctaacgtgaatctggacgtgccactgcaggtcgactttccgacccccaagactgaattggttcagaaatttcatgtccagtatttaggaatgttgcccgtggacaaacccgttggaatggacattcttaacagcgcgattgaaaatttgatgaccagttcgaataaggaggactggctgtccgtgaatatgaatgtggcggacgcaaccgtcacagtgatctcagagaaaaacgaagaggaggtgctggtggagtgtcgcgttagattcttgagcttcatgggtgtggggaaggatgtgcacacttttgccttcatcatggatactggaaaccagagatttgagtgtcacgtgttctggtgtgaacccaatgcgggtaacgtgagtgaggccgtgcaagcggcatgtatgctcagataccagaaatgccttgtcgcaaggcctccatcccagaaagtgcggccaccaccacccccagcggactccgttacacgcagagtgacaactaatgtgaagagaggcgtgctctcacttattgacactctgaagcaaaagcgacccgtgaccgagatgccgtag

SEQ ID NO: 214293 - DNA, 2274 bp, Artificial Sequence
  Description of Artificial Sequence: Synthetic coding sequence
tcgcattgtataccagccgacagtggtgtcgacactcttgccgtctttatggcctcctctggaacaactgatgtgaccaacaggaatagtcctgctacacctccaaatacactaaacctgcgctcatctcataacgagctgctgaatgcggaaatcaagcatactgaaaccaaaaactctacccctccgaaatgtcggaagaagtatgccctgactaatatacaggctgctatgggcctgagcgatccagctgctcaaccgcttttggggaacggaagcgccaatattaagctcgtgaagaacggcgagaaccaactacggaaggccgctgagcagggtcagcaggaccctaacaagaacttaagccctaccgccgtgatcaatatcactagtgaaaagctggagggtaaagagccccatccacaggactcttcttcatgcgaaattctgccaagccagccacgcagaacaaagagctttctgaactactacgcagatttagaaacttcagcgcgagagctcgagcagaacagaggaaaccatcacgggaccgcagaagaaaagagccagccggtccagggacaagcttctaccatcattgggaatggggatttgctgctccagaagcccaaccgtcctcagtcatcccccgaggatggtcaagttgcaactgtgtctagcagtcctgagacaaaaaaggaccatccgaaaacgggggcaaaaacggattgtgccctgcaccgcatccagaacctcgctccatcagacgaggaatcctcctggacaaccctgagccaggatagcgctagcccgtcatcacccgacgagacggacatttggtccgaccattcatttcaaacggatcccgaccttccccctggatggaagagggtatccgatatcgcgggtacttactactggcatatcccgaccgggacaacacaatgggagcgcccagtctcaattccggcagatttgcagggttccaggaagggatcgttgtcgtcagtcacaccaagccccacccccgaaaatgaaaaacaaccttggtccgatttcgcggtactgaacggcggaaaaataaattccgacatctggaaggacctgcatgctgcgactgtaaaccctgaccctagcctgaaagaattcgaaggcgcaacccttcgctacgccagccttaaactgcggaacgcccctcatcccgatgacgatgattcatgctccatcaattcagatcctgaagcaaaatgcttcgcagtgcgtagcctcgggtgggtggagatggccgaagaggacttagcacctgggaaaagctcggtcgccgtgaataactgtattcgacaactctcgtattgtaagaacgatatccgtgacacggttggtatctggggggagggcaaggacatgtacctgatcctggagaatgatatgctttcgctggttgatcccatggaccgatccgtgctgcacagccagcccattgtgtctatccgggtttggggggtggggagggataatggtcgtgactttgcttatgtcgccagagataaggatactcggattcttaaatgccatgtcttccggtgtgacactcccgctaaagcgatcgccacatctctacacgagatttgctctaagatcatggccgagagaaagaacgccaaggccctcgcctgctcatcactgcaggaacgagcaaacgttaatctcgatgtccccctccaggtggacttcccgacgcctaagacggaactagtccagaagttccacgtacagtatctcggcatgctcccagtggataagcctgtcggcatggacatcctaaactcagctatcgagaatcttatgacgagctcgaataaggaggattggctgtcagtgaatatgaacgtggccgatgctacagtcacagtgatttcagaaaaaaacgaggaggaggtgttagtggagtgccgggtgcgtttcctgtcgttcatgggcgtgggcaaagacgtacatactttcgctttcatcatggatacgggcaaccagcgattcgaatgccacgtgttttggtgtgagccaaacgccggaaatgtctcagaagcagtgcaggccgcttgtatgttgagatatcagaagtgccttgtggctagacccccatctcaaaaggtgagaccacctccacctccagcagactccgtgacccggagagtcacgaccaacgtgaagcgcggtgtgttaagcctgattgataccttaaagcagaaaaggccagtgaccgagatgccctag

SEQ ID NO: 214294 - DNA, 633 bp, Artificial Sequence
  Description of Artificial Sequence: Synthetic coding sequence
atggcagaaagaaaaaatgcaaaagctctcgcgtgttcctcactgcaggagcgcgctaatgtcaacttggacgtgcctctgcaggtagactttccaactcctaagaccgagctagttcagaagttccacgtacagtatctgggcatgctccctgtggacaagccagtggggatggatattcttaactctgcaatcgaaaacttgatgacttccagtaataaagaggactggctctccgttaacatgaatgtggccgatgcaaccgtgaccgttatcagcgagaaaaacgaggaagaggtgcttgtagagtgtagagtacgctttttatctttcatgggcgtgggtaaagacgtgcatactttcgcatttatcatggacacgggcaatcagagattcgagtgccacgtgttctggtgcgaacctaatgcgggaaatgtcagcgaagccgtgcaggccgcttgtatgctcaggtaccagaagtgcttagtcgcacgaccaccaagccagaaggttcggccacctccaccaccagccgattcagtgacccgtcgggtgacaaccaacgtcaagagaggagtgctatccctgattgataccctcaagcaaaagagacctgtgaccgagatgccatag

SEQ ID NO: 214295 - DNA, 33 bp, Artificial Sequence
  Description of Artificial Sequence: Synthetic coding sequence
atgagtgaagtgctgccagccgattccggatag

SEQ ID NO: 214296 - DNA, 633 bp, Artificial Sequence
  Description of Artificial Sequence: Synthetic coding sequence
atggcagagagaaagaatgccaaggcattagcatgttcttccctccaggagcgggcaaacgtgaacttggacgtgccgcttcaggtggattttccaaccccaaagaccgagctcgtgcagaaattccatgtgcagtatctggggatgctgccggttgataaacctgtgggtatggatattctcaattcggccatcgagaatcttatgacgtccagcaataaggaggactggctgagtgtgaacatgaatgtagccgatgccaccgttactgtgatcagcgaaaagaatgaagaggaagttctggttgagtgcagggtgcgttttctgtcattcatgggagtggggaaggatgtgcacacctttgcttttataatggataccggaaaccagcgctttgaatgtcatgttttttggtgtgagccgaatgcaggaaacgtatccgaggccgtacaggccgcatgcatgttgcgttatcagaagtgtctggtggctagacctccctcacagaaagttcggccaccaccccctcctgcagactccgtaactcgtcgagtgactacaaacgtcaaacgtggcgtgctttcactgattgacacactgaaacagaagcggccagtcactgagatgccctag

SEQ ID NO: 214297 - DNA, 2214 bp, Artificial Sequence
  Description of Artificial Sequence: Synthetic coding sequence
atgtccgaagtcttgccagccgactctggagtggataccctcgctgtgttcatggcttccagtgggacgactgatgtgacaaatcgcaattcccctgctacccccccaaataccctgaacctgaggtcctctcacaacgagctgctcaacgccgagataaaacacacggagaccaagaactctaccccccctaagtgcaggaaaaagtacgccctgacgaatattcaggcagccatggggctttctgatcctgcagcccagccgcttttaggtaacgggtccgccaatattaagcttgtgaaaaatggcgaaaatcagctgagaaaagctgctgaacaggggcaacaggatcccaataagaacctctcacccaccgctgttatcaatatcacatcggagaaactggaggggaaagagcctcaccctcaagattcttcatcctgtgagatcctccctagccagccacgcaggacaaaaagctttctgaattactacgctgacctggagacatccgcccgagaactggaacaaaacagggggaaccatcatggtacggctgaagaaaagtcccagcccgttcaggggcaggcttcaactattatcgggaacggcgacctgctgctccagaagcccaacaggccccaatcctcccccgaggatggacaagtggcaaccgtttcatccagtcccgaaacaaagaaggaccatccaaaaaccggagccaaaaccgactgcgctctgcatcgaatccagaatctggcccctagtgacgaagagagctcttggacaactttatcccaggattcagcatcgccatccagccccgacgaaaccgatatttggtcagaccacagttttcagacggaccccgacttacctccgggttggaagagggtgtcagacatcgctggcacctactactggcacatcccaaccggcaccacccaatgggaacgacctgtgtcaattcccgcagacctgcagggtagtcgtaaaggctctctaagctcagtcacaccctcgcctaccccggagaacgaagacctgcacgccgctaccgtgaacccggacccttcgcttaaagagttcgagggcgctaccctaaggtatgccagcctgaagcttcgcaatgcccctcaccctgacgatgacgactcctgcagtatcaattctgatccggaggccaagtgttttgctgtgcgcagtctgggctgggtggaaatggccgaggaggatctggccccaggtaagtcaagcgttgctgtcaataattgcattaggcaactgtcttattgtaagaacgacattcgcgacacagttggaatctggggggaaggcaaagatatgtacttaatactcgagaatgatatgctctcccttgtcgatcctatggacaggtcagttttgcattctcagcctattgtgtccattagggtttggggcgttggcagggacaacggccgtgactttgcctatgtggcccgagacaaagatactcggattctgaagtgccatgtctttagatgcgatactcctgcaaaagccatagctactagcttacatgagatctgctccaaaataatggccgagagaaagaacgcaaaggcactggcctgcagctctctccaggaacgtgcaaatgttaatctcgatgtgccccttcaggtcgattttccaactcctaagaccgagctggtgcagaagtttcacgtgcaatacctggggatgctgcccgtggataagcccgtgggcatggatattttgaattctgcgattgagaatctgatgacaagcagcaataaagaggactggctcagtgtgaacatgaacgtcgcggatgctacagtgacggtgattagtgaaaagaatgaggaggaagttttggtggagtgcagggtaagatttttgagcttcatgggcgtcggcaaagacgtgcacaccttcgcgtttatcatggacactggcaatcaaaggttcgagtgccacgtcttttggtgtgaacctaacgctggcaacgtttccgaggcggtgcaggctgcatgtatgttaaggtaccaaaagtgtttggtggccagacctccttcacagaaggtgagacctccgcctccgccagcggacagcgtcaccaggcgtgttactacgaatgttaaaagaggtgtgctatctctcatcgacacactgaaacagaagcgacccgtgacagagatgccctag

SEQ ID NO: 214298 - DNA, 2280 bp, Artificial Sequence
  Description of Artificial Sequence: Synthetic coding sequence
atgtccgaggtgctgcccgctgactccggtgtcgacactctagctgtgttcatggcgagtagcggaactaccgatgtcacaaaccgaaacagccccgctacccctccaaacacactcaacctgcggtcttctcacaacgagctgttgaatgctgagattaagcatacggagactaagaattcgacccccccaaagtgccgcaagaaatacgccctgacaaatattcaggcggcaatgggtttatccgacccggcagcgcagccactcctggggaacggaagtgccaatataaaactggtcaaaaacggtgagaatcagttgcgtaaggccgctgaacagggccagcaggacccaaacaagaatctatccccgactgcggttattaacattactagcgagaagctggagggtaaggagccgcaccctcaagactcatcatcatgtgaaattcttccttcccaaccaaggcgaacaaagtcttttctcaactattacgctgacttagaaacctcagcccgagaattagagcagaacaggggaaaccatcacggaacagccgaggagaagtcacagccagtccagggacaggcctcaacaattatcgggaatggcgatctgcttctgcagaagccaaatcggccacagtcttctccagaggacggacaggttgccactgttagttctagcccagagacgaaaaaagatcaccccaagacgggggctaaaactgactgtgctctacatcggatacagaacctggccccatccgacgaagagtcctcctggaccaccctctctcaggattccgcctcgccctcttcaccagatgagacagcggacatctggtctgatcattcctttcagacagatccggatctgccgcctgggtggaagcgcgtctctgacatcgctggaacctattattggcacattcccaccggcactacccagtgggaaagacccgtgtctatccctgccgacctgcagggatctcgaaaaggctcactgtcaagcgtgaccccatctcctactcctgagaatgaaaagcaaccttggtctgacttcgccgtgctcaatggtggaaaaataaacagcgatatctggaaagatctccatgccgcaaccgttaacccggatccaagcttgaaggaattcgagggcgctacactcaggtatgcttctctgaaattgagaaatgctccgcatccagacgacgacgattcctgtagtatcaacagcgacccagaagctaagtgcttcgcggtgcggagccttggctgggtcgagatggctgaagaggatttggccccagggaagtccagtgtggccgtgaataattgcattaggcagttaagttattgtaagaatgatatccgggatactgtgggcatctggggtgaaggtaaggacatgtatctgatcctagagaacgacatgctcagcctcgtggatccgatggatcgcagtgttctgcatagtcagcccatcgtcagtatcagggtgtggggggtgggcagagacaacggtcgggactttgcctacgtggccagagacaaagatacacgaattctcaagtgccatgtttttcggtgtgacaccccagcaaaggccatcgcaacaagtcttcatgaaatctgctcgaaaattatggccgagcggaaaaacgcaaaagcgctggcatgctcctccttgcaggaaagggctaatgtgaacctggacgtacctcttcaggtagattttccaacgcctaagactgagttggtgcaaaagtttcatgtgcagtaccttggaatgctgcccgtcgacaagcctgtaggtatggacatactgaacagcgcaatcgagaacctcatgacatcatctaataaggaagattggttgtcagtcaacatgaacgtcgctgatgctacagtgaccgtcatatctgaaaagaatgaggaagaggtcctggtggaatgtcgcgtccgtttcctgagtttcatgggtgtgggcaaagatgtgcacacattcgcgtttatcatggacaccggaaatcaacgattcgaatgccatgtgttttggtgtgagccaaatgctgggaatgtttcagaggctgtgcaggccgcttgtatgctgaggtaccagaagtgcctcgttgccaggccaccctcgcagaaggtgcggccaccgccacctccggctgacagtgtgactcgcagagtgaccacgaatgtgaagaggggcgtgttatcgttgatcgacacactgaaacagaaaaggccagtcacagagatgccatag

SEQ ID NO: 214299 - DNA, 84 bp, Artificial Sequence
  Description of Artificial Sequence: Synthetic coding sequence
atgagcgaagtgctacccgctgattctggagttgacactttggccgtgttcatggctagctccggcacaactgacgttacgtag

SEQ ID NO: 214300 - DNA, 207 bp, Artificial Sequence
  Description of Artificial Sequence: Synthetic coding sequence
atgagtgaggtcttacctgcggacagcggggtagacacccttgcagtctttatggcgtccagtgggactacggacgtgacaaacagaaactcccccgctactcctcccaataccctcaatctccgatccagccataatgaactgttaaacgccgaaatcaagcacaccgaaacgaagaattctacaccgccaaagtgtaggaaatag

SEQ ID NO: 214301 - DNA, 2211 bp, Artificial Sequence
  Description of Artificial Sequence: Synthetic coding sequence
atgtcagaagtattaccggctgactctggagtggataccctggccgtcttcatggcctcgtcagggacaacagatgtcaccaatagaaattctcctgcgaccccacctaacaccctcaatctcaggagttcccataatgagctgttaaatgccgagatcaagcataccgagaccaagaatagtactccaccaaaatgccgcaaaaagtacgctttaaccaacattcaggcagcaatgggcctctccgaccctgcagctcagccactactgggcaacggctccgcaaatatcaaattggtaaagaatggcgaaaaccagctgcgaaaggccgctgagcaaggacaacaggacccaaacaaaaacctgtcgcccacagccgttatcaacatcacgagtgagaaactcgagggaaaggaacctcacccacaagattcttcgtcttgtgagatcctacccagtcagcctaggcggactaaatcattcctcaactattatgccgatctcgaaacgtccgccagagagctggagcagaatcggggaaaccaccatggtacagctgaagagaaaagccagcccgttcagggccaggcaagcaccattatagggaacggagatctcttgttgcagaaacctaaccgtccccagagttcaccagaggacgggcaggtggctactgtatcatcaagccccgagacaaagaaagaccacccaaaaaccggagccaagacagactgtgcgcttcataggattcagaatctggctccttccgacgaagagtcttcttggaccacactgtcccaggattctgcctcaccatccagccctgatgagactgacatttggtccgatcactccttccagacagatccagacctgcccccaggatggaagcgcgtcagcgacattgccggtacctattattggcacatccccactggtactacccagtgggaacggccagttagtattccagcagaccttcagggctctcgcaaaggtagcttgagctcagtcacgccctcccctacccctgaaaacgaagaccttcacgcggcaactgttaacccagatccgagtctaaaagaattcgaaggggcaacattgcgttatgcctcactcaagctgcggaacgctccgcacccggacgacgacgattcctgctccatcaactccgatcccgaagctaagtgtttcgccgtgagaagcctggggtgggtggaaatggctgaggaggatctcgcccctggtaagtcgagcgtggcagtgaacaactgcattagacagttgtcttattgtaaaaacgatatacgcgatacagtgggaatttggggagagggcaaagacatgtacttaattctcgagaacgacatgttgtccttggtcgacccaatggacagaagcgtcctacactcccaacctattgttagcattcgcgtatggggggtgggacgtgacaatggacgggatttcgcctacgtcgctagggacaaagatacgagaatcctgaagtgccatgtgtttcgctgcgacacaccagccaaggcaatagcgacgtccctgcacgagatatgctcaaaaattatggccgagagaaagaacgcaaaagccctcgcgtgttcctccctccaggagcgtgccaacgtcaacttggatgttcccctgcaagattttccgacaccaaaaacagagctggttcagaaattccacgtgcagtacctcgggatgctgccggtggacaaacccgtcggtatggacattctgaattctgcaattgaaaacctgatgactagcagcaacaaggaagactggctcagcgttaatatgaacgtggccgacgcaacagtgacggtcatttctgaaaagaacgaggaagaagttctcgtggagtgcagagtgcgctttttgtccttcatgggcgtaggcaaggacgttcacaccttcgctttcattatggacacgggaaatcagcgttttgagtgtcacgtgttctggtgtgagcccaacgccggtaatgtttctgaagctgtgcaggcagcctgtatgctgcgctatcaaaagtgcctcgtggccagaccacccagccagaaggtaaggccgcctccacctcccgctgacagcgttacccgacgcgtaaccacaaacgtcaaaaggggcgtgttatcgctcatcgatacccttaaacaaaagcggccagtgactgagatgccctag

SEQ ID NO: 214302 - DNA, 2187 bp, Artificial Sequence
  Description of Artificial Sequence: Synthetic coding sequence
taagatacattagccgtgttcatggcgtcatccggtactactgacgtcacaaatagaaattctccggctacaccccctaacacgctcaacctgagaagttcacacaacgagttactcaatgcagagatcaagcataccgagactaagaactctacacctcccaagtgtcggaaaaagtacgcgttgacgaacattcaggcagcaatgggactgtccgaccccgcagctcagccccttctgggaaatggttctgcgaatatcaagttagtcaagaatggcgagaaccagcttcgcaaggcggcagaacagggtcaacaagacccgaacaagaacctgagccctaccgcggtgataaatatcacatctgagaaacttgaagggaaagagccccacccacaagactcaagttcttgtgagatcctaccctctcagcctcggagaactaagagttttctcaactactacgcagacctcgagacctctgcgcgagaactggaacagaatagagggaaccatcacgggactgctgaagagaaaagccagcctgtacaggggcaagctagtacgatcataggaaacggggacctcctactgcagaagcctaaccggcctcaatcatcacctgaagatggacaagtggctacagtttcctcctcaccggagacgaaaaaagaccatccaaaaacaggtgcgaagactgattgtgctctgcaccgtattcagaacctggctcccagcgatgaagagtcatcttggaccaccctatcccaggactccgcaagcccgagcagccccgatgagacagccgatatttggtcagaccattcattccagacagaccctgacctgccacccggatggaagcgagtatcagacattgccggaacttactattggcatatacccacaggcacgacacagtgggaacgccctgtgagtatcccagctgacctgcagggatctaggaaggggtctctgtcctcagtcacaccttctcctacccccgagaacgaggacctgcacgctgctactgtcaatcccgatccttccttgaaggagtttgagggagccaccctgcggtatgcatcacttaaactgcgaaacgccccacacccagatgatgatgactcttgcagtatcaacagtgatcccgaagccaagtgcttcgctgttagatccttgggttgggtggagatggcagaggaggacctcgccccaggcaaaagttccgtcgccgtcaacaattgtatccgccagttaagctattgtaagaacgacatccgcgacactgtgggcatctggggagagggaaaggacatgtatctgatactggaaaacgatatgctgtcactggtggaccccatggatagaagcgtactgcattcccagccaatcgtatcaataagggtctggggggtcggtagagacaatggcagggacttcgcgtacgtagcacgagacaaggatactcgtatcctaaagtgtcacgtgtttagatgtgacacaccggcaaaggcaatagccacatccctgcatgaaatctgttctaaaattatggccgagaggaagaacgctaaagccttggcttgtagttctctgcaagagcgtgccaatgtgaacctggacgtgccattgcaggtggacttccctacccccaagaccgagctggtacagaagttccacgtgcaatatctggggatgctgccagtggataagcccgtgggcatggatatcctcaactcagccatcgagaacctcatgacttcttccaacaaggaggactggctgtccgtgaacatgaacgtggccgacgcaaccgtcactgtgatttccgaaaaaaacgaagaggaagtcttagtagaatgcagagttcgatttttatcttttatgggggtaggtaaggacgtgcatacgtttgcattcatcatggataccggaaatcagcggttcgagtgtcatgtgttttggtgcgagcccaacgccggaaacgtctcagaagccgtgcaggctgcatgtatgctgcggtaccagaagtgtttggtcgctaggccacccagccagaaagtgagaccccctccacccccagccgatagtgtcactcgacgggtcacaacaaatgtcaagaggggggttctgtcgctcattgacacgctaaagcagaaacggcctgtgacagaaatgccctag

SEQ ID NO: 214303 - DNA, 633 bp, Artificial Sequence
  Description of Artificial Sequence: Synthetic coding sequence
atggcagaacggaaaaacgccaaggctctggcctgcagctctctgcaggagcgggcaaatgtgaatcttgacgtgccactccaagtcgacttcccaacaccaaaaaccgagctggttcagaagtttcacgtgcagtacctcggcatgctgcctgtagataagcccgtagggatggatattctcaacagtgcaatagaaaatctgatgacgtcctcaaacaaggaagattggctcagtgttaacatgaacgtggccgatgccacagtgaccgttatctcagaaaaaaatgaggaggaggtgctcgtggagtgccgcgtcaggtttttgtcattcatgggagtcggcaaggatgtgcacacctttgcttttattatggacaccggcaaccagcggttcgaatgccatgtgttctggtgtgagcccaacgctggtaacgtgtcagaggctgtgcaagcagcctgcatgctgaggtatcagaagtgtctggtagccaggccaccatcgcaaaaggtgagaccacctcctcctccagcggacagtgtaactaggcgagtcactaccaatgtcaagcgaggtgtactgtcacttatagatacactgaagcagaagcggcctgtcacggagatgccctag

SEQ ID NO: 214304 - DNA, 1476 bp, Artificial Sequence
  Description of Artificial Sequence: Synthetic coding sequence
atgctggggaaggactacatgctggctatcatactcgtgaactgcgacgacgacctctggggagaccattctctggaagtcgaggccggactgccacccggatggcgcaaaatccacgacgccgcaggcacatactactggcacgtgccctccgggagtacccagtggcagcgccctacttgggagctgggcgatgcagaagaccccggtacaggaacagagggcatttgggggttgcgaccccctaaaggtcgatcgttttcaagtcttgagagcagcctcgaccggtccaattctctttcgtggtacggcggagagtcatatatacagtccatggagccaggcgctaagtgttttgccgtgcgtagtcttgggtgggttgaagtgccagaggaagatctagcgcctggaaagagctcaatcgccgtaaacaactgtatacagcaactggctcaaacaagaagccgttcacaaccccctgacggcgcatggggcgaagggcaaaacatgctgatgattttgaagaaggacgccatgagcctggtgaatcctctggaccattctctgatccactgccaacccctggtccatattagggtgtggggtgtgggatcaagtaagggaaggcccatatcggcgccagcaagagactttgccttcgttgcctcagataaagattcttgcatgctgaagtgccatgtgttctgttgtgatgtgcccgcaaaagccattgcctctgctcttcacgggctttgcgctcaaattttatccgagcgcgtggaggtttcaggagatgctagctgttgttctcctgaccccatctcccccgaggacctacctcgtcaggtggagctgctggacgctgtgtcccaagctgcacagaaatacgaggctttgtatatgggaaccctgccagttacaaaggctatgggcatggatgtcctgaatgaggcgatcggtacacttacagctagaggggatagaaacgcttgggtccccacgatgctctctgtcagcgattctctcatgaccgcgcaccctattcaagccgaggctagtaccgaagaagaacccctgtggcagtgccccgtcagactggtaactttcattggagtggggagggatcctcacacatttgggctgattgctgaccttggcagacagtcgtttcagtgtgcggcattttggtgtcaaccgcacgctgggggtttaagtgaagccgtacaagccgcatgtatggtacaataccagaaatgcctggttgccagcgcagctagaggcaaagcatggggggcacaggcgagggctcggctgcggctcaagcggacatcatctatggattctccaggcggaccacttccattacctctcctgaaagggggagtgggtggcgcaggggctacccctagaaagagaggcgtcttctccttcctggatgcattccgcctgaaaccttccctgcttcacatgccatag

SEQ ID NO: 214305 - DNA, 1461 bp, Artificial Sequence
  Description of Artificial Sequence: Synthetic coding sequence
atgctgggtaaggattacatgttggcgatcatcctcgtgaattgcgatgatgatctgtggggggatcattcattggaggttgaagccggtctacctccagggtggagaaaaatccacgacgccgctgggacatattactggcatgtgccatctggaagcacccagtggcagagacccacatgggagctgggggacgctgaagatcccggaaccgggaccgaggggatctggggactccggcctccgaaaggacggagtttttcctccctggaatcgtcccttgacaggtctaattctctttcttggtatggcggagagagctacatccagtcgatggagcccggagccaaatgtttcgccgttaggtctctcgggtgggtcgaagtgcctgaggaagacctcgctccaggcaaatcttccatagccgtcaacaattgtatacaacagctcgcacagactaggagtaggagccaaccaccggacggtgcctggggagaagggcaaaacatgctaatgattctcaaaaaagacgctatgtccctagtgaatccactggatcatagcctcattcactgtcagcccttggtgcacatccgggtttggggcgttgggagcagcaagggcagagaccgcgatttcgctttcgtggcttcagacaaggactcatgcatgctcaaatgtcacgtcttttgctgcgatgtgcctgcgaaagcaatcgcctccgctctccacggcctgtgtgcgcagatcctaagcgaacgagttgaggtatcgggagacgctagttgctgttctccagaccccatctcccccgaggacctgccacggcaggttgagctgctggatgctgtgtcacaggcagcccagaagtacgaggccctgtacatggggaccctgccagtgactaaagccatgggaatggatgttctcaacgaggcaatagggactcttacagcccgaggcgacaggaatgcctgggtgcccaccatgctgtccgtttcggacagcctcatgacggcacatcctatccaggcggaggccagcacagaggaagaacctttgtggcagtgtccggtgaggttggtaactttcattggggtgggcagagaccctcacaccttcggcctcatcgcagatcttggaagacaatccttccagtgtgcagccttctggtgtcaacctcatgctggcggattgtccgaggccgtacaggcggcatgcatggtccagtatcagaagtgtctggttgcctccgccgcaagagggaaagcctggggggctcaggccagggcaagactgcgcttgaaacgcacatcttccatggactcacccggagggccactacctctgccactcctgaaaggcggagtaggcggagcaggggcaacaccacgcaagaggggcgttttttctttcttggatgccttccgcctgaaacctagccttctgcatatgccatag

SEQ ID NO: 214306 - DNA, 1020 bp, Artificial Sequence
  Description of Artificial Sequence: Synthetic coding sequence
atgctgggcaaagactatatgctggccattatcctggtgaattgcgatgatgacttgtggggagaccatagcttggaggtagaggccggactcccacctggatggcggaagatccacgacgccgcaggaacttattattggcatgtcccgtctgggtcaacacagtggcaaagacccacttgggagctgggcgacgccgaagacccagggacgggcaccgaaggcatatgggggctgcgccctcccaaaggcagatcgttcagttcactcgaaagcagcttggatcggtcaaatagcctgtcttggtacggaggagagtcttacattcagagcatggagcccggagccaagtgcttcgccgtccgtagcctcggatgggttgaggtgccagaagaagacctggcacctggcaagagctccatcgcagtcaataattgcatccagcagctcgctcagacaaggagtcggtctcagccgccagatggcgcatggggcgaaggtcaaaacatgctaatgatcctcaagaaggacgctatgagcttggttaatcccctggaccacagcttgattcactgccaaccactggtgcacataagggtgtggggcgtggggtcatctaagggtcgtgatagggatttcgcgttcgtcgcctcagacaaggacagctgcatgttgaagtgtcacgtgttctgttgcgatgtacccgctaaagctatcgcttcggccctccacgggctctgtgcccagattctgagtgagagggttgaagtatccggagacgctagttgttgtagtcctgaccccatctctccagaggacctgccacgacaagtggaattgctcgatgcggtcagccaggcggctcagaaatatgaagcactgtatatgggcacactgcctgtgaccaaagccatggggaggggccagtaccggggtggcgctatcgttgccgtaccctgcgcaccttgtgatatttactggtgttggcccaggcccacacacctttggcctcatcgatag

SEQ ID NO: 214307 - DNA, 1455 bp, Artificial Sequence
  Description of Artificial Sequence: Synthetic coding sequence
atgctggggaaggattacatgctcgccataatactggtgaactgcgatgatgatttatggggggaccacagcttggaggtcgaagctggcctgccacccggatggcgcaaaatccacgatgctgctggcacatactactggcacgtgccgagcggttctacgcagtggcagcggcctacctgggaactgggcgatgccgaggatcctggtaccggaacggagggcatatgggggttgcgcccaccaaaaggccgatcctttagctccctggagtccagcctggatcggtctaattcactgagttggtacgggggagaaagctatatccaaagtatggagcccggagcaaaatgtttcgcagtcagaagcttaggttgggtggaggtcccggaagaggatctggcgcctggcaagtcaagcattgctgtgaacaattgcattcagcagctggcacagacacgatctagatctcaacccccagacggggcatggggggaaggtcagaacatgctcatgatcctgaagaaggacgcaatgtccctggtgaacccccttgatcactcactgatccattgccaaccattagttcatatcagggtgtggggagtggggtcctctaaagggagggattttgctttcgtggccagcgataaagactcctgcatgcttaagtgccacgtgttctgttgtgacgtgccggcaaaggctattgcaagcgctctgcacggcctgtgtgcacagatcctgtctgaacgggtggaggtgtctggcgacgcatcctgttgttctcccgatccaatctcgcctgaagacctcccgagacaggtggagctgctggatgctgtctctcaggccgcacaaaagtatgaagccctctacatgggcacactccccgtaaccaaggcaatgggcatggacgtattaaacgaagctattggaacgctcactgctagaggcgatcggaacgcctgggtcccaaccatgctttctgtgtccgattcgttgatgaccgcccaccctattcaagcagaggccagcacggaagaggaaccactatggcagtgccccgtccggctcgtgacatttatcggtgtgggaagagacccacatacattcggactgattgccgacctgggaaggcagagcttccaatgtgccgcattttggtgtcagccccatgcgggtgggctcagcgaagcagtgcaggccgcttgtatggtgcaataccaaaagtgtttggtagccagtgcggctcgaggcaaggcatggggtgcacaggccagagccaggcttcgtctgaagcgcacatcaagtatggatagcccgggtggacccctgccgctgcctctgctgaaaggcggagtgggcggagcgggtgctactcctcgcaagaggggagttttttcttttctcgacgcgtttcgtcttaagcccagccttctgcatatgccttag

SEQ ID NO: 214308 - DNA, 738 bp, Artificial Sequence
  Description of Artificial Sequence: Synthetic coding sequence
atgctcggcaaggattacatgctggcgatcatcctggtaaactgtgacgatgatctgtggggagatcacagcttagaggtagaggccggtctgccgcctggctggcgaaaaattcacgatgccgctggcacatactattggcacgtgccatcgggctccacccagtggcagagaccgacatgggagctaggcgatgccgaagaccccggtactggaactgaagggatctggggacttcgcccacccaaagggagatccttctcatcacttgagagctcactggatcgttcaaactctctctcttggtacggtggagagtcatacatccaatcgatggaacctggagccaagtgttttgcagtcagaagcctgggttgggtcgaggtgccagaagaagacctagctccaggaaaatctagtattgcggtgaataactgcattcagcaactcgcccaaaccaggagccggtcacagcccccagacggggcatggggagagggccaaaacatgctgatgatcttaaagaaggacgccatgtccctggtcaatcctttggaccattcccttatccattgccagccactggtgcatatacgagtgtggggggtcggtagttcgaaaggtaggagctctgatgtggaccctggactgctgccattgcccggtccagcgctcgtgggcgaggggggaccctcgtcagcaggtacggtgtggggggagagcgaacgtctcggctag

SEQ ID NO: 214309 - DNA, 792 bp, Artificial Sequence
  Description of Artificial Sequence: Synthetic coding sequence
atgctcaagtgccacgtgttttgctgtgatgtgcctgccaaagcgattgccagtgcgctgcatggactttgcgctcagattctcagcgagcgcgtcgaggttagcggtgatgcatcttgctgcagccctgatccaatttccccagaggatctcccgaggcaggttgaacttctcgacgcagtcagccaggccgctcagaagtacgaggccctgtacatgggcacgctccctgttacaaaggctatggggatggacgtgcttaatgaagccataggaaccctcacggctaggggagatcgcaatgcctgggttcccacgatgctctccgtctccgattcactgatgactgcacacccgattcaggcggaggcgtcaacagaagaagaaccgctctggcagtgcccagtccggctggtgacattcataggtgttggacgagaccctcacacattcggattgatcgccgaccttggccgacagagcttccagtgcgcagccttctggtgccagccccatgcaggaggtctgtctgaggcagtacaggctgcctgtatggtccagtaccagaaatgcctcgtggccagcgccgctcggggaaaagcgtggggggcacaggcgagggccagactccgtctgaaacggacctcctcaatggatagtcccggagggcctttacccctgcccctcctaaagggcggtgtaggcggagctggcgctacgccccgtaagagaggagttttttcctttcttgatgcgttccgcctgaaaccctctctcttgcacatgccgtag

SEQ ID NO: 214310 - DNA, 645 bp, Artificial Sequence
  Description of Artificial Sequence: Synthetic coding sequence
atgctgggaaaggactacatgctggctattatccttgtgaactgtgacgacgatctttggggcgaccacagtctcgaagttgaagccggacttccacctggatggagaaaaattcatgacgctgctggcacttactactggcacgtgcctagcggcagcacgcagtggcaacggcctacctgggagctcggggacgctgaggatcccggtactggaacagaaggcatttggggtctgcggccaccgaaagggcgatcattttcatcgttggaaagtagcctggacaggagtaattcattgtcatggtacggaggagaatcttacatacagtctatggagcccggtgctaagtgttttgctgtcagatctctcgggtgggttgaagttcctgaggaggatctggcaccaggaaaatcttccattgccgtaaacaattgcattcaacagctagcacagacacgctccaggtcccagccaccagacggagcatggggcgagggacagaacatgcttatgatcctgaaaaaagatgcaatgtccctggtgaacccgctcgatcactcattgatccattgccagcccctcgctgttatccctacggacgctgatcctcagtatttgaacccctggactcaaatcctttag

SEQ ID NO: 214311 - DNA, 378 bp, Artificial Sequence
  Description of Artificial Sequence: Synthetic coding sequence
atggagcccgacggcacatacgagccaggatttgtgggcattaggttttgccaggaatgtaataacatgctgtatccaaaagaagacaaagagaaccggatcctgctgtacgcctgtagaaactgcgattatcagcaggaggccgataacagctgcatctacgtgaataagattactcatgaggttgatgaactgactcagattatagccgatgtttctcaagacccaaccctgcccaggaccgaggatcacccgtgtcagaaatgcggacacaaggaagctgttttctttcagagtcattctgccagggctgaagacgctatgcgactgtattacgtctgcaccgcgccacactgcggtcataggtggacagagtag

SEQ ID NO: 214312 - DNA, 1836 bp, Artificial Sequence
  Description of Artificial Sequence: Synthetic coding sequence
atgctcgcttctcttgagaaggataaaaccgctccgggaagtgcccaggtagcaggcctgtgcggcagactcaccttgcatcgtgatctgcgcaccggcaggtgggaacctgacccacagcggtcacgaagatgtctccgggacccacaaagagtgttagaatactgtcgccagatgtaccccgagctacagatcgcacgggtggaacaggctacgcaggccatccctatggagcgctggtgtggtggctcacgctccggtagctgcgcgcatcctcaccatcaagtggtaccttttcggtgcctgcccggagaattcgtgtccgaagcgctgctggtccctgaaggttgtcggtttctgcatcaggagcgcatggatcagtgcgagagttccacgagacggcatcaagaagcccaggaagcctgttcttcccagggactgatactgcacgggagcgggatgctgctcccctgcgggagcgatcggtttcgtggagtcgaatacgtttgctgccctccacctgggacccccgatccctcaggaacagccgtcggggacccaagcacccggagctggccaccaggttctagggtagagggagccgaggacgaagaagaagaggagtcatttccgcagccggtggacgattactttgttgagcctcctcaagcggaagaggaggaggaaaccgtgccgcctccttcttcccacaccctcgccgttgtcggtaaagttacacctacaccccgtcctactgacggcgtcgacatctattttggaatgcccggagaaatcagtgagcatgagggttttctgcgggctaaaatggacttggaggagagacgaatgcgccaaataaatgaagtgatgagggagtgggctatggctgacaatcagagcaaaaatctgcctaaagctgaccggcaggccctgaatgagcatttccagtccatacttcagactctggaagagcaggtgtccggcgagaggcagagactcgtggagactcacgcgactcgagtaatcgcactgataaacgaccaaaggcgtgctgcactggaaggatttctggctgcccttcaagcagacccaccccaggccgaacgcgttctgctggccttgcgtagatatctgagagcggagcaaaaggagcagcgacacacccttcgccattatcagcacgtggccgcagtcgaccccgaaaaagcccagcagatgcgctttcaggtgcacacccatttgcaagttatagaagagagagtcaatcagtctctggggttgctggatcagaatccccacctggcacaggaactgcgcccacagattcaggagctccttcattcggagcacctcggaccaagcgagctcgaggcacccgctcccggagggagtagcgaggataaaggcggtctgcagcccccagatagcaaagacgacactccaatgacgttgcctaaaggatctaccgaacaggacgccgctagtcccgaaaaggaaaagatgaaccccctcgagcagtacgagcgcaaggtcaatgcttccgtgcccagggggtttccatttcattcctcagagatccagagagatgagctggctccggctggcaccggagtcagcagagaggccgtctctgggctgctgataatgggcgctggcggaggctccctaatcgtgctgagcatgctgctgcttcgaagaaaaaagccatatggcgctatctcccacggggtggtagaagtggatcccatgctgacactggaggagcaacaactaagggagctgcaacgccacggttatgaaaaccctacgtaccgctttctcgaggagcgcccttag

SEQ ID NO: 214313 - DNA, 2292 bp, Artificial Sequence
  Description of Artificial Sequence: Synthetic coding sequence
atggccgctaccggaactgccgctgccgcagccactggaagattactgctgctacttttagtcggtttgacggcacctgcactcgctctggccggatacattgaagctctggccgctaatgcaggaaccggatttgctgtcgcagagccccagattgcgatgttctgtggtaaacttaacatgcacgttaacatacagactggtaagtgggagcccgatccaaccggcacaaaatcctgcttcgagaccaaagaggaagtcctgcagtactgtcaggaaatgtatcccgagcttcagataacaaacgtgatggaggcaaatcagcgcgtcagcattgacaattggtgccgcagggataagaaacagtgtaagagccggttcgtgacaccatttaagtgtctggtcggcgaatttgtgtctgatgtgctgctcgtgcccgagaaatgccagttttttcataaggaaagaatggaggtttgtgagaaccatcagcactggcacaccgtcgtgaaggaggcatgcctgacccagggcatgacactttactcctacgggatgctgctcccctgcggagtggatcagttccacgggacagagtacgtttgttgtccccagacaaaaatcatcggatccgtatcaaaagaggaagaggaagaggatgaggaggaagaggaggaggaggacgaagaggaggactatgacgtttacaagagtgagttccccaccgaagccgacctggaggattttacagaagcggctgtcgacgaagatgacgaagatgaggaggagggagaggaagtggtggaggatagagattactactacgacacttttaagggtgatgactacaacgaggagaaccctacagaacccggatcggacggaaccatgtcagataaggagataacacatgatgtgaaggcagtgtgttcgcaggaagccatgaccggaccctgtagagcagtcatgccgagatggtactttgatttgagtaaagggaaatgcgtgagattcatctacgggggttgcgggggtaaccggaataactttgagtctgaggattattgcatggccgtctgtaaagccatgatccctcccactcctcttcccactaatgacgtcgacgtctacttcgagacttccgccgatgacaatgagcatgcgagatttcagaaggccaaggaacaactggagatccggcaccggaaccggatggacagagtaaagaaagagtgggaggaagccgagctgcaggctaaaaatcttcccaaagccgagaggcagactctaatccaacacttccaggccatggtcaaggccctggaaaaggaggctgccagcgagaagcaacaattagtagagacccatctggcacgcgttgaggccatgctcaatgaccgtcggaggatggctctcgaaaactatcttgctgctcttcagagtgacccccctcggccacatagaattctccaagctctccggagatatgtgcgcgctgagaataaggaccgcttacatacaattcgccactaccaacacgtcctagcagtggacccggaaaaggccgcacagatgaagtcccaggtcatgactcacctgcacgtgatcgaagaaaggaggaaccaaagcctgagtttgttgtacaaagtgccctatgtggcacaggaaatccaggaagaaatcgacgagctactccaggaacagagagccgatatggaccagtttaccgccagcatctccgaaacccctgtggacgtgcgagtaagcagtgaggagtccgaggaaattccaccctttcatccatttcacccttttcccgctcttcccgagaacgaagatactcagcccgaactgtatcaccctatgaaaaaaggctcaggggtgggggagcaggacggcggattaattggggctgaggagaaagtgatcaacagcaagaataaagtcgatgaaaatatggtgattgatgagacattggatgtcaaggaaatgatttttaatgccgagagagtgggaggattggaggaagagagagagagcgtgggccctcttcgcgaggatttctcattatcctcctccgctttgatcggcctcctggtgatcgcggtggctattgcaacggtaattgtgatctctctggtgatgctgcggaagcgacagtatggaaccatttctcacggtattgtagaggtggaccctatgctcaccccagaagagcggcacctgaacaagatgcaaaatcacggctacgaaaatcctacgtataagtatcttgagcaaatgcaaatatag

SEQ ID NO: 214314 - DNA, 2286 bp, Artificial Sequence
  Description of Artificial Sequence: Synthetic coding sequence
atgctgcgggctcctggcgaactccccaggcaggctgcaaggtgtagcctctgccgcctggggcctggcagaggcagagccttctttaaatggcgctgcctgccggcaagtgtggacagaggcaaccccctgtgggccctagccgctaacgctggcacaggattcgccgtagccgaaccccagatcgccatgttttgcggaaaactgaacatgcacgtgaatatccagacgggcaaatgggagcctgacccgaccggcaccaagagctgttttgagacaaaagaggaggtgctacagtattgccaggaaatgtatcccgagcttcaaattaccaacgtcatggaggctaaccagagggtttcaattgataactggtgtaggcgggacaagaaacagtgcaagagcaggtttgtcacacctttcaaatgcctggtgggcgaattcgtgtcagacgtgctattagtgcccgaaaaatgtcagttttttcacaaggaaagaatggaggtctgcgagaatcatcagcattggcacactgtggtcaaggaggcatgcctgacccagggcatgaccctctacagttatggaatgctcctgccttgtggtgtggatcagttccatggcaccgagtacgtgtgctgccctcagaccaagataatcggctccgtttcgaaggaggaagaggaagaggatgaagaggaggaggaggaggaagatgaggaggaggattacgacgtctataagtccgagttcccaactgaggctgatctggaagacttcaccgaagctgccgtggacgaggatgatgaagacgaagaagaaggcgaagaagttgttgaagaccgcgactattattatgacacgtttaagggagacgactataacgaggaaaaccctaccgagcctggctcagacgggactatgtcagataaggagattacgcatgatgtgaaagcagtgtgttcacaggaggccatgacaggtccttgtagagcagttatgcctcggtggtattttgacttgagtaaaggaaagtgtgtgcgctttatatatgggggatgcgggggtaaccgcaacaactttgaaagtgaggactactgcatggcggtgtgtaaggcaatgataccgccaaccccactaccaaccaatgacgtcgacgtctactttgagacgtccgctgacgacaatgagcacgcacggttccagaaggctaaggaacaactggaaatcagacatagaaatcgtatggacagggttaaaaaggagtgggaagaggccgagttacaggccaagaacttgcctaaagccgaaagacagactctgattcagcacttccaggccatggtcaaggccctggaaaaggaagccgcatccgagaagcagcaactggtggaaacccatctagcccgagtagaggcaatgctgaacgacagaagacggatggcgcttgagaattatctcgctgccttgcagagcgatcctcccagaccacacagaattctgcaggccctccggagatacgtccgggcagaaaataaagaccggttgcataccattaggcattaccagcacgtgctcgctgttgatccggaaaaagcagcccagatgaagagccaggttatgacacatctgcatgtgatagaggaacggagaaatcagtcgctgagcctgctttataaggtgccatacgtggcacaggagatccaggaggagatcgatgagctcttacaggagcaacgcgcagatatggatcagttcacagcttccatttcagaaactcccgtggacgtgcgtgtcagcagcgaagagagcgaggagatacccccttttcatccgtttcacccttttccagcactacccgaaaatgaagggtcgggggttggggagcaggatgggggtctgataggcgcagaggagaaagtgataaattctaagaacaaagtggacgagaacatggtcatcgatgaaacactggacgtcaaagagatgatctttaatgccgagagggtgggtggcctggaagaggaacgagaaagtgtgggacccttgcgggaagactttagcctgtcttcttcggccctgatcggtttgttagtgatcgccgtcgctatagcaaccgtgatcgtgatatcgttggtgatgttgaggaaaaggcagtatggtactatttcccacggaatcgtagaggttgatcccatgttgacgccagaggagagacatttgaataagatgcagaaccacggctacgagaaccctacctataaataccttgaacagatgcaaatttag

SEQ ID NO: 214315 - DNA, 2256 bp, Artificial Sequence
  Description of Artificial Sequence: Synthetic coding sequence
atggctgctacaggtactgctgctgctgctgcaaccggaaggttgttactccttctactggtgggtctgactgcgcctgcccttgctttggccggatacatcgaagccctggcagcaaacgctggaactggatttgctgtagcggagcctcagattgccatgttttgcgggaaactcaacatgcatgtgaatatccagaccggtaaatgggagcccgatcctacaggtaccaagtcttgtttcgaaacaaaggaagaagtgctgcaatactgtcaggagatgtaccccgagttgcagatcactaacgtgatggaagccaatcagcgggtctctatagacaattggtgtcggagagacaagaaacagtgtaagtcaagattcgtgacaccgtttaagtgcctggtaggtgagttcgtgagcgacgtgctcttggtccccgaaaagtgccagttcttccacaaagaacggatggaggtctgcgagaaccaccagcactggcatacagttgtgaaggaggcctgcctgacacagggcatgactctgtacagctacggcatgctcctgccctgtggtgtggatcagtttcatggtacggagtatgtctgttgtcctcagacaaagatcattggctcagtctctaaagaagaggaggaagaggacgaggaagaggaggaggaggaagatgaagaagaagactacgatgtgtataagagcgaattccctaccgaggcagacttagaagacttcacagaggccgcagtggatgaggacgacgaggacgaagaggagggcgaggaggttgtggaggacagggattactactacgacactttcaaaggagacgactacaacgaagaaaacccaacagaacctgggagtgatggcactatgtccgacaaagagatcacgcacgatgtcaaggccgtctgctcacaggaggctatgacggggccttgtagagccgtcatgccaagatggtatttcgatctgtccaagggcaagtgcgttcgattcatatacggcggttgcggaggcaatagaaataattttgagagtgaggactattgcatggcggtgtgcaaagctatgatccccccaacccctctccctacaaacgacgtggacgtctacttcgaaaccagcgccgatgacaatgagcacgcacgctttcagaaagccaaagaacagttggagatcaggcataggaatcggatggaccgtgtgaaaaaggagtgggaagaggccgagctacaagctaaaaacctgccaaaggcggagcggcaaacgcttatccagcacttccaggctatggtcaaggctctcgagaaagaagctgcaagtgagaagcagcaactggtggagacacacctcgctagagtggaagctatgctaaacgatagaaggcggatggcccttgagaactaccttgccgctcttcagagtgatccccctagaccacacagaattcttcaggccctccgccgttacgtgcgtgctgaaaataaagatcgcctgcatacgattcggcactatcagcacgtcttggcagtcgaccctgaaaaggcagctcagatgaagagccaggtaatgacccacctacacgttatcgaagagcggaggaatcagtccttgagcttactgtacaaggtcccatatgttgcacaggaaatacaggaagagatcgacgaattactgcaggagcagcgggctgacatggaccaatttactgctagtataagcgagacacctgtggacgtcagggtctcctcagaggaaagcgaggaaattccaccatttcatccctttcatcccttcccagccctaccggaaaatgaaggatccggtgtgggggagcaagacgggggacttatcggtgccgaggaaaaagtgatcaactctaagaataaagtggacgagaacatggttattgatgagactctcgatgtcaaggagatgatttttaacgctgaaagagtcggcggacttgaagaagagagggaaagtgttggacctctcagagaagatttctccctatcctcgtccgctctcatcgggctcttagtgatagccgtggcaattgcaaccgtcatagtcatctcactggtgatgctgagaaaaagacagtatggaacaatttctcacggcattgtcgaagttgaccctatgctaacccctgaggagcggcatcttaacaaaatgcagaatcatgggtatgaaaatcctacttacaaatacctggagcagatgcagatctag

SEQ ID NO: 214316 - DNA, 1569 bp, Artificial Sequence
  Description of Artificial Sequence: Synthetic coding sequence
atggctgccacaggtactgctgctgccgcagccacgggtcgcttgttgttgctactactggtggggctgactgcaccagcccttgcactggccggatacatcgaggccctcgcggcaaatgccggaacgggtttcgccgtagccgagccacaaatagccatgttctgcgggaagctaaacatgcacgtgaatatccaaaccggaaaatgggagcccgatcctaccggaacgaagagttgctttgaaactaaagaggaagtcctccaatactgccaggagatgtaccctgagctgcagattaccaatgtgatggaggctaatcagagggtctcaatcgataactggtgcaggagagacaagaagcagtgcaagagtagattcgtcaccccttttaagtgtctggtacctccaacgccattgccaaccaacgatgtagatgtctactttgaaacaagcgccgacgataatgagcatgctcgctttcagaaggccaaggagcaactggagatccgccataggaataggatggatagagtaaagaaggaatgggaggaagcagaactccaggcaaagaatcttccaaaagccgaacgccagactctcattcaacactttcaagctatggtaaaggcgctagaaaaggaggcagctagcgaaaagcagcagcttgtagagacacacctggcccgtgtggaagccatgcttaacgataggcgtcgcatggccctggagaattatctggccgctctccagagcgaccctcctcgaccacacaggatcttgcaggcacttagacgttacgtgcgcgctgaaaacaaagacagactgcacacaattagacactatcagcacgttctcgctgtggatccagaaaaggccgcacaaatgaagagccaagtgatgactcacttacatgtcatcgaggagagaaggaaccagtcattgagcctgctgtacaaggtgccctatgttgcgcaggaaatccaagaggagattgacgagctgttacaggagcagcgggctgatatggatcagtttactgcatctatttctgaaaccccagtcgacgtgagagtcagttctgaggagtcagaggagatccctcctttccatccgttccacccattccctgcccttccggagaacgaaggaagcggcgtaggcgagcaggacgggggtttgattggcgctgaggagaaagtcatcaacagcaagaacaaagtggatgagaacatggtgattgacgaaacactggatgtgaaagaaatgattttcaatgcagagcgggtcggtggtctcgaagaagaacgcgagtcagtaggacccctgcgggaggactttagtttatcatcaagtgcccttattggcctgttggtgatagcagttgccatcgcgactgtgatcgtgatctccctcgtgatgcttcggaaacgccagtatgggacgatcagccacgggattgtggaggtcgatccaatgctaacacctgaagagcgacatctcaacaaaatgcaaaaccacgggtacgagaatccgacttataagtatcttgaacagatgcagatatag

SEQ ID NO: 214317 - DNA, 2088 bp, Artificial Sequence
  Description of Artificial Sequence: Synthetic coding sequence
atggctgccaccggaacagccgctgctgctgccactggacgtcttctcctgctgctgctggtgggactgaccgctcccgctcttgccctggccggatacatcgaagctctagccgctaatgccggtactggatttgccgtggctgaaccgcagatcgctatgttctgcggcaagctgaacatgcatgtgaatattcagacagggaagtgggaaccggatccaactgggaccaaatcctgttttgaaacaaaagaggaggtattgcagtactgtcaggaaatgtatcctgagctccagatcacgaacgtaatggaggctaaccagcgggtttctatcgacaattggtgtagacgggataaaaaacagtgcaagagtcgctttgtgaccccattcaagtgtttggtgggagagttcgtgtcagacgtattgttagtgcctgaaaaatgtcagttcttccacaaagaacggatggaggtgtgcgagaatcatcagcactggcatacagtggtcaaggaagcatgtttaacacaaggcatgactctatacagttatggtatgctactgccctgtggagtggaccaattccatgggaccgagtatgtgtgctgcccacaaactaaaatcatcgggtctgttagcaaggaggaggaggaggaggatgaggaagaggaggaagaagaggatgaggaggaggactatgatgtgtacaagtcagagttcccgacagaagccgatcttgaggatttcacagaagctgcggttgacgaagatgatgaggacgaggaggagggtgaagaagtggtggaggatagggactattactacgacaccttcaaaggagacgactacaacgaggagaatccgacagaaccagggagcgatggaactatgagcgacaaggagatcacccacgatgtgaaagtgccccctacacctcttcctacaaatgacgtggacgtctacttcgaaacaagcgccgatgacaatgagcatgccaggttccagaaagctaaggaacagttagaaatacggcatagaaacagaatggatagagtaaaaaaggaatgggaagaggctgagttacaggctaaaaatctgcccaaagcagaaagacaaactctgatccagcacttccaggccatggtcaaggcactggaaaaggaagccgcttcagagaaacaacagctggtggaaacacatctcgcccgagtcgaggcaatgctgaatgacaggaggaggatggcactggaaaactatctggcagcactccaatcagaccccccaagaccacacaggatcctgcaagcccttaggcggtacgtgagggccgagaacaaggatagattgcacaccatccgccactaccagcatgtgctggctgtggaccctgagaaggccgcacagatgaagagccaagttatgactcacctgcatgtgatcgaggagcgcagaaaccagtctctgagcttgctctacaaagtgccctatgttgcgcaggaaatccaggaagaaatcgacgagctcctgcaggaacagagggcggacatggaccagtttacggcaagtattagtgagacaccagtggacgtacgggtgtcgagcgaggagtccgaagaaatcccgcctttccatcctttccatcctttcccagccctgcccgaaaatgagggatctggcgtgggcgagcaggatggagggctgataggcgctgaggagaaggtgatcaactctaagaataaggtcgatgagaacatggtgatcgacgagacgctggacgttaaggaaatgattttcaacgctgaaagggtcggtggcttggaggaagaacgtgagagcgtagggcctttgagagaggatttttctctatccagttctgccctgatcgggctgctggtcatcgcggtggcaatcgccaccgttattgtgatctctttggtgatgcttaggaagcgccagtacggtactataagccacggaatagtcgaggttgaccctatgctgaccccggaggaacggcatctgaacaagatgcagaaccacggatatgagaatccaacctataagtatctggagcagatgcagatctag

SEQ ID NO: 214318 - DNA, 480 bp, Artificial Sequence
  Description of Artificial Sequence: Synthetic coding sequence
atggccgcaaccggcactgccgcagccgcagccactggtagactcctgctgctgctcctcgttggccttaccgcgccagcccttgcccttgccggttatatcgaatcctctcagatttgctgtagccctcgcagtttcctgatttctaccctcaagtgccttatagtggatgagattaacgcgctggccgctaatgccggaaccgggttcgctgtggccgaacctcaaattgccatgttctgcggcaaactgaacatgcatgtcaacatccagaccggcaagtgggagcccgatcccacaggcactaaaagctgcttcgagactaaagaggaggtgctgcagtattgtcaggagatgtacccagaattgcagatcacaaacgtgatggaagcaaaccaaagagtgagcattgataattggtgccgtagagacaagaagcaatgtaaatccagattcgtgacgccctttaagtgcttgtag

SEQ ID NO: 214319 - DNA, 351 bp, Artificial Sequence
  Description of Artificial Sequence: Synthetic coding sequence
atggctgccaccggtaccgccgcagcggctgccacgggccgactgctgctgctgttgttggttggcctcactgctccggctcttgcattggccggatatatcgaggcattggccgcaaacgccggtactgggtttgccgtcgcggagccacagatagcaatgttctgtggcaaactcaatatgcatgttaatattcagactgggaaatgggagcccgatccaacagggactaagtcatgttttgagacaaaggaggaggtgctgcaatattgccaggagatgtatcctgaactgcagatcaccaactccgggtggcgttgcgtgcgcataacctctacaggtacaagatag

SEQ ID NO: 214320 - DNA, 1656 bp, Artificial Sequence
  Description of Artificial Sequence: Synthetic coding sequence
atggaggtgtgcgagaaccatcagcattggcacactgtcgtgaaggaagcctgtctgacacaggggatgacactgtacagctacggcatgcttttgccatgtggggtggatcaattccacggaaccgaatatgtgtgctgtccacagacaaaaattatcggtagtgtttcgaaggaggaggaggaggaggacgaagaggaagaggaggaggaagacgaggaagaggattatgatgtctataaatcagagttccctactgaggcggacttagaggatttcaccgaagcggcagtagacgaagatgacgaagacgaagaagaaggagaagaagtagtagaagacagagactattactacgatacgttcaaaggtgacgattataatgaagaaaaccccaccgagcccggaagtgatggtactatgagcgacaaagagataactcacgatgtaaaggtaccgccaactccccttccgactaacgatgtcgatgtgtacttcgagacaagcgccgatgacaatgagcacgcccgtttccagaaggccaaggagcagcttgagatacgtcatcggaaccggatggacagagttaagaaggaatgggaagaagcggaattacaggccaagaacctgccaaaggccgagaggcagaccctgatccagcattttcaagccatggttaaagccctggagaaggaggccgcatccgagaagcagcagttggtcgaaacccatctcgcccgagttgaggcaatgttgaacgatcgtcgtagaatggccctcgagaattacctggccgcactccaatccgatcctccacgcccacacagaattctccaggcccttcgtcggtatgtcagagcggaaaacaaggatcggctgcatacaatccggcattaccagcatgtgctggcagtggatcccgaaaaagctgcgcaaatgaagagccaggtgatgacacacctacacgtgatcgaagagcgcagaaatcagtcactctcactgctttacaaggttccatatgtggcgcaggagatccaggaggaaatagatgagctgctgcaggagcagagagcagacatggatcaatttacagcctcaataagtgagacaccggtggacgtacgcgtatcctccgaagagagcgaggagattccccctttccacccattccaccccttcccagcactgcctgaaaacgaggacactcagccagagctttaccacccaatgaagaagggctcaggtgtgggagagcaggacgggggactgattggagccgaagaaaaagtgattaacagcaagaataaagtggacgaaaatatggtaattgacgagactttggatgtgaaagaaatgatctttaacgcagaacgagttggtggcctcgaggaagaacgggaatctgtggggccactcagagaggatttttccctttcgtcttccgcccttataggactgttagtgattgccgttgccatagccaccgtgatcgttatcagtttggtcatgctccgcaaacgccagtacggaaccatctcacacggaatagtggaagtcgacccaatgcttacacctgaagagcgccacctgaataagatgcaaaatcatgggtacgagaatcctacttacaagtacctggagcaaatgcaaatatag

SEQ ID NO: 214321 - DNA, 1977 bp, Artificial Sequence
  Description of Artificial Sequence: Synthetic coding sequence
atgtatccggagctgcagatcaccaatgtcatggaagctaatcaaagggtaagcatcgataactggtgccggcgagataagaagcagtgtaagtccaggttcgtcacaccatttaaatgtctcgttggagagtttgtgtccgatgtactcctggtcccagagaagtgtcagttctttcataaggagcgcatggaagtttgtgaaaaccatcaacactggcatacagtcgtgaaggaggcctgcctgacccaggggatgactctatactcctatggcatgctgttgccatgcggcgtagatcagtttcatgggaccgagtatgtgtgttgtcctcagacaaagatcatcggctccgtaagtaaagaagaggaagaggaagacgaggaggaggaggaggaggaggacgaggaagaggattacgatgtctacaaatctgaattccccacagaagctgacctggaggatttcaccgaggctgccgtggatgaggacgacgaggatgaggaggaaggtgaggaagtagtggaagatcgcgactattattacgacacattcaaaggggacgattataatgaagagaaccctactgaacctgggtcggacggaaccatgagcgataaggagatcactcacgacgtaaaggccgtttgttctcaggaagctatgacaggaccctgcagagccgtcatgcccaggtggtacttcgatctctccaaaggcaaatgtgtccgcttcatatatggtggctgtgggggtaatcggaacaatttcgaatcagaggattactgcatggcagtgtgcaaggctatgattccacccacccctttacccactaacgatgtagacgtgtactttgagacttcggccgatgataatgagcacgctcgcttccaaaaggccaaagagcagctcgagattagacaccgtaaccgcatggatcgcgtgaagaaagaatgggaggaggctgaactgcaggctaagaacttgccgaaagccgagcggcagactcttatccagcactttcaagccatggtcaaagccctggagaaggaggcggcatccgagaaacagcagctggtagagacacacctcgcaagggtggaggctatgctgaatgatcgtagaagaatggccctggaaaactacctcgctgccctgcagtcagacccaccgcgtccacaccggattctacaggctctgaggcggtatgtcagggccgagaacaaagatagactccataccattaggcattatcagcacgttctagcagtcgatcctgagaaagcagcccagatgaagagccaggtgatgacgcatctgcacgttattgaagagcgccgaaaccagtctcttagtctcctgtacaaggtcccttacgtcgcccaggagattcaggaagaaattgacgaactgctgcaggagcagagagcagacatggaccagttcacagcctccattagcgaaaccccggtagatgtgcgcgtgtcttccgaggaatccgaagagatcccacccttccacccgttccacccgtttccggcactgccagaaaacgaaggctctggtgtgggcgagcaggacgggggacttatcggggctgaggaaaaagtaattaactcaaagaataaggtggatgagaacatggtgatcgatgagacactggatgtcaaggagatgatttttaatgccgagagagtgggaggcctagaagaggagcgagagtccgtgggacccctgcgtgaggatttttcattgtccagtagcgccctgatcggccttctggtgattgccgtggccatagccaccgtgattgtgatctcacttgtcatgcttaggaaaagacaatatggtacaatatctcacggaattgtggaagtcgacccgatgctgacacctgaagagagacatctcaataagatgcagaaccatggttatgagaaccccacctacaagtacctggaacagatgcaaatttag

SEQ ID NO: 214322 - DNA, 1758 bp, Artificial Sequence
  Description of Artificial Sequence: Synthetic coding sequence
atggcagccgtggagctcgaatggattcccgagaccctgtacaacacagccataagcgcagtagtggacaactatattcgttcaagacgcgacatccggagccttcccgagaacatacagttcgacgtgtattataagttataccagcagggaagactgtgccaattaggatcagagttttgtgagctggaggtattcgccaaggtactcagggcactggataaacgccacttattgcatcattgttttcaggccctcatggaccacggagtcaaagtcgcgtcagtgctagcttatagcttttcccgccgatgctcatatatcgctgagagcgacgcagccgtcaaagaaaaggccatccaagttgggtttgtgctgggtgggttcctgagcgacgccggatggtactcagacgcagagaaggtttttctgtcttgcttacaactttgtacacttcacgacgagatgctgcactggttccgggcagttgagtgttgcgtgaggcttcttcatgtacgaaacggaaattgcaaatatcatctcggggaggagacctttaagctagctcagacatatatggacaaacttagtaagcacggtcagcaagccaataaggctgctttgtatggggagctctgcgccctcttgtttgccaaatcacactacgatgaggcgtataagtggtgtattgaagctatgaaggaaataaccgctggactgcctgttaaggttgtcgtagacgtgttaaggcaagcctccaaagcctgcgtggtcaagcgcgagttcaagaaggccgaacaactcattaagcacgctgtgtacctcgcacgggaccactttgggtccaaacaccctaagtacagtgacacgttgctcgactacggattctacttgctaaacgtggacaacatctgtcagagtgtggcgatataccaggctgctttggatattagacagtctgtctttggcggtaaaaacattcacgtggcaaccgctcatgaagacctggcatactctagctacgtgcaccagtattccagtgggaagttcgataacgctttgtttcacgcggagcgagccattggaatcatcacacacatccttcccgaagatcatctgctcttggcaagttcaaaaagagtcaaggccctgatactcgaagagatcgccatcgattgccacaacaaagagacagaacaacggctcctgcaagaagctcacgacctgcatcttagcagtttacagctcgccaaaaaagcattcggagagttcaatgtccagactgctaaacattatggtaatctgggcaggctataccagtctatgcgcaaatttaaggaggcagaggagatgcatataaaggctatacaaatcaaagagcaactgctcggccaggaagactatgaggttgctctctccgtggggcatctagccagcttatacaattatgacatgaaccaatacgagaatgctgaaaagctctatctgcgatccatcgctatcggaaaaaaactatttggagagggctatagtggtcttgaatacgactatcgtgggctcataaaactatacaactccattgggaattacgagaaggtcttcgaatatcataacgtcctttctaattggaaccgcctccgtgatagacagtacagcgtgactgacgccttggaggatgtgtccactagccctcagtcaaccgaagaagttgtccagtctttccttatctcccagaacgtggaaggtccctcatgttag

SEQ ID NO: 214323 - DNA, 4974 bp, Artificial Sequence
  Description of Artificial Sequence: Synthetic coding sequence
atggacagtaaaaaaagaagctccaccgaggcagaggggagcaaagagcggggtttggtgcatatctggcaggccggatccttccccatcacacctgaaagactgcctggctggggcggtaaaactgtgctgcaggcggcactgggcgttaagcatggcgtcctgctcactgaggatggggaggtgtatagttttgggacacttccatggcgctcaggtcctgttgagatctgtccctcctcccctattctcgagaacgccctggtgggtcagtatgtcataactgttgcgaccggcagcttccacagtggtgccgtcacagataatggagtggcctatatgtggggagagaacagcgctggccagtgcgctgtggcaaaccaacagtatgtgcctgagcctaaccctgtgtccattgctgatagcgaggcttctcctcttttagcagttcgaattctgcaacttgcttgtggggaggaacatacattagcgctcagtataagcagagagatttgggcttggggaactggatgtcaactggggctgatcaccactgcatttccagtgacaaagccacagaaagtggagcatctggctggcagggtggttcttcaggtcgcctgcggtgcattccactctctcgcgctagtccagtgtctaccctctcaggatcttaagccggtccctgagcgatgcaaccagtgcagccaactccttatcaccatgaccgataaagaggaccacgtgattattagcgattcccactgctgcccactcggcgtcaccctcactgagagccaggcagagaatcatgctagtacggccctgtccccttctactgagactttagatcgacaagaagaagtgttcgaaaacaccctggtcgccaatgatcagagtgttgccacagaattgaatgccgtgagcgctcagatcactagttcagacgccatgtctagccagcaaaatgtgatgggtacaactgagatctcgagcgccagaaacattccatcatatcccgatactcaggctgttaacgagtatttgcgaaagttaagtgaccactccgtaagagaggattcagaacacggagaaaaacccgttccgagccagcccctgctcgaagaagcaatcccaaaccttcactctccccctacaacctccactagcgccttgaacagcctagtcgtgagctgcgcctcagccgtcggggtcagggtggccgctacatatgaagctggtgccttgtccctcaaaaaggtaatgaatttctacagcaccacaccttgcgaaaccggggcacaggcaggtagctccgcaataggaccagagggcttaaaggactcaagagaagaacaagttaaacaagagtccatgcagggcaaaaagagttcgagcctggttgacatcagggaggaagaaaccgaggggggttccaggcgcctttcgctacccggattgcttagtcaggtgtcccctcggctcctgcgcaaggcagcccgagttaaaacgcgaaccgtcgtcttaacccccacttattcaggagaggctgacgctctactcccatctctcagaaccgaagtgtggacttggggaaaagggaaggagggacagcttgggcatggcgacgtgctgccacgccttcagccattatgcgtcaaatgcctagacggtaaggaggtcattcatctagaggcaggcggataccatagcctggcgctcacagccaagtcccaggtgtactcatggggctccaacaccttcggacagctgggacatagtgactttccaactacagtgccccgtctggccaaaatcagcagcgagaatggtgtgtggtctatagctgctggacgagattatagtttgttcctcgtggataccgaagacttccagcccggactctactacagcgggagacaggaccccacggagggtgacaatctgccagagaaccactccggatctaagacccccgtactgttgagttgctcaaaacttggttatatcagcagagtgactgcgggaaaggattcttatctcgccttagttgacaagaatatcatgggatacatcgcatcccttcacgagctagccaccaccgagaggaggttttactctaaattgtcagatattaagtcccagatcctgcgcccactcctgagtctggagaatctgggcactacaaccaccgttcagttacttcaggaagttgctagtcgtttctcaaagctgtgctatctgatcggccagcatggcgctagtttgtcaagttttctgcatggggtgaaggaggcacgcagcctcgttatactgaaacattcaagcctgtttcttgatagttatactgagtactgtacctccatcacgaacttccttgtgatgggtggttttcagctgctggcgaagcccgctatagatttcctgaacaagaatcaagagctgctacaggacttgagtgaggtaaatgatgagaatacccaacttatggaaatactgaacaccctttttttcttgccaattaggcgactccacaactacgccaaggtattattgaagctggcaacctgtttcgaagtggcgtccccggagtaccagaagctgcaagacagctccagctgctacgaatgccttgccctgcatctgggcagaaagcggaaggaagcggaatacacactgggattctggaagacatttccaggtaaaatgactgatagcttgagaaagcccgagaggagacttctgtgtgagtcatcaaatcgagcgctatccctccaacacgccggacggttctccgttaattggttcatactgtttaatgatgccttggtacacgcacaattttccactcatcacgtctttcccttggcgacgctctgggctgagccactaagcgaggaagccggaggggttaatggtctgaaaattacaaccccagaagagcagtttaccctgattagttcaactccacaggagaaaacaaaatggttacgggctatctctcaggccgtggatcaagccttgaggggcatgtcagatcttccaccctatggttctggtagtagcgttcagcgccaagagccccctatttcccgctccgctaaatataccttctacaaagacccgaggttgaaggatgctacttacgatggaaggtggctaagtggtaaacctcatgggcgtggggttctcaaatggcctgacggaaaaatgtactcgggcatgtttcgcaacggactggaggacgggtacggtgagtaccgaatcccaaacaaagccatgaacaaggaagaccactatgtaggacactggaaggagggtaagatgtgtggacagggtgtctattcctatgcaagtggcgaggtgtttgaaggctgcttccaggacaatatgagacacggacacggactgctgcgatctggaaaactgacatcgagcagccctagtatgttcattgggcagtgggtcatggacaaaaaggccggttacggagtttttgacgatatcacgaggggtgagaagtacatggggatgtggcaggatgacgtgtgccaagggaacggggtggtggtaacacaatttgggctgtactatgagggcaatttccacctgaataagatgatgggtaacggcgtgctactcagtgaggacgacacaatatacgagggtgaattctccgatgactggaccctcagcggtaagggcaccctgaccatgccgaacggggattacatcgaaggttacttcagtggcgaatgggggtccgggatcaagattaccggaacttattttaagccctccttgtatgaaagtgacaaggatcgtccaaaagtcttccggaaactcgggaatctcgctgtccccgctgacgagaagtggaaggccgtgtttgatgagtgctggaggcaattggggtgcgagggccctggccagggcgaagtctggaaagcctgggataacatagccgtagcgctgacaacctcccgacgtcagcaccgagattcaccagaaatcctgtcgagaagtcaaacccagactctggagagcttggaattcattccccaacatgtcggcgctttcagtgtggagaagtacgacgacatcagaaagtatctgattaaggcatgtgacacacctctccatcctctgggtcggcttgtagaaacactcgttgcagtgtaccgaatgacgtatgtaggtgtaggcgctaacaggcgcctgctgcaggaagcagtgaaagagatcaagtcctacctgaagcgaatatttcagctcgtgcgatttttatttccggagctgcccgaggagggctccactatcccgctcagcgcaccgcttcctaccgagcggaaaagcttttgtactggcaagtctgattcaaggtccgagtcaccagagcctgggtatgtggttacctcttcaggactgttgctgccagtgctgcttcccaggctgtatccgccactgttcatgctgtacgccttggataatgaccgcgaagaagatatttattgggagtgtgtgctgagacttaataagcaacctgacatcgccctgcttggattcctgggcgttcagaggaaattctggcccgcaactctgtccatattgggcgagagcaagaaagtgctcccgacaaccaaagacgcatgtttcgcttctgctgtggaatgcctacaacagatcagcactacattcactccatccgataagctgaaggtgattcagcagacttttgaagagatcagtcaaagcgtcctcgctagtctgcatgaggacttcttatggagtatggacgacctgttccctgttttcctttatgttgtgttaagagccaggatccgcaacctgggttctgaggtgcacctgatcgaggacttgatggacccatatctgcagcatggcgagcaggggattatgtttaccaccctcaaagcctgttattatcagatccaaagggaaaagttgaattat

SEQ ID NO: 214324 - DNA, 420 bp, Artificial Sequence
  Description of Artificial Sequence: Synthetic coding sequence
atggacagtaagaagagaagttctaccgaggcagagggatctaaggaacgtggcctggtgcacatatggcaagcagggagcttcccaatcacccccgaacgtcttcctggatggggcggaaaaaccgttctgcaggccgcattaggtgtaaagcatggggtgctgctgaccgaagatggcgaggtatatagcttcggtaccctgccctggcgaagcggccctgttgagatttgccctagttcaccaatcctcgaaaacgctctggtgggccaatacgtaatcacagtggccacaggctcttttcactcaggcgctgtcaccgacaatggcgttgcctacatgtggggcgagaactcagctggccaatgcgctgtggcaaaccaacagtatgtgcctgaacccaatcccgttagcatctag

SEQ ID NO: 214325 - DNA, 321 bp, Artificial Sequence
  Description of Artificial Sequence: Synthetic coding sequence
atggacagcaaaaagcggtcctccactgaagcagaaggatccaaggagcgcggtctggtccacatctggcaggccggtagtttccccatcacacctgagaggctgcccggttggggagggaagaccgtcctgcaggctgctttaggagtgaagcatggggtccttctcactgaggacggcgaagtttacagcttcgggactttgccctggcggagcggccctgtagaaatatgcccgtcatcccctatcctggagaacgcactggttgggcaatacgtgattacggttgccacgggctctttccatagtggggctgtgtag

SEQ ID NO: 214326 - DNA, 1758 bp, Artificial Sequence
  Description of Artificial Sequence: Synthetic coding sequence
tagctagccctggtggacaaaaatatcatgggatatatcgcaagcctgcacgaacttgccaccaccgagaggagattctactcaaagttgagcgacataaagagtcagattctgcgcccactgctgtcattggagaatcttgggacaacaactaccgtacagcttctgcaggaggtggcgtcaagattttcaaagctgtgctaccttatcgggcagcacggcgcttcactttcaagttttctgcacggcgttaaggaggctaggtctttggtaatactaaaacacagcagcttgttccttgacagctataccgaatattgtacatcaatcaccaactttctcgtcatgggcggatttcaactgctcgctaagccagccatcgactttctaaataaaaaccaggaacttctacaggacctgagtgaggtgaatgatgaaaatacacagctcatggaaatattgaacaccctgttcttcttgccaatccggagactgcacaactacgctaaagtgttgttgaagctggccacgtgctttgaagttgcttctcccgagtaccagaaattgcaagactcttcatcctgttatgagtgtcttgctttacacctggggcgaaagcgcaaagaggccgagtacacattgggcttttggaaaacgttcccaggaaaaatgaccgactccttgagaaagcctgagagaaggctactgtgcgaatcctccaaccgtgccctgtccctgcagcacgcaggcaggttcagtgtgaactggttcatcctcttcaacgatgccttagtacatgcccagttctctacccaccacgtatttcccttagctaccctgtgggcagaaccactctctgaggaggccggtggtgtcaatgggctgaagattactacacctgaggagcagtttacactcatatccagtactccacaggagaagaccaaatggctgcgggcaatcagccaggcagtcgatcaggcactgcgtggaatgagcgacctgccgccttatggatccggctccagcgtgcagcgccaggagcccccaatctccaggagcgctaagtataccttttataaagacccacggctgaaggacgccacatatgatggcaggtggttgagcggcaaaccacatgggagaggcgttttgaaatggccagacggcaaaatgtatagtggcatgtttcgcaatgggctggaagacggatatggcgagtatagaattcctaacaaagctatgaataaagaagaccattacgtggggcactggaaggagggcaagatgtgcggccagggagtctacagctacgcttctggcgaggtatttgaggggtgcttccaggacaatatgaggcatggccatgggctgctgcgctctggaaagctaaccagcagttctccttctatgttcatcggacaatgggtgatggataaaaaggccggatacggtgtattcgatgacatcactcgcggagaaaagtatatggggatgtggcaggacgacgtgtgccagggaaatggagtggtggtaactcagtttggcctgtactatgaaggcaactttcacctcaataagatgatgggaaatggggtgttgctgtccgaggacgatacaatctatgaaggagagttttcggacgattggacgctctctgggaaagacaactctggtctaatcgaacaagtggggaaatgctcactacttccatactttctaaaggtctgcgaggcactggtcctttttttgctgtag

SEQ ID NO: 214327 - DNA, 1731 bp, Artificial Sequence
  Description of Artificial Sequence: Synthetic coding sequence
atgggctatatagcttccctgcatgaactggcgaccaccgaaaggagattttacagcaagctgtctgatattaagtcccagattttgcggccactgttaagtcttgagaatttgggcactacaaccaccgtccaacttctgcaggaggttgccagtcgctttagcaaattgtgttatctgatcggacagcatggcgcatcactcagcagtttcctgcatggagttaaagaggcgcgtagccttgtcattcttaaacacagctcactattcctcgactcctatactgagtattgcacgtctatcactaatttcctcgtcatgggcggatttcagcttttagcgaaacctgctatagactttctaaataagaaccaagagctgctacaggatctgtctgaggtgaatgatgagaacacgcagcttatggagatcctgaacacactgttctttttacctatcaggcgacttcataactacgccaaggtgcttctaaaattagcaacctgttttgaggttgccagtcctgagtatcagaagctccaggactcatctagctgttacgaatgcctcgcactgcatctagggcgtaaacgaaaggaagccgaatatacacttggattctggaaaactttccctggaaaaatgaccgactcccttcgcaaacctgaaagaaggctgctctgcgagagctctaaccgggctctttccttgcaacacgcaggcaggttctccgttaactggtttattttattcaatgatgctctggtacacgcccagtttagtacacaccatgtatttcctttggctacactttgggccgaacctctctcagaggaagccggtggggttaatggtctgaagatcaccactcccgaggagcagtttacactgatcagttcaacaccgcaggagaagaccaagtggctgcgggctataagccaagctgtagaccaggcgctgagggggatgtctgacctgcccccatatggaagtggctcgtccgtacagagacaggagcccccaattagccgaagcgcaaaatacacattctacaaggacccgcgtcttaaggacgctacctatgatggacgttggttaagcggcaagccccacggcaggggcgtcctgaaatggcctgatgggaaaatgtacagtggtatgtttcgtaacggcctggaggatggttatggggagtataggatccccaacaaggcgatgaataaagaagatcactatgtagggcattggaaggaagggaaaatgtgcggtcagggtgtctatagttacgcttcgggtgaagtattcgaaggatgtttccaggataatatgaggcacggtcacgggctgctccggtctggtaagctgacctcatcttccccaagtatgttcattggacagtgggttatggataaaaaagcaggctacggcgtgtttgatgacatcacccgcggtgagaagtatatggggatgtggcaagatgacgtgtgccaggggaatggcgtggtggtcacccaatttggtttgtattacgaaggaaatttccatctgaataagatgatgggcaacggggtgttgctctctgaagatgataccatttatgaaggcgagtttagcgatgactggaccctgagtggcaaggacaactccggtctaattgaacaggttggtaagtgttccctcctgccctacttccttaaggtatgtgaagccctcgttctgtttttactttag

SEQ ID NO: 214328 - DNA, 1191 bp, Artificial Sequence
  Description of Artificial Sequence: Synthetic coding sequence
atggacagcaagaaaaggtcatccaccgaggccgaagggtcaaaagagcgtggccttgtgcatatttggcaagcgggaagctttcccatcacgccagagaggctgcctggatgggggggaaagaccgtgctgcaggctgccctgggtgtcaagcacggagtactgctgacagaggacggcgaggtgtattccttcggcacactcccttggagatcggggccagtagaaatatgcccatcttctcccattctggaaaatgctctcgtgggccagtacgtcattactgtcgctactggttctttccatagcggtgcagtaacagataacggagtggcctacatgtggggggagaatagcgccggacaatgcgctgtggccaaccagcagtacgtgcctgaacccaatcccgtaagtatcgccgattctgaggctagtcctcttcttgctgtgaggatcctccagctggcttgtggagaggaacataccctcgccctttccatatctagggagatctgggcttgggggacagggtgtcaactgggactgataaccactgctttcccagtcacaaagcctcaaaaggttgaacacctcgcgggacgtgttgtgctccaggtggcctgcggcgctttccactccttagcgctggtccagtgcctcccctcccaggatctgaaacctgtaccagagcgatgtaatcagtgctcacagctcctcataactatgactgacaaagaagatcacgtgatcatcagcgactcccactgctgtccactcggagtgacgcttaccgagagtcaagccgagaaccacgctagcaccgctctctctccatctacagagaccttggataggcaggaagaggttttcgagaatacactggtggccaacgaccaatctgtcgccaccgagctgaatgcagtgtcagcccagatcacatcctcggacgccatgtcatctcagcagaacgtgatgggaaccacagagatcagctctgctaggaatattccatcttaccctgatacccaggctgtgaacgaatatcttagaaagttgagtgatcactctgtgagggaggactcagaacacggcgagaagcccgtgcccagtcaggtgccagcgcagttctacaaaattaaggtgtgtctcgaactcaactgtatgggattcagcttagaaacacttaagtag

SEQ ID NO: 214329 - DNA, 2178 bp, Artificial Sequence
  Description of Artificial Sequence: Synthetic coding sequence
atggaacagtcaaacgactccctgcgggtgaaccataatgacggcgaggaatccaagacatccgcccaggtgttcgagcaccttatctgcatggattcacgcgatagctcttttggccaaaacgacagccctactgtcctgccgatcactacacgcgaggccaacaactccctaattagtcaaaacatccctggccctctcacgcagacgcagacactgtccgcagaacaattccacctggtggaccaaaacgggcaggccatccagtacgagctccagagccttggtgagagcaatgcgcaaatgatgattgtggcaagtcctaccgagaacgggcaggtcctccgtgtaataccaccgactcagaccgggatggctcaggtgattatcccccaaggtcaactggtagacgtgaattccccccgagatgtgccggaagagaagccctcaaatcgcaacctgcctaccgtccgcgtcgatacgctggcagacaacaccagcaactatatcctgcacccacaaacctccttccctctgccaaagaaatccgtaactggcatgctggaagagcctttgctggggcctctgcagccactgtcatcaaacacccccatttgggcttgccggctgcgttcctgtgagaaaatcggagattcatacaggggatattgtgtttctgagactgagctggaatcagtgcttacttttcacaagcagcagacccagagcgtgtggggtactagacagagtccctcaccggctaagcccgctaccagattgatgtggaagtctcagtatgttccttacgatgggatcccttttgtcaacgccggatcacgggcagtggtgatggaatgtcagtacggccctaggcgtaagggctttcagttgaagaaggtgtcggagcaggaaagcaggagctgccagctctacaaagctacctgcccagccaggatttacatcaaaaaagtgcagaagttcccagagtatcgtgtacccacagaccctaaaatcgataagaagataattcgtatggagcaggaaaaggccttcaatatgctgaaaaaaaacttagtggatgcaggaggggtgttaaggtggtatgtccagttacccactcagcaagcccaccaataccatgagctagaaacgccatgtctcaccctgtctcccagtccatttcctgtttcctcactcgaagaagaagaaacggcagtgagggatgaaaactgcgctctgcccagccggttacacccccaggtggcacacaagattcaggagttggtcagccaaggcatagaacaggtgtatgcagtgcggaagcagctccggaagtttgtcgagcgtgagctcttcaagccagatgaggtgcctgagcggcacaacctatctttttttcctacagtgaacgacattaagaaccacattcatgaagtgcaaaagtccttacgcaatggggacacagtgtacaatagcgagattatccctgcgaccttgcaatggacaaccgatagtgggaatatcctcaaggaaaccatgactgtcacgtttgcagaaggtaactcacctggggagagcattacaacaaaagtggaaaccaaccagacccgcggatccttatcacccgagcccacccacctgctgtctagcctgagtagctttcagccaaaaatattcacccagttgcagggattgcagctacaacctcgatacacatctcctgacgagagcccagcagtcgtgagtgtgaacaaccagccctcatcttctccgtccgggctgctggacactattggtagcgccgtcatgaataacaattcgctcctactgggccaatcacacagcttgcagcgagatacctgtttgactcagaataattcaactgcaagcacaatgggtaacttaccggagccagatcagaatcttgtcgcaatggatgaactggtcgaggtgggtgacgtggaggatacaggaaacctggaaggcacagtccatcggattctactgggtgacgtacaaactatccccatccagatcatcgacaatcattccgccttgatagaagagaaccccgagagtactatttcagttagccaggtcaagcaagaacccaaagaacccgctttgtcaatggaggcgaagaagaccgtggactataagaaacttagtgctacttag

SEQ ID NO: 214330 - DNA, 2178 bp, Artificial Sequence
  Description of Artificial Sequence: Synthetic coding sequence
atggagcagtccaatgactcactgagggtgaatcacaacgacggggaagagtcgaaaacaagcgcccaggttttcgagcacttgatctgcatggatagccgcgacagcagcttcgggcaaaatgactcccctacagtgctgcccatcactacccgagaggccaataattcccttatttcacagaatattcctgggcctctgactcagacgcagacactgagcgcggaacaattccacctcgtagaccaaaatggccaggccattcaatatgagctccagtccctcggggagagtaacgcacagatgatgattgtggcctcacccaccgaaaatggacaggttttgagagtgattcctccaacccagactggaatggcccaggtcatcatcccccaggggcagctggtcgatgtgaactctcccagggatgtccccgaggaaaagccttcgaatcgaaatttacctaccgtgcgtgtggataccctagccgataatacaagcaactatatcctccatccgcagacatcatttcccctacctaaaaagtccgtcaccgggatgctggaggaacccctgctgggtcctcttcagcctcttagctccaatacccccatttgggcttgccggttgcggtcttgtgagaagataggagacagttacagggggtactgtgtgtccgagactgagttggagtcagtgctgaccttccacaagcagcagacacagtccgtatggggcacgagacagtctccgtcaccagcaaaaccagccacccggttaatgtggaagtctcaatatgttccttacgacggcataccctttgttaatgcagggtcgagagcagtggtgatggagtgccagtatgggcctcggaggaaaggctttcaattaaaaaaagtgtccgagcaggagtcacgcagctgtcagttatataaggccacctgccccgcacggatctacattaagaaggtgcaaaagtttccagaatacagagtgcccactgaccccaaaatcgacaaaaagattatccgcatggaacaagaaaaggcgttcaacatgctgaagaagaacctggtagacgccggtggcgtgttgaggtggtacgttcagttgcctacccagcaggctcaccagtatcacgagctagaaaccccctgccttacacttagtccttcaccttttcccgtcagcagcctggaagaagaagagacagcggttagggatgagaactgcgcactgcctagccgattgcacccacaagtggcccacaagatccaggagcttgtctctcaggggatagaacaggtctacgctgtcagaaagcagctgaggaagtttgtggagcgggagctttttaagccagatgaagtgcccgagcgtcacaacctctccttctttcctactgttaacgacattaaaaatcacattcatgaggtgcagaagtcactgcggaacggagacacagtatataactccgagatcattcctgccaccctgcagtggaccaccgacagtggtaacatactgaaggagactatgacggtcactttcgccgaaggaaacagccccggagaaagcatcacaacaaaagttgagaccaatcagactaggggatccctatccccggagcctactcacctcctatcatctcttagttcgttccagcctaaaattttcacccaactgcaggggctccagctgcagcctcggtataccagccctgacgaatctcctgctgtggtctccgtgaacaatcagccatcctccagcccgagcggcctgctcgatacaattggatctgccgtgatgaacaacaactctctcctcctgggccagagtcacagtctgcagcgagatacatgtcttactcagaataatagcacggccagtacaatgggcaacttacccgagcccgaccagaatttagtggcaatggacgagctggtggaggtaggagatgtggaagatactgggaacttagagggtaccgtgcacagaattcttctgggtgacgtacaaaccatcccaattcagatcattgataaccacagcgcactcattgaagagaatccggagagtaccatctcagtgagccaggtgaagcaagagcccaaagaaccagcactgtctatggaggctaaaaaaacagtggattacaaaaagctgtcagcgacttag

SEQ ID NO: 214331 - DNA, 165 bp, Artificial Sequence
  Description of Artificial Sequence: Synthetic coding sequence
atggagcagtccaacgattctctgagagtcaatcacaatgacggggaggaaagtaagacatccgcgcaggtgttcgaacacttaatctgcatggactcccgagactcatcatttgggcagaatgactcccccaccgtgttacccattacaactcgcgaggcctag

SEQ ID NO: 214332 - DNA, 396 bp, Artificial Sequence
  Description of Artificial Sequence: Synthetic coding sequence
atggagcagagcaacgacagcctgcgggtgaatcacaacgacggtgaggagtccaaaacctcagcccaagtctttgaacatctgatctgcatggactctcgagactcctccttcggccagaatgacagtcccaccgtccttcccatcacgacccgggaggctaataatagcttgatctctcagaacattcctgggcctctcacccaaacccagaccctgtcagcagagcagttccacctcgtcgatcagaatggccaggctatccagtatgagcttcagagcctgggcgaatcaaatgctcaaatgatgatagtcgccagcccaaccgagaacggccaggtactgcgcgtgatcccccctacccagacaggcatggcccaggtgataatcccctag

SEQ ID NO: 214333 - DNA, 66 bp, Artificial Sequence
  Description of Artificial Sequence: Synthetic coding sequence
atggaacagagcaatgattcactcagggtgaaccacaacgacggtgaagagagcaaaacaagttag

SEQ ID NO: 214334 - DNA, 222 bp, Artificial Sequence
  Description of Artificial Sequence: Synthetic coding sequence
atggagcagtctaacgactccctccgcgtgaatcataatgatggggaagagtccaagacctcagctcaggtattcgaacatctaatctgcatggattctagggactcctctttcggtcagaacgacagcccgaccgtgctacccatcacgactcgagaggcaaacaacagtttaataagtcagaacatacctggaccactgacccagacgcagaccctatag

SEQ ID NO: 214335 - DNA, 2178 bp, Artificial Sequence
  Description of Artificial Sequence: Synthetic coding sequence
atggagcaaagtaacgatagcctgagagtcaaccacaacgacggggaggagtccaagaccagcgctcaggtatttgagcacctgatttgtatggacagcagagacagctcgtttggccaaaacgattcccctactgtgttaccaattaccaccagggaggcaaataatagtctgatatcccagaacatccccggtccactcacgcagactcaaactctgagcgctgaacaattccacctggtggatcagaacgggcaggccatccagtacgaattgcagtctcttggagagtccaatgcacagatgatgatcgtggcgtcccctaccgaaaatgggcaagtgctcagagtgatcccacccacacaaacagggatggcccaggtaataatcccacagggacagctggtggacgtcaactctccccgtgacgtgccagaagagaagcctagtaaccgcaatttgcctacagtgagagtggacactctggcggacaacacttcaaactacattctgcatcctcagacctctttccccctgcctaaaaagtcagttaccgggatgctggaagagcccctgttaggcccactgcagccgctgagcagcaatacaccgatatgggcgtgcagactcaggtcgtgtgagaagatcggcgacagctacagaggctattgtgtgagtgagacagagctggagtctgtcctgactttccacaagcagcagactcagtccgtgtggggaacgaggcaatctccaagcccagccaagccagccacacggctcatgtggaagtctcagtatgtcccctatgacggcatcccattcgtgaatgcaggctcaagggccgtcgtgatggagtgtcagtatggccctaggcggaagggttttcagctaaagaaggtttcagaacaggaaagccggtcttgtcaactgtacaaggcaacatgccccgctcgcatttacatcaagaaagtgcagaagttccctgaatacagggtaccaacagatccaaagatcgacaagaagattattagaatggagcaagagaaagcgttcaacatgctgaaaaaaaacctagtcgacgctggtggtgtgctgagatggtacgtgcagctgcctacccaacaggctcaccagtatcacgagctggagaccccttgcctgaccctatctcctagtccgttccctgttagctccctagaagaggaggagacagcagtcagggatgagaactgcgccttacctagtcgccttcatccgcaggtggcgcataagatccaggaactggtgtcccaaggaattgaacaggtgtacgccgttcgcaagcagctgaggaaattcgtagagagagagttgtttaaacccgacgaggtacccgaacgccacaacctgtcctttttccctacagttaatgacattaaaaaccacatccacgaagtgcaaaagtctttacgtaatggcgacacagtgtacaactctgaaatcattcctgcgacactacagtggacgaccgatagtggtaacatcctgaaggaaaccatgactgtgactttcgccgagggcaattcccctggagagagcattactacaaaggttgaaactaaccagactagaggctctctctcacccgagcctacccacctactttcaagtctttctagttttcagcccaagatcttcacccagctacaggggttacagttgcaaccccgatatacgagccctgatgagagtccagctgtagtgagtgtgaacaatcagcccagttcctccccaagcggcctgctcgataccatcggaagtgcggttatgaacaataatagtctgctgctgggacagtcccattccctgcaacgggacacttgtctgacccagaacaacagcactgcttccactatgggtaacctcccagaacccgatcagaatctggttgccatggacgaacttgtggaagtgggggacgtggaagatactggaaacctggagggaacagtgcatcggatcttactgggcgacgtacagacaatccccattcaaatcatcgataatcacagcgcgctgattgaagaaaaccccgaatccacaatctctgtctctcaggtcaagcaggagccgaaagaacctgccctatcaatggaggctaaaaagacagtggattacaaaaagctgagtgccacttag

SEQ ID NO: 214336 - DNA, 222 bp, Artificial Sequence
  Description of Artificial Sequence: Synthetic coding sequence
atggaacagagcaacgacagcctccgtgtcaaccacaatgacggcgaggagtcaaaaaccagcgcccaagtgtttgaacacttaatttgcatggactctcgcgactcctctttcggacagaatgacagtccaaccgtcctgccaataaccactcgcgaagccaataattctctcatctctcagaacatccctggccctctgacccaaacccaaacattatag

SEQ ID NO: 214337 - DNA, 288 bp, Artificial Sequence
  Description of Artificial Sequence: Synthetic coding sequence
atggagcagagtaatgatagtttgcgtgtaaatcataacgacggcgaagaaagtaagacctccgcccaagtcttcgaacacctgatttgcatggactccagggattcatcgttcggccaaaatgactctccaacagtgctccccatcacaactcgcgaggctaataatagtctgatttcacaaaacattcccggaccccttactcaaactcagactctatccgctgagcagtttcacctggtggaccaaaacggtcaggctattcagtacgagctgcagagcctgtag

SEQ ID NO: 214338 - DNA, 624 bp, Artificial Sequence
  Description of Artificial Sequence: Synthetic coding sequence
atgttggaagcgtggaacctgaacctttctcactacttgaaacatctcatatgtatggactcccgcgattcatcttttggccagaatgatagtccaacagtgctccctataacaacccgcgaagcaaataattctctgattagccagaatatcccgggaccactgactcagactcaaaccctgagtgccgaacaattccatctcgtcgatcagaacgggcaggctatccagtatgaactgcaaagtcttggggagtcgaatgcgcagatgatgatcgtcgcaagtcccacagagaatgggcaggtgctcagagtgatccctcctacccagaccggaatggctcaagtcattattcctcaggggcagttagtggacgtaaactctccgagagatgttcccgaagagaagccctcgaatcggaatttgccaacagtccgggtcgataccctggccgataacacctctaattacatcctgcacccccagacctcattcccactgcccaaaaagagcgttaccggtatgcttgaagaacctctcctcggtccactgcagcctttgagctcaaacacgccgatatgggcttgccggttgaggtcgtgtgagggggtagaattatggtag

SEQ ID NO: 214339 - DNA, 1914 bp, Artificial Sequence
  Description of Artificial Sequence: Synthetic coding sequence
atgctggaagcttggaatctgaatctctctcattacctcaagatgattgtcgcctcccccacagaaaacggtcaggtgcttcgcgtgatacctcctactcagactggtatggcgcaagtcatcataccgcaaggccaactggtggacgtgaacagccccagggacgtgcccgaggaaaagccaagtaataggaacttgccaacggtgcgagttgataccctcgccgacaacacctcaaactacatcctccatccccagacatctttccctctgccaaaaaaatcagtgaccgggatgttagaagagcccttactcgggcctttacaaccactcagttctaacaccccaatatgggcctgccgtctgaggtcttgcgagaagattggcgactcataccgaggctactgcgtcagcgagacagagctcgaaagcgtgttgaccttccacaaacagcagacccagtcagtgtgggggacacgccagagcccttcacctgccaaaccagccacgcgcctaatgtggaagagtcagtatgtgccgtatgatggaatcccattcgtcaatgcgggaagccgggcagtggtgatggagtgccaatacggacctaggcggaaaggctttcagctgaagaaggttagcgaacaggaatccagatcttgccagttgtataaagcgacctgtcccgctaggatatacatcaagaaggtacagaaattccctgaatatagggttccaaccgatcccaaaatagacaagaaaataatccgaatggaacaagagaaagccttcaatatgcttaagaaaaatctcgtagacgccggaggagtattgagatggtatgtccagctcccgacacagcaagcccaccagtatcatgagttggagactccctgtttgacacttagtcctagccccttccctgtcagtagcctggaggaagaggaaaccgccgtgcgggacgaaaactgcgccttaccaagtagattgcatcctcaggtggctcacaaaatccaggaattggtgtctcagggcattgagcaggtctatgccgtgcggaaacaactgcgtaagtttgtggagcgggagctgtttaaaccagatgaggtccccgaacgtcataatctcagtttcttcccgacagttaatgatattaaaaatcacatccacgaggttcagaagagtttaagaaacggggacacggtctataattccgagatcataccggctaccctgcagtggaccacagactctggcaatatcctgaaagaaaccatgaccgttacatttgctgagggtaattccccaggcgagtctattaccactaaagtggaaaccaaccagacaaggggctcactgagtccagagccaacacatctgcttagttctctcagctcattccagcctaagattttcacccagctacaaggtctgcagcttcagccgagatatacaagcccggatgaatctcccgctgtcgtctccgtgaataatcagcccagcagttccccttctggactgctggacacaatcggctcagccgtgatgaacaataattccctccttttaggtcagtcacattctctgcagcgggacacctgtttaactcaaaataactcgacggcgtctactatgggcaacctgcccgagcctgatcaaaatctggtagccatggacgagctcgtagaggtaggagatgtggaagatacaggaaatctggaaggcacggtccaccgtatcctgctgggcgacgtgcaaacgatccctatccagattattgacaaccacagcgcattgatcgaagagaatccagagagcacgatctccgtttctcaggtgaagcaagagccaaaagagccagctctgagtatggaagccaagaaaactgtggattacaagaaactctcagccacctag

SEQ ID NO: 214340 - DNA, 1950 bp, Artificial Sequence
  Description of Artificial Sequence: Synthetic coding sequence
atggagcagtcaaacgattctctacgggtcaaccacaatgatggcgaggagtcgaagacatctgcacaggtgttcgaaatgattgtagcctctccgacagaaaatggccaggttctgcgcgttattcctcctactcagacaggcatggcccaggtcataatcccccagggccagttagtggacgtgaactcccctagagatgttcccgaggaaaagccctccaacagaaatcttccaacagtgagagttgacacactggccgataatacctccaattacatactgcacccccagacttctttccccctccctaagaagagcgtgacaggcatgctcgaggagccccttctgggcccactgcagccactgagcagtaatacccccatttgggcgtgcagactgcgctcctgcgagaagatcggggattcttatagagggtactgcgtgagtgaaaccgagttggaatccgtgctcaccttccataagcaacagacgcaaagcgtatgggggacacgccagtccccgagccctgcaaaacccgcaactaggttgatgtggaaaagtcagtacgttccatatgacggaattccattcgtgaatgccggtagccgggcagtggtgatggaatgtcagtacggcccacggagaaagggctttcagttaaaaaaggtgagcgagcaggagagtaggagctgccagctgtacaaagctacctgccccgcacgaatctatattaaaaaggtccagaagttccctgagtatcgcgttcccactgaccccaagattgacaagaagatcatccggatggaacaagagaaggccttcaacatgttgaagaagaatctggtggatgccggaggagtgttgcgctggtatgttcagttgccgactcaacaggcccaccagtatcacgaactcgagaccccctgtctcacgctgagtccatccccttttccagttagcagcttagaggaggaggaaaccgccgtccgcgatgagaattgcgctctccctagtagattgcatccacaagtggcccataagattcaagagcttgtgtctcagggtatagaacaggtgtatgctgtgagaaagcagctgaggaaattcgtagaaagggaactgtttaagccggacgaagttccggagaggcataacctgtccttcttccccaccgtgaatgacatcaaaaatcacatccacgaggtgcaaaagtcccttcgaaacggagataccgtttataattcagagattatacccgcaactctccagtggacaactgattctggtaacattctgaaagagacaatgacagtaaccttcgcagaaggtaactcacctggggagtctatcaccacaaaggtggaaaccaatcagacacgcggatctctgtcacccgaaccgactcacctgttgtcctcactgtcctctttccagccgaaaatttttactcagctgcagggtttacagttgcaaccaaggtatacctctccagatgagtcacctgcagtggtctccgtgaataatcagcccagcagctccccgagcggcttgctggatactatcgggtctgccgtaatgaataataatagcctcctgctggggcagagccattcacttcaaagggatacctgcctgactcagaataattcgaccgcctcaaccatgggtaacctacccgaaccagatcaaaacctggtggcgatggacgagctggttgaggtcggcgatgtagaagatacaggtaatttggagggcaccgtgcaccgtatcctgctgggggacgtacagaccatcccaatccagataatagacaatcatagcgcccttatagaggagaaccccgaaagcaccattagcgtatcacaagtgaagcaggaacccaaggagcctgccctatctatggaggccaagaaaactgttgactacaaaaagctttctgctacatag

SEQ ID NO: 214341 - DNA, 558 bp, Artificial Sequence
  Description of Artificial Sequence: Synthetic coding sequence
atgacgactcctaataagacacccccaggcgctgaccctaagcagctggagcgaaccggcaccgtgcgagagatcggatcccaggcggtgtggagcctttcttcttgcaaaccgggtttcggcgtggatcagcttagagatgacaatttagagacttactggcagagcgatggctctcagccccacttggttaatatacaatttcgtagaaagactacagtcaagactttgtgtatctatgccgactataagtctgatgagtcttatactcccagcaaaatatccgtgcgggtaggaaataactttcacaatctccaggagatcaggcaactagaactggtcgagccctctggttggattcacgtgccattgacagataatcataagaaaccaacgcgcacgttcatgattcagatagcagtattggcaaatcatcagaacggaagggacacgcatatgcggcagattaaaatttatacaccggttgaagagtcttccatagggaaatttcccaggtgcacaactattgacttcatgatgtatcgttccattcggtag

SEQ ID NO: 214342 - DNA, 558 bp, Artificial Sequence
  Description of Artificial Sequence: Synthetic coding sequence
atgacgacaccaaataagaccccaccaggagctgacccaaagcaacttgaaagaactggtaccgttagagagattgggagccaggcagtgtggtctttatcttcatgtaagcccggatttggggtagaccaactgagggacgataatctggagacatactggcagagcgacggaagtcagccccatctggtcaacatccagttcaggagaaagacaaccgttaagactctctgcatttatgcagattacaagtccgacgaaagttacaccccctctaaaatttccgtgagggttgggaataactttcataacttgcaggagattagacagctggagctagtggagccgtccgggtggatccacgtcccattaactgataatcacaagaaaccaactaggacctttatgatacagatcgcggtcttagccaatcaccagaatggaagagacacgcatatgaggcagattaagatctatactcctgtagaagaatctagtattgggaagtttcctcgatgcacgacaatcgattttatgatgtaccgaagcattcgttag

SEQ ID NO: 214343 - DNA, 207 bp, Artificial Sequence
  Description of Artificial Sequence: Synthetic coding sequence
atgacgaccccaaataaaactcctccgggagctgacccaaagcaactcgaaaggacggggactgtgcgtgaaattggaagccaagctgtttggtcattgtccagttgcaaaccaggcttcggggttgaccagctgcgggatgacaatctggaaacctactggcagtctgacggttcccagccccacctagtcaacattcagttttag

SEQ ID NO: 214344 - DNA, 330 bp, Artificial Sequence
  Description of Artificial Sequence: Synthetic coding sequence
atgaccactcccaacaaaacaccacccggagcagacccaaaacagcttgagcggacgggcaccgtgagagagattggtagtcaagccgtgtggtccctcagttcttgcaaacctggatttggtgtggatcagcttagagatgacaacctcgaaacatattggcagtcggatggaagccagccccacctggtgaacatccaattcaggaggaagacaacagtaaagaccctttgcatctatgctgactacaagtcagacgaatcttataccccatctaagataagtgtacgcgttggaaacaattttcataatctgcaggagatccgttag

SEQ ID NO: 214345 - DNA, 558 bp, Artificial Sequence
  Description of Artificial Sequence: Synthetic coding sequence
atgaccacccccaacaagactcctccaggagctgatcccaagcagctggaacggacaggcactgtaagggaaataggaagccaagcagtttggtcgctttctagctgtaagcccggatttggtgtcgatcaattaagagatgacaatctggagacctattggcagtccgacggttcacagccccatctcgttaatatccagttccgccgaaaaactaccgtcaagactctctgtatttacgccgactataagtccgacgagagctacactccctcaaagataagcgtccgagtcgggaataactttcacaaccttcaggagattcggcagctggaactggtagaaccatccggctggatccacgtgcctctgaccgacaaccataaaaagcccactcggacattcatgatccagatcgcggtgctagctaatcaccagaacggcagagatacgcacatgcgccagatcaagatctatactccagtggaggaaagtagcatcgggaagtttcccagatgtacaactatcgattttatgatgtatcggagcatccggtag

SEQ ID NO: 214346 - DNA, 477 bp, Artificial Sequence
  Description of Artificial Sequence: Synthetic coding sequence
atgacaaccccaaacaagacccctcccggtgcggatcccaaacaacttgagcggacaggtactgtacgggaaatcggctcgcaggcagtgtggtctttgagcagctgtaaacctgggttcggtgttgatcagcttcgcgatgacaacctggagacttactggcaatccgatggttctcagccgcatctagtgaatattcaattcaggagaaagactacagttaagaccctctgtatctatgccgactacaaatctgatgaaagctataccccaagtaaaataagtgtgcgagtgggtaacaacttccacaatctacaggaaatcaggcagctggaactcgtggagcctagtgggtggattcatgtgcctctgaccgacaatcataagaaacctaccagaactttcatgatccaaattgcagtgttggccaaccaccaaaatgggagagacactcacatgcgtcaaatcaagatttag

SEQ ID NO: 214347 - DNA, 477 bp, Artificial Sequence
  Description of Artificial Sequence: Synthetic coding sequence
atgacaaccccaaataagacccccccaggggctgaccctaagcagcttgagaggactggaaccgttagggagattggatctcaggctgtgtggagccttagtagttgtaaacccggattcggagtggaccagctcagggatgacaatctggagacgtattggcagtccgatggaagccaacctcaccttgttaacatccaattccgcaggaaaactaccgttaagacactgtgtatctatgcagattataagtcggatgagagctacacccccagcaagattagcgtccgggtaggaaataacttccataatctccaagaaattagacagctggaattggtggagccaagcggctggatccacgtccctcttaccgataaccacaagaagccaactcgaacgttcatgatccagatcgcagtcctcgccaaccatcagaatggaagagatacgcatatgcggcagattaagatctag

SEQ ID NO: 214348 - DNA, 333 bp, Artificial Sequence
  Description of Artificial Sequence: Synthetic coding sequence
atggcagcgagtagcagctcatcaagcgcaggaggggtctcgggcagcagtgtgacagggtccggctttagtgtgagtgacctcgcccctccaagaaaggcgttattcacctacccaaaaggcgctggcgaaatgctcgaagatggaagcgaaaggtttctgtgcgagagcgtttttagctaccaggtggcaagtactctgaagcaggtcaagcacgatcagcaggttgccaggatggagaagttggccggtctcgtggaagaactggaggccgatgagtggagatttaaacctatagagcagctgttaggctttacacctagctctgggtag

SEQ ID NO: 214349 - DNA, 2427 bp, Artificial Sequence
  Description of Artificial Sequence: Synthetic coding sequence
atgctgcggttcccaacttgtttcccaagcttcagggtggttggcgagaaacagctgccccaggagatcatctttctggtttggtcccctaaaagagatctcattgccctggcgaacacagccggagaggtcttgctgcataggctcgccagctttcatagagtatggtccttcccccctaatgagaacaccggaaaagaggtcacttgtctcgcgtggcggccagacgggaaactgctagcctttgcattagcggacacgaagaagatcgttctctgcgatgtcgaaaagccagagtcgcttcactcgttttctgtggaggcaccggtttcgtgcatgcactggatggaagtgactgtggagagttcagtgctgacatccttttataacgctgaggacgagtccaatttactgctgcccaaactgccaactctccctaagaactattccaatactagcaagattttttcagaggagaatagcgatgagattattaaactcctgggggacgttagattgaacatcttagtgctggggggatccagcggatttattgagctgtacgcttacgggatgtttaaaatagctcgcgtgacagggatcgcaggcacttgcttagccctttgcctgtccagcgatcttaaatctctgtctgtagtaactgaagtgtccacgaatggggcttcagaggtctcatacttccagctagagaccaatctcttgtattcatttcttcccgaagtgacgcgcatggcaagaaaatttacacacatatccgctttgctgcagtacatcaatttatcactgacttgtatgtgtgaggcctgggaagagattctgatgcaaatggattcgcgtttgactaaatttgtgcaggaaaaaaatacaaccaccagtgttcaggatgagtttatgcacctcttactctgggggaaggcgtcggctgaactgcaaacgctgctgatgaaccagctgactgtgaaaggtctgaagaagcttgggcagagtattgaaagttcatacagtagtatacagaaacttgtgatatctcaccttcagagcggcagcgagtctctcttgtaccacctgtccgaacttaagggtatggcatcttggaagcagaaatacgagcctttgggattggacgctgcgggaatcgaggaggcgattacagccgtgggaagctttattctcaaggcaaatgaactgctgcaggttatagatagctcaatgaaaaattttaaggctttttttagatggctgtatgttgctatgcttcgtatgacagaggaccatgtgctcccggaactcaacaagatgacacagaaggacatcacgttcgttgcagaatttctgaccgagcatttcaatgaagcgcctgacctgtacaatcgtaaaggcaagtacttcaatgtggaacgagttggccagtatttgaaagatgaggacgacgacctcgtgagccccccaaacacggaggggaaccaatggtatgattttctgcaaaatagcagtcatctcaaagagtcacctctgctgttcccttactatccccgaaagagcctgcactttgtcaaaaggaggatggagaatatcatcgatcagtgcttgcagaagccagccgatgtcataggaaagagcatgaaccaggccatctgcatacccctgtatagggatactagatctgaagatagcacgaggcggttgttcaagtttcctttcctttggaataataagacgtcaaatctccactacttactgttcactatattggaggatagtctctacaaaatgtgcatactgcgcaggcacaccgatatatctcaatcagtcagtaatggattgattgccattaagtttggttcttttacctatgccaccacagagaaggtccgacggtctatatatagttgtctggatgcccagttctatgacgacgagacagtgactgttgttctgaaggacaccgtggggagggaaggacgcgaccgtttgttggtgcagttgcccctgtctctggtgtacaactctgaagactcagccgagtaccagttcaccgggacatattctactagactggatgaacagtgttcggccatcccaaccagaaccatgcatttcgagaaacactggcgcctcttggagagcatgaaggcccagtatgtagcgggaaatggcttccggaaagtctcttgtgtcctgagctctaatctaaggcatgtgagagtcttcgaaatggatatcgacgacgaatgggagctggacgaatcgagcgatgaagaggaagaggcctcaaataagcctgtgaaaataaaagaagaggtgctcagcgaatccgaggctgagaatcagcaagccggagctgctgctctcgctcctgagattgttataaaagtggaaaagctagaccccgagctcgactcctag

SEQ ID NO: 214350 - DNA, 489 bp, Artificial Sequence
  Description of Artificial Sequence: Synthetic coding sequence
atgctgagattccctacttgtttcccgtcgtttagggttgtcggtgaaaaacagcttccacaagaaataatttttttagtctggtcaccaaaacgggacctcatcgccttggcaaacacagccggagaggtgctcctccacaggctggcctcatttcaccgggtgtggtcttttccacctaatgaaaataccggaaaggaagtgacatgcctggcttggaggccggacgggaagctcctggcatttgctctggcagacacaaagaagatagtcttatgcgatgtggaaaaacctgagagtctccactctttctcggtagaggccccagtgtcatgtatgcactggatggaagtgactgttgagagcagcgtactgacatcattctacaatgctgaggatgagagtaatcttctccttccgaaactcccaacgctcccaaaaaactatagcaacactagcaaaatctttagcgaggaaaattctgattag

SEQ ID NO: 214351 - DNA, 2430 bp, Artificial Sequence
  Description of Artificial Sequence: Synthetic coding sequence
atgctgcgttttcctacatgtttccctagcttcagggtcgttggagagaaacagctgcctcaggaaattatttttctcgtgtggtccccaaagagggacctgatcgctctcgccaacacagcaggggaggttctgctgcatcgattagcgtcctttcaccgggtctggagttttcccccaaacgagaacactggcaaggaggtaacctgtttagcctggaggcccgacggcaaactgttagccttcgctttggcggacacgaaaaaaatcgtcttgtgtgacgtcgaaaaacccgagtctcttcattccttctcagtggaggccccagtgtcctgtatgcactggatggaagtcaccgtagaatcatccgtactgacatctttttataacgcggaggatgagagtaacctcctgctgccaaaattgcccaccttgccaaaaaattattccaacacttcaaagattttttctgaggaaaactccgatgaaatcattaagctgctgggggatgtgagactcaatattttggtgctgggcggatcgtctggttttattgaactgtacgcctacgggatgttcaagatcgcgagggtgaccgggatcgcagggacttgcctggcactttgccttagctccgacttgaagtcactgtctgtcgtcactgaggttagtacaaatggcgcaagcgaggtgtcatacttccagttagagactaatctcctgtatagtttcttacccgaggtgacgagaatggccagaaaatttacccatatttccgccctactccagtatattaatctctccctcacctgtatgtgcgaagcctgggaggagattctcatgcagatggactcccgcctcacaaaatttgtacaggaaaagaacacaacaactagcgtccaagatgaattcatgcacctgctcttatgggggaaggcctcagcggaactgcagactctgttaatgaatcaactgactgtcaagggcttgaaaaaactcggccagagtatagaatcaagttattcatctatccagaaactggtgatctctcacctccaaagcgggagtgagagcttgctgtaccatttgagcgagctcaaaggtatggcttcttggaagcagaagtatgagcctctaggcctggatgccgctggtatagaggaggccataacggctgtcggaagcttcatcctaaaggccaatgaactgctccaagtcatcgattctagcatgaaaaattttaaagcatttttccggtggttgtacgtcgcaatgctgagaatgactgaagatcacgttctccccgaactgaataaagtgatgacccaaaaggatattacctttgttgcagagtttctgaccgagcattttaacgaggcccctgatctatacaatcggaagggcaaatatttcaacgtagagcgtgtggggcagtatctgaaagacgaagatgatgatctagtttcccccccaaacacggagggtaatcagtggtacgacttcttgcagaattcctctcatctaaaagagtcccctttgctgtttccttattatccccgaaagagcctgcacttcgtgaaacgccgaatggaaaatattattgaccagtgcctccagaagccagccgacgtcattggcaaatccatgaatcaggcaatctgcatccctctttatcgtgatactcgctccgaagactctacccgaagattgtttaaattcccgttcctttggaataacaaaacctcaaacctgcattatctgctgtttacaatcttggaggactcactgtataagatgtgtattctgagacggcatacagacatctcgcagtcagtatctaacggcctgatagcaatcaagtttggctcatttacatacgccacaactgagaaggtgcggcgttccatatattcatgcttggatgctcagttttatgatgatgagaccgtcaccgttgtcctgaaggataccgtgggacgcgagggccgtgatcggctgctcgtgcaactgcccttgtcacttgtgtacaattccgaggacagtgcggagtatcagtttaccggcacctactccacacgactggacgagcaatgctcggccatcccgactcgcacgatgcacttcgaaaagcactggcggctgctggagtctatgaaagcccagtacgtggccggaaacggattccgtaaagtcagctgcgtgctctcgtccaacctgagacacgtgagggtgtttgaaatggacatcgacgacgagtgggaacttgacgagtcatccgatgaggaagaggaggctagtaacaaaccagtgaaaattaaggaggaggttttgtctgagtccgaggcggagaaccaacaggccggtgctgcagctcttgcccctgagatcgttataaaggtggaaaagctggatcctgagcttgactcctag

SEQ ID NO: 214352 - DNA, 2268 bp, Artificial Sequence
  Description of Artificial Sequence: Synthetic coding sequence
atggccagcgtgcatgagagcctttattttaatcctatgatgacaaatggggtggtgcacgcaaacgtgttcggcataaaggattgggtgactccatataagatcgccgtactggtgctgctgaacgaaatgagcagaacaggcgagggcgcagtgtctctcatggaacgcaggcgcttgaaccagctgctgctgcccctgttgcagggtcccgacatcaccttgtctaagctgtacaaacttatcgaggagtcatgcccgcagctggccaacagcgtccaaatcaggattaaactcatggccgagggcgaattaaaagatatggaacagttcttcgacgacctttccgactccttttcgggtaccgaacccgaggtgcataagacctccgtcgtgggcctgtttctccgccacatgattctcgcatactccaagttgtcgttttcacaggtgtttaagctgtacacagcgctgcagcaatacttccagaacggggaaaagaagacagtggaagacgcagatatggaactcacttctagagatgaaggcgagcggaaaatggagaaagaggagttagatgtatctgtgcgagaagaggaggtgtcttgcagcggcccactgtctcaaaagcaagctgagtttttcttatcccaacaagcctccctcctgaagaatgacgaaacaaaggcactgacaccggcaagtctgcaaaaggagcttaataacttgttgaaattcaatcccgatttcgctgaggcccactatctatcatatttaaataacttgcgcgtccaagacgtattcagctccacgcatagtctgctgcattactttgatcggctcatcctgacaggagccgagtcaaaatccaacggagaggagggatatgggagatccttaagatatgcagctctcaatctcgccgcactgcactgccggtttggccattaccagcaggcagaactggcgttgcaggaagctattcggattgctcaggaaagcaacgaccatgtgtgcctgcaacactgcttgagctggctctacgtgttgggccagaaaagatccgattcctatgtgctacttgaacatagtgtcaaaaaggcggtccattttggattgccctacctcgcttctctgggtattcaatctctggtccaacagcgcgcatttgctgggaagacagccaataagctgatggacgctctgaaagatagcgacctcttacactggaaacattctttgtcagaattgattgacattagcattgctcaaaagacggctatctggcgactgtatgggaggagcaccatggccctccagcaggcgcaaatgcttctttctatgaactcactggaggcagtgaatgctggcgtgcagcagaataacactgaaagttttgcagtggccctatgccacctggctgagctgcatgccgagcaagggtgctttgctgcagcaagcgaagtgctgaagcatctgaaggaaagattcccaccgaattcccagcacgctcagctgtggatgttgtgtgaccagaagattcaatttgacagggccatgaatgacggaaagtatcacctagctgatagtctggtgaccggaattaccgctttgaacagcattgaaggggtctataggaaagccgttgtgttgcaggcccaaaaccaaatgtcggaagcccataagctgctgcagaaactgttagtccattgccagaaactgaagaacaccgaaatggtcatcagtgtcttactgtcagttgctgaactctattggcgctcgtctagccctacgatcgcccttcctatgcttttgcaagccctcgcactgagcaaagagtacagactacagtacttggctagcgaaactgtcctgaacctggcctttgctcaattgattctgggcatcccggaacaggcactcagcttgctccatatggccatcgaaccaattttagcagatggcgcaatcctggacaaaggtagagccatgttccttgtggccaaatgccaggtggcctcagcggcatcctatgatcaacccaagaaggcggaagctctcgaagctgcgatcgagaacctcaatgaagctaagaactattttgcaaaggtagactgcaaggagcgaattagagacgtggtttatttccaggcccgtctgtaccacaccctgggcaagacacaggagagaaaccggtgcgcaatgctcttcaggcaattgcatcaggagctgccgtctcacggcgtgcctctcattaaccatctttag

SEQ ID NO: 214353 - DNA, 1932 bp, Artificial Sequence
  Description of Artificial Sequence: Synthetic coding sequence
atggcagagggtgagctgaaggacatggagcagttttttgacgacttgagtgactccttctcgggcacagagcccgaagtgcacaagacatccgtagttggcctatttctccgccacatgatactggcctactccaagctctctttttcacaggttttcaagctctacacagcgctgcagcaatacttccagaacggcgaaaagaagaccgtagaggacgccgatatggaactgacatctcgcgatgaaggagagcggaagatggaaaaagaggagctggacgtatctgtgagggaggaggaggtttcttgttctgggccactgtcgcaaaagcaggcggagttcttcctgagtcaacaggcctccctgctgaaaaacgatgaaaccaaagccttgactcccgctagcttgcagaaggaattgaacaatcttttgaagttcaatcctgattttgcagaggcccactacctgtcttatctaaataacctgagggtgcaggatgtgttctcgtctactcattccctgctccactacttcgatagattgatacttacaggtgcagagagtaagtcaaatggcgaagagggatacggaagatccttgaggtacgccgctcttaatctggcagccttacactgtaggtttggccattatcaacaggctgaactcgctctgcaggaagccatcaggatcgctcaggagagtaatgatcacgtgtgcttacagcactgtttgtcgtggctttacgtccttggccagaagagatctgattcttacgtccttctagagcactcagttaagaaagcagtgcatttcggcctcccccgtgcctttgctgggaaaacggccaataagcttatggacgctctgaaggattcagatctcctgcactggaaacattcactctccgagctgattgacatctccatcgctcagaaaactgcaatctggcgcctctacgggcgttcaactatggcactgcagcaggcccagatgctgctgtcaatgaactccctggaagcagtgaatgcaggtgttcagcaaaacaacactgagagcttcgccgttgcgttatgccacctggcagaactacacgctgagcaaggttgcttcgcagctgcttcagaagtgctgaagcacttaaaggaacggttcccgcctaactcccagcatgcacagctgtggatgctgtgcgaccagaaaattcagttcgatagagcgatgaacgatgggaaataccacctcgcagatagccttgtgaccgggatcaccgcccttaacagcatagaaggggtgtataggaaggccgtggtactgcaagcccagaatcagatgagcgaagcccataagctgctgcagaagcttctggtacattgtcagaagttgaagaatacagagatggtgatatccgtactactcagcgtagccgagctgtactggagatcttcatcacctaccatagctctgcctatgctgctgcaagctctggccctcagcaaagaatacagacttcagtatttagcatccgaaactgtgcttaacctcgccttcgcccaactcatcctgggtatcccggagcaggccctgtctctccttcacatggcaatcgaaccgattctggcagacggtgctatattggacaaaggcagggcaatgtttttggtggcaaagtgccaagtcgcgtcggcggcatcctatgatcagcccaaaaaggccgaggcgctcgaagccgcaatcgaaaacctgaacgaagctaaaaactactttgcaaaggtcgactgcaaggagagaatccgcgacgttgtgtactttcaggctcggttatatcacaccttagggaaaactcaggagcgcaatagatgcgcaatgctcttccggcaactccaccaggagttgccttcccatggcgtgccccttattaaccatctgtag

SEQ ID NO: 214354 - DNA, 1932 bp, Artificial Sequence
  Description of Artificial Sequence: Synthetic coding sequence
atggctgaaggcgagttgaaagatatggagcagtttttcgacgatctgtccgacagtttctctggcactgaacccgaggtgcacaagactagcgtggtgggactcttcttgagacatatgattttagcatattccaagcttagcttttcgcaggtgtttaagttgtacacagccctgcagcagtacttccagaacggggagaaaaagactgtggaggacgccgatatggagttaacaagcagggacgaaggcgagaggaagatggaaaaagaggaactagatgtcagtgtgcgggaggaagaagtgagctgttctgggccattgagccagaagcaggccgagttttttctgagccagcaagcttcactgctaaaaaatgacgagaccaaagcgcttacgcctgcaagcctgcagaaagaattgaacaatcttcttaagtttaatcctgatttcgccgaagctcattatctctcctatttgaataacctgcgggtccaggacgtcttcagttccactcattcccttcttcactactttgaccggttgattctcactggagcggagagtaagagtaatggcgaggagggctacggacgtagtcttcgctacgccgcacttaatcttgctgcactccattgcagattcgggcattaccagcaggcagagctggcactgcaggaggcaattcgaattgcacaggagtcaaatgatcacgtctgcctgcagcactgcctcagctggctgtatgtgttgggacagaaaaggtccgacagctatgttctgctcgagcactcagtgaaaaaggccgtacattttggcctaccacgcgctttcgccggaaaaacggcgaacaagctgatggacgccctcaaggacagcgacctgcttcattggaagcacagtctcagcgagttaatcgacatctccattgctcagaaaacagctatttggcgcttgtacgggagatcaactatggccttgcagcaggcacaaatgctcctttctatgaacagcttagaggctgtcaacgccggtgtccagcagaacaacaccgagtctttcgctgtagctctctgtcacctggcggaactgcacgccgaacaagggtgctttgctgcagccagcgaagtcctgaaacatctgaaggaaagatttcccccaaatagccagcatgcccaactttggatgctttgcgatcagaagattcagttcgatcgagctatgaatgacgggaaataccacctggcggactcactggtgactggcataaccgctctcaatagtatagaaggggtgtacaggaaagccgtggtgcttcaagcacagaaccaaatgtccgaggcccataaactcctgcagaagctgctggtgcactgccaaaagttaaagaacactgagatggtgatttccgtgctgttgtccgtggctgagttgtactggcgctcatcttccccaacaattgctctgcccatgctgctgcaagccctagcactgtctaaggaatacagactccaatatctggcctccgagaccgtccttaatctggcatttgcccagctgatccttggaatccctgagcaggctctgtctctcctgcacatggctatcgagcccattttggccgatggggcaattctggacaaaggcagggccatgtttctcgtggccaaatgtcaggtggctagcgctgcatcctacgatcagcccaagaaagcggaggccctggaggccgctatcgagaacctcaacgaggcaaagaattactttgccaaggtggattgtaaggagagaattcgtgacgtggtctactttcaagctcggctttatcacactctgggcaaaactcaagagaggaacagatgtgccatgctgttccgacagctgcaccaggaactgccctcacacggggtgcccctgatcaaccatttgtag

SEQ ID NO: 214355 - DNA, 660 bp, Artificial Sequence
  Description of Artificial Sequence: Synthetic coding sequence
atgctgtccccttgtctgagttcttactttgtgggattatttctgcggcatatgattctggcttattctaaactgagcttctcacaagtgtttaaactgtacacagcattacagcagtactttcaaaatggggagaaaaaaacagtggaagatgccgacatggagctgacttctagggatgaaggcgaaagaaagatggagaaggaggaattggatgtaagtgttcgtgaggaagaagttagctgctctgggccactgtcccagaaacaggctgaattttttctgagccagcaggccagtctgttgaaaaacgatgaaactaaagcactcactcccgcttccctgcaaaaagaactgaataatttgctgaagtttaatccagacttcgcggaagcgcactacttgagctacttaaataacttgcgggttcaggatgtcttctccagcacacactcgctgctgcattactttgaccggctgattctgacaggagcagaatcgaagtccaacggtgaagaagggtacggtaggtcactccggtacgcggcactcaacctggctgccctccactgccgattcggccactacacctcgccaccttgggaatattccccactctttaatagggagttactgctggggcgacggcagacgtcctag

SEQ ID NO: 214356 - DNA, 135 bp, Artificial Sequence
  Description of Artificial Sequence: Synthetic coding sequence
atggcggagggcgaactcaaagatatggaacaattttttgatgatctgtcagactcattctctggaactgagccagaggtacacaagaccagcgttgtgggcctgtttctgcggcatatgatccttgcctactag

SEQ ID NO: 214357 - DNA, 1074 bp, Artificial Sequence
  Description of Artificial Sequence: Synthetic coding sequence
atggacgccctgaaggattccgaccttctgcactggaaacactccctgagcgaactaattgacatttctattgcacaaaaaacagccatttggaggctgtatggccgatcaaccatggccctccaacaggcccagatgctcttatctatgaacagcctcgaagctgtgaacgcaggcgtccaacagaacaatacagagtccttcgccgtggcattatgtcacttagctgaactgcacgcggagcagggctgttttgccgctgcttctgaagtcctgaagcacttaaaggaacgttttcctcctaattcgcagcatgcacagctgtggatgctgtgtgatcagaaaattcagtttgacagagccatgaatgacggcaaatatcatctggctgacagcctagttacaggaataactgccctgaatagcattgagggagtttacaggaaagctgtggtactgcaagctcagaatcagatgtctgaggctcacaagctgctacagaagcttctggtccactgtcagaaattaaaaaataccgaaatggtcatttcagtattgttaagtgtggcagaactgtattggcgcagtagctctcccacaatcgcactgcctatgttgctccaagccctggctctcagtaaggagtacaggctccaatacttagcctctgagaccgtgctgaacctggcgtttgcccaacttatactgggaataccagaacaggccctgtcattgctacatatggcaatcgagcccatacttgcagacggggctatcttggataagggacgagccatgtttctcgtcgctaagtgtcaggtggccagcgctgcctcttatgatcagcccaaaaaagccgaggcactggaggcggctatcgagaatctaaacgaggccaaaaattacttcgctaaggtcgattgcaaagaaagaattagggacgtcgtgtattttcaagcccgtttataccatactctgggaaaaacacaggaacggaatcggtgtgcaatgctgtttcgccagctgcaccaggaactgcctagtcacggtgtgcctcttatcaatcacctctag

SEQ ID NO: 214358 - DNA, 2229 bp, Artificial Sequence
  Description of Artificial Sequence: Synthetic coding sequence
atggcgtcggtgcatgagtcactgtattttaacccaatgatgacaaacggggtcgtgcatgccaacgtctttggaatcaaggattgggtgaccccctacaagatcgcagtcctggtgttattgaatgagatgtccagaaccggcgaaggcgcagtgagcctgatggagcggaggcgcttgaatcagctacttctgcctctgttacagggacctgacatcaccctgagcaagctgtataagctgatcgaggaatcgtgtcctcaactcgccaattctgtgcaaattcgaatcaagctaatggccgagggagaactgaaagacatggagcagtttttcgacgacctttcagactctttctctggaacagagcctgaggtccataagacctctgtggttgggctgttcctccgtcatatgatcttggcatattccaagctctctttcagtcaggttttcaaactgtataccgcgctccagcaatactttcagaatggagagaagaagaccgtcgaggacgccgatatggagctgaccagccgtgatgagggcgagaggaaaatggagaaggaagagctggacgtgtccgtgcgggaagaagaagtgtcttgttctggtcctttatctcagaagcaggccgaattctttctaagtcaacaggcctcgttactgaagaatgatgaaacaaaggccctgacccctgcctctctccagaaagagttgaataacctgttaaagtttaaccctgacttcgctgaggcccactatctgagttatctcaataacttgagggtgcaagacgttttttcctccacgcattctctcctccactacttcgatcggctgatactgactggcgctgaatctaaatccaacggggaagagggctatgggagatccctcaggtatgcagcgctcaatcttgctgcactgcattgcagatttggtcattatcaacaggctgaactggccctgcaggaagctatccggatcgcccaggaaagcaacgatcatgtttgcctgcagcactgtttgtcttggttgtacgtgctcggacagaaaaggtccgattcatacgtcttgctagagcatagtgtcaagaaggcggtgcattttggactgccacgcgcatttgctgggaagaccgctaataaactgatggacgccctgaaggactcagatctcttacattggaagcattccttgtcagaactgattgacatcagcattgcccagaagaccgcgatatggcggctgtacgggagatccaccatggcgctacagcaggctcagatgcttctttctatgaactccctcgaggccgtgaatgccggagtccagcaaaacaatactgagagtttcgctgtggctctttgtcacctcgctgagctccacgcagaacagggatgttttgctgccgcttctgaagtcttgaagcacctaaaggagcgttttcccccaaactcacaacatgcccaattatggatgttgtgcgaccagaaaatacagttcgatcgggctatgaatgacggaaagtatcacctggcggattccctcgtgacaggaatcactgcgctgaacagtattgaaggggtatatcggaaagccgtagtgctgcaggcccagaatcagatgtccgaggcccataagctgctccagaaattgctcgtccactgtcagaaactgaagaataccgagatggttatatcggtgctcttgtcagtggccgagctctattggcggtccagctcgcctacaatcgcccttcccatgttgttgcaggcgcttgcactttccaaggagtaccgccttcaatatttggcatctgaaacagtactgaacctcgcatttgctcaactgatactgggcattcccgaacaggccctgtccctgcttcatatggccattgagcctattctcgcagatggagcgattctggataaagggagagccatgtttctagttgccaagtgtcaagttgcctctgccgcatcgtacgatcaaccaaaaaaggctgaagccctggaagctgccatcgagaacctcaatgaagccaaaaattacttcgccaaggtagattgcaaagaacggatccgggacgttgtgtactttcaagcacgcctgtaccacactctcggcaaaacacaggaacgcaacaggtgcgctatgctgtttcgtcagctgcatcaagaactgccgtctcatggtgtgcccctcatcaaccatctgtag

SEQ ID NO: 214359 - DNA, 1425 bp, Artificial Sequence
  Description of Artificial Sequence: Synthetic coding sequence
atggaactcccgtccggacctggcccagaacggctgttcgactcacataggctgcctggtgattgtttcctgttattagtgctcctgttgtacgctccagtggggttctgcctgctcgtccttcggctttttctcgggattcacgtctttctcgtaagctgtgcactgcccgatagcgtgctcaggagattcgtggttaggacgatgtgcgccgtgcttggactggtagctaggcaggaagacagcggccttagggatcatagtgtcagagtacttatctccaatcacgttactcctttcgaccataacattgtgaatctgctcactacttgttctacagtgagcgagagcgaagccgagagcgcaaccgggcgattccctggtgcccagcttaaggctcccttaagccccctcgcgttcccaatggaggacacggaactgcctctcactccaatcctgtaccctacgtgtcagttcttctttatattcctcaatatcttcctgctggctttttcatcacctggctcacagccactcctcaactctccccctagcttcgtctgctggagtagggggtttatggagatgaatgggaggggggaactcgtcgaaagtttaaaaagattctgtgccagcacccgccttcctccaactccccttctcctgtttcccgaggaagaagccactaatggcagggaggggcttctcaggttttccagctggcccttctcaatccaggacgttgtgcagcccctgacgctccaggtccagcgccctctggtcagcgtcactgtctctgacgcctcttgggtgagtgagttactctggagcctgtttgtcccattcaccgtgtaccaggtgagatggctcagaccagtgcaccgacagcttggtgaggcaaacgaggaattcgccctaagggtgcaacagctcgtcgccaaagaactcggccagaccggtacccgactgacgccggctgataaagccgagcacatgaaaaggcagaggcaccccagattacgccctcagagcgcacaatctagcttccctccaagtccgggacccagtcctgatgtgcagctggcgactctcgcccagcgcgtgaaggaagttttgccacacgtgcctcttggtgttatccaacgagacctcgccaagaccggctgcgtcgatcttaccataaccaacttgttagaaggggctgtggcattcatgcctgaagatataacaaaaggcacacagtctctgccaacagctagtgcatctaaatttccatcttctggacccgtgacgcctcaaccgacagcactgactttcgctaagagcagctgggccaggcaggaaagcctacaggaacgcaaacaggcactttatgaatacgccaggcggagatttacggagcgacgcgcacaggaagctgactag

SEQ ID NO: 214360 - DNA, 1233 bp, Artificial Sequence
  Description of Artificial Sequence: Synthetic coding sequence
atggaactgccctcagggcctgggcctgagcgtcttttcgacagccatcggctccccggagactgcttccttctgctggtcctgctactctatgctcccgtaggcttctgtctgctagtactgcggctttttctgggaatccacgtatttctcgtttcctgcgcgcttccagactccgtcctaagacgatttgtggttaggaccatgtgtgccgtgctcggcctggtggccaggcaggaggacagtggactgagagaccactcagtgagagttctaataagcaaccatgtgacacctttcgaccacaatatagtcaaccttctcacgacatgctccacacccctgctgaactcacctcccagctttgtttgctggagtaggggctttatggagatgaatggtcgaggtgaactcgtggagtctttaaagaggttttgtgcatcaacgcggctgccgcctaccccattgctactattcccagaggaggaagccaccaatggtcgggaggggctcctcagattctccagttggcccttctctattcaagatgtcgtgcaacccctcacgctccaagttcagaggccgctagtgagcgtgacagttagcgatgctagctgggtgagcgagttgctgtggtcgctgtttgtcccattcacagtataccaggtgagatggctccgccctgttcatcgccagctgggagaagcaaatgaggagtttgccttaagagttcagcagctggtggccaaagaactcggacagacaggtaccagacttacccctgccgataaagctgaacacatgaagcggcagaggcaccctagactgagaccgcaatctgcccaaagttcattcccaccatctccgggtccctcccccgatgttcaactcgccaccttagcccagcgtgtcaaagaggtcttgccgcatgtgccattaggcgtcatccagcgggacttagcaaagacaggttgcgtagacctaaccatcacaaacttactcgaaggcgctgtcgcatttatgcccgaggatataacaaaaggaacccagtcattacctacagcatcggcttcgaaattcccaagctcgggcccagtaactccgcagcctaccgccctaacgtttgctaaaagttcatgggcccgtcaagaatctctacaggagaggaaacaggctctgtacgagtatgctcgtagacgattcacggaaagacgcgcacaggaggctgactag

SEQ ID NO: 214361 - DNA, 1128 bp, Artificial Sequence
  Description of Artificial Sequence: Synthetic coding sequence
atggagctccctagtggacctggtcccgaacgtcttttcgatagccatcggcttccgggtgactgctttctgttactcgtgcttttgttatacgctccagttggcttctgcctgctggtgctgaggctgtttctcggtatacatgtgtttctcgtgtcatgcgccctgccggacagcgtcttgaggagatttcgctttgtggttcgcacaatgtgtgctgtcttggggctggtcgcaagacaggaggacagtggacttagagaccattctgtcagagtgctgatctctaaccacgtgactccattcgaccacaacatagtgaatttactgaccacttgctctaccccgctgttgaactcacctccctcatttgtgtgctggagcagagggttcatggagatgaatggcaggggcgagctggtggaatccctgaaaaggttctgcgcaagcactcggctaccacctactcccctgctgttattccccgaggaagaggccaccaacggacgggagggcctgctgcgcttctcatcatggcctttcagcattcaggatgttgtacagccgctcactctgcaggtgcaaaggccccttgttagcgtcacggtgtcagacgccagctgggtgtctgagttgctctggtctcttttcgtgccctttaccgtgtatcaagtgcgttggctgcggcctgtgcatcgccagctcggggaggctaatgaagagtttgcactgcgggtgcagcaactggtggccaaggagttggggcagactggaactcggctgacaccagcagacaaggcagagcacatgaagagacagaggcatcctcgcctgagaccccagtccgctcaatctagtttccctccgtcccctggccctagtccagacgtacagctggcaactctcgcacagagggtgaaggaggtgctcccacatgtcccattaggggtgatccagcgggatctcgcaaagacaggctgcgtggacttgaccattaccaacttacttgagggtgccgtcgcctttatgcccgaggatataacaaaagggacgcagagcctgccgacagcatccgcatccaaggccttcgacgcgtgtctgatgatgatgacaccgcaggctctttag

SEQ ID NO: 214362 - DNA, 2145 bp, Artificial Sequence
  Description of Artificial Sequence: Synthetic coding sequence
atggcttctgaagccccttcaccaccgcgatcacccccacctcccacatccccagagcctgagctggcccaattgagacggaaagtggagaagctggagagagagctccgctcgtgtaaacgccaggtccgcgagattgagaagttactgcatcacaccgagagactctaccagaacgcggagtccaataaccaggaacttcgaacacaggtcgaggagcttagtaaaattttacagcgcggaagaaacgaggataataagaagtccgatgtcgaagtgcagactgaaaatcatgcaccttggtcaattagtgattatttttaccagacttattacaatgacgtgagcctgcccaacaaggtcacagaactctccgatcagcaggaccaggccatcgaaacctccatcttgaactccaaagaccatctgcaggtggaaaatgacgcatatcctgggactgatcggaccgagaatgttaagtaccgccaggtcgatcacttcgcatctaattctcaagaaccagcctccgccctcgcgactgaggatacatcccttgaagggtccagccttgcagaatctctgagagctgcagcggaagccgcagtaagccagactggatttagctacgatgaaaacacgggactgtatttcgaccactctactggattctattatgactccgagaatcagctgtactacgatccatccacaggaatctactactactgtgacgtggagagcggcaggtatcaatttcactctagagtagacctgcagccataccctaccagctctacgaagcagagcaaagataaaaagctcaagaaaaagagaaaagacccggactcctcggccacgaacgaagagaaagatctgaattccgaagaccagaaagcctttagtgttgagcatacaagttgtaatgaagaagaaaacttcgccaatatgaaaaaaaaagccaagattggtattcaccataagaacagtcctcctaaggttaccgtgcctacaagtgggaatacaattgaatcccccctgcatgaaaatatttccaacagtacaagcttcaaagacgagaaaataatggaaaccgattcggaacctgaggagggagagatcacagacagtcagaccgaggattcttatgacgaggccataacttctgaagggaatgtcaccgccgaggatagcgaggacgaggacgaggataaaatctggccaccttgtattagagtgatcgtcatcaggagtccagtgctccagattggatccctgttcatcataactgcggtcaaccccgctacaatagggcgagaaaaagacatggaacatacacttcgcatcccggaggtaggggtctctaaattccatgccgaaatctatttcgaccacgatcttcagagctacgttctggtcgaccagggttctcagaatgggacaattgtcaatggcaagcagattttgcagcccaaaactaagtgtgatccttacgtgttggagcacggcgatgaggtcaaaatcggcgagactgttcttagttttcatattcaccccggtagtgacacttgtgacgggtgtgaacccggacaggtccgggcacaccttaggcttgataagaaggatgagtcttttgtggggccaacactaagcaaggaagagaaggaactagagcgtagaaaagagctcaagaaaatacgggtgaagtacggactacagaatactgagtatgaagatgagaaaacgctgaaaaatcctaaatacaaggatcgcgctggcaagcggcgtgagcaggtggggtctgaaggcacatttcagcgagacgatgcgcctgcatctgttcattccgaaataacggattctaataaaggccgaaagatgctggaaaagatgggttggaagaaaggggagggcttaggcaaagacgggggtggaatgaagaccccgatacagctgcagctgcgtcgcacgcacgcgggactggggaccggtaaaccgtcgagctttgaagatgtccatttgctccagaataaaaacaaaaaaaactgggataaagcaagggaacggttcacagaaaacttccctgagactaagcctcagaaggacgatccaggaactatgccatgggtgaagggcacgctggagtag

SEQ ID NO: 214363 - DNA, 531 bp, Artificial Sequence
  Description of Artificial Sequence: Synthetic coding sequence
atggcatcagaagccccatcgcctcccagatcgcctccacccccaactagtccagagccagaactggcccagctccgacgcaaagtggagaaactcgagcgcgaattgcggtcatgcaagcgacaggtgagggaaatcgagaaattactacaccataccgaaagactgtaccagaacgcggagtccaataatcaggaactccggacccaagttgaggagctatcgaagatcctgcaacggggaaggaacgaggataataaaaagtccgacgttgaagtccaaaccgagaatcacgctccctggtccatctcggattacttttatcagacttattataatgacgtctctctgccaaacaaggtaactgagctgagcgatcagcaggatcaggctattgaaacaagcattcttaacagcaaggaccacctgcaggtggagaacgatgcttaccccggaactgaccgcactgagaatgtcaaatacaggcaggtggatcacttcgcatctaactctcaggttataaaatgctag

SEQ ID NO: 214364 - DNA, 2028 bp, Artificial Sequence
  Description of Artificial Sequence: Synthetic coding sequence
atgcccagggcccagccttcatctgcttcttaccagcccgtcccagccgacccgttcgccatcgtctctcgagctcagcaaatggtcgagattctgtcagatgaaaacagaaatctccgacaagagttggagggatgttatgagaaggttgcccgtctacaaaaggtcgaaacagagatccaaagagtcagcgaggcctatgagaatctggtcaaaagctcttccaagcgcgaggcgcttgaaaaagccatgcggaataaactggaaggagagattagacgcatgcatgattttaaccgggacttacgggagcgattggaaacggcgaacaaacagttggccgagaaagagtatgaagggagcgaggatacaaggaagacaatctcccaattgtttgccaaaaacaaagagtctcagagagaaaaagaaaagctggaggccgagctcgcaaccgcacgcagtactaatgaggaccagcgccgacatatcgagatccgagaccaagcactctctaacgcccaggctaaagtcgtgaagctcgaagaagagctaaagaaaaagcaggtgtacgtggacaaagtggagaagatgcagcaggctttggtgcagttgcaagccgcttgtgagaaacgcgagcaattggagcatcggctccggacccgtctggagagggagctcgagagcttgagaatccagcaaaggcagggtaattgccaacctaccaacgtgtccgagtataacgctgctgcgctcatggaactcttaagagaaaaagaagagaggatcctggccttggaagctgacatgactaaatgggagcagaagtatttggaggagaatgtgatgcggcacttcgctctggacgccgcagcaaccgtggcagctcagagggacactactgttatttcgcattcgcctaatactagctacgatactgcattggaagctcgaatccagaaagaagaagaggaaattctgatggccaataaaagatgcctcgacatggagggaaggataaaaacccttcacgcacagatcatcgaaaaggacgcaatgattaaggttctgcagcagagaagcaggaaggagccatcaaagacagaacagctgagctgtatgcgcccagcgaaatctctaatgtctatctcgaacgccggttccggcctcctgtcgcattctagcacactgaccggctctccaatcatggaggaaaaaagagatgacaagtcatggaaagggagcctgggcatcctacttgggggtgattaccgagctgaatatgtgcccagcacaccaagccccgtaccaccgagtacacccctgttgagcgctcattccaagactgggtcacgggactgcagcacccaaacagagaggggaacagagtctaataagactgcggcagtggcgccaatcagcgttcctgcacctgttgctgctgcggcaactgccgctgcgattaccgccactgctgctaccattacgaccaccatggtcgccgcagcccctgttgccgttgccgctgctgcggctccagccgctgcggctgccccatccccagctactgcagctgctacagccgcagctgttagtccggctgcagctgggcagattcccgctgctgcctcagtcgcttccgcagccgcagttgcaccgtcggcagcggctgccgcagcagtccaggtcgcgccagcggctccagcccctgttcccgctccagccctagtgccggtcccagctcctgcggcagcacaggcctccgctcctgctcagacccaggctcccacgtctgctcctgcagtagctcctacccctgccccaaccccaactccagcagttgcacaggcggaagtgcccgcaagcccagcaacgggcccaggcccacaccggctcagtatccccagcttaacctgcaatcccgataaaacagacggtccagtcttccattcaaatactctcgagcgtaaaaccccaatacagatcctgggacaagagcctgatgccgaaatggtcgagtacctgatctag

SEQ ID NO: 214365 - DNA, 1794 bp, Artificial Sequence
  Description of Artificial Sequence: Synthetic coding sequence
atggagcatcgcggtcctccccctgagtacccatttaaaggcatgccccctcagtcagttgtctgcaagccccaggagccaggacacttctattctgagcatcggctgaaccagcctggcagaaccgaggggcagctcatgagataccagcatcctcctgaatatggcgcagcgcgaccggcacaggatatctcgctgcctctgagcgcacgtaacagccagcctcactctcccacttcttcgcttacatccggcggttctttgcctctgcttcagagccccccaagcacaaggctgtcaccagcacgtcatcccctagtgcctaatcaaggggaccatagcgcgcaccttcccaggccccagcagcactttcttcccaatcaagctcaccagggagatcactaccgtctgagccaaccagggctctcccagcagcaacagcaacagcagcagcagcatcaccatcaccaccatcatcagcagcagcagcaacaacagccacagcaacagccaggggaggcgtactcggcaatgccaagagcacagccatcatccgctagttaccagcctgtaccggcagacccatttgccatcgtgagcagagcccaacagatggtagaaattctttccgacgaaaatcggaaccttcggcaggaactggaaggatgctacgaaaaggtggcaaggctgcagaaggtggagaccgaaattcaacgagtttctgaggcgtacgagaatctcgtcaagtcaagcagcaaacgagaggctcttgagaaggcgatgaggaataaactagaaggtgagatcaggaggatgcacgattttaacagagacctgagggagcgcctggaaaccgccaataaacaactcgcggagaaagaatacgagggctccgaagatactcgaaagactatcagccagctttttgctaagaacaaagaatcccagagggaaaaggaaaaactggaggcagaattagcaacagcaaggagcaccaatgaggaccagcgcagacacattgaaattcgggatcaggcgttgagcaatgcccaggctaaggtggttaagctggaagaggagctaaaaaaaaagcaggtgtacgtggataaggtggaaaagatgcagcaggcgcttgtacaactccaggctgcctgcgaaaagcgtgagcagctggagcatagactcagaactagactggagcgggaactggaatcattgaggattcagcagaggcaaggaaattgtcagcccaccaacgtgagcgaatacaatgctgccgcattaatggagctgcttcgtgagaaagaagagaggatcctcgctctggaagccgacatgacaaaatgggaacaaaaatatttggaggagaatgtgatgaggcacttcgctctggatgctgccgctaccgtggcagctcagagagacaccaccgtcattagccactcccctaacacctcgtacgataccgccctcgaagcaagaatccagaaagaagaagaggagatcctgatggcaaacaaacgatgcctggatatggagggacggattaaaaccctccacgcccagattatagaaaaggacgctatgatcaaggtgttacagcagcggagtaggaaggaaccgtccaaaaccgagcaactctcatgtatgaggcccgctaagagcttgatgtccatctccaatgccggatcgggtcttctgtcgcactcctccaccctgacgggaagtcctattatggaggagaagcgagatgataagagttggaagggatccttaggtaacgacagtaagtag

SEQ ID NO: 214366 - DNA, 3255 bp, Artificial Sequence
  Description of Artificial Sequence: Synthetic coding sequence
atgaggaactccgaggagcagccatctggtgggactaccgtgttgcaacgcctgctgcaggaacagctgcgctacggaaacccctctgaaaatcgctccctgcttgccattcaccagcaggccacaggaaatggaccgcctttcccttctggctccgggaacccagggcctcagtctgatgttctctccccacaagaccatcatcaacagctggtagctcacgccgcacgccaggaacctcagggccaggagatacaatccgagaacttgataatggaaaagcagctgtcaccgagaatgcagaacaacgaggaattaccgacttacgaggaagcaaaggtgcaatcccaatacttcaggggacaacaacacgcatcagtcggggcagcattttatgtgacaggtgtcaccaaccagaagatgcgtactgaaggtaggccttcagttcagcgcctgaacccgggaaagatgcaccaggacgaaggtctgagggacctgaagcagggacacgtgaggtcgctttctgagcgattaatgcaaatgagcttggcaacctcaggggtcaaagcccatccccctgtcactagtgcgccactgtccccccctcaacctaacgacctctataagaaccccactagcagctctgagttctataaagcacaaggtccactgccaaatcagcactcactcaagggcatggagcataggggcccacccccagaatatcccttcaagggcatgcccccacagtccgtggtgtgcaagccacaggaacctgggcacttctacagcgaacacagactgaatcagccgggtcggaccgaaggtcagctgatgaggtatcaacatccacccgagtatggcgctgctagacccgctcaggacatctccctgcccctatccgccagaaactcacagcctcactcccctacaagcagtctgacgagcggcggtagcctccccctactgcagtcacctcccagcactagactgtcccccgcaagacacccactagtccctaatcagggggatcatagcgctcacctgccccgtccccagcagcacttcctccctaaccaggcccatcaaggcgatcattacaggctttcccagcctggcctgtctcagcagcagcagcagcaacagcaacaacatcaccaccatcaccaccaccaacagcagcagcagcagcagcctcagcagcagcctggtgaagcctatagcgcaatgccccgagcccaaccgtcttccgcctcctaccaaccggtgcccgctgatccatttgccattgtttccagagctcagcagatggtcgaaatcctgtccgacgagaaccgtaacttgaggcaggagttggagggctgttatgagaaggtggctcggctacagaaggtggagaccgaaattcagagagtgagcgaggcctacgagaatctggtcaaaagctcttccaagcgggaggcactggagaaagctatgcgaaataaactggaaggcgaaatcagaaggatgcatgacttcaatagggatctccgtgagagactcgagacagctaacaaacagcttgccgagaaagagtatgagggctctgaggatactagaaaaactattagtcagctgttcgcaaaaaataaagaatcccagagagaaaaagagaaactggaagccgaactggccactgccagatcaacgaatgaggaccagcgccgacatatcgaaattagggaccaggccttatccaacgcccaagctaaagttgttaagctggaagaggagttgaaaaagaaacaggtatatgtggataaggtcgagaagatgcaacaggccctggtacaattacaagccgcttgtgaaaaacgagagcagctggagcatcggctgagaacgagacttgaaagggagctggagagcctgcggatccaacaacgccagggcaactgtcagcccaccaatgtcagcgagtataacgctgcagctcttatggagttactgagagaaaaagaggaacggatccttgctctcgaagctgatatgactaagtgggaacagaagtaccttgaggagaacgtcatgcgccacttcgctctcgatgctgccgctactgtggccgcacagcgggataccaccgtgatttcgcattcacccaatacctcctacgacaccgcactcgaggcgagaattcagaaggaggaggaggaaattttgatggccaataaaaggtgccttgacatggaggggagaataaagacactgcacgcgcaaattattgaaaaagatgccatgattaaagtcctgcagcagagatcgcgtaaggagccgagcaagactgaacagctgtcctgcatgcggccagccaaatcactgatgtctatcagcaatgcaggctcaggacttctgtcacattcttctacattgacaggctctcctatcatggaggagaaacgggatgacaagagctggaaaggcagcttaggcattctgctgggaggggattatcgcgctgagtacgtcccctcgacaccttcacccgtgccacccagcaccccgctcctgtcagcccactccaagacagggagccgggattgttcaacccagactgaacgtgggaccgaaagcaataagacagccgcagttgccccaatatcagttccagcgccagtcgcagcagccgctacagcagccgctattacggcaactgcagccactatcactaccactatggtcgccgcagcccctgtggctgtggctgctgctgccgctcccgctgcagccgctgctcctagccccgctacggccgctgcaactgctgcagcagtgtcaccggcagccgcagggcaaattcccgcagctgcgtctgtagcgtcagctgcagccgtggccccaagcgccgcagcagccgctgcggtgcaggtcgcccctgctgcccctgccccagtgccagctccggctcttgtgcctgtgcccgcaccagccgctgcccaggcatcggcccctgcgcagacacaggcacccacaagtgcccctgcagttgcaccaactccagccccaaccccaactcccgctgtcgctcaggcggaagtccccgcatcaccggctaccggacctgggccacaccggctctccattccaagcctcacgtgtaacccagacaaaacggatggtccggtgtttcacagtaatacattggagcgtaagacgccgatccaaatcttggggcaggagcccgacgctgagatggtcgagtatcttatatag

SEQ ID NO: 214367 - DNA, 2559 bp, Artificial Sequence
  Description of Artificial Sequence: Synthetic coding sequence
atggaacaccgcggaccccctccggagtatccattcaagggcatgcccccacagagtgtggtctgcaagccacaggaaccgggacacttttactcggagcaccggttaaatcaacctggacgtacagaggggcagctgatgcgctatcagcatccaccagagtatggggcagctcggcctgcccaggacattagccttccattgtcggctcgtaacagccagccacactcccctaccagctcactgacgtccgggggaagccttccactgctccagagccccccaagcactaggctttccccagccaggcatccgttggtccccaaccagggtgaccactctgcccaccttccgaggccacagcagcacttcttgccaaaccaggcccaccaaggagatcactaccgcctctctcaaccgggtctcagtcagcagcagcaacagcagcagcaacagcaccatcaccaccatcatcatcaacagcagcagcaacagcagcctcagcagcagcctggagaagcctattcagctatgcctcgcgctcaacctagcagcgctagctatcagcctgtgccagccgatccttttgccatcgtgagtcgcgcacagcagatggtcgagatcctgtcggacgaaaaccgcaacctgcggcaggaactggagggatgttatgagaaggttgccagactgcagaaggtcgagacagagatccagcgggtctctgaggcctacgagaatctcgtgaagtcgtcaagcaaacgcgaagcactcgaaaaggctatgcggaacaaacttgagggcgaaatcaggcgaatgcacgacttcaaccgggaccttagggaacgcctcgaaaccgctaataaacagttagccgagaaagagtatgaaggctccgaagacacccgcaagaccatttctcagctgttcgccaagaataaggagtcgcaaagggagaaggaaaaattagaagcagaactggccaccgcccgttccaccaatgaagaccaacgcaggcatatcgaaattcgagaccaagctttgtccaatgcgcaagcaaaagttgttaaactagaggaggaactaaaaaagaagcaggtttacgtggataaggtggagaaaatgcagcaggccctagtgcagcttcaggcggcatgcgagaagcgcgaacagctggagcataggctgagaacaagactcgaacgggaactggaatcactgcgcattcagcaacgacagggaaattgccaaccgacaaacgtcagcgaatataatgccgctgctttgatggaacttcttcgcgaaaaagaggaacgtatcttggccctcgaggccgacatgaccaaatgggagcagaaatatctcgaagagaatgtgatgagacacttcgccctggacgcggctgcgaccgttgcagcacagcgcgatacaacggtaattagccactctcctaacacaagttacgacacggctctggaggcgcgaatccagaaagaagaagaagagatactgatggccaacaaacgttgtttggacatggagggaaggattaaaactctgcatgcccaaatcattgaaaaggatgcgatgatcaaggtccttcagcaacgttctcgaaaggaaccaagcaagacagagcaactgtcatgcatgcggcctgctaaatctctgatgagtatatccaacgccggatccggtctactttcccattcctccacattaaccggttcccctattatggaggaaaaacgggatgacaaaagctggaagggatcgctgggcattctccttggaggcgactaccgcgcagaatatgttccctcaaccccttcacccgttcccccaagcacccctctcctgtctgcacatagcaagacaggaagtagagactgctccacccaaaccgagcgcggaacagagtccaataagaccgcggcagtggcccctatcagtgtgccagcccctgtggctgcagcagcaacagccgctgcaatcaccgctacagcagccacaatcacgaccacaatggttgctgccgctcccgtggccgtcgcagctgcggctgctccagctgctgctgctgctccttccccagcaacagccgctgctaccgccgctgccgtttcaccagccgcagccggtcaaatccccgcagcagcctctgtcgcctcagccgctgccgtagccccaagtgccgctgcagccgcagctgtgcaagtcgccccagccgcacccgctcccgtccccgctcctgcactggtgccagtaccagcccctgcagctgctcaagcatctgcccctgcacagactcaggccccaacgtctgcacccgcagtggcacccacccctgctcctacccccacgcccgctgttgcacaagctgaagtgccagcttctcctgcaacaggccctgggccacacaggctgtcgatcccttccttaacttgtaaccctgacaaaacggatggacctgtattccacagcaatactctcgaaaggaaaactcccatccagatcttagggcaggagccggacgctgagatggtcgagtatctgatttag

SEQ ID NO: 214368 - DNA, 549 bp, Artificial Sequence
  Description of Artificial Sequence: Synthetic coding sequence
atgatcaaggtcctgcagcagcgctcaagaaaggaaccttccaagactgagcaactgtcctgtatgcgccctgccaagagcctaatgagcatttctaatgcagggagtgggctcctgagccacagcagcacgctaaccggctcaccaatcatggaagaaaagcgagacgacaagtcatggaaggggagcctcgggattctgctcggtggagattaccgagcggagtatgttccttccacacctagtcccgtgccaccaagcactccattgctaagtgcacatagcaaaactggctcccgcgattgtagcacccaaacagaacgtggcacggagagcaataagaccgccgctgtggcacccatctctgtccccgctccggtggccgctgccgcaactgcagcagcaattaccgccaccgccgcaaccattaccaccacaatggctgcggctgccgctccatctcctgccacagcagccgcaaccgctgctgcagtttctccagccgcagccggtcagatcccggctgcagcctctgtcgctagcgcgtag

SEQ ID NO: 214369 - DNA, 3255 bp, Artificial Sequence
  Description of Artificial Sequence: Synthetic coding sequence
atgcggaatagtgaggaacaaccctccggcggaaccactgtcttacaacgattgttacaagagcagctgcgttacgggaacccctcagagaatcggtcactgctcgctattcaccaacaggccaccggcaatggacctcccttccctagtggctccggcaacccagggccacagtccgacgtgttatccccgcaagatcaccatcaacagcttgtggctcatgctgctcggcaggagccccaaggtcaggaaattcagagcgagaatctaataatggagaagcaattgtccccacgcatgcagaacaacgaagaactcccaacctacgaggaggccaaggttcagtcccagtatttcaggggccagcaacacgcatctgttggcgcagccttctacgtaacaggagtcacgaatcaaaaaatgcgaaccgaggggaggccgtccgtccaaagattgaacccaggcaaaatgcaccaagacgagggcctcagggatctgaagcagggtcacgtccgctccctgagcgagcgactgatgcagatgtccctcgccacatccggcgtgaaggcccacccaccggttacatctgccccactttccccaccacaacccaatgatttgtataagaacccgacgtcgagtagcgaattctataaagcgcagggcccactgccaaaccaacacagtcttaagggcatggaacataggggccctcctccagagtaccccttcaagggcatgcccccacaatctgttgtctgtaagccccaagagccaggccacttctattcagagcacaggttgaatcaacccggaagaacggagggacagctgatgaggtaccagcaccccccagagtatggggcagcccgtcccgcacaagatatcagtttaccgctgtctgcgaggaattcccagccccactcaccgacatccagtctcactagcggtgggtctctgccactgctgcagagtcctccgtcaacacgtctctcccctgctcgccatccactagtgcccaaccagggggatcattccgcccatctgccaagaccacagcagcatttcctgcccaaccaggcccaccagggcgaccactatcgactgtcgcagcccggactctcccaacagcaacaacagcagcagcagcagcatcaccaccatcaccaccaccagcagcagcagcagcagcagccgcagcagcagcccggagaagcatatagcgccatgcctcgcgctcagccgtccagtgcttcataccagcctgtcccagccgatcccttcgcaattgtcagtcgggcacagcaaatggtggagatactctctgacgagaatcggaacctgaggcaggagctagagggctgctacgagaaggtggcccgtctgcagaaggtggagactgaaattcagagagtgagcgaagcatacgagaatcttgtgaaatcgtcttcaaaacgggaggcattggagaaggccatgagaaataagttggagggcgagatccgtcggatgcatgatttcaacagagatctgcgcgagcggttagaaaccgccaataagcagctagccgagaaggaatatgaagggagtgaggacacaaggaagactatctcccagctgtttgccaaaaacaaggaatctcaacgcgagaaagagaaactggaagcagagctggccacggctagaagtacgaatgaggaccagcgaagacatatcgagatacgcgaccaggctctctccaacgcacaggctaaagtggtaaaactcgaggaggagcttaaaaagaagcaggtatacgtcgacaaagtggaaaagatgcagcaagcgctcgtacagctgcaggcagcttgcgagaaacgggagcagttggaacaccgcctgcgcacccgactggagcgcgagctcgaatcacttaggattcagcagcgccagggcaactgtcagcctaccaatgtgagcgagtataacgctgctgctctgatggagctgcttcgcgagaaggaggaaagaatactagcccttgaggctgatatgaccaaatgggagcagaagtaccttgaggagaatgtaatgaggcacttcgcattggacgcagcagccacggttgcagcccaacgagacactaccgtcataagtcattcgcctaacacgtcttacgacaccgcactggaagccaggatccaaaaggaggaggaagaaatactcatggctaacaaaagatgcctcgatatggaagggcgaataaaaacgctgcacgcacagattattgagaaagacgccatgattaaagtgcttcagcagcgtagccgcaaagaaccctctaaaactgaacagctgtcatgcatgaggcccgcaaagagcttgatgagcatttccaacgctggctctggactgctgagtcactcgagcactctcacagggtcacccatcatggaagagaaacgggacgacaaatcatggaaaggctccttgggtattctcctggggggtgattaccgagccgagtacgttccatcaacccccagcccagtacccccatccactcctctgctgtcagcccatagtaagaccggcagcagagactgcagcacgcagacagagcgcggaacagagtctaacaaaacggccgcagtggcaccaatttcggtgcccgctcccgtggccgctgctgctactgcagccgcaattaccgccaccgcagcgactattactacaaccatggtggctgccgctccggttgcagtcgcagcagcagccgcacccgcagccgctgctgctccttccccagctacagccgctgcaaccgctgccgcagtctcccccgctgcagccggtcagatccctgcagccgctagcgtggcttctgcagccgcagtggccccatccgccgctgcagcagccgcagtgcaggtggcaccagcagcccctgctccagttccagcaccagccctcgtgcccgtgcctgctcccgcagccgcacaggctagcgcccctgcacagacccaagcacccacctcagccccagcggtcgctccgacacctgccccaacacccactcccgctgtagcccaggccgaagtacctgccagtcccgcaaccggaccgggaccacacagattgtcaatcccaagcctaacctgtaacccagacaagaccgacgggccagtctttcatagcaataccctggagaggaagacgcccatccagatcctgggccaggaacctgatgcagagatggttgagtatctgatatag

SEQ ID NO: 214370 - DNA, 1512 bp, Artificial Sequence
  Description of Artificial Sequence: Synthetic coding sequence
atgctgagccagcttgccatgctgcaaggatcgctcctacttgtagtggctaccatgtccgtggcccaacagaccaggcaggaggccgaccgaggatgtgaaaccctggtggtgcagcatgggcactgctcctacacttttctcctccccaaatccgagccctgtccccctggccctgaggtgagtcgcgactcaaacactttgcaaagggaatccctcgcgaatccactgcatcttggtaaactgcctacccagcaggtgaaacagctggagcaggccttacaaaataacacgcagtggctgaaaaaactagagcgagctattaaaaccatcttgaggtctaaattagaacaagtgcagcagcaaatggcacagaaccagacggctccaatgctcgagctgggcacatcgctgttaaaccagacaactgctcagattagaaagctaaccgacatggaggctcagctactcaatcaaactagcagaatggacgctcagatgcctgagacctttctgagtactaacaagctcgagaatcagctgttactgcagcgtcaaaaacttcaacagttgcagggtcagaactctgccctggaaaaacgactgcaagcacttgaaacaaagcagcaggaggaactggcgtccatcttgtctaaaaaagccaagcttctcaatacgctgagcagacaaagcgccgctcttactaacatcgaacggggactaaggggcgtgcggcataactcttcactgcttcaagaccagcagcactccctgcgccagctgttggttctgctcagacacctggttcaggagagagccaatgcatcagcgcctgccttcatcatggccggagaacaggtctttcaggactgcgccgagatacagcggtccggggcttcggcttccggtgtgtatacaattcaagtgagtaacgccacaaaaccgcgaaaggtgttctgcgatctgcaaagcagcggcggacgctggacgctgatccaacggagggaaaacggaacagtgaatttccagaggaattggaaggactataagcaagggtttggcgaccccgctggtgaacactggctgggcaacgaggtggtccaccagttgacgcgtcgtgctgcttatagcctgcgcgtggagttgcaggattgggaggggcatgaagcgtatgcacagtacgagcactttcaccttggctcggaaaaccaactgtacaggcttagcgtggttggttatagcggttcagcgggaaggcagagctccctggttcttcaaaacacaagcttttccacacttgattccgataacgaccactgcctttgcaagtgtgctcaggtaatgagtggaggttggtggtttgacgcatgcggcctgagcaacctcaacggtgtgtactatcacgcccctgataacaagtacaaaatggacggaattaggtggcactacttcaagggcccaagctatagcctgcgagcctcccgcatgatgattcgccctctcgatatttag

SEQ ID NO: 214371 - DNA, 1233 bp, Artificial Sequence
  Description of Artificial Sequence: Synthetic coding sequence
atgttgagccagctagcaatgctacagggttcacttcttctggtcgtagccacgatgagcgtggcgcagcagacacgtcaggaagctgaccggggttgtgagactcttgtggtccagcacgggcattgttcttatacctttctgctgcctaagtcggaaccctgtccgccaggcccagaggtgtcccgagatagtaatactctgcagcgggagagcctggcaaacccactgcacctagggaagctccctacacagcaggtcaagcagctggaacaggcgctgcagaacaatacccagtggttgaagaagctcgaacgcgcaatcaaaacaatcttacgctcaaagctggagcaggtgcagcagcagatggcccaaaaccagacagcaccaatgctggagctggggactagtctcctaaatcaaacaactgctcagatcaggaaacttacagacatggaagctcaattgctcaaccagacatctaggatggacgcacagatgcccgagacattcctctcgaccaacaagctcgagaaccaactgctcctgcaaagacagaagttgcagcagctgcagggtcagaacagtgcactggaaaagcggctacaggccctcgaaaccaaacagcaggaggaactcgcttcaattctgagcaagaaagccaaactgttgaataccctctctaggcagagcgcagccctgacgaacattgaaaggggactccgaggggttagacataactcatcgttgctccaggaccagcagcattcactgcgccagctgctggtattgctaagacacctggttcaggaaagggcaaatgccagcgcccctgccttcattatggcaggagagcaggttttccaggactgtgcagaaattcaaaggagcggtgctagtgcctcaggggtctacacaattcaggtttcaaacgcaactaagccaagaaaggtgttctgcgatctgcagagctctggcggtcgctggacactgattcagagaagagagaacgggaccgttaattttcagagaaattggaaggactataaacaggggtttggagaccccgcaggcgaacactggctggggaatgaggtggtccatcagttgacacgtagagcggcatattctttgcgggtggagctgcaagactgggagggccacgaggcatacgcccaatatgaacatttccacctcggttcagaaaatcagttataccgagtagtcgtttag

SEQ ID NO: 214372 - DNA, 1383 bp, Artificial Sequence
  Description of Artificial Sequence: Synthetic coding sequence
atgtttaccataaaacttcttttattcattgttcccctggtgattagcagcaggatcgatcaggacaattccagtttcgatagtctgtctcctgagcccaaatcacggtttgctatgcttgatgacgtgaaaatcctcgcaaatgggttgctacagctaggtcacggactgaaggactttgtccacaaaaccaagggacaaatcaatgacattttccaaaagctgaacatctttgatcagtccttctatgatctctccctgcagacatcagagatcaaagaagaggaaaaagagttaagacgtacgacgtataagttgcaagtaaagaacgaggaggtgaaaaatatgtcactggaactgaacagtaaactcgagtccctgcttgaagagaaaatcctactccagcagaaagtcaaatacttggaagagcagctgacaaacctcatccaaaatcaacctgagacaccagagcacccggaggtaactagcctgaaaacctttgtggaaaagcaggataacagcatcaaagacctcctgcaaactgtggaagaccagtataagcagctgaaccaacagcactcacaaattaaggaaattgaaaatcaacttagaaggacctcgattcaagaaccaacggagatctcgctctcttctaagcccagagcaccgaggacaacaccttttcttcaactcaacgagatacgaaatgtaaagcacgatggtattcccgcagaatgcacaacaatctataatcggggagagcacacgagtggaatgtacgctatcaggccttccaattcccaagtgttccacgtctactgtgatgtcattagcgggtctccatggactctgattcagcatcgcattgatggaagccagaactttaatgaaacatgggagaactacaagtacggattcgggagactggacggtgagttctggctaggccttgaaaagatctattccatcgtcaaacagagtaactacgtcctgagaatagagctcgaggattggaaagataacaaacactacatcgagtattccttctacctagggaaccatgagacaaactatactctgcacctagtcgctattaccggcaatgtccctaacgcaatccccgagaacaaggatcttgtcttctccacttgggaccacaaggcgaagggccacttcaactgcccagaaggctattcaggcggttggtggtggcacgatgagtgtggcgaaaacaatctgaatggaaagtataataaaccaagagccaaaagtaagccagaacgtcggagaggtctgagttggaaaagccagaacggccgactgtattcgattaaaagtactaagatgcttatccatccgaccgattccgagagctttgaatag

SEQ ID NO: 214373 - DNA, 1167 bp, Artificial Sequence
  Description of Artificial Sequence: Synthetic coding sequence
atgatgtcaccatctcaggccagtctcctctttcttaatgtgtgcatcttcatatgtggagaagccgtgcagggaaactgtgtccaccacagcaccgactctagcgtcgttaacatcgtggaggacggatctaatgccaaagacgaatccaagtccaatgacacagtgtgtaaggaagattgcgaggaaagttgcgacgtgaaaactaaaatcacaagagaagagaagcacttcatgtgtaggaatctccaaaactcgatcgtgtcgtataccaggtctactaagaaactgctgaggaatatgatggacgagcagcaagcttctctggattatctatccaatcaggtgaacgaactcatgaacagggtgctgttgctgactacagaggtatttcgcaaacaacttgacccctttccacaccgcccagtccaatctcacggactggactgcacggacataaaagatacgataggatcagtgacgaagacccccagtggactttacatcattcaccctgaggggtcttcctacccattcgaggtgatgtgtgatatggattacagaggcggagggagaaccgtgattcaaaagcggatcgatggcattattgactttcaaagactgtggtgtgattatttggatgggttcggggacctcttgggcgagttttggctgggtctgaaaaaaatattctatatcgtgaaccaaaagaataccagctttatgttatatgtggccttggagtcagaggatgatacattggcatatgcttcatatgacaacttctggttagaggacgaaacgcgcttctttaaaatgcacttggggagatatagcggcaacgccggagatgccttccgagggcttaagaaagaggacaaccagaacgcaatgcccttctcaacctccgatgtcgacaatgatggctgccgaccagcatgtttggtcaacggacagagcgtaaagagttgctcacacctgcacaataagaccggctggtggttcaacgaatgtgggctcgccaaccttaacggcattcaccacttctcgggcaagttgctggctacagggatccagtggggcacttggacaaaaaataacagtcccgtgaaaatcaagtccgttagtatgaagattcgtaggatgtataatccttacttcaaatag

SEQ ID NO: 214374 - DNA, 1413 bp, Artificial Sequence
  Description of Artificial Sequence: Synthetic coding sequence
atgggtaagccctggctcagagcacttcagcttctccttctattaggggcttcctgggccagggctggggcaccaagatgtacatacacttttgtgctcccaccgcagaaatttacgggcgctgtgtgctggtccggtcccgctagcactagagcgactcctgaggctgctaatgcttcggagttggcagccctgcggatgcgtgtgggcaggcatgaggaactcttgcgagagctccaaaggctggctgcagctgacggcgcagtggctggagaggtccgcgctctccggaaggaatctagagggttgtcagcgcgattgggtcagctgagagctcaattgcagcacgaagccggtcccggagcaggacctggtgccgaccttggcgctgagccagcggcagcactggcccttctcggagaaagggtgctgaatgcttcagctgaggcccagagagctgctgcgcgtttccatcagctggacgttaagttccgtgagctggcacagctggtgacgcaacagagtagcctcattgctcgcctggagcggctctgcccaggcggtgctggcggacaacagcaggtcctgccgcctccccctctggtaccagtcgtgcctgtgaggttagtcggctcaacaagtgatacaagcaggatgcttgatcccgctcctgagccacaacgggaccaaacacagcgccagcaggaacccatggcatcacccatgccagccggacaccccgctgtaccaaccaagcccgtgggcccttggcaagactgcgcagaggctcgtcaggctggacacgaacaatccggagtgtatgagctgagagtcggtcgtcatgtcgtgtcagtgtggtgtgagcagcagctggagggaggtggctggactgtcatccagaggagacaggatggcagtgttaatttctttactacttggcagcactataaggccggtttcgggaggccagatggggagtactggttaggattggagccggtgtatcagctgacatcccgtggcgaccatgagctactcgtcttgctggaagattggggcggtaggggggcaagggctcactacgacgggttttctttggagcccgaatctgatcattacagattgcggcttggccaatatcacggagacgcgggagattcgctctcatggcataacgacaagcctttctcaaccgttgatcgtgaccgcgactcttatagcgggaattgtgcgctgtatcagagaggcggatggtggtaccatgcctgtgcccactccaatctcaatggggtctggcaccacgggggacactaccgctccagatatcaggatggcgtgtattgggcagaattccgaggcggtgcttattccctgcgaaaggctgctatgctcattagacccctcaaactgtag

SEQ ID NO: 214375 - DNA, 2199 bp, Artificial Sequence
  Description of Artificial Sequence: Synthetic coding sequence
atgggccagggatgggccacagcaggactcccttctctgctgttcctactgctgtgctacggccacccgctgttggtgccaagtcaggaggcctcccagcaggtgactgtcacccacgggacctcaagccaagctaccacgtccagtcagaccacgacacaccaggcaacagcccaccaaacgagcgcccagtcgcctaacctcgtgacggacgaggccgaggctagtaagtttgtcgaggaatatgacaggacttctcaggtcgtgtggaatgagtatgcggaagctaattggaattacaatactaacatcacaaccgagacctccaagatcttgcttcagaaaaacatgcagatcgcgaatcacacgctgaagtacggcacacaggccagaaagtttgacgtgaatcagctccagaatacaacaattaagagaattatcaaaaaggtccaagatctcgaaagggcagctctgcctgcacaggaactggaggagtacaacaagatactgctggacatggaaaccacatattcggttgccaccgtttgccatcccaacgggtcttgcttacagctcgagccagatctcactaatgtgatggccacttctaggaagtacgaagatctcctttgggcttgggagggttggcgtgacaaagccggaagggccatcctgcaattttatcccaaatacgtggagctcataaatcaggcggcaagactcaacggttacgtcgacgctggtgactcttggcggtcgatgtacgaaactccgtcacttgaacaggatctggaacgcctgttccaggaactccagcccctatacctgaacctccacgcgtacgtaagaagggctttgcatcgccattacggagcccagcatatcaacctcgaaggcccaataccggctcacctgctagggaacatgtgggcccaaacttggagcaacatctacgacctggtcgtgcccttcccaagcgcccctagcatggacacgaccgaggcgatgctgaaacaggggtggaccccacggagaatgttcaaggaagcagatgatttcttcacctcgctgggcttgctccctgtcccacccgagttttggaacaagtctatgttagagaaacctaccgatggacgcgaggtcgtgtgtcatgcctcagcttgggatttttacaatggtaaggacttccggattaagcagtgcacgactgtgaatctcgaagatctggtggtggcccaccacgagatgggccacattcaatacttcatgcaatataaagacctgccagtggccctgagagagggtgccaacccgggatttcatgaggctattggagacgttttggcgctcagcgtcagcacacctaagcacctccactccctcaacctgctgagttccgagggtggatctgatgaacatgatatcaatttccttatgaaaatggccctggacaaaatcgcttttattcctttctcatacctggtggaccaatggcgatggagggtgttcgacggaagtatcactaaggagaactacaatcaggagtggtggtcccttcgactgaaatatcagggcctgtgtccgccagtcccacggactcagggagactttgacccaggagcaaagttccatattcctagttccgttccgtatattaggtatttcgtgtccttcatcatacagttccagtttcacgaagccttgtgccaggccgctggccacacgggtccgctgcacaagtgcgatatttatcagtccaaagaagctggccagaggctcgccactgctatgaagttaggctttagccgcccatggcctgaggcgatgcagctgatcacaggtcagcccaatatgtccgctagtgcaatgttaagttacttcaaacccttgctggactggctgaggaccgagaatgagctgcatggagagaaactggggtggcctcagtataactggacacccaacagtgcgcgttcggagggcccactgccagactccggccgtgtcagttttctggggttggatcttgacgcccaacaagctcgcgtcgggcagtggctgttgctttttctggggatagcattactggtggccaccctaggtttgagccagagactgttttcgattagacacaggtcactgcatagacactctcatggcccacaatttggaagcgaggtcgagctgcgacacagttag

SEQ ID NO: 214376 - DNA, 3921 bp, Artificial Sequence
  Description of Artificial Sequence: Synthetic coding sequence
atgggcgctgcatctggaaggaggggtcctgggttgctcctgccattgccgctgctcttactgctgcctccccagccagccttggcgctggacccaggcctgcagccaggtaacttcagcgcagatgaggcgggagctcagctgtttgcacagtcttacaattcatccgctgagcaggtgttgtttcagtctgtagcggcaagctgggcccatgacacaaatattactgccgagaacgccaggaggcaggaggaggccgcactcctgtcccaggaatttgcagaagcttgggggcaaaaggcaaaagagctgtacgagccgatttggcagaatttcacagaccctcagttgcgcaggattatcggtgccgtacgcactcttggaagcgccaacctgccactggcaaagagacaacagtacaatgcccttctgagtaacatgtctcgaatttacagcactgccaaagtgtgtctgccaaacaaaaccgctacatgttggtccctggaccctgatttaaccaacattttagcctccagtcgatcctatgctatgctccttttcgcgtgggagggctggcacaatgccgctggcatccctctcaagcctctgtatgaggatttcactgcgttaagcaacgaagcatacaaacaagatggctttacagacaccggggcttactggaggtcttggtacaactcacctacttttgaggatgaccttgagcatctgtaccagcagctggaacccctctacctgaacctgcatgccttcgtcaggagagctctgcacaggcgatatggggacagatacatcaacctgcggggacccatccccgcacatcttctcggtgatatgtgggctcagtcctgggagaacatttatgacatggttgttccattccctgacaaacctaaccttgacgtcacctctacaatgctccagcagggctggaacgcaacacacatgttcagggtggccgaggagttcttcacatctttggaactgtcccccatgccgcctgaattctgggagggtagcatgcttgagaaacccgctgacggtcgggaggtcgtgtgtcacgccagcgcgtgggatttttacaaccgaaaagatttccgaattaaacagtgcactcgagtgacaatggatcagctgtccactgttcatcatgagatgggtcacatccaatattatctgcagtataaagacctccccgtgagtctccgacggggtgcgaatcccggattccatgaggccattggggacgtgctggcccttagtgtgagtaccccagagcacctgcataaaattggcttactcgaccgggtgacgaacgataccgagtcagatattaactacctcctgaagatggctcttgaaaaaattgccttcctgccatttggatacctggtggatcagtggaggtggggcgttttcagcggcaggacaccacctagccgatataactttgactggtggtacctcagaacaaagtatcagggaatttgcccccctgtgacacgaaatgaaacccattttgatgcgggagcaaagttccatgttccaaacgtgactccctacatcaggtactttgtttccttcgttctgcagttccagtttcacgaagccctgtgtaaagaggctggatatgagggaccacttcaccagtgcgacatctacagaagcacgaaggctggtgccaaactgaggaaagttctacaagcagggtcgtctcggccatggcaagaagttcttaaagacatggtggggctggatgccttggacgcccagcccctgttaaagtattttcagcccgtgactcagtggctgcaggagcagaaccagcaaaacggtgaagttctcggctggccagaataccaatggcaccccccactgcctgataattaccctgaggggatagacctcgttacagatgaagcagaggcttccaagtttgtcgaagagtacgatagaacatcgcaagttgtctggaacgagtacgctgaagctaactggaactacaacaccaatattaccacagagaccagcaaaattttactgcagaagaacatgcagattgcaaaccacactttgaagtacgggactcaggcgagaaagtttgatgtgaaccaacttcaaaatacgacaataaagcgaattatcaaaaaggtacaagatttagaacgcgcagctctccctgcacaagaacttgaggagtacaataagatcctactggatatggagacgacatacagtgtggccactgtctgccatccaaatgggagctgccttcagctggaacctgacctcacaaacgtcatggctaccagtagaaagtacgaggacctgttgtgggcctgggaggggtggcgggacaaagcaggacgtgccatactgcagttttaccccaaatacgtggaactcatcaaccaggcagcacggctcaatgggtatgtagacgctggtgactcttggagatccatgtatgaaactccttccctggaacaggaccttgagagactgttccaagagctgcagccactgtacttgaacctgcacgcctatgtacggagagccctccatcgccactatggtgcacagcatattaacctggaggggcctataccggcacatttgctaggcaacatgtgggctcagacatggagcaacatctacgatctggtggtgcctttcccttccgcgcctagtatggataccaccgaggcaatgttaaagcagggatggacccctaggagaatgttcaaagaggctgatgactttttcactagccttggccttcttcccgtgcccccagagttctggaataaatctatgctggaaaaacctactgatggaagggaggtggtgtgccacgcctccgcttgggatttttataatgggaaggacttccgcatcaaacagtgcactacagtaaaccttgaagacctggtcgtcgcccaccacgaaatgggacatattcagtattttatgcagtacaaagatctgcccgtggctctacgtgaaggagctaacccgggatttcatgaagcgatcggtgatgtgctggccctctccgtgagcaccccgaagcatttgcactctctgaacctgctgtcttcggagggtgggtcagatgaacatgacataaacttcctgatgaagatggccctcgacaagatcgccttcataccatttagctacctcgtggatcagtggagatggcgagttttcgacggatccattacaaaagaaaattacaaccaggagtggtggtccttaagactaaaatatcagggcctatgcccccctgtcccacggacccagggggacttcgacccaggagccaagttccacatccccagctcggttccttacattagatattttgtgtcctttattattcagttccagttccatgaagccctttgtcaggccgctggccacactggacctctgcacaagtgtgacatctatcagagcaaggaagccggacagcggctagctacggccatgaagttagggttctcaagaccctggcccgaggctatgcagctgataacaggacagccaaatatgagcgcaagcgcaatgctgagctactttaaaccgctgttggactggctgcgtaccgaaaacgaattgcatggtgagaaactgggatggccccaatataactggactcctaactctgctcggtcagagggacccttgccggatagcgggagggtgtcgttcctgggcctggacctcgatgcacaacaggcaagagtgggacagtggttactcctcttcctgggaatcgctctgctggtggctacccttggcctgtcccagcggctgttttctataaggcaccgctctttgcacaggcatagtcatggaccccagtttggctctgaggtggagcttaggcactcttag

SEQ ID NO: 214377 - DNA, 2076 bp, Artificial Sequence
  Description of Artificial Sequence: Synthetic coding sequence
atggggcagggctgggctacagctggacttcccagcctgctgttcctgctgctctgctacggacatcccttgctcgtgcctagtcaggaagcttcacagcaagtgactgtgacccacggtacgtcaagccaagctactacttctagccaaacaaccactcaccaggccacagcccaccaaacaagtgcgcagtctcctaacctggtcactgacgaggctgaggctagtaagttcgtcgaagagtatgatagaacctcacaggtggtgtggaatgaatatgccgaagcaaactggaactacaataccaatattaccacggagaccagtaagatcctacttcagaaaaacatgcagatcgccaaccatactctcaagtacggcacacaagcccgaaagtttgacgtgaatcagctccagaacacaacgatcaagagaatcatcaagaaagtacaggacctggaaagggcagcactccccgctcaagaacttgaggaatataacaagatcttgcttgatatggagacaacctatagtgtcgctaccgtgtgccatccaaatggaagctgtctacagctagagccagatctgactaacgtgatggccacctcacgcaagtacgaagacctcctctgggcctgggaaggctggcgcgacaaggctgggagggcaatactccagttctaccccaagtacgttgagctcatcaatcaggcagctcgactgaatggatatgtggacgctggagatagctggcgttccatgtacgagaccccatctctcgagcaggatctcgaacgcctctttcaagaactgcaacccctgtatctcaatctgcatgcctacgttcgcagggccttacaccgccactacggtgcccagcatattaacttggagggtccaatcccggctcatcttctagggaatatgtgggcccaaacttggtccaacatctacgacctggtggtgccttttcccagcgccccatctatggatactacggaagcaatgctgaagcagggatggactcccaggaggatgttcaaggaggccgatgatttcttcactagtctgggactcctgccagtcccaccagaattttggaacaaatccatgctagagaagcctaccgacggaagagaagtggtctgccatgcatccgcctgggatttttataacggcaaagacttcaggattaaacagtgcaccactgtcaatctggaggatctggtcgtggctcaccatgaaatgggtcacatacagtactttatgcaatataaagatctgcccgtcgccttgcgcgaaggggctaatcccggtttccacgaggccattggcgacgtgctggctctgagtgtaagcacaccaaagcacctccattcactgaatctactgagcagcgagggaggaagcgacgaacacgacattaactttctgatgaagatggctttggataagatagcttttattcccttctcctacctagtggaccaatggaggtggcgcgtattcgatggcagtattaccaaagagaattacaaccaggaatggtggagcctgcgactaaaatatcagggactctgtccccctgtgcctaggacccaaggggatttcgaccccggagctaagtttcacattccgagtagcgttccatatattaggaccgcgatgaagcttgggttctcacgtccctggccagaggcaatgcagctgattaccgggcaacccaatatgagcgctagtgcaatgcttagttacttcaaacccctgctagactggctgagaacagaaaacgagcttcatggggagaaactcgggtggcctcagtacaattggactcccaatagcgctagatccgaggggccactgccagattcaggacgagtctctttccttggcttggacctcgatgctcagcaggccagggtggggcagtggctgttgttatttctgggtatagccctgctcgtagccactttgggactctcccagcgactatttagtatccggcaccgcagtcttcataggcacagccacggaccacagttcggcagcgaggtggagctcaggcactcatag

SEQ ID NO: 214378 - DNA, 1536 bp, Artificial Sequence
  Description of Artificial Sequence: Synthetic coding sequence
atgcagattgcgaaccacacgctgaagtacggtacacaggccaggaagtttgatgtgaatcagctccagaatacaaccattaagagaatcatcaaaaaggtccaggatctggagagagccgctctgcccgctcaggaacttgaggagtacaacaaaatactgctggatatggaaaccacgtattcagtggccaccgtttgccaccctaacggtagctgtctgcagctcgagcctgacctgactaacgttatggccacaagcagaaaatacgaagaccttctctgggcttgggaaggctggcgggacaaggcgggtcgtgcgatcctccagttttatccaaaatatgtcgagctgatcaaccaggcggcacgactgaacggaaatatgtgggctcaaacttggagcaacatttacgatctcgtggttccgttccccagcgctcccagtatggataccaccgaggctatgctcaaacaaggctggactcctcggagaatgtttaaagaggccgatgattttttcaccagtctcgggctcctcccagtaccgccagagttttggaacaaaagtatgctggaaaagccaaccgacgggagagaagttgtgtgccatgcttccgcatgggacttctacaatggcaaagatttcagaataaaacagtgtacaactgtcaacctggaggaccttgtagttgcacaccatgaaatgggacacatacagtacttcatgcaatataaggaccttccagtggccctgcgcgagggcgctaacccaggattccatgaggctatcggcgatgtcctcgcccttagtgtctccaccccaaagcaccttcattctcttaacctactctcaagcgaggggggtagtgacgagcatgatataaactttctgatgaaaatggcattggataagatagcttttattccatttagttacctggtggaccagtggcggtggagggtctttgacggcagtatcaccaaagaaaactataaccaggaatggtggagtttacgtcttaagtatcagggactctgccctcccgtccccaggactcaaggtgacttcgatcctggtgccaaatttcatattccatccagcgtaccatatatccgcactgccatgaagctcggcttctcccgcccttggccggaggccatgcagcttatcacgggccagcccaacatgtcggcgagtgcaatgctgagctactttaagccccttctggactggctccgcactgagaatgaactgcacggcgagaagctaggatggccccaatataattggaccccaaattctgccaggagcgaggggccacttcctgattctgggcgagtatccttcttgggcctagatctcgatgctcagcaggctcgcgttggtcaatggctgctcctattcctgggtatcgctctgctagtggcgactctcggcctgagccagagactgttcagtattagacacagatccctccaccgccactcccatggccctcagttcgggtccgaggtggagctgcgccacagttag

SEQ ID NO: 214379 - DNA, 3438 bp, Artificial Sequence
  Description of Artificial Sequence: Synthetic coding sequence
atgggcgctgcctccggcagacggggacccggactgttgttaccactgcctctgctcctgctcctgccacctcagcctgcccttgccctggatcccggattgcagcccggaaatttcagcgccgatgaggccggagcgcagctgttcgcccagtcgtacaattccagcgccgagcaggtactatttcagtcagtagctgcctcatgggcacacgataccaacatcaccgcggaaaatgctaggcgccaggaggaggccgctctactttcccaggagttcgccgaggcgtggggacagaaagcaaaggaactgtacgaaccaatatggcaaaacttcaccgacccgcaactgagaagaatcatcggcgcagttaggaccctgggaagtgctaacttacctttagcgaagcggcagcagtataacgccctcctgtccaatatgtcaagaatatacagcaccgccaaagtgtgccttcccaacaagacagcaacctgctggagtttagacccggatctgacaaatatccttgcttcatcccgatcctacgcgatgttactcttcgcttgggagggatggcataatgctgccggaattcccctgaaacctctctacgaggacttcactgccctaagcaatgaagcatataaacaggatggcttcactgataccggcgcttactggaggagctggtacaattcccctaccttcgaggacgatctcgagcatttgtatcagcaattggagcctctttacttaaatctgcatgcttttgtgcggagagccctacacagaagatacggggatcggtatatcaacctgaggggaccgatcccagcccacctcctgggcgatatgtgggcccaatcctgggaaaacatttatgacatggtggtgccttttcccgacaaacctaatctcgacgtcaccagcacaatgctgcagcagggatggaatgcgactcatatgttccgggtggctgaagagttctttacaagtctcgagctcagccctatgccccctgagttctgggaggggtccatgttggaaaagcccgctgacggaagagaggtcgtgtgtcatgcatcggcatgggacttctacaacagaaaagacttccggatcaagcagtgcacaagggtaaccatggaccagttgtcaacggtacaccatgaaatggggcacatccagtactatcttcagtacaaagatttaccggtgagtttgcgcaggggggcaaatcccggatttcacgaagccattggggatgtgcttgcgctatcagtttccacccctgaacacctgcataaaatcggactgctggatagggttaccaacgacacggagtcagacattaattatttgctcaaaatggcattggagaagatagcctttctacccttcggatacctggtggaccaatggcgctggggcgtattttccggccgtacgcccccatctcggtacaacttcgattggtggtacttgcgtactaagtaccagggcatctgccccccagtgacacggaatgagacccacttcgatgcaggagctaagttccacgtcccaaatgttacaccatatattcggtacttcgtatccttcgttctacagttccagttccacgaagcgctgtgcaaggaggctggctacgagggaccacttcatcaatgcgatatatatcgaagtacaaaagccggagccaagcttcgcaaagtcctgcaggccggaagcagtcggccttggcaagaagttctcaaagatatggtgggcctcgatgcactcgacgcccagccattattaaagtacttccagcctgttacccaatggttgcaggagcagaaccagcagaatggggaggttttggggtggcctgagtatcagtggcatcctcctctaccggacaattaccccgagggcattgaccttgtgaccgatgaagccgaggcctcaaagttcgtggaagagtacgaccgaacctcccaggtggtttggaacgagtatgccgaagcgaattggaattacaacactaatattaccacagaaacatccaagatacttctccagaagaatatgcagatcgccaatcacactctgaagtatggcacacaggcccgaaagtttgacgtgaatcaactccaaaacacgacaattaagaggatcatcaagaaggtccaagatctcgaacgggcagccttgcctgctcaagaacttgaggaatacaacaaaattctgcttgatatggaaaccacctatagcgttgccacagtatgccacccaaatggtagttgcctacaactggagccagacttgaccaatgtaatggctactagtagaaaatatgaagacctcctgtgggcttgggaaggctggagggacaaggccggaagggctatcctgcagttctaccctaaatacgttgaattaatcaaccaggccgctcgcttgaatgggtatgtggacgccggagattcctggcggtcaatgtatgaaacaccttctctggaacaggacctcgagcgtctctttcaggagctgcaacccctgtatctgaacttacacgcctacgtgaggcgcgctctgcacagacactacggcgctcagcatattaacttagaaggccctattcctgcccatttgctcggtaacatgtgggctcagacctggagcaatatctacgatttagtcgtgcccttcccttcagcaccatctatggacaccacggaggcaatgctcaagcaaggctggaccccacgcaggatgtttaaggaagctgacgacttctttacgtcacttggactgctgcctgtgcctccagaattctggaacaagtcaatgctggaaaaacccacagatgggcgtgaggtcgtgtgtcacgcctccgcttgggacttttacaacggaaaagacttcaggatcaaacagtgcacaaccgtgaatcttgaggacttggtcgtggcacaccacgaaatgggacacattcagtacttcatgcagtataaggatcttccagttgccctccgagagggcgcaaatccagggtttcatgaggctattggggacgttctcgctctctctgtgtctacacccaagcacctccactctctgaatctgttgtcctcagaggggggttccgatgagcatgacattaattttctcatgaagatggcactggacaagattgcctttatcccattctcctacctggttgaccagtggcgatggagggttttcgacgggagcattaccaaagaaaactacaatcaggagtggtggagcttgcgcttaaagtatcagggtctatgcccccctgtcccgaggactcaaggcgactttgaccctggggcaaagttccatattccctcatccgtaccttacatcagatactttgtgtctttcatcatccagttccatcccttctcccagcacacggctgcatag

SEQ ID NO: 214380 - DNA, 1428 bp, Artificial Sequence
  Description of Artificial Sequence: Synthetic coding sequence
atgggggctgcttctgggaggcggggtccgggtttattactcccgctgcctctgcttttgttactccctccacagccagcactcgctctggatccaggcctgcaacccggtaacttctcagcagatgaggctggtgcacagctgtttgcacagagctacaattcttccgctgagcaggtgctgttccaatccgtggcagcttcctgggcgcacgataccaacataactgctgaaaatgctcggcgacaagaggaagccgcacttctcagccaggaatttgctgaagcatgggggcaaaaggccaaggaactatacgagcctatttggcagaacttcactgacccacagttacgaaggattattggagcagtccggaccctgggcagcgccaacctgcctcttgcaaaacgccaacagtataatgccctcctgtctaatatgtctcggatttactccactgccaaggtatgtctgcctaataaaacagcgacctgttggtccctggacccagatctaaccaacatactggcttcttctaggtcatatgcaatgctgttgtttgcttgggaaggttggcacaatgctgccggaattccactcaagccgctgtacgaggatttcacggccttgagcaatgaggcctataagcaggatggattcacagacacaggcgcttattggagatcctggtacaactcccctactttcgaggacgatctcgaacacctctaccagcagttagaaccgctgtacttaaacttgcatgcattcgtccggcgagcgttgcacaggaggtacggcgaccgctacatcaacctgcgtggcccaattccagcccatctgcttggcgacatgtgggcccagtcatgggagaatatttatgacatggtggtccccttccctgacaaaccaaacctcgatgtgacatcaactatgctgcagcagggctggaacgctactcatatgtttcgcgtggcagaggaattctttacgtcattagaactgagccccatgcctcccgaattctgggaaggatctatgctggaaaagcccgctgatggaagggaagttgtctgtcacgctagtgcctgggacttctataatagaaaggatttccgtataaaacagtgcacaagagtcacaatggatcagctgtcaacggtgcatcatgaaatgggtcatatccagtattatctgcaatacaaagatcttcctgtgagcttacgcagaggtgccaacccgggattccatgaggccatcggcgatgtgctggccctaagcgtaagtacacccgaacacctgcacaagatcggattactggatcgcgtcacgaatgacaccgagccatcgatccgcggttccgtgctgcttctgcccgagacaaaacctacacttatgcttgagttatcattcatgttccagatgtag

SEQ ID NO: 214381 - DNA, 1080 bp, Artificial Sequence
  Description of Artificial Sequence: Synthetic coding sequence
atgattttgaattcttccacggaggatgggattaagcggattcaggatgactgcccaaaagcgggaaggcacaactacatattcgtgatgatccccacgctttactctattatcttcgttgtgggcattttcggcaactcgctggtggtgattgtaatctacttttacatgaagcttaagactgtcgcttctgtatttctgctgaacctggcactcgcagacttgtgttttcttcttacccttccgctgtgggccgtgtacaccgccatggagtacaggtggccttttggcaattacctctgtaagattgcttctgccagcgtctcatttaatctttacgccagtgtgtttcttctgacatgcttgagtattgaccgttacctggccatcgttcatccaatgaagtcaaggcttagacgcaccatgttggtggcaaaagtgacttgcataattatttggcttctggcaggcttagcgtcacttcccgcaattatccaccgcaacgtttttttcatagagaatacaaacattacggtatgtgcattccattatgagtcccagaacagcactctgccaatcgggctgggacttaccaagaatatcttgggcttcctgttcccatttttgatcattctgacatcgtacacattaatttggaaagcactaaaaaaagcatatgagatacagaagaacaaaccgcgaaatgatgacattttcaaaatcataatggcaatcgtgttattcttcttcttctcttggattccgcaccagatcttcaccttcttggatgtccttatccaattaggcatcatacgggactgtcggattgcagatatcgttgataccgccatgccgattacgatttgcatagcttactttaataactgtcttaacccccttttctacggattcttgggcaaaaagtttaaaagatactttctccagctcttgaagtatattccaccaaaggcaaaaagccatagtaacttaagtacaaagatgagcactctctcctacaggccgtctgacaacgtctcttcatcgactaaaaaaccagcaccctgcttcgaagtcgagtag

SEQ ID NO: 214382 - DNA, 1080 bp, Artificial Sequence
  Description of Artificial Sequence: Synthetic coding sequence
atgattctgaactcgtcaacagaggacggcattaaaagaatccaggacgattgcccaaaagcagggagacataactatatctttgtgatgattcccaccctctattccatcatcttcgtggttgggattttcggaaatagcttagttgtgattgttatttatttctacatgaagctgaaaacggttgcatcggtgtttctactcaacttagccctggccgacttatgtttccttctcacccttcccctctgggcggtctacaccgcaatggaatacagatggccatttggcaactacctctgcaagattgcctcagcttccgtctcatttaacttatacgcttccgtgtttcttctgacatgtctcagtatcgatcgctacttggcaatcgtgcacccgatgaagtcccggctaaggcgcactatgcttgtggccaaagttacttgtattatcatctggctactggccggactggcgagtctgcccgctattatccaccgcaacgtgttcttcatcgagaacaccaacataaccgtgtgtgcctttcattatgaaagtcagaatagtaccctccccattggcctgggtctcaccaagaatatcttggggtttctgttccctttcctgatcatactgacatcctacacattgatctggaaggccttaaagaaagcatacgagattcagaagaataagcctaggaacgatgatatatttaagatcatcatggcgatagtgctcttcttcttcttcagttggattcctcatcagattttcacattcttggacgtgttgattcagttgggtatcatccgagactgcagaatcgcggacatcgtggatacagccatgccgatcacaatctgcatcgcttactttaataactgtcttaatccattattttatggctttttgggaaagaaattcaagagatatttcttgcagcttctgaagtatatcccccctaaggctaagtcacattcaaatctgagtacgaaaatgtccaccttaagttatcgtccatccgacaacgtctcatccagcaccaagaaacccgctccatgttttgaggtcgagtag

SEQ ID NO: 214383 - DNA, 1080 bp, Artificial Sequence
  Description of Artificial Sequence: Synthetic coding sequence
atgatcctcaattcatcgacagaagatgggattaagaggattcaggatgattgcccaaaggcagggaggcacaactatatttttgttatgatccccacgctgtacagcatcattttcgtggtcggcatcttcggaaattctctggtggtcatagtgatctacttctacatgaagctgaagaccgtagcctcagtgttcctgctgaatcttgcactggctgacctgtgctttcttttaactctgccgttgtgggctgtctacactgctatggagtaccgctggccattcgggaactacttgtgcaaaattgcaagcgcgagtgtgtccttcaacctttatgcctccgtgttcctcctgacctgtctgagtatcgatcggtacctcgcgattgtgcatcccatgaagtcacgcctgcgaaggacgatgctggtggcgaaagtgacatgtattattatctggttgcttgctgggctggcatcactccccgctatcatccacagaaatgtcttctttatcgagaatactaacatcaccgtgtgtgctttccactacgaaagccagaatagcacccttccaattggactcggactcaccaagaacatactcggttttctgtttccgtttctcataatccttacttcttataccctgatttggaaagcattgaaaaaagcctacgaaatccagaagaacaaacccagaaacgacgatatcttcaagatcatcatggccatagtccttttttttttctttagttggatcccacatcagatctttacttttctcgacgtgttaatccagcttgggatcattagggactgtagaattgcggatatcgtagatacggctatgccaatcactatctgtatcgcctattttaacaactgcctcaatcccctgttctacggatttctgggcaaaaagttcaaaaggtacttcctgcaactgctgaaatacatcccccctaaggccaaatcacactcgaatctgagtacaaagatgtcaaccttaagctatcggccatccgataacgtctcctcgagtaccaaaaagcctgctccatgcttcgaggtggagtag

SEQ ID NO: 214384 - DNA, 1080 bp, Artificial Sequence
  Description of Artificial Sequence: Synthetic coding sequence
atgattctcaatagctctactgaagatggaattaaaaggattcaggacgattgccccaaggctggaaggcacaactatatctttgtcatgatccccacattgtattcaattatttttgtggtaggaattttcggaaacagcctggtggttatagtgatttatttctatatgaaactcaaaaccgtggccagcgtgttccttctcaacctggcacttgcagatctatgctttctattaactttgcctctctgggctgtctacactgccatggaatacagatggccttttggtaattatctgtgcaagattgcctccgccagcgtcagctttaacctatatgcatctgtgtttttgctgacttgtctgagcattgatcgctatttagccattgtccaccccatgaaatctcgcctgaggaggacgatgctggtggccaaggtgacatgtatcatcatctggctcctggccggtctcgccagcctcccagcgatcattcaccgcaacgtatttttcatcgagaatactaatattactgtgtgcgcatttcattacgaaagtcagaattctacactgccgatcgggctcggcctaacgaaaaatattctgggttttctttttcccttcttaatcattttgacaagctacaccctgatttggaaagccctaaaaaaagcttacgaaatccagaagaacaaacccagaaatgatgacatttttaaaatcattatggcgatagtgctgttcttcttcttcagctggatcccccaccagatttttacatttctagatgtccttatacagctcgggatcatccgcgactgccgtatcgccgatattgtagacaccgcgatgccaattaccatctgtattgcttactttaacaattgcctgaaccccttgttctatggtttcttagggaagaagttcaagagatattttctccagctcctaaagtacatcccaccaaaagctaagtctcattctaatctgtcgactaagatgagcacactctcctatcgcccatctgacaatgtctcaagtagtactaagaaacctgcaccttgcttcgaggtggagtag

SEQ ID NO: 214385 - DNA, 1080 bp, Artificial Sequence
  Description of Artificial Sequence: Synthetic coding sequence
atgattttaaacagctccaccgaggacgggatcaagaggatacaagatgattgtcccaaggccggacggcacaactatatttttgttatgatacccaccttatactctattatcttcgtcgtaggtatcttcgggaatagcttagtcgtgatcgttatctacttctatatgaaattgaaaaccgtggcatccgtttttctcctgaacttagcacttgcagacctatgtttcctgctgaccttaccactgtgggctgtgtacaccgcgatggagtaccgatggccctttggaaactatctatgtaagattgctagcgccagtgtgtctttcaacttatacgccagcgtctttctgttaacctgtttgtccatagaccggtatttggccattgtgcatccaatgaagtcaaggctacgacggaccatgctggtggccaaagtgacttgtatcataatctggttgcttgcaggccttgcttccttgcctgccataatccacagaaacgtgttctttatagaaaatacaaatatcaccgtgtgtgcatttcactatgaatcacagaatagtacgctcccgatagggctaggccttacgaaaaatatcctgggctttctgttcccctttttaattatcctgactagttacaccctgatctggaaggccttgaaaaaggcttacgagatccagaaaaataaaccaagaaatgatgacattttcaagatcattatggccatcgtcctctttttttttttctcctggatccctcaccagatcttcacatttctcgacgttttgatccaactcgggattatccgagattgcaggatcgctgacatcgtggacacggccatgcccattacaatctgcatcgcttatttcaataactgtctcaaccctctgttctacggattcttgggcaagaaatttaagaggtacttcctccagctgctaaaatatattcccccaaaggctaaatcccacagcaatttatctaccaaaatgtcaaccctgagttacaggccttccgataacgtatcttcatccactaaaaaaccagcaccttgtttcgaggtagaatag

SEQ ID NO: 214386 - DNA, 1080 bp, Artificial Sequence
  Description of Artificial Sequence: Synthetic coding sequence
atgatcctgaactcttcaaccgaagacggtatcaaaaggatacaggatgactgcccaaaggcaggacggcacaactatatcttcgtgatgataccaactctttattcaatcatctttgttgtggggattttcggtaacagcctagtcgtaatcgttatctacttttacatgaaacttaaaacagtcgcatctgtcttcctgcttaaccttgcgctcgccgacctgtgtttcctgctcactctgccgctctgggccgtatatacggctatggagtatcgctggccgttcggcaactatctgtgtaagatcgctagcgcaagtgtgtctttcaatctttatgcctctgtgtttctgttgacctgtctatctattgatcggtatctcgcaattgtgcatcctatgaaaagccgtctccgtcgcacaatgctggtggctaaagtgacctgtatcattatatggctcctcgcaggactggcttcactcccggctatcatccatcgaaacgttttctttattgagaataccaacatcacagtttgtgctttccattatgagtctcagaactctacgctgccgatcgggctcggtttgacaaagaacatccttggattcctttttcccttcttaatcattctgaccagctacaccctcatttggaaagccttgaaaaaggcttatgaaatccagaaaaataaaccaaggaacgacgatattttcaaaattatcatggccattgtgctgtttttctttttctcttggatcccacatcaaatctttacgtttctggatgtgttgatccagttggggatcattcgcgattgtagaatcgcagacattgtggataccgctatgccaattactatttgcatcgcttactttaataattgcctgaatcctctcttttacggctttctgggaaaaaaattcaaaaggtactttcttcagctgcttaaatacataccgccaaaggcaaagtctcattcaaacctttcaaccaaaatgagcactctttcttacaggccttctgacaacgtgagcagttcgactaagaaacccgctccgtgtttcgaggtggagtag

SEQ ID NO: 214387 - DNA, 1080 bp, Artificial Sequence
  Description of Artificial Sequence: Synthetic coding sequence
atgatcctgaactccagcacagaggacgggatcaaaagaatccaggacgactgtccaaaggctggccgacacaactatatatttgtcatgatcccaactctgtactctataattttcgtcgtcggcatctttggcaactctcttgtcgtgattgtcatctacttctacatgaaattaaagacagtcgccagtgtgttcctgctaaatctggccctggccgatctgtgcttcctgctcaccttaccactctgggctgtctacacagcaatggaatacaggtggcctttcggaaattacctgtgcaaaattgcatctgccagcgtttcgttcaacctatacgcttcggtgtttctgcttacgtgcctctccatcgataggtacctggctatcgtccaccccatgaagtcccgattgcgacggacaatgttggtggctaaagtaacttgtataatcatttggctgctcgcgggactggcctcactgccagctattattcacaggaatgtcttctttatcgaaaatactaatatcaccgtctgcgcatttcactatgagtcgcagaattctacactccctataggcctggggctgacaaagaacattctgggctttcttttccccttccttattatcctcacttcttacaccctgatttggaaggccttgaagaaggcctacgagattcagaaaaacaagcccaggaatgacgacatcttcaaaatcatcatggccattgtgctgttcttctttttcagctggattccccaccaaatatttacatttctggatgtactgatacagcttggcatcatccgcgactgtaggatcgctgacatcgtggataccgctatgcccattacaatttgcatagcttacttcaacaactgcctcaaccccctcttttatgggttcttgggaaagaagttcaagcgttatttcctgcagctcctgaaatatatccctcccaaagcaaaatcccattccaacttatcaactaagatgtctacactgtcatatcggccaagcgataacgtctcatcttctacaaagaaaccggcaccttgtttcgaagtggagtag

SEQ ID NO: 214388 - DNA, 1080 bp, Artificial Sequence
  Description of Artificial Sequence: Synthetic coding sequence
atgattcttaacagttcaactgaggacggtatcaaacggatccaggacgactgccccaaagccggaaggcacaactatatcttcgtgatgatacccacactatactccatcatcttcgttgtgggaatattcggaaatagcctcgtcgttatagtgatatatttttatatgaaactgaagaccgtggctagcgtgtttcttctcaatcttgccttggccgacctctgctttttactcaccctgccgctgtgggccgtctacaccgctatggagtataggtggccatttggcaattatttgtgtaaaatcgccagtgcctcagtttcctttaacctgtatgccagtgtattcctattgacctgtttatccatcgatagatacctggcaatcgtgcatccaatgaaaagtcgcctgaggaggaccatgttggtggctaaggtcacatgcataatcatctggctgctcgcagggctggcctccttaccggctattatacacaggaacgtcttcttcatcgagaacacaaacattaccgtgtgtgccttccattacgagagtcagaactccacgctccctatcggcttaggcctgacgaaaaacattctgggattcctcttcccatttctcatcattcttaccagttatacgcttatctggaaggcactgaaaaaggcttacgaaatccagaaaaataagccgagaaacgatgacatcttcaaaatcattatggcgattgtgctattcttttttttctcctggatcccccaccagatatttacgttcctggacgttcttatccaactaggaataatccgtgattgtaggatcgctgacattgttgataccgccatgccaattacaatctgtatcgcctattttaacaactgcctcaacccccttttttacggctttctgggcaaaaaatttaagagatactttttgcagctgcttaagtacattcctcccaaggcgaaatctcattccaatttatctacaaagatgtctaccctctcttacagaccatcggataacgtcagctcttccaccaaaaaaccggcaccttgtttcgaggtcgaatag

SEQ ID NO: 214389 - DNA, 1080 bp, Artificial Sequence
  Description of Artificial Sequence: Synthetic coding sequence
atgattttgaatagttctacggaagacggtattaaaaggattcaggacgactgtcctaaagctggtagacacaactatatcttcgttatgatccctacactttacagcattatctttgtcgtcggaatttttgggaattccctcgtggtcatcgtcatctatttttacatgaaactgaagacagtcgcatccgtgttcctgctgaatttggcgcttgccgatctgtgttttttgttaacactgcccctttgggcggtgtataccgctatggaatacagatggccattcggtaactacttgtgtaaaattgccagcgcttctgtcagttttaatctctatgcttccgtttttctcttgacgtgcctctccatcgatagatatttggctatcgtgcatcccatgaagtcaagacttcgcaggactatgctggtcgccaaggttacatgcatcatcatttggctcctagccggtctcgccagtctgccagcaatcatacacagaaacgtgttcttcattgaaaataccaacataaccgtgtgtgcctttcattacgagagccagaactccaccttaccaattggacttggcctaaccaagaacattctcgggtttctgtttcctttcctcataattctcaccagttacacactgatctggaaagcactcaagaaggcatacgagatacagaagaacaagcctaggaacgacgacattttcaagattatcatggctatcgtgctgttttttttctttagctggatcccacaccagatcttcactttcctggacgttcttatccagctgggcattatcagggattgtagaatcgcagatattgtggataccgctatgccgatcacaatctgtattgcctacttcaacaattgtctgaaccccctcttctacggatttctgggcaaaaaattcaagcgatatttcctgcagctgttgaagtatatcccaccaaaggctaaatcccatagcaatctcagcaccaaaatgtctacactgagctaccggcctagcgataacgtctcttctagtacgaaaaagcccgcaccgtgtttcgaagtggaatag

SEQ ID NO: 214390 - DNA, 1092 bp, Artificial Sequence
  Description of Artificial Sequence: Synthetic coding sequence
atgaagggaaactccacactcgctactacatccaagaatataacaagcggcctgcattttgggctagtgaacatcagcgggaataatgaaagtaccctgaactgttctcagaaaccgtctgacaagcacctagatgctatccctattctgtactacatcatcttcgtcatcggctttctggtgaacattgtggtggtcacattgttttgttgccagaaaggccctaagaaagtgagttccatatacatctttaacctcgctgtggctgatttactcctgcttgcaacactccccctctgggccacctactactcgtatagatatgattggttatttgggcctgtgatgtgtaaagttttcggctcattcttaacactgaatatgttcgcctctattttctttattacctgtatgtccgttgacaggtaccagtccgtgatttatccctttctttcccagcgaaggaatccatggcaggcatcatatatagtgccactggtttggtgcatggcatgcctgagctccttgccaactttctatttccgggatgtccgcaccatcgaatacctgggtgtgaatgcttgcattatggcctttccccctgaaaaatacgcacaatggagtgccggaattgcactgatgaagaatatcctgggctttataattccactgattttcatagccacctgttattttggaatccgcaaacacttattgaagacgaattcctacggtaaaaaccgaatcactcgggaccaggtcctgaaaatggccgctgccgtcgttctggccttcatcatttgttggttaccctttcatgtgctgactttcctagatgccctggcctggatgggagttatcaactcctgcgaggtcatcgcggtaatagacctggctttgccgtttgcgatccttctggggtttacaaactcttgtgtcaaccctttcctttactgttttgttggcaatagatttcagcagaagttgcggagcgtattccgggtccctatcacctggctgcagggtaaaagagaatccatgagctgcagaaagtcttcgtcccttcgcgaaatggaaactttcgtgagttag

SEQ ID NO: 214391 - DNA, 1458 bp, Artificial Sequence
  Description of Artificial Sequence: Synthetic coding sequence
atgcgcaagagagcgcctcagtccgagatggctcctgccggagtgtccttgcgagcaaccatcctgtgcctgcttgcctgggccggtctcgcagccggtgacagggtgtacatacatccgttccacctcgtgatacacaacgagagtacatgtgagcagctagccaaagccaacgcgggaaaacctaaggacccaactttcatccccgctcctatccaggccaagacttcccctgtggatgagaaggccctccaagaccaattggttctggtcgctgcaaagttggatacagaggacaagctgagggccgctatggtgggcatgttggcaaatttcttgggcttcaggatctatgggatgcactccgagctgtggggtgtggttcacggtgccaccgtgttgagtcccactgccgtttttggcacactcgcctccctgtatttaggggcactggatcatacagcagaccggctgcaggccatactgggagtgccctggaaggacaagaactgcacatcacgattagatgctcataaagtcctgtccgctcttcaggcggtgcagggtctcctggtggcccagggacgcgcagactcccaggcccagttactcctttccacagtagttggagtgtttacagcccctggattgcatctcaaacagccatttgtccagggactcgcactctacaccccagttgtgctgcctaggtcgctggatttcaccgagttggacgttgccgctgaaaagatagacagattcatgcaggccgttactggctggaagacaggttgcagtctgatgggagcgtccgtggattccacccttgcattcaacacatatgtgcacttccagggtaagatgaaaggtttcagtttactggcggagcctcaggagttttgggttgataatagcacgagtgttagtgtgcctatgttgagcggcatgggtacctttcagcactggagcgatattcaggacaattttagcgtgacacaggttccttttaccgagagtgcttgtctcctgctcattcagccccattacgcttccgatttggataaggtcgaggggctgacatttcagcagaacagtcttaattggatgaaaaaactaagcccccgaactattcacctgactatgccgcagttagtactccagggaagttacgacttacaggacctcctggcccaagccgaattacccgctatcctccataccgagctgaacctgcagaagctttcaaacgatcgaatccgggtaggcgaagtgttgaacagcatcttcttcgagctagaggctgatgagcgtgaaccaaccgaatccacgcagcagctcaacaagcctgaggttctggaggttacgttaaatcgcccatttctcttcgccgtctatgaccagtcagccacggcgcttcactttcttggacgggtggcgaaccctctctcaactgcctag

SEQ ID NO: 214392 - DNA, 1212 bp, Artificial Sequence
  Description of Artificial Sequence: Synthetic coding sequence
atgcggaagagggctccacagtcagaaatggccccagcaggtgtgtcactccgcgcaactattctctgcctgttggcttgggcaggactcgctgcaggggacagagtgtacatccacccatttcaccttgtgattcacaacgagtccacatgtgagcagctggcaaaggctaacgctggaaagccgaaagatcccaccttcatcccagctcctatccaggcaaaaacaagtcctgtggatgagaaggcacttcaggatcagctagtgctcgttgccgctaagctcgacacagaggacaaattacgggcagcaatggtcggcatgctggccaacttcctgggtttccgcatttatggtatgcattctgagctctggggcgtggtgcatggagccacggttctctccccgacggcggttttcggcaccctggcttcactgtatctcggggcacttgatcacactgccgatagactacaggctatcttagatgttgccgctgaaaaaattgacagatttatgcaggccgttacgggatggaagactgggtgttctctgatgggcgcatcagtggattcaacattggcctttaatacctacgtacacttccaaggaaagatgaagggatttagcctgttggctgaacctcaggagttctgggtagataatagtacctcagtcagcgtgcccatgctgtccgggatgggtacttttcaacactggtcagacatccaagataacttttccgtaacccaggtgccgttcacagaaagcgcctgccttctgcttatccagccgcattacgcttccgacctggataaagtcgaggggcttacctttcagcaaaactccttgaactggatgaaaaagttgtcaccaagaacaattcacctgaccatgccgcagttagttttgcaaggcagttacgacctccaagatctgctcgcacaagcagagttgccagctatcttacatactgaacttaatctgcagaaactgtctaatgaccggattcgggttggcgaagttctgaacagtatcttcttcgagctggaggctgacgagcgcgagcccaccgagtccacgcagcagttaaacaaacccgaagtgctggaggtgactctcaacaggccctttctgtttgccgtttacgaccaatcggccacagctctgcattttctgggtcgagtcgccaaccccctgtctactgcctag

SEQ ID NO: 214393 - DNA, 1479 bp, Artificial Sequence
  Description of Artificial Sequence: Synthetic coding sequence
atggtcaaattccctgccctgactcactattggcctctcatccggtttttagttcccctcggaattactaacatcgctatagattttggtgagcaggccctgaacagggggatcgctgccgtaaaagaagacgctgtcgagatgctcgctagctacggcctggcctactcgttgatgaagttctttaccggaccaatgagcgacttcaagaatgtcggactcgtcttcgtcaattcgaagagggacagaacaaaagcagtcctgtgcatggtggtagccggagcaatagctgccgtgtttcataccctgattgcctactcagatcttgggtattatataattaacaaactgcaccatgtggacgaatccgtcgggtcgaagacacgaagggcatttctgtatttagcagccttccccttcatggatgctatggcttggacccacgctggaattctgctaaagcacaagtacagttttctggtcggctgcgcctcgatcagcgatgttatcgcccaggtagttttcgtggccatcctgctgcacagtcacctggagtgtcgggaacccttgctgatccccatcctctccctatacatgggggcactggtgagatgcacaaccctctgtctcgggtattataagaatatccatgacataatccctgacagaagcggcccagagcttgggggagacgccaccatccgtaaaatgctgtctttttggtggcctctcgcgcttattctggcaacacagcgaatctcacgtcccatagttaacctttttgtgtcacgggaccttggcggatccagtgcagctaccgaagccgtggccattctgacagctacttatcccgtcggccatatgccgtacggctggttgaccgagatccgggcagtctaccctgctttcgacaaaaataacccctcaaacaaactagtgagcaccagcaacacagttaccgccgcacacatcaaaaagtttacatttgtctgcatggcactgtccctgaccctgtgctttgtgatgttttggacacccaacgtgtccgagaagatattgatagatattatcggggtggacttcgcgttcgccgaattgtgcgtggtgccattgagaatcttctccttcttcccagtgccggtgacagtgcgcgctcatctcaccggctggttaatgacactgaagaagactttcgtcctagctcccagttctgtgctcaggatcatcgtcttgatagcttcactcgtcgtcctcccatacctcggcgtgcatggagcaaccctgggggtgggaagcctgctggcgggatttgttggggagtcaacaatggtggccattgcggcttgttacgtctaccgcaagcagaaaaaaaagatggagaacgagtctgccactgagggggaggattcagctatgaccgatatgccgccaaccgaagaagttactgacattgtggagatgcgcgaggaaaacgagtag

SEQ ID NO: 214394 - DNA, 885 bp, Artificial Sequence
  Description of Artificial Sequence: Synthetic coding sequence
atgggtgccttagttagatgcaccacactttgcctgggctactataaaaacatccacgatatcatcccagaccgctccggccctgagcttggaggggacgcaactatccgcaagatgctgtccttttggtggccactggccctgatacttgctacgcagcgaattagccgcccaatcgtgaacctgtttgtgtccagggacctgggcggatcctccgcagcaaccgaggccgtggcaatcctgacagctacgtatccagtgggccacatgccttatggctggcttaccgaaatcagggctgtctatccggctttcgacaagaacaacccatccaacaaactcgtgagcacaagcaataccgtcaccgccgctcatattaagaagtttaccttcgtgtgtatggccctgtcactgaccctgtgtttcgtcatgttctggacgccaaacgtgagtgagaaaatcctgatagacataataggagtcgactttgcctttgctgaactttgcgtggtgcctctgcgtatcttcagcttttttcctgtgccagtcacagtccgtgcgcacctcaccggttggctgatgactttgaagaagactttcgttctggcaccatcctccgtcttgaggattatcgtactgatcgcgtctctggtcgtgctaccttaccttggcgtgcatggggctactctcggtgttgggtccctgcttgcaggcttcgtgggggagagtaccatggtagccatagctgcatgctacgtgtaccgtaagcagaaaaagaaaatggagaatgaaagcgcgacagagggggaggatagcgccatgactgatatgcctcctaccgaggaggtgacggacatcgttgaaatgcgagaggagaacgaatag

SEQ ID NO: 214395 - DNA, 471 bp, Artificial Sequence
  Description of Artificial Sequence: Synthetic coding sequence
atgtggaccttcgttactcaactgctggtcaccctcgtgctgctctcattcttcctggtgtcttgccagaatgtgatgcatatcgtgcgaggatccctctgcttcgtcttaaagcatatccaccaggaacttgataaggaattgggagagtccgaaggattaagcgatgacgaggagaccatcagcactcgggtggtccggaggcgcgtctttctgaaagggaatgaatttcagaatattccaggcgaacaggtgacggaggaacaatttactgatgaacagggtaatattgtgactaagaaaatcatcaggaaggtggtccgccagattgacctcagtagtgccgacgccgctcaggaacacgaagaggttaccgtagagggacccctggaagacccatcagagctcgaggtggacatcgattattttatgaagcattcaaaggaccatacctccacacctaatccgtag

SEQ ID NO: 214396 - DNA, 5694 bp, Artificial Sequence
  Description of Artificial Sequence: Synthetic coding sequence
atggcacaggcagcaaagcagctgaagaaaatcaaggacattgaagcccaggcgctgcaggaacagaaggaaaaagaggagtccaacaggaaaagaaggaaccggagcagagataggaaaaaaaaagccgatgccgcaaccagttttttaagggccgcaaggagtgggaacctcgacaaggcactggaccacctgagaaatggagtagacatcaatacatgcaaccagaacggcctgaacgggcttcatctcgcctccaaggaaggccatgttaaaatggtcgtcgaacttctgcataaggagatcattctggagacaacaaccaaaaaagggaatactgccttacatattgccgctcttgcaggccaagacgaagttgtacgagaacttgtgaactatggagccaacgtgaatgcacagtcacagaaggggtttacaccactctacatggcagctcaagagaaccatctcgaagtggtgaagtttctcctggagaacggggctaatcagaatgtggctacggaggacgggttcacgcctctggccgtggccttacaacagggccatgaaaacgtcgtcgcacacctgattaactacgggacgaagggaaaagtgagacttcccgcactgcacatcgccgctcgtaacgacgatacaaggacagctgctgtcctgctccagaacgatccaaaccccgacgtactgagtaaaactggatttacacccctgcatatcgcagctcactacgagaacctgaacgtggcccagctccttttaaacaggggcgcaagtgtgaacttcaccccccagaacgggatcactccacttcacatagcgtctaggagagggaacgtcatcatggtgaggctgctgctcgaccgtggagctcagatcgaaaccaaaacaaaggacgagctcacaccgctccattgtgctgcacgaaatggccacgtgcgtatctccgaaattctgcttgaccacggcgctcccatacaggcaaaaaccaagaatggtctgtccccaatacacatggctgcacagggagatcacctggactgcgtccgtctcctgctgcagtacgacgctgagatagacgacattacactcgatcaccttactcccttgcacgtggctgctcactgcggacaccatagagtggccaaggtgctcctggacaagggagcgaagccaaacagtcgggcactgaatggttttactcctctccacattgcctgcaaaaaaaaccacgtccgagttatggagctgttgctcaaaaccggtgccagcattgacgcagtcaccgaatcagggttgacacccctgcatgtggcctccttcatgggacatctccctattgtaaagaacctgttacagcgaggagcatccccaaatgtaagcaacgtgaaggtggagacaccgctgcatatggctgctcgagccggtcatactgaggttgcgaagtacttgctgcaaaacaaagccaaggttaacgcaaaagccaaagatgaccagacacctctgcattgcgccgctaggatcggtcatactaacatggtgaaactgctgctcgagaacaacgcaaacccaaacctggccacaaccgctgggcacactcccctgcatatcgccgctcgagaaggccatgtggagacagtgctcgcgctgctggagaaggaggccagccaggcttgtatgactaaaaagggctttacaccccttcatgttgccgctaagtatggcaaggtcagagtcgcggagctcctccttgaacgggatgcccacccaaacgccgctggcaaaaatggattaacccccctccacgtcgccgtgcaccacaataatttggacatcgtgaaactgttgctcccccgtggtggatctccccattccccggcatggaatggatacacccccctccatatcgctgcaaagcaaaaccaggtggaggtggctcgttctctccttcagtatggcggatccgccaatgcagagtcggtgcagggcgttacaccattgcatctcgccgctcaggagggtcacgcagagatggtggccttgctcttgtccaaacaagccaatggaaacctgggcaataaatctgggctgacccctctgcacctcgtggctcaagagggacacgtgcccgttgccgatgtgctcatcaagcatggggtaatggtcgacgcaacaactaggatgggctacacccctttgcacgttgcatcacattatggcaatattaaactcgtgaaatttcttttacagcaccaggcggatgtaaatgccaagaccaagttaggctatagccccctccatcaggctgcacagcagggacacacagatatagtaactctactattgaaaaatggcgcatctcctaacgaggtgtccagcgacggcacaacaccactcgctatcgccaaacggcttggttacatctcggttacggatgtacttaaagttgttaccgatgagacaagctttgtgctggtcagtgacaagcaccgcatgtcattcccggaaacagttgatgaaatacttgacgtctccgaggacgagggcaccgcacacataaccattatgggggaggagctgatcagctttaaggccgagagacgagattcccgtgatgttgacgaagagaaggagctccttgacttcgtgccaaagcttgaccaggtcgtggaaagccctgccataccaagaatcccatgcgccatgcccgagacagtagtgataagatccgaggaacaggaacaggcgagcaaggaatacgacgaggatagcctgatacccagtagcccagccaccgagactagcgacaacatcagcccagtggcatctccagtgcacaccggctttctcgtgtccttcatggttgatgctcgtgggggatctatgaggggctcacgccacaatggcttgagagtggtgataccccctcgaacatgtgctgctcccacaagaataacgtgtaggctcgtgaaaccccaaaaacttagcaccccaccgccactggcagaggaggaaggattggcctcccggattatagcactgggaccaactggtgcacagttcctgtcacctgtaatcgtcgagattccgcatttcgcatctcacgggcgtggagatcgagaactggtcgtactccgctctgagaacgggagcgtgtggaaggaacaccggagccgctatggtgagtcttacctagaccagatcctcaatggtatggacgaggaactggggtcccttgaggagctcgaaaagaaaagagtgtgtcgtatcataaccaccgattttccactctattttgtcataatgtcccgtctgtgccaggactacgacaccataggaccagagggtggcagcctcaagagtaagctggttccccttgtccaagcgaccttcccggagaatgccgttactaaaagagtgaaattagccctgcaggcgcagccagttcctgacgagctagtaacgaaattgttggggaatcaggcgacattctccccgattgtcactgtggaaccaaggcgacgaaagtttcaccgcccaatcgggctgcgaattcctctccctccttcctggaccgataacccacgggattcaggcgagggagatactaccagcctccgcctgctgtgctctgtaatcgggggtactgatcaggcacagtgggaagatatcaccggtaccactaaactcgtgtatgcaaatgagtgtgcgaatttcaccaccaatgtgagtgctcgcttttggctctcagactgtccccgaaccgcagaggccgtaaactttgccacccttctgtataaggaactcactgcagtcccatatatggccaaatttgtgattttcgctaaaatgaacgaccctcgcgagggcagactgaggtgctactgcatgacagacgacaaggttgacaaaactttggaacaacatgaaaactttgtcgaagtggcccgaagcagagatatagaggttctggagggtatgagcctgttcgcagaactgtctggcaatttagtgcccgtaaaaaaagccgcacaacagcggtccttccatttccagagcttccgcgagaaccgacttgcaatgcctgtgaaagttcgggattccagtcgagaacctgggggaagcttgtctttcctgcggaaagccatgaaatacgaagacacacaacatattctctgtcacctcaatattaccatgccaccctgcgctaagggctccggagccgaggatcggcgaaggactccgactccccttgctctaaggtacagtattctctcagagtctacacccggttctctttctgggactgagcaagccgaaatgaaaatggctgtgatctccgagcatttggggctgagttgggctgaactggcgcgtgagctacagttttcagtggaggacattaacaggataagggtggagaacccaaacagcttgttagagcagtccgtcgctctgctaaacttgtgggtgatccgagagggccaaaacgccaacatggagaacctttacaccgccttgcaatccatagaccgtggagagattgttaacatgctagagggtagcggacgccagtctaggaacttgaagccggatcgccgacacactgaccgggattatagtctttcaccctctcagatgaatggatacagctccttgcaggacgaactactttctcccgctagtcttggttgtgccttgtcctcccctcttcgcgctgaccaatattggaacgaggtggccgtgttagatgccattccgctggcagctacagagcatgatacaatgcttgagatgtctgacatgcaggtgtggagcgcgggtctaactccctcgctagtgaccgcagaagacagtagcctcgagtgtagtaaagccgaggactccgatgccactggccatgaatggaaacttgagggagcgttaagtgaagagccacgtggacccgagctgggctcactcgaactggtcgaagatgacacagtggacagcgatgctaccaacggactgattgacttgctggaacaggaggagggccaacgttctgaggagaagcttcccggaagcaaaagacaggacgatgctactggagccggacaggattccgagaatgaggtttctctcgtgagcggccaccaacggggacaagccagaatcactcattcacccacagtttcacaggtgaccgagaggtcccaggaccggctccaggactgggacgcggacggatctatcgtgtcctatctgcaggacgcggctcagggttcttggcaggaagaggttacacaggggcctcattcgtttcagggcacaagtacgatgacagaggggctggaaccgggaggcagccaggagtacgagaaggtgctggtgagcgtctccgaacacacttggactgaacagcctgaagctgagagtagccaggcagaccgggacaggaggcagcagggacaggaggagcaagtgcaggaggctaagaacacattcacacaagtggtgcaaggtaacgagttccagaatattccaggggaacaggtgaccgaggagcaatttactgacgaacagggcaacatcgtgacaaaaaagatcattagaaaggtggtgcggcagattgacctctcaagcgcggatgcagctcaagagcatgaagaagatcacacatcgacccccaatccctar

SEQ ID NO: 214397 - DNA, 5643 bp, Artificial Sequence
  Description of Artificial Sequence: Synthetic coding sequence
atgccctacagcgtgggattcagggaagctgacgcagccactagctttctacgtgccgcaagaagcggtaacctagataaggctctcgatcacctgcgcaatggggtggatatcaatacttgtaatcagaacggattaaatggactgcacctggccagcaaagagggccatgtcaaaatggtggtggaattactccacaaagaaatcatcttggaaactacaaccaaaaagggcaatactgcccttcacattgcagcactggccggacaggacgaggtcgtgcgagaactggtaaactacggagctaatgtgaatgcgcaaagccagaagggcttcacaccgttgtatatggctgcgcaagagaatcacctggaggtcgtgaagtttttgctggagaacggagctaatcagaacgtcgccactgaggacgggtttactccactcgccgtggccctgcaacagggacacgaaaatgtggtggcccatctgattaattacgggacaaaaggcaaggtccggcttcccgcactgcatatagctgcacgcaatgatgatacacgaacggccgctgtactattgcagaatgacccaaatcccgacgtgttgagcaaaacaggcttcacaccacttcacatagccgcacattacgagaatctgaacgtggctcagttgcttctgaacaggggggcttccgtgaatttcacgccgcaaaacggcatcacccctcttcatattgcctcacgcaggggaaacgtaatcatggtcagactgttgttggaccgcggagcccaaatagaaacaaagacaaaggacgagctgactcccctccactgcgccgctagaaacggacacgtacgcataagcgagatactgttggaccatggcgcaccaattcaggctaagacgaagaacggactctcacccatccatatggccgctcagggggaccatcttgactgcgtcagactcctgttacagtacgacgctgagatagacgatattaccctggatcacttgacacctctgcatgtggccgctcattgtgggcatcatcgtgtggccaaggtattgttggacaagggagccaaaccgaattctagggccctcaatggcttcactccgctgcacattgcgtgtaaaaaaaatcacgtgcgggtcatggaacttctcctaaaaacaggggcttctatagatgctgttaccgagtccggcctgaccccgctacacgtggcctctttcatgggccacctgcccatcgtgaaaaatttgttgcagagaggcgcttctccaaatgtatctaacgttaaagtagagacgcctttacatatggcagccagagcaggacacacagaggtggccaagtaccttctgcaaaacaaggcaaaagtcaacgcgaaagccaaggacgaccagactccactccattgcgcggctcggatcgggcacaccaatatggtgaagcttctgctcgagaacaatgctaacccaaacttagctaccaccgccggtcacacgcctctccacatagcggctcgggaaggacatgtcgaaaccgtcctggccctcctggagaaagaggcctctcaagcctgcatgaccaagaagggctttacccctcttcatgtcgctgcaaagtacggaaaggtcagagtggcagagctcctgctggaacgcgatgcacaccctaatgccgcaggtaagaatggcctgaccccgctgcacgtggccgtgcaccacaacaaccttgacattgtgaagctgttgctgccacgcggaggttctccacactctcctgcatggaacgggtacaccccattgcacatcgccgctaaacagaaccaggtggaggtcgctagatctctactgcaatatggtggtagcgccaacgcagagtctgtgcagggcgtgacccccttacacttggcggctcaggaagggcacgccgagatggtcgcgctgctcttgagcaagcaggcaaatgggaatcttgggaataagtcgggactgacaccactgcacttggtagcacaggaaggacacgtgcctgtggccgatgtactgatcaagcatggagtgatggttgacgctaccacacgcatgggatacactccactacacgtagcatcacattacgggaacattaagttagtgaagttcctgcttcaacatcaagccgatgtgaatgccaaaaccaagctgggatattcccctctgcaccaagctgcccagcaaggccacaccgatatagtgacactgttattgaaaaatggcgcaagccccaacgaagtctcaagtgatggaaccacgcccctggccattgctaagaggttaggctatatttccgtgacggacgttttgaaggtggtgactgacgaaacctccttcgtattggttagtgacaagcatagaatgtcttttccagaaaccgtagatgaaatcttggacgtttcagaagacgagggagaagagctgatttcttttaaagccgagagaagagactctcgtgacgtcgacgaagaaaaagaactgctcgatttcgtgcccaagctcgaccaagttgtggaatccccagccatcccgagaattccttgtgcaatgccagagacagtggttatccggtctgaagagcaagagcaagcttctaaggagtacgatgaggacagcctgattccttcgtcaccggctacggagacatctgacaacatctcacccgtggcctcccccgtgcacacagggttcctggtctcgtttatggttgatgcgagaggcggatctatgcggggtagccggcacaatggactgagggtcgtcattcctcccaggacttgcgcagctcccaccaggatcacttgtcggctcgtgaaaccccaaaagctgtcgacacccccacctctggcagaagaagagggcctggcatcaagaataatagccctcggccctacaggagcccagtttctctcgccggtgatcgttgagatacctcacttcgctagccacgggcgtggggaccgggaattagtggtgctccggagcgaaaacggctctgtttggaaagaacacagaagcaggtacggggagagctacctggatcagattttaaatgggatggacgaagagctgggttcattagaggagctggagaaaaaacgggtgtgccgcattattacgacagacttccctttgtactttgtcattatgagcagactgtgccaggattacgacacaatcggtcctgaggggggatctctgaaaagcaaactcgtacctcttgttcaggctacctttcctgaaaacgctgtaactaaaagggtgaaactggccctacaggcccaaccagtgccagatgagctagtgaccaagctcctcggcaaccaggctacatttagtcctattgtgactgtcgagccccgacggaggaaatttcacagacctattggtcttcgaatccccctgcctccatcgtggacggataaccccagggatagcggggagggcgataccaccagcctgcgtctgctctgttcagtgatcggagggacagaccaggcacagtgggaagacattacaggcactacgaaattggtatacgctaacgagtgcgccaattttactactaatgtgagcgccagattttggttgtctgattgccccagaactgctgaggcagtgaactttgccaccctgctctataaggagcttactgccgtcccttacatggccaagttcgtgatttttgctaaaatgaatgatcccagagaagggcgactgcgctgttactgcatgaccgacgacaaggtggacaagactttggaacaacatgaaaactttgtcgaggtggctaggagccgagacatagaggtgctagaaggaatgtccctgtttgcagaactcagcgggaatctagttcccgtgaaaaaggcagcccagcaacgttcctttcacttccagtcttttcgcgagaatagattggcaatgcctgttaaggtcagagactcaagccgggaacctggcggttcactgtctttcctgagaaaagccatgaaatatgaagatacccagcacatactatgtcaccttaacatcactatgcccccttgcgccaaaggatctggcgctgaggacagacggaggactcccacgcccctggcactccgatattccattctctctgagtccacgcccggttccctcagtgggaccgaacaggccgaaatgaagatggctgtgatctccgagcacttggggttgagctgggctgagctggcaagagaacttcagttttccgtggaagacatcaaccggatacgggtggaaaacccgaactcgctgcttgagcaatctgttgctctgctcaacctgtgggtgattcgcgaagggcaaaacgcgaatatggagaacctgtacactgccctgcagagcattgaccggggtgaaattgttaatatgctcgaaggatcagggaggcagagtcggaatctgaaacccgaccggcgacacaccgaccgggattattccctgagccctagtcagatgaacgggtacagttccttgcaagatgagctcctgtccccggctagcctgggctgtgccttgagcagccctctgagagccgatcagtattggaatgaagtcgcagttctcgacgctatcccactagctgctactgaacatgataccatgctagaaatgtcagacatgcaggtttggagcgcgggattgactccctctttagtaactgcggaggatagcagtcttgaatgttctaaggcagaggactctgatgccaccggacatgaatggaagctggaaggggctctgtccgaagaacctcggggtcctgaactgggttcccttgagctggtcgaggatgacactgtggacagtgatgctacaaatggcctgattgatttgcttgagcaggaggagggacagaggtcagaagaaaagctccctggttccaaacgtcaagatgatgctacaggggctggtcaggattccgagaacgaggtcagtctcgtttctggacatcagcgcggtcaggcacggatcacacactcaccaacagtgagccaggtaaccgagcgctcccaggaccgcctgcaggactgggatgctgatgggtccattgtcagctacttacaggacgcggctcagggttcatggcaggaggaggtaacccagggcccacacagcttccagggcacatccactatgactgaggggttagagcccggtggaagccaggaatacgagaaggtgctggtgtccgtctcagaacacacttggactgaacagccagaggcggaatcatcacaggccgacagagaccgtcgccaacagggacaggaggagcaagttcaggaagcaaaaaacacatttacacaggttgttcagggcaatgagtttcagaatatccctggggagcaagttaccgaggagcagtttactgacgaacaggggaacattgtgactaaaaaaattatacgtaaggtggtgagacaaatagacctgagctcagccgatgccgcacaagagcatgaggaggtcgagctgcgcggatccggactgcagcccgacctgatagagggtcgcaaaggcgcacagatagtgaagagggcgtccctaaaaaggggaaaacaatat

SEQ ID NO: 214398 - DNA, 468 bp, Artificial Sequence
  Description of Artificial Sequence: Synthetic coding sequence
atgtggacctttgtgacccagctcctggtgaccttagttcttctgtcttttttcttagtcagttgccagaacgtgatgcatatagttaggggcagcctctgtttcgtgctgaagcacattcatcaggagctcgataaggagctgggggagtcagagggactgagcgacgacgaagagacaatctcaacccgggttgtacgaaggcgagttttcctgaagggcaacgaatttcaaaacatccctggcgaacaggtgacagaggagcagttcaccgatgagcagggtaacattgtcaccaagaaaatcatccgaaaggtggtgcggcagattgacctatcatcggcagatgctgctcaggagcacgaagaggtggagctgcgagggtctgggcttcagcccgacttgatcgaaggtcgcaagggtgctcagatcgtgaaaagggcttccctgaagagaggaaagcaatag

SEQ ID NO: 214399 - DNA, 5645 bp, Artificial Sequence
  Description of Artificial Sequence: Synthetic coding sequence
atgccatactcagtgggatttagggaagcagatgctgcgacaagcttcctgcgagctgctaggagtgggaacctggacaaggcattggatcatctgagaaatggtgtagatatcaatacatgcaatcaaaacggattgaacgggttgcatctggctagcaaggaaggccacgtcaaaatggtggtggagctgctgcacaaggaaataatcctggagactacaaccaaaaagggcaataccgcactgcacatagccgcactggcaggacaggacgaggtcgttcgggagctggttaactacggagccaatgtaaacgcccagtcccagaaaggattcacaccactctatatggcggctcaggaaaatcacctcgaggtggtgaagttcttactggaaaacggggctaaccagaatgtggcgacggaggatggcttcactccattagccgttgccctgcagcagggccatgagaatgtcgtcgcacacctgatcaattacggcacgaaaggcaaagtgaggctgcctgcactccatatcgcggcacgaaacgacgacacgaggactgccgctgttttactacagaacgacccaaaccctgacgtgctgtctaagactggattcacccctctacatattgccgcacactatgagaatttgaatgtcgcacagctattactcaacaggggtgctagcgtgaacttcactcctcagaacggaatcacgccgctccacatcgcaagccgtcggggaaacgtcattatggtccgactcctgctggacagaggcgctcagatcgaaaccaaaaccaaggatgagttgactccactgcattgtgccgcaagaaatggtcacgtgcgcatttcagaaattttgctggaccacggcgctcctatccaggctaaaacaaaaaacggcctttcccctatacacatggccgcacagggagaccatctggattgcgtgagactcttgctgcagtacgatgccgaaattgacgatatcaccctggatcacctgacccccctgcatgtcgcagcgcattgcggacatcaccgggtggccaaggtgctgctcgacaaaggggcaaagccaaacagccgcgctttaaacggcttcacaccgctgcatatcgcctgtaaaaagaaccacgtccgcgttatggagctcctgctcaagacgggtgcctctatcgatgctgtgacagaatctggtctgacccctttgcatgtcgcttccttcatgggacatttgcctatcgtgaaaaaccttctgcagcgtggggcaagccctaatgtttcaaacgtgaaagtggagacccctttgcacatggctgctcgggctgggcatacagaggttgccaaatacctgctacaaaacaaagccaaagttaacgcaaaggccaaggatgaccagacgccccttcattgtgcggctaggatcgggcataccaatatggtcaagctgttgctcgagaacaacgcaaatcccaatctcgcaactaccgcaggccacaccccgttgcacatcgccgctagagaggggcatgtggagacagtgctggccctgcttgagaaagaggcctcccaagcctgcatgactaagaaaggatttaccccactccacgtcgcagcaaaatatggtaaagtaagggtggcggagctcctgctagagcgggacgcccatcctaacgctgcaggcaaaaacgggctcacaccactacatgtagccgttcaccacaacaacttggatatcgtcaagcttttgttacccaggggtggtagtccgcacagcccagcgtggaatggatacacaccccttcatattgccgcaaaacagaaccaggtcgaagtggcacggtctctcctacagtatgggggaagcgccaacgcagagagcgtgcagggggttactccactccatctggctgcccaggagggacatgccgaaatggtggctctactactgagcaagcaagccaacggaaatttgggcaacaagagcggcctgactcccctgcatcttgtggcccaggagggacacgtgcctgtggccgatgtccttataaagcatggtgtaatggtagatgctaccacgagaatgggttatactccactccacgttgcttcccattatgggaatataaagttagtcaagttcctgcttcagcaccaggccgatgttaatgccaaaacaaagttgggatactctcctcttcatcaggccgcacagcagggccatacggatatcgtgactttattattaaaaaacggtgcgtctcccaatgaggtgtccagcgatggtaccacaccactggcaatcgccaagcgcctgggttacatcagtgtcactgacgtacttaaggtggttacagacgaaaccagctttgttctcgtcagtgacaagcaccgaatgtcctttccagagacagtggatgagattttggacgtgtccgaagatgaaggtgaggagctcatcagcttcaaagcagagagaagggatagccgagacgtggacgaggagaaggagcttctcgattttgttcccaaactcgaccaagtggtagaatctccagcaattccccgtattccctgtgctatgccagagactgtggtcatcaggtctgaagagcaggaacaagcctctaaagaatacgatgaggattccctgatccccagctcgcccgcaacagaaacttccgataacataagccctgtggctagtcctgtccacaccgggtttcttgtgtcattcatggttgatgctcgaggcggtagcatgaggggatctcgacataacggattacgcgtcgtcattcctcctcgtacctgtgccgctcccaccagaattacctgtcggctggttaagcctcaaaagttgagcacccccccaccccttgccgaggaggaggggttagcaagccgtatcatcgccttaggaccaactggcgctcagtttttgagcccggttatcgtcgagataccccacttcgccagccatggacgaggggacagagagttggttgtactccggtcagaaaacggcagcgtttggaaagaacataggagccgatacggagagtcctacctggaccagatcttaaatggaatggacgaagaactcggtagtctggaggaactcgagaaaaaacgagtgtgccgtatcattacgaccgatttcccgctgtactttgtcatcatgtcgaggctgtgccaggactatgacacaattggcccagagggcggaagcctgaagtctaagttggtcccactcgttcaggccacatttcccgagaacgccgtgactaagagggtgaagctcgccttacaggcgcagcccgttccagatgaattagtcactaaattattaggtaaccaagcgaccttcagcccaatcgtcacagttgaaccacgccgtaggaaattccaccgaccaatcgggctaaggatcccgttgccccctagttggaccgacaaccctagggatagcggagaaggcgacacgacctccctccgactgctgtgcagtgttattggcggtaccgaccaagcccaatgggaggatattactggaacgaccaaactggtctacgcgaacgaatgcgctaactttaccaccaacgtttctgcccgtttctggctttcggactgtccgagaacggccgaggccgtcaatttcgcgactctgctgtacaaggagctgactgcagtgccctacatggctaagttcgtgattttcgccaagatgaatgatccaagggaagggagactccgttgctactgcatgaccgatgataaagttgacaagacactggagcagcacgagaatttcgttgaagttgcgcgtagccgagatatagaggttcttgaaggcatgtcgctgtttgcggagctctccgggaacctggttcccgtgaagaaggccgctcaacagaggagttttcattttcaatctttcagagaaaacagactggcgatgccagtgaaagttagagattcctcgagggaacccggaggtagcctgagtttcctacggaaagccatgaagtacgaagacacacagcatatactgtgccacctcaatatcacgatgcctccatgtgcaaaaggctctggtgctgaggaccgtcggagaactccgactcctctggcattacggtattctatcttgtcagaatccacgccaggaagcctgagcggcactgaacaggcggaaatgaagatggccgtcatcagcgaacatttgggcctctcttgggcagaacttgcgagagaacttcagttttctgtggaagatattaacaggatccgggtggaaaaccctaactccctcctggagcaaagtgtcgccttgttgaatctgtgggtaatccgagagggccagaatgccaacatggagaacctgtataccgccctccagtccattgacagaggtgagatcgttaacatgctggaggggagcggccgtcagagtcggaacctgaagcctgacagacggcatacggacagagactacagcttgtcaccatcgcagatgaacggttacagctccctacaggatgaactgcttagccccgcaagtcttggctgtgcattatcttcgcccctgcgggctgaccagtactggaatgaagtggcggtactcgatgcgataccccttgctgctaccgagcatgacaccatgctggagatgagcgatatgcaagtgtggagtgcaggtctcaccccttccctggtaaccgcagaagatagttctctggagtgctctaaggccgaggacagcgatgccacaggacatgagtggaagcttgagggcgcattgtcggaggagccgaggggacccgagttgggtagccttgagctggtggaggacgatactgtggatagtgacgcaacgaatggacttatagacctgctagagcaggaggagggtcagcggtctgaggaaaaactgcctgggtccaagaggcaggacgacgccactggagctggacaggattctgagaacgaggtcagcctggtgtccggccaccagcggggtcaggctcggatcacccacagtcctacggtgagccaggttacagagagaagccaagataggctacaggattgggatgctgatgggagtatcgtgagctacctgcaggacgccgcacagggaagctggcaggaggaggtcacgcaagggccacattcctttcagggcacgtctacgatgacagaagggctggaaccaggcggaagccaggagtatgagaaggttctggtctcagtttctgagcatacctggacagagcaacctgaagcggagagttcccaagcggatcgcgacagacggcagcaaggacaagaggagcaagtgcaggaggctaaaaatacattcacccaggttgtgcaaggaaacgagttccaaaatattccgggagaacaggtaactgaggaacagttcacagacgagcagggaaacattgtcacaaaaaaaattatccgcaaggttgtgagacagatagatctgagcagcgcagacgctgcccaggaacacgaggaagtgacagtggaggggcctctcgaggacccaagcgaattggaggtggacatcgattattttatgaagcacagcaaggatcatacttcgacacccaaccccta

SEQ ID NO: 214400 - DNA, 330 bp, Artificial Sequence
  Description of Artificial Sequence: Synthetic coding sequence
atgtggacattcgtgacacaactgctggtgaccctcgtgcttctctccttttttctggtgtcatgccagaatgtcatgcatatcgtcaggggaagcctgtgtttcgtcctaaagcatattcaccaggagctggataaagaactcggtgagagtgaagggctcagcgatgacgaagaaacaatttccaccagagttgtgcgcagaagagttttcctgaagggtaacgagtttcaaaacatcccaggcgaacaggtaaccgaagagcaattcacggacgaacagggtaatatagtgactaaaaaagaccatacatccaccccgaatccttag

SEQ ID NO: 214401 - DNA, 5576 bp, Artificial Sequence
  Description of Artificial Sequence: Synthetic coding sequence
atgccttactcagtcggtttcagagaagctgacgctgccactagcttcttgcgcgctgccagaagcggaaacctggataaggcactggatcacctgcgaaacggcgttgacataaatacatgcaaccagaatggactcaatgggctgcacctggcctccaaagaagggcacgtgaagatggtcgttgaactgttgcacaaggagattattctggagactaccacaaaaaaggggaacacagccctgcatattgcagctctggccggtcaggacgaggtggtcagggagttggttaactatggagccaatgtgaacgcgcagagccagaaagggttcacccccctgtacatggcagctcaggaaaaccacctcgaagtagtgaagttcctgctggagaatggagcgaaccagaacgtggctaccgaggatggttttacacccctggcagtggcgttgcagcagggacacgaaaacgtcgttgcgcatttgatcaattacgggacaaaaggtaaagtccgactccctgctctgcatattgccgcacgcaacgatgacactaggaccgcggctgttcttcttcagaatgatccaaatcctgacgtactgtccaagactgggtttactccattgcacatcgccgcacactatgaaaacctcaacgtggctcagctcctccttaacagaggcgcttcagtgaactttaccccacagaacgggattacccccctgcatatagccagtcggagggggaacgttatcatggtgcggctcttgctggaccgcggagcacagatcgaaactaagacaaaggatgaactcacaccactacattgtgctgcacggaatgggcacgtgagaatcagcgaaattttgctcgatcacggagcacctattcaagccaagacaaaaaacggactatcacctattcacatggccgctcagggagaccatctggactgcgtccggctgctcctgcagtacgatgccgaaatcgatgacataacacttgaccacctcacccctcttcatgtggctgcccactgcggccaccaccgcgtggccaaggtgctcttagacaaaggcgcaaaacctaacagccgagccctgaatggcttcactccattacatattgcttgcaagaagaatcatgtgcgagtaatggagctgctcctgaagacgggtgcatctattgatgccgttaccgaatcagggctgactcctctgcatgtggccagctttatgggacatctgccaattgtaaaaaacctgctgcaacgaggtgctagccccaacgtttccaatgtgaaagttgagaccccgcttcatatggccgcacgcgcaggacacaccgaggtggccaaatacttattacagaataaggccaaagtgaatgcaaaggcaaaggatgatcagaccccactgcactgtgccgcacgcattggccatactaacatggtcaagctcctcctagaaaataacgcgaatcccaatctcgccacaactgctggtcacacaccattgcacattgctgcccgagagggccacgttgaaaccgtgcttgctttgttggaaaaggaagcgtcccaagcttgcatgacaaagaagggatttaccccccttcacgtcgccgctaagtacggaaaggtaagagttgccgagctcttgctggagcgagacgcacatcccaacgctgccggtaagaatggcctgacacctctgcatgtggcggtgcatcacaataacctcgatatagttaagctgctcctaccgagagggggttccccccattcacccgcatggaatggatacactcccctgcacattgccgcaaaacagaatcaagtagaagtagctaggagcttgctccagtatggcggttcagcaaacgccgagtccgttcagggtgtcacacctctgcatttggctgcacaggaggggcatgccgaaatggtggcgctcctgttgagcaaacaggccaatggaaatctgggcaacaagtccggactgacccccctccacttagtggcccaggaagggcatgtaccagtcgccgatgtcctgatcaagcatggagtcatggtggacgctactaccagaatgggttacactccactgcacgtagcaagtcactacggcaacatcaaactcgttaagttcctgctgcagcaccaggcggacgtaaacgccaagactaagctagggtattcgccattacaccaagcagcccaacaaggtcacaccgatatagtcactctgttactgaagaacggcgcttcaccaaacgaggttagttccgatggaactacaccactggcaatcgcaaaacgactcggctacatcagtgtgaccgacgttctgaaagtggtgaccgatgagacatcatttgtcttggtgtctgataagcaccgaatgagtttccctgagacagttgacgagatcttggacgtttcagaggacgagggagaggagttgatcagcttcaaagcggaaaggagagatagcagggacgtggacgaggaaaaggagcttttggatttcgtccctaaactggaccaggttgttgagtccccggcaatccctcgtatcccgtgcgccatgcctgaaacagtcgtcatccgaagcgaggagcaggaacaggcatccaaagagtacgatgaagactctctgataccttctagtccagccacggagacgtccgataatataagtcctgtggcgtctcccgtccatacaggctttctcgtctccttcatggttgacgccagggggggatccatgagggggagtagacataacggcctccgggtagtcattccacctagaacctgcgctgcacccacccggatcacatgccgtttggttaagcctcagaagctgagcaccccccctccgctggctgaggaagagggattggctagcagaattatagctctcgggcctaccggggctcagttcctgagccctgtcatcgtggaaatcccccacttcgcgagtcacggaaggggggaccgcgaactcgtcgtgcttagatcagaaaacggcagtgtgtggaaggagcaccggagccggtatggagagtcttacctggatcagattctgaacggcatggacgaggaactggggagcctagaggagctggaaaagaagcgggtgtgtcggatcataacaacggatttccccctgtacttcgtgataatgtcacgcctctgccaggactacgacacaattggacccgagggcggttctctgaaaagtaagctcgtgcctctggtacaggctacatttcccgagaatgcagtgacaaaacgggtcaagctggctctgcaggcccagcccgtcccagacgagctggtcaccaagctcctgggcaatcaggctaccttctccccgatcgtaaccgttgaaccgagacggcgaaaatttcatcgtcctatcgggctgaggattcccctgccgccttcttggacagataaccctagggattccggggagggcgataccacttctctgcgcctgctatgctcggttatcgggggtacagatcaggcacagtgggaagacatcaccggcaccaccaagcttgtgtacgctaatgaatgtgctaacttcacgacgaatgtgagtgcacggttctggctaagcgactgccccaggacagccgaagcggtaaacttcgcaacgctgctgtataaggaactcactgctgtgccgtatatggcgaagttcgtgatctttgcgaagatgaatgatccaagggagggccgtctgaggtgctattgcatgacggacgataaagtggacaagaccctggagcaacacgagaacttcgtcgaggtggctcgctcaagagacattgaagtgttggagggcatgtctctttttgcagagctgtctggcaatctggttcctgtgaaaaaagccgctcagcaacgtagcttccatttccagtcattcagggaaaaccggctcgctatgcctgtgaaggtccgggacagttctcgggaacctggtgggtctctgagcttcctccgcaaagctatgaaatacgaagacacgcagcacattctgtgtcacctgaatatcactatgcccccatgtgcaaaaggctctggcgctgaagaccgaaggcgcacccccacacctctcgctcttcgatattcaatcttgagtgaaagcacacccggatctctgtccggcaccgagcaggcagaaatgaaaatggctgttatatctgagcacctgggcctgagctgggcggagttagcaagggagctacagttctcagtggaggacattaacagaatacgggtggaaaatccaaacagtctcctggagcagtctgtcgctcttttaaatctatgggtcattcgggagggccagaacgccaacatggagaacctgtacactgccctgcagtccattgacaggggtgaaatagtgaacatgctcgagggttcaggaaggcaaagccgtaacttgaagcccgacagaagacacactgaccgggattactctcttagtccatcacagatgaatggatactcttctctgcaggatgagctcttgtccccagctagcctggggtgtgcgctgtccagtcccctcagggccgaccaatattggaacgaagtggctgtgttggacgccataccactggccgctaccgagcacgatacgatgctggagatgagcgacatgcaggtctggagtgcaggactaaccccctcactcgttacagctgaggatagcagccttgagtgctcaaaggcggaggattccgatgccacaggccatgagtggaaacttgagggagccctgtccgaagaacctcggggtccagagttaggttctctggagttagtggaggatgacactgtggactctgacgccactaacggcttaatcgaccttctcgagcaggaagagggccaacggtctgaagagaagctgcccggatctaagagacaagacgacgcaactggcgctgggcaggactcagagaacgaagtttcccttgtgtcggggcaccaacgtgggcaggctagaattacacactctcccacggtgagtcaggtgacagaacgctcccaggataggctgcaggactgggatgctgatgggagtatcgtcagctatttgcaggacgcagcgcagggatcctggcaggaggaggtgacccaaggaccacattctttccagggcactagcactatgacagaaggacttgagcctgggggaagtcaggagtacgagaaggttttggtcagcgtatccgaacatacatggaccgaacagcctgaagcagagagctcacaggcagatagggacagaagacagcaggggcaggaggaacaggtgcaggaggcaaagaataccttcactcaagtggtccagggtaatgaattccagaatatccctggcgagcaggtgaccgaggagcagttcacagacgagcaggggaacattgtgactaaaaaggtggagcttcgcggatccggtctccagccagacttaattgaggggagaaaaggtgcccaaattgttaaaagggcatcactcaaaaggggtaagcagta

SEQ ID NO: 214402 - DNA, 4560 bp, Artificial Sequence
  Description of Artificial Sequence: Synthetic coding sequence
atgccatactccgtcggatttcgagaggccgatgccgcaacaagtttcctcagagccgcaagatccgggaacctcgacaaggcactggaccatcttcgtaatggggtggacataaacacttgtaatcagaatggtctgaacggcctgcacttagctagtaaagagggacacgttaagatggtggttgagctactgcataaagagatcatattagaaacgacgactaagaagggaaataccgctctccacatcgcagcacttgctgggcaggacgaggtggtccgggagctggtgaattatggggcaaatgtgaatgctcagtctcagaagggatttacgcctctgtacatggcagcacaggagaatcatctggaggtcgtgaagttcctgctcgaaaatggagccaatcagaacgtcgctacagaggacggtttcaccccattggctgtggcactgcagcaggggcacgaaaatgtggtcgctcaccttatcaattatggcacaaaaggaaaagtgcgactgcctgctctccacatcgccgctaggaacgatgataccagaactgccgcagtactgctccaaaatgaccccaaccccgacgtgctgtcaaagaccggcttcacaccactccatattgccgcacattacgaaaatttgaatgtggcacagctcctgctgaacaggggcgcatccgttaattttactccacagaacgggatcactccattacacatcgcctctagacggggtaatgttattatggtgagactgctcctcgatcgtggcgctcaaattgaaacgaagactaaggacgaactgaccccactccattgtgcagcaaggaatggacacgtgcggatctccgaaatactcttagaccatggagcaccgatccaggcaaagaccaagaatggactgtcccctatccatatggcagctcagggggatcacttagactgcgttcggctgctgctgcagtatgatgctgagattgacgacatcactttggaccacctgacccctctgcacgttgccgctcactgcggccatcaccgggttgctaaagtgctccttgacaagggagctaaacccaactctagggctttaaatggctttactccattacatattgcgtgcaaaaaaaaccacgtgcgcgtcatggagctgctcctcaaaactggtgcatcaatcgatgccgtgactgaatcgggcctgacaccgcttcacgtcgcctcctttatggggcatctcccaattgtcaagaacctgctccaaaggggagcgagcccaaacgtctctaacgttaaggtagagaccccactgcacatggctgctagagccggacacacagaggtcgcgaaatatcttctgcagaacaaggcgaaggtcaatgccaaggccaaggatgatcagacaccgcttcattgtgccgcacgaatcggacacaccaatatggtcaaactcttactagagaataatgccaacccaaatctggctacaacagcagggcacactcccttacacatcgccgctagggaggggcatgtggagacagttctcgccctgctggagaaagaggccagccaggcttgtatgactaagaaaggtttcacccccttgcacgtggctgccaaatatggcaaagttcgggtcgccgagctgctgctggaaagagacgcacacccaaatgccgcaggaaaaaatggcctcactccacttcatgtggctgtgcaccacaacaatctcgatatcgttaagctgcttctgcctcgaggtggctctcctcatagcccggcttggaatgggtacacgcccctccatatcgccgcaaagcagaatcaggtggaggttgccaggagtctgttgcaatatggcggaagcgccaatgccgagagtgttcaaggagtcacgcctcttcatctggccgcacaagaagggcacgccgaaatggttgcactcttactgtccaaacaggcaaacggcaatctcggaaataaaagcggactcaccccacttcacttagtggcccaagaaggtcacgttcccgtggctgatgttttgattaaacacggtgtgatggtggatgcaacgaccagaatggggtatacccccctgcatgtcgccagccactacggcaatatcaaactggtgaagttcctgctccagcaccaggccgatgtgaatgcaaaaactaaactgggctatagtccactgcatcaggccgcacagcagggacacaccgacattgtcacactcttgttaaagaatggtgcctcccccaatgaagtctcatccgatggcacaactccactcgcaatcgctaaacgattggggtatataagcgttactgacgtgctgaaagtcgtgacagatgaaacctcattcgttcttgtgagcgacaaacacagaatgagctttcccgaaactgtagacgagatcttggatgtcagcgaggacgagggggaggaactgatcagcttcaaagcagagcggagagatagcagagatgtggacgaggaaaaggagctgttggacttcgtccccaagctggaccaggtggtggagagtccagccataccgaggataccctgtgctatgcccgaaactgtcgtaatcaggtctgaggaacaggagcaagcctcgaaggaatacgacgaagacagtttaataccatcttccccagcaacggaaacttccgataacattagccctgtcgcgtcccctgtccataccggcttcttagtctccttcatggttgacgcccgaggtgggtcaatgaggggcagcaggcacaacggccttcgcgtcgtgatcccacccaggacgtgcgccgcacccactcgcattacttgcagactcgttaaaccccaaaaactgtccaccccgcctccccttgccgaagaagaagggttggcctctcggatcatagcactaggcccaacaggcgctcagttcctcagcccagtgattgtggagatcccacacttcgctagtcatgggagaggagaccgcgagctggttgttctcagatctgagaacggtagcgtttggaaagaacatagatccaggtacggggaatcatatcttgatcagatcctgaatggtatggacgaggaattgggcagtctggaagagctcgagaagaagcgggtgtgccggataatcacgacagacttccctctatactttgtcatcatgagccgcttgtgtcaggactacgataccatcggacctgaagggggttcgctgaagtccaagcttgtgcccctcgtgcaggccacgtttccagaaaacgcagtgacaaagagagtcaaactggcgctgcaggcccagccagttcccgacgagctcgtcacaaagctgctggggaatcaggcaaccttcagcccaattgtgactgtggaaccccgtcggagaaagtttcatcgtccaatcgggctgcggattcccctgccgccaagttggactgataaccccagggattccggcgaaggggacaccaccagcttgagactactgtgtagcgtcatcggcggtactgaccaagcacagtgggaggacatcactgggaccactaagctggtgtacgccaacgagtgtgctaattttactacaaatgtttccgctcgcttttggctttcagactgcccaagaactgcggaggccgtgaatttcgcaaccctgctttacaaggagctcacagcggttccttatatggccaaatttgttatcttcgctaagatgaatgatccccgagaaggcagactgaggtgctattgcatgaccgatgataaggtcgacaaaactctggaacagcacgaaaactttgtcgaggtggcaagatcgagagacattgaggttctggagggaatgtctctttttgccgagctatcagggaatctcgttccagtgaagaaagccgcacagcagcgtagcttccacttccagagtttccgagaaaatagactggccatgccagtcaaagtgcgagacagttcccgggaacctggcggatcactaagttttctcaggaaggcaatgaaatacgaagacactcaacatatcctatgccaccttaatatcactatgcctccctgcgcgaaaggtagcggggcagaggataggcgtagaactccaacaccccttgccctgcgatattcaatactgtccgaatccacacctggaagcctcagtgggaccgagcaggcggagatgaaaatggctgtcatatctgagcatttaggtctgagctgggcagagttggctcgcgaacttcagttttccgtagaggacatcaatcgaatacgtgtcgaaaatcccaactcattgttggaacagtcagttgccctgctgaacctgtgggtcatccgggagggacaaaacgcgaacatggagaatctgtacaccgctctgcagagtatcgatcgaggggaaattgtgaatatgctcgaaggctccggccgacagtcccggaacctgaagcctgacagaagacacactgatagggactattctctgtcacctagccaaatgaacggtatctccactaataacccttag

SEQ ID NO: 214403 - DNA, 5504 bp, Artificial Sequence
  Description of Artificial Sequence: Synthetic coding sequence
atgccttattctgtgggctttcgcgaggctgatgcagccacgtcattcctaagagccgcaaggagtggtaacctggataaggccctggatcatctgagaaatggcgttgacatcaacacttgtaaccaaaacggccttaacggcctccatcttgctagtaaagaggggcatgtaaagatggtggtcgaactgcttcataaagaaataatcctagaaaccacaaccaaaaagggcaataccgctctgcacatagctgccctcgctggacaggacgaggtcgtgagagagctcgttaactacggtgccaatgtgaatgcacagtcccagaagggatttacccccttgtacatggccgcacaagaaaaccatctggaagtggtaaaattcctattggagaacggtgctaatcagaatgtggccacagaggacgggtttacgcctcttgccgtcgccctacagcaagggcacgaaaatgtagtagcccacttgatcaattatggtaccaaaggaaaggtcaggctccctgcccttcacattgccgcacgtaacgatgacacccgtacagccgctgttttgttgcagaacgatcctaacccagacgtgctaagcaagactggctttacacccttacatattgcagcccattacgagaatctgaacgtggcccaactgttgctgaatcgtggagcctctgtcaacttcactccccagaacgggatcacgccattacatatagcatctaggcggggaaacgttataatggtgcgtttgcttctcgacaggggggcacaaatagagactaagacgaaagacgaactaacacccctgcactgcgctgcgagaaacggccacgtgagaatcagtgagatcctccttgatcatggtgctcccatacaggctaagactaagaacggactgagtcccatacatatggcggcacagggtgaccaccttgactgcgttcggttgttgctgcagtacgacgcagaaatcgacgacatcaccttggaccacttgacgccactgcacgttgcggcacattgcggtcaccatagggtggccaaggtgcttctggacaaaggtgccaaaccaaactcccgggctctgaacggattcactccactgcacatcgcctgtaagaagaatcacgtgcgcgttatggagctcctcctgaagacaggagcgtccattgatgctgtcacagagtccgggttaaccccactccatgtggccagcttcatgggacacttaccaatcgttaagaacttgctgcagcggggtgccagtcctaacgtgtctaacgtcaaggtagaaaccccccttcatatggccgctcgggctggacacaccgaagtcgccaagtaccttttacagaataaggctaaagttaatgctaaggcaaaggatgatcagacccccctgcattgtgcagccagaatcggacatactaacatggttaagctgctcctggagaataacgcaaatccaaacctggctaccacagccggtcataccccactgcatatcgcagccagagagggacacgtggagacagtgcttgccctgttggagaaagaggctagccaggcctgcatgacaaaaaaaggatttacccctctgcatgttgccgcaaagtacggaaaggtccgagtcgctgaactgctgctggagagggatgcgcaccccaacgccgctggaaagaacggattaacgcctctgcatgtagcagtgcaccataataatctggacatagttaaactattgttgcctagaggcggaagtccacacagcccggcatggaacggttacacccccctgcacatcgcagccaagcaaaaccaagtagaggttgcccgaagtcttctacagtatggcggttccgctaacgctgagtccgtccagggcgtgactccccttcacctggcagctcaggaagggcacgccgagatggttgctttgctcctgtctaagcaggctaatgggaaccttggtaataaaagcgggctaacacccctgcacctggttgctcaggaaggtcacgtgcccgttgcagacgtgctgataaagcatggagtaatggtcgacgccactactcgtatgggatatacgccactccatgtcgcctctcattatggcaacattaaattggtcaaattcttactacagcatcaggccgacgtgaacgcaaagactaaactcggctactccccccttcaccaggctgcccagcagggccacaccgacatcgtgactttattattaaagaatggggcttcccccaatgaggtgagttcggacggtacgacccccctggctattgcgaagaggctcggatatatcagcgttaccgacgtgcttaaagtggttactgatgaaacatccttcgtgctcgtatctgataagcatcgcatgagcttcccagaaaccgtagacgagatacttgatgtctctgaagatgaaggcgaggagctgatttctttcaaggctgagcggagggacagcagggatgtcgatgaggagaaggagctcctcgatttcgtaccgaagctcgatcaggtcgtcgaatcccccgctattcctagaatcccgtgcgcaatgcctgaaactgtggtaatccgcagtgaagaacaagagcaggccagtaaggaatacgacgaagacagccttatcccttccagccccgctactgaaacaagcgataatatttctccagtggctagcccagtgcacaccggcttcttggtgtcttttatggttgacgccagggggggttccatgcgcggatccaggcacaacgggctgcgggtggtcatccctccacgaacttgcgccgcacctacacgcatcacctgtagattagttaaaccgcagaaactctccacacctcctcccttggccgaggaagagggtctcgctagccgtataattgctctaggacctactggtgctcagtttctgagtcccgtgattgtggagattcctcattttgctagccacgggagaggagaccgcgaattggtggtgctaaggtctgagaacggcagcgtgtggaaagaacacaggtcccgttacggcgagtcctacctcgatcagatccttaacgggatggacgaggagctgggctccctcgaagagcttgagaaaaagagggtgtgtcgaattatcacaactgactttccgctttattttgttataatgtccagactgtgccaggattacgacaccatcgggcctgagggaggttctttaaaatccaagttggtgcccctcgtgcaagcaaccttccccgaaaatgcggttaccaagcgagtgaagctggccctccaagcacaaccagtgccggacgagctggtgacaaaacttctcgggaatcaagcaacgtttagtccgatcgttactgttgaaccgagacgcagaaaattccaccgtccaattggcctacgaatacccttaccaccgagctggacagacaatccacgagacagcggcgaaggggatacaacatccctgagactcctttgctcggtgatcggagggacagatcaggcacaatgggaagacattaccggtactaccaagctggtgtatgcaaatgagtgtgctaacttcacaactaacgtctccgccaggttttggctgtcagactgtccaaggaccgccgaggcggtgaacttcgccaccttgctgtacaaagaacttacggccgtcccctacatggccaagttcgttatttttgccaagatgaacgatcctagagaaggacgcctacgatgttactgtatgactgacgacaaagtggacaaaacactagaacagcatgaaaacttcgtggaagtcgccaggagtcgcgatatagaggtgttggagggcatgtctctgtttgctgagctgtctggaaatctggtgcctgtcaaaaaagccgcacagcagagaagtttccattttcagagctttagagaaaaccggctggcgatgcctgtgaaggtacgcgatagctccagggaacccggtggctcactatcctttctaagaaaagctatgaagtacgaagatactcaacacatcctgtgtcatttaaatatcacaatgcccccatgcgcgaaggggagcggagccgaagatcgtcgtcgcaccccaacccccctggctctcaggtactccatactgtccgaatctacaccaggctcactctccggaaccgagcaggcagagatgaaaatggcagtgatctcagagcacctgggcctgtcttgggcagagttagcccgagagttgcagttctccgttgaagatattaaccgcatcagggtcgagaacccaaattcacttttggagcagtctgtggctttattaaatctttgggtcataagggagggccaaaacgcaaacatggaaaatctgtatacagccctccagtccatcgacaggggcgagattgtcaatatgttagaaggatctggcaggcaaagtcgtaacctgaaaccagaccgtaggcacaccgacagagattatagtctatctccttcccagatgaacggatatagcagcttgcaggatgaactcctgtcccccgcttcgcttggctgcgccctatcttcccctcttagggctgatcagtactggaatgaggtggctgttctcgacgcaatccctctcgctgccactgaacacgataccatgctggaaatgagcgacatgcaggtttggagtgccggactcaccccttctctggtgacagcagaagattcatccctcgagtgctccaaggccgaagactccgatgccactgggcacgagtggaaactagagggcgcactgtctgaggagcctcggggtccagagcttgggtcactggagctggtagaggacgacaccgttgacagcgatgccactaacggcctcatcgacctgctcgagcaggaggagggtcagcggtccgaggaaaaacttcccggaagcaaaagacaggacgatgcgacgggggcaggccaggactcagaaaatgaggtctccttagtcagtggtcaccagagaggacaagctaggatcacccacagccccacggtgtcccaagtcactgaaaggtcacaggaccgcctgcaggactgggacgccgatggcagcattgtatcatatctacaggatgctgcacagggctcttggcaggaagaggttacccagggcccacactccttccagggaaccagcactatgacggaaggccttgagccgggtggatcccaggaatacgagaaggtgctggtctcagtgtcagagcacacttggactgagcaaccagaggctgaatcctcacaggccgacagggacaggcggcagcagggccaggaagagcaggtgcaagaggccaagaataccttcacacaggtggtccaaggtaacgagttccagaatatacccggagagcaggtaaccgaggagcaattcaccgacgagcaggggaatattgtgactaagaaggatcacacgagcacaccaaacccata

SEQ ID NO: 214404 - DNA, 5717 bp, Artificial Sequence
  Description of Artificial Sequence: Synthetic coding sequence
atgccatatagcgtgggctttcgggaagccgacgccgcaacttcttttttgagggcggcacgctctggaaatttggataaggctttagaccatctgagaaacggcgtggatattaacacctgtaatcagaatgggctcaatgggctgcaccttgcgtctaaggaaggacacgtgaaaatggtggttgaacttcttcacaaagaaatcattctggagaccacaactaagaagggtaacacagcccttcacatagcagcactcgcaggtcaggacgaggtggtgcgagaattggtcaattacggtgccaacgttaacgcccaatctcaaaaaggtttcacccccctttatatggcggctcaggagaatcaccttgaagttgtgaagtttcttctagagaatggcgcaaaccaaaacgtagcaaccgaggatggtttcacacctttggctgtggcacttcagcagggtcatgaaaacgttgtcgctcacctgattaattatggcaccaaaggaaaggtacggctccccgcactccatatcgcggcaagaaacgacgacacccgcaccgccgcagttcttcttcagaatgaccccaatcccgacgttctgtccaagaccggctttacacccctgcatattgctgcccactacgaaaacctaaacgtggcacagctattactgaatagaggagcaagtgtgaatttcactccccagaacggcattactcctctgcacattgccagccgaaggggcaacgtgataatggtacgactgttgctggaccggggagcccagattgaaaccaaaactaaggatgagttgacccctttacactgtgctgccaggaacggtcacgtccggataagtgaaatcctgctggaccatggggcacccatccaggccaagacaaaaaacggtctctcccctattcacatggctgcccaaggcgaccacctcgattgtgtccgccttctgctgcagtatgacgcagaaattgatgatatcacactggatcaccttacgcctctgcacgtggctgctcattgcggccaccatagggtggcgaaagtactacttgataaaggggctaaacccaactcccgggctctgaatggtttcacacctttgcatattgcctgcaagaagaatcatgtgcgagtgatggaattgctcctaaaaactggggctagcattgacgctgtcactgagtctgggctgactcccttgcacgtggccagcttcatgggacacctgcccatagtgaaaaacctcctccagcgtggagcatcccccaatgtgagcaatgtcaaggtcgagacccccctccacatggctgccagggccggacacaccgaggtggctaaataccttttgcaaaacaaagccaaggtgaacgccaaagctaaagacgaccagactccgttgcactgcgccgctcggattggacataccaacatggtgaagcttctgttggagaacaatgcaaatcctaatctggctactacagcaggacatacacccctccacatagcagcacgcgaggggcacgtggaaacagttttggcccttctggagaaggaagctagccaagcatgcatgacaaaaaagggcttcacgccgttacacgtcgccgcaaagtatggcaaggtacgcgttgccgaactcttgttagagagggacgcccacccaaatgccgcaggtaaaaatgggctcactccattacacgtagccgttcaccataataacctggacatcgtcaagctcctgctcccacggggtggctcaccgcacagccctgcatggaatggatacacaccactccacatagcggctaaacagaatcaggtggaggtcgctcgctctctcctccagtatgggggaagcgctaacgccgagtcagtccagggggtgacacctcttcacctggccgcacaggaagggcacgctgagatggtggccctcctcttgtccaagcaggcgaatgggaacctcggcaataaaagcggacttactccgctgcacctggtggctcaggaaggccatgttccagtggccgatgtgctcataaagcacggagtgatggtcgatgcgaccactagaatggggtatacccctttacacgtagccagtcattatggcaatataaaactggtgaaattccttctccagcatcaggccgatgtcaacgcgaaaaccaagctgggatatagtcccctacaccaggctgcccagcaaggccatactgatattgttacgttgctgctgaagaatggagcctctcctaacgaagtttcatcggatgggacaacccccctggcaatcgccaagcgactgggttacatctccgttacagacgtgctaaaggtagtcaccgatgagacctcgttcgttctcgtgtccgacaagcacagaatgtccttcccagaaaccgtggacgagatcctggacgtgtccgaggacgagggtgaggagttgatctcgtttaaagctgaacgtcgggatagtcgtgatgtcgatgaggagaaagagctccttgattttgtccccaagttagaccaggtggtggagtcccccgcaatacctcgcattccgtgcgccatgcccgaaaccgtggtaattagaagcgaggaacaagagcaagcaagtaaggagtacgatgaagactctctgatccccagctcccctgcgaccgagacctcggataacatatctcctgtggcatcccctgtccacacaggtttcttggtaagctttatggtagatgcaaggggtggatctatgaggggcagtcgtcataacggcctgagagttgtcatacctccgcgaacatgcgctgcacctacaagaataacttgcaggctcgtaaaaccacagaagctgtctactccaccaccattggcagaggaggaggggctggcatcacgtatcattgcactcgggcctaccggcgctcaattcctgtctcccgttatagtagaaatccctcacttcgcaagccacggccgtggggacagggagcttgtggtgctgaggtctgagaatgggtctgtgtggaaggaacatagaagcaggtatggggagtcatatttggatcagatcttaaacggaatggacgaagagcttggatccttggaagagttagagaaaaaaagggtgtgcaggatcattacaacagatttcccactttatttcgttatcatgtctaggctgtgccaagactacgacacgataggcccagagggcggatcattgaagagcaagctggttcctcttgttcaggccacattcccagagaatgccgtaacaaagagggtaaaactcgccctgcaggcacaacccgtgcccgacgaactcgttacgaagctgctggggaatcaggccacattttcaccaattgttacagtggagccacggaggcggaaatttcatcggccaataggccttaggatccccctgccaccctcgtggaccgataatccgcgtgattccggggaaggggatacaacttctctacggttgctgtgcagcgtaataggtggcacagatcaggcccagtgggaagatatcaccggaaccaccaaacttgtgtacgcaaatgagtgcgccaattttaccactaacgtgtctgcacgattttggctatccgactgtcccaggacggccgaagcagttaatttcgctactctgctttataaagagttaaccgccgttccttatatggccaaatttgtcatattcgctaaaatgaacgatccaagagaaggtcgcctgcgctgttattgcatgactgatgacaaggtggataagactctggagcaacatgagaacttcgtagaggtcgcccgttcccgcgatatcgaagtgctggaaggcatgtcgctgttcgcagagctaagcggaaacctcgtccctgtgaaaaaagccgcacagcaaaggtcctttcatttccaatcattccgcgagaatagacttgctatgcctgtgaaggtgcgggattcctccagggaaccgggtggttcactttccttcctgaggaaggctatgaagtatgaggacactcagcacatcctctgtcacctgaacattactatgcccccatgcgctaaaggatccggtgcagaagatcggcgtcgaacccccaccccactcgccctgcgctattccattctgtcagagtcaactccaggaagcctgtcaggaaccgaacaagccgagatgaagatggctgttatttcggagcacttggggctgtcctgggcagaattagctagggagctgcagttttctgtggaagatatcaatcgcattagggtcgagaatcctaattctttgttggagcagtctgttgccctgctgaacctgtgggtcatcagagaagggcaaaacgccaatatggaaaatctgtacacagctttgcagtctattgatcggggtgaaattgtaaacatgcttgaaggcagcggcaggcagagccgtaacttgaagcccgacaggcgccataccgatcgtgattacagtttaagtccgagccaaatgaatggctactcctctctgcaggacgaactgctcagtccagcttctctgggctgcgccctgtcctcgcctttacgagctgaccagtattggaatgaagtggccgttctggacgctataccactggccgctaccgagcatgacacaatgctggaaatgtcagatatgcaagtttggtctgctgggctgactccttcactggtgaccgccgaggactctagccttgaatgttctaaagcggaggatagtgacgccaccgggcatgagtggaagcttgagggagcactctctgaagaacctcggggacctgagttaggaagcttagagctggtcgaggacgatacggttgactccgatgctaccaacggactgatagacctcttagagcaggaggagggtcaaaggagcgaagaaaaactccctggctcgaaacggcaggatgatgcgaccggggcaggccaggatagcgaaaacgaggtctccttagttagtggccaccagcggggacaggcaagaattacgcactcccccacggtctcccaggtaaccgagcgcagccaggatcggctgcaggactgggatgccgacggatccatagtgagctatctgcaggacgctgcccagggctcttggcaggaagaggtgacccaagggcctcacagctttcagggtacttcaacaatgacagagggtctggaacctggaggctctcaagagtacgagaaggtcttggtgagcgtgtcagagcatacttggactgagcagccagaggcggaaagctcccaagctgatcgcgatcggagacagcagggccaggaggagcaggtgcaggaggcaaaaaacactttcacccaagttgtgcaaggaaacgaattccaaaatatacctggagagcaggttactgaagagcaattcacagatgagcagggaaatatcgtcactaaaaaaataattcgtaaagtggtccgacagatcgatctatcctccgccgatgccgctcaggagcatgaagaggtcacggtcgagggccctctcgaagacccgagtgagctcgaggttgacattgactactttatgaagcattcaaaggttgaattgcgcggatccggcctgcagcctgacttgattgaaggaaggaagggcgctcaaattgtcaagcgggcaagtctgaaacggggtaaacagta

SEQ ID NO: 214405 - DNA, 5420 bp, Artificial Sequence
  Description of Artificial Sequence: Synthetic coding sequence
atgccttattcagtcggcttccgggaagccgacgctgcaacctcttttttaagagctgctagatcaggcaacctggacaaggcactggatcacctgaggaacggggttgacattaatacatgtaatcagaatgggctgaatggattgcatctggccagcaaagaggggcatgttaagatggtggtcgagctgttacacaaggaaataattcttgagacaaccacaaaaaaggggaacacagcgcttcacatcgcagctcttgctggccaggatgaggtcgtacgggagctggtgaactatggggcaaatgtcaacgctcaatctcagaaagggtttacaccgctgtacatggcagctcaagaaaatcatttggaagtagttaagttcctgctggagaatggggcaaaccaaaacgtcgctacggaggacgggttcactcctctggccgtcgctttacagcagggccacgaaaatgttgtggcccacctgataaattacggcaccaaggggaaagttcgccttccagcgctccatatagccgcaagaaatgatgacacccgcactgcagcagttctcctgcagaacgatcctaacccagatgtcctgagtaaaactggatttactcccttgcacatagccgcacactacgaaaacctcaacgttgcccagctgctcctaaataggggagcatcagtgaacttcactccccagaatggaatcacacccctccacatcgcaagtcgtcggggaaacgttatcatggtgcgattgttgctggatcggggagctcaaatagaaacaaagacaaaagacgagcttacccccctacattgcgcggctagaaacgggcatgttagaatttccgagattctcctcgaccacggggctcccatccaggcaaaaactaaaaacggcctctctcccattcatatggcggcacagggtgatcatctggactgtgtgcgacttcttctgcagtacgacgccgaaattgatgacattactctggaccatttgacacctttacacgtggcagcccactgtgggcatcatagagttgccaaggttctccttgataagggcgcaaagccaaattccagagcactcaatggatttacaccactgcacatagcttgtaagaagaatcacgttcgggtgatggagctactgctgaaaaccggagcaagtatcgacgcagtgaccgaatctggattgacccccctacatgttgcctcatttatggggcacctgcctattgtcaaaaacctgcttcagaggggagcaagccccaacgtgagtaacgtcaaggtggagacccctctgcatatggccgctcgagccggtcatacagaagtggcaaaataccttctgcagaacaaagctaaagtgaatgcgaaagcgaaggacgatcagacccccctgcactgcgctgcacgtatcggccacacgaacatggtgaagctgctgctggaaaacaacgctaaccctaatctagcaaccaccgctgggcacaccccactccacatcgctgctcgcgagggccacgtggagaccgtgctggccctccttgaaaaagaggcaagccaagcgtgcatgactaaaaaggggtttacccccctccatgttgccgcaaaatacggaaaggtgcgcgtagctgaattgctacttgagagagatgctcaccccaacgctgcagggaaaaacggtcttacaccgctccatgtggccgtgcaccacaataacctcgacattgtgaaactccttctgcctcggggaggatcccctcacagccccgcttggaacgggtacacacctctgcatatagccgctaagcagaaccaggtggaggttgccagatcacttctccaatacgggggaagcgcgaatgccgagtccgtgcagggcgtgacccctcttcacttggctgcccaggagggacacgccgagatggtggccctgcttctctccaaacaagcaaatggcaacctgggaaacaaatccggtctcactcccctgcatctagtggcccaggagggacacgtccccgttgctgacgttttaatcaagcacggcgtcatggtagacgctactactagaatgggatatacaccgctccacgtggcctcccactacggcaatattaagctggtgaagttcttgctccagcaccaagcggatgtgaacgccaagaccaagctgggatactcacccttacaccaagctgcccagcagggccacacagatatagtcaccctgcttctgaagaacggcgcatctcccaacgaggtgagtagcgacggaaccactcctctcgcgattgcaaaaaggctggggtacatctcggtcactgacgtgttaaaggtagtcactgatgagacctcgttcgtgttggtgtctgacaaacatcgaatgtcgtttccagaaactgtcgatgaaattcttgacgtaagcgaagacgagggtgaagagctgatctctttcaaggccgagaggcgcgattcccgggacgtggacgaagagaaggaactcctcgattttgttcctaagttggatcaggtcgttgagagccccgcaataccgcgtatcccatgtgcaatgcccgagaccgttgtaattcggagcgaggagcaggaacaggccagcaaggagtatgacgaggactccctgattccaagttctccagcaaccgagacatccgataacatcagccccgtggcatccccagtgcacacaggcttcttggtttcttttatggtggacgccagaggcggatcgatgcgcggaagcagacacaatgggctgagggtggtgatacccccacgtacttgtgccgcacccacgaggattacctgtagactagtgaaaccccagaaattatcaacaccaccgcctctagctgaagaggaaggactggcctcacgcattattgctctgggacccaccggggcacagttcttgtctccagtgattgtggaaatcccacatttcgcatctcatggtaggggagatagagagcttgtggttctgcggagcgagaacggttctgtgtggaaggaacaccggtcccgctacggcgaaagctatctcgaccaaatcctgaacggaatggatgaggaattaggcagccttgaagaattggagaaaaagagagtgtgcaggatcatcactacggacttccccctatattttgtgatcatgtcccgcctatgccaggactacgatacaatcggccctgagggaggttctctgaagtctaaacttgttcccctcgtgcaggccacatttcccgagaacgcggttaccaagagagttaaactcgctttgcaagcgcagccagtccctgacgaacttgtcacgaaattacttgggaaccaagctactttcagtcccattgtcactgtagaacctagaagaagaaaatttcaccggcctatcggtctgagaattccactgcccccatcctggactgacaatcctcgcgacagcggggaaggtgacacaacctccctccgattactctgcagtgtcattgggggaacggatcaggcacagtgggaagatataaccggtaccactaagctggtctacgccaacgaatgtgctaattttacgacaaacgtaagtgcaagattttggctttccgattgccctagaaccgctgaagccgtgaattttgctacactgctatataaagagctgaccgcggttccgtacatggcaaagttcgttatcttcgcaaagatgaacgacccccgagagggaagacttcggtgttattgcatgacggacgataaagtagataagacgctggagcagcacgagaacttcgtggaagttgctagatcaagagacattgaggtgctcgagggaatgagtctgttcgcagagctgtcagggaatcttgtgccggtgaaaaaagctgctcaacagagaagctttcattttcagagtttcagggaaaataggttggccatgcctgtcaaggtccgggactccagtagggaacctggcggttcactgagcttcctgaggaaggccatgaagtatgaggacacgcagcacattctgtgccatctgaatataaccatgcccccatgtgcaaagggatccggcgctgaggacaggagacggacacccacccctctggccctacgctactccatcctgtcagaatccacccccggatccctgtcaggcacagaacaagctgagatgaagatggctgtgatcagcgaacatctgggtctgtcatgggcagagcttgcgagggagctgcagttctctgttgaggacataaatcggattagggtcgaaaatcctaactctttgctagaacaatccgtggcgctgttaaatctctgggttattcgcgaaggccaaaatgctaatatggagaatctgtatacggctttacagagcatagaccggggtgagattgtgaacatgctggaaggcagtggccgacagtctcgcaatctgaagcccgacaggcgtcacacggaccgcgactactccctctctccatctcagatgaacggctactcgtctctccaagacgagctattgagtcccgcttctctcggctgcgcccttagctctcccctgagggcagaccagtattggaacgaggtagccgtcctcgacgctattcccctcgccgctaccgagcacgacactatgttagagatgtcagatatgcaggtttggtcggccggtctgactcccagcttggtcaccgctgaggattccagcctggagtgcagcaaggctgaggatagcgacgctaccgggcatgaatggaagttggagggggcactgagtgaagaacctcgcggacccgagcttggcagcctggagttggttgaggacgacaccgtggacagtgacgcaacaaatgggctaatcgatttattagagcaggaggagggacaaaggagtgaagaaaagctgcctggctctaaacggcaggatgatgcaaccggcgctggtcaggattccgagaacgaagtctctcttgtatctgggcaccagcgtggccaggcaaggattacgcacagtcccactgtctcccaagtaactgagcgttcccaggataggttacaagactgggacgctgatgggtcaatagtaagctaccttcaggacgctgctcaaggtagctggcaggaggaagtgacgcaaggtcctcactcgtttcagggaactagtaccatgacagagggcctggaaccgggaggcagccaggaatacgagaaggtgcttgtttctgtgagcgaacatacctggaccgagcagccagaagctgagtcaagtcaggcggacagggatcgaaggcagcagggacaagaggaacaggtacaggaagctaagaatacctttacacaggtggtccaggaccacacgagtactcctaacccata

SEQ ID NO: 214406 - DNA, 330 bp, Artificial Sequence
  Description of Artificial Sequence: Synthetic coding sequence
atgtggacattcgtcacacagctgttggtaaccctggtgctgctgagtttctttcttgttagttgccagaacgttatgcacattgtacgtggttccctctgtttcgtgttgaaacacatccatcaggagcttgacaaggaattgggagaaagtgaaggactctccgatgacgaggagacaattagcaccagggtggtaaggcgacgagtgtttctgaaaggaaatgaatttcagaatatccctggcgaacaggtcactgaagaacagttcactgacgagcagggaaacatcgtgaccaaaaaagatcatactagcacaccgaacccttag

SEQ ID NO: 214407 - DNA, 11775 bp, Artificial Sequence
  Description of Artificial Sequence: Synthetic coding sequence
atgatgaatgaggatgcagcccagaaatcagacagtggggaaaaattcaacggctcctcccaacgcagaaaacggcctaagaagtcagattcaaatgcatcgttcctgagagccgctcgtgcgggaaatctagataaggtcgttgagtatctgaagggtggtatagatatcaacacgtgtaaccagaacggcctcaacgctctgcacctcgcagcgaaagaaggtcacgtgggtttggtgcaggagttactagggagaggctcctcggtagactccgcaaccaaaaaaggaaatacagctctccatattgctagcctggccggacaggccgaggtggtgaaagtactcgtgaaagaaggtgctaacattaacgctcaatctcaaaatggtttcactccactctacatggctgcgcaggagaaccacatagatgtggtaaaatacttgctggagaacggagctaatcagtcaacggctactgaagatgggtttactcccctggctgtggcccttcagcagggtcacaatcaagccgtcgccatacttctggaaaatgatacaaagggcaaggtcaggttgcctgccttacacatcgcagcacgaaaagacgatactaagtccgccgcactgcttctccagaatgatcataacgctgacgttcagtccaagatgatggtgaaccgaactacggaaagcgggttcacccccctgcacattgccgctcactatggaaatgtcaatgtggccaccctgttgctcaatcgcggagccgctgtggacttcacagccagaaatggtatcacccccttacatgtcgcatcaaagaggggcaacacaaatatggttaagttgctcttagacaggggcggacagatcgacgccaaaacccgcgacggcctaactccactgcactgcgccgctcgctctggtcacgatcaggtggttgaacttctcctggagcggggagctcctcttcttgccaggacaaagaatggactgtcccccctacatatggccgcacaaggagatcatgtggagtgcgtgaaacatctgctgcagcataaagcacccgtcgatgatgtcacactcgattatctcaccgccttacacgtagcagcccattgcggacattacagggtaactaaattgcttctagataaacgggcaaaccctaatgcacgcgctctcaacggttttacgccgttgcacatagcctgtaaaaagaatcgaattaaagtaatggagttgcttgtcaagtacggagccagtatccaggcgatcaccgaaagtgggctgacacccattcatgttgccgcattcatggggcacctgaatatcgtcctgctcctgcttcagaatggggcaagccccgatgtcactaatatcaggggcgaaaccgccctccatatggctgctcgcgctggacaagtggaagtggtgagatgcttattgagaaatggggcactggtagacgcacgagcaagagaggagcagacccctctgcatatagccagccgacttggtaaaacagaaattgtgcaactgctattgcagcatatggctcacccagacgctgctaccacaaacggttacacaccactgcatatttcagctcgggaaggacaggtcgacgtcgcctctgtacttcttgaggccggtgctgcacactctctggccaccaaaaaaggctttaccccactccatgttgccgctaagtatgggagcctggacgttgccaagctgcttctgcagcgtcgggcagcagccgattctgcaggtaaaaatggactcactccccttcacgttgcagctcattatgacaaccagaaagtggcattactgttactggaaaaaggcgcaagtccacacgcaacagccaaaaatggttacacacccctgcatattgctgccaaaaagaaccagatgcagatcgcttcaaccctcctaaactacggagctgagaccaatattgtcaccaaacagggcgtgaccccgctccatctggcctcccaggaaggtcataccgacatggtgacgctgctgctggacaaaggggcaaacatccatatgtcaaccaagtctgggctgaccagcttacacttggctgctcaggaagacaaagttaacgtagctgacattttgactaagcatggtgccgaccaagacgcccataccaagcttggatacacgcctctgattgtagcctgccactatggtaacgtgaaaatggtaaactttctgctgaaacagggcgctaatgtgaacgcgaaaactaagaatggctatacgcccctgcaccaggctgctcagcaggggcatactcacattatcaatgttctgctccaacacggggcaaagcccaatgccacaacagctaacggcaacactgccctggctatagccaaacgactcggctatatcagcgtagtagatacgctgaaggttgttactgaagaggtgacaacaaccaccactactattacagagaagcataaattgaatgtgccagaaactatgactgaggtcctcgacgtcagcgatgaggagggcgacgataccatgacgggcgatggaggagaatatctcagaccagaagaccttaaggagttaggggacgactctctgccttccagtcagtttcttgatgggatgaattatctgcgatattccctggagggcggacggagtgattccctaaggtcttttagctccgacagatctcataccctgagtcacgcctcttatttgcgagactccgcagttatggatgacagcgttgtgatcccctctcaccaagtatctacgctggcaaaggaggccgaacgtaattcctaccgcctgtcgtgggggactgagaatctagataatgttgccctgtccagttcccctatccacagcggtttcttggtgtctttcatggtcgacgccaggggcggagctatgagaggttgtagacacaatggcttgaggattattatccccccaagaaagtgtacagcacctactcgtgtgacttgcagactggtaaaacgacacaggctggctacaatgccacctatggttgaaggagaaggcctcgcctcccgactgattgaagtggggccttctggggcacagttcctcgggccagtgatagtagagattccacactttgccgctctgcgtggtaaggagagagagctcgtggtccttaggagcgagaacggggactcatggaaggagcatttttgcgattacaccgaggacgaactgaatgaaatcctgaacggcatggatgaggttttggacagtcccgaagatctggagaagaaaaggatctgtcgaataattaccagggatttcccccagtatttcgctgtcgtgagtcgaatcaagcaggatagtaatctgattggtcccgaagggggagtgctgagttccacagttgtgccccaagttcaggccgtctttccggaaggcgctctgaccaaacggatccgtgtcgggttgcaggcccagcctatgcactcagaacttgtaaagaagatcctgggaaacaaagccactttctctcctatcgtgacactcgagcctcgaaggagaaagtttcataaacctataacaatgacaattcctgtgcctaaggcctccagcgacgtcatgcttaatggttttgggggagatgcacccacactgaggttactctgctctataaccgggggaactactccagctcaatgggaggacattaccggaacaactcctctcacattcgtaaatgagtgtgtgagcttcaccacgaatgtctctgccagattttggctcatcgattgcagacagatccaagagagtgtcaccttcgcttctcaggtgtatagggagataatatgtgtgccttatatggctaaatttgtcgtattcgctaagagtcatgatcccattgaagctaggctgcggtgtttttgcatgacagacgacaaagtagacaagaccttggaacagcaggagaattttgccgaggtggcccgttctcgagacgtggaagtgctggaaggcaagcctatctatgtcgactgcttcggcaacctcgtccccctgaccaaatctggccagcaccacatcttttccttcttcgccttcaaggaaaaccgcctgcctttgttcgtcaaggttagagacacaacacaggaaccctgtgggaggctgagcttcatgaaagagccgaagtctacacgagggcttgtgcatcaagctatatgcaatttgaacattaccctgccaatttacaccaaagaatccgagagcgatcaggagcaggaagaggagattgacatgacttctgagaaaaacgacgagaccgagtccaccgaaactagtgtactaaagtcccatctggtgaacgaagttcctgtacttgcttcgcctgacctcctgtctgaagtgtctgagatgaaacaagatctgatcaaaatgactgctattctgacaactgacgtgtctgataaggccggatccatcaaggtgaaggagcttgttaaggccgctgaagaggagcctggcgagccattcgaaatcgttgagagagtgaaggaggatctggaaaaagtgaacgagattctccgctccgggacctgtacgagagatgagtcatcagtgcagtctagcaggagtgaacgcggtctagtggaagaagagtgggtgattgtgtcagatgaagagattgaggaagcaagacagaaggccccactagagatcaccgagtatccctgcgtggaggtgaggatcgataaggagattaaggggaaggtggaaaaggatagcacgggcctggtcaactatctgaccgacgacctgaacacgtgtgtccctctgcccaaggaacagctgcagacagtccaagacaaggcgggaaagaagtgtgaggctctggccgtcggtcgatccagcgagaaggagggcaaggacataccgcctgatgagacacagtctacgcagaaacagcataaaccctccctgggaataaagaaacccgtgcgcaggaaactcaaggagaagcagaaacagaaggaagaaggactccaggcctccgccgagaaggccgaactcaagaaggggagttcagaggagagcctgggggaggatcccggactcgcccctgagcctctgcctactgtgaaagccactagtcctctgattgaagaaacccccattggctccattaaagataaggtaaaggccctacagaagagagtggaggatgagcagaagggtagatctaaactgcctatccgcgtgaaaggtaaagaggacgttccaaaaaaaaccactcatcgaccacatcctgcggcttccccaagtctaaaatcagaaagacacgctcccggttctccaagtcccaagaccgagagacacagcactctcagctctagtgccaaaacagaacgccacccacctgtgagtccttctagtaaaactgaaaagcactcccctgtgtcgccaagtgctaagaccgagcgacattcccctgcctcgagtagttccaagacagagaagcatagcccagtttcccctagcacaaagactgaaaggcacagccccgtgagctctacaaagacagaacgtcatccgcctgtatctccatcgggcaagacagataaacgaccacctgtgtcaccttctgggagaactgaaaagcaccctcccgtgtcacccggtagaaccgagaagcgcctccctgtaagcccctccggacgaaccgacaaacaccaacctgtgtccactgccggtaagacagaaaagcatttaccagttagtccaagtggcaaaacggaaaaacagccacctgtgtcacctactagcaaaaccgagaggattgaggagactatgtctgtgcgagagctaatgaaggcttttcagtctgggcaggacccttctaagcacaaaactggcctgtttgaacacaaaagcgctaagcagaagcagccacaagaaaagggaaaggtgcgtgtggagaaagaaaagggccctatccttacgcagagagaggcacaaaagacggagaatcaaacaattaaaaggggacagcggctgcccgtgacagggacagccgagtcaaagagaggcgtcagagttagctcaatcggcgtaaaaaaagaggatgcagctggagggaaagagaaagtactgagtcataagattcctgagcccgtgcagtcagtgccggaagaggaaagtcatcgcgagtccgaggttcccaaggagaagatggcagacgagcaaggcgacatggatctccagatttccccagaccggaagacaagcacagatttttctgaggtgattaaacaggaacttgaggacaatgacaagtaccagcagttccgtcttagtgaggaaaccgagaaggctcaattgcacttggaccaagtgctcaccagtcccttcaacacaactttcccacttgactatatgaaggacgaatttctgcccgcattgtctttgcagtcaggggcacttgacggttcctctgaaagcctcaagaacgaaggggtggcagggtccccctgcgggtctctcatggagggaaccccccagatatccagcgaagaaagctataagcatgagggtttggccgaaacgcctgagaccagtcccgagagtcttagtttctccccgaaaaaatctgaagagcaaaccggagaaaccaaggagagcaccaaaaccgaaacgaccaccgagatcagatccgaaaaagagcacccgacaacaaaggacattaccgggggatctgaggaaagaggtgccactgttaccgaagatagcgagacttcgacagagtctttccagaaggaggccactcttggatcgccgaaggacacgtcccctaagagacaggacgactgtactgggtcctgttctgtcgccttggccaaggagacccctaccggtcttactgaagaggcggcttgcgatgaaggtcagaggacgtttgggagctccgctcataagacccagactgattccgaggtgcaggaaagtactgccaccagtgatgagacaaaagccctgccgcttcccgaggcttccgttaaaaccgacaccggcaccgaatctaaacctcagggtgttatccgctcaccgcaaggactggagcttgcgcttccttcacgggattcagaagtgctcagcgccgttgcagatgattcactcgcagtgagtcataaggattcgcttgaggcgtctcctgttctggaagacaacagcagtcacaagacccctgattcactggagccttctccattgaaagagtcgccttgtcgcgattccctggaatccagtcctgtggagccaaagatgaaggccggaatctttccatcccacttcccattgcccgcagccgtggcgaaaaccgagttgttaacagaagtcgcaagcgtgaggtcccgtctgttacgcgacccagacggctccgctgaggacgactcccttgagcagacttccctcatggagagttccggaaagtctcccctcagcccagataccccgtcatctgaagaagtcagctacgaagtcacccctaaaacaacggacgttagcactcccaaaccagcggtcattcacgaatgtgccgaggaggacgacagtgaaaatggcgaaaaaaagagatttacacccgaggaagaaatgtttaaaatggtgaccaaaatcaaaatgttcgacgaacttgaacaggaagcaaaacaaaagcgtgattacaaaaaagaacctaaacaggaggaaagtagcagctccagtgacccagacgccgattgttctgtggatgtggacgagcctaaacacaccggttccggagaagacgagtccggagtgcccgtactagtgacatctgaaagcagaaaggtctcttccagcagtgaatcagaacccgagctggcgcaactgaaaaagggcgctgacagcggccttcttccagagccagtgatcagagtgcagcctcctagccccctgccctcctccatggactcaaatagctctcccgaagaagtccagtttcagccagttgtttctaagcaatacacctttaagatgaacgaggacacccaggaggagcccggtaaatccgaggaggagaaggacagtgaaagtcatctggcggaagacaggcatgccgtgtctacagaggctgaagatagatcttatgataagcttaaccgtgacaccgatcagcctaagatttgcgatgggcatggctgtgaagccatgtccccgtcaagtagcgccgcacctgtgtcttccggtttgcagtcccctacaggcgatgacgtcgatgagcaaccagtaatttataaggaatcattggccttgcagggtactcacgagaaggataccgagggagaagaactggatgtgtctagagcagaaagccctcaagctgattgtccaagcgagtccttttccagctccagctccttgccacactgccttgtatcagagggaaaagaattggatgaggatatctctgcaaccagttctatccagaaaactgaggtaaccaaaaccgatgagacttttgagaatcttcccaaggattgtcctagccaggattccagtatcaccacacaaaccgaccggtttagcatggatgtcccggtttccgatctggccgaaaacgacgagatatatgatccacagattacctcaccttatgagaatgttccatctcaatcttttttcagttcagaggaatccaaaactcagactgatgcaaaccacaccacatcctttcactccagcgaagtttacagcgtgactattactagccctgtcgaggatgtagtcgtggcctcctcctccagcggaaccgtgttgtccaaagagagtaattttgagggtcaggatatcaagatggagtctcagcaggaaagtaccctgtgggagatgcaatccgactcggtgagctcatcgttcgagccaacaatgagcgctactaccactgtggtgggcgaacagatatcgaaggtcatcatcacaaagaccgacgtggactctgattcatggtctgagatcagagaagatgatgaggcgttcgaggctcgagtaaaagaagaggagcaaaagatattcggcctgatggtcgatcgacagtcccagggaaccacccccgacaccaccccagccaggacacccaccgaagaaggcacaccaacaagtgaacagaatccattcctgttccaggagggcaaactgtttgaaatgactaggtcgggggctatcgatatgaccaagcgaagttatgctgacgaatccttccacttttttcaaattggccaggaatctagagaggaaacattgagtgaggacgttaaagaaggcgctacaggcgctgacccactgcccctggaaaccagcgccgagtcactggccctgagcgagtccaaagagacggtggatgatgaagctgacctcttacctgatgacgttagtgaggaagtagaagagatcccggctagtgacgcccagttaaactcgcaaatgggaatctccgcgagtactgagacacccaccaaagaggccgtgagcgtcggaaccaaggatcttccgaccgtgcagacaggggacattccgcctcttagtggcgtcaaacagatatcatgccctgactccagtgagcccgctgtgcaggtgcagcttgatttttcgacactcacaagatccgtctacagcgaccggggtgacgacagtcctgacagctctcccgaggagcaaaaaagcgtcatcgaaattccgactgcccctatggagaatgttcctttcactgagtccaagagcaaaattcctgtgaggacgatgcctacgtcaacgcccgctccacctagcgcagaatacgaatccagcgtgagcgaagacttcctgtcttccgtggatgaggagaacaaagcagacgaagcgaagcctaaaagtaagttgccagtcaaagtgcccctgcagagggtcgaacaacagctgagcgatcttgacacgtctgttcagaagactgtggcacctcaaggccaggacatggcctctatcgctcccgataatcgatcgaaaagtgagagcgacgctagctccctggattccaagaccaaatgtcccgtgaagaccagaagttacacggaaacagagaccgaatcacgtgagagagcggaggagttggaactggaatccgaagaaggcgcaactaggcctaagattctgacctcgcggcttcccgtcaagtctcgatctaccacaagctcttgtcggggtgggacttccccaacaaaggaaagcaaagaacatttctttgacctctacagaaacagcatcgaattctttgaagaaatcagcgatgaagcatcaaaacttgtcgaccgcctgacccagtctgagcgggagcaagaaatagtgagcgacgacgagtcttctagtgctctggaggtgagcgtgatcgagaacctgccaccggtggagaccgagcatagtgtccccgaggacatctttgatacaagacctatttgggacgagagcattgaaaccctcatcgagcgtatcccagacgagaacgggcatgaccatgcggaggaccctcaagacgaacaggaacgcatcgaggagaggctcgcctacatcgccgaccaccttggtttcagttggacggagctggcacgcgaactcgactttactgaagagcagattcaccagattcgcattgaaaacccaaatagtctccaggatcaatctcatgctctgctgaagtattggctagaacgggacggaaaacatgctacagatactaatttagtggagtgtctcactaaaatcaatcgcatggacatagttcatctgatggagacaaacactgagcccctccaggagcgcatttctcactcttacgccgagattgagcaaactataacactcgatcactccgaaggattctccgtcttgcaagaagagctgtgcacggcacagcataagcagaaggaagaacaggccgtatccaaggagtcagagacctgcgatcatcccccaatcgtgtcagaggaggacataagcgtgggttatagcaccttccaggatggggttccgaagaccgagggtgatagtagtgctactgcccttttcccccaaactcataaggagcaggttcagcaggacttctctggcaaaatgcaggatctgcctgaagaaagcagcctggagtatcagcaagagtatttcgtgaccactcctggcacggaaacctctgagactcaaaaagcgatgatcgttccttccagccctagcaagacccccgaggaggtgtctacacctgcggaagaagaaaagctgtatctgcagacgcccaccagcagtgagcggggaggatccccaattatccaagagcccgaagaaccctcagagcaccgcgaggaatcatcaccaaggaagacatctttggtgatcgtggagtcagctgacaatcagccagagacctgcgagaggctggatgaagacgctgcatttgaaaagggcgacgacatgcccgagatccctccagagactgtcaccgaggaagaatacatcgatgaacatggccataccgtagtcaagaaggtcacgcgcaaaatcataaggagatacgtctcatcagaaggcacagaaaaagaggaaatcatggtccagggcatgccacaggaacctgtgaatatcgaagaaggggacggatacagtaaagtgatcaagagagtcgtcttgaagtccgacaccgaacagtccgaggacaacaatgagtat

SEQ ID NO: 214408 - DNA, 5591 bp, Artificial Sequence
  Description of Artificial Sequence: Synthetic coding sequence
atgtcacaccacattcaaaggtcggacagcaatgcctccttcctgagagctgccagggcaggcaacctggataaagtggtcgagtatttgaagggcggtatcgacattaatacatgcaaccaaaacggactgaacgccctgcatctggcggctaaggaggggcatgtgggcctggtgcaggagttactgggccgtggctcttccgttgattctgcgactaaaaagggtaataccgccctccacattgcctctttagcgggacaggcagaggtggttaaggtcctggtgaaggagggggcaaatattaatgcccaaagccaaaacggatttacacctctctatatggcagcgcaagaaaatcatattgatgtggtcaagtaccttctggagaacggagccaaccagtcgacagccacggaggacggttttactcccctggccgtggccctgcagcagggccataaccaggctgtagctattctgctggaaaatgacaccaagggcaaagtgcgcttgcccgcactgcacatcgctgcacggaaggacgacactaaaagcgcagctctattattacaaaacgatcacaatgcagatgtgcagagcaagatgatggttaatcggacaaccgagagcggattcacacccttacacatcgctgcccattacggtaatgtgaatgtggccactctgctgttgaatagaggcgcagccgtcgatttcacagcgcgaaatggcattaccccccttcacgtcgcctcaaaaagaggaaacacaaatatggtgaagctcctccttgaccgtgggggacagatagacgccaaaaccagggacggactgacgcctctgcactgtgctgcaagatctggacacgaccaggtggtggagctcctgctggagcggggtgctcccctgctggcaagaaccaagaacggcctcagtcctttgcacatggcggctcagggggatcatgtggaatgcgtaaaacaccttctgcagcacaaggccccagtggatgatgttaccctggactatctgaccgcactgcacgttgctgcacattgtggccactatagagtaacaaaactactgcttgacaagagggcaaacccaaatgccagggccctaaacggcttcacaccactgcacatcgcctgtaagaagaacaggattaaagtgatggaactcctggtgaagtatggggctagcatacaggcaatcactgaaagcgggctgactcctatacatgtcgcggcattcatggggcatctgaatattgttctgctgctgctacagaacggagcgagtcctgatgtgactaatatcaggggggaaactgccctacacatggccgctcgtgctgggcaagtggaagtagtgagatgtcttttgagaaacggagccctggtagacgcaagagcgagggaggagcagacgccactgcacatcgccagccgtctgggaaaaaccgagatagtccaactgctccttcaacacatggcccatccagatgcagctaccaccaacgggtacactccacttcatatctcagcgcgtgagggtcaagtagacgttgctagtgtgcttctggaggccggtgccgcacacagcctcgccaccaaaaagggcttcactcctctacacgttgccgctaagtacggatctctggatgtcgccaagttactacttcagcggagagctgctgctgacagtgccggaaaaaacggtctcacccctctccacgttgccgcacattatgataatcagaaagtcgcattacttcttctagaaaagggcgcatccccccatgctactgctaaaaacggatacacgccactgcatatcgccgcaaagaaaaaccagatgcagattgcaagcaccctactgaattatggagctgaaaccaacatcgtgactaaacaaggagtgactcctcttcatctcgctagccaagaggggcacacggacatggtaaccttactgctggacaaaggcgcaaacatccacatgagcacaaaatccggccttacatctctgcacctggctgctcaagaggataaggtcaacgtagccgatatccttacaaaacatggagccgaccaggatgctcacacaaaactgggttacactccactgatcgtggcgtgccattatggaaacgtcaagatggtgaattttcttctgaagcagggagccaacgtcaatgctaagaccaagaacggttatacccctctgcatcaagccgcacagcaaggacatacacatattattaacgtcctcttgcaacacggagccaagccaaacgcaactactgccaatgggaataccgccctggctatcgccaaaagactcggatacatctccgtcgtggacactttaaaggttgtgacagaggaagtcaccactacaaccactaccataacggaaaagcacaaactgaacgtccccgaaactatgacagaggttctggatgtgagtgacgaggaaggtgacgacacaatgaccggtgacggcggagagtaccttaggcccgaggatctgaaagaacttggcgatgactcacttcccagcagccagttcctcgacgggatgaactacctgaggtatagtctggagggcggacgaagtgatagtctgaggagctttagttcagacagatctcatactctgtctcatgcctcgtatctcagggactccgctgtgatggacgacagcgtggtgataccctctcatcaggtgtcaacactagctaaagaagccgagagaaacagttacaggctctcctggggcaccgagaacctcgacaacgttgcgctatcatctagccctatccattcggggcgagcttcaccctgcctggaacgggacaattccagctttctagtcagttttatggtggatgctcgcggaggggctatgcgcggttgcagacacaatggtctgagaatcatcattccgccacgcaagtgtacagcccctacgagagttacctgtagactcgtgaaaagacatcggctcgcaacgatgcctccaatggtggagggtgagggcctggccagccgcctgattgaggtaggccctagcggggctcagttcctaggcaagttgcatttaccaacagcaccaccgcctctcaacgagggcgagtcactggtgagtaggattctccagcttggacccccaggcactaaattcctcgggccagtgatcgttgaaattccccattttgctgccctgcgcggtaaggaaagagagctggtggtattacggagtgaaaacggcgatagctggaaggaacacttttgtgactacaccgaagacgaattgaatgagattctgaatggtatggacgaggttctggactctccagaagacctcgagaaaaaacgcatctgtcgaatcataacacgagactttcctcagtacttcgccgttgtgagcaggattaaacaggacagtaacctaataggccctgagggcggagtcttatcttcgactgtcgtcccccaagtgcaggccgtttttcctgagggggcattaacgaagagaattagagtgggtttgcaggctcagcctatgcatagcgagctagtcaaaaagatcttgggcaataaagccacgttcagcccaatcgtgacccttgaaccccgacggaggaaattccataagccgatcaccatgacaatccccgtccccaaggcctcctccgatgtgatgctcaacggtttcgggggagatgccccaaccctgaggctcctctgtagtataaccgggggaacaacacctgcgcagtgggaggatatcacgggcactacccctctgacattcgtgaatgagtgtgtgagtttcacaaccaatgtgtccgcgcgtttctggttgattgactgccgccaaattcaagaatcggtcacgtttgcctcccaggtgtacagagaaataatttgtgtgccatacatggctaagtttgtagtctttgctaagagtcatgacccaatcgaggcaaggctgaggtgcttctgcatgacagatgataaggtggataagaccctagaacagcaggagaacttcgctgaggttgcaaggagccgtgacgtggaggtgctcgaaggtaagccaatctatgtcgattgtttcgggaacctggtccctttaacaaagtccgggcagcaccacatattttccttcttcgcgtttaaagagaaccgattaccattgttcgtcaaggtccgagatacaacccaggagccttgcggcaggctgtcttttatgaaggagccaaagtccaccagggggctggtccatcaggccatttgcaatctcaatataaccttacctatttacacaaaggagtctgagagcgatcaggagcaggaagaagagattgggcaagagtcccggaggtatccacaggacgagcaagagaggattgaggagagactggcttacattgctgaccatctgggcttctcctggacggagctggccagagagcttgatttcactgaagaacagattcatcagattaggatagaaaatccaaactccttgcaggaccagagccatgccctgttgaaatactggctggagcgcgacggaaaacacgctaccgataccaacctcgttgaatgcttaacgaagatcaaccgcatggacattgtgcacctaatggagactaacaccgaacctttgcaggagaggatctctcactcctatgccgagatcgaacagaccattacactcgatcactccgagggtttctcagtccttcaggaggagctgtgcaccgcacaacacaagcaaaaggaagagcaagccgtaagtaaagagtctgaaacctgtgaccatcccccaattgtgagtgaagaggatatatccgtaggttactctactttccaagacggggtgccaaagacagaaggtgactctagcgccacagctctgttcccccaaacacacaaggagcaggttcaacaggatttctcgggaaaaatgcaagaccttcctgaggaaagctcgcttgaatatcaacaagagtactttgtcacgacccccggtaccgagacgagtgagacccagaaagcaatgatcgtgccttcaagcccttctaaaacacctgaagaagttagcacaccagccgaggaggagaaactgtatctccagacccccaccagctctgaacgcggagggtctcccatcattcaggagcctgaggagccctccgagcaccgcgaagaatccagtccacgtaaaactagtctggtcattgttgagtccgccgacaatcagcccgaaacatgtgaacgactcgatgaggacgcggcattcgaaaaaggcgacgacatgcctgaaatcccaccagaaaccgtgactgaagaagaatacatcgatgagcatggccatactgttgttaaaaaggtgacccgaaagattatacggaggtatgtctcctcagaggggacagagaaggaggaaattatggtgcagggcatgccccaagagccagttaatatcgaggaaggcgatggctatagcaaggtgattaagagagttgtgctgaagagcgatacagagcaatctgaggattccatggagta

SEQ ID NO: 214409 - DNA, 11874 bp, Artificial Sequence
  Description of Artificial Sequence: Synthetic coding sequence
atgatgaacgaggatgccgctcagaaatctgatagtggggaaaagtttaacggctccagtcagagacgaaagaggcctaaaaagagtgattccaacgcttccttcctgcgagcagctagagcaggtaacctcgataaggtggtggaatatttgaagggtggtatcgatataaacacctgcaaccagaatggtctgaatgcattgcacctggccgctaaggaagggcatgtgggcttggtccaggaacttcttgggcgaggctctagtgtcgactctgctaccaaaaagggaaacacagctctccatatagcttccttggccggacaagccgaggtcgtgaaggtcctggttaaagagggagccaacataaatgcgcaaagccagaacggttttacgcctctgtacatggcagcacaggaaaaccacattgatgtggtgaagtatctcctggaaaacggggctaaccagtctacagctacggaagatggattcacacctcttgccgtcgctctgcagcagggccacaatcaggccgttgccatcctcttggagaacgacaccaaaggaaaggtacgactgcccgcacttcatattgccgcacgcaaggacgacaccaaatcagcagcactgctgctgcagaacgaccacaatgccgacgtgcagtcaaaaatgatggtcaatagaactaccgagtcaggatttaccccactccacatcgctgcgcactacgggaatgtcaatgtggcaacactgctcctgaaccggggtgcggctgtggattttaccgccagaaacggcatcaccccacttcacgtcgcctcaaagagaggtaacaccaacatggtcaagctgctcttggaccgagggggacagatagatgccaaaactcgcgacgggctaactccgcttcactgtgccgctaggtcaggccacgaccaagtagtggaactgctccttgaacgtggcgctccactacttgcccgaaccaaaaacgggctctcacctctccatatggcagctcagggggatcacgttgagtgcgtcaaacacctgctgcagcacaaggccccagtcgacgatgtgacactggactatctcacagcactccacgtcgccgcacactgcggacactatcgggtcacaaagctgcttctggataagcgagccaaccctaacgctcgggcattaaatggcttcactccactgcatatagcttgtaaaaaaaacagaatcaaggtgatggagcttctggtcaaatatggggcttccatccaggcaattactgagagcggcctgactcccatccacgtcgccgcatttatgggacatctcaatatcgtattgctactgctgcagaatggcgctagccccgacgttacgaatattagaggagagactgcactgcatatggcagctcgggcagggcaggtggaagtggttagatgcctcctgcgtaacggagccttggtggacgcacgggctagggaggagcagacacctctgcacatcgcttcccgtctaggcaaaacggaaatcgtccagctacttctgcagcatatggcccatcctgacgcagctactaccaacggttacacacctctgcacatttcggcacgagaggggcaggtggacgtggcgagcgttctcctggaagccggagctgctcactccctggctacgaagaagggtttcactcccctacacgtggctgcaaagtatggttcactagatgtggccaaactgcttctgcagagaagggccgctgctgattccgcgggaaagaatggcttgactccccttcatgtcgcagctcattatgacaatcaaaaagttgccctgctactcctggagaagggcgcatctccacatgccaccgccaaaaacggttacacgcctctccacatagccgctaagaagaaccagatgcagatcgcttccaccctcttgaactacggagccgaaaccaacattgtgacaaagcaaggcgtgacccccctccacttggcctcacaggaaggccacactgacatggtcaccttgcttctggacaaaggcgctaatattcatatgtccaccaagagtggattgacgtcgttacacttggctgcccaggaggataaggtgaatgtggctgatatactcacaaagcacggggcagaccaggatgcacatacaaaattaggctacacacctctcatcgtggcctgccactatgggaatgttaagatggtcaacttccttctgaagcaaggtgcaaatgtaaacgcaaaaacaaagaatggctatactcccctgcaccaggcggctcaacaagggcatacccacattatcaacgtgcttctgcaacacggcgcaaagcctaacgccaccactgcaaacgggaacacagccctagcaatagccaagaggctagggtatatctcagtggtggacacactgaaagtagtgacagaagaggtcactaccacaaccacgacaatcacagagaagcacaagcttaacgttccagagactatgactgaagtgctggatgtctcagacgaggagggcgacgacactatgaccggggacggtggggaatatctccggcctgaggacctgaaagagttaggcgatgattctctgccatcctcccagtttctcgacgggatgaactacttacgctactctctggaggggggaaggtctgacagtcttagaagtttctccagcgatcggtctcacaccctcagccacgcctcatacctgagagatagcgcggtgatggacgactccgttgtcatcccctcacaccaggtgtcaacactggctaaggaggccgagaggaacagctaccgccttagttgggggacggagaacttagataacgtcgctttaagcagctctcccattcactcaggcttcctcgtgagctttatggttgacgctaggggcggagccatgcggggatgtcgacacaacgggctaaggatcattatcccccctcgaaagtgtaccgctcctactcgagtgacttgtaggttggtgaagaggcacagactggctacaatgccaccaatggtggagggcgagggtctggcctcacggctgattgaggtgggtccatcaggggctcagttcttaggcaaactgcacctaccaacagctcccccacccctgaacgagggcgagagcctcgtgtcccgcatattacagctggggccaccaggcaccaagttcttgggccctgtcattgtggaaatcccacatttcgccgctctgaggggcaaagagcgggaacttgtggtattgcgttcagaaaatggcgacagttggaaggaacacttctgcgactatacagaagatgagctcaatgaaatactgaatgggatggatgaggttctcgactcgccagaagatctcgaaaagaagcggatatgtcggatcatcaccagagatttcccacaatactttgcagtggtctcacgcatcaagcaggacagcaatctgataggtcctgagggaggggtgctcagcagcacggtagtccctcaggtccaggccgtttttccagagggagcactcaccaagcgcatcagggtggggctgcaggcccagcccatgcacagtgagctcgtgaagaagatcttgggcaataaggcaacatttagtccaatcgtgacactcgagcccagaagaaggaagtttcataaacctattaccatgaccatacccgtacccaaagcatccagcgacgtcatgcttaacggctttggaggagatgccccaactctccggctattgtgcagcatcaccgggggaaccacacccgctcagtgggaagacattacagggacaactcccctcacctttgtcaatgagtgcgtcagcttcactaccaacgtttcagctcggttttggcttatagactgccggcagattcaggagagcgtgacattcgctagccaggtgtacagggaaatcatctgtgtgccttacatggcgaaattcgtggtgttcgctaaaagccacgatcctatcgaggccagactgagatgcttctgcatgaccgatgacaaggtcgataagaccctagagcaacaagagaacttcgcagaagtggcacggtctcgggatgtggaggtgctggagggcaagccgatctatgtcgattgtttcggaaatctggttcctctcaccaaaagtggacagcaccacatcttctccttcttcgcatttaaagagaacagattaccacttttcgtaaaagtgagagacactacgcaggagccgtgtggccgactcagctttatgaaagaacccaagagcacaaggggtctggtgcaccaagctatctgcaatcttaacataaccctgcctatctacacaaaggagagtgagtccgaccaggaacaggaagaggaaatcgacatgacctctgagaaaaacgatgaaaccgagtcgaccgaaacaagcgtcctcaagagccatctcgtgaacgaggtccctgtgctggctagcccagatctgctctccgaggtgtccgaaatgaagcaggacctcataaagatgaccgctatcctgacaaccgacgtaagcgataaagcagggtcgattaaagtcaaggagctcgtgaaagccgctgaggaggaacctggcgaacctttcgaaatcgtggaacgcgtcaaggaggacttggagaaggtaaacgagatccttcggtccggcacatgtacccgcgacgaatcatcagtgcagagctctcgctcagagcgaggtctggtggaggaggagtgggtgatagtaagcgacgaggagatagaagaggcaaggcagaaggctccgctcgaaattaccgagtatccttgcgtagaggtgcggatagataaggaaatcaaagggaaggtggaaaaggatagcaccggcctggtgaactatttaaccgacgatttgaatacatgtgtgcctttgccgaaggagcagctgcagaccgtacaggataaggcgggaaagaagtgtgaggccctggccgtgggcagatccagcgagaaagaaggcaaggatatccccccagacgaaactcagagcactcagaagcagcataagccctctctcggtattaagaagccagtgaggcgaaagctcaaagagaagcagaagcaaaaggaggagggactccaggcctctgccgaaaaggcagagcttaaaaaaggctcatctgaggaatcattaggggaagacccagggctggccccagagccactgcctaccgtgaaagctacctctccactgattgaggaaactcccatcggctcaatcaaagataaagtgaaggccctgcagaagcgggtggaggacgagcaaaaagggcgatctaaacttccaatcagggtgaaagggaaggaagacgttccaaagaagactactcatagaccccaccccgctgcatcccccagcctgaaaagtgaacggcacgcccctgggtccccctctcctaagacagagcgacactccacactgagcagcagcgctaagacagagcggcacccaccagtctcaccatcaagcaaaactgaaaagcactcccctgtgtctccatctgcaaaaacggaaagacactcccctgcttcctcttcatctaaaacagaaaaacacagtcccgttagccctagcaccaaaactgagcggcattcacccgtatctagcacaaagacggaacggcaccctcctgtttcaccatccggtaagacggataaacgtcctccagtgtctccaagtggacgcaccgagaagcatccgcctgtttctcccggacgaactgaaaagcgcctgcctgtgtctccaagtggcagaactgacaagcaccagcctgtgtcgacggcaggcaaaactgagaagcacctgcccgtttctcctagcggaaagacagagaaacagccgccagtgtcaccaacctccaagacggaaagaatagaggagacaatgtcggtccgtgagctgatgaaggcgtttcagagcgggcaggatccctccaagcataagacgggccttttcgagcacaagtccgccaagcaaaagcagccccaagagaagggaaaggttagagttgagaaggagaagggcccaatcttgacccagagggaggcccaaaaaaccgagaaccagactattaagagggggcaaagactgccagtgactggcaccgcagagtccaaaaggggagttagggtgtcttcaataggggtgaagaaggaggatgctgccggaggtaaagagaaagtgctgagccacaagatacccgagccagtccagtctgtccctgaggaagagtcccaccgcgaatctgaagtgccgaaagagaaaatggcagatgaacagggggatatggacctgcagatcagtcctgacagaaagacaagtaccgacttttcggaggttataaaacaggaactggaagataatgacaagtaccagcaatttagactgagtgaagagaccgagaaggcccaattgcaccttgatcaggtattgaccagccctttcaacaccaccttcccactggactacatgaaggacgaattcctgcctgctctgtccttgcagtcaggggcactcgacggctccagcgagtcattgaagaacgagggtgttgccggttccccatgtggttcactgatggaaggtacaccccaaatctcaagcgaggaatcctataagcatgaggggttggccgagacacctgaaacttcaccggaaagtctgtcttttagtccgaaaaagtccgaagagcaaacaggcgaaaccaaggaaagcaccaagacggaaactaccaccgagatccgatcagagaaagaacacccaactaccaaagatatcacaggcggtagcgaggaacgcggagccactgtcactgaggacagcgaaacctctaccgaatccttccaaaaggaggcaaccctcggttcccccaaggacacttcccctaagaggcaagacgattgcaccggctcatgctccgtcgccttggctaaagaaacccctactgggctgacagaagaagctgcttgcgatgaaggacagaggacattcggctcgagcgctcacaagacgcagactgactcagaagttcaagaatccacagctacatccgatgaaacaaaggcattgccacttccagaggcttccgtgaagaccgatacaggtactgaatccaagcctcagggtgtgatcagatctccccagggattggaactggcactccctagcagagattcagaagtcctctccgctgtggcagacgattccctggctgttagccacaaagatagcctggaggctagccccgttttagaagacaattcaagccacaagacaccggattcactcgaaccaagtcctctcaaggagtctccttgtcgcgatagcctggagagctcccccgtggagcctaagatgaaagcgggtatcttcccctcccatttccctctcccggctgccgtggctaagacagaactgttgacagaggttgcctctgtgagatccaggttgttacgggaccctgacggcagcgctgaagacgattcactagagcagacaagccttatggagagctccggcaaatctcctttgtctcctgacacaccctcctccgaggaggtttcctatgaggtcactcccaaaactactgacgtctcaactcccaagcccgctgtgattcatgaatgtgcagaggaggacgactccgaaaacggcgaaaagaagagattcactcccgaagaggagatgtttaagatggtgactaaaatcaaaatgtttgacgagctcgaacaggaggcaaagcaaaagagggactacaaaaaggaaccaaagcaggaggaatccagctcctcctctgatccggatgcggattgtagcgtggatgtcgacgaacctaagcacacaggcagcggggaagatgagagcggagtccctgtcctggtaacatccgagagtaggaaggtgtcatctagcagcgagtctgaacccgaactggcacagcttaagaagggagcggatagcgggctgctcccagaacccgtgattcgtgtgcagcccccttccccactgcccagtagcatggattcgaactcctctccagaagaagtgcagttccagcctgtggtatcaaagcagtacactttcaaaatgaatgaggatacacaagaagaaccaggaaagagtgaggaggagaaagacagtgagtcccacttggcggaggatcggcacgcagtctccacagaggctgaagaccgatcctacgacaagttgaatcgagatacagatcagcccaaaatttgcgacggccatggctgtgaggccatgtccccgagcagcagcgctgctcccgtgtcaagcggactgcagagtcccacgggggatgacgttgacgaacagccagtcatctacaaagagtcattagcgctccagggcacacatgagaaggataccgaaggggaggagctggatgtgagtcgcgctgaatcaccacaggcagactgcccctcagagtccttttcaagttccagctcactgccacactgtcttgtgtccgagggcaaggagctggatgaggacatcagcgccacgtcttcaattcagaaaaccgaagtgactaaaacagatgagactttcgaaaacctgcccaaggattgcccaagccaagatagctcgatcacaacacagactgaccgattttccatggatgtgcccgtatctgatctagccgaaaacgacgagatctacgaccctcagattacctctccctacgagaacgtgccttcgcaatcttttttctctagcgaagagtctaaaacgcaaacagacgccaaccataccacctcttttcactcgtctgaggtgtacagcgtgactattacgtcacctgttgaagacgtggtcgtggcatcctctagtagtggaacggtgctgagcaaagaatccaacttcgaggggcaggacataaagatggaatcccagcaggagtcgaccctgtgggaaatgcagagcgactcggtgtcaagcagcttcgaacccaccatgtcagccactactactgtggtgggtgaacagataagcaaggtgatcatcaccaaaaccgacgtggacagcgattcatggtctgagatcagggaagatgacgaggccttcgaagcacgtgttaaggaggaggaacagaaaatcttcgggcttatggtggacagacaatcacaggggacaacacccgacaccacacctgctagaacgccgaccgaagagggcacgccgaccagcgagcagaaccccttcttgttccaggaagggaagctttttgagatgactagatcaggggcaatcgacatgacgaagcggagctatgcagacgaaagcttccatttttttcagatcggtcaggagagtagggaggaaaccttgagtgaagatgtgaaggagggagctactggagcagatcctctgccactcgaaacctctgcagagtccctggctctgtctgagagcaaggagacagtagacgacgaagctgatttgttaccggacgatgtatccgaagaggtcgaagaaatacccgcttccgacgcccaactcaatagccagatgggaatctcagcttctacagagacccctaccaaggaagctgtttccgtcggaaccaaagatcttccaactgtgcaaacaggcgacatacccccactctccggggtgaagcaaatctcatgcccagatagttccgagcccgctgtgcaagtgcaactggattttagcacgctcacgcgatccgtgtacagtgaccggggagacgacagtcctgatagcagcccagaagagcagaagtctgtcatagagatcccaacagcaccaatggagaatgtaccattcacagaatctaagagcaaaatacctgtgaggacaatgccaacttcaaccccggcacccccaagcgccgaatacgagtccagtgtatcagaagacttcctcagttctgtagacgaggaaaacaaggccgatgaggctaaacccaagtcaaaattgccagtcaaggttccactgcagagagtggaacagcagctgagtgaccttgatacgtctgtacagaagactgtagctcctcaggggcaggacatggccagcattgcacctgacaaccgatccaagagcgaatcagacgccagcagcctcgattccaaaaccaaatgccctgtgaagacccggagctatactgagactgagacggaatctcgtgagcgtgccgaagagctggaattagaatctgaagaaggtgcgaccaggccgaaaattctgacaagtcggctgcctgtgaagtcccgtagcacaacgagcagctgtcgcggtggcaccagtcctaccaaggagagtaaagagcacttctttgatttatatagaaactctatcgaattttttgaggaaatctcagacgaagcatcaaaacttgtggatcggttaacccagtccgaaagggaacaagagatcgtctcagacgatgagtcctcctccgcgctcgaggtttccgttatagagaatctcccaccagttgaaactgagcattccgtccccgaggatattttcgatacaaggccgatttgggatgaaagcattgagactctgattgagagaatacccgatgaaaatgggcacgaccacgccgaggatccgcaggacgagcaagagcggatcgaagaaaggctggcctatatcgccgaccacctcggctttagttggacagagctagcacgtgaactggatttcactgaagaacaaattcaccagatcagaattgagaatcctaacagcttgcaggaccagtcgcacgcgctcctgaaatactggttagagagggatggcaaacacgcgactgacacaaacctcgtggaatgcttgaccaaaatcaatcgcatggatatagtgcacctgatggaaacaaataccgagcccctccaagaacggattagccactcgtatgccgagattgaacagaccatcacacttgaccattcagaagggttctctgttcttcaggaggagctctgtaccgctcagcacaagcagaaagaagaacaggccgtctccaaggagagcgagacatgcgaccacccaccgattgtctctgaggaggatatctctgtcggctacagtacattccaggatggcgtgcctaaaaccgaaggcgattccagtgcgactgcccttttcccccagacccataaagagcaggttcaacaagatttcagtgggaaaatgcaggacctgcctgaggagagctctctggaataccagcaggagtacttcgttacgacccccggaaccgagacctccgaaacccagaaagccatgatcgtgcccagctcccccagcaagacacctgaggaagtaagcacaccggctgaggaggagaaattatatctgcagactcctacatcttctgaaaggggcggatcacctattattcaagaacccgaggagccaagtgaacaccgcgaggagtcgagcccacggaaaacaagcctggttatcgtagaatccgcggacaaccagccggaaacttgtgaacgtctggatgaagacgcagcctttgaaaaaggcgacgacatgcccgaaattccacccgagactgtcactgaagaggagtacatcgacgagcacggtcataccgtggtaaaaaaggtgaccaggaaaataatcaggaggtatgtttcttctgaaggaacagaaaaggaggagattatggtccagggcatgccacaggagcccgtgaacatcgaggagggagacggatacagtaaggtgatcaagcgtgtggtactcaagtccgacaccgagcagagtgaggataacaacgaatac

SEQ ID NO: 214410 - DNA, 5618 bp, Artificial Sequence
  Description of Artificial Sequence: Synthetic coding sequence
atgatgaacgaggacgcggctcagaagagtgactccggtgagaagttcaatggaagttcccagaggcgtaaacgcccaaaaaaatctgactccaacgcctcctttctccgggctgcgagagccggaaatttggataaggtggtggaatatttaaaaggaggcattgacataaatacctgtaatcaaaacggtcttaatgcactccatctagccgctaaagaagggcacgtgggacttgtccaagaacttttgggcaggggaagttcggttgatagcgctacgaaaaaggggaatacagccctccatatcgcatctctggccggtcaggccgaggtcgtcaaggtcttggtgaaggagggcgctaacattaacgcacagtcacagaacggcttcacccctctgtacatggccgcacaggaaaatcacatcgacgtggtgaaatatctgctggagaacggagccaaccagtctacagctacagaggatgggttcacgcctctggcagtggccctgcaacagggacataaccaggccgtggccatcctactggaaaacgacactaagggcaaagtccggctacctgcgctgcacatcgcagcgagaaaagatgacaccaagtcagccgctctactgctgcagaacgatcacaacgcagatgtccagagtaaaatgatggtcaaccggacgacagaatccgggtttaccccgttgcatatcgcagcccactacggcaatgtgaacgtggcaacattgctgctgaatagaggcgcagccgtagacttcactgccaggaatgggatcacccccctacacgtggcaagcaaaaggggcaacactaacatggtgaagctattgctggaccgcggtgggcaaatcgatgccaagacaagagacggattgacgcccctgcactgcgccgcaaggagcgggcacgaccaggtcgtagagctgttgctggagcggggtgcccctctgctggcccgaacgaaaaacggattgtctcctctgcacatggcggcacagggggatcacgtggagtgtgtgaaacatttgctccagcacaaagcccctgtggatgacgtcaccctcgactatcttaccgccctgcacgttgctgcccattgtggccattaccgtgtgacaaaactgctcctcgataagagggcaaatccaaatgccagggctctcaacggttttacccccttacacatagcttgcaagaagaacaggatcaaggtgatggagctgctggtgaaatacggcgcaagtattcaggctattacagaaagtgggctcacacctattcacgtggctgcctttatggggcacttgaacatcgtgctcctgctgctgcagaacggagcaagtcctgacgtcacaaacatacgaggagagaccgccctacacatggcggcaagagccggtcaagtagaagtggtgcgttgcctgttgcgtaatggcgcacttgtagacgccagggctcgggaggaacagacccctctacacatcgcatcgaggctgggcaaaactgagatagttcagctgttgctgcaacatatggcacaccccgacgcggcaactacaaacgggtacacccctctgcacatatctgcaagggaagggcaagtggatgtggccagtgtcctgctcgaggctggcgctgctcactctctggctaccaagaagggttttactcctctacatgtggccgcaaagtatggtagcctggacgtggcaaagctgctgttgcaaagaagagcagccgcagatagtgcaggaaagaatgggctgacgccactgcacgtcgctgctcattatgacaatcagaaggtggccttacttctgctggaaaaaggagcttcccctcacgcgacggcaaagaatggatatacccccctgcacatcgccgctaagaagaatcaaatgcaaatagcatctacgctacttaactacggggcagagactaacattgttactaaacaaggcgtaactccgttacatctggcatcacaggagggccacacggatatggtaacactgttgctcgataagggcgcaaacattcacatgtctaccaaatctggcctgacatcactccatctggctgcacaggaggataaggttaacgtagccgatatcctgaccaagcatggagcagaccaggatgcgcacacgaaactaggctacactccacttatcgtagcctgtcactacggtaatgtgaaaatggtgaacttcctccttaagcagggggcaaatgtcaatgccaaaaccaagaacggctacacgcctctacaccaggcagcgcagcagggtcacactcacatcattaatgtgctgttgcagcatggcgctaagccgaatgcaacgaccgcaaatgggaacacagcactggctattgccaagcgtctgggctatatctctgttgtagacacactcaaagtagtcactgaagaggtaaccactacaactactaccatcacggaaaagcacaagttgaacgtcccagagaccatgacagaggtgctggacgtgtcagacgaggagggggatgacaccatgacgggcgacggaggcgaatacctccgacctgaggaccttaaagagctcggggatgactctcttccatcctcacagttcctggacgggatgaactacctcagatatagcctggaaggcggaagatccgatagtctccgttcatttagctcagaccggtcccataccctctcccatgcctcctacctgagggattctgccgtgatggacgattcagtcgttatcccgtctcaccaggtgtccaccttagcaaaggaagccgaacggaactcctaccgactgtcttgggggactgagaatctcgataatgttgccctgagctcttctcctatccatagcggtttcctggtgtcatttatggtggacgctcggggtggagctatgaggggttgcagacacaacggtctccggattatcatcccccctcgaaagtgcaccgcacctacgcgtgtgacatgtagactcgtaaaacgccacaggctggcgactatgcccccaatggtcgagggggagggccttgcgtcccgcctcatcgaagtggggccaagcggcgctcagtttctcggtaaacttcatcttcccactgccccacctcccctcaacgagggcgaaagcctcgtgagcagaatcctgcagctgggccctcccggaaccaagttcctgggccctgtgattgtggagattcctcacttcgctgcactgagggggaaggagagagagctagtggtgctgcgctccgaaaacggggacagctggaaagaacatttctgtgactacacggaagacgagttgaatgaaatcctgaacggtatggatgaggttctggatagccccgaggaccttgaaaagaaaagaatttgtcgcatcatcactcgggatttcccccaatacttcgcggttgtttcccgcattaaacaggattctaatcttatcggaccagaaggcggagtgctgtcctccaccgtagtgcctcaggtgcaagctgttttccctgagggggctttgaccaagagaattagggtcggcctacaggctcaacccatgcactctgaactcgtcaagaaaattttgggcaataaagccacttttagccccattgtcaccttagaaccaagaagaagaaaatttcacaaaccaatcacgatgaccattcctgttcctaaggctagcagcgatgtcatgctgaatggatttggcggtgacgccccaacacttcggctgctgtgttctattacaggcggaaccacaccagcccagtgggaggacattacaggaacaacaccactaaccttcgtgaacgagtgtgtgtcatttactacaaatgtgtctgcacggttctggctgattgattgtcgacagatccaagagagtgtgacattcgcctctcaggtgtatcgcgaaattatctgtgtaccgtatatggcgaagtttgtagtcttcgccaagagtcatgaccccatcgaagcccgactcagatgtttttgcatgacagacgacaaagttgacaagaccttggagcagcaggagaacttcgcagaggtcgctcgttcccgggacgtcgaggtgctggaaggtaagcctatctacgtggattgcttcggcaacctggtgccacttaccaaaagtggccagcaccacatcttcagcttttttgcctttaaggagaacagactgccactgtttgttaaagtgagagataccacccaggagccatgcggcagactgtcatttatgaaagagcctaagtccacccggggacttgtgcaccaggctatctgcaacctgaatatcacgctgcctatctatacgaaggagtcagagagcgatcaagagcaggaggaagaaatcgacatgacgagtgagaagaacccacaagacgagcaagagcgtattgaagaacgcctggcatacattgctgatcacctgggtttcagttggaccgagctggccagggaactggattttacagaagaacagatccatcagattaggattgaaaatcctaactcgctccaggatcaaagtcatgcactgctgaagtactggctcgagcgcgacggtaagcacgccactgatacgaatctcgttgaatgcttaacaaaaataaatcgtatggacattgtgcatctaatggaaacaaatacggagccactccaagagcgcatctcccacagctacgccgagattgagcagactatcacattagatcactccgaaggcttctcagtattacaggaggagttgtgcaccgcacagcacaagcagaaagaggagcaagccgtaagcaaggagagcgaaacctgcgatcatccaccaatcgttagcgaagaggacatcagtgtgggatacagcacattccaggatggggtacccaagactgaaggtgatagttctgctacggccctgtttcctcagacccacaaagaacaagttcagcaggacttcagcggtaagatgcaggatctgcccgaagagtcatctctggaatatcagcaggagtacttcgtgaccacccctggtaccgaaacttcagagacacagaaagcaatgattgtacctagctccccttctaagacccccgaggaagttagcacgcctgcggaagaggagaaactgtatctgcaaacaccgacctccagcgaaagggggggatctccaatcatccaggagcccgaagaaccaagcgagcatagggaggaatcaagccctcgtaagacatccctggtcattgtggaatccgccgataatcaacctgaaacctgcgagagactagacgaagatgctgcatttgagaagggcgatgatatgccagagattccacccgagactgtgacagaggaagagtacatcgacgaacatggccacaccgtcgtgaagaaggtcacacgaaaaattatcaggcggtatgtttcctccgagggaacggagaaggaagagattatggtccagggaatgccacaagaaccagtgaacatcgaggagggcgatgggtatagtaaagtgattaaaagggttgtgctgaaaagcgacaccgaacagtcagaggacaacaacgagta

SEQ ID NO: 214411 - DNA, 2988 bp, Artificial Sequence
  Description of Artificial Sequence: Synthetic coding sequence
atggatgattccgtggtgatcccatctcatcaggtgagcacactggcaaaggaagccgaaagaaactcttacaggcttagttgggggacggagaatctagacaacgtggcactgtctagctcgcccatacacagcggattcttggtgtccttcatggtggacgcacggggtggagccatgcggggttgtcgacataatggtttgcgcatcattatcccccctcgcaaatgtactgcacccactcgggtgacatgtcgactggttaagagacatagactcgctaccatgccacctatggtagagggagaaggcctggcgagcagactgatagaagttggaccatctggagctcagtttctggggcctgtcatagtggagattccacattttgctgctctgcggggaaaggagcgggagctcgtcgtgctcagaagcgagaacggtgactcatggaaggaacatttctgcgattacacagaggatgagttgaacgagatactgaacggtatggacgaggtgttagactccccggaggaccttgaaaagaagaggatttgccgaatcataactagggattttccgcagtactttgcggtcgtgtcccgcataaagcaggacagtaacctcatcgggcctgaaggtggtgtcctgagttctactgtcgttccacaagttcaggcagtctttcccgagggggcacttaccaagcgaatcagagttggcttgcaggcccaaccgatgcactctgaactggtgaaaaagatccttggcaacaaagctaccttcagtccaattgtcaccctagagccaaggaggcgtaagttccataaacctatcacgatgacgatccctgtgcccaaggcatcttcggacgtgatgttgaacggatttggcggagatgctcccacacttcgactcctgtgttccataacagggggaaccacacctgcacagtgggaggacatcactggcacgacacctctaacgtttgtgaacgaatgtgtgagcttcaccaccaacgtcagcgctagattctggctgattgactgtcgtcagattcaggagtccgtgacatttgccagccaggtctaccgtgaaatcatctgtgtgccatatatggccaaatttgtagtctttgccaagagccacgatcctattgaagccagactgaggtgcttctgcatgactgatgataaagttgataagacattggaacagcaggagaatttcgccgaggttgccagatccagagatgtagaagtgctggaaggcaaacccatctacgtggactgttttggcaaccttgtcccccttaccaagtcgggacaacaccatatattcagttttttcgcatttaaggaaaatcggctgcctctgtttgtcaaggtcagagacactacacaagaaccttgcggcaggctttccttcatgaaggagcccaaaagcacacgcggactggttcaccaggccatctgcaatctgaacattaccctacccatctacacaaagaccgagacgacaactgagatccacccacaggacgagcaagaacggatagaggagcggctcgcctacattgcagaccatctcggtttctcttggaccgaactcgcccgtgagctggatttcaccgaagaacagatccatcaaataagaattgagaaccctaacagtctgcaagaccagtcacacgctttgttgaagtactggttggagcgcgacggaaagcacgcaactgacaccaatctggttgagtgcttaacaaagataaaccgcatggatattgtgcacctcatggaaaccaataccgaacccctgcaagaaaggatcagtcattcatacgccgagatagagcagactataacactcgatcactctgagggattcagtgtactgcaagaggagctgtgcacagctcaacataaacagaaggaggagcaggctgtgtccaaagagagcgaaacttgtgatcacccccctatcgtctctgaggaagatatttcagttggttactcgacgtttcaggacggggtgccaaaaaccgagggtgactccagcgctactgcactgtttccacaaactcacaaagaacaagttcagcaggacttctccggcaagatgcaagatttgcctgaagagtcctctctggagtatcagcaggagtattttgtcacaacaccgggtacggagacatctgagacgcagaaggcaatgattgtaccatcctccccatccaaaacccccgaggaggtctcaacaccggctgaagaggaaaagctgtaccttcagacaccaaccagttccgaaaggggcggttctccaattattcaggagccagaggaaccctcagagcacagagaggagtcctcaccacgtaagacttcactggttatcgtggaatctgccgataaccagccggagacttgtgagagactggacgaagatgccgcatttgagaaggagctcacagaagagctaggagagttggaggcctcttctgacgaagaagccatggttaccacccgcgtggtgcgtcgcagagtcattatacagggagatgatatgccggagataccgcctgagacggtgaccgaggaggagtatattgatgaacatggccacactgtggtaaaaaaggtaaccagaaaaattattcggaggtacgtgtcaagcgaaggcacggagaaggaagagattatggtgcagggtatgccccaggaacccgtgaacatcgaggagggagacgggtacagcaaggtgattaagcgagtggttttgaaatcagacaccgaacagtctgaagtgacgctgtgcgaaccctctatcctgagctctacatcacagttccaggcagaacccgtggaaggcagacgggtgtccaaggtggtgaagactaccgtcgtgctgggggaacggatggagaagcatttaggggactctagcctagcaacggacctgccaagcgcaaaagacgatttcgaggaatag

SEQ ID NO: 214412 - DNA, 3345 bp, Artificial Sequence
  Description of Artificial Sequence: Synthetic coding sequence
atgacgacaatgctgcaaaaatccgacagcaacgccagctttctccgcgcagctagagctggcaacctggacaaggttgtggaatacctgaagggaggcattgatatcaacacttgtaatcagaatggactcaatgcactgcaccttgccgcaaaggaaggtcatgtcgggttagtgcaggaactgctgggcagaggctcctcagtggacagcgccaccaagaagggtaacactgctctgcacatagcgtcacttgccggacaggcggaagtcgtgaaggtactggtgaaagaaggtgcaaatatcaacgcccagagtcaaaacggattcacccccctgtacatggctgcacaagaaaaccacatcgatgtggttaaatacctgctggaaaacggcgctaatcagtcaaccgcaacagaggatggctttactcctctggctgtcgccctccagcagggacacaaccaagccgttgccattctactagagaatgacactaagggcaaggttcgcctcccagctctgcacattgccgcaaggaaagacgacacgaagtccgcggcattactcctgcagaatgatcataacgcagacgtccagtccaaaatgatggtgaatcggactacagagagcggatttacgcccttacacatagccgctcattatggtaacgtgaacgtcgccacactgctccttaatcgcggagccgcagtagacttcaccgcgagaaacggcatcacccctcttcatgtagcctccaagaggggtaatacgaatatggtgaagctgctcctggacaggggaggtcagatagatgctaaaacaagggacggtctgacacctttgcattgcgctgccaggagcggccacgatcaggtggtagagctcctgctggagcgcggagcgcctctcttggctcggacaaagaatggtctgagtccactgcacatggccgctcagggtgatcacgtcgagtgtgtaaagcacttgctacaacacaaggcaccagtggacgatgtaactctggactacctgacagccctgcacgtagcggctcactgtgggcattatagggtgactaagctactgctggacaagagagctaatcctaacgcacgggctctcaacggtttcacacctctgcatatcgcctgcaagaagaataggattaaggtcatggaattgcttgtgaaatacggagcttccattcaggccatcactgaatctggtctgacccctatccatgtcgctgccttcatgggacacctaaacattgtgttactcttgttgcagaacggagcttcaccagatgtcacaaatattcggggagaaaccgccctgcatatggcagcccgtgctggccaggtggaggtggtacgctgcctgctgcgtaatggcgctttagtcgacgctagggccagggaagaacagacccccctccacatagcatcccgtttggggaagaccgaaattgtgcagctgttgctccagcacatggcgcacccggatgccgcaaccaccaacgggtacacaccactgcacattagtgcacgggagggccaagtcgatgtggccagcgttcttctagaagctggagcagcccactccctcgctactaagaagggcttcactccattgcacgtggccgctaagtacggcagcctggacgttgctaaactgctgcttcagaggcgcgctgcagctgactctgctggtaagaatggcctgacaccactgcacgtggctgcccattacgacaatcagaaggtggcccttcttcttctagagaagggagcatctccacacgccaccgccaagaatggctacacacccctccacattgccgcaaagaagaaccagatgcaaatagcctctacactgctaaactacggggctgaaactaatattgtgacaaagcaaggtgtgacccccctgcacctcgctagtcaggagggtcatactgacatggtgactctccttctcgataagggcgctaacatccatatgtccaccaaaagcggtttgaccagtctccacttagcagctcaggaggataaggtaaatgttgccgatattctgacgaaacacggggctgatcaggacgcccatacgaagctcggctacactcctctcatcgtcgcctgccactacggaaatgtcaagatggtaaactttttgcttaagcagggcgctaacgtcaacgcaaagaccaaaaatggctacacacctctgcaccaggccgcacagcagggccacacccacatcattaatgttctccttcagcacggggctaaaccgaacgcgaccactgcgaacgggaataccgcactggctatcgcaaagcggctgggatatataagcgtcgttgacaccttgaaggtggtgacagaagaagtgactacaacgacaaccactattactgagaagcataagctgaatgtgcctgagactatgactgaggtcctcgacgtctctgatgaggaaggagacgataccatgaccggagacggcggtgagtatctgaggccggaggacttgaaagagttaggggacgatagcctgcctagctcccagttcctggatggaatgaattacttgagatactccctggaggggggtcgatccgactctctgagaagcttctctagtgacagatcccacaccctttcacatgccagctacttgcgggattcagctgtaatggacgactccgtagtgattccaagccaccaagtgtcaacgcttgccaaagaagctgagcgaaacagctaccgcctatcgtggggaacagagaacttagataacgtagccctgtcgtcttcacccattcatagcgggtttctggtatcatttatggtcgatgccagaggaggggcaatgaggggctgcagacataacggtcttcgcatcattatccccccacggaaatgtaccgccccaacccgcgtgacctgtagattggtaaaacgccataggctcgccactatgccacccatggtcgagggtgaaggcctggcaagcagattaatcgaagtgggcccaagcggcgcacaatttctcggaaagctgcacctccccacagcccctcccccactgaacgaaggtgagagtctggtctcacgcatcttacagctcggtcctccgggtactaaatttctaggaccagtgatagtagagattccgcatttcgcagctttgcggggtaaggagagggagctggtggtgctccggtccgaaaacggggacagctggaaggaacacttttgcgattatactgaggatgagctcaatgaaatactcaatggcatggacgaggtccttgattcgcctgaagatttggaatag

SEQ ID NO: 214413 - DNA, 5192 bp, Artificial Sequence
  Description of Artificial Sequence: Synthetic coding sequence
atgatgaacgaagatgcagcccagaaatccgactcaggagaaaagtttaacggtagcagtcaaaggcggaagaggcctaagaaggtgacttgtccgcagatgaagccggaggctgcaaatattgaaaaaagtgattctaacgcctccttcctgagggcggctcgggctggcaatctcgacaaggtggtggaatatctgaaaggaggaatcgacatcaacacctgtaatcagaatgggctgaacgcactgcacctagccgcaaaagaaggccacgtaggactggttcaggagctcctgggccgaggtagcagcgtggattctgcgacaaagaagggcaatacggctctgcatattgctagcctggccggacaggcagaagtggtaaaagtcctcgtcaaggagggcgcaaatatcaacgcccaatcacaaaatggcttcacgcctctgtatatggctgcacaggaaaaccatatcgatgtggtaaagtacttgctagagaatggcgctaaccaaagcaccgctacggaggacgggttcacacctctggctgtagccctgcaacaggggcacaaccaggccgtggccatcctattagaaaacgatacaaaagggaaggtcaggttgcccgctctccatattgccgctagaaaggacgacaccaaaagtgccgctctcctgctccaaaatgatcataacgccgacgtacagagcaagatgatggtgaacaggactactgagtccggcttcactcccctgcacatagccgcacactacggcaacgtcaacgtagcaactctcttgttaaacagaggtgcggcagtggatttcactgccagaaatggcatcaccccactgcacgtggcctctaagagaggcaataccaacatggtgaagctgctcctcgacagaggtgggcagattgacgccaagacccgggatggactcacaccgttacactgcgccgctcgctcgggacatgatcaggtagtggagcttcttttggaacgaggagcccctttgctggctcgtactaagaacggcctgagccctttgcatatggccgctcagggtgaccatgtcgagtgcgttaaacatctgctccagcacaaggcgccagttgatgacgtcactctcgattatcttacagctcttcatgtggctgcccattgtggccattatcgagttactaaactactcctggataagagagccaaccccaatgcacgcgcattgaacggatttacaccacttcatattgcatgcaaaaaaaaccgcattaaggtgatggagctcctagtgaagtacggagccagcattcaggctatcacagaatctggtctgacaccgatacatgtggcggcttttatggggcatcttaacattgtgctgctgctgctacaaaatggggcttccccagacgtcaccaacataaggggagaaacagcattacacatggccgcacgcgcaggccaggtcgaggtggttcggtgtcttctcagaaatggagccctggtcgacgctcgggctcgggaagagcagacacccctgcacattgcctcaaggctcggcaaaaccgagattgtgcaattactgctccaacacatggcccacccagacgcagctacaacaaatgggtatacaccactacatatctctgctcgggagggccaggtagacgttgcctctgtgttgctcgaagcaggcgctgctcatagcctggcaacaaagaagggttttacgccactccatgtggccgcaaagtatggaagtctggatgtcgctaaacttctgcttcaaaggagggcagctgctgattcagccggaaaaaacggattgacacctctgcacgtggccgctcattatgataaccagaaagttgctttgctgctcctagagaaaggggcaagcccacacgcgactgcaaagaatgggtacacaccccttcatatcgcagcgaaaaagaatcagatgcagatagcaagcactctacttaattatggagcagagacgaatattgtgaccaaacagggagtcacgccattgcatcttgcctcccaagaaggccatactgacatggttaccttgttactggacaaaggggcaaatattcatatgtctaccaagagcggcttaaccagcctgcatctggccgcacaggaggacaaagtgaatgtggccgatattcttactaagcatggagctgaccaagacgctcatacaaagctgggctataccccgctcatcgtagcttgccattacggcaatgtaaagatggtaaattttctcctgaaacagggcgctaatgtaaacgcaaagaccaagaatggctacacacctttgcaccaggcagctcagcaaggtcatacgcatatcataaacgtgctgctgcagcacggcgctaaacccaatgcgacaactgcaaacggaaacactgccctggcgattgctaaacggctcgggtacatctctgtcgttgacacactcaaggttgtcaccgaagaagtcaccaccacgacaacaaccatcaccgaaaagcataagctcaacgttcccgagacaatgacggaggtgctcgatgtgtctgatgaggaaggagatgacaccatgaccggtgatgggggagagtacctgaggcccgaggatcttaaggaactgggtgatgattcccttcccagttcacagtttctcgatgggatgaattacctcaggtacagcctcgagggcggacggagcgatagtcttcggagtttctcatccgacaggtcccatacactctcccacgccagctacctcagagattctgcagtcatggacgattccgtagtcattcccagtcatcaggtgagtacactcgctaaagaggcagagcgcaacagttatcgactctcctggggaacagagaatctggacaatgtggctctgtcctcaagtccaatccatagcggattcttggtctcatttatggtggatgcccgtggaggcgctatgagaggatgtcgccataacggtctgaggattattataccacctaggaagtgcactgcaccgactcgcgtgacttgtcgcttagttaaaagacaccgcctcgctacgatgccgcctatggtggaaggtgaaggcttggcctcaaggttaattgaagttggtccttccggcgcacaattcctcggcaaattgcacctgcctacagcccctcccccattgaacgagggagagtctctggtctcccgaattctccagctgggaccacctggtaccaagttcttgggtccagttatcgtcgagatacctcactttgcagcgctccggggaaaagaaagggaactcgtggtattaagaagtgaaaacggagattcatggaaggaacacttttgtgactatacagaggatgagcttaacgagatcttgaatggtatggacgaagtcctggactctccggaggatctcgagaaaaagcgcatctgcaggattataactcgggacttccctcagtattttgccgtcgtcagtcgcatcaaacaagactccaatctcatcgggccagagggcggtgtgctgagttccaccgtcgtcccccaggtgcaggcggttttccccgagggcgcattaacaaagagaattcgagttggcttgcaggctcagcccatgcactctgagctggtaaaaaagattttggggaacaaggccactttttcccctattgttacacttgaacccagacgcaggaagtttcacaagccaatcaccatgaccatccctgtgccaaaggccagctcagatgtgatgcttaatgggttcggtggggatgcccctactttaagattattgtgtagcatcacaggtggaaccacgccggcacagtgggaggacatcacaggcaccacaccattgacgtttgtgaacgaatgcgtaagttttaccactaatgtgagcgcgcgtttttggctgatcgattgccggcagattcaggagagcgtaacctttgctagtcaggtttaccgggagattatttgcgtgccatacatggccaagtttgtcgtcttcgctaagagccatgatcctattgaggctcgtctgcgttgtttctgtatgactgacgacaaagttgacaagacactggagcagcaggaaaacttcgccgaagtcgctagatctcgggacgtcgaggtgctggaaggtaagccaatatacgtggattgtttcgggaacctggttcctctgactaagtcaggtcagcaccacatcttttcatttttcgcattcaaagaaaaccggctgcctctctttgtgaaagttcgcgatacgactcaagagccatgcggaagactgagctttatgaaggagccaaagagcacgcggggattggtgcaccaggccatctgcaacttgaacattacactacctatctataccaaggagtctgagtcagaccaagagcaggaggaagaaatagacatgacaagcgaaaaaaacgacgaaacagagtcgacggagacctccgtactcaaaagccatttagtgaacgaggtccctgtcctggcttctccagacctgcttagcgaggtttctgaaatgaaacaggacctcattaagatgaccgccatcctgacaactgacgttagcgataaggcaggctctattaaggtcaaagagttggtgaaggctgccgaggaggagcctggcgaacctttcgagatcgtggagagagtgaaagaggacctcgagaaggtgaacgagatccttagatccggtacttgcacaagagacgagagctctgtccagtcgtcccgctccgagcggggtctcgtggaagaggaatgggtgatcgtttctgatgaggaaatcgaggaggctcgccagaaggcccctctggaaatcacagaatatccttgcgtggaagtacgaatcgataaggagataaaagggaaggttgagaaagattctacagggctggtgaattatctaactgatgatttgaatacatgcgtacctctgccaaaggagcagcttcagactgtgcaggataaggctggaaaaaaatgtgaggccctggctgtcgggcgatcaagcgagaaagagggtaaggatatccctcctgatgagactcagagtacccaaaagcagcacaaaccttctctaggaatcaagaagccggtgcggaggaaattgaaagaaaagcagaagcagaagta

SEQ ID NO: 214414 - DNA, 5591 bp, Artificial Sequence
  Description of Artificial Sequence: Synthetic coding sequence
atgaccaccatgttgcagaaatccgattctaacgcctcatttctgcgggcagccagggccggtaatttggataaggtggttgaatacctgaagggaggcatcgacataaacacctgcaaccagaatgggctgaacgcgctccacctggccgctaaggaggggcacgtgggtctggtgcaggaactgcttggtcgtgggtcctcagtcgatagcgctacaaaaaagggcaacaccgcccttcatattgcaagcctggccggacaggcagaggttgtgaaggtgctcgttaaagagggtgctaacattaatgcgcaatctcagaatggctttacaccgttgtatatggccgctcaggaaaaccatattgacgtagttaagtatctccttgagaacggagcaaatcagtctacggcaactgaagacggatttacacccttagctgtggcacttcagcagggccataatcaggcggtggccatcctgttggaaaatgacactaaagggaaggtccgcctgcccgctctgcatatcgctgcaagaaaggatgacactaagtctgccgctttgttgctgcagaacgatcacaatgcggacgtccagtcaaagatgatggtaaacagaacaacagagtctggctttacacccttacatattgctgcgcattatggaaacgtcaacgttgcaactctgttgctgaatcgtggagccgcagtggatttcacagcacgtaacggcatcacccctctacacgtagctagtaagaggggcaataccaatatggtcaaacttctccttgaccgagggggacagatcgacgccaaaactcgagatggacttacccctctacactgcgcagcgaggtcaggccacgatcaagttgtcgagctgttgctggagagaggcgcacccttgctggccagaactaagaacgggttgagcccactgcacatggctgcccagggcgaccacgttgagtgtgtgaagcatcttctacagcacaaagctccagttgacgatgtcactcttgattatctaacagcgctccacgtcgcagcgcactgcgggcactatagagtcacaaaactgctccttgacaagagagccaaccctaacgccagggccctgaatgggttcacaccacttcatatcgcttgcaagaaaaacagaatcaaagttatggagctgcttgtgaagtatggagcctcaatacaagctatcaccgagagtggacttacacctatccatgttgccgcttttatgggtcatctcaacattgtgctgctgctgctccagaatggcgctagccctgacgtaactaacatccgcggtgaaactgcgctccacatggcagcccgagcagggcaggtcgaggttgtgagatgtcttttgcgcaatggcgcattggttgatgctagggccagggaagagcagacacccctgcacatcgcctcccggctaggcaaaacggagattgtgcagttgctcctccaacacatggcacatcctgacgctgctactacaaatggctacacacctttgcacatctcagcccgtgagggccaggttgacgtggcttccgtgctgctagaggcaggggctgctcatagccttgccacaaaaaaggggtttactcctctacacgtcgcagctaagtatgggagcctggacgtggcaaagctgttgttgcaacgaagggccgctgctgacagcgctggcaagaatggtctcacacccttgcacgtggctgctcattacgacaatcaaaaagtcgcacttcttctgcttgagaaaggagcatccccccacgccaccgcaaaaaacggctacacgcccctgcacatcgctgccaaaaaaaatcagatgcaaatcgcatccacactgctgaattacggggctgaaactaacattgtgacaaaacagggcgtgacacctctccatctggcttcccaagaagggcacacagatatggtgacactgctccttgacaaaggcgctaatattcatatgtcaacaaaaagcggtttgacaagcctgcacttagccgctcaggaggataaagtcaatgtggcggacatactcacaaaacacggagccgaccaggatgctcatacaaaattaggctacacccctctcattgttgcatgtcactatggcaacgtaaaaatggttaatttcctgcttaaacagggggctaacgtaaacgccaaaacaaagaatggatatacacccttgcatcaggcggcacagcaggggcacacccacattattaacgtgctgctccaacacggagccaagcccaatgctaccactgcgaatggaaatacggcattggcgattgcaaagcggctcggctatattagtgttgtggataccctgaaggtggtcaccgaagaagttacaaccactacaacgacgatcaccgagaaacataaactaaatgtgcctgagacgatgaccgaggtgctggacgtgagcgatgaggaaggtgatgacaccatgactggtgacggaggcgagtatctgcgacccgaggacctcaaagagctgggcgacgatagtctgccgtcaagtcagtttctggacggtatgaattacttaaggtactctctagagggaggtcgttcagattccctgaggtcctttagttcggatcgtagtcacacactctcccacgccagttatctgagggactcggcggtcatggacgacagcgttgttatcccctctcaccaggtcagcacccttgctaaggaggcagaacgaaattcttaccgcttaagctgggggacggagaacctggacaatgtggccctgtccagctcaccaatacactcaggcagagctagcccttgcctcgaaagggataattcctcattccttgtgtccttcatggtagatgccagggggggagcaatgagaggatgccggcacaatggtcttaggatcataatccctcccaggaaatgtacagccccaactcgcgttacatgcagattagtaaaacggcatcgattagcaaccatgccccctatggtggagggagaggggctggcttcacgcttaattgaagtgggcccatcaggcgctcagttcctagggaagctgcatctgccaactgctcctccgcctctgaacgagggcgagagcctcgtgagcagaattctacaactgggaccaccagggaccaaattcctgggacccgtgatcgtcgaaatcccccacttcgcagccctgcgcggtaaggaaagagaactggtggtgttgcggagtgagaacggtgattcgtggaaggaacacttctgtgactataccgaggacgagctgaacgagattctgaacggtatggacgaggtcctggattctcctgaagatttagagaaaaagagaatatgccggatcatcaccagggattttccacaatacttcgctgtcgtctcccgcatcaagcaggattccaacctgatcggacctgagggaggtgtgctaagcagcaccgtcgtgcctcaggtccaagcagtgttccctgagggtgccctgacgaagaggattcgcgtgggcttgcaggcgcagccaatgcactctgaattggtgaaaaagatccttggcaataaggccactttcagcccgattgtgaccctcgaacctagacgccgtaaattccacaaacccattacgatgacaatccctgtgcctaaggccagcagcgacgttatgctcaatggatttgggggagacgcgccaacgctcaggctgctgtgctccatcacaggaggcaccacaccagcccagtgggaggacattaccggcaccacccccctcacctttgtgaacgagtgtgtgagcttcactacaaatgtctctgctaggttttggctgattgattgtcgacagattcaagagtctgtgacatttgccagccaagtctatcgtgaaatcatttgcgtgccctacatggccaagtttgtggtgtttgctaaaagccacgatcctattgaggcaaggctgcggtgtttctgtatgaccgacgataaggtagataagactctggaacaacaggaaaacttcgcagaagttgccagatcccgtgatgtcgaggtgttggaggggaaaccaatctatgtcgactgcttcggcaaccttgttccgctgacaaaatctgggcagcaccatatcttttcgttctttgcgttcaaagagaaccgtttacctctgttcgtcaaggtgagggacactacacaggaaccgtgtggaagactgagctttatgaaagaaccaaagtctacgaggggactcgtgcaccaagccatctgcaacctgaacatcacgctgccaatatacactaaggaaagcgaatccgatcaggaacaagaagaagagattgatatgaccagcgagaaaaatcctcaggacgaacaggaaaggattgaggaaagactggcttacatcgcagaccaccttggattcagctggaccgagttagctcgagagctggactttacagaggagcaaatacaccaaatcagaattgagaatcctaacagcctgcaggaccaaagccatgcactgctgaaatactggctggagcgggatggcaagcatgccacagacaccaacttagttgagtgcctgacgaaaatcaatagaatggacatcgtccacttaatggagaccaatacagagcctctgcaggagcgaataagtcacagttatgccgagatagagcaaacaataaccctggaccacagtgaaggattttctgtgctccaggaggagctatgcaccgcccagcacaaacagaaggaggagcaggccgtgtctaaggaatctgagacctgcgatcaccccccaatagtttctgaagaagacatctccgtgggctactcaactttccaagatggagtccccaagactgaaggcgacagttctgccactgctttgtttcctcaaactcacaaggagcaagtccaacaggatttctcaggcaagatgcaggacctgcccgaagaatcctctctcgagtatcagcaggagtacttcgtgacgactcccggtaccgagacctccgaaactcagaaggctatgatcgtcccttcgtctccttctaaaacccccgaggaagtatccactccagccgaggaggaaaagctttacctacaaacccccacaagctctgaaagggggggttccccgatcatccaagagccagaagagccaagtgagcacagggaggaatcgagtcctaggaaaacatccctggttattgtcgaatcagcagataatcagcccgagacttgtgaaaggctggacgaggatgcagcctttgagaaaggtgatgacatgccagagatccctcccgaaactgtgacagaggaggaatacattgacgaacatggccataccgtggtaaaaaaggtgacgcgaaaaataatcagacgctatgtatccagtgagggaactgagaaggaggagataatggtgcagggaatgccgcaagaacccgtaaatattgaagagggagatggatactccaaggttataaagagagtcgtgcttaaaagtgataccgagcagtctgaggataataatgagta

SEQ ID NO: 214415 - DNA, 5585 bp, Artificial Sequence
  Description of Artificial Sequence: Synthetic coding sequence
atggcgtcatccgctagctcttcccccgctggcaccgaagatagtgctcctgcccaggggggatttggatccgattactcccgttcctccaggaagagcgacgccaacgcttcatatctgagagctgcaagggctggccacctggagaaggcgctggactacatcaagaatggcgtagacataaacatttgcaaccagaacggcctgaatgctctgcaccttgcctctaaagagggccatgtggaggtcgtgtcagagctcctccagcgcgaagccaatgtggacgcggctaccaagaaaggcaacactgccctccacatagcctctctggctgggcaggctgaagtggttaaagtgctggtgacaaatggagcaaacgttaacgcccagtcccagaacggctttacacctctgtatatggccgcacaggaaaaccatctcgaggtcgttaagttcttacttgataacggcgctagccagtccctggctacagaggacgggttcactccgcttgcagttgccctacagcaaggacatgaccaggtagtatctctgcttctggaaaacgatactaagggtaaggtcagactcccagccctgcatattgccgctcgaaaagacgacacgaaggccgcagccctgctccttcagaacgacaacaacgccgatgtggagtcaaagtccggatttaccccactccacatcgcagctcactatggcaatattaacgtggcaaccttgctgctgaatcgagccgcagccgttgactttaccgcccgaaatgacattacccctttgcacgtggcttccaagaggggcaacgcgaatatggtgaagctgctgctggatcgtggggctaaaatagacgcaaagacgcgggacggtttgacaccgcttcactgcggggcaagaagcggtcacgagcaggtggtggaaatgctgctggaccgggcagcccctattttaagcaagacaaaaaacgggcttagtcccctacacatggcgacccagggagaccatctgaactgcgtccaactcctattgcagcacaatgtcccggtggacgacgtcacgaacgattacctgacggccttgcacgtcgctgctcactgtggccactacaaagtggccaaggttctgctggataaaaaggctaaccccaacgcaaaagcattgaacggcttcaccccgttgcacattgcttgtaagaagaaccggataaaggtgatggagctattgcttaagcacggcgctagcattcaggccgtaacagaatccggactcacgcctattcatgttgcggctttcatgggacacgtgaatattgttagtcagctgatgcaccacggcgctagccccaatacaactaacgtgaggggcgaaaccgcgctccacatggccgcacggtccggccaggccgaggtggtcaggtatttggtccaggatggagcacaagtcgaggctaaggccaaggacgatcagacccctcttcacatctctgcacggttaggcaaggctgacatcgtccagcagttactgcagcagggagcatcccctaacgcagctacaactagcggctacactcctctccacctttcggcgagagagggccatgaagatgtggctgctttccttcttgatcacggcgcatcactctctatcacaactaaaaaaggattcacacctttgcatgttgctgctaaatacggcaaactcgaagttgccaatctgctcttgcagaagtctgcttcgccggatgcggcagggaaatcaggccttactccgcttcacgttgctgctcactatgataatcagaaggtggccctgctcctcctggatcagggtgcctcgccccacgccgctgctaagaacgggtatacacccctgcacatcgctgccaaaaagaatcagatggatatcgccaccacactacttgaatatggagccgacgccaatgctgttacacgccagggcatagcatccgtgcatcttgctgcacaggaaggacatgtggatatggtgtcacttttattgggcagaaatgccaacgtcaacctgtctaataagtctgggctgacacctctgcatctagccgcacaggaggacagagtcaacgtggctgaagttctcgttaaccagggcgcacacgtggacgcgcagactaagatgggctacactcctttgcacgtgggctgtcattacggcaatattaagattgttaacttcctgctgcagcactctgctaaagtgaatgcaaagaccaagaacggatatacgccactgcatcaggcagctcagcagggccacactcatataataaatgtcctactccagaataacgctagccctaatgagctgactgtgaacggcaacacagcactgggcatcgcgcgacgcttaggatacattagcgtggtggatacactcaaaatcgttaccgaagagacaatgactacaaccaccgttaccgaaaagcacaaaatgaacgtccctgagacaatgaatgaagtgttggacatgagcgacgacgaggtgaggaaggcgaatgctcccgaaatgttatccgatggcgaatatatctcggacgtggaagagggagaggatgctatgacaggtgataccgataagtacttgggcccacaggatctgaaagaactcggggacgatagtctccccgcagagggctacatgggcttcagtctgggcgctagatccgcatccctgcggagtttctcctccgatcggagctacacactgaacaggtcttcatacgccagggatagcatgatgatagaggagctattagtccccagtaaagaacagcacctaacattcactagagaattcgatagtgacagcctgagacattacagctgggcggctgatacactggacaacgtaaatctggtcagcagcccgatccattctggctttttggtgagctttatggtcgatgcaagggggggtagtatgcgcggatcgcgacaccacggaatgagaatcataattccaccccgtaaatgtacggcgcctacccgaataacctgtcgactggtgaagagacataagcttgcaaatcctcccccaatggtcgagggcgagggacttgccagtcgcctcgtggaaatgggtcccgctggcgcacagtttttaggcccagtgattgtcgagatcccacactttgggtctatgagggggaaagagcgcgaactgatagtactcagaagcgagaatggggaaacttggaaggaacaccagtttgactccaagaatgaggatttgacagaactgttaaacggaatggatgaagaactcgatagccctgaggagctgggcaagaaaaggatttgcagaataattaccaaggattttccccagtactttgctgtcgtgtctagaatcaaacaggagagcaaccagatcggtccggagggaggaatcctgagttccacgacggtgcccctagttcaggctagttttccagagggagccttgacaaaaaggatccgggtgggactgcaggcacaacccgtgcctgacgagatcgtgaagaaaatccttggcaataaggcaacattttcccccatcgttacagtagaacccaggcgtcgtaaattccacaagcctataactatgactattccagtacccccacctagcggtgaaggggtgagtaacggatataagggagatactacccccaacttgcggctcttatgctcaattaccggcggtacaagccctgcccagtgggaggacattacaggcacaaccccgctgacattcattaaggactgtgtaagttttactacaaatgtgtccgcacggttctggttggcagattgtcatcaagtgttggagactgtgggtctagcgacacagctatatcgtgagctaatctgtgtaccctacatggccaagttcgtggtctttgcaaagatgaacgaccccgtggagtcttccctccggtgcttttgcatgactgatgacaaggtagacaaaacccttgaacagcaagagaacttcgaggaagtggctcgtagtaaagacattgaggtgttggaggggaagcctatctacgtagactgctatggtaatcttgcgccactgaccaagggaggtcaacaattagtgtttaacttctactcattcaaagagaatcgactgcccttctctattaagatccgagatacatcacaagagccctgtggccgattgtccttcctaaaagaaccaaagaccaccaagggcctgcctcagaccgccgtttgcaaccttaatattaccctgcctgcccacaaaaagatcgagaaaactgaccgtagacaatcttttgccagcttggcacttaggaagagatacagctacctcaccgagcctggcatgagtccgcagtccccctgcgaacggacagatattagaatggccattgtggccgatcatttgggacttagctggaccgagcttgcacgagagctgaatttttccgtcgacgaaatcaaccagattcgggtcgagaatccaaatagtctcatatcccagtcattcatgttgctcaagaagtgggttacaagagacgggaaaaacgccaccacagacgccctcactagtgttctcaccaaaattaaccgtatcgacatagttactttgttagaaggcccaatcttcgactacggtaacataagcggcactcggagttttgctgacgaaaataacgtgtttcacgatcctgttgatggctacccctcgctgcaggtggaattagagactccaacgggactccactacacgcctcccacaccgttccagcaggacgattatttcagcgacatctccagcatcgaatctccgttaagaaccccgagcagactcagcgatgggctggtgccaagccagggcaacatcgaacactccgcagatgggcctccggtggtgacggcagaagacgcaagcctcgaagactcaaagcttgaagactctgttcccttaaccgaaatgccggaagccgtcgatgtagatgaatcacagttagagaacgtctgcctatcttggcagaatgagaccagttcaggaaacttagaatcctgcgcgcaagcccgtagagttacaggcggtctgttagaccgtctggatgactcaccagatcagtgtcgcgacagtatcacttcatacctgaaaggagaagcaggcaaatttgaagctaacggatcccacactgaaattactcccgaagccaaaacaaaatcatatttccctgaatcccagaatgatgtcggtaaacaaagcacaaaagaaactctcaaaccaaaaatccacggcagtggacacgttgaggagccagcaagtcctctagccgcataccagaagagcctcgaagagacgtcaaaactgatcattgaggaaaccaaaccatgcgtgcctgtgagcatgaaaaagatgagcagaacaagcccagcagacggcaaacccaggctcagcctgcatgaagaggagggcagctctgggtcggagcaaaaacagggggagggatttaaggtgaagaccaagaaggagatccgacacgtcgagaagaagagccactcata

SEQ ID NO: 214416 - DNA, 5606 bp, Artificial Sequence
  Description of Artificial Sequence: Synthetic coding sequence
atgtccgaggagcccaaggaaaagaacgcaaaaccagcgcaccgtaaacggaaggggaagaagtctgatgctaatgccagttacctcagggccgctcgagccggtcaccttgaaaaagccttggactatattaagaacggcgtcgatatcaacatatgcaaccagaatggcttgaacgccttacacctcgcctccaaggaaggccatgtcgaagtggtatctgagttgctgcagcgcgaggccaacgtagatgccgcaaccaagaagggaaacacggctttgcacatcgcatctttggctgggcaggccgaagtggtgaaagtactcgtgacgaacggagccaatgtaaacgcacaaagtcaaaatggatttactcctctgtacatggccgctcaagaaaatcacctggaagtggttaagttcctccttgacaatggcgcatctcaaagtctagccaccgaggatggcttcacacccctggcagtggccctgcaacagggccacgatcaggtggtttcactcttgctggaaaacgacaccaagggaaaagtccgcctgcccgcattacatattgcagcccgaaaagacgacactaaggctgccgctcttctgctgcagaatgacaacaacgcggacgtcgagagcaagagtggatttacccccttgcacatcgctgcccactatggaaacatcaacgtggcaacactgctgctaaaccgggcagctgcggtggattttacggccagaaatgatatcactccccttcatgtcgcctctaaacgcggtaatgccaatatggtgaagttactgttagatagaggagccaagattgatgctaagacgcgagatggcctgacccctctgcattgtggtgctcgctccggccatgaacaggtggttgagatgctgctggatcgcgcagcgcctatactgtccaagaccaagaacggactgtctccactgcatatggccacacagggggaccatctgaattgtgttcaactgctgctgcaacataatgtgcccgttgatgatgtaacgaacgattacctcactgccctacacgttgctgcacactgtgggcactataaggtcgcaaaggttctattggacaaaaaggcaaatccgaacgccaaagccctgaacgggtttacaccgttgcatatcgcgtgcaaaaagaatcgaatcaaggtgatggagctccttctgaagcacggagcttctattcaggctgtaacggagtctggcttaacacctattcatgtcgcagctttcatggggcacgtgaacatagtgtctcagctgatgcaccacggtgcgtcacctaatactactaatgtacggggagagactgccctgcatatggctgccaggtcgggccaagcagaagtggtccgatacctggtccaagatggtgcccaggtcgaggctaaagcaaaagacgatcagacacccctgcacatatccgccagactgggtaaggcagacattgtgcagcaattattacaacagggagcctcccctaacgccgcaacaaccagcggctacacgccactgcacctcagcgcacgagaaggccacgaggacgtcgccgctttcctgctggaccatggcgcttccctgagtattaccaccaagaagggcttcacccccctccatgtagctgcgaagtatggcaagctcgaggtggccaacttacttctacaaaagtcagcgtcccccgatgctgccggaaaaagcggattgactcctctgcatgtggccgctcattacgacaatcaaaaagtggcactgctcttgctggaccagggagccagtccacacgccgcagccaagaatggctacacgccgctgcatatcgccgcaaagaagaatcagatggatatagcaaccactctgctggagtacggggctgacgccaatgcggtcactaggcagggaatcgcttccgtccaccttgctgctcaagagggtcacgtggatatggttagcctcctgcttggccgtaatgccaacgtgaacctctccaataagagcgggctaaccccactgcatctcgcggctcaggaggaccgggtgaatgtggctgaggtgcttgtgaatcagggcgctcacgtggacgctcaaacgaagatgggatacacccctctccacgttggttgtcactacgggaacattaaaatcgtaaacttcctcctgcagcacagcgcaaaagtcaatgccaagaccaagaatgggtatacgcctctccatcaggccgctcaacaggggcatacccatatcataaacgtcctgctgcaaaacaatgcctctcccaatgagctgacagttaacggtaataccgcccttgggatagctcggaggttgggttacatctcagtggtcgacactttgaagatcgtgactgaggagaccatgacaacaactactgtcaccgaaaaacacaaaatgaatgtgccagaaaccatgaacgaagtgttagatatgagtgacgacgaagtaagaaaagctaacgccccagaaatgctgagcgacggtgagtacatctctgacgtggaggagggcaacaggtgtacatggtataaaattcccaaggtgcaagaatttaccgtgaagtctgaagacgcaatgactggagataccgacaaataccttggcccacaggatcttaaggagctgggcgatgactcccttcccgctgaaggctatatgggcttttccttaggggctcgatcagcatccctgagatctttctcttcagatagaagctataccctgaatagaagcagctacgcacgggacagcatgatgatagaggagctgctggtgccttctaaggagcagcacctcacattcaccagggaatttgatagcgattccttgaggcactactcatgggcagccgacacacttgacaatgtaaaccttgtctctagtcctattcactcggggttcttggtgtcgtttatggtcgacgctcgtgggggatcgatgaggggatctcgccaccatggtatgagaatcattataccccctcgaaagtgcacagccccaaccagaatcacatgccgcctcgtgaagcgccacaagctcgccaatccgccaccaatggttgaaggagagggcctggccagcagactggttgaaatggggccagctggcgcacagttccttggacccgttatagtcgaaattccccatttcggatccatgcgcggaaaggagcgcgagttaattgtactcagatccgagaacggggaaacgtggaaggagcaccagttcgattccaagaacgaagatctcactgagcttttaaatggtatggacgaggaactagattccccagaagagcttgggaaaaagaggatctgcagaatcataaccaaggattttccgcaatatttcgccgtggtgagccgcataaaacaggaatccaaccagatcgggcctgagggcggtatcctgtcatccaccactgtaccgctggtgcaggcatccttccctgaaggagcactgaccaaaaggattagggttggtctgcaggcccagcccgtgcccgacgaaatcgtgaagaaaatcttaggcaataaggccacatttagtccgatcgtcactgtcgaacccagacgccgtaagtttcacaaaccaatcactatgacaattcctgtcccgccaccttcaggcgagggcgtgagtaatgggtataaaggcgacaccaccccgaacctgagactactctgttccatcacagggggaacttcccctgcccagtgggaggatatcactggcactacaccactcacatttatcaaagattgcgtttctttcactacaaatgtaagtgctaggttttggcttgcagactgccaccaggtactggagaccgttggactggccacgcaactgtacagggagctgatctgcgtcccatatatggccaagttcgtggtcttcgctaaaatgaatgatcctgttgagagttccctgcgatgcttttgcatgactgacgataaggttgacaaaacccttgagcaacaggagaactttgaagaggtggcccgtagtaaggatatagaggtgctggaggggaagcctatctacgtggactgttacggtaatctggcaccattaaccaagggaggccagcagctagtcttcaatttttactcttttaaagagaacagactgccattctctattaaaattcgtgacaccagccaggaaccttgtggccgactcagctttttgaaagagccaaagacaacaaaaggactcccacaaactgccgtgtgtaacctgaacattacgctgcccgcacacaagaagattgagaagactgacaggaggcagagcttcgcatcactagcacttaggaaacgctactcctatctgaccgagcctggcatgtctcctcaatccccctgtgagagaaccgacattcggatggccattgtggccgaccatctcggccttagctggacagaattggccagggagctcaatttctcagtggacgagatcaatcaaatccgggtcgagaatccaaattcccttatttcccagagctttatgctgcttaagaagtgggtgactagggacgggaaaaacgcaaccaccgacgcactgacctctgtccttactaaaataaatcggattgatattgttactctcctcgaagggcctatctttgattatgggaatatttcagggactcgcagtttcgcggacgaaaacaatgtatttcacgaccctgtcgatggctacccttctctgcaagtcgaacttgaaacacctaccggcctccactataccccccctaccccattccagcaggacgattacttctctgatatctcttcaattgaatccccccttcgaacccccagccggctgagcgatgggctcgtacccagccagggtaacatcgaacacagcgctgatggtcctcccgtagtgacagcagaagatgcttcattggaggacagtaagcttgaagatagcgttccactgactgagatgcccgaagcggtggacgtggacgaaagtcaactcgagaacgtgtgtttatcctggcagaatgaaacctcatcaggcaatttagaaagctgtgctcaggcaaggcgcgtcaccgggggtctgctggatcggcttgatgattctccagatcagtgtcgtgacagtatcacgagctatctgaagggtgaagcaggcaaatttgaagcaaatggatcacatacagaaattaccccagaagccaaaacgaaatcgtacttccctgagtcccaaaatgacgtcgggaagcagtctaccaaggagaccttgaaaccaaaaatccacggctccggacacgttgaagagccagctagtccactggccgcataccaaaagtccctggaggagacctcaaaactcattatcgaagaaacgaagccctgcgtgcccgtctctatgaaaaagatgtctcggacctcccccgctgatggaaaaccacgactttccctgcacgaggaggaaggttcctccggatctgagcagaagcagggggaaggctttaaggtgaagaccaagaaggaaatccgacacgtcgaaaagaagagtcatagcta

SEQ ID NO: 214417 - DNA, 13134 bp, Artificial Sequence
  Description of Artificial Sequence: Synthetic coding sequence
atggcacacgctgcctcccagctgaagaaaaacagggaccttgagataaatgcagaggaagagcccgagaagaagcgaaagcaccgaaagaggagtagggatcgcaagaagaagtcagatgccaatgcgtcctatctaagagctgccagagctggccacctggaaaaggccctcgactatattaaaaatggcgtggacattaacatttgcaaccagaatgggttaaatgcactgcacttagcctcaaaggagggacacgtagaagtggtctctgaactcctccagagagaagccaacgtggacgcagctaccaaaaaggggaacaccgctctgcatattgcttccctggccggacaagctgaggtcgtcaaagtcctggtaacaaatggcgcaaatgttaacgctcagagccaaaatggtttcaccccactttatatggctgctcaggagaaccacctggaagtggtaaaatttctgcttgataacggagccagccagagtcttgccacagaggacggtttcacgcctctggctgttgcattgcagcaaggccacgaccaggtggtgagcctactgttagagaacgacaccaaagggaaggtacgcttacccgcactccacatcgccgctcgcaaagatgataccaaagctgctgccctgctacttcagaatgataataacgccgacgtggagagcaagtccggctttacacctttacacattgccgcacattatgggaacataaacgtggcaacgctgctgttgaatagggctgcagctgtcgatttcaccgctaggaatgacatcacaccactgcacgttgcatccaaacggggtaatgccaatatggtgaagctcctcttggatcgaggagctaagatagatgccaagaccagagatggattgacacctctccactgtggagctaggagtgggcacgagcaggtggtggagatgctgctcgaccgcgctgcccctattctctccaagaccaagaacggactctctccccttcatatggccactcaaggagaccatcttaactgcgtgcagctactacttcagcataatgtgccagtggacgacgtgaccaacgattacctcactgctctgcacgttgctgcccactgtgggcactataaggtggctaaggtgttgctggacaagaaggccaacccgaacgcaaaggctttgaatggctttaccccgctgcacatagcttgcaagaagaatagaataaaggtgatggagcttctgctcaagcacggcgctagtatccaggccgtgactgagtcagggctcacacccattcatgtcgctgctttcatgggccatgtgaatatcgtgtcccaacttatgcaccacggcgctagtcctaatacaactaacgtcagaggtgagaccgctttgcacatggctgctaggagtggccaggccgaggtcgtccggtaccttgtccaggatggcgctcaggtggaggccaaagccaaagatgaccagactcctcttcatatctctgccaggttgggcaaggctgatattgtgcagcagctattgcagcagggagcttcaccaaacgccgctacaacaagtggttacacccctctacatctgtcagcgagggaaggtcacgaggatgtcgccgcattcctgttggatcatggtgcgagtcttagcattaccactaagaagggattcacgcctcttcacgttgcggctaagtatggtaagcttgaagttgccaacctgcttctgcagaagtctgccagcccggatgctgccggtaagagcggtctgaccccattacacgtagctgcgcactatgacaaccaaaaggtggccctgttactgttagatcagggcgctagcccccatgccgctgcaaagaatggatataccccgcttcatattgccgcaaagaagaatcagatggatattgcaacgaccttactagagtatggagctgacgccaacgcagtgacgagacaggggatcgcttcagttcacctagctgctcaagagggccatgtggatatggttagcctactgctcggccgaaacgccaatgtgaacctctccaataagagtggcctcacccccctgcacttagcagcacaggaggatcgcgttaatgttgctgaggtgttagtaaatcaaggtgcccacgtggatgctcaaactaaaatgggttatactcctctgcacgttgggtgtcattatggaaacattaaaatcgtgaacttcctgctgcaacactctgcaaaggtgaatgccaagacaaaaaatggctatacacccctccatcaggccgcacaacagggccacacacacattatcaacgttcttcttcaaaataacgccagccccaatgagcttaccgtgaatgggaatactgcattaggaatagctaggaggctgggttacatcagcgtggtggacaccttgaaaattgtgacagaggagacaatgactaccaccactgtcacggagaaacataaaatgaacgtacccgaaactatgaatgaggtgctggacatgagcgacgacgaagtcaggaaggccaatgcaccggaaatgttaagcgacggtgagtacatatctgacgtcgaagaaggcgaggatgcaatgaccggggacacagacaaatacctcggtccccaggacctcaaagagcttggtgacgatagcctccctgcagagggttatatgggattctctctcggggctcggtccgcctcacttaggtctttcagctcggacaggtcatacaccctgaaccggagttcttacgcccgagactctatgatgattgaggaactgctggtgccatctaaagagcagcacctgaccttcacgcgcgaattcgatagcgactccctccgtcactattcctgggcagccgatactttagataatgttaaccttgtctcttcccctatccactccggattcctcgtgtccttcatggttgacgccagggggggtagcatgagggggagccgacaccacggaatgaggatcataattcccccacgcaagtgtaccgcaccgacccggatcacatgtaggctagtgaagaggcacaagctggccaatccccctcctatggtggagggtgagggacttgccagtagactggtggagatgggacccgcaggtgcacagttcttggggcctgtgatagtggagatccctcactttgggagtatgcggggaaaggaacgggaactgatagtgctacgatccgagaacggagaaacgtggaaggagcaccagtttgactctaaaaacgaagacttgacggagctgttaaacggcatggacgaggaacttgatagcccggaggaactgggtaaaaagcgtatatgtaggatcataacaaaagatttcccccaatacttcgcagtcgtttcccgcataaaacaggagagcaatcaaattggacccgaaggtggcatactgtccagcactaccgtgcccttggttcaggctagtttccccgaaggcgcactcactaaacgaatccgggtggggctgcaggctcagcctgtgcccgatgaaatcgtgaaaaagatcctgggtaacaaggcaacttttagtcccattgttacagttgagccacgccgtcggaaatttcataagcctattacaatgactattccagtcccaccgccaagcggcgagggcgtctcaaacggctacaagggcgacaccactcctaaccttcgcctgctgtgctctataaccggcggtacatccccggcacagtgggaagatatcacggggactactccgctgaccttcataaaggattgcgttagttttactacaaatgtatctgcacgcttttggttagcagactgtcaccaggtgttagaaaccgtggggcttgcaacccagctgtacagggaactgatctgcgtgccctacatggccaagtttgtggtcttcgccaaaatgaatgatccagtggagtcaagcctgcgctgtttttgcatgactgacgacaaggtagataagactctcgagcagcaagagaacttcgaggaggtcgcaaggtccaaggatatcgaggtgcttgagggcaagcctatttacgtagactgctacggcaacctcgcgccactcaccaagggcggacaacagttggtattcaacttttattcttttaaggagaacaggctccctttttccatcaagattagggacaccagccaggagccatgcggccgactgtcttttctcaaggagccgaagactacgaaggggctcccacagaccgctgtttgcaacctaaatataacgttaccagcacacaagaaggagaccgaaagcgaccaggacgacgagatcgaaaagacagaccggagacaatccttcgcctctttagcgctgagaaaacgatacagttacctgactgaacccggaatgatcgagcgcagcaccggcgctacaagatcgcttcccacaacatactcctacaagccattcttttccacacgtccgtaccaatcatggacaacagcgcctattactgtccccggtcctgccaagtctgggttcacatctttatctagctcatccagcaatactccatccgcgtctccattgaagagcatatggtccgtgagtactccttcacccattaagtctactctgggagcatccacaaccagctcagtgaagagcatttccgatgttgcaagcccaatccggtcatttagaaccatgtcttccccgattaagacagttgtgagccaatccccttacaatattcaggtcagcagcggcacgttggcccgtgcccctgcagtcacagaagccacccccctcaaggggctggcctctaactccacattttcctctaggacatctcccgtgactactgccggatctcttctggagcgctcctccattacaatgacaccaccagcaagccctaaatcaaatatcaacatgtactcgtctagtctcccattcaaatccattattacaagcgcagcccctctgatttctagtccactaaagtctgtagtgagccccgttaagtcagcggtcgatgtgatatcaagcgccaagatcactatggcctcctctctctccagccccgtgaaacagatgcctggacacgctgaggtcgcactggtgaacggaagcatcagtcctcttaaatacccctcctcttccaccctcataaacggctgtaaagctaccgccacccttcaggagaaaattagttctgccactaattccgtgtctagtgtggtgtctgcagccactgatacagttgagaaggttttttctactacaaccgcgatgccctttagtcccctgcggtcctatgtaagtgccgctcctagtgcctttcagtccctgcgcacgccatcagcctcagctttgtacacgtcactggggagctcaatcagtgccactacaagcagcgtgacatccagcatcattacagtaccagtgtacagcgtggtgaacgtgctcccggaaccagctctaaaaaagctaccagactcgaacagctttacaaagtctgcagcagccctgctgagtcctataaaaacgctcaccacagagacccaccctcagccacacttttcccgcacgagtagtcctgtcaaatcctccttgttcttggccccttctgccttgaagctttcaactccctcgtctctgagttcaagtcaggagattctcaaggacgtcgctgagatgaaggaagatttgatgaggatgacggctattttgcagaccgacgttcctgaggagaaacccttccagcctgaactgcccaaggaaggcagaatcgacgacgaagagccctttaaaattgttgagaaagtgaaagaagatctggtgaaagtgtcggaaattctgaagaaagacgtctgcgttgacaacaaaggatctcccaagagcccaaaatcagacaagggccacagtcccgaggacgactggattgagtttagctccgaagagatcagggaggcacggcaacaggccgcagcatcccagagtccatccctgcccgagcgcgtccaggttaaggccaaagcagcttccgaaaaagattacaatctgaccaaagtgattgattacctgaccaacgacattggctcttcgtcgctgactaacctcaaatataagttcgaagatgccaagaaagatggtgaggaacgtcaaaaacgggtactaaagcctgcaattgctctgcaagaacacaagttgaagatgccaccagctagcatgcgcacctctacctcagagaaggagctttgtaaaatggcggattcattttttggcactgatacaattctggagagtccagatgattttagtcagcacgatcaggataagtctcccctgagcgactccgggttcgagacccggtccgaaaagacgccatctgctccacagagtgcagagagcaccggtcccaagccactgttccatgaggtccctatcccacctgtgataacagagactaggacggaggtggttcacgtgatcagatcctatgacccttctgctggcgacgtgcctcagacacagcccgaggaacccgtgtcccccaagccatcacccaccttcatggaactggaaccaaagcctaccacctcctcaattaaagaaaaagtgaaggccttccagatgaaagcaagctccgaggaggacgaccacaatcgagttttatccaaaggcatgcgggtgaaggaggaaactcatattaccaccactacgcgcatggtctatcattcccctccagggggagagggcgcaagcgagaggatcgaggaaaccatgtctgttcatgatattatgaaagcctttcagtccggcagagacccatccaaggagctggctgggctgttcgagcacaagagcgccgtctcccctgacgtacataaatctgccgcagagactagcgcacagcacgcagagaaggacaaccagatgaaacctaagctggagaggataattgaggtccacatcgagaaaggcaatcaggcagagccaaccgaggtcattattcgggagaccaagaagcatcctgagaaggaaatgtacgtttaccagaaggacctcagccgaggggacattaatctcaaggattttttacctgagaagcacgacgcgtttccatgtagcgaagaacagggtcaacaagaggaagaggaacttaccgccgaagagtcactgcctagttacttggagagctcgcgggtcaacaccccagtgagccaagaggaggatagccgtccctcaagtgcccagctcatctcagacgactcatacaagactttgaaactgctgtcccagcattcaatcgagtatcatgacgatgaattgtcagagctccgtggtgagagttatagattcgccgagaaaatgctgctcagtgagaaactcgacgtttcccactcagataccgaagagtcagttaccgaccatgccggaccaccatcctcagagctgcagggcagtgataaacgaagtcgagagaagatcgccacggctcctaaaaaggagattctgagtaaaatctacaaggatgtgtctgaaaacggggtcggaaaggtatcaaaggatgagcatttcgacaaagtgacagtgctgcattactccggaaacgtctcttctccaaagcacgccatgtggatgcggttcactgaggaccgcctggaccgaggccgagagaagttgatctatgaagatagagtggatcgcacagttaaggaagcggaagagaagctgactgaagtgagtcagttcttccgcgataaaacagagaaactgaacgacgagctgcagagccctgaaaagaaggctcggccaaagaacggtaaagaatactcgtcgcagtctcctacaagctcttctccggaaaaggttctcctgaccgagctacttgccagtaatgacgagtgggtgaaggcccgtcagcatggtcccgacggccaggggtttccaaaagccgaagaaaaagccccaagccttccatcttcccccgagaagatggttttgtcccagcaaacagaggacagcaagtcaaccgtggaagctaagggctcgatttcccagtctaaggcacctgacggcccacagagtggattccaactgaagcaatcaaaactcagctctatacgcttgaagttcgagcaggggactcatgcaaagtccaaagacatgagccaagaggaccgcaagtccgacggccagtcacggatccctgtgaaaaaaattcaggagtccaaactgcctgtgtaccaggtttttgcacgggagaaacaacagaaggccattgacctccccgatgagtccgtctcggtccagaaggatttcatggtgctgaagacaaaagacgaacatgcccagtctaacgaaatcgtggttaatgacagcgggagtgataatgtaaagaaacagcgtacagaaatgtcttcaaaagctatgcctgacagtttctcagagcagcaagccaaagacctggcctgtcacatcactagcgacctggccacccgcggaccatgggacaaaaaagtgttccggacttgggagtccagcggagctacgaacaacaaaagtcagaaggaaaagctgtctcacgtattagtgcacgatgtcagagagaatcacataggacatcccgagagcaagtcagtcgaccagaagaatgaattcatgtccgtcaccgagagggaaagaaaactcttgaccaatgggtccctgagtgagattaaggagatgaccgtgaagagtccttctaagaaggtgttatatcgcgaatatgtcgtcaaggagggcgaccacccaggaggccttctcgaccagccctcgagacggagtgagtcatctgcagtgagccatattccggtgcgtgtcgcggatgaacgaagaatgctatcttctaacatccccgacgggttctgcgagcaaagcgcttttcccaaacatgagctgtctcaaaaattgagtcagagctcaatgagcaaagaaactgtggagacacaacattttaatagcattgaggacgagaaggttacttactccgagatatcaaaggtgtccaaacatcagagttatgtggggctgtgtccccctctggaagaaaccgaaacatctcccacaaagagtccagattcactcgaattcagccccggaaaagaatccccatcctcagacgtattcgatcacagcccaattgacgggctggagaaactagcccctctggcccagactgaagggggaaaggagattaagaccctgcctgtctatgtctctttcgtacaagtgggtaaacaatacgagaaggagatccaacaggggggtgtcaagaagattatttcccaggaatgcaagacagtgcaagaaactagaggcaccttctataccacacggcagcaaaagcagcccccttcccctcaggggagccctgaggacgatacgctcgagcaggtctcattcttggattcctctggaaagagtcctctgactcccgaaacaccctcttccgaggaggtgagttacgagtttaccagcaaaactcccgattcccttattgcctacattcctggtaaaccgtccccaataccagaggtgtctgaggagtctgaggaagaggagcaggctaaaagcacttccttaaagcaaaccaccgtggaagaaacggcggttgagcgagagatgcccaatgacgtcagcaaagattctaaccagcggcctaaaaacaatagagtggcctacatcgaatttccgcctcctcctcccctggatgctgaccagattgaaagcgataaaaagcatcattacctccccgagaaggaggtggacatgatcgaggtgaacctacaagatgaacacgataaataccagctggctgaacctgtcatcagggttcagcccccttcccctgtaccacctggcgcagacgtcagtgatagctcagatgatgagtctatttaccagcctgtgcccgtaaagaaatatacattcaagttgaaggaggtggatgatgaacagaaggagaaaccaaaagcgtccgctgaaaaggcatcaaatcaaaaagaactggagagcaacgggtcaggcaaggataatgaattcggactggggcttgacagtcctcagaatgagatcgcacagaacggcaacaatgaccagtctatcactgagtgcagcatcgccacaactgctgaattctcacatgacaccgatgcaaccgagattgactccctcgacggatatgatctccaggacgaagatgatggccttactgagtccgacagcaaactgcctatccaggccatggagataaagaaagacatttggaacactgaggggatcctgaagccagcagataggtcattttctcagtccaaacttgaagttatcgaggaagaaggcaaggtgggccctgatgaggataaaccaccttccaagagttctagcagcgagaaaactcctgataagactgaccagaagtctggtgctcagttttttacactcgaaggcaggcatcctgatcggtctgttttccctgatacttatttctcatacaaggtggatgaggagttcgccacgcccttcaaaaccgtggcgacgaaaggcctcgactttgatccttggagcaacaaccgcggtgatgatgaggtattcgactcaaaaagtcgtgaagacgaaaccaaaccattcggccttgccgtggaagataggtcacctgcgactactccagatacaacacccgcacgcacgcccacggacgagagcactcctacatccgagccaaacccgtttcccttccacgagggtaagatgtttgaaatgacccgatcaggggcaatcgatatgtccaagcgagactttgttgaagagcggctgcaatttttccagataggcgaacacacctcagaaggcaaatccggagaccagggggagggggataaatctatggttaccgccactccgcagccacaaagcggggatactaccgtggaaaccaacttggagcgaaatgtggagacacctacagtggagccaaacccctccatcccaacaagtggtgagtgccaagaggggacaagcagctcaggcagcctagaaaagtcagcagccgctaccaacacctctaaggtggacccaaagctgcggacccctatcaagatggggatttcagcaagcacgatgacgatgaaaaaggagggaccaggggagatcaccgataaaatcgaggccgtgatgacatcatgtcaaggactggagaacgaaaccatcacaatgattagtaacaccgctaactcacaaatgggtgtaaggccccatgaaaagcacgacttccagaaagataatttcaacaataacaacaatctagattcttccacaattcaaacggataacatcatgtctaatatcgttctgactgaacactccgccccaacttgcactactgagaaggacaatccagttaaggtgtccagcggaaagaaaaccggcgtattgcaggggcactgtgtacgcgataaacagaaagttctcggtgagcagcagaaaaccaaggagctaattggtattcggcagaaatctaaattgccaattaaggcaactagcccgaaagatacctttccccctaaccacatgagcaatacgaaagcaagtaaaatgaagcaagtgtcacagagcgagaagactaaagcactgaccacctccagctgtgtggatgtcaagtctcggatcccggtcaagaatactcacagggataacattatagccgtaagaaaggcctgtgccacacagaaacagggccagcctgagaagggaaaggccaaacagctccctagcaaactgccggtcaaggtgcgcagcacgtgcgttaccacaacaactaccaccgcgactaccacgaccaccacaaccacaaccactactactagttgtactgtcaaagtgagaaaaagtcaacttaaggaggtttgcaaacacagcatcgagtactttaaaggaatctccggggaaacgctgaagctagtggataggctgagcgaggaagaaaaaaaaatgcaatccgagctgtccgatgaagaggagtccaccagccgaaacacctcgctatccgaaacatctagagggggacagcccagcgtgaccaccaaatcagccagagacaaaaagaccgaggccgcacctctgaagtccaagagcgaaaaagcgggaagcgagaagcgcagctccagaaggactggcccacagagcccttgcgagagaaccgacatcagaatggctattgtggccgatcacctgggcctgtcctggaccgaactcgccagggagctgaatttctctgttgacgagatcaatcagattagagtcgaaaaccctaactccctcatttctcagtcattcatgttacttaagaagtgggtgacacgggatgggaaaaatgccactacagacgcacttaccagcgtcttaacaaagatcaacagaatcgacatcgtcacgcttctcgaaggacccatctttgattatgggaatataagtggtacccggagttttgccgacgagaataacgtattccacgacccggtggacggttggcagaacgagacttcatctggcaacctcgaatcatgtgcccaggccaggcgagtgaccgggggtctgctggataggctggacgattctcctgaccagtgtagagatagtatcacctcttatctgaaaggcgaggccggaaaattcgaggccaacggcagccatactgaaatcacaccagaggctaagaccaagtcatacttcccagagtcgcaaaatgacgtaggcaaacagtccacaaaagagactctgaagcctaagattcatggctctggacacgtcgaagaaccagccagtcccctggctgcctaccaaaagagcctcgaagagacatcgaagctgatcattgaagaaacaaagccatgcgtgccagtttccatgaagaaaatgtctaggacaagtccagcagacggaaagccgcgtctatcacttcatgaggaggagggctctagcggaagcgagcagaagcagggcgaaggtttcaaggtgaagaccaagaaggagatcagacacgttgagaaaaagtctcattcatat

SEQ ID NO: 214418 - DNA, 3006 bp, Artificial Sequence
  Description of Artificial Sequence: Synthetic coding sequence
atggccctgccacaaagcgaagacgcaatgaccggggatacagataaatacctggggccacaggacctcaaggagttgggagatgactctcttcctgccgaagggtacatggggtttagtttgggggcacggtccgcatccctacgctccttttcgagcgatcgcagctacaccctgaatcgatcttcttacgccagagattcaatgatgatagaggagcttctagtgccaagcaaagaacagcatcttacctttacccgggagttcgattcagattctcttcggcattattcctgggcagctgatacactcgataatgtgaacctagtatcttcccccattcactccggctttcttgtaagttttatggttgatgccagagggggaagtatgagaggatcgagacatcacggaatgcgaatcattatccctcctcggaaatgtactgctcctactagaattacatgcaggctggtgaagcgtcacaagctggccaatcctccaccgatggtggagggagaagggctggcctcccggcttgtggagatgggcccagccggtgcgcagtttctgggacccgtcatcgtggaaatccctcattttggatccatgcggggaaaggaaagggagttaatcgtcctgagatctgagaacggcgaaacttggaaggagcaccaattcgattccaaaaacgaagaccttacggaactacttaatgggatggacgaagagctcgacagccccgaggaattgggcaagaaacggatctgccgtatcataactaaagatttcccccaatactttgctgtggtctcccgaatcaaacaggaatccaaccagatcgggcctgaggggggtattctgtcttccactaccgttcccctggttcaggcctcttttcccgagggcgcactcacgaaacggatcagagtggggctccaggcacagcctgtgccagacgagatcgtgaaaaagatcctggggaacaaggccaccttcagtcctatcgttacagttgagccacgtaggagaaagtttcacaagccgattaccatgacaattccagtccctccaccttcgggcgagggagtcagcaacggctataagggcgacaccacccctaacttacgcctgctgtgctctattacaggtggtacgagccccgcacagtgggaggatataaccggaaccacgccattaacattcatcaaggactgtgtcagttttactaccaacgtttctgctagattttggctggcagattgccatcaggtgctggagacagttggcttggccacgcagctgtacagggaactgatatgcgtgccctacatggcgaaattcgtggtgtttgcaaagatgaatgatcccgttgagtcctcgctgagatgtttctgtatgaccgatgataaggtggacaaaactctggaacaacaggagaattttgaggaggtggctagatctaaggacatcgaagtgctggaaggtaagcccatatacgtagactgctatgggaacctggcacccctgacaaaaggtggccaacaacttgtgttcaatttctatagcttcaaagagaataggctgcccttctctattaagatccgggatacaagccaggagccatgcggaaggttatcattcctgaaggagccgaaaacaactaagggattgcctcaaacagctgtgtgcaacttgaatatcaccttgcctgctcacaaaaaaatcgaaaaaaccgataggcgccaaagctttgcttctctcgccctgcgcaagcggtatagttatctcactgaacctggaatgtccccacagtctccctgtgagagaaccgacataagaatggccattgtggcggatcatcttggcctgagctggaccgaactggccagagaattgaacttctccgtcgacgaaattaaccaaataagagttgaaaatcccaactcccttatcagtcagtctttcatgctgcttaaaaaatgggtcacccgcgacgggaaaaacgccactaccgacgccctaacatccgtgctaacaaagattaatcgcattgatatcgttacattattggaggggccaatcttcgactatgggaacatcagcggtacgcgttcatttgctgacgaaaataatgtgttccatgacccagtggatggctatccctccctgcaggtggaactggagacacccacagggctgcattacacacccccaaccccctttcaacaggacgattatttctcagacatttcatcaatcgaatcacctctgaggacgccatcaaggctgtccgacggtctcgtgccctctcagggaaacatcgaacactctgccgatgggccacctgtcgtcacagccgaggatgcgtcactggaagacagcaaactcgaggacagcgtcccccttacagagatgcctgaggctgtggacgtcgacgagtcgcaactggaaaacgtgtgcctttcctggcagaatgagacctcaagtggcaacttggaatcctgtgcccaggccagacgcgtgaccggaggactgctggatcggctggacgacagtcctgaccagtgtcgggattctattactagttatctcaaaggggaagccggaaagttcgaggcaaatggctctcacaccgagataacccctgaggccaaaactaaaagttactttcccgagtctcagaatgacgtggggaagcagtccaccaaagagaccctaaagccaaagatccacggctcgggacatgtcgaggagcccgcatctccactggcagcgtaccagaagtctttggaggagacctcaaagttaattatcgaggagaccaagccgtgtgtgcctgtgagtatgaagaaaatgtcacgtacctctccagcagatgggaagccacgtctctctttgcacgaggaggaggggagtagcggtagcgaacagaaacagggggagggctttaaggtcaaaaccaagaaggaaattaggcacgtcgagaaaaagtctcatagttag

SEQ ID NO: 214419 - DNA, 3306 bp, Artificial Sequence
  Description of Artificial Sequence: Synthetic coding sequence
atgtcagaggagcccaaggaaaaaaacgccaaaccagcacaccggaagaggaaaggcaagaagtcggatgccaacgcgtcttatctgcgggcagcacgagctggtcacttggagaaagctcttgactacatctctgtcgtagacactttaaaaattgtgacagaagaaacaatgacaacgactaccgtgactgaaaaacataagatgaatgttcccgagacaatgaacgaagtgctagatatgtccgatgacgaggtgcgaaaggctaacgcgcctgagatgctatctgacggcgaatatatcagcgacgttgaagagggagaggatgctatgacaggagacaccgacaaatacctggggccacaggatctcaaggaactgggggatgacagcctgcctgcagaaggatatatgggattcagcctgggcgctagaagtgcatcccttaggtcattctcaagtgatcgatcttacactcttaatcgttcatcttacgccagagacagcatgatgatagaggaactgctggtgccaagtaaggaacagcatttgacatttaccagggagtttgactctgactcactgcggcattacagttgggcggcagacaccttagacaacgtgaacctggtgtctagccccatccacagcggatttcttgtgagcttcatggtggatgcacggggagggagcatgcgcggatcacgacatcatggcatgcgtatcatcatccctcctcgaaaatgcacagcaccgactaggatcacatgcaggcttgtaaaaaggcacaagttagctaacccacctcccatggtcgagggggaagggcttgcttcgcgcctcgtagaaatggggcctgccggtgcgcaatttctggggccagtaatcgtggaaattccacatttcgggtccatgcgaggcaaggagagagagctcattgtactccgatcggagaatggtgaaacttggaaggagcaccagttcgactctaagaatgaagatctgaccgagctgctcaatggcatggatgaggaactggattctcccgaggaactcgggaagaaaagaatttgtaggattatcacaaaggactttccacagtattttgctgtggtaagcaggattaaacaggaatccaaccagatcggccctgagggtggcatcctcagctctactacagtacccttagtgcaggcttcattccctgagggcgctctgactaaaaggatcagggttggccttcaagctcagccagtccccgacgagattgtgaagaagattctaggaaataaggccacgtttagtcccattgtgaccgtagaacccaggagacggaagttccacaaaccgatcaccatgaccatccccgtccctcctccatccggcgagggagtaagcaacggctataaaggcgacacaacccccaatcttaggctcctgtgctcaataacaggtggcacctcccccgcacagtgggaagatatcacaggcacaaccccgctcacgtttatcaaagattgtgtttctttcactacgaacgtcagtgcccgtttttggttggccgattgccaccaggtgcttgagaccgtggggctggctactcagctgtatagagagctcatctgcgttccctacatggccaagttcgtggttttcgctaagatgaacgacccagtagaatcatccttgaggtgcttttgcatgactgacgataaggttgataagacattggagcagcaggaaaatttcgaagaggtcgctagaagcaaggacatcgaggtgctggagggcaagcccatttacgtcgactgctacggcaatctcgctcctttgacaaaaggagggcaacagctggtctttaatttctatagcttcaaggagaatcgtttaccttttagcatcaagatccgcgacacgtcacaggagccatgcggacgactaagcttcctgaaggaacctaagaccacgaagggtttacctcaaacggctgtctgcaacttgaatatcaccctgccagcccacaagaagattgagaagaccgacagacggcaatccttcgccagcctggccttgcggaagcgctactcttacctcacagaacctggcatgagtccccaatctccttgtgagcgcaccgatatcaggatggccatcgtggctgaccaccttggcctttcctggaccgagctcgcccgagagcttaacttctctgtggatgagatcaaccaaattagggtggagaaccccaactctcttatcagccaaagctttatgctacttaaaaaatgggtgacccgggacggcaaaaatgctacaacagacgcgctcaccagtgtgctgaccaaaataaatagaatcgacattgtgacactcttggaagggcctattttcgattatggaaatatctcaggcacccgctcgttcgccgatgagaacaacgtttttcatgaccccgtggacggataccctagcctgcaggtggagctagaaacgccgacaggactccattatacccctccaacaccctttcagcaagacgattacttctccgacatcagctcgattgagtcaccattgcggacacccagtcgattatctgatgggttggttccaagccagggcaatatagaacattctgctgacgggcctcctgtagtgaccgccgaggacgcttctctagaggacagtaagcttgaggatagtgtacctctgactgagatgccggaggccgtcgatgtggacgaatcacagctggagaatgtatgcctgagttggcagaatgagacctctagcggtaacttggaaagctgcgctcaggcacggagagtgacaggaggcttactggaccgcctcgacgacagccccgatcaatgccgcgactccatcacgtcctacctgaagggagaagctgggaagttcgaggctaacggaagccacacagagatcactcccgaggcaaagactaaatcgtactttcccgagtcccagaacgacgtcggtaaacagtctactaaggaaacccttaaacccaaaatccacgggtccgggcacgtcgaagaaccggcaagccccctggccgcttatcagaaaagtttggaagagacgagtaagctcatcattgaagagacaaagccatgtgtgcccgtgtctatgaagaaaatgtcccgcacgtctccagccgatggcaaacccagactaagtctgcacgaagaggagggctcttctggcagtgagcaaaaaggcgaaggattcaaggtgaagaccaaaaaggagatccgccacgtggagaaaaagtctcactcctag

SEQ ID NO: 214420 - DNA, 3387 bp, Artificial Sequence
  Description of Artificial Sequence: Synthetic coding sequence
atggcaacacagggggaccacctgaactgcgtgcagctgctactacagcataacgtgcccgtggacgatgtcaccaatgactacctcaccgcactccacgtagccgctcactgcggacattacaaggttgcgaaagtgttactggacaagaaggctaaccctaacgctaaggccctcaacgggtttacacccttgcacattgcatgcaagaaaaaccgaatcaaagtcatggaattgctactcaagcatggggctagcatccaggctgtaactgaatccggtctgactccgatccatgtggccgcttttatgggtcacgtcaatatagtatcacagttgatgcaccacggtgcttcccccaataccacaaatgtccggggagagactgcactccacatggccgcacgatctggccaagccgaggtggtgagatacctggtccaggacggagcccaggttgaagccaaggccaaagacgatcagacacctcttcacatctcagcgagactgggtaaagctgacatcgtacaacagctgctgcagcagggggcttcacccaacgcagcgacgactagcggctacacccctttacacctgtctgcgagggaaggtcacgaggatgtcgctgccttccttttggaccacggcgcttccctgtccatcaccacgaaaaaggggttcactccattacatgtggcagccaaatatgggaaactcgaggttgctaatctactacttcagaaaagtgcaagtcccgatgctgccggaaagtccggactcacacctctccacgttgcagcccactacgacaatcagaaggtggcgttgctgctgctcgatcagggagcctccccacacgcggctgcaaagaacggatacacgccactacacatcgccgctaaaaaaaaccagatggacattgccactactctgctggagtacggcgctgatgctaacgccgttacacggcaaggtatagccagcgtgcacctggcagcccaggagggccacgtggatatggtgtctctcctgttggggagaaatgccaatgttaacttatccaacaagagtggcctgacccctctacacctagccgcacaggaggacagagtaaatgtggcggaggtgctggtgaatcagggagcgcacgtggatgcccagaccaaaatggggtacaccccccttcacgtcggttgccactacggtaatattaaaatcgtgaactttctgctccagcacagtgctaaagtgaacgccaagacaaagaatgggtatacacctttgcaccaagcagcacagcagggacacactcacatcatcaatgtgctacttcagaacaacgcctctccaaacgagctgacggtcaatggaaatacagcattaggtatagctaggcggcttggctacatctccgtcgtagacactctgaagatcgtgacagaggagacaatgacaacaaccaccgttacagaaaagcataaaatgaatgtccccgaaacaatgaacgaagtactggatatgtccgacgacgagggggaggatgccatgactggggacacagacaagtatctgggtccccaggatcttaaggagttaggggacgactctctacccgcagaaggttatatggggtttagcctcggggcacgctccgcaagcagcgatcggtcatacactctgaatcggtccagctatgcccgtgacagtatgatgattgaagaattactggtccctagtaaggaacaacatctgactttcacccgggagtttgattccgattctcttagacattatagttgggccgctgacacccttgacaacgtcaatctggtctctagtcctattcatagcggcttcctagtcagcttcatggtcgacgctagaggagggagcatgcggggttcaaggcatcatggcatgcgcatcattatccccccaagaaaatgcacggcccctacacggatcacctgccggctggttaagaggcacaagcttgcaaacccccctccaatggtcgaaggagagggcctcgcgtctcggttagtggagatgggccctgcaggggctcagttccttggtcccgttattgtggaaatcccacatttcggttctatgaggggcaaggagagggagctcatagtgttgagaagcgaaaacggtgagacctggaaggagcatcaatttgatagtaagaatgaggatctgaccgaactcctgaacggaatggacgaagagctcgactcaccagaagaattggggaagaagcgcatttgtagaattatcacgaaagactttcctcagtacttcgctgtggtgtcaagaattaaacaagagtcgaatcagataggcccagaaggcggtattttatccagcactacggtccccctggtgcaggcctcgttccctgaaggggcacttaccaaacggatcagggtcgggttgcaggctcagcccgtcccggatgaaatagtaaaaaagatcctcggcaacaaagccactttttccccaattgtcactgttgagccaagacgtcgcaagttccacaaaccgatcacaatgaccatacccgttccacctccttcgggagagggcgtgtctaacggctataaaggagacaccacccctaacttgaggctgttatgcagcatcacagggggtacatctcccgctcagtgggaggacataaccggcacaacgccattgactttcatcaaagactgtgttagcttcacaactaacgtgagtgctcgcttttggctggctgactgccatcaggtgttagaaaccgtgggtctagccacgcagctgtatcgcgaattgatttgtgtgccgtatatggcaaagttcgtggtatttgccaagatgaatgaccctgtggaaagctccctgcgctgcttctgtatgaccgacgacaaggttgacaaaacactggaacagcaggaaaattttgaagaggtggccagaagtaaagatattgaggttctcgaggggaaaccgatctacgtcgactgctatggaaacttggcacccctgactaagggtggccagcaattagtgttcaatttctactcttttaaggaaaatagattgcccttttctatcaagattcgagatacatcccaggagccttgtggaaggctcagtttcttaaaagagcccaaaacaaccaagggcctgccgcagacagccgtttgtaatttgaatatcacactacctgcgcacaaaaaaattgagaagacggatcgccgacagagttttgcatcgctggctttgcggaaaaggtatagctacttgaccgaacctgggatgtccgagtttcctaataccttcacgaatacgtggatttttatcagacgtgatatctttagcattcagactaaattctag

SEQ ID NO: 214421 - DNA, 5543 bp, Artificial Sequence
  Description of Artificial Sequence: Synthetic coding sequence
tctgatgcaaatgcctcttatttacgggctgcacgagccggtcatctggagaaggcccttgattatattaagaacggcgtcgacattaatatatgcaatcagaatggtctgaatgcactgcacctggccagcaaagaagggcacgtcgaggttgtttcggaacttcttcagcgggaggccaatgtggacgctgccaccaagaaggggaacaccgcattacatattgcctcattggccggtcaggcagaggtcgttaaagtactggtcactaacggcgctaacgtcaatgcacagagtcagaatggctttacacctctgtatatggcagctcaggagaatcatctcgaggtggtaaaatttctacttgataatggcgcaagccagtccctggccacggaagatggtttcacccctcttgctgtggctctacagcaaggccatgaccaagttgtctcactcttactcgagaatgacaccaaggggaaagtgcggctccccgctcttcacatcgcagctcgaaaagacgatactaaagcagctgccctgcttcttcaaaacgataacaatgccgatgtggaatctaagagtggtttcactccacttcacatcgcagcacactacggaaacattaatgtcgcaacactccttctgaacagggctgcagccgtggacttcaccgctcggaatgacattacgccactccacgttgctagcaagcggggaaacgccaatatggtgaagttactcctcgacagaggcgctaagatcgacgccaaaacgcgcgacggattgacaccactgcactgcggagctcgatcgggccatgaacaggtcgtcgagatgttactcgaccgggctgcccctatactgagtaaaacaaaaaacggcttgtccccacttcacatggcaactcagggggatcacctgaactgcgtgcagctactgctccaacataacgttccagttgatgacgttaccaatgattatctgaccgctctccacgtggctgcccactgcggccactacaaagtggcgaaagtgctgctcgacaaaaaggcgaatcccaatgcaaaagccctgaacgggttcacccctctccatatcgcatgtaagaaaaataggatcaaagttatggaactgcttctcaagcacggcgctagcattcaagccgtgaccgaatcaggattgacaccaattcacgtggcggcttttatgggccatgttaacatcgtgtcacagctgatgcaccatggagcttctccaaatacgactaatgtgaggggtgaaaccgctctgcatatggccgctcgaagcgggcaggcagaagtggttagataccttgtccaggacggtgcacaggtagaggccaaagctaaagatgaccagacccccttacatatcagcgcaaggctggggaaagctgacatcgtccagcagctgttacagcaaggagcctctcccaacgccgctactacatccggctatacccctcttcatctgagcgctcgtgagggccacgaggacgtggccgctttcctccttgaccacggagccagcctcagcattacaacaaagaaaggttttacacctttgcacgtggctgcaaaatacggaaagttggaggtggctaacctcttgttgcagaagtccgccagccccgacgcagccggaaagtctggtctgacgccactacatgtggctgcacattacgacaaccagaaggtcgccctgttgctgcttgatcagggagccagtccgcacgctgcagcaaaaaacggttatacaccactgcacatcgcggcaaagaaaaatcagatggacatcgcgacgactctattggaatatggtgccgacgctaatgccgtgacacgtcagggtatcgcgtcagtccatttagccgcacaggagggacacgtcgatatggttagtttgctcctggggcgaaatgcaaacgtaaatctttctaataagagcggtctgacccccctccatctcgccgcacaggaggacagggtaaatgtggctgaggtgctcgtcaaccaaggggctcatgtggacgcacagacaaaaatgggctatacaccgcttcacgtcggctgccattacggcaacataaaaattgtgaattttcttctccagcactccgctaaagtcaacgctaagactaaaaacggctataccccgctccaccaagctgcacaacaggggcacacacatataattaacgtcctgttacagaacaacgcttcccccaatgaactgacagtgaacggaaatacagcgctcggcattgcacgaaggctgggctacatctcagtggttgacacattgaaaattgtcacagaggagactatgaccacaaccacagtcactgagaaacacaagatgaatgtgccagaaacaatgaacgaggtactcgatatgagcgatgacgaagttcggaaggcaaacgctcctgagatgttgtcagacggcgaatacattagtgacgttgaggaaggaaataggtgcacgtggtataaaattcccaaggtgcaagaatttaccgtaaaatccgaagatgccatgacaggcgacactgataagtatcttggcccacaggatttgaaggagttaggcgacgatagcttgcccgcagaaggatacatgggatttagtctcggcgctcgatccgcttccctgcgcagcttctcgtccgatcgaagttacacactgaacagaagctcctatgctcgcgactcgatgatgattgaggagctactagtgccatctaaagagcagcatctcactttcaccagagagttcgactccgatagcctgagacattacagttgggccgctgacacacttgacaatgttaatttggttagctcacccatccactctggctttctggtgtctttcatggttgatgcgcgtggtgggagtatgaggggttcacgacatcacggcatgcgcatcattatcccgccaaggaaatgtaccgccccaacccggattacctgtcggcttgtgaagaggcacaagctcgccaatcctccacccatggttgaaggagagggtctggctagtaggctcgtggagatgggacccgctggtgcccagttcctcggcccagtcattgtggaaattccacacttcgggagcatgcgaggcaaagaaagggagcttattgtgctaaggtctgaaaacggggagacctggaaggagcatcaattcgacagcaaaaatgaggacctgacagagctcctgaacggcatggatgaagaactggatagccccgaggaactcgggaagaagaggatctgcagaattataactaaagatttcccacaatacttcgccgtcgtgtctcggattaaacaggaatccaatcaaatcggtcccgagggcggaatcttgagctctacgaccgtccctctggtccaagccagcttcccagagggcgctttaacaaagaggattcgtgtagggctgcaggcccaaccagtccctgacgagatcgtaaaaaagattctcggaaataaagcgacattttctcctattgtcacggttgaacctcgtagaagaaagttccacaaacctataacgatgaccatccccgtaccaccaccttcaggcgaaggcgtgtctaacgggtataaaggggatacgactcctaacctgaggctgctatgctccattactggaggtaccagccctgcacaatgggaggacatcacaggaaccaccccactgacgttcattaaggactgcgtctcatttaccaccaacgtgtcagccaggttctggcttgctgattgccaccaggtgcttgagacagtgggcttggctactcaactgtacagggagctcatatgcgtgccctacatggccaagtttgtcgtgttcgctaaaatgaacgatccagtcgagagttctctcaggtgtttctgcatgactgacgataaggttgacaagactcttgaacaacaagaaaatttcgaagaagtcgcaagatcaaaagacattgaggtcctcgaaggcaaacctatctacgtggactgctacggtaatctcgctccactaactaaaggtggccagcagctggtttttaatttctacagcttcaaggaaaataggctgcctttctcaattaagattagggatacatctcaagagccttgtggaagactgtccttcttgaaagagcctaagactaccaaggggctacctcaaaccgccgtttgcaacctgaatatcaccttgcccgctcataagaagattgaaaagaccgaccgtcgacagtcgttcgcctccctcgccttacggaagcggtactcgtacctaaccgaacccggaatgagcccccagagcccctgtgagcgtacagacatacggatggctattgtggccgatcacttgggactcagctggacagaactggccagagagttgaacttttcagtggatgagatcaaccagatccgcgtcgaaaaccccaacagcctcatctcccagagtttcatgctgctgaagaaatgggtgactcgcgatggaaagaacgctactaccgatgcactgaccagcgtgctgaccaagatcaaccgaattgacatcgtgactctgctggaaggccctatcttcgactatggcaatatcagcggaacacggagcttcgctgacgagaacaatgtattccatgacccggtggacggctatccctcactccaggtggaattggagactcccactggcctgcactatactcccccaacaccatttcagcaggatgattattttagtgatatctcgtctatcgagagtccactccgaaccccctctcgcctcagcgatgggctggtgccctcccaaggcaatatcgaacacagtgcagacggacccccagtggtgactgctgaagatgccagcctggaggacagtaaactagaggacagcgtacccctcacggagatgccagaagctgtcgacgtcgatgagtcccagcttgaaaacgtctgtctctcctggcagaacgaaacatcttctgggaacttggagagctgcgcccaggccaggcgagtgaccggtggccttctggaccgactggacgactccccagatcagtgtcgagattctattacaagctatctgaagggtgaggcagggaagttcgaggcgaacgggtcccacacagagatcacgccagaggcgaaaaccaagtcatactttccggagagtcagaacgatgttggaaaacagtccaccaaagaaaccctcaagccgaaaatacacggtagcggccatgtcgaggaacctgcatctcccctggcggcataccagaaaagcctggaggaaactagcaagctgattatcgaggagactaaaccatgcgtgccagtcagcatgaaaaagatgagtcgcacctcgccagccgacggcaaaccccgtctcagcctacatgaagaggaggggtccagcggatctgagcaaaaacaaggagaaggctttaaggtgaagaccaagaaagagatccgccatgttgagaaaaagtcacactcata

SEQ ID NO: 214422 - DNA, 3354 bp, Artificial Sequence
  Description of Artificial Sequence: Synthetic coding sequence
atggccacacagggagatcacctcaactgcgtacagttgctgctgcaacataatgtgcctgtcgacgacgtgactaatgactatttaactgcgctgcatgtcgcagcacactgcggccactataaggtcgcgaaagtactcctcgacaaaaaagccaatccgaacgcaaaggctctgaacggatttacaccgctgcatattgcatgcaagaaaaacagaattaaggtgatggagctgctgctcaagcacggagcctccattcaggccgtcaccgagagtggccttacccccattcacgtggctgccttcatggggcacgtgaacatcgtgtcacagctgatgcatcacggtgcatcccctaataccactaacgtgcgaggtgagacagcactccacatggcagcacggtccgggcaggccgaagtagttcggtacctggtacaggacggagctcaggtagaggcaaaggcaaaggacgaccagactcctctgcacatcagcgctcggctgggtaaagccgatatagtgcagcaactgctgcagcagggggcttctcccaatgctgcaaccacaagtggttacactccgctccacttaagtgctagggaaggccacgaggatgttgcagcattcctccttgatcatggtgcatccctatccataaccaccaaaaagggattcactcctttacatgtcgccgctaaatatggaaaacttgaggtggccaacctgctactccagaaatccgcttcaccggacgccgctggtaagagcgggttaacacccttacacgtggccgctcactacgacaatcagaaggtagccctgctgttgctggatcagggagcctcccctcacgccgctgcaaaaaacggctacactcccctgcatattgctgccaagaagaatcagatggacatcgctactaccctgcttgaatatggcgctgacgccaatgccgtcactagacagggcatcgcctcggtccacctcgcagcccaggaaggtcatgtagacatggtgtctctgctcctgggccgtaacgccaatgatagtggactgactcccctgcatcttgccgctcaggaggacagggtgaacgtagcagaggtgctggttaatcagggtgctcacgtagatgctcagacaaagatgggatatactccactgcatgtcggctgtcactatggtaacataaagatcgtaaactttctgttgcagcactcagctaaagttaacgcaaagacgaaaaatggctatacccctctccaccaggctgcacaacagggacacactcatattattaatgttctgctacagaacaacgcatcccccaacgaacttaccgtgaacggcaatacggccctggggatcgcgcgtagactcggatacattagtgtggttgatactctcaaaattgtgacagaggaaaccatgaccaccacaaccgttacagaaaaacacaagatgaacgtgccagagacgatgaacgaggttttggatatgtcagacgacgagggggaagatgcgatgaccggtgacaccgacaaatatttgggccctcaggatcttaaggaacttggcgatgatagtctcccggcagagggctatatgggcttcagtttgggcgctaggagtgcttcactgcgcagtttctcctccgacagatcttacacgctgaatcgtagcagctacgcccgagacagtatgatgattgaggaactgctcgtcccttccaaggagcagcacctgacttttacacgcgagtttgactcagactcccttaggcactacagctgggctgctgataccctagacaatgtgaatctcgttagcagcccaattcactccggttttctagtgagcttcatggtggatgccagaggaggctcaatgcggggatcacggcaccacgggatgagaatcatcatcccacccaggaagtgcactgctcccacaagaatcacctgcagattggtgaagcgccataagttggcaaatccccctccaatggtggagggcgaagggctagcaagcaggcttgtcgaaatgggaccagcaggggctcagttcctcgggccagttattgtagaaattcctcacttcggctccatgagaggtaaagaaagggagttaatcgtgttacggtctgaaaacggcgaaacctggaaggagcaccaattcgattcgaaaaatgaagatctaactgagttactgaacggtatggatgaagagctggattcccctgaggaactcggcaaaaaacgtatctgtagaataattaccaaagactttccgcaatactttgcggtcgtcagtagaatcaagcaagaatcaaaccagattggccctgaaggcggtatcctgtcatcaacgactgttccgctggtacaggcaagcttccctgagggtgccctgacaaaaagaattagggttgggctgcaggctcaacccgtgccggatgagatcgtgaagaaaattctgggtaacaaagctacgttcagccccattgtgaccgtggaacccaggcgcagaaagttccacaagcccattacaatgactatccctgttccacccccaagcggcgagggcgtaagtaacggctacaagggggacactacccccaatctacgtctgctttgctcgatcaccggaggaacttcacccgcacagtgggaggatatcaccggaactaccccattgacttttattaaggactgtgtgtctttcaccactaacgtgtctgctcgcttctggcttgctgactgccaccaagtgttggaaacagtcggactagccacccaattatatagagaactgatctgcgtgccttatatggcgaagtttgtcgtatttgctaagatgaacgaccctgtggagagctctttgcgctgcttctgcatgaccgacgataaggttgacaagaccctcgaacagcaggaaaacttcgaggaagttgcaagaagtaaagacatagaggtgctggagggtaaacccatttatgtggattgttacggcaacctggctcctctcaccaagggcggacaacagttggtcttcaacttctacagcttcaaggagaaccgccttcctttctccatcaaaatacgggatacctcgcaggaaccatgtgggagattgtcgtttctgaaggaacctaagacaactaaaggcctcccccagaccgctgtgtgtaacctgaatatcacactgcccgcacacaaaaaaatagaaaaaacagaccggaggcagagcttcgcatcactcgctctaaggaaacgatatagctatctcaccgaaccaggaatgtcagagtttcccaacacatttacaaatctgcggggtttctcttag

SEQ ID NO: 214423 - DNA, 2436 bp, Artificial Sequence
  Description of Artificial Sequence: Synthetic coding sequence
atggccctgcctcagagcgaagacgctatgactggggacactgataaatacctcggtcctcaggatttgaaagaactgggagatgactcccttccggcagaggggtatatgggattttcactgggcgctcggtctgcatcactacggtcattttcctccgatcgaagctatactctcaatcggtcatcttacgcacgtgattctatgatgattgaggaactgctggtcccatctaaggagcagcacctgacattcacgagagaatttgatagcgactcgcttcgccactacagttgggcggctgatacattggacaatgttaacctggtcagtagcccaattcatagtggattcctggtatcctttatggtggatgccagaggcggaagcatgcgaggctcacggcatcatggcatgcgaatcattatccctccgagaaagtgtaccgcgccaacaaggattacctgtcggctggtcaaacgccataaactggcaaatccccctccaatggtcgagggagagggtttggcgagtcgcctcgtcgagatggggcctgccggagcccaatttctgggccctgttattgtggagatcccccacttcgggtcaatgaggggtaaagagagggagttaatcgtgttgagaagcgagaatggggaaacctggaaagaacatcagtttgacagtaaaaatgaagacctgactgagttactgaacggcatggacgaggaacttgactctcccgaagaactcggcaagaaacgtatctgtaggattatcactaaagacttcccccaatactttgctgttgtttcaagaataaagcaggagtccaatcagattgggccagagggagggattctcagctccacaacagtgccattagtccaagcctcatttcccgaaggagcactgaccaagcgcatccgcgtgggcctccaagcacagcccgttccagatgaaatcgtaaaaaaaatcctgggaaacaaagccacgttcagcccaattgtgactgtggagcccaggcggcgaaaatttcataaaccaattaccatgaccatccctgtcccccctccgtctggcgagggggtgagcaatggatataagggcgacaccacacccaatcttcgcctgctgtgtagtatcaccggcggtacgtcacctgcccagtgggaggatattacaggcaccacaccccttaccttcatcaaggattgcgtgtcctttacaaccaacgtgagcgctcggttttggctcgccgattgccaccaagtcctggagaccgttggcctggcaactcagctatatcgggaactcatctgtgtcccctacatggccaagtttgtggtctttgctaagatgaacgatcccgtagaatcctcactgaggtgtttctgtatgactgatgacaaggtagacaagacactggaacagcaggagaactttgaagaggtagcaagatctaaagacatcgaggtcttggagggaaaacctatttacgttgattgttatgggaacctggcaccccttaccaagggtggacagcagctagtctttaacttttattcatttaaggaaaatagactcccgttctccatcaaaatcagagacacatcacaggagccatgtggcagactcagcttccttaaggaaccgaaaacaacaaaagggctgcctcaaactgctgtctgcaatctgaacataaccctccctgcccataagaagattgagaaaaccgaccggcgtcaatctttcgccagcctcgcactgcggaagagatactcttacctgacagagcctggcatgagcccacagagcccatgcgagcgcaccgatattcgaatggctattgtggctgaccacttgggtttgtcttggaccgagttagcaagggagctgaatttcagcgtcgacgaaatcaatcagatcagggttgagaaccccaatagcctgatttctcaatccttcatgcttctgaaaaagtgggtcactcgggatgggaagaatgccaccactgatgccctaacaagtgtgctcacaaaaataaaccgcatcgatatcgtgaccctgctggagggccctatctttgattacgggaacatttccggtactcgatcatttgctgacgagaacaacgtgttccacgatcccgttgatggatacccttccctccaggtagaactcgaaacaccgacaggcctccattatacaccacccactccattccaacaggacgactacttttctgacatctcttctattgagtcaccactgcgaacccccagcaggctgagtgacggtttggtcccctcccagggtaacattgaacacagtgcggatggtccacccgtggtgactgccgaggatgcttcgttggaagacagtaagctcgaagactctgtgcctctcacagagatgccggaggccgttatgtag

SEQ ID NO: 214424 - DNA, 2796 bp, Artificial Sequence
  Description of Artificial Sequence: Synthetic coding sequence
tttacgttggcccatgtgccacaacggggagagaccgcactacatatggcggctcgatcagggcaagctgaggtcgtccgctacctcgttcaagacggagcccaggtcgaggcaaaagccaaagatgatcaaacccctctgcacatctcagccaggctcggcaaagcagacatcgttcagcaactcttgcagcagggggcatcacctaatgcagcgacaacttcaggttatactcccctacacctctccgctagggaggggcatgaagatgttgccgcatttttactggatcatggcgcttcactatccattacgacaaagaagggctttacccccctgcacgtggccgctaaatacggaaaattggaagtcgctaacttgttgctgcagaaatcagcaagcccagacgcagccggaaagtctggtctgactcctctgcacgtggctgcacattacgacaatcagaaggtagccttactgcttcttgaccagggggcttccccacacgctgcggctaagaatggatacacccctctgcatattgccgcaaaaaaaaaccaaatggatatcgcgacgaccctcctcgagtatggagcggatgccaacgcagtgacccgacagggtatagcttccgttcatctcgccgctcaggaaggacacgttgacatggtgagcttactgctgggccgaaatgctaacgttaacttatcgaataaaagcggattgacaccactacatttggccgctcaagaggatcgtgtgaatgtcgccgaggtgctcgtgaaccaaggagcccacgtagacgcccagacaaaaatgggatacacgccactgcacgtcgggtgccattatgggaacatcaagattgtcaacttcctcctgcaacattctgccaaggtgaatgcaaagactaagaacggctacactcccctgcaccaggccgcacagcaggggcatacccacatcataaacgtcctgttgcagaacaatgcaagtcccaatgagctgacagttaacggcaataccgccctaggtatcgccaggagactgggttatattagcgtggttgatacactcaaaatagtgactgaggaaacaatgacaaccaccaccgtgaccgaaaaacataaaatgaacgttcccgagaccatgaacgaggtgctcgacatgagcgatgatgaaggagaagacgccatgacgggggatacagataagtacctgggtccccaagatctgaaggagcttggagacgattcattgcctgccgaagggtacatgggcttctcactgggcgcaagatcagccagtcggagtttctcctcagacaggagctacactttaaatcgaagttcatatgccagggactcgatgatgattgaggaactgctggtccccagcaaggaacaacacctgacctttacccgagagttcgatagtgatagtctacgccactattcttgggctgccgatactctggacaacgtgaatctggtatccagccctatccacagtggatactcctccccgttaccccagtacgattcacggtttctggtttccttcatggttgacgcacgcggtggcagcatgcgtgggtcacgccaccacggaatgcggattataatcccgcctcgcaagtgcaccgcccctactagaatcacttgccgcctggtgaaacgacacaagctggcgaatcccccaccgatggtggagggagaaggcctcgcttctagattagtggagatgggccctgccggagcccaatttttgggccctgtgattgtagagattccacatttcggaagtatgcgaggtaaggagcgcgagctaatcgtgctcagaagtgaaaacggcgagacttggaaggagcatcagttcgactccaagaatgaagacctgactgagttattgaatggaatggatgaggagctggacagccccgaggaactggggaagaaacgtatatgtagaatcatcactaaagacttccctcagtattttgcggtggtatctcggattaagcaagaaagcaaccagatcgggcctgaaggagggatcctgtcttcaacaacagtaccactggtgcaggcatcgtttcccgagggcgctctgacaaaacggatcagagttggcctgcaagcacagcccgtaccagacgaaatcgtgaagaaaatcctgggtaataaggcaaccttttctcctatagttaccgtggagcctcgacgtcggaaattccacaaaccgataacgatgacaatccccgttcccccaccctcaggggagggcgtctctaatggatataagggagacactactcccaacctgcggctgctgtgttctataacaggagggacaagcccagctcagtgggaggacatcacaggtaccacccctctgacctttataaaggactgcgtttcattcacaaccaacgttagcgcaaggttctggttagccgactgccatcaggtactagagactgttggcctagctacccaactctaccgcgagttgatttgcgttccatatatggctaaatttgttgtatttgcaaagatgaacgatccggttgagagttctctacgctgcttctgcatgacagacgataaagtcgataagacacttgaacagcaagagaactttgaagaagttgctcgcagcaaggacatagaagtcccttgcagccagaagcaggttcattttataacatattcaaggtacgaggtgctattttgcggcctgaacagtacgcactacaagattccttctgctctgctgattttgttgcttctgtag

SEQ ID NO: 214425 - DNA, 1647 bp, Artificial Sequence
  Description of Artificial Sequence: Synthetic coding sequence
tccctgcctgagtccgaagacgccatgactggggacaccgataagtacttaggcccacaggacctgaaagagttaggggacgactcgctccccgctgaaggctatatgggcttttctctgggggctcgctccgcatctctgcgatccttctcttctgataggtcatacacgttgaaccgctcttcttatgcacgtgatagtatgatgatcgaggaactactggtgccttctaaagagcagcatttgaccttcacacgcgagttcgactctgacagccttagacactattcttgggccgcagacaccttggacaatgtgaatctggtttcatcccctatccattcaggcttcctggtgtcctttatggtggacgctcgagggggatcaatgagaggtagtcgccaccacggcatgcggatcattatcccccctaggaagtgcaccgctcctacaaggatcacctgtagactcgtgaagagacacaagctcgcgaacccccctcccatggttgaaggcgaagggctggcatccagattggtggaaatgggacctgccggtgcccagtttctcggaccagtaatagtcgagattcctcacttcggatctatgaggggcaaggagagagagctgatagtgctgcgctctgagaacggtgagacatggaaggagcatcaatttgactcaaagaacgaagacttaacagaactgttaaatggaatggacgaagagctggattcccccgaggaacttggaaagaagcgcatctgtaggatcatcacgaaggacttccctcaatattttgcggttgtgagtagaattaaacaggaatccaatcaaatagggcctgaagggggaatactcagttcaacaactgtcccactcgtgcaggcgagtttccccgagggcgctttaactaaaaggatcagggtggggctccaagctcagcctgtgcccgatgagatcgtgaaaaaaatcctcggcaataaggccaccttctctcctatcgttactgtcgagcccagacggaggaaattccacaaacctatcacaatgactatccccgtgccaccaccatccggagagggcgtaagcaacggatataaaggcgacactacccccaatttaagattgctctgttcgatcacagggggaacatctcctgcacagtgggaggacatcaccgggacgacgccattaacattcattaaggattgtgtgtccttcacaaccaacgtgtccgcccgtttctggctcgcagattgtcaccaggtgctggaaactgtgggacttgccacccagctttaccgcgaactgatttgtgttccctatatggctaagtttgtggtgtttgctaagatgaacgatccagttgagtcttccttgcgttgtttttgtatgactgatgacaaggttgataaaacgctggaacaacaggagaactttgaagaggtcgctagaagcaaagatattgaagtcttagaaggcaagccgatctatgtcgactgctacgggaatctggcacccctgaccaaagggggacagcagctggtcttcaacttctatagctttaaagagaacagactgcctttcagcattaaaattagagacaccagccagaatatagttcagctgtcatgcctcctgtag

SEQ ID NO: 214426 - DNA, 1443 bp, Artificial Sequence
  Description of Artificial Sequence: Synthetic coding sequence
atggccgtcgcccgtgccgctctcgggcctctggtgacaggactgtacgatgtacaggccttcaagtttggcgacttcgtgttaaaatcaggcctctcctcgcctatttatatagacttacgcggtatcgtgtctcggccaaggcttctctcccaggtcgctgacatactgtttcagaccgcccagaacgccggaatctcttttgacacagtctgtggcgtgccctatacggctctccctttggctacagtgatatgctccaccaaccagataccgatgttaattcgaagaaaggaaaccaaggactatggaactaagagactggtggaaggtactattaacccaggtgagacatgcttgattatcgaggacgtggtgacgagtggatcaagcgttctggagaccgtggaggtgcttcaaaaggaaggattgaaagtgacggatgctatagttctgttggatagagaacaggggggaaaagataagctgcaggcccatggaatcaggctgcactctgtgtgtactctcagcaaaatgttagagattctagagcagcagaagaaggtcgacgcagaaaccgtgggaagagtgaagaggtttatccaggagaatgtgtttgtggccgcaaatcacaatggttctccactctcaatcaaagaggccccaaaggaactgtccttcggtgccagggcggagctcccaaggatccaccccgtggcctccaaattgttgaggcttatgcagaaaaaagagacgaacctctgccttagtgctgatgtgagtctggccagggaactgcttcagctcgcagatgctttgggaccttcaatttgcatgctgaagactcatgtcgatattttaaacgacttcacactggatgtgatgaaagaactcatcactctggctaaatgtcatgagtttctgatttttgaagatagaaagtttgcagacatcggcaacacggtgaaaaagcagtatgaggggggtatatttaaaatcgcctcctgggcagatctcgtgaacgctcatgtggtgcctggaagtggcgttgtgaaaggacttcaggaggtgggcctcccgctgcataggggctgtcttctcatagcagagatgtctagcaccggatccttggctacaggggattatactagagccgcagtgcggatggcggaggagcattcagagttcgttgtcgggttcatcagtggctcgcgcgtctccatgaagccggagttcctccatctgacacccggtgtgcaactggaggccggaggcgataacttgggtcaacagtacaactctcctcaagaggtaatcggaaagagaggatctgacatcatcattgtcgggcgtggaattatctcagccgctgatcgtctcgaagctgccgagatgtataggaaagctgcctgggaagcctatttgagtagattgggtgtgtag

SEQ ID NO: 214427 - DNA, 1218 bp, Artificial Sequence
  Description of Artificial Sequence: Synthetic coding sequence
atggataccagtgacctattcgcctcttgtagaaaaggcgacgtgggaagggtgagatatctgctcgaacaagtgctgtacctgctggctaacggcgcacggtgtgaagctaacacgtttgacggagagcggtgcctctacggtgccctgagcgatcctataagacgcgctcttcgggattataagcacccactgctctgggatctgctctcagacctcgaggccaaatgcgagaaggtctccgagtttgttgcaagcaagcctggaacttgcgtaaaggtgctaactatcgaacctcccccagcagaccctagactgagagaagacatggcgctccttgcagattgcgctcttccacccgagcttagagctttcttttgtggcaggagtgattacttccgtgccctactggacgaccacttccgggaatccgaggagccagcaacttctggtggaccaccagccgtcaccctgcacgggatttcacccgatgtgttcacacatgttctgtactacatgtattccgaccacaccgagttgagccccgaagccgcttatgacgtactgtcagtggccgacatgtacctgttgcctgggctgaaacggctctgcgggaggtcactggctcagatgttggacgaagacacagtcgtgggagtctggagagtcgctaaactatttcggcttgctcggctggaagatcagtgtacggagtatatggccaaggttattgaaaagttagtggagcgagaagattttgtggaagctgtcaaagaagaggccgctgccgtcgctgcccgacaggagacggacagcatccctctcgtcgatgacattaggttccatgtggcttctacagtgcagacatacagcgccattgaggaggctcagcagcgcttaagggccctggaagacacctctatgtgcatgcgcctgtgcgctgctttgctgcccgcaccatgcaccttgcgcgcatcctggggcgtgcgtggtgcgcagtggggcttttccagtctgcacgaacccggagatccccgaggaggttcaatctgggacgagccccctccccctaacgcccaagcatcaccccaggacccaggtgggggacaccactccgggaagcccggtgtaggcgttggattcggcctttccacttttctcttacagatccctcctactcacccttcacctaaatcctctcccttagcgctcgcttag

SEQ ID NO: 214428 - DNA, 1011 bp, Artificial Sequence
  Description of Artificial Sequence: Synthetic coding sequence
atgctggacacaaaatggaagggcaagtccgtcgtcgtacttcggcaccccttgattaatccggttgccttcggagcccttctgcagtatctgtacactggccgactggatattggagttgagcacgtcagcgattgtgaacggttagctaaacagtgccagttgtgggatctgctcagcgatctggaagcaaagtgtgaaaaagtgagtgagttcgtggcttctaagccaggaacctgcgtgaaagtgctcacgatcgagccgccacccgcagaccccaggctgagggaggatatggccctgctagcagactgtgcgcttccccctgagttaaggggtgacctgtgggagttgccgtttccctgtcctgacggctttaattcgtgtccggatatctgctttagggtggcaggttgctctttcctgtgtcataaggcatttttctgcggtcgcagtgattattttagagccctgctagatgatcatttccgggaaagtgaggagcctgcaaccagtggaggacctcccgcagttaccttgcacggtataagcccagatgtttttactcacgtcttgtattatatgtattcagatcataccgaactcagcccggaggctgcctatgacgtgctctccgtcgctgatatgtacctcctgccgggacttaagcgcctctgtggcaggtcactggctcagatgctcgatgaagatactgtggtgggagtttggcgcgttgccaaactgttcaggttagccaggctggaagaccagtgcacagagtacatggcaaaagtgatagagaagttggtggagagagaagatttcgtcgaggccgttaaggaggaagcagctgctgttgcagcgaggcaagagacagacagtattccgctggtcgatgacatccgctttcacgtcgctagcactgttcaaacctactcggcaatcgaggaggctcagcaacgactgagagcacttgaggacctcctggtgtcaataggtctcgattgctag

SEQ ID NO: 214429 - DNA, 1011 bp, Artificial Sequence
  Description of Artificial Sequence: Synthetic coding sequence
atgctagataccaaatggaaggggaaatctgtggtggtgctcaggcatccgcttatcaacccggtggctttcggcgctctgctacagtatttgtacacagggcgtcttgacattggagtggagcatgtcagcgactgtgagcggctggcgaagcaatgccaactttgggacctgttgagcgatctggaagccaagtgcgagaaagtttcagagttcgttgctagcaagccaggaacgtgcgtcaaggtgttaaccattgagccccctccagcagacccccgactgcgcgaggatatggccctcctggccgactgtgcgctgcctcctgagttgcgcggagatttgtgggagctcccctttccgtgtccggatgggtttaactcttgccccgacatctgcttccgggtcgctggctgttcattcctgtgccataaggctttcttttgtggtcgatcagattactttagggccttactagacgatcatttcagagaatctgaggagccggcaacttccggtggtccccctgccgtgaccctgcatggtatctcacccgacgtcttcacccacgtcctctattacatgtactccgatcataccgaactgtcccccgaggccgcatacgacgtgctctccgtggccgatatgtatctcctcccaggcctcaagagattatgcggcagatcactcgctcagatgcttgatgaggacactgttgtgggggtgtggagagtcgcaaagctttttcgcctggctaggttggaagatcaatgcactgaatatatggctaaggtgatcgagaaactcgtggagcgggaagacttcgtggaagccgtcaaagaggaggccgctgctgtagcagcccgtcaggagaccgacagcatacctctcgtagatgacatcagatttcacgtcgcaagcaccgtgcagacatacagcgcaattgaagaggctcagcagcggctgagggccctcgaggacctgctggtgagcatcggtctggattgctag

SEQ ID NO: 214430 - DNA, 1011 bp, Artificial Sequence
  Description of Artificial Sequence: Synthetic coding sequence
atgctagataccaagtggaagggcaagagcgtggtggtgcttaggcacccactgatcaatcctgtcgcattcggagcactactgcagtatctgtacacgggacgcctagacattggcgtggaacatgtctccgattgtgagaggctggcgaagcagtgccagctatgggacctgctcagcgacctcgaggccaaatgcgaaaaggtgagtgagttcgttgctagtaagcccggtacatgtgtaaaggtactgactatagaaccaccaccggctgaccctaggctgagggaagacatggctctgctggctgactgcgccctgcctcctgaactgaggggagatttgtgggagctgcctttcccctgcccggatggctttaacagctgcccagatatttgcttccgagtggcagggtgcagtttcctgtgccacaaagctttcttttgtggaagaagcgattacttccgagccttgctcgacgatcacttccgggagtcagaggaacccgctacctcgggaggccctccagccgtgacactgcacggtatctctcccgacgtgttcactcatgtgctgtactatatgtatagcgaccacacagagctgtctccagaggctgcctacgatgtactatccgtggcagacatgtacctgctgcctggtttgaagagactttgcggtaggtcccttgctcagatgctggacgaagacaccgtagttggagtgtggcgggtagccaaattgtttcgcctggctagactcgaagatcagtgtaccgagtacatggccaaggttattgaaaagctcgttgagagagaggatttcgttgaagccgttaaggaggaggcggctgccgtggctgccaggcaggagaccgactccataccactcgtggatgacatcaggtttcacgttgcttcgacagttcagacctattcggcaattgaagaagcacaacagcgactgagagctctcgaggatttgctcgtgagcattggcctagactgttag

SEQ ID NO: 214431 - DNA, 2061 bp, Artificial Sequence
  Description of Artificial Sequence: Synthetic coding sequence
atggaggccagccaagagggacaccttgaattggtgaaatatctcctcgcctcaggggctaatgttcacgctacgaccgcgacaggcgacaccgctctgacctacgcctgtgaaaacgggcacaccgatgtggccgacgttctgctgcaggcaggagctgaccttgacaagcaagaggacatgaaaaccattttagagggcatcgatcctgcgaagcatcaggagcatgagtcagagggtggcagaactcccctaatgaaggccgcaagagcaggacacctctgtacagttcagtttctgatctctaagggggctaatgtcaaccgagctacagcaaataatgaccacactgtcgtgtccctcgcttgtgccggaggccacctggcggtggtggagctgttattagcccacggggcagacccaacacacaggctcaaagacgggtctacaatgctgatcgaggctgccaagggaggacacaccaatgtcgtgtcttacttacttgactaccctaacaatgtgttgtcagtgccaacaaccgatgtctcccagctgcccccaccgtcccaggaccagtctcaggagcccgatcgcacgagccaggagaattcaccagctctactaggggtgcagaaagccgtttcaaccagagtaccaacaggctccaactccagcagtcagacaactgaatgtctgacaccggaatcttgcagccagaccacctccaatgtagcctcccagagtatgcctccagtctacccgtctgtagatatcgacgcccatacagagagcaatcacgatactgccctgacactggcgtgcgccggtggacatgaggagctggtttccgtgctcattgctagggacgctaagattgaacaccgtgacaagaaaggattcaccccgcttattctggcagctaccgcagggcacgtgggcgttgttgagatcctgctggacaagggcggtgacatcgaggcccagtccgaacgaacaaaagatacaccactcagtcttgcttgctccgggggtcgtcaggaggtcgtcgatcttttactggcccgtggggcaaacaaagagcatcgcaacgtctctgactatacgccgctgagcctggcagcctctggcggatacgtgaacattatcaagatcctgctgaacgcgggtgccgaaattaactctcggaccggctccaagttgggaatctcccccctaatgttggccgcaatgaatggtcatgtgcccgctgtgaagctgctgctggacatgggcagtgatattaacgcccagatagagaccaatcgcaacacagccctgaccttagcctgcttccagggaagagcagaagtggtatcactgctgcttgaccgaaaggctaacgtcgaacacagagcaaagactgggttgaccccgctgatggaggcagcctcaggtgggtatgccgaggtcggcagggtcctgctggataagggcgctgatgttaatgccccacctgtaccctcatcaagggacaccgcactcactatagctgccgataaagggcattataaattttgcgaactgctcatccataggggcgcacatatagacgtacggaacaagaagggaaacactccactgtggctcgcctctaacggcggtcatttcgatgtggtacagctgcttgttcaggctggcgctgacgtcgacgctgcggataatcgcaaaattactccacttatgtctgccttccggaagggccatgtcaaggtcgtccagtacttggtgaaggaagtcaatcagtttccctccgatattgaatgtatgagatacatcgcaaccatcaccgataaggaacttctcaaaaagtgccaccagtgcgtcgagactattgtcaaggctaaagatcagcaggctgccgaggccaataaaaacgcttctatcctcctgaaagagctggatctagagaagagcagggaagaatcccggaaacaagcgctggccgcaaagagagaaaaaagaaaggaaaaacggaaaaagaagaaggaggaacagaaaaggaagcaggaggaggacgagtag

SEQ ID NO: 214432 - DNA, 7623 bp, Artificial Sequence
  Description of Artificial Sequence: Synthetic coding sequence
atgctgactgactccggcggaggaggcacatccttcgaggaggacttggactctgtagctcctcgaagcgctcccgcaggcgctagtgagcctcctccaccaggcggagtcggcttgggtattagaacggtgagactgtttggcgaggcaggccctgcctcgggagtgggctcatccggcggaggtggttccgggtctggaaccggagggggagacgccgctctcgatttcaagctggcagccgcagtgctgaggaccggtggaggcggaggcgcttcaggttccgacgaggacgaggtgagcgaagtagaatcatttatcctggaccaggaagacctggataacccagtccttaagacaacctccgagatttttctttcttctacagccgagggcgctgatctgagaaccgtggaccccgagacacaggcacggctggaggcactgctggaggccgcaggcattggcaaactgagtacagccgatgggaaggcattcgctgatcccgaagtgttgcgcaggctcacctctagtgttagctgtgctctggacgaagccgctgctgcccttacccgcatgaaagccgaaaatagccataacgccggtcaggtggatacaaggagcttggccgaggcttgctctgatggcgatgtcaatgctgttcggaagctgttggacgagggccgatccgtcaacgagcatacggaggaaggggaatcccttctgtgcctagcttgcagcgcaggctactatgagctggcccaggtgctgttggctatgcatgccaatgtagaggaccggggaaacaagggagacataacccctctaatggccgcaagctccggcggttacctcgatattgtgaagttgctgttactccacgatgccgatgtaaactcacaaagcgccaccgggaacaccgctctgacgtatgcttgcgccggaggctttgttgatatcgtgaaggtcttactgaacgagggcgcaaatatcgaagaccataacgagaatggacacacacccctgatggaggcagcaagtgccggacacgttgaagtggcccgtgttctcttggaccatggtgcaggtattaacacccactctaacgagttcaaagagtcagcactgacactggcttgttacaaagggcatctcgatatggtcagattcctgctggaagccggagccgaccaagaacataagacagatgagatgcatacagcgcttatggaggcttgcatggatggtcacgtggaggttgccaggctgctgctggattctggggctcaggtcaacatgcccgcagatagctttgagagtcctctgactttggcagcatgcggcggacatgtggaactcgccgctttgctgatcgaaaggggagcaaacctagaggaagtcaacgatgagggatatacaccactaatggaagctgctagagaggggcacgaagagatggtcgctctgctgttagctcagggcgcaaatatcaatgcccagacagaagagacgcaggaaaccgccctcaccttagcttgttgtggcggtttttctgaggttgccgattttctcatcaaggcaggtgcggacatagagctaggttgttccacgcccctgatggaggccagccaggagggccaccttgagctagtgaaatacttattggcatccggagccaacgtacacgctactaccgcgacaggcgatacagctctgacctatgcgtgtgagaatggccatacggacgtagcggatgtcctcctgcaagcgggtgctgatcttgagcacgagtcagagggaggcaggactcctttgatgaaagccgcaagagccggacacctgtgcactgtccagttcctgatttctaagggcgctaacgtgaaccgcgcaaccgccaataatgaccacaccgtagtgtcactggcctgtgcgggtggacacttggcagtcgtcgagctgcttctcgcccatggggctgatcctacccacagattaaaggacggcagtaccatgctgatagaggcggcaaaggggggacataccaacgtcgtatcttacctgctggactatcccaataacgtgctgtccgttccaacaaccgatgtgagccagcttccacccccatcacaggaccagtcccaggtgcctagagtgcccacacatactcttgccatggtggtgccaccacaggagcccgaccggacctctcaggaaaactctccagctctgctcggcgtgcaaaaagggacgagcaaacaaaagtccagcagcctccaggtggccgaccaggacctactgccaagcttccatccataccaaccgctggagtgcattgtggaagagaccgagggtaaattaaatgagttgggccagagaatctctgcaatcgagaaagcccagctgaaaagccttgagctgatccaaggagagccccttaacaaagataaaattgaagagttaaagaaaaaccgcgaagaacaggtgcagaagaagaaaaaaatactgaaggagctccagaaggtcgaaagacaactccagatgaagacacagcaacaattcaccaaggagtacctggaaactaaaggccagaaggatacggtgtcacttcaccagcagtgcagtcatcgcggtgtcttcccagaaggtgaaggagacggatccctccctgaagaccattttagcgaactcccacaagtcgacaccattttattcaaggacaatgatgtcgatgacgaacagcagagtccccctagtgccgaacagattgatttcgttccagtccagccgctttcctcaccccaatgcaatttcagtagcgatctgggcagtaacgggaccaactcactggagttacagaaggtgagcggcaatcagcagatcgtgggccagccccagatagctatcacaggccatgaccagggtttgcttgttcaggagccagatggccttatggtcgcgactcccgctcagacacttaccgatactctagacgatctgattgcagctgtttctactcgcgtgcccaccggaagtaatagcagtagccagacgacggagtgccttacacctgaaagctgctcacagaccacttcgaatgtggctagccagagcatgccgcctgtgtacccatctgttgatattgacgcccacactgaatccaaccatgacacagcattaacgctggcttgcgccggaggccatgaggagctcgtgtcggtgctaatagctcgagatgctaaaattgagcatcgtgacaaaaagggctttaccccgcttatcttggcggctactgctgggcacgtgggcgtggttgaaatcctgctcgacaaggggggagacattgaggcacagagcgagagaacaaaggacaccccactgagcttggcctgctccgggggtcggcaggaggtagtggatttattgctggcacggggagctaacaaagagcaccggaacgtaagcgactacacccctctcagtttggccgcatcaggcggatatgttaatattattaagattctcctaaacgcaggggcagaaatcaattctcggactgggtcgaagctcgggattagtccccttatgctagcggctatgaacggacacgtacccgcagtcaagctgctgctggatatgggttcagatatcaatgcccagatcgagactaatcgtaataccgccttgacactcgcctgtttccagggtcgtgcagaagttgtttccctgcttctcgaccgcaaggcgaatgttgagcaccgggctaagacaggactgactcccctgatggaggccgcttctggaggctacgcggaggtgggaagagtgctactggacaaaggggcagacgtcaatgcccctccagtgccctccagccgagacacggcactcaccatcgctgcagataagggacactacaagttctgcgagctgctgatccatcggggagcccacatcgatgtgcgcaacaaaaaaggaaatacccccctgtggctagcaagtaacggcggacacttcgatgtcgtgcaacttctcgtccaggccggtgctgatgttgatgcggcagataatcgcaaaattacacccctcatgtccgctttccggaaagggcatgtcaaggtcgttcaatatctcgtgaaagaagtgaatcagtttccaagtgacatcgagtgcatgcgctatattgcaaccattacggacaaggaactgttgaaaaagtgtcatcagtgtgtggaaaccattgttaaggcaaaagaccagcaggccgcagaagctaataagaatgcttcaattctgctgaaggagctggacttggagaaatcccgggaggagtcaagaaagcaggcattggctgctaaacgggaaaaaaggaaagagaaacgcaagaagaagaaggaagaacagaagcgtaagcaggaggaggatgaggagaacaaaccaaaggaaaactcagaactccccgaggacgaggatgaggaggaaaacgatgaggacgtggagcaggaagtcccgatcgaaccacccagcgccactactaccacaaccattggaatcagcgctacctcagccactttcacaaacgtttttggaaagaagagagccaatgtggtgaccacacctagtactaacaggaagaacaagaagaataaaactaaagagacgccaccaactgcccatctgatactgcccgagcagcacatgtctctggcccagcagaaggccgacaagaacaagataaacggtgaaccacgcggtggcggtgcaggcggtaatagcgacagcgacaatttagattccactgactgcaactcagagagctcctcaggcggaaaaagtcaagaactgaattttgtcatggacgtgaatagctccaagtatcctagtcttcttctgcatagtcaggaggaaaagacatccactgctactagtaaaacccaaacccgactggaaggagaggtgacacccaacagccttagtacctcgtataaaaccgtatctctgccactgagctccccaaatataaaactcaaccttacctccccaaagcggggacagaagagagaggaaggatggaaagaggtggtgcggagaagtaagaaactgtctgttccagcctccgtcgtgagccggattatggggcgtggcggttgtaacattaccgctattcaggatgtgactggcgcacacatcgacgtggacaaacagaaagacaaaaacggggaacggatgatcactatccgcggaggaactgaaagcacccgctacgccgtgcagctgattaacgctctgattcaggatccagcaaaagagctcgaggatctcataccaaaaaaccacattcggacgcccgcaagcacgaaatctatccacgccaattttagctctggagtcgggaccacagccgcatccagcaagaacgcgttcccactaggtgcgcctaccttagtaacttcgcaggctacaaccctgagcacatttcagccggctaataagttgaacaagaacgtgcctacgaatgtccgttcctctttcccagtgagcctgccattagcataccctcaccctcacttcgctttactcgcagctcagactatgcagcagatccggcaccctaggctcccaatggcccagttcggcggaacgttttcgcctagtcctaatacctggggcccttttcctgttaggcctgtgaacccgggaaatacaaatagtagtccaaagcataataatacttcaagactgccaaatcagaatggaactgtcctgccttcggaatccgcaggtctggcgaccgccagctgccctattaccgtgtcaagtgtggttgccgctagtcagcaactttgtgtgacaaataccagaacccctagttccgtgcgtaagcaactgttcgcctgcgttcctaaaacctcccccccagccaccgtgattagttcagtcacctcaacatgctcctccctgcctagtgtaagcagtgctcctattacttctggtcaggcgcctaccacgtttttgccggcatctacgtcccaggcccaactctcctctcagaaaatggaatcattctctgccgtgcctcccaccaaggaaaaggttagtacccaggatcagcctatggcaaatctgtgcactcccagttctacggccaatagttgcagctcttcagctagtaatactccaggtgcacctgagacccacccgagcagtagtccaacccccacttcatccaatacacaggaggaggcccagcctagtagcgtatctgacttatctccgatgagcatgccatttgcctccaatagcgaacccgctccccttactctgacatcccccagaatggttgctgctgataatcaagatacctctaacctgcctcagctggctgtgccagctcccagagtgtcccataggatgcagcctcgcggtagcttttattctatggtcccgaacgcaacaatccatcaagaccctcagtccattttcgtgaccaatccggtgaccctcaccccgccacagggaccccctgcagcagttcagctctcttctgcagtgaacattatgaacggctcccagatgcacattaatccggctaataaaagtttaccacctacatttggcccagccacccttttcaaccatttcagctcactttttgatagtagccaagtgcctgcaaaccagggatggggcgatggccctttgtcatcccgggtggccaccgacgcatcttttacagtgcagtcggcctttctggggaacagtgtgttaggccacttggaaaacatgcatccagataactctaaggccccaggttttagacctcctagccagcgagtgtcgacgagccctgttggtctaccatctatcgacccttctggaagcagcccttcctccagctctgccccactcgcatctttctctggaattccaggaacccgggtcttcttacaggggccagccccagtaggaacgcccagctttaataggcagcacttctctcctcatccttggacatccgcttctaattcctgtgatagccctattccctctgtgagcagcggatccagttccccacttagcgctactagcgcccctcctactctgggtcagcccaagggagtgtccgcatctcaggacaggaagatcccgcctccaattggcacggagcgactggccagaattagacagggaggctctgtcgctcaggccccagccggtactagtttcgtggcgcctgttggacactctggcatctggtcattcggggtgaatgctgtgtcagagggactttccggctggagtcagtctgtgatggggaatcatccaatgcatcaacagctctccgatccctcaacattttctcaacaccagcccatggagagagatgacagcggcatggtggccccttctaacattttccaccagcccatggcttccggattcgtggatttctcaaaggggctgccaatttcaatgtacggcggaaccattatcccttcacacccgcaactggccgatgtcccaggtggccctcttttcaatggattgcacaaccctgatcctgcttggaatcccatgatcaaagttattcagaactcaacagaatgcaccgacgctcagcagtaa

SEQ ID NO: 214433 - DNA, 7853 bp, Artificial Sequence
  Description of Artificial Sequence: Synthetic coding sequence
atgctcaccgattcgggcggaggaggcacaagctttgaggaggatctagatagcgtcgcccctcggtccgcccctgctggcgcttcagagcccccacctcctggtggagtcggactgggcatccggaccgtacggctcttcggggaagctgggccagcctcaggtgtggggtcttctgggggaggcggatctggctcggggactggaggaggagacgccgctctggattttaagctcgccgctgccgtgctcagaactggcggagggggtggggctagcgggtccgacgaagacgaagtgtccgaagtggaaagtttcatattggatcaggaggatctggacaaccctgtgcttaagacgacttccgagatctttctgtcttctaccgccgagggagcagacctacgcactgtggatcccgaaactcaggcgcgactggaggctctcctggaagccgctggtataggcaagttaagcactgcagacggaaaggcattcgccgacccggaagtgctgcgcaggctcacttccagtgtctcatgcgcgctggacgaggcagccgctgcattgactaggatgaaggctgagaactcccacaacgccggacaagtcgacacacgctcgctggctgaggcttgttccgatggcgatgtcaatgccgtgaggaaattgctcgacgaaggtaggagtgtgaatgagcacacagaggaaggcgagtcacttctgtgtcttgcctgtagtgctggatactatgagcttgcccaggtgctgctcgccatgcacgcgaatgtggaagatagggggaacaagggtgacatcacaccactcatggccgcaagctcagggggttacctggacattgtgaagctgctcctcctgcacgatgcagatgttaattcccagagcgctaccggtaacactgccctgacctatgcctgcgcagggggatttgtagatattgtgaaggtcctgctgaatgagggtgcaaacattgaagaccataacgagaacggacacaccccccttatggaggccgcatcggccggacatgtggaagtggcccgagtgttactagaccatggagcgggaataaacacccattccaacgaatttaaggagtcagccttgaccctggcatgttataaaggccacttagatatggtcagattcctgctggaggctggagcggaccaagagcataaaacagacgagatgcacactgccctgatggaggcctgtatggacggccacgtggaagtggctcgcttgttgctcgacagcggggctcaagtgaacatgcctgccgacagcttcgagagccccctcacgttggccgcatgtggcggtcacgtggagctcgccgcattgctgattgagagaggagccaatctggaggaggtgaacgatgaaggatatactcccttgatggaagctgcgagggagggtcacgaggaaatggtcgcactgttgctggcacagggtgccaatattaacgctcagaccgaggagacgcaggagacagctctcactctggcatgttgcggtggtttttcagaggtggctgattttctgataaaagcaggtgcggacattgagcttggatgttccacccccttgatggaggcaagccaggaaggacatcttgaacttgtgaagtaccttctcgccagcggtgctaatgtccacgctactaccgcaactggggacacggcattaacctatgcttgcgaaaacgggcatacagatgtggcagatgtattgttgcaggccggagccgacttggaacatgagagcgaagggggaagaaccccattgatgaaggctgcgagagccggtcatctgtgcacggtgcagtttctgatttccaaaggtgctaatgttaatcgagccacagcaaataatgatcatactgtggttagccttgcctgcgccggtggccacttagcagtagtggagctgctgttggcgcatggagccgaccccacacaccggctcaaggacggatcgacaatgctgatagaagccgctaaaggcggacatacgaacgtcgtaagctacctgctggactatcctaataatgtcttgtctgtccctacgacagacgtctcccagctacctcccccatctcaggaccagtcacaggttccaagagtgccaacacatacgctggctatggtcgtccccccacaggagcctgacagaaccagccaggagaactcaccagcccttcttggggtgcagaaagggacaagtaagcagaaatcgtcaagcctgcaggtggcggatcaagacctgttacctagcttccacccctaccagccgttggaatgtatcgtcgaggagacagagggcaaattgaacgaacttggccaaagaatttcagctattgagaaggctcagctcaagagcctcgaactaattcagggtgagccattgaacaaagacaaaattgaggagctcaagaagaacagggaggagcaggtgcagaaaaaaaaaaagatcctcaaagagctccagaaagtggaaagacagctgcagatgaagactcagcagcagtttactaaagaatacttggagaccaagggtcaaaaagacacagtgagcttgcaccaacagtgctcgcatagaggggtcttccctgagggcgaaggtgacggatctctgcctgaggatcacttttccgaactcccacaggttgatacaatactgtttaaagataacgacgttgacgatgagcagcaaagcccacccagtgcggagcagatagattttgtccctgtccagcccttgagctctccccaatgtaacttttccagcgaccttggctccaatgggaccaacagcttggagctgcagaaggtgtcggggaatcagcagatcgttggtcaaccgcagatcgccatcacagggcacgaccagggtctcctggtgcaggagccagatggcctcatggtagcgacccctgcccagaccctgactgacaccctggatgaccttatcgcagctgtgtccactagagtgcccacagggtctaacagttcttctcagactacggagtgtcttacacctgagagctgtagccaaaccacaagtaatgtggcatcacagtctatgccaccagtatatcccagtgttgacattgacgcacacaccgagagcaatcacgataccgccctgaccttagcctgtgctggagggcatgaagagttggttagcgtgctgatagctcgcgacgctaaaatcgagcaccgggataagaaaggcttcacacctctgattctggcagccacggctggacacgtgggggtggttgagatcctgctcgataaaggaggagacattgaagcacagtctgaaagaacaaaggacacacctctgtcacttgcttgctcaggcggaagacaggaagtggttgatcttctactagcacgcggagctaacaaagaacatcgcaacgtttccgattatacgccactgtcccttgcggcttccgggggttatgtgaacatcataaagatcctactaaacgctggggcagagatcaacagccggacgggcagtaaactcggtattagtccactgatgcttgctgccatgaatggccacgttccagccgtcaagctgctgttagacatgggctctgatataaatgcacagattgaaactaacagaaataccgcattgacactcgcttgctttcaaggtagggctgaagtcgtatctctcctcctggacaggaaggccaacgttgagcatagggcaaaaacgggtctcactcccctgatggaggccgcttccgggggttacgcagaagttggacgggtgctcctcgataagggcgcagacgttaatgccccaccagtcccatcctccagggacaccgccctgaccatagccgctgataaggggcattacaagttctgcgagcttcttatccataggggagcacatattgatgtgaggaataagaagggcaatacacctttatggcttgctagcaacggcggacactttgacgtggttcagctgctcgtacaggccggagcagacgtcgatgccgcagacaatcggaagatcacaccactgatgtcagcctttaggaagggtcatgtcaaggtggttcagtatcttgtgaaggaggttaatcaatttccatccgatatcgaatgcatgcgctacatcgcaaccatcactgacaaggaacttctaaaaaagtgccaccagtgtgtggagacaattgtcaaagccaaggatcaacaagccgcagaggcaaataagaatgcaagcatcctcctcaaggaattggatttggagaaaagtagagaggagagccgcaagcaagctttagcagcaaaaagagagaagaggaaagaaaaaagaaaaaaaaagaaggaggaacagaagagaaagcaggaggaagatgaagagaacaagccaaaagaaaattctgaactgcccgaggatgaagacgaggaggaaaacgatgaagacgtggagcaggaagttccaattgagccaccatccgccacgactactaccacaatcggcatttccgcgacatccgccaccttcacaaacgtgtttggcaagaagcgggcaaacgttgttacaaccccctcaaccaataggaaaaataaaaagaacaagacaaaagagacccctccaaccgcacatctgattctccccgagcagcatatgtcactggcgcagcagaaggccgacaaaaataagatcaatggcgagcccagggggggtggtgccggaggcaattcagattcagataacctcgactctaccgattgcaacagcgaatcatcttctggtgggaagagtcaggagctgaatttcgttatggatgtgaatagcagcaaatatccctctctccttctacactcccaggaggagaaaactagtaccgctaccagtaagacacaaactagacttgagggggaggtcacgcccaattccctttcaacttcttacaaaaccgtctctctgccgctgagctctccgaacataaagctgaatctgacatcccccaaacgtggtcagaagcgcgaggaaggatggaaggaagtggtaaggcggagcaagaaactatcggtccccgcatcggtggtcagtcgcattatggggagagggggttgcaacatcacagcgattcaggatgtgaccggggctcacatcgacgtggacaagcaaaaagacaaaaatggcgaaagaatgatcaccataagaggaggcacggagtcaactcggtatgccgtacaactgatcaacgccctcatccaggatcctgctaaagaactggaggacctcatcccaaaaaatcatattcgaactcccgctagcactaagagtatacacgccaatttttcatctggcgtgggcacgacagccgcatccagcaagaatgcattcccgctgggagcccctaccctcgtcacctcacaagccacaactttgtccacatttcagcccgctaacaagttaaataaaaatgtgcctacgaatgtgcggtcctcattccctgtgagcctgccactggcttatccccatccccacttcgcgcttttagccgctcagaccatgcagcaaatccgacaccctcggttacccatggctcaattcggcggtacattttcacccagccctaatacctggggcccatttccagtcaggcctgtgaacccgggaaacactaattcttcccctaagcataataacacctcgcgcttgcccaaccaaaacgggacggtgctcccttcggaatctgcaggactagctacggcttcatgtcctattactgtgtcctcagttgtcgcagcaagtcagcagttgtgtgtcacaaataccaggacaccttcaagcgtaagaaagcagctgtttgcgtgtgtccccaagacctctccccctgcgacggtgatcagttcggtaacgtccacctgctcttccctccccagcgttagctcagcaccgataacttcaggccaggcgcctaccaccttcttgcccgcaagcaccagtcaggcacagctgagttcgcagaaaatggaatctttttccgctgttcccccaacgaaggaaaaggtgtccacgcaggaccagccaatggccaatttgtgcacaccttctagcaccgccaacagctgctcctcctccgcatcaaacacacccggagcacccgagactcacccctcatcatcccctacgccaacatcttctaatacccaggaggaggctcagccgtcatcagtgtcggacttgagccctatgagcatgcccttcgcatcaaacagcgagcccgcacccttgaccctgactagtccgcgaatggtggcagccgataaccaggatacctccaatctgccacaattggccgtaccagcacctagagtatcacacagaatgcagccacgcggatccttttattcgatggtgccaaacgccaccattcaccaagaccctcagtctatttttgttacaaatcccgtgaccttgacaccaccacaagggcctcctgccgcagtgcagctgagctccgccgtgaatattatgaatggctcacagatgcacataaatccagccaacaagtctctgccacccacatttggtccagccactcttttcaatcatttctcgtctttatttgacagctcacaagtgcccgctaaccaggggtggggggacggacctctgagttcaagggtggccactgacgcttcttttactgtgcagagtgcttttctcggcaatagtgtgctgggtcacctcgaaaatatgcatcccgacaattccaaggcccctgggtttcgccctccatctcaacgcgtctccacctctccagtggggctgccttccattgacccttctggttcttctcccagttcctcctctgctcctttagcctccttctctggaattcctggaaccagagtgttcttacaagggcctgcccctgtgggaactcctagttttaatagacagcatttttctccccacccctggacaagcgcctctaacagttcgacctcagctcctccaacgctcgggcagcctaagggggtctccgcttctcaggaccggaaaattccgcctcccattggtacggagaggctggctcgcatacgccagggtggctctgtggctcaggcaccggctggaacctctttcgtggctcctgtgggccacagcggcatctggtcatttggcgttaacgctgtgtccgagggcttgagtgggtggtcacaatcagtgatggggaatcaccccatgcatcagcagctgagtgacccttcaacattcagccagcaccaaccaatggaacgcgatgattcagggatggtggcaccatccaacatctttcatcagcccatggcaagtggatttgtggacttttcaaagggactgcccatttcgatgtacgggggaaccataataccaagccacccccagttggccgacgttccaggcggaccgctgttcaatggactgcataatcctgatcctgcttggaatcccatgatcaaggtgatacagaatagcacagaatgcaccgacgcccaacaggcctctctgctcccatctgtcccagctctgaagggcgaaattccttcccctcagctgactcgccctaagaagcgtattggaagacccatggtcgcatctccgaaccaacgccaccaggatcatctgcgccctaaagtgccagccggtgttcaggagctgactcactgtccagacactccactccttccgccaagtgacagccgcggacacaactcctcaaactccccttctctccaggcaggcggagctgagggcgctggggataggggacgggacacaagata

SEQ ID NO: 214434 - DNA, 3024 bp, Artificial Sequence
  Description of Artificial Sequence: Synthetic coding sequence
atggtggctcttcttctcgcgcagggagccaacataaatgcccaaactgaggaaactcaagagaccgctttgactctggcttgttgtgggggattttcagaagtggccgatttcctcatcaaagcaggggctgatattgaactcggctgctctactcctttgatggaggcctcacaagaggggcatctggagctagtcaagtatttgctcgctagtggagccaatgtgcacgccacgactgctaccggagatacagcactgacctacgcctgcgaaaatgggcatacagacgtcgcagatgtgctcctccaggccggtgccgacctcgataagcaggaggacatgaaaactattctcgagggcatcgacccagcaaagcaccaagagcatgaaagcgaggggggtcgcactccactaatgaaggcagcaagggccggacacctttgtaccgtgcaattcctcatctcaaaaggggcaaacgtaaatcgggctaccgcaaacaatgatcacaccgttgtgagcctcgcctgcgccggagggcaccttgccgtagtggaattactgcttgctcacggcgctgaccccactcaccgactaaaggatgggtctactatgcttatagaagccgcaaaggggggtcatactaatgttgtgagttacctcctagactaccctaataatgtgcttagcgttccaactacagatgtgagtcagctgccccctccatcccaggatcagtctcaggtgccccgtgtacccacccatactttagccatggtggtcccccctcaggaacctgaccgtacaagtcaggagaactcacccgctttgctaggagtgcagaaggggacttccaagcagaagtcctcaagtctccaagtggccgatcaggatctcctacccagctttcacccttaccagcccctggaatgcatcgttgaggagactgaaggtaaactgaacgagctgggacagagaatctctgctattgaaaaagcccagctcaagtccctagagctgatacagggcgagcccctgaataaggacaagatcgaagagttgaaaaagaacagagaagagcaggtccagaaaaaaaaaaaaatactgaaagaactgcagaaggtagagcggcaactccagatgaaaactcagcagcaatttacaaaagagtacctggaaacaaagggtcagaaggacaccgtgtccctacaccagcagtgtagccataggggggtttttcctgagggtgagggcgacggatcactgcccgaagaccatttttctgagctcccccaggtcgatactattctttttaaggacaacgatgtagatgacgagcagcaatctcctcccagtgcagagcaaattgacttcgtgccagttcagcccctgtcctcaccacaatgcaatttttctagtgacctcgggtcgaacggaacaaactccctggagctgcagaaggtttcgggcaaccagcaaatcgttggccaacctcagattgccattacaggtcatgatcagggcttgctcgttcaggagcccgatgggttaatggtcgcaacaccagcacagaccctcacagacacactggacgatttgatcgccgcagtaagcactagagtgcccaccggttccaatagcagttcccaaacaactgagtgcctgacccctgaaagttgctcccagacaacatcaaacgttgcatctcagtcaatgccgccagtgtacccatctgttgatatagacgcccacacagaatctaaccacgataccgcactgactctggcgtgtgccggaggccacgaagaactggtatccgtgttaattgccagagatgccaaaatcgaacaccgcgataaaaagggctttactccactcatactcgctgctaccgctggacacgtcggggttgtagaaattctgctggacaaaggtggagacattgaggctcagtcagagcgcaccaaggatacccctctgtctctagcatgttccggcggtcgacaggaggtggttgacctcttgctggctcgcggagctaataaggagcaccgtaatgtttctgactatacgccactctccttagccgcttctggagggtatgtgaacatcatcaaaatcctgctgaatgccggagcagaaatcaatagtagaacggggagcaaactggggatcagcccgctgatgttggccgctatgaacggccatgtcccagcggtcaagttgttgctggatatgggctccgacattaacgcgcaaatcgaaaccaataggaatactgctctgacgctggcctgctttcaggggagggccgaggtggtatcattgctgctcgaccgcaaagccaacgtagagcatagggcgaaaactggattaaccccactgatggaggcagcctcaggcggatacgcagaggtcggacgcgtgttactcgataaaggcgctgacgtgaatgctccacccgtcccctcgtccagagacactgccttgactatagcagccgacaaaggccattacaagttctgcgagctcttgattcatcgcggtgcgcacatcgatgtacgcaataaaaagggcaatacccccctatggctagctagtaatggaggtcactttgacgtagtgcagctgcttgtacaagccggtgcagacgtggacgccgctgataatcgtaaaattaccccccttatgtctgcattccggaaaggccatgtgaaggttgtacaatacctcgtcaaggaggtcaaccaatttccctcggacatcgagtgtatgcgctatattgccacaataactgacaaagaactcctcaagaaatgccaccaatgcgtcgagaccatcgtcaaggccaaagatcagcaagccgctgaagcaaataagaacgcttctatcctgcttaaagaacttgacctcgagaagtctcgcgaagagagccgaaaacaagcactagcagccaagagagagaaacggaaggagaagaggaaggagaagcgtgggacagagaaggagacagggagacgctag

SEQ ID NO: 214435 - DNA, 7628 bp, Artificial Sequence
  Description of Artificial Sequence: Synthetic coding sequence
atgctgacggattcaggcggaggcggaacctcattcgaagaagacctggattcggtggccccaagaagcgctcccgcaggagcctctgaaccacctcctcccggtggagtgggtctcggcatccggacagtgagactttttggggaggccggtcccgcttccggagtagggtcttctgggggtggcggtagcgggtcaggaacaggaggaggagacgcggcactagactttaaactggcggctgccgttctgcggactggcggaggcggtggggcttcaggaagcgacgaagatgaagtgagtgaagtagaaagcttcatactcgaccaggaggacctcgataatcctgtgctcaaaacaaccagtgaaatcttcctctcgtctacagctgagggcgctgacttacgtactgtcgaccctgaaacccaggccagactcgaagccctactcgaggctgctggcatcgggaaactgtccaccgccgatggcaaggcttttgctgacccagaagtactccgccgtctgacaagctctgtcagttgcgcactcgatgaagctgcagctgccctgacccgcatgaaggcagaaaactctcacaacgctggccaagttgatacacggagtcttgctgaagcctgttcagacggcgacgtgaatgccgtgaggaagttattagatgaagggaggagtgtaaacgaacacacggaggaaggtgagagcctgctctgtctggcatgtagcgcaggatactatgagttagctcaagtccttctcgcaatgcatgccaatgtcgaggatcgagggaacaaaggcgacataacccctctgatggctgcctcaagcggcggttatttggatattgtaaaactactcctgcttcacgatgctgatgtgaactcccaatccgcgacaggaaacaccgccttgacctacgcctgtgctgggggtttcgttgacatagttaaggtactgttgaatgagggcgctaatatcgaagatcacaatgagaatgggcacacaccacttatggaggccgcatccgccggacatgttgaagtagccagggtacttctagaccacggagctggcattaacacccattctaatgagttcaaggaatctgccctgacccttgcctgctataagggacatctggatatggtcaggtttctgttggaggctggcgctgaccaggaacacaagactgatgaaatgcatacggcactgatggaagcctgcatggatggccacgttgaagtggccagattgttgctggactcaggggctcaggtgaacatgcccgctgatagctttgaaagcccattaaccctcgccgcatgcggaggtcacgtagaactagccgctttgttaattgagcggggtgccaatcttgaggaagtgaatgacgagggctacaccccactgatggaggccgctcgcgaagggcacgaagagatggtggccctgctcctggcgcaaggagccaatatcaacgctcagacagaagagacccaggaaactgccctgaccctcgcctgctgtggaggtttttcagaggttgccgacttcttaattaaagccggagccgacattgagcttggctgctctacaccgttgatggaagcttctcaggagggccacctcgaactggtcaagtacttgctggccagtggagccaatgttcacgccactaccgccacaggagacacagccctcacctatgcctgcgaaaacggacacactgacgtagctgatgtgctactacaggccggagccgacctggagcacgaaagtgagggcggacgcacaccgctgatgaaggccgctagagctggtcacctttgcaccgtccaattcctgatatcgaagggagcaaatgtgaaccgggctaccgctaacaatgatcacaccgtagtctcgctggcctgtgccggtggccacctcgccgtagtcgagctgttgttagcgcacggcgctgatcctacccatcggctgaaggacggctctaccatgctgatcgaggctgctaagggaggtcacacaaacgtggtctcttacctgctcgactaccccaacaacgtactttctgtgcccacaacagatgtatcccaactacccccaccaagtcaggaccaaagtcaagttcccagggtccccacccacacccttgctatggtcgtgccaccacaggagcctgatcgcacctctcaggagaattcgcctgccttactgggagtgcagaagggaacaagcaagcaaaagtcttcatccctccaagtggccgatcaggaccttctgccatctttccacccatatcaacccctcgaatgcatagttgaggagacagaagggaagctgaatgagctcgggcagagaataagcgccattgagaaagcacaactgaagagcttggaactgatccagggggagccacttaacaaagataaaatcgaagaattgaaaaaaaacagggaggagcaggtccagaaaaaaaagaagattttaaaagagttgcagaaagtcgaacgtcaattacagatgaaaacacaacagcaattcacgaaagagtacctcgagaccaagggccaaaaggacacagtatcgctgcaccagcagtgttcccacaggggagtgtttcccgagggagagggggatggaagtctcccagaagatcacttttccgagctgccacaggtcgacactatcctgttcaaggacaacgatgtggacgatgagcagcaatcacctccaagtgccgaacagattgatttcgtacccgtgcaaccactgtcgtcaccgcagtgtaatttctccagcgacctcggctccaacggtaccaacagtctggagctgcagaaggtctcaggtaatcagcagatcgtaggacagccacaaatcgccatcacaggacatgaccaggggttgcttgtccaggagcctgacgggttaatggtggcgaccccagcccagacactgaccgacactctggatgatctgatagccgcagtatcaacaagggtgcctactggaagcaatagtagctcacagactacggagtgtctgaccccagagtcctgctcacaaacaacctccaatgtggcatctcagtctatgccacctgtgtatccgagtgtggacatcgacgctcacacagagagtaaccatgatactgccctgactcttgcctgcgccggagggcacgaagagctggtctccgtcctcattgcacgggatgcaaagatcgagcaccgcgataaaaagggttttacacctctgatactggctgccaccgcgggtcacgtgggggtggttgaaattctgctggacaagggaggagacattgaggctcaaagcgagcgcacaaaggacacgccattatcccttgcgtgctcagggggtcgacaggaggtcgtggacttactccttgccagaggcgctaataaagaacacaggaacgtgtcagactacactccactgagcttggccgcatctggcggatacgtgaatatcattaaaatcctgttgaatgcgggagctgagattaattcacggactggcagcaagctcggcatctcccccctcatgctggcagctatgaacgggcacgtccctgccgtcaagctgctgctcgatatgggctctgatatcaatgcacaaatcgagaccaaccgtaatacggcccttactcttgcttgttttcaaggaagggcagaggtggtctcccttcttctcgaccgcaaagcaaacgtggagcatagagcaaagactggcctgactcctctcatggaggccgcttctggtggatacgccgaagtgggaagagtgctcctggacaagggcgctgatgtgaatgccccacctgtcccatcgtccagagataccgcactgactatcgccgcagataaaggtcactataagttctgtgagctgttaatacaccgtggagcacacatagatgtccgcaacaaaaagggcaacactcccctgtggctcgcctccaatggtggccatttcgacgtagtgcaattacttgtacaggctggagccgacgttgacgctgccgacaaccgaaagatcacgccacttatgagtgcttttaggaaagggcacgtcaaggtggtccaatacctcgtgaaagaagtgaaccaattcccatcggacattgagtgcatgcggtacatcgctacgataaccgataaggagctcttgaagaaatgtcatcagtgtgtggaaactattgtaaaagctaaagaccagcaggctgccgaggccaataagaatgcgagtatactgctgaaagaacttgatctggaaaagtctcgcgaagagagtaggaagcaagccctagctgctaagagggagaagcgaaaggagaagcgtaagaaaaagaaagaagaacagaagagaaagcaggaagaggacgaagagaataagccaaaggagaacagcgagctgcctgaggatgaggatgaggaggagaatgatgaggacgtagagcaagaagttcctatcgagccaccatcagctacaactactaccacaatcggtatttctgccaccagcgccactttcaccaacgtgttcgggaaaaaaagggcaaacgtcgtgacaaccccttctaccaaccggaagaacaagaagaacaaaactaaggaaacacccccaacagcccacctgatattgccagaacagcatatgagtctggcccagcaaaaggccgacaagaacaagatcaacggggagcctcgtggaggcggagcgggtggaaatagtgatagcgataatctggactctacagactgcaactccgagtcttcttccggcggtaagagccaggaactgaattttgttatggacgtcaatagcagtaaatacccctccctcttgctgcattcccaagaggaaaagacttcaacggctacctctaagacccagacacgacttgaaggcgaggttaccccaaattccttgagcacctcatataagaccgtctccctacctctctcgtcaccaaacatcaaattgaacctgacctcaccaaagcggggacagaagcgcgaggaagggtggaaggaggtcgtccgccgtagtaaaaagctatccgttccagccagcgttgtctctcgaataatgggaagaggaggatgcaatatcaccgcaattcaagatgtgactggggctcatattgacgttgataagcaaaaggataaaaacggagaacgaatgatcacaattcgcggaggtacagagtccacaaggtacgctgtgcagctaattaacgctctcatccaggacccagccaaggaactggaagacctgatcccgaagaaccacattagaacgcccgctagcactaaatccattcatgcaaatttctccagtggggtagggacaacagctgcctccagcaaaaatgcctttcccctaggtgctccgactttagtgacaagtcaggccacgaccctgtcaacattccagccagcaaataaactcaataagaatgtccccacaaatgtccggagctcctttcccgtatctctacccctggcctatcctcatcctcacttcgcgctcctggcggcacaaaccatgcagcaaattcgacatcctcggttgccgatggcgcaatttggcggaactttttcacctagtcccaatacgtggggccctttccccgtgaggccagtgaaccccggaaatacaaacagttctcctaagcataacaacacttctaggctcccgaaccagaacggcaccgtgctcccgtccgagagcgccggtctggccaccgctagctgtccgatcacggtctccagcgtggtagcggcatcacaacagctgtgcgtaactaacacccggaccccctcttctgtgagaaaacagctgtttgcttgtgtccctaaaacttctcctccagctacagtgataagcagtgtgacctctacctgctccagtctcccttctgtcagcagcgcccctatcactagcggtcaggctccgacaacattccttcccgcaagtacttctcaggcacagctttctagccagaagatggaatcattcagtgctgtgcctcccacgaaggaaaaagtcagcactcaagaccagcctatggccaacctgtgcactccatcctccaccgccaattcctgttcctcgtcggcgtctaatactcccggagcccctgagacccatccgtcatcaagccccacgcccaccagttccaatacacaggaggaggctcagccttcttcagtgtcagacctcagccctatgagcatgccattcgcctctaattcagaaccggcacctttaacgctcacatcccccagaatggtagcagccgataaccaggatacgtctaatcttcctcagcttgctgtgcccgctcctcgagttagtcaccgaatgcaacctcggggttctttttattccatggtaccgaatgcaacaatccaccaagatccccagtccatcttcgtgacaaaccctgtcactctgacccctccccagggcccacctgccgctgtgcagctcagttctgctgtgaacattatgaacgggtcgcaaatgcacatcaatccggctaataaatccctccctccaacctttggtcccgctactttgttcaaccacttttcatccctgttcgactcatctcaagtgcccgctaatcagggctggggggatggcccactctcttcgcgtgtggcgactgatgcctccttcaccgtgcagagcgccttcctgggcaattccgttctgggtcatctcgagaacatgcatcccgacaatagtaaagctcccggttttagacctccttcacagagagtgtctacctcaccagtcggtctgcccagcattgacccatctggttctagccccagcagctccagtgctccacttgcatcattttcaggtatccccggaactcgcgtattcctccagggacccgctccagtcggaacgccaagttttaaccgccagcacttctctccccacccttggacttccgcgtccaattcatcaacttcagctcctccaaccctgggacaacctaagggggtcagcgctagtcaggatagaaagattccccctcctataggaaccgaaaggctcgctagaatcaggcaggggggaagtgtggcccaggcccctgcaggcacatcctttgtggctcctgtcgggcactcaggtatttggtccttcggcgtcaacgcggtctccgagggattatccggctggtctcaaagcgtaatggggaatcaccctatgcaccagcagctgagcgacccttccaccttctcccagcatcagccaatggaaagagatgatagtggaatggtcgctccttccaatatatttcaccagcctatggcttcagggtttgtggactttagtaaggggctgcctattagtatgtacggcggaactattatccccagccacccccagttggccgatgtccctggcggtccactgttcaatggactgcataaccccgatcccgcatggaaccctatgataaaagtgatacagaactccacagaatgtacggacgctcaacaaatctggccaggcacgtgggctccacatattggcaacatgcacttaaagtatgtgaacta

SEQ ID NO: 214436 - DNA, 1851 bp, Artificial Sequence
  Description of Artificial Sequence: Synthetic coding sequence
atgctcacagacagcggaggcggaggcacatctttcgaggaggacttggattcggtggctcccagatccgcacccgctggggcttccgagccacccccaccgggaggcgtgggcctcggtatcaggactgtgagactcttcggcgaagccggacccgctagcggggtcggaagctcgggcggagggggatccggtagcggaactgggggaggcgatgctgcgctagatttcaaactggcggctgctgtgcttcggacagggggaggaggtggcgcttctggctctgatgaagatgaggtgtccgaggtagagtccttcatactcgatcaggaagatctagacaatcccgtcctcaagaccacctccgaaattttcttaagcagcaccgcagagggcgctgacttaagaactgttgatcccgagacacaggctcgccttgaggcactccttgaagctgcagcctttgcagaccccgaagtgcttaggcgtttaacctcgtccgtgtcctgtgctctggatgaagctgccgctgccctcacgagaatgaaggccgaaaatagccataacgcagggcaagtcgataccagatcgcttgccgaagcctgttccgacggggatgtgaacgccgtgcgcaagctgttggacgaaggtcgatctgtcaatgaacacacagaagagggggaatccctgctgtgcctcgcctgctcggccggttattacgaattagcccaggttttgcttgcaatgcatgcaaacgtggaagacagggggaacaagggagatatcacgcctctgatggcggcaagcagcggaggttatctggacattgtgaagctgctcctgctgcacgacgccgatgtaaacagccaatctgccaccggcaacacagcccttacctatgcatgtgccggtgggtttgtggatatagtgaaagtgctgctcaatgaaggcgcaaatatcgaagatcacaacgagaatggtcataccccgttgatggaggccgctagtgcagggcatgtggaggtagcacgggtgctgctcgatcacggcgcagggatcaacacccacagtaacgagttcaaggaatccgcacttacactcgcatgctataagggacacctggatatggtccgatttcttctggaggctggagccgatcaggagcacaagacagacgagatgcacacagctctgatggaagcctgcatggatggacatgtggaggtggcacgcctcctcctggatagcggagcacaggtgaatatgcctgccgactcattcgagagccctttaacactggcagcgtgtggtgggcatgtggagctcgcagcattgctcattgagaggggtgccaaccttgaggaagtgaacgacgagggctatacccccttaatggaggctgctagggaggggcacgaggagatggtggcgctcttgctggcccagggtgctaacatcaacgcccagactgaggaaactcaggaaactgctctgacattggcttgttgtggcggattttccgaagtggccgactttctgataaaggccggagctgacattgagttaggttgttcaactcctctaatggaagcttcacaagaggggcatttggagttggtaaaatacttgttagcatccggcgctaatgtacatgcgaccactgcaaccggcgacaccgcactcacctatgcctgcgagaatgggcacacagacgttgccgacgttctgctacaggcaggcgcagacctcgacaaacaggaagacatgaagactattctggagggtattgatccggcaaagcatcaggtgcgagtcgcgttcgacgcttgtaagctgctgcggaaggaatag

SEQ ID NO: 214437 - DNA, 1884 bp, Artificial Sequence
  Description of Artificial Sequence: Synthetic coding sequence
atgctcaccgactctggtggcggagggacaagctttgaagaggacctggacagcgtggcaccacggtccgcgccagccggagcctctgagcccccacctccaggtggtgtgggcctaggaattcgcacagtgcgactgttcggggaagcgggtccagccagcggggtgggctcctcgggagggggaggttccggttccggaacaggtggcggtgatgcagctctggattttaaactggccgctgcagtactgagaaccggtgggggagggggagcctctggcagtgatgaggatgaagtgagtgaggtggagagttttatcctggatcaggaagacctcgataatcctgttctcaagaccactagcgaaattttcctgtcttccactgccgaaggcgcagacctgagaaccgtcgaccctgagacccaagcccgactggaagcgctgctcgaagcggctggcataggcaaactgtctacagctgacggcaaagccttcgctgatccggaagtgctgagaaggctcacctcatctgtttcctgtgcattagatgaagccgctgccgctcttaccagaatgaaagccgagaatagccataatgctggtcaggtcgacacccggtctcttgccgaggcctgtagtgacggcgacgttaacgcagttcgcaagctgttagacgagggccgatccgtgaacgagcacaccgaggagggcgagtctctcctttgtctcgcttgttccgccggatattatgagcttgctcaggtgctcctggctatgcacgccaacgtggaagatcgagggaataaaggcgacattacgcctctgatggccgcttcatctgggggttatttggatatcgtcaaattacttctgctacacgacgcagatgtcaacagtcagagcgccaccgggaataccgcacttacgtatgcctgtgccggtggattcgtcgacattgtgaaggtgcttctgaatgagggagctaatatcgaagatcacaatgagaacggccacaccccactcatggaagcagcgtctgcaggtcatgtggaggtggctagggttctgttagaccatggcgctggcatcaacacccactctaatgagttcaaggagtctgctttgacccttgcctgctataagggacaccttgatatggtgcgcttccttttggaggctggcgcagatcaagaacacaagaccgacgaaatgcacaccgcgctaatggaagcatgtatggatgggcatgtggaggttgccagacttctgctggattctggcgctcaagttaatatgccggcagacagcttcgaatcccccctaacactagcagcttgtggtggccacgtggagttggctgccctgctgatcgagagaggcgctaacttggaggaggtgaacgacgaagggtacacaccactgatggaagcagccagagaagggcacgaagagatggtggccttgctgctagcccagggagccaatatcaatgcgcagaccgaggagacgcaggaaacggcactaacccttgcttgttgtgggggattcagtgaagtcgccgatttcctgattaaagccggagctgatatcgagctcggctgctccacccctctgatggaagccagtcaggaaggacatctggagttggtcaagtacctcctggcgtccggcgctaatgtgcacgccacaactgctactggagacacagctctgacttacgcatgcgaaaatggccacacggacgttgctgacgtcctactgcaggcaggggctgatctggacaagcaagaggacatgaagaccattttggaaggaatagacccagcgaaacatcaggttagggtcgcgtttgatgcatgtaagctgttgcgcaaagaatag

SEQ ID NO: 214438 - DNA, 4461 bp, Artificial Sequence
  Description of Artificial Sequence: Synthetic coding sequence
cccagggtgggcaggcacaggcttcggctaagggtcagaacaatgctgacagattcagggggagggggaacctcattcgaggaggaccttgactccgtcgccccaagatccgctcctgcgggtgcaagtgagcctcctccgcctggtggagttgggctgggaatacgtacagtcagattgttcggagaggctggtccagcttctggggtgggcagctccggcggaggaggctcagggtcagggacagggggaggcgacgctgccctggatttcaagctggccgctgccgtgctaaggactgggggaggtgggggagccagcggcagcgatgaagatgaagtgagcgaggtggagtctttcatactcgatcaagaagacctcgataaccccgttctgaagaccacttcagaaatctttctcagctcaaccgctgagggcgctgatttgcggacagtggatcctgagacgcaagctcgcttggaggcattactggaggcggcaggcattggcaagctgtcaacagcagacggaaaagccttcgctgaccctgaggttctcagacgtttgacctctagcgtgtcgtgtgctttggacgaggctgccgctgcactgacccgcatgaaagcagagaattcccataacgctggccaggtggatactcgctccctcgccgaggcttgctcagacggcgatgtgaacgctgttcggaaactcctcgacgagggccgtagcgtcaacgagcatacagaggaaggcgagtcattgctgtgccttgcttgttctgcgggatattacgaactggcccaggttctgctggcaatgcatgctaatgtggaggatagaggtaacaagggcgacatcacgcccctgatggctgcaagttcaggaggttatcttgacattgttaagctgctgcttctgcacgatgcagatgtgaactctcaatcagccaccggtaacactgcacttacgtatgcgtgtgccggaggcttcgtggatattgtgaaggttttactgaacgaaggcgcaaatattgaggatcacaatgagaacgggcatacccccctaatggaggccgcttctgcaggacacgtcgaggtggctcgagtgctcctggaccacggtgcgggtataaacactcatagcaatgagttcaaagagagtgcactgacactggcctgctacaagggccatctggatatggtgagatttttgctggaagctggcgctgatcaggagcataagaccgatgagatgcatacagccctgatggaagcttgcatggacggacacgtggaggtggcacgacttcttttggacagtggggctcaggtgaatatgcccgcagactctttcgaaagtccactcaccctcgcggcatgcgggggtcatgttgaattggccgctctgctgatcgagcgcggtgctaacctggaggaagtcaacgatgagggctacactccgctcatggaagctgccagagaaggccacgaagaaatggtggctcttctcctcgcacaaggggctaacattaacgcacagaccgaggaaacccaggaaacagccctgaccctggcttgctgcggcggtttttcagaggtagcagattttttgataaaagctggtgcagatatcgaactcggctgctcgacaccccttatggaggcatcccaggaaggacatctggaactggtgaagtacctgctcgctagcggcgctaacgtgcatgccacaacggccacaggggacaccgctctgacctacgcttgcgagaatggccatacagatgtagctgatgtgctgctgcaagcaggcgctgatttggataagcaggaggacatgaaaactattttggaaggaatagacccggctaaacaccaggaacacgagtcagaaggcggtcgaacccctttaatgaaagcagcacgtgctggtcacctctgcacagtacagttccttattagcaagggcgcaaacgtgaacagggcaacagccaacaatgatcacactgtagtctccctggcatgcgcagggggacatctcgcagttgtggagcttttactggctcatggcgcagatccgacacacaggttaaaggacggctcaaccatgttgattgaggctgccaaggggggacacacaaatgtcgtctcatatcttctcgactacccgaacaacgtgctctccgttccaaccacagatgtttcacagctgcccccaccaagccaggaccaaagtcaggtgccgagggtccccacgcataccttggcaatggtcgtgccccctcaggaaccagataggacaagtcaggagaacagtcccgctttgctcggcgtgcagaagggcacttcaaagcagaagtcaagcagtctacaggtggcagatcaagacctacttccctctttccacccatatcagccattggaatgcatcgtcgaagagaccgaaggaaaacttaatgaattgggccagcggatcagtgcaatagagaaggctcagctaaagagcctcgagctaattcagggagagccacttaataaagacaagatagaggaattgaaaaagaatcgagaagaacaggtgcagaagaagaagaaaatcctgaaagagctacagaaggtggagcgtcagcttcaaatgaagactcagcaacagtttacaaaagaatacctggaaaccaagggccagaaggatacggtgtctctccaccagcagtgtagtcacagaggtgtatttccagagggagaaggagatggatctttgccagaggatcactttagcgagttaccacaggtggacactattttgttcaaggacaatgacgtggatgatgagcaacagagcccgccatcggctgaacagatagatttcgtgccagtgcagccactgagttcgccccagtgcaacttttcaagtgatctagggtccaatggtaccaactctctggagttacagaaggttagcggaaatcagcagattgtagggcagcctcaaatcgcaattacaggacacgatcaaggactgctagtgcaggaaccagacgggctcatggtcgctacacccgcacagaccctgacggacactctggatgacctgatcgcagcagtttcaacgagagtaccaacaggatcaaacagctcatcccaaaccacagagtgcctgacgccagagagctgctcacagaccacaagcaatgtggcttcccaaagcatgcccccagtgtacccttccgtggacatagacgcacatacagagtccaatcacgacaccgccctaactctggcgtgcgccggagggcacgaagagcttgtgagcgtgctcatcgccagggacgctaaaatcgagcaccgggataagaagggatttactcccctcatcctcgctgccactgccggacacgtcggcgtggtggagatcctgctggataagggaggcgacatcgaggcccagagcgaacggaccaaggacaccccactgtctctggcctgtagcggtggccgtcaagaggtggtggaccttctgttggcgcgaggggctaacaaagagcaccgcaacgtttcggactatacacctttgtctctggcagcatccgggggttacgttaatattattaagatactgttgaatgccggagccgagatcaattcgcgcactggaagtaaactcgggatttcaccgctgatgctggcggctatgaatgggcacgtcccagccgtaaaactcttgctcgatatgggatccgatataaacgcccagattgaaaccaaccgcaacaccgccctcaccctggcttgtttccaggggagagccgaagtggtgagcctcctgcttgacagaaaagctaatgttgagcatcgtgccaaaaccgggcttacacctctgatggaagccgcatcaggaggctacgcagaggtgggacgggtgctgctcgacaaaggagccgatgtcaatgcccctcccgttccatccagtcgcgacaccgccctgacaatagccgcagataagggtcactacaaattctgcgagctactgatccatcggggtgcacacatagacgtccggaataagaaggggaacacccccctctggctcgcatcgaatggcggacacttcgacgtagtacaactgctggtgcaggctggagcggacgtggatgctgcagataacagaaagataaccccccttatgtctgcctttagaaagggccacgtgaaagtagtacagtacctggtgaaggaagtaaatcagttcccatccgacatcgagtgtatgcgctatatagccaccatcaccgacaaggagctcttgaaaaagtgccaccagtgcgtggagacaatcgtcaaggccaaagaccaacaagccgctgaggccaataagaacgccagcatcctgcttaaagagctggatctggaaaagtcccgcgaggaatcgcgaaagcaggctctggccgcaaagcgctag

SEQ ID NO: 214439 - DNA, 1863 bp, Artificial Sequence
  Description of Artificial Sequence: Synthetic coding sequence
atgtctctggctcagcaaaaggcagacaagaacaagatcaatggagaaccgcgtggaggtggcgctggcggtaactccgattctgacaatctggattcaactgattgtaattcagagagcagttcgggaggtaagtcgcaggaacttaatttcgtcatggatgtcaattcatctaagtacccgtcgctattgctgcattctcaagaagagaaaacatccaccgccacctccaaaactcagacgcgccttgaaggggaagtcacccccaatagcttatcgacttcttataaaacagtgtcactgcctctcagcagccctaacatcaagctgaatctgactagtcccaagcggggacaaaagcgcgaggaggggtggaaggaagtggtgcggaggagcaaaaaattgagcgtgccggcttctgtcgtgagtagaataatgggcaggggcggatgtaacatcaccgccatccaggatgtgactggggctcatattgatgttgacaagcagaaggataagaatggggagagaatgattacaattcgcggaggaactgagagtacccgctacgccgttcagctaataaatgcacttattcaggacccggcaaaggagctggaggacctgatccccaaaaaccacatcaggaccccggctagcacaaaatctattcacgcaaatttttcttccggggtcggtaccacagccgcttcatctaaaaatgccttcccactcggggctcccactcttgtgacaagccaggcgactactttgtccactttccagcctgcgaataagctaaataagaacgttcccacgaatgtccgaagctcctttccagtgtcgctgcccttggcgtaccctcacccccactttgccctgttggcagcacagactatgcagcagattcggcaccctagacttccaatggcacagttcgggggaacctttagtccgtcgcccaacacttggggtcctttccctgtaaggcctgtgaaccccggtaatactaattcgagtccgaaacacaacaacaccagtaggctgcctaatcaaaacgggacggtgctccctagtgaaagtgccggactcgcaaccgcatcctgtccaatcaccgtaagttcagtcgtcgcagccagccaacagctgtgtgtcacaaatacacgcacccccagcagcgttcgcaagcagctgttcgcctgtgtcccaaagacatctcctcccgctacagtgataagttcagtgacgtcaacctgttcttctcttccatcagtgtctagtgccccaatcaccagtggccaagcgccaacaacatttctaccggcttcgacatcccaagctcagttgtcctcccagaagatggaaagcttcagtgcagtccctccaactaaagaaaaagtcagcactcaggaccagccgatggctaatctgtgtaccccttcctctacggctaactcttgttccagcagcgcctcaaacactcccggagctccagaaacccatcctagcagctcgcccacacccacgtctagtaacacccaggaagaggctcagccgtccagcgtgtcggacctgtcacctatgagtatgccgttcgcttccaactctgagcccgctccattgacgctaacaagtcctagaatggttgcggcagataaccaggacacctctaacctgcctcagctggcggtgccagcccctagggtctcgcatcgaatgcaacccagggggtctttttactccatggtgccaaacgcgactatccaccaggatccgcaaagcatcttcgtaacaaatcctgttacactgtgggaggccgaggccagtgggttgcatgaagtacggagcctgcgtcaagcgtggtag

SEQ ID NO: 214440 - DNA, 2601 bp, Artificial Sequence
  Description of Artificial Sequence: Synthetic coding sequence
atggatgtgaactcctctaagtaccctagtttactactgcatagtcaggaagagaagactagcactgctacaagtaaaacccagacaaggctcgaaggtgaggttaccccaaactctctgtctacaagttacaaaaccgtgtcacttcccttgtcgtcgccaaacattaagttgaacctgacttcacccaaacgaggacagaagcgcgaagagggctggaaggaagtcgtgcgcagatcaaaaaagctgagcgtgccggcaagtgtggtgagcagaattatgggtcggggtggatgcaatatcacagccattcaagatgttacaggggctcatattgacgtggacaaacagaaggacaaaaacggagagaggatgataaccatcaggggcggtacagaatccacccggtacgcggtgcagcttattaacgcattgatccaggatcctgcaaaggaactggaagatctgatccccaagaatcatatccgtaccccagcctccacgaagtccatccatgcaaactttagctccggagtggggactactgctgccagcagcaagaatgctttccccctgggcgcaccaacacttgtgacaagccaggcaaccacgttaagcacatttcagcccgctaataaattaaacaaaaacgtgccaactaatgtgagatcttctttcccggtgtcattacctctcgcatatccccaccctcattttgcacttctcgccgctcagacaatgcagcagattcggcaccctagacttcctatggctcagttcggcggaactttctcaccttctcccaatacatgggggccttttcctgtgaggcccgttaatcctggcaataccaactctagccctaagcacaataatacttcaagattgccaaaccagaatgggaccgtgctgcccagtgaatccgctggtttggccactgccagctgtcctatcacggtttcatccgtggtcgccgcaagccagcaactctgtgtgacaaacacgaggaccccttcctcagtacggaagcagctgtttgcatgcgtacctaagacttccccaccagccaccgtcatcagtagcgtgactagtacatgtagcagtctcccatcagtgagttctgcccctatcacttctggccaggccccaactacatttttgcctgccagtacatctcaagcacaactgtcctctcagaagatggaaagcttctcggccgttccccctacaaaagaaaaggtgtcgacccaggaccagccgatggctaacttatgcaccccatcgtcaacagcaaatagttgctcctctagtgctagcaacactcccggtgccccagaaactcatccttcgagcagccccacccctacaagcagtaatacacaggaggaggcacagccatcttccgtttcagacttaagcccaatgtctatgccgtttgcttcaaactctgaacccgctccccttacactgactagccccagaatggtagccgcagataatcaggacacatcaaatctgccacagcttgctgtgcctgctccgagggtttcacaccgcatgcagccgcgtggatctttttactcaatggtgcctaatgcaacaattcatcaggacccgcagtccattttcgtcaccaatccagtgaccttgacacctcctcagggcccacccgctgcagtgcagctgtcttcggcagtgaacattatgaacggctcacagatgcacatcaaccccgcaaacaagagtttaccccctaccttcggaccagcaactctgttcaatcactttagtagtttgtttgatagctcgcaggtgcctgctaaccagggttggggtgatgggcctttgtcatcccgggttgctactgacgcttcattcacagtgcagtccgcttttctgggcaattctgttctggggcatctggaaaatatgcaccccgacaactctaaagcaccgggttttcggccaccgtcccaaagggtgtccacctcccctgtcgccaccagcgcccctccaacccttggacagcccaagggagtttctgcctcgcaggataggaaaatccctcctccgatcggtaccgagcgcctagctcgcattagacaagggggatccgtggcgcaggcaccggcaggtacatcttttgttgcaccggttgggcatagtggaatctggagtttcggagtcaatgccgtgtcagaaggcttgtccggttggtcacaaagtgtgatgggaaaccaccctatgcaccaacagctgtcagacccatctacattcagtcaacaccagccgatggagcgcgatgacagcgggatggtggcgccatctaatatcttccatcagccgatggccagtgggtttgtggattttagtaagggacttcccatttctatgtatgggggtaccattataccatcccacccccagctggctgatgttccaggaggtccgctctttaacggactgcacaatcctgacccagcctggaatcctatgatcaaggtcatccagaactcaacagagtgcactgacgcacagcagatatggccaggcacttgggcccctcatattggcaacatgcacctaaagtacgttaattag

SEQ ID NO: 214441 - DNA, 2298 bp, Artificial Sequence
  Description of Artificial Sequence: Synthetic coding sequence
atggccgcagatccaaccgaactaagactgggaagtctgcctgtgtttactagagacgatttcgagggtgactggagactggttgcaagcggcggattctcacaggtttttcaggcacggcatcggaggtggaggaccgagtacgctattaagtgtgcaccttgtctccccccagacgctgccagtagtgatgtgaattatttaattgaggaggccgctaagatgaagaagataaagttccagcacattgtgtccatctacggcgtctgtaagcagcccttaggaatcgtgatggagttcatggctaatggatcattggagaaagtgctcagcacacactctttgtgctggaagctgagattcagaatcatccacgaaacctccctcgctatgaactttctgcactccatcaaacccccattgctgcacctagatttaaaacctggcaacatccttttagattctaatatgcatgtgaaaattagcgattttggtctgtcaaaatggatggagcagagcacccgaatgcagtatatcgaacgcagcgccctccgaggcatgctgtcttatattccccctgagatgttccttgaatccaacaaggctcctggcccaaagtacgacgtttattctttcgccatcgtgatatgggagctgctgacacagaagaaaccctattccgggttcaacatgatgatgattatcatcagagtcgctgctgggatgcggccttctctacagccagtgagtgaccaatggccaagtgaggctcagcaaatggtagacctcatgaaacgttgctgggaccaggacccaaagaagagaccatgtttcttggatatcacgatagaaacagacatcctcctgtctctccttcagtctcgggtggccgtgccggaatctaaagcacttgcgcgaaaagtctcctgcaaactgagcctcaggcagcccggtgaagtgaacgaagatatctctcaggaactgatggactccgatagtggtaactatctgaaacgggctttgcaactgtctgatcgaaagaatctggtgccaagggatgaagaattatgcatctacgaaaacaaagtaaccccactgcatttccttgtcgcccaagggtccgtggaacaggtgcgacttctcttagcccatgaagtggatgtcgattgtcagaccgcctccgggtacacacccctgctgatcgctgcacaagaccagcagcctgatctttgtgctttgctgctggcccacggggctgatgccaacagggtggatgaggacggctgggccccactccatttcgctgcccagaacggagacgacggcacagcccgattgttactggaccatggcgcttgtgtggatgcccaggagcgggagggctggaccccactgcacttggcggcacaaaacaattttgaaaatgtcgctcggctcttggtaagccgccaggcggatcctaatttgcatgaggctgagggaaagactccactgcatgtggccgcttatttcggccacgtgtcgctcgtgaaactactaacctcgcaaggcgctgagctggacgctcaacagcggaacctgcgtacaccccttcacctggcggtggaacgtggtaaagtacgcgcaattcagcacttgctaaaaagcggtgctgtgccagacgcgctggatcagagcggatatggccctctccacacagccgctgctcgaggcaagtacctgatctgcaaaatgctgttgcgctacggagctagtctggagttgccaacacatcaggggtggactccactgcatcttgcagcttacaagggccatttggagatcattcacctcctcgcagaaagccatgctaatatgggtgcgctgggcgctgtcaactggacccccctgcatctcgccgctcgccacggagaggaggccgtcgtgtctgccctgcttcaatgtggggctgatcctaacgcagccgagcagtctggttggacccctctgcaccttgccgtgcagcgatctacctttttgtctgtgatcaatcttttagaacatcacgccaacgtgcatgcacggaacaaggtgggttggacacctgcccacttggccgctctgaaaggaaacactgccatcctaaaagttctggtggaagctggcgctcagctggatgtccaggacggagtgtcatgcactcccttacaattagctctgcgcagtaggaagcagggaatcatgtcgtttctggaagggaaagagccaagcgtggcaaccctgggaggatccaaaccaggagccgaaatggaaatttag

SEQ ID NO: 214442 - DNA, 1008 bp, Artificial Sequence
  Description of Artificial Sequence: Synthetic coding sequence
atggctgaaggaggcagtccagacggaagggccggaccaggatcagccggtcgtaatctcaaggagtggctacgcgagcagttctgcgaccaccccctggaacattgtgaggatacccggttgcacgacgccgcatacgtcggcgatctgcaaaccctccgctctctgctgcaggaggagagttacaggtcccgcattaatgagaagtctgtgtggtgctgtggctggctcccatgcacacctctccgtatcgccgctacagccggtcatggcagctgcgtggacttcctgattcgaaaaggcgctgaggtggatctggtcgacgttaaagggcagaccgctttgtatgtcgctgttgtcaatgggcaccttgagtcaactcaaatcctgctcgaggcgggtgcagatcccaacggcagtcgacaccaccgcagcaccccagtgtaccatgctagcagagtcggcagggccgacattcttaaggcacttatccggtatggcgctgatgtggacgtcaaccaccacctgacccctgatgtacaaccacgcttctcccggcgtctcacgtcactggttgtgtgtcctttgtacatttctgccgcttatcataacctccagtgtttcaggttgctccttctcgctggtgccaaccctgacttcaattgcaatggacccgtcaatacccagggcttctaccgaggctcccctggctgtgtcatggacgctgtgctacgtcatggctgcgaggctgccttcgtgagtctgctagtcgagttcggggcaaatttgaacctcgtgaaatgggagtcactggggcctgaatcacgcggacgacgcaaggtggaccctgaggccctgcaggtattcaaggaggctcggtccgtgccacgcaccctgctgtgcctgtgccgtgtggcagtacgcagagccttgggaaagcacagactccacttaatcccaagcctgcccctgcccgatcccatcaaaaaattcctccttcacgaatag

SEQ ID NO: 214443 - DNA, 909 bp, Artificial Sequence
  Description of Artificial Sequence: Synthetic coding sequence
atgctccagctcactggcgaaaacgagaaaaactgcgaagtgtccgaaagaattagacgttccggtccgtggaaggagatctcatttggagactacatctgccacaccttccagggggactgctgggccgacagaagcccattgcatgaggctgcggctcagggcagactgctggccttgaagacgctgatcgcacagggagtcaacgtcaatctggtgactatcaacagagtttctagccttcatgaggcttgcctggggggacatgtcgcatgcgctaaggcgctccttgagaacggggcacacgttaatggagtgacggtgcacggggctacgcctctgttcaatgcgtgctgctcggggtcagcagcctgtgtaaacgtgttgctggagttcggtgcaaaggcccaactcgaggtacacctggcttcgcctatccacgaagctgttaagcgcggtcacagagagtgcatggaaattctcttggcaaataatgtcaatatagatcacgaggtgccccaactgggcacccccctgtacgtggcctgtacttaccaaagagttgactgtgtgaaaaaactgcttgaattgggcgctagcgtagatcatggccagtggttggatacccctctccacgccgcagctcgacagtcaaatgtcgaggtgatacaccttctgacagattatggggctaaccttaaacggaggaatgcccagggtaaatctgccttggacctggccgcacccaaatcctctgtggaacaagcacttctactgcgagagggccctcccgcattgagccagctgtgcagactgtgcgtgcgtaagtgcctcggacgcgcatgccaccaggctatccataagctccacctgccagagccactggaacggtttctgctgtatcagtag

SEQ ID NO: 214444 - DNA, 972 bp, Artificial Sequence
  Description of Artificial Sequence: Synthetic coding sequence
atggaggacggcccagttttttacgggtttaaaaacatttttataaccatgttcgctactttcttcttctttaagttgctgatcaaagtgtttctggcactgctcacccatttctatatcgttaaagggaataggaaagaggccgctcgcattgccgaggagatttacggcggaatctccgactgctgggctgataggtcaccccttcatgaagccgctgcacaaggtaggcttttggcgttgaaaaccctgattgctcagggggtcaatgtgaatctagtcactattaatcgggtgtcttccctacacgaagcctgcctcgggggacatgtggcctgcgctaaagcgctgctcgagaacggagctcacgtcaacggagtgactgttcatggagcaacgccgctgttcaatgcctgctgtagcggctctgccgcttgcgttaatgttctgcttgagttcggcgcaaaggcgcagctcgaggtccatcttgcatctcccattcacgaagctgtgaaacgcggtcatagagagtgtatggaaattctcctagcaaataatgtcaatattgaccacgaggttccccagctcggtacacctctgtacgtggcttgcacctaccagcgtgtagattgcgtgaagaagctactggaactgggggcttctgtggatcacgggcagtggctggacactcccctacacgccgctgcaagacagagtaacgtggaggtgatccaccttttgacggattatggtgcgaacctaaagaggcgaaacgcacaggggaagtcagctttggacctggcagcacctaagtccagcgtggagcaggccctattgctacgggagggaccacccgctctttcccaattatgccgtctgtgcgttagaaagtgtctgggacgcgcttgtcatcaagcgattcacaagctccatctccctgaacctctggaaaggtttttgctttaccaatag

SEQ ID NO: 214445 - DNA, 909 bp, Artificial Sequence
  Description of Artificial Sequence: Synthetic coding sequence
atgctgcagctgacaggggagaacgaaaaaaattgcgaagtttctgaacgcatccggaggagcggcccatggaaagagatctccttcggagattacatttgccatactttccaaggcgattgctgggccgacagatcacccctacatgaggctgccgctcaaggcaggttactggctttaaagacactgatagcccagggcgtgaacgtgaatttggtaacaatcaacagagtgagtagtctacatgaagcttgtctcggcggacacgtcgcttgtgcaaaagctctgctggaaaatggggcacatgtgaacggcgtaaccgtgcacggggcaacccccttgttcaatgcctgctgcagcggcagcgcagcctgcgtgaatgtactgctggagtttggggcaaaagcacagctggaagttcacttagcctctcccattcatgaggccgtgaagaggggacacagagaatgtatggaaattctgcttgcgaataatgtcaatatcgatcacgaggtcccccaacttggcacccccctctatgtggcctgcacctatcagcgggtcgactgtgtgaaaaaactgcttgagctcggggcaagtgtcgaccacggccagtggctggacacgcctttgcacgccgcagccagacaatccaatgtggaagttatccatctgctgaccgactacggagccaatctgaagcgaaggaacgctcagggaaaaagcgctctcgatcttgccgcacccaagtccagtgtggaacaagcactcctcctacgggaaggacccccagccctatcacagctctgtcgcctttgcgtaaggaaatgtctgggaagagcctgccaccaggcaattcacaagctgcatctccccgaacctttagaacgattcctcttgtaccaatag

SEQ ID NO: 214446 - DNA, 921 bp, Artificial Sequence
  Description of Artificial Sequence: Synthetic coding sequence
atggaggacggccctgtcttttatggttttaagaacatcttcatcaccatgttcgcaactttcttcttttttaaactgctgatcaaggtattccttgctctgttgacccatttttacatcgtcaaagggaaccggaaagaggcggctagaatcgccgaggaaatctacggagggatctcggactgttgggctgacaggtctcctctacacgaggcggcagctcaaggacggctcctcgcactgaaaactctcattgctcaggcctgtttgggtggacatgttgcctgtgctaaggccctgctggaaaacggggctcatgttaacggggtgactgttcatggggcaactccgctattcaacgcgtgttgttccggcagtgccgcatgcgtcaacgtgctactcgaattcggggctaaagcccagctggaggtccatctagcctccccaatccatgaggcagtcaagcggggacatcgggaatgcatggaaatcttgctcgccaataacgtaaacatagaccatgaagtgccccagctcggcacacccctgtacgtagcctgtacatatcagagagtggattgcgtgaaaaaactgctggagctcggggcaagtgtcgatcatggccagtggttggatacacctctccacgctgctgccaggcagtcaaacgtggaagtgatccacttgctcacagactatggagcaaatttgaagcggagaaatgcccagggcaagtctgccttggacctggccgctccaaagtcaagtgtagagcaagcattgctgctgcgagaaggccctccagcactatctcaactgtgcaggctgtgtgtcaggaaatgcctcgggagggcgtgccatcaggccatccataagttgcacctccctgagcccctcgaaaggttcctgctctatcagtag

SEQ ID NO: 214447 - DNA, 1764 bp, Artificial Sequence
  Description of Artificial Sequence: Synthetic coding sequence
atgacccggttcagctatgccgagtatttctccctttttcactcctgcagcgcccctagcagatccacagcacctccggagtcatctcccgctagagcgcctatggggctgttccaaggagttatgcaaaagtattctagttctctgttcaagacatctcagctggcgcctgctgacccccttattaaggccatcaaggacggcgatgaagaggccttaaagacaatgatcaaagagggcaagaatctagctgaacctaataaggaagggtggctgcccctgcatgaagccgcatattatggtcaggtagggtgtttgaaggtgttgcagagggcgtatcctggcacaatcgaccaaagaaccctgcaggaagagaccgcggtgtacctggctacgtgtagggggcacctggactgtctactgtccctgctacaagccggagccgaacccgatatcagcaacaaaagccgagagacccctctctataaggcatgcgaaaggaagaacgccgaggccgtgaaaatcttggtgcagcacaacgcagatacaaatcaccgctgcaatagaggatggaccgccctacacgaaagtgtctctcgcaacgatctggaggtgatgcaaattctggtaagcggaggggcaaaggtggagtctaaaaatgcatatggaattactcctctgttcgtggccgctcagtccggacagctggaggccttgcgattcttagccaagtatggcgctgatatcaacacacaggcctcagataacgcctccgcactgtatgaggcatgtaaaaacgagcatgaggaggtggtcgagttcctgctgtctcagggggctgatgccaataagacaaataaggatggcctactgcccctccacattgcttcaaagaaagggaattacagaatcgtccagatgttactccccgtgacaagcagaacccgtattcgtagaagtggggtcagcccactgcaccttgctgcggagcgtaaccacgatgaggtactcgaggcactactgtccgcacggttcgacgttaacacccctctggccccagagcgcgctcggctgtacgaagaccgaaggagtagcgcgttgtacttcgctgtggtgaataacaacgtctacgcgaccgagctactcctgcagcacggagcggaccctaaccgagacgtgataagtccccttctggtcgctatcaggcacggctgccttcgcacaatgcaacttcttctggatcatggcgcaaacatcgatgcctacattgccacacaccctaccgctttccctgctaccattatgtttgccatgaagtgcctttccctgctgaaattcctgatggatttggggtgcgacggagaaccatgtttcagctgcttatacgggaatggtccccaccccccagcaccacaaccatcttcacgcttcaatgacgctccagcagccgacaaggagccatccgtggtccagttttgtgaatttgtgtctgcaccggaagttagccgttgggctggccctatcattgacgttttgctcgactacgtcggaaatgtgcagctctgtagcaggcttaaagaacacatagactcttttgaagattgggccgtgatcaaagagaaggccgagccgcctcgaccgctggctcacctgtgtaggcttagagtccgtaaggcgattggcaagtatcggattaagctgctcgacacccttcctttacccggtaggcttattcggtacctgaagtacgaaaacactcaatag

SEQ ID NO: 214448 - DNA, 1812 bp, Artificial Sequence
  Description of Artificial Sequence: Synthetic coding sequence
atggcaatcgaacagagcctcgctgataaaacgcgcggtcctactactgccgaagccacagccagtgcttgtacaaatcgtcagcctgcccacttttacccatggacccggagcacggccccacctgagtcctctcccgcaagggcccctatgggcctctttcagggagtcatgcagaagtattcgtccagcctctttaaaaccagccagctggcccctgccgaccccctgattaaggccattaaggacggggacgaagaagccctcaaaacaatgattaaggaagggaaaaacctagcagaacctaataaagaaggttggctgcctctgcatgaagccgcatactacggtcaggtaggttgcctaaaagtgctgcaacgggcatacccgggaaccatagatcaacggactctgcaggaggagacagccgtctatctggccacgtgtagaggacatctggattgtttattgagcctgctgcaagctggcgctgaaccggatatctcaaacaagagcagggagactccattatacaaggcttgtgaacgtaaaaacgctgaggccgtcaagattctcgtccaacacaatgccgacaccaatcatcgctgtaaccgtgggtggacagccctacatgaatccgtaagtcggaatgatctcgaggttatgcagatacttgtctccggcggagccaaggttgagagcaaaaatgcttacggcataactcctttattcgtggctgcccaatcaggccagctggaagccctcaggttcctcgcgaagtatggtgctgatatcaacacacaagccagcgataatgcctctgctttgtatgaagcatgtaaaaatgagcacgaagaagtggtggaattcttgctgagtcagggtgctgatgccaacaagacaaataaggatgggttactgccgttgcacattgcttccaaaaaagggaattaccgcatcgtacagatgctgttgcccgtgacttccaggaccaggatacgcagatccggcgtctccccattacacctggcagcggaaaggaaccacgacgaagtgctggaggccttactgagtgcccgatttgacgtgaatactccgttagcaccagaaagggccaggttatacgaggatagacgatcatccgctctttactttgccgtagtgaacaacaacgtgtatgctactgaattactactgcaacacggcgctgacccaaatagggacgtgatctcacctctgctcgtggccatcagacatggttgcctgaggactatgcaattactgctggatcatggtgccaatattgacgcatacatagcgacgcacccaacagcctttccagccaccattatgttcgccatgaaatgtctctctcttctcaagttcctgatggacctgggctgcgacggtgagccatgtttctcatgcttgtacgggaatggtccacatccccctgcaccgcagccctcgtcacgattcaatgacgccccagccgctgacaaggaacccagtgtggtgcaattttgcgaatttgtatccgccccagaagtgtctagatgggctgggcctataattgatgtgctgcttgattatgtgggaaacgtgcaattgtgctcccggctgaaggagcatatcgactctttcgaggactgggctgtgataaaagaaaaagccgaaccgccacgtcccctggctcacttatgccgactcagagtccgtaaggcaattggtaaataccgaatcaaactcctggacacacttccgctccctgggcgtcttatcagatatctcaagtatgagaacacacagtag

SEQ ID NO: 214449 - DNA, 1470 bp, Artificial Sequence
  Description of Artificial Sequence: Synthetic coding sequence
atgcgcccagccgaccccctgattaaagccattaaagacggtgacgaagaggcattgaaaacaatgatcaaggaaggtaagaacctggctgaacctaataaagaaggctggctacctctgcacgaggccgcttactatgggcaagtggggtgtctaaaagtgctgcagagagcttatccgggtacaatcgaccagcggactctccaggaggaaacggccgtgtacttagctacttgccgcggtcatttagattgtttgctcagcttgctgcaggctggggctgagcctgatatctcaaacaagtcccgtgagacccctctgtataaagcctgtgaaagaaagaatgctgaagccgttaagatcctggtgcaacacaacgccgatacgaaccacagatgtaatcgcggttggaccgcgctgcatgaatccgtgtcccggaacgatctggaggtgatgcagatcctggtctctggcggtgccaaggtcgagagtaaaaacgcatacggaattactcccttgtttgtggccgctcaatctggacagctcgaggcactgagatttcttgcaaagtacggcgctgacatcaacactcaggcctctgacaatgccagcgcgctgtacgaagcctgtaaaaatgagcacgaggaggtcgtggaattcctgctctcccaaggggcagatgcgaacaagactaacaaagatggcctgctgcccttacacatcgcctccaaaaaaggcaattatcggattgtgcagatgttgctgcccgtgacttctcggacgcgaattaggaggtccggggtgtctcctttgcaccttgctgccgaaagaaatcacgacgaggtcctcgaggctcttctgagcgctagatttgatgttaataccccattggcacctgaaagagccaggctgtatgaagatcggaggtccagcgcgttgtactttgccgtggtcaataacaatgtctatgctacagaactcctgctgcaacatggcgcagaccctaatcgggatgtgatcagtccgcttttggttgcgatcaggcacggctgtctccgcactatgcagctgctgctggaccacggtgccaacattgacgcttatatcgccacacaccccactgctttcccagccactattatgttcgccatgaagtgtttgtcactcctgaaattcctcatggatttggggtgcgatggcgaaccatgctttagctgcctgtacggcaacgggcctcaccctcccgctccgcagccgtccagccgctttaatgacgcccctgccgctgacaaggagccttcagttgtgcagttctgtgaatttgtctctgcacctgaggttagcagatgggcaggacccatcatcgacgtattgctggactatgtggggaatgttcagctctgtagtagattaaaagaacacatcgattccttcgaggattgggttcttgaggggttcgtgaagtactag

SEQ ID NO: 214450 - DNA, 1908 bp, Artificial Sequence
  Description of Artificial Sequence: Synthetic coding sequence
atggctacacagatttctacaagggggagtcagtgtaccattgggcaggaggagtactccctctactcaagccttagtgaggatgagctggttcagatggctattgagcaatccctagccgacaagactcgcggaccgacaaccgccgaagccacagccagcgcctgtaccaaccggcagcccgctcatttctatccatggacgagatcaaccgcaccacccgagtcctcgccggcaagggctcccatggggctgtttcaaggcgtgatgcagaagtattccagcagtctatttaaaactagccagctggctcccgctgaccctttgataaaggcaattaaagatggggatgaggaagctctcaagactatgataaaagagggcaagaacctcgctgaaccgaacaaagaaggctggctccccttgcacgaagccgcttactacggccaggtaggttgcctgaaagtgttgcaacgtgcctacccaggaactatagatcagcggactttgcaggaggagaccgccgtgtacttggccacttgcaggggccacctggattgtctcctgtcactgcttcaggccggagctgagcccgacatttcgaacaagtcaagagagactccgttatataaggcctgtgagcgtaagaacgccgaggcagtgaagattctagtgcaacacaacgccgataccaatcatcggtgcaatcgaggctggaccgcactccatgagtcggtcagcaggaacgatcttgaggtcatgcagatactggtcagcggaggcgcaaaagtcgagagcaaaaatgcgtatggcattaccccgttatttgttgctgcacagagtggacagttagaggcactcaggtttcttgccaagtatggtgcagacattaatacacaagcgagcgacaacgcttcggcgctctacgaggcctgtaagaacgaacacgaagaggtagttgagttcctactctcgcagggcgctgacgctaacaagacgaacaaggacgggctgctcccacttcacattgcttccaagaagggcaattacaggattgtgcagatgctgttgccagtgacatctaggaccagaattagacgttctggagtgtcaccgcttcacctcgcagccgagcgaaaccacgatgaagttttggaagccctgctgtcggctcgcttcgatgttaatacccctctcgccccagagagggcacggctttatgaagaccgcaggtcctcagctctctacttcgcagtggtcaataataatgtctatgccacagagctgctcttgcagcatggcgctgatccgaatcgcgatgtcatatcccctctactagtagcgatccggcatggttgcttgagaaccatgcagttgctactagaccacggtgcaaatatcgatgcttacatcgctactcacccaaccgcctttcctgctactatcatgttcgccatgaaatgcctgtccctgctcaagtttctgatggacctcggttgtgacggggaaccatgtttctcatgcctgtacggaaacgggccacaccctcccgctccacagccctcctcccggttcaatgacgccccagcagccgataaagaaccatcagtggtccagttctgtgaatttgtctctgcaccagaggtttccaggtgggccggtcccatcatcgatgtgctcctagactacgttggaaacgtgcagctgtgctctcggctgaaagagcacattgactcctttgaagattgggccgtgatcaaagaaaaggccgagcctcccaggccactcgcacatttgtgtcgtctgcgcgttaggaaggccattgggaagtatcgcataaagctccttgacaccctgccactccctggcagattgatcagatatttgaagtatgagaatacccagtag

SEQ ID NO: 214451 - DNA, 1557 bp, Artificial Sequence
  Description of Artificial Sequence: Synthetic coding sequence
atggatttcactgaagcatatgctgacacatgctccacagtcgggctggcagcccgtgagggaaacgtcaaggtgcttcgcaagttgcttaaaaaggggaggtctgtggacgtggccgacaacagaggttggatgccgatacacgaggccgcttaccataactctgtagaatgtctacagatgttgattaacgctgatagcagcgagaactacattaaaatgaaaacctttgaagggttttgcgccctccatctcgctgcgtcgcaagggcactggaagattgttcagatcctgttagaggcaggagccgatcccaatgcaacaacacttgaggagaccacacccctgtttttggcagtggaaaatgggcagatcgatgtgttgaggctgctgctgcagcacggagcaaatgtgaacggcagccactcgatgtgcggttggaacagcctccatcaagcctcgtttcaagaaaatgctgagatcatcaaactgctgctccggaaaggggcaaacaaagagtgccaggacgactttgggataactcctctgtttgtggcagcacagtatggtaaactagaaagtctgagtatcctgatcagctcaggagccaacgtcaactgccaagcactcgacaaggctaccccactcttcattgctgctcaagaaggccacaccaagtgcgtagagttacttctctctagtggtgctgaccctgacctgtactgtaacgaggattcctggcagttacccatccatgctgctgcgcagatgggtcacaccaaaatactggatttgcttatccccctgacaaatcgagcttgcgatactgggctgaacaaagtgagtccggtttactcagccgtgttcggcggacacgaagactgcctggagattctgctccgcaatggctatagcccggacgcccaagcatgcctcgtcttcgggttctcctccccagtgtgtatggctttccaaaaagattgtgagttttttggcattgtaaatattctgcttaaatatggcgctcaaattaacgaactacatttggcatattgtctgaaatacgagaaatttagcatcttccgctattttctgcgcaaaggatgctccttgggtccctggaaccatatatatgagtttgtgaatcatgccattaaggcacaggccaagtacaaagagtggctaccccatctgttggtggctggattcgatccgctgatcctgttgtgcaactcatggattgactccgtgtccattgacactttaatatttactttggagttcaccaattggaaaaccctggccccagcagtggaacgcatgctctcagcacgagctagtaacgcctggatcctccaacagcacatcgccactgtgccatcactaacgcacttgtgcagacttgagattcggtctagtctcaagtccgagagactgcgatcagactcctacatctctcagcttcccttaccgaggtcgcttcacaactatctgctgtacgaagatgtactgagaatgtatgaggtgccagaactggcggctatccaggatgggtag

SEQ ID NO: 214452 - DNA, 1671 bp, Artificial Sequence
  Description of Artificial Sequence: Synthetic coding sequence
atggccatgatgcctctcgttctgcatcatcccgaacgccaagccgaactaggcagcggcctgcgggacgggggtggcgcagcattgaggcctcctggacgcctggtgaaacaaatggatttcacagaggcgtacgccgacacctgctccactgtcggcctggcagcacgtgagggcaacgtcaaagtcctaagaaagctcctgaaaaagggcaggtctgtggacgtggccgacaatcgagggtggatgccgatccacgaagctgcttaccacaatagtgtggaatgtttgcagatgctgataaacgctgactcaagcgagaattatatcaaaatgaagacattcgagggcttttgcgcacttcaccttgcagcctctcaggggcattggaagattgtccagatcctgttagaggccggagccgacccaaatgcgacaacgttggaggaaactacacccctcttcttggcagttgagaatggacagattgacgtcttacgcctgcttctgcaacacggggcaaacgtgaacggctcccactcaatgtgtggatggaattcactccatcaggcgtcttttcaggagaatgccgagatcataaaacttctcctgcggaaaggtgctaataaggagtgccaggatgattttgggatcaccccactctttgtggccgctcaatacggaaagcttgaaagcctgtccattctgatcagctccggcgctaacgtgaattgccaagccttggacaaagccacaccactgttcatcgctgcacaggaagggcacactaagtgcgtcgaactccttctgagcagtggggctgatcccgatctgtactgtaatgaagacagctggcagcttccaattcacgccgcagctcagatgggtcacactaaaatcttggatctccttattcctcttaccaaccgggcttgtgatacgggcctcaacaaagtttcacctgtttacagcgccgtgttcggcggacatgaagactgcctcgaaatcctgctgcggaacggatactcaccagatgctcaggcctgtctcgtttttgggttcagttcaccggtgtgcatggctttccagaaggattgtgaattcttcggcatcgtaaacatactgctgaaatacggcgctcagattaatgagctccacctagcttactgcctgaagtatgaaaagttcagtatattccggtattttctccgcaaggggtgttctctggggccatggaaccatatatatgagtttgtaaaccatgctatcaaggctcaggccaagtacaaagaatggctgccccatttgctggtcgctggctttgatcctctcatactgctatgcaattcttggattgattcggtgtccatagatactctgatctttactctggaattcacgaattggaagacgcttgcccctgcagtcgagcgaatgctgtccgccagagctagcaacgcttggattctccagcagcacatcgccactgtgccttcgctcactcacctgtgtcgcttggagattagatcttccttaaagtcagagaggctacggtcagactcctatatatcccagcttcccctccccaggagtctgcataactatctcctttatgaggacgtcctgcgcatgtatgaagttcccgaactcgcagccatccaggacggatag

SEQ ID NO: 214453 - DNA, 1338 bp, Artificial Sequence
  Description of Artificial Sequence: Synthetic coding sequence
atgaagaccttcgagggtttctgtgctttgcatctggccgctagccaggggcattggaagatcgtccagatactgctggaggccggtgcagacccgaacgcaactacactggaagaaaccacccctctcttccttgccgttgagaacggacagatcgatgttctgcgtttgctgcttcaacacggtgccaatgtgaatgggagccactcaatgtgtggatggaattcccttcatcaggcctcttttcaggaaaacgctgagatcatcaaactgctcttgcgaaaaggtgccaataaagagtgccaggacgactttgggattactcctttatttgttgccgcacagtatggcaagcttgagtctctctccatcctgatctcaagtggagccaatgtaaactgccaggctctggacaaagctaccccattgtttatcgcagcacaggaaggacacacaaagtgcgtggagttactcctgagctccggtgcagatccggacctctattgcaatgaggacagctggcagctcccaatccatgcggctgcccagatgggacataccaagatcctggacctgttgatccctctgaccaatagagcttgcgataccggcctaaacaaggtctccccggtgtactccgccgtcttcggcggacacgaagactgtctggaaatcttactcagaaacggctatagcccggacgcccaggcctgcctggtgtttggattctccagcccggtgtgcatggcctttcagaaagattgcgagttctttgggattgttaatatcttgttgaaatacggcgcacagattaacgagctgcatctggcatattgcctgaagtacgagaagtttagcatctttagatacttcctccggaaggggtgtagcttgggaccttggaaccatatttatgaattcgttaatcatgccatcaaggcccaggcgaagtacaaggaatggctgccacacctgctggttgcgggttttgatccactcattctgttgtgtaattcttggattgactccgtgtctatagatacactgatatttacgcttgagtttactaactggaagactctagccccagctgtagagcgcatgttaagcgctagggcgtccaatgcttggatcctgcaacagcatatcgcaactgtgccatcactcacgcatctctgtagactggagatcagaagctcccttaagagcgaacggcttcgatcggacagttatataagccagctgccactgcccagatctttgcacaattacttgctgtacgaggacgtgcttagaatgtatgaggttccagaattggcagcgatccaggacggttag

SEQ ID NO: 214454 - DNA, 1662 bp, Artificial Sequence
  Description of Artificial Sequence: Synthetic coding sequence
atgcctctagtcttacatcatccagagcgacaggccgaactgggctccggtcttcgtgacgggggtggggctgcattgcgacccccaggtaggctggtcaaacagatggatttcactgaagcctatgccgacacctgctcaaccgtaggcttggccgctcgggaggggaacgtaaaggtgctgcgcaaactcctgaaaaaaggtagatctgtggatgttgcagacaatagggggtggatgccgattcatgaggcagcgtaccataactctgttgaatgtctccagatgctcataaacgccgattctagcgagaattatataaagatgaagaccttcgagggtttctgcgcccttcacctggctgcctcacaaggccactggaagattgtgcagattcttttagaggctggcgctgaccccaatgccacaactctcgaagaaactacccccctttttctggccgtggagaacggccagattgatgtccttcgccttctattgcagcatggggcaaatgtgaacggctcccacagcatgtgcggctggaactccctgcaccaggctagttttcaggagaacgctgaaatcatcaagcttctgcttcgaaaaggcgcaaataaggagtgtcaagacgacttcggcattaccccgctcttcgtggctgcccagtacgggaaactcgaaagcttgtcgatccttattagcagtggagccaacgtcaactgtcaggccttggataaggcaactcccctgttcatcgctgcacaggaaggccacaccaaatgcgtcgagctacttctctctagcggagccgatccagatttgtattgcaatgaagattcctggcagctgccaatccatgcagctgcacagatgggtcacacaaagatcctcgatttgctgataccgcttaccaaccgggcatgtgatactggactcaacaaagtgtcccctgtatattccgcagtgttcggcggacacgaggattgcctcgaaatcttactgaggaacggctacagccccgacgcccaagcatgcctggtgttcggcttctcatctccagtttgcatggcattccaaaaggattgtgagttttttggaattgtgaacatattgttgaaatacggtgcccagatcaatgagttgcatctggcttactgccttaagtacgaaaagttctctatcttcaggtattttctgcgaaaggggtgctccttggggccatggaatcacatttacgagtttgtgaatcacgccatcaaggcccaggctaagtataaggaatggttacctcatttgctcgtagccggattcgatcccttaatcctcctatgtaacagctggatagattctgtgtcgattgataccctcatttttactcttgagttcactaattggaaaacactggcccctgcagtagaacggatgctgtctgccagggcatcaaacgcatggatcttgcaacaacatatcgcaacagtcccaagcctgactcacctctgccgtctggagatacgctccagccttaagtctgaaaggcttaggagcgactcgtatatctctcagcttcctttgccacgttccctccataattatctgctctacgaggacgtgctccgaatgtatgaggtgcctgagctggctgctatccaagacgggtag

SEQ ID NO: 214455 - DNA, 1338 bp, Artificial Sequence
  Description of Artificial Sequence: Synthetic coding sequence
atgaaaactttcgaaggattttgtgctttgcacttggctgcttctcaaggccactggaagatcgttcagattctcttggaggctggggcagatccgaacgccaccactctggaggagacaacccctctgtttctggccgtggagaacggacagatcgatgtgctcagattgctgctccagcacggcgcaaatgtcaatggcagccactccatgtgcgggtggaattcgctccatcaggcctcatttcaagaaaacgcagaaatcatcaaattgcttttgagaaagggcgcaaacaaggagtgtcaggacgacttcggaataacgccgctgttcgtggcagctcagtacggtaaattggaaagtctttccatacttattagcagtggagcaaatgttaattgccaggccttggataaagccacgcctctcttcattgcagcacaggaggggcataccaagtgcgttgagctcttgctatccagtggtgccgaccctgacctgtactgtaacgaggattcctggcagctgccgattcatgcagctgctcagatgggtcatacgaagattctagacctcctcatcccactgaccaaccgcgcatgcgacacagggctaaataaggtgagtccagtatatagtgctgtattcggcggacacgaggattgtctggaaatcctgctgagaaacggatactccccagatgcccaggcatgtctcgtgttcggcttctcgtcaccagtttgtatggcatttcagaaagattgtgaattctttggtattgtgaatatactcctaaagtatggggctcagatcaatgagctccatctggcctattgtttgaagtacgagaaattttccatcttccggtactttctcagaaaaggatgctcgctcggtccctggaaccatatatacgaattcgtaaaccatgcgattaaagcccaggccaagtataaggagtggcttccccacctcctggtggctggattcgacccattaatcctgctgtgtaacagctggattgatagcgtatcgatagacaccttgatttttaccctggagtttacaaactggaagaccctcgctcccgctgtggagagaatgttaagcgctcgcgcttcaaatgcttggatcttacagcagcacattgctactgtcccatctcttacccacctttgccgcctggagatacggtcatcgctcaaatcagagcgtctccgatctgactcatacatctctcaactccccctccccaggtctctccacaattatctgctgtatgaagatgtgttgagaatgtatgaggtgccggaactggccgcaatccaagatgggtag

SEQ ID NO: 214456 - DNA, 1314 bp, Artificial Sequence
  Description of Artificial Sequence: Synthetic coding sequence
atggattttacagaggcttatgcagatacttgctctaccgtgggtctcgccgcacgggagggtaatgtgaaggttctgcgaaaactgctaaagaaggggaggtccgtggacgtggccgacaaccgcggttggatgcccatccatgaagctgcctatcataattcagtagaatgcttgcagatgctcattaatgccgatagctcagagaattacataaagatgaaaaccttcgagggcttttgtgccctgcacctggctgcctcacaaggccactggaagatcgtgcagattctgctggaggccggagccgaccccaacgccacgacgctggaagaaactactcctctgttcctgggagctaatgtgaattgccaggctttggacaaggccacaccactcttcatcgccgcacaggagggtcacacaaagtgtgtggagcttttattgagttcaggtgcggacccagacctttattgtaacgaggactcatggcagttgccgatccacgcggcagcccagatgggccacacgaagatcttggatctactcattccccttacaaatcgcgcatgcgacactggtctgaataaggtaagcccagtctactctgccgtgtttggtgggcacgaggactgtttagaaatccttctgagaaacggttattctcccgatgcgcaggcatgcctggttttcggctttagttcaccagtgtgtatggcattccaaaaggagtggtcctgtgagtttttcgggatcgtaaatattcttcttaagtacggggctcagattaatgagctgcatctggcatactgtctgaagtatgaaaagttctctattttccgatatttcttgcggaaaggctgcagcttgggtccctggaatcatatatatgagttcgtcaaccacgctatcaaggcccaggccaagtacaaagaatggctgccccacctactggtggcaggattcgatccactcattctgctgtgcaacagttggattgactctgtaagcattgacactttgatcttcacgctggagtttactaattggaaaacattggctcctgcagtcgaaagaatgctttctgcccgtgccagtaacgcatggattctgcagcagcacattgctaccgtgccttccctgacccatctctgtaggcttgagatccggagcagcctcaagagtgagagactacgatcagattcatacatcagccaactgccacttccccgatctctgcataactatctgctatacgaagacgtgctgcgcatgtacgaagtgcctgagttggcagcgattcaggatggatag

SEQ ID NO: 214457 - DNA, 1281 bp, Artificial Sequence
  Description of Artificial Sequence: Synthetic coding sequence
atggacggtactaccgcacccgtaacaaagagcggggcagcaaaactagtgaagcgaaatttcctggaggccctgaaaagcaatgacttcgggaagctgaaggccatcctcatacagcggcaaattgatgtggacaccgtgtttgaagtggaagatgaaaatatggttctggcatcgtacaagcagggatactggctgccaagctacaagttaaagtcgagttgggcaaccgggctgcatttgagcgtcctgtttgggcacgtggaatgtctgcttgtgctattggaccacaatgctaccatcaactgcagacccaacgggaagactcccctacacgtagcttgcgaaatggccaatgtggactgcgtcaagatactgtgtgaccgcggtgctaaacttaactgttactccctgtcaggtcacaccgctctgcacttttgcaccaccccttcaagcatactatgcgccaaacaattggtctggaggggcgctaatgtcaatatgaaaaccaataaccaagatgaggaaacaccgcttcacacagccgcacatttcggcctatctgagctcgtggccttctatgtggagcatggcgctatcgtggactccgttaacgcgcacatggaaacaccactggctatagcagcttattgggctcttagattcaaggagcaagaatacagcactgaacaccatcttgtgtgccgcatgctgcttgattacaaagcagaagtgaacgcacgcgacgacgatttcaagtcaccactacacaaagctgcttggaattgtgaccacgtgttgatgcacatgatgctagaagctggcgctgaggcaaacctcatggacattaatggctgcgcggcaattcagtatgtgctaaaagtgacttccgtgaggccagccgctcaacctgaaatctgttaccaactgctgttgaaccatggcgctgcacgtatttacccgcctcagtttcataaggtgatacaagcctgccacagctgccccaaggccattgaggtagttgtgaacgcttacgagcacatcaggtggaatacaaaatggaggagggccattccagatgacgatttagagaagtactgggacttttatcactcactttttaccgtgtgctgcaactctcctcgtactctgatgcacctgtcccggtgtgccatcagaaggactttgcataaccggtgtcatagggctatcccactcctgtcattaccgcttagcctgaagaaatacttgctgctggagcctgagggcatcatttactag

SEQ ID NO: 214458 - DNA, 1050 bp, Artificial Sequence
  Description of Artificial Sequence: Synthetic coding sequence
atggatggaacaaccgcgccagtaacaaaatctggcgcagcaaagctcgtgaaacgcaattttctggaggcactgaaatctaacgactttgggaagctgaaggccattctgattcagcgacagatcgatgtggacacagtgtttgaggttgaagatgaaaatatggttttagcgagttataagcagggctattggctcccaagttacaaactcaagtcctcctgggcgactgggctccacttgtcggtactgttcggacacgtagagtgtctattggtactgctcgatcacaacgccaccattaattgtaggccgaacggtaagacaccgctgcacgtggcctgcgagatggccaatgtagactgtgtaaagatcctgtgtgataggggagcaaaactgaactgctattccctgagcggacatactgctcttcacttctgcaccacaccaagctccatcctgtgcgccaaacagctcgtctggaggggcgctaacgtcaatatgaagactaataaccaagacgaagagaccccgctgcacaccgccgcacacttcggcttgtccgagctggtggccttctacgtcgagcatggcgctattgtggactccgtgaatgcacacatggagacccctctggccatcgcagcttactgggctttgcgattcaaagaacaggagtatagtacggagcatcacctggtatgtaggatgttgctggattataaggctgaagtcaacgctagggacgatgattttaagtcccctcttcacaaggccgcttggaattgcgatcacgtgctgatgcatatgatgcttgaagcgggagccgaggccaatctgatggacatcaacggctgcgctgctatccagtacgtgttgaaggtaactagcgtgcgccctgcagcccagccagaaatctgctatcaacttctcctcaaccacggggctgcacgtatataccctccacagtttcacaaagttcgcctctgtcccgtcgtaagtcggctgaggaagatccaaatggccgctttgtctgagatttcaaaatag

SEQ ID NO: 214459 - DNA, 3747 bp, Artificial Sequence
  Description of Artificial Sequence: Synthetic coding sequence
atgggtaaagatcaagaactgctcgaggccgcaagaaccggtaatgttgcattggtggaaaagttgctgagtggtagaaaaggagggatccttgggggtgggagcggtcccctaccgctgagcaacctgctttcaatctggcggggaccaaacgtcaactgcaccgactcaagcggatacactgccttacaccacgctgccctgaatgggcataaagatattgtgctcaagttactgcaatacgaagctagcaccaacgtggccgacaacaagggatatttccccatacacctcgcagcgtggaagggcgacgtggagattgttaagatactaatccatcacggacctagtcacagccgggtgaacgagcagaataacgagaatgaaaccgccttacattgcgccgctcaatacggtcactcagaagtagtggctgtattgctagaggaactgaccgaccccacaataagaaacagtaagctggagactccgttagatctcgcagccctgtatggcagactccgtgtcgtgaagatgattatttcagctcatccaaacttaatgagctgtaatactaggaagcacacacctctccacttagcagctagaaacggccacaaggccgttgtccaggtcttactggaagcaggaatggatgtgagctgccaaacagagaagggcagcgcactccacgaggctgccctctttggaaaggtcgacgtcgttcgcgtgctgctcgagaccggaatcgatgccaacatcaaagacagcttgggccgtactgtcttggacatcctcaaggaacatccgagccagaaatcattacagattgcaaccctgctccaggaataccttgaaggagtcggcagaagcacagtgttagaagagcctgtacaagaggatgctacccaggaaactcacatctcaagcccagtggagagtccctcgcagaagacaaagagcgaaacagtgacgggcgagttatctaagctcctcgacgagattaagttgtgccaggaaaaggattactcgttcgaagacttgtgtcacacaatctccgaccactacttggacaatctgtcaaaaatcagcgaggaagaactgggaaaaaacggctcacagagcgtgagaacatcaagtactattaatctcagtcctggggaagtggaagaagaagatgatgatgagaacacgtgcgggccttcgggtctgtgggaggctctgacaccctgcaatggatgtcgcaacttggggttccctatgctggctcaggagtcttatcccaagaaacgaaactacaccatggaaatagtcccaagcgcttcgctggacacattcccaagtgagaacgagaatttcctgtgcgatctgatggatacggcagttaccaaaaagccatgctccctcgaaatcgcaagggctccttctcctagaaccgacaatgccagtgaggttgcagtgaccactcctgggaccagcaaccacaggaatagcagtactggcccaacgcccgattgctcaccaccatctccagatacagctctcaagaatatcgtgaaagtgatacgacctcagcctaaacagcgtacttccatcgtgtcgtcactagattttcatagaatgaaccacaaccaggagtactttgagatcaatacctcgacgggttgtacttctttcacagcctcgcctcctgcaagcccaccaacatcgtccgtgggaacaactgaggtgaagaatgaaggcaccaatcatactgatgatctctcccggcaggatgacaacgacccacccaaggaatacgaccctggccagtttgcgggattgcttcacgggtcctccccggcatgtgagtctcctgagaacccttttcatctctacgggaagcgcgagcagtgcgaaaagggacaagatgaggttagcctggccaattcccccctgccctttaagcaaagtcccatagagaacaatagcgagccgctggtaaagaaaattaagcctaaagtggttagccggaccatttttcataaaaagtctaaccaactggaaaaccacaccatcgtgggaactaggagtactaggagtggcagcaggaacggcgatcagtgggtgatgaatgccggaggctttgtagagcgcgcatgcactctggggagaattcggtcactgcccaaagctctcatcgatatgcatttatctaaatcagtgagcaagtccgactcagatctgattgcctatcccagcaatgagaagacatctagagtgaattggagcgaaagttctaccgccgaacattccagcaaggggaactccgagcgaaccccgagcttcacttctgagtgggaggagatcgataaaattatgtcaagcatagatgtcgggattaacaatgagctgaaagagatgaacggggaaacaacccgccctaggtgccctgtgcagacagtgggtcaatggttggaaagcataggactgcctcagtacgaaaaccacctcatggcaaacggattcgataacgtgcagtttatgggctccaacgtcatggaggatcaggatttgcttgagatcggaatcctcaattccggacacaggcagcgcatactacaggcgatacagctgctccccaagatgcgcccaataggccacgatggttaccaccccactagcgtggctgagtggctggactccatcgaactgggggattataccaaggccttcctgattaacggatatacctccatggatctcttgaagaagatatgggaagtagaattaataaacgtactaaaaattaatttaatcgggcatcgcaagcgaattctggcttctctgggtgatcgcctgcacgatgatcctccgcagaaaccgcctcgctccatcacactccgagaaccctctggcaatcacacccctccccaactgagcccgagcttgagccagtccacttacactaccggcggatccctggatgtcccgcacatcatcatgcaaggagatgccagacgtcgacgaaatgagaactatttcgatgatattcccagaagtaagttggagcgtcagatggctcaaacgggggactggggtgagcctagcatcacccttagaccgccaaacgaagccaccgcctctacacctgtgcagtactggcagcaccatccagaaaagttgatctttcagagttgtgattacaaggccttctacttgggaagcatgctcatcaaggagttacggggaaccgaaagcactcaggatgcttgcgcaaaaatgcgggtgatgtgtgtgaagtcgacggagcagatgaaaaaggttccgacaattatcctgtcagtgtcatacaagggggtaaaattcatagatgcaacaaacaagaacatcattgctgaacatgagattcgaaacatttcctgtgccgctcaggatcctgaggacctgagtacatttgcctatatcaccaaggatttgaaaagcaaccaccattattgtcatgtgttcactgcgtttgacgtgaacctggcttacgaaatcatcctcactttggggcaggctttcgaggtggcatatcaactggcccttcaggctagaaagggaggacatagcagcactctgccagaaagctttgagaataaaccttccaagcctattcctaaaccgcgagtctcaatccgaaagtctgtcgacttgctgcacgcgtcccacaccggacaggagccttctgagagacacactgaagaggccttaagaaagttctag

SEQ ID NO: 214460 - DNA, 1353 bp, Artificial Sequence
  Description of Artificial Sequence: Synthetic coding sequence
atgatgtggcagtgtcatctgagtgcacaggattatcgctactaccctgtggatggctactcccttttaaagcgtttcccgctgcacccactgaccggcccacgatgtcccgttcagactgtgggacaatggcttgaatctatcggactgccccagtacgaaaaccacctcatggccaacggattcgacaacgtgcagtttatggggtctaacgtcatggaggaccaggatctgctggaaatcggaatcctgaattctggacacaggcagagaattcttcaggccatccagttactaccaaaaatgcggccaattgggcatgacggctaccaccctacctctgtcgccgagtggctagactccatagagctgggagactacacaaaagcattcctgatcaacggatacacatcaatggacctgttaaagaagatttgggaagtggagctgattaacgtgctgaaaataaacctgattggccaccgaaaaaggatcctggccagcttgggagatcgcctgcatgacgacccccctcagaagccccctcggtctatcacacttcgttcaagcgtgtgcgagatctggacaaatcagaacgctggcttcccgttctccgccattcaccaggtccataacacaggtgattggggagaaccctctatcacactgcgccctcccaacgaggctacagcctccactcctgtccagtattggcagcaccatcccgaaaagctcatttttcagtcatgcgactacaaggctttttacctgggcagtatgcttatcaaggaattacggggtactgaaagcacacaagacgcctgtgctaagatgagagcaaatatacagaagtctacagagcaaatgaaaaaggtcccaactataatactgtccgtctcatataaaggggtaaaattcattgacgccactaataagaacatcatagccgagcacgagatccgcaatatcagctgtgccgctcaagaccctgaggacctttccaccttcgcgtacataacgaaagatctgaaatcgaaccaccactattgccatgtgttcaccgcattcgacgtaaatctggcgtacgagatcattctaaccctggggcaggcctttgaagtggcctaccagcttgccctacaggcaagaaagggcggtcactccagtacattgcccgaaagctttgagaataaaccaagtaaacctatccctaaacctagggtgtctattcggaaaagtgtccaaattgacccaagtgaacagaagacattggctaatttgccctggattgttgaacccggacaggaggcgaaacgtgggatcaacacaaaatatgagacaactatcttctag

SEQ ID NO: 214461 - DNA, 765 bp, Artificial Sequence
  Description of Artificial Sequence: Synthetic coding sequence
atgcagggggacgcgaggcggcgtcggaatgagaactatttcgacgacattcccaggtccaagttggagcgtcagatggctcagaccggagactggggcgaacccagcatcacacttaggccgccaaatgaggcgactgcatcgactccggtccaatactggcagcatcatccagaaaagctgatattccaaagttgcgactacaaagccttttacctagggtctatgttgattaaggaactgcggggaactgagtccactcaggacgcctgcgcaaaaatgagggcgaactgccagaaatccactgagcagatgaaaaaagtgccaacgatcattttgagcgtaagctataaaggggttaagtttatcgacgccacaaacaagaatatcattgctgaacatgaaattcgaaacatctcttgcgcagcccaggatcccgaggatctaagtacatttgcctacatcaccaaagacctcaagtcaaaccaccattattgccatgtgtttacagcatttgatgtgaatttggcatacgaaatcatcctgacactcgggcaggcgttcgaggttgcataccaactggccctccaggcacgcaagggtgggcactcttccaccctgcctgaatccttcgaaaataagccttcgaagcctatccctaagcctcgggtcagcatacggaaatcagtagacctgttgcacgcaagtcacactggtcaggagcccagtgaacgacatacagaagaagccctcagaaaattttag

SEQ ID NO: 214462 - DNA, 1053 bp, Artificial Sequence
  Description of Artificial Sequence: Synthetic coding sequence
gtcctgtttcagggaagcaacgtgatggaagatcaagacctgctggagataggaatcttgaactcagggcacagacagagaatcctgcaggcaatccagctcctgccaaagatgcggcctataggtcatgacggttatcatcccacaagcgtagccgagtggctggatagtatcgagctcggcgattatactaaagcctttctcatcaacggctataccagtatggacctgctcaaaaagatctgggaggttgagctgatcaaccagagctctgtatgcgaaatttggaccaatcagaacgccggttttcctttttctgcaattcatcaggtgcacaataccggggactggggtgagccaagcattactctacgtccacctaacgaggccaccgcctctacaccggtgcagtactggcaacaccatccagagaaactcatttttcagtcttgtgattacaaagccttttatctcggctccatgttgattaaggaacttcgaggaacagagtccactcaggatgcgtgtgccaagatgagggccaacatccagaagtccactgagcagatgaagaaagtaccaaccatcatcctgagtgtgtcttacaagggcgtgaagtttatcgatgccacgaacaaaaatatcattgccgagcacgaaattcggaatattagctgcgcagcacaggatcctgaagatctgagcacctttgcctacataaccaaggacctcaaaagcaaccaccattactgtcatgtgttcaccgcattcgatgtcaaccttgcttatgagattattctgacgctggggcaagctttcgaagtggcatatcagctggccctgcaggcaaggaagggcggtcatagctccacactcccagaaagttttgagaacaagccatccaaacctatccccaagccgagggtgtcgatccgtaagagcgtaatcgacccttctgagcagaagaccctcgccaatcttccatggatcgtggaacccggacaggaggctaagcgcggaatcaatactaaatatgagacaacgattttctag

SEQ ID NO: 214463 - DNA, 2292 bp, Artificial Sequence
  Description of Artificial Sequence: Synthetic coding sequence
tcctttcaagaatcatacccaaagaaaagaaactacacgatggaaatcgtgccctcagccagcctggacacttttccctctgagaacgagaattttctgtgtgatctaatggatactgcagtgaccaagaagccgtgctcactcgagatcgcgcgtgccccaagcccaaggacagacaatgcctctgaggtcgctgttacaacgcctgggacctccaatcacaggaatagctctaccgggcctacccccgactgcagtccaccatctccagacacggccctcaaaaacatcgtgaaggttattagaccacagccaaaacagaggacctccattgtaagcagcttggattttcaccgcatgaaccacaatcaggagtacttcgagataaacactagcacaggctgcaccagtttcacagcctctccacccgcaagccctcctacaagttctgtggggaccaccgaagtgaaaaatgagggaacaaatcacactgacgacctgtctaggcaggatgataacgaccctccaaaggaatacgaccccggtcagttcgccggtctgcttcacggaagctccccagcctgtgaatctcccgagaaccctttccacctctatgggaaaagagagcagtgtgaaaagggacaagatgaggttagcctggccaattccccgctgccctttaagcagagtcccattgaaaataacagtgagccacttgtgaagaaaattaaacctaaggtggttagccgaactatctttcacaagaaaagcaaccagctagaaaaccatacgattgtgggaaccagatccacccgcagtggaagtaggaacggcgaccagtgggtgatgaatgccggtggctttgtggagcgggcttgcacgttaggtcgtatccggtctctccctaaggcccttatcgatatgcacctgagcaaatcagtgagtaagagcgattcggacctgattgcctatccatccaacgagaaaacgtctagggttaattggtccgagtcctctaccgccgagcattcatcaaagggaaactcggaaagaactccgagtttcacaagtgaatgggaagagattgacaagataatgtcctctatcgatgttggcatcaataatgaactaaaagaaatgaacgggccacggtgtcccgttcagacagtgggacagtggcttgagtccattggcctcccccagtacgaaaaccacctgatggccaatggctttgacaatgtgcagtttatgggctctaatgtgatggaggatcaggatcttctggagataggaatcttaaattctggacaccggcagagaatccttcaggccatacagctgctcccgaagatgagacccattggccacgacgggtatcatccaacgagcgtggccgaatggctcgacagcatcgagctgggagactacaccaaagcgtttttaataaatggttatactagtatggatttgttgaagaaaatttgggaagttgaactgattaacgtgttaaagatcaatttgattggccaccgcaagcgaatcttagcgagtttgggcgaccgcctgcacgacgacccaccgcaaaaaccgcctcggtcaataaccctccgcaccggagattggggagaaccaagcatcaccttacgcccacctaatgaggctaccgcgtccacaccagtgcagtattggcaacaccaccctgaaaagctgattttccagtcttgcgactataaagctttctacctgggctcgatgttaattaaggagctgcgaggaacagagtcaactcaggatgcatgcgctaaaatgcgcgtgatgtgtgtcaagtctactgagcagatgaagaaggtgcctaccataatcctgtcggtcagctataaaggcgtcaagttcatagacgcaaccaacaagaatatcatcgcggaacacgaaattagaaatatctcgtgtgccgctcaggatcccgaggacctgtccacctttgcgtacattactaaagacctgaagtctaaccatcattattgccacgtgttcacagctttcgatgtgaatcttgcatatgagatcatactgactctcggacaggccttcgaggtcgcttaccagctcgccctgcaggccagaaagggtggacacagctcaacactcccggagtcattcgaaaacaagccgtcaaagccaatccccaagccgcgtgtgagcatcaggaaatcagtggacttattgcatgcctcacacaccggacaggagccatctgagaggcacactgaagaggcccttcgcaaattttag

SEQ ID NO: 214464 - DNA, 1281 bp, Artificial Sequence
  Description of Artificial Sequence: Synthetic coding sequence
atgatgtggcagtgccacctgtctgcacaggattataggtattatcccgtggatggatatagcctcctaaaacgttttcctctgcacccgctgacagggccacgttgtccagtacagaccgtagggcaatggttagagtcgattgggttaccccagtatgagaaccatctgatggccaatgggttcgacaatgtgcagttcatgggctcgaacgtgatggaggaccaggatcttcttgagataggcattttgaattccggccataggcaacgcatactgcaggccatccagttactacccaaaatgaggcctatagggcatgatggataccatcctacctccgttgcggagtggttagacagcattgaactgggagactacacaaaggcctttctgatcaacggttacacctccatggatcttctgaaaaagatctgggaagtggagctgatcaacgtcctgaagatcaacctaatcggtcatcgtaaaaggatcctcgcgagtttgggcgatcgccttcacgacgatccaccacagaagcctccaaggtcgataacccttagaacaggcgattggggcgaaccatctataaccctgcgtcccccaaacgaggcaaccgcatccacacccgtccagtattggcaacaccaccctgagaagcttattttccagtcttgcgactataaggccttttacctggggtctatgctgattaaggaactgaggggcacggagagtacccaggacgcttgcgctaagatgagagccaactgtcagaaatcaacagagcagatgaaaaaggtgcctactataattctgagtgtgtcttataaaggcgtaaaattcatcgatgccacaaacaaaaacattatagccgagcatgagataagaaacatctcttgtgccgcacaggaccccgaggacctcagcacctttgcttacatcaccaaggacctgaaatcgaaccatcactattgccacgtattcaccgcattcgatgtgaatttggcatacgagatcattctcacacttggacaggcatttgaggtcgcctatcaacttgctctgcaggctcgtaagggagggcattcttccacactgcccgagagtttcgagaacaaacctagcaagcctattccgaagcctagagtgagcattcgaaaatctgtgcagattgaccccagcgaacagaaaacactcgccaatctaccttggatcgtcgaaccaggtcaagaggctaaacgtggcatcaacacgaaatacgaaaccacaatcttctag

SEQ ID NO: 214465 - DNA, 1383 bp, Artificial Sequence
  Description of Artificial Sequence: Synthetic coding sequence
atgatgtggcagtgccacctttcagcccaggactacagatattatccggtggatggctattctctgcttaagaggtttcctctgcatcctctaaccggaccgagatgcccagtgcagaccgtcggccaatggttagagtccatcggcctgccccagtatgagaatcaccttatggccaacggcttcgataatgtacagtttatgggatccaatgttatggaagaccaagatttgctggaaatcggcattctgaacagcggacaccgccaaaggatcttgcaggctattcagctgcttcctaaaatgcgcccaatcgggcatgacgggtatcatcctacctcggtggctgagtggctggacagtatcgagctgggggattacaccaaggccttccttatcaacggctacacttcgatggatcttttgaaaaaaatatgggaagtagagctcattaacgttttaaagattaatctcatagggcacagaaaacgcatcctcgccagcctgggagatagattgcatgacgacccaccgcaaaagccccctcgttccatcaccttgagagaaccgagtggcaaccacaccccaccacagctgtctccatctctctcacaaagcacatatactactgggggaagcctggacgttccacatattatcatgcaaggcgatgccagacggaggaggaatgagaattactttgacgacatccccagaagtaagctggaacggcaaatggcacaaaccggggactggggtgaacccagtatcaccctccgccctccgaacgaggccactgccagtacgcctgttcagtattggcaacaccatcctgagaaactgatctttcagtcttgcgactataaagccttttacttgggctctatgctgatcaaagaattacgaggcactgagagtacccaggacgcttgtgctaaaatgcgagccaactgccaaaagagcaccgaacagatgaagaaagtgcctaccatcatcctgtccgtctcctataagggcgtaaaattcattgatgcaacaaataaaaacatcattgcagaacacgaaatcaggaatatctcttgtgccgctcaagatcccgaggatctgagcacctttgcatacattaccaaggacctgaagagcaatcatcattattgccacgtgttcactgcattcgatgtcaacttagcctacgaaattatccttacattgggacaggcctttgaggtggcataccaactcgcacttcaggccaggaaggggggacactctagcacactccctgaatccttcgaaaataagcccagtaaaccgataccaaaaccacgggtctcaatccgcaaaagtgtccccttttgtttcaaagcagataggcccatttag

SEQ ID NO: 214466 - DNA, 2295 bp, Artificial Sequence
  Description of Artificial Sequence: Synthetic coding sequence
atgctggcccaggaatcgtacccaaaaaagcgcaattatacgatggaaattgtgccgagcgcctctctggatacattccccagcgaaaacgagaacttcctttgcgacctaatggacaccgctgtcaccaaaaaaccttgctcccttgagatcgccagggctccaagcccgagaactgacaacgcctcagaggttgctgtaacaacacccggaacctccaaccaccggaacagttccaccggcccaacccctgactgttcgcctccttctcctgacacagccctcaaaaacatagttaaagtgataaggccgcagcctaaacagcgtacatcaatagtaagttcactcgattttcatagaatgaaccataaccaagagtacttcgagattaatacttccacggggtgtactagttttaccgcatctccacctgcatctccaccaacctccagcgtcgggactacagaagtaaagaacgaaggcaccaatcacacggatgacttgtcaaggcaagacgacaatgaccctccaaaagagtacgatcccggacagtttgcaggtttactgcatggaagctcccccgcttgcgagtcacctgagaatccatttcatctgtacggtaaacgggaacagtgcgagaaggggcaggatgaggtatccctggctaactcgcctttgccctttaaacaaagcccaattgaaaataactctgaacctctggtcaaaaaaataaagcccaaggtggtttccagaacaatcttccacaagaaatctaatcaactcgaaaatcacaccatcgtaggcaccaggagcaccagatcaggatctcgaaatggggaccagtgggttatgaatgccggaggtttcgtggaaagagcctgcactctcggacgaattagaagcttaccaaaagcgctgattgacatgcacctgtccaaatccgtgtcaaagagcgattctgatctgatagcctatccatcaaacgagaaaacgtcccgtgttaattggtccgagtccagtactgcagagcactctagtaaaggaaactcagagcgcacaccatcattcactagtgaatgggaggagatagacaagattatgtcttcaatcgacgttggcatcaataacgaactgaaggagatgaatggcccacgatgcccagttcagaccgttggtcagtggctggagagcatcggactgccacaatatgagaatcacctgatggccaatggtttcgacaacgtccaattcatgggctcaaatgtaatggaggaccaggacttgctggaaattgggatcctcaatagtggccacagacaacgtatactccaggccatccaactcctgccaaagatgagacctatcggtcacgatggctaccatcccacctctgtggcagaatggctggatagtatcgagctgggagactatactaaggcatttcttattaacggctacacctcaatggacctcttgaaaaagatatgggaggtggaattgataaacgtcctgaagatcaatctgatcgggcacagaaagaggatcttagcctctttgggggaccgccttcatgatgacccccctcaaaagcctccacgaagtatcactctccggaccggcgactggggtgaaccctctattactctgcggccaccaaacgaagcaaccgcttccacccctgtccaatactggcagcaccaccccgagaaactgatctttcaatcttgcgactacaaagccttttatctaggctcaatgctgattaaagagctcagggggaccgaatcaactcaagacgcctgtgccaagatgcgcgctaactgccaaaaaagtactgaacaaatgaaaaaagttccaaccataatcctgtctgtgtcttacaagggagttaagttcatcgacgccacaaacaaaaatatcatcgccgagcatgaaattaggaatatatcatgtgctgcccaggacccagaggacttgtctacctttgcgtacattacgaaagacctcaagagcaatcatcactactgtcatgtgttcacagccttcgacgtgaacctagcgtatgagatcattctgacgctcggacaggcttttgaagttgcataccagctcgccctccaggccagaaagggtggccacagttccacactgcccgagagtttcgaaaataaaccctccaagcctattcccaaaccacgtgtgtcaattcgcaagtctgtcgatctgctccacgcctctcatactggccaggagccctccgaaaggcataccgaggaggctttgcgtaaattttag

SEQ ID NO: 214467 - DNA, 3747 bp, Artificial Sequence
  Description of Artificial Sequence: Synthetic coding sequence
atgggcaaagaccaggaactgctcgaggccgcaaggaccggaaatgtcgctcttgttgagaagcttctatcagggcgaaaaggcggtattctcgggggaggctccggcccacttccacttagtaaccttctatcaatttggcgaggaccaaacgtgaactgcacagatagttccggatatacagccctccatcatgcagctcttaacgggcacaaagacattgtcctgaaactgttacagtacgaagcctctactaatgttgccgataacaaagggtattttcctatccatctggctgcttggaaaggcgacgtcgagatagtgaaaatcctcatccaccatgggccttcgcattccagagttaatgaacagaataatgaaaacgagacagcactccactgtgctgcccagtacgggcatagtgaggtggtggcggtgttgctagaggaacttacagacccaacaattcggaatagcaaactcgagactcccctcgatctggccgcactctatgggagactaagagtagttaagatgattatctccgcgcatcccaacctgatgtcttgcaacacaagaaagcatacaccattgcatctcgccgcacggaatggacataaagcagtggtgcaggtcctgctggaagctgggatggatgtcagttgtcagacagagaagggtagcgccctgcacgaggcagccctcttcgggaaggtagacgttgtgcgcgtattgcttgagacagggattgacgccaacattaaggatagtctcggtaggaccgtcctcgatattctcaaggagcacccttcacagaagtcacttcaaatagcgacattgctgcaggagtacctggaaggtgtgggccgatccacagtgctggaggagcccgttcaggaagacgcaacccaggaaactcacatctcgtcccctgtcgagtccccctcccagaagaccaaaagcgagaccgtaactggcgagctttccaaactattagacgagattaaactgtgccaggagaaagactatagctttgaagatctttgccacactatctctgaccactacctcgacaacttgtccaagatcagtgaggaggagctgggcaagaacgggtcacagagcgtgaggacgagttccactatcaacctgagtccaggcgaagtggaagaggaagatgatgatgagaacacatgcggacccagcggattgtgggaggcattgacaccttgcaacggctgtcgcaatctcgggttccctatgctagctcaggagtcataccccaaaaagaggaattataccatggagatagtacccagtgcatcactggacacgttcccctctgaaaatgaaaatttcttatgtgatctgatggataccgcggtcaccaagaagccttgcagtctagaaattgcacgggcaccttcacccagaaccgacaatgcttctgaagtggctgtcacaactcctggcacttctaaccaccggaatagtagtactgggccaacccccgattgttccccgccatctcctgatactgctttgaagaacattgtgaaagttattcggccacagcccaaacaacgcacttccatcgtatcctcacttgacttccaccgcatgaatcataatcaggaatatttcgaaataaataccagtaccggctgcactagcttcacagctagccctcctgcatctcccccaaccagtagtgtcggaaccactgaggttaaaaacgagggtactaaccataccgacgatctctctcgtcaggatgacaatgatcctcctaaagagtacgacccaggccagtttgctggtctgctacacggcagctctcccgcttgtgaatctcctgaaaaccccttccacctgtatggtaaaagagagcagtgcgagaaaggtcaagacgaagtttctttggctaattcaccactgccctttaaacagtcccccatagaaaacaactctgagcctttggtgaaaaaaattaagccaaaggtcgtgtcaagaaccatatttcacaagaaaagcaatcaacttgagaatcacacgatcgtaggaaccagatccacaaggtcaggttcacgcaatggcgaccagtgggtcatgaacgctggcggttttgtggagcgagcctgcactttagggagaatcaggtctttacccaaagccctgatagacatgcacttgagcaagagcgtctcaaagagcgatagtgacctgatcgcctatccatctaacgaaaagacaagccgggttaactggtcagagtcgtcaacagctgaacactcttccaaagggaacagtgagcgtacaccctcttttacgagcgaatgggaggagatcgacaagatcatgagcagcattgacgtcggcataaataatgaattgaaagaaatgaacggagagaccaccagacccagatgcccggttcagacagtagggcagtggctggaaagcatcggactgcctcagtacgagaatcacttgatggccaacggttttgataacgtgcagtttatgggtagcaatgtcatggaggatcaggatctgctcgaaatcgggatattgaacagcgggcatagacagagaatccttcaggctatccagcttctgcccaagatgagacctataggccacgacggataccatccaacgtcagtggcggagtggctggacagtattgagttaggagattacactaaggctttcctcattaatggctacacaagtatggacctgcttaagaagatctgggaagtcgagcttatcaatgtgctgaagatcaatctaatcggccacaggaagagaatactggcatcattgggcgaccggctgcacgacgatccaccccagaagccacccaggtccatcactctaagagagccttccggtaatcacacgccccctcagctttcaccttctctgtcgcagtcaacatatactaccggcggaagcctggacgtgccccacattataatgcaaggagatgctcgacgcagacgaaacgagaattattttgacgacatcccaagatcaaagcttgagcggcagatggcccagacaggcgactggggcgagccctccattacattacggccaccaaatgaggctacagcatcgacgccagtgcaatactggcagcaccatccggagaaattgattttccagagctgcgattataaagctttctatctcggaagtatgctgattaaagaactgagagggaccgaatccactcaagatgcgtgtgcgaaaatgagggcgaattgtcaaaaaagtaccgagcagatgaagaaagtgcctacaatcatcctgagtgttagttacaagggggttaagtttatagatgcaactaacaagaacatcatcgcggagcatgagattagaaatatcagctgcgccgcacaggacccggaggatttatccacattcgcatacattacaaaggacttaaagtcaaatcaccattactgccacgtgttcactgcatttgatgtgaatctcgcctacgagattattctgactcttgggcaggcctttgaggtcgcgtatcagctggctttgcaggccagaaaagggggacacagttccaccttgcccgaaagttttgagaataaacctagcaagcctatccctaaacccagagtgtccattagaaaaagcgtcgacctgctacatgcatcacacacaggtcaggaaccctcagaaaggcatacggaggaagccctgaggaaattctag

SEQ ID NO: 214468 - DNA, 1074 bp, Artificial Sequence
  Description of Artificial Sequence: Synthetic coding sequence
atggctaatggatttgataacgtccagtttatgggatccaatgtaatggaggaccaggacctactggaaatagggatcttaaacagtggacacaggcagagaatcctccaggccatacagctcttgccgaaaatgaggcctatcgggcatgatggctatcaccccaccagcgtggctgagtggctggactccatcgagctgggtgattacacgaaagcttttctcattaacgggtatactagtatggatctgttaaagaagatttgggaggttgaacttattaaccagtctagcgtgtgcgaaatctggactaatcagaacgccggatttcccttttcagccatacatcaagtacataacacaggagactggggcgaaccctcaataacactgcgccctcctaacgaggccacggcctccactcctgtacagtactggcagcaccatcctgagaagctgatctttcagagttgtgactataaggcattttacttagggagtatgctcattaaagaactccggggtaccgagagtacgcaagatgcgtgtgcaaaaatgagagctaattgtcagaagagcaccgaacaaatgaagaaagtacctaccatcatcctctctgtgtcgtataagggcgtgaaatttatagatgccactaataagaatatcatagcggaacatgaaatcagaaacatttcatgcgccgcacaggatcccgaagacctctctacctttgcttacattaccaaggacttgaagtccaatcaccattattgccacgtttttacagcattcgacgttaacctcgcctacgaaattatccttaccctgggtcaggctttcgaagtggcctaccagctggccctccaagccaggaagggaggtcacagttcaactttacctgaaagctttgaaaacaaacctagcaaacctattccgaagcctcgagtgtcgattagaaagtcggttatcgaccctagtgagcagaagacattggccaaccttccatggattgtagagcccggtcaggaggctaaacggggaatcaatactaagtatgagaccactattttttag

SEQ ID NO: 214469 - DNA, 1533 bp, Artificial Sequence
  Description of Artificial Sequence: Synthetic coding sequence
atgatgtggcagtgtcacctgagcgcacaagattatcgctactatcctgttgacggatattcattgctaaagcgctttccactgcacccactgaccggaccaaggtgccctgtgcagactgtgggacagtggctagaatcaattgggctaccccaatatgaaaatcatctgatggccaatggcttcgataacgtccagtttatgggatcaaatgtcatggaagatcaggaccttcttgagattggaattctaaactccgggcaccggcagaggattctgcaagctatccaactcctcccgaaaatgagaccaatcggacacgatggctatcacccaacatccgtagcagagtggctcgatagtatagagttaggcgactatacaaaggctttcctgatcaacgggtatacaagcatggatctgttaaaaaagatctgggaggtcgagttgattaacgtgctaaaaattaatttaatcggccaccgaaaaaggatacttgctagtcttggcgatagactgcatgatgatcctccacaaaaacccccaagatccatcactctaagagaaccgtcaggcaatcacacacctccccaactcagcccatcgttgagccagagtacatatactactggtggatccctggacgtcccccatattattatgcagggagacgctcgcaggcggcgtaacgaaaattattttgacgatataccacggagcaagctagagcgccagatggcccagtcgtccgtgtgtgagatatggactaatcagaatgcgggtttcccattcagcgccatccatcaggtgcacaacacaggcgattggggcgaacccagcattaccctcagaccaccgaatgaagcgactgcgtcgactcccgtccagtactggcaacatcaccccgaaaaactaatttttcaatcctgtgattataaggccttctatctagggtccatgctcataaaggagctcagaggcacagaaagtacgcaggacgcgtgtgccaagatgcgcgcaaattgtcagaagtccactgagcagatgaagaaggtgcccacaatcattctttcagtgagttataagggtgtgaaattcattgacgcaaccaataagaatatcatcgcagaacatgagatccggaatatatcgtgcgccgcacaggaccctgaagacctgtctaccttcgcttacattactaaagacctcaaaagtaatcatcattactgccatgtgttcaccgcctttgatgtcaatcttgcctatgagattattttgacactcggtcaggcgttcgaagttgcttaccagctggcccttcaggccagaaagggagggcattcatcaaccctgccagaatcttttgaaaataaaccatcgaagcctatccctaaaccacgcgtttccatacgcaaaagcgtgcaaatcgacccgtccgaacagaagacactggccaaccttccctggatcgtggagcctggccaggaagcaaagcggggaatcaacacgaaatacgagactactatcttttag

SEQ ID NO: 214470 - DNA, 1245 bp, Artificial Sequence
  Description of Artificial Sequence: Synthetic coding sequence
atgatgtggcagtgccacctctcggctcaggattaccggtactaccctgtcgatgggtactctctgctgaagaggtttccactgcacccccttactggaccaagatgtcccgttcagaccgtcggccagtggttggagtcgattggcttaccccaatacgagaatcacctgatggctaatggcttcgataatgtccagtttatgggatcaaacgtcatggaggaccaggacctgctcgaaattggcattctcaattctggtcaccggcaacgcattctgcaggccatccagttattacctaagatgcggcctattggccacgacggctaccacccaacaagcgtggcagagtggctggactcgatcgagctgggagactatacaaaggcctttctgattaatggctacacttcgatggacctactaaaaaagatctgggaagtagagttgattaatgtgctgaaaatcaacctgatcgggcatagaaagcgaattctggccagcctgggcgatagactacatgacgacccgcctcagaagcccccaagatccattacactgcgcacgggcgactggggagagcctagtataaccctgcgcccaccaaacgaagcaacagcgtcaacccctgtccagtattggcagcaccacccagagaagctcatcttccagtcctgtgactacaaggcgttttacttgggatcaatgctgattaaggagctgcggggtactgaatccacacaggacgcctgcgccaagatgcgcgcaaattgtcagaagtcaactgagcagatgaagaaagtgcctacgatcatcttgagcgtaagttataagggggtcaagttcatcgatgctacaaataagaacatcatcgccgagcacgaaattagaaacatcagttgcgcagctcaggatccagaggatctttcaacattcgcttacattactaaggacctgaagagtaatcaccactactgtcacgtctttactgcgttcgacgtgaacctggcttatgagatcatactgacactggggcaggccttcgaggtggcataccaattggcattacaagctcggaagggcggacattcctctaccctgccagagagctttgaaaacaaaccaagcaaacccatacctaagcccagggtctccatccgaaagtccgtggacctgctccacgccagtcatacaggacaggagccctccgaacggcacaccgaggaagccctccggaagttctag

SEQ ID NO: 214471 - DNA, 1353 bp, Artificial Sequence
  Description of Artificial Sequence: Synthetic coding sequence
atgatgtggcagtgtcacctaagcgcccaggattatcggtactacccagtagatggatacagtctcctcaagcggttcccgttgcacccattaactgggccaagatgtccagtccagactgtgggacagtggctagagagcatagggttgccacagtacgagaaccacttgatggctaacggcttcgacaacgtgcagtttatgggatcgaatgtgatggaggatcaggacctattagaaatcggtatactcaatagtggtcatagacagcggatactccaggccatacagcttcttcccaagatgcgccctattggccatgacggatatcaccctacctccgtggccgagtggcttgactcaattgagttgggcgactatactaaagctttcctcatcaatgggtacactagtatggacctcctgaagaagatatgggaagtggagctgattaacgttctgaagatcaatctcatcggccatagaaagcgtattcttgcctctctgggagatagactccacgatgaccctccccagaagccacctaggagtatcacattgcggtcttccgtgtgcgagatttggactaaccaaaacgctggtttccctttttctgctatccaccaagtgcataataccggcgattggggagaaccctctatcaccctgagaccaccgaatgaagccacagcttcaactcccgtgcaatactggcagcatcatcccgaaaaactcatttttcagagctgcgattacaaggccttttatctaggatccatgttaatcaaggaactgcgcggaaccgaatctacacaggatgcttgtgctaagatgagggctaactgtcagaagagtaccgagcagatgaagaaggtgccgaccataatactgtcagtcagttacaaaggagtgaagttcatcgatgccaccaataagaacattatagcagagcacgaaattcggaatatttcatgtgcagctcaggatccagaggacctcagcacatttgcctacatcacaaaggacctcaaatcaaatcatcattactgtcatgtctttactgcattcgatgtgaatcttgcctacgagatcattctaactctgggacaggctttcgaggtcgcctatcagttggccctccaggctcgtaaagggggtcattctagcactctgcctgaaagcttcgagaataaacccagcaagcccatcccgaagcctcgcgtgtcaattaggaagagcgtgcagattgatccatctgaacagaaaaccctggctaacctgccctggatcgtcgaacctggtcaggaggctaaaaggggaattaacactaagtacgagacaaccatcttctag

SEQ ID NO: 214472 - DNA, 1185 bp, Artificial Sequence
  Description of Artificial Sequence: Synthetic coding sequence
atgggccctagatgccctgtgcagactgtgggccagtggttagagagcattggactgccccagtatgaaaaccatctcatggctaacggttttgataacgtccagtttatgggctcaaacgtaatggaggaccaggatctcttggaaattggcattctgaattctgggcaccggcagagaattcttcaggcaattcagctgctccctaaaatgcggcctattggccacgatggttaccacccaacttccgtagctgagtggttagacagcatcgaactgggtgattacacgaaggcctttctgatcaacggatatacaagcatggatctgcttaaaaaaatttgggaggtagagcttattaacgtgctgaagattaatctgattggccaccggaaacggattctggcttcattaggcgaccgtctgcatgatgatcctccccagaaaccacccaggtctattacgttgcgaacaggagattggggagagccatccattacacttcggccacctaacgaagcgacagcatccacacctgtacagtattggcagcaccaccctgaaaagctgatctttcagtcttgcgattacaaggctttttatctgggtagtatgctcatcaaggaattgcgtgggaccgagtcaacccaggacgcgtgtgccaaaatgcgtgccaattgtcagaagtccacagagcagatgaaaaaagtgccaaccataattcttagcgtcagttataagggcgtcaaatttatcgacgccacaaacaagaacataatcgcagaacatgagattagaaacattagctgcgccgctcaagaccctgaagatttatccacatttgcatatatcaccaaggatcttaaatctaaccaccactactgccacgtcttcacagccttcgatgtgaacctagcttatgagatcatcctcactctggggcaggctttcgaggttgcataccagctggccctccaggccaggaaaggcggacacagctccacactcccggaatcattcgagaataagccctctaagccgatccctaagcccagggtgtccatcaggaagtccgtcatcgaccctagcgagcagaagactttagccaatctcccatggatagtagagccaggtcaggaagctaaacggggtattaatacgaagtacgagaccaccattttttag

SEQ ID NO: 214473 - DNA, 1254 bp, Artificial Sequence
  Description of Artificial Sequence: Synthetic coding sequence
atgagcacacgttaccaccaggccgcatccgattcctatctggaactgctgaaagaggctaccaagcgggacctcaacctgtcagatgaggatgggatgacacctactttgctggctgcgtaccacggcaatcttgaagccctcgaaatcatctgcagtcgtggcggtgatcctgaccgatgcgacatctggggcaatacccctttgcacttcgccgcatcaaacgggcacgctcattgcgtaagttttctcgtgaacttcggcgcaaatatatttgcccttgataacgacttgcagacacctctcgatgcagccgcaagtcgggagcagaatgaatgcgtggctctgctcgataaagcagctaccgcccagaatatcatgaacccaaagaaagttacccggcttaaggaacaggcccagaagaatgcccgacggcaaatcaaagaatgcgagagactgcaggaaaaacatcagaacaaaatggcgcatacttacagcaaggaggaatccggaaccctctcgtcttccaagggcacctttagcaggtcctcgcctagcaacgcgtcagctccgggtaccttcgggtcactgagtaaaggaatcaaggatacttttaagataaaatttaagaagaataaggatacagccgagcaagtcggaaaagaaggacggtcaggtcagaggaatgtcatggaggtgttccgggaagaagaggaggattcgttttccggagattttaaggaaaaactgcaattgtccgctgaggaggacggctccgttcatcatgaatcaatcctgaaccgaccaggtttggggtcgattgtgttcaggagaaataggatctccagtccggaagacatctctgattcaaaacgggagtttggctttaagctgccttcagaactcctgcagcggcagggagcctccgaagctgatgagggggcagccgacgaggaaggagaggagaatgggttgaaagatgacctaccttgggacgacgatgaagtcgagtgggaggaagacgtggtcgacgcaaccccactcgaggtgttcctcctctctcaacacctggaagagttcttgccaatctttaaaagggagcagatagatctggaggcgctgctcctttgttcagacgaggacctccagtctatacagatgcagctcggaccccgaaagaaagtcctcaatgcgatcaaccgccgaaagcaggtccttcagcagccagggcaactggtggacacatccttgtag

SEQ ID NO: 214474 - DNA, 7991 bp, Artificial Sequence
  Description of Artificial Sequence: Synthetic coding sequence
atgcccaagggtgggtgcccaaaggctcctcagcaggaggagctgcctctaagctccgacatggtggaaaaacagaccggaaagaaagacaaggataaggtctccctgacaaagaccccaaagctcgaaagaggggatggcggaaaagaagtaagagagcgtgcgagtaaaagaaaactcccttttaccgctggcgcaaacggagagcagaaggacagcgacacagaaaagcagggccctgagcgaaagcggattaaaaaggagcctgtgaccaggaaggccggactgctgttcggcatgggtcttagtggcatacgtgctgggtatcccctctcagaacgccaacaagtggctctgctcatgcagatgaccgccgaagagtctgcaaattctcccgtcgacaccacacccaaacatccgagtcagtccacggtgtgccagaaaggcacccccaactccgccagcaaaacaaaggacaaagtcaataagcgtaatgagcggggagaaaccaggttgcaccgggctgccatccggggagacgccagacggatcaaggaactcattagcgagggcgctgatgttaacgtgaaagactttgctggatggaccgccctgcatgaggcatgcaaccgcggatactatgacgtggccaagcagctcttagcggctggggctgaggtgaacactaaagggcttgacgacgatacgccattgcatgacgccgctaacaatggacattataaggttgtgaagcttctgctgaggtacggtggtaacccgcagcagagtaatcgcaagggcgagacacccctaaaggtggcaaattccccaacaatggtgaacctgctcctgggtaaaggtacttacacatcttcagaggaatcaagtactgagtccagcgaagaagaggatgcaccatcctttgccccttcttcctccgtggatgggaataacaccgacagcgagttcgaaaagggactcaagcataaagccaagaacccggagcctcagaaggccaccgccccagtgaaggacgagtatgagtttgatgaagacgatgagcaagatagggtgcccccagtggatgacaaacatttattgaagaaggactatcggaaggaaactaagtccaacagtttcatctcaattcctaaaatggaggttaaatcctatactaaaaataacaccattgccccaaagaaggcatcgcaccgcatcctgtctgatacctccgacgaagaagatgcttctgtcactgtggggacgggcgagaaactcaggctgtctgctcatactatcctaccgggatccaagactagagaaccttccaacgcaaagcaacagaaagaaaagaataaggtcaaaaagaagcggaagaaggagaccaaaggccgtgaagtccgatttggcaagcgaagcgacaagttctgttccagcgagtctgaatcagaatcctccgagagcggagaagacgaccgcgacagtctcggaagtagtgggtgcctgaagggatcccctctcgtgctcaaggacccatcactgttcagcagcttaagcgcctcaagtacgagttcacatggttcttcagccgctcagaagcagaatccctctcacacagaccagcacaccaaacactggcgtacggataattggaagacaatttcaagcccagcctggtctgaggtctctagcctctccgattctactaggactcgattgacttccgagagcgactactcatcggagggaagcagcgtcgagtcccttaaacccgtgcgtaagagacaggaacacagaaagcgggcatcactgtccgagaagaagagcccatttctcagtagtgcagaaggagcagtccccaagttggataaggagggtaaggtcgtgaagaaacacaaaactaagcataaacacaagaacaaggagaaggggcagtgtagcatcagccaggagttgaaactcaagtctttcacttatgagtacgaggacagcaagcagaagagtgataaggccattctgttggagaacgaccttagcacagaaaacaaactgaaagtgttaaaacatgaccgggaccacttcaaaaaggaagagaaactttctaagatgaaactagaggagaaagagtggctcttcaaggatgagaaatctttaaagcggatcaaagatactaataaggacatcagtcggtccttccgcgaagagaaggaccgatctaacaaggctgaaaaggagcgcagcctgaaggagaagtcaccgaaagaagaaaaactgagactgtacaaggaggagcggaagaagaagtccaaagacagaccaagcaaactggaaaagaagaatgacctgaaagaggataaaattagcaaggagaaggagaaaatattcaaggaggataaagaaaagttaaagaaagagaaagtgtaccgagaagactcagctttcgacgagtactgtaacaagaatcagtttcttgagaatgaggacacaaaattcagcttgtctgacgatcagcgagatcgatggtttagtgacctgtcagactcaagcttcgatttcaaaggggaggactcctgggattcgccggttactgattaccgggacatgaagtccgattcagtggccaaattgatcctggaaacggttaaggaagacagcaaggagagaagacgggatagtagagcgagggaaaaacgcgattatcgtgagccttttttccgcaaaaaagacagagattatctggacaaaaattctgagaaacgaaaggagcagaccgagaagcataaatcagtgcccggatatctttctgagaaagataaaaagcgtagagaaagcgcagaggcaggaagagacagaaaggacgcactggagtcatgtaaagaaaggagggatggaagagcaaagccggaggaggcccaccgcgaggagctaaaggaatgcggctgtgagagtggcttcaaggacaagagtgacggtgactttggaaaaggactagagccatgggagcgccaccaccccgctcgcgagaaggagaagaaagatggtccagataaagaacgcaaggagaagaccaaacctgaaagatacaaagaaaagagctctgacaaagacaaatccgaaaagagtatcctggagaagtgccagaaagacaaagaatttgataagtgcttcaaggaaaaaaaggacactaaggaaaaacataaagatactcatggtaaagacaaagaaaggaaagctagcctggatcagggcaaggagaaaaaagaaaaggcgtttcccggaatcatctcggaagatttctcggagaagaaggacgataaaaagggtaaggagaagtcgtggtatatagccgacatattcaccgatgagtcagaggatgacagagatagctgtatgggttctggatttaagatgggagaggcgtcagatctcccacggacggacggcctgcaggagaaagaggagggcagggaagcatatgcctcggataggcaccgaaagtcatctgataagcagcatcctgagagacagaaggataaggagcccagagatagacgcaaagaccggggagccgctgatgcagggagggataaaaaagagaaagtgtttgagaaacacaaagagaaaaaggacaaagagtcaacggagaagtacaaggatagaaaggatcgggcatccgttgactcaacacaggacaaaaaaaacaagcagaaactccctgaaaaggccgagaagaaacacgcagccgaggataaggcaaaatcaaagcacaaagaaaaaagtgacaaggaacactctaaggagcggaagtcatcccgttccgccgatgctgagaagagcctcctggaaaagctagaagaggaggccctccacgaatatagagaggactctaacgataaaataagcgaggtgagcagcgatagttttaccgacagaggccaagagcctggtctcaccgcattcctcgaggtgtccttcaccgagcctcccggagacgacaaacccagggagagcgcctgccttcccgaaaagctaaaggagaaggagcggcaccgccattcttcctcctccagcaagaagtcgcacgatcgtgaacgggcaaagaaggagaaagccgagaagaaggagaaaggagaggattacaaagagggcggaagccgcaaggattctggacaatacgaaaaggactttttggaagcagatgcgtatggcgtgtcgtacaacatgaaggcagacatcgaggacgaactcgacaagacaatcgagctcttcagtacggagaagaaagataagaatgacagcgagagggaaccctccaaaaagatcgagaaggaactgaaaccgtacggaagttctgccattaatatcctgaaagaaaagaaaaaaagagaaaaacatagggagaagtggcgggacgaaaaggagagacacagagatcgtcacgctgacggattgctcagacatcatagggatgagctgctgagacaccacagagatgaacagaagcccgctacccgcgataaagattctcctccaagggtgctgaaagacaagtcgcgtgacgagggccctagacttggggacgcaaagctgaaggaaaagttcaaggatggcgctgaaaaagagaagggggacccagtgaaaatgtcaaatggtaatgataaggtggctccttccaaagaccccggtaagaaggacgcacgccctcgcgaaaagctgttaggcgatggtgacctcatgatgacctctttcgagcggatgttatctcagaaagacctggagatcgaagagagacacaaacgtcataaggaaaggatgaagcagatggaaaagctgagacacagatctggggatcctaagttgaaagagaaagcaaaaccagcagatgacggaaggaaaaaaggactcgacatacccgcaaaaaaaccccctggtctcgaccccccttttaaagataagaaactgaaagagtccacccctatccctcctgcagcagagaacaagctacacccagcatccggggctgatagcaaagattggctggctggaccacacatgaaagaagtgctgccagccagccctcggccagaccagtcccggcctactggcgttccaactcccactagcgttttatcatgtccgagctacgaggaggtcatgcacactcccaggacgccttcctgctccgccgatgattacgccgacctggtttttgactgcgccgacagccagcacagcacccccgtaccaacagcccctacctccgcctgcagccccagcttttttgaccggtttagcgtcgcttcatctggcctgtccgaaaatgcaagccaggctcctgcgcgacccctgagtactaacctgtacagatccgtgtctgtggacataaggcggactcctgaagaggagttcagtgtcggcgataagttgtttcggcaacaatccgtccccgcagcttcctcgtacgactcacctatgcccccaagtatggaggatcgcgctccattgccccctgtgcctgccgaaaagttcgcttgtctgtcacctggatattatagcccagactacggactgcctagcccgaaagttgacgcccttcattgtccccctgccgcagtggtcaccgtgaccccatccccagaaggcgtcttcagcagccttcaggccaaaccaagcccgtcgcctcgcgctgagctgttagtgcctagtctcgaaggcgctctgccccctgatcttgatacttccgaagatcagcaagccaccgccgcaatcatacccccagaaccctcctacttggagccactcgacgagggcccattttcggctgtgattaccgaggaacccgtggagtgggcccacccctctgagcaggcattagcctcttctctgattggcggaactagtgagaacccagtgtcttggcctgttggaagcgatctattattaaaatctccccagcgatttccagaatcaccgaagcggttctgtccagcggaccctctccactctgctgcgccaggaccttttagcgcttcagaggccccatatccagccccacccgcaagtcccgctccctacgccctgccggtagccgagcctggcctggaggatgtcaaggacggcgtggacgccgtcccagctgccatttctacaagtgaggccgctccttacgcccctccttcaggactggagagctttttttcaaactgcaagagtctgcctgaagcccctcttgacgttgcgcctgagcctgcctgcgtggctgctgtggcgcaggtggaggctcttggacccctggagaattctttcctcgacggctcaaggggcctgtcccacctgggacaggttgagccagtcccgtgggcagacgcctttgctgggcctgaagatgatcttgacctcggcccattctccttaccagagcttcccctccagaccaaagatgcggctgatggagaagccgagcccgttgaggaatctctcgcaccccctgaagagatgcctcccggtgcccctggagtgatcaatggcggagacgtgtccacagttgttgctgaagaaccaccagcgctacctcctgaccaggcttccacccgtctgccagcggagcttgagcccgaacctagcggtgaaccaaagctcgacgtcgctctggaagcggcagtggaggccgagactgtgccagaggaaagggccaggggcgaccctgattcttccgtcgaaccagctccggtgcctcctgaacagaggcctctcggatcgggtgaccagggcgcagaggccgaggggcctcctgccgcatccctttgcgctcccgatgggccagcacccaacaccgtggctcaggcacaggccgctgacggcgcaggacccgaagacgatactgaggcctctcgggcagccgcacctgccgaaggtcccccagggggaatacagcctgaggcagccgaaccgaagccaacagcggaagccccaaaggctcccagagtagaagagatccctcagagaatgacaaggaatagggcacagatgcttgccaatcaatcgaaacaaggtccaccccctagcgaaaaagaatgcgccccaacgccggctcccgtgacacgggctaaagctcgcggaagcgaggatgacgatgcacaggcacagcaccccagaaaacgccgattccaacgaagcactcaacagctgcagcagcagcttaatacaagcactcagcagacgcgggaagttatccagcagacgctcgcagcaatagtggacgccatcaaactagatgcaattgagccgtatcacagtgaccgcgcaaatccatactttgagtaccttcaaattcgcaaaaagatcgaggaaaaaaggaaaattctctgctgcatcacaccccaggctccccagtgctatgcggaatacgtcacctataccgggagctatcttctagacgggaaaccactcagcaaactgcatattccggtgatagcgcctccaccttccctggctgaacctttgaaagaactgtttaggcagcaggaggccgtgagaggcaaattacgactgcagcatagtatcgagagggaaaagttaatcgtctcgtgcgaacaggagattctacgagtccattgtagggcagcgaggaccatcgctaaccaagccgttccgttttctgcctgcacaatgcttctagacagcgaagtgtataatatgccactcgaaagccagggagatgagaacaagagtgtcagggaccgcttcaatgccaggcagttcatttcatggctgcaagacgtggacgataagtacgaccgaatgaagacctgcttactcatgcggcaacaacatgaagccgctgccctcaacgcagtgcaacgaatggaatggcagctgaaagtgcaggagttagacccagcgggtcacaagtccctgtgtgtcaacgaggtcccaagcttctatgtgcctatggttgacgtgaacgatgattttgttctcctgccagcata

SEQ ID NO: 214475 - DNA, 1836 bp, Artificial Sequence
  Description of Artificial Sequence: Synthetic coding sequence
agtatccccaaaatggaggtaaagagttacacgaagaacaatacgatcgcaccaaaaaaggcgagccaccggatactgagcgacaccagtgacgaggaggacgcttccgtgaccgtaggcactggcgagaagctaaggttgtctgctcacacaatcctgccagggtctaaaacccgggagccatccaatgccaagcagcagaaagagaagaataaagtaaaaaagaaacggaagaaggaaaccaaaggaagagaggttcgttttggtaagcggagcgataaattctgttcttccgagagcgagtctgagtcctcagagtccggcgaggacgaccgtgactcactcggctcatctgggtgtcttaaagggtcacctttggttctgaaggacccctctctattttccagcctctccgcctcctcgactagttctcacggatcatccgcagctcaaaaacagaacccctcccatacagatcaacatactaagcactggcgcacagataattggaagacgatctcttccccggcatggagtgaggtctcaagcttgtccgacagcacgcgcaccagattgacatccgagagtgactactcgtcagaggggtcctctgtagaatccctgaagccagtacggaagaggcaggagcaccgaaagcgggcatccctctcggagaaaaagtccccatttctatcctctgccgagggtgctgttcctaagctcgataaagaggggaaggttgtcaagaaacacaagacgaagcataagcacaagaataaagaaaaggggcagtgtagtattagccaggagctgaagctcaaaagctttacgtacgaatacgaagatagcaagcaaaagagcgataaggccatccttctggagaacgatctgagcactgagaataagctgaaggtgctgaaacacgatagggaccacttcaagaaggaggagaaacttagcaaaatgaaactcgaagaaaaagagtggcttttcaaggatgaaaaaagcttgaaacgtattaaggataccaataaggatatttcccgttccttccgcgaggagaaggaccggtccaataaagctgagaaggaaagaagcttaaaggagaaaagtcccaaagaggaaaaactaagattatacaaagaggaacgcaaaaagaagagcaaagataggcctagcaagctggagaagaaaaatgacttgaaggaagataagatttctaaagaaaaggagaaaatcttcaaggaagataaagaaaagctgaagaaggagaaagtgtaccgagaggattctgcctttgacgagtactgcaataaaaatcagttcctggaaaacgaggatacaaagttttccctcagtgacgaccagcgcgatcgttggttctcagatctaagcgatagctcattcgatttcaaaggggaagattcgtgggatagcccggttacagattacagggatatgaaaagcgatagcgtggccaagctgattcttgagaccgtcaaagaggattctaaagagcggagacgcgattcgagggctcgagagaaacgggattaccgggagcccttttttaggaaaaaggaccgagactatttggataagaactccgagaaacgcaaagaacaaaccgaaaagcacaaatccgtgccgggatatctgagcgagaagcacgagcgcaggagacgtaggatggccccaataagaaaaggtcgccgtcgacagaatcagaaggacactaagagaaacccagtaacacgcacaaaagttcgaaatcagtcctggaaaaatgtgagaaggaccaagaatcttattaatgtcctcaagaggaagaagtag

SEQ ID NO: 214476 - DNA, 7991 bp, Artificial Sequence
  Description of Artificial Sequence: Synthetic coding sequence
atgccaaagggcggatgtcctaaagcgccacaacaggaagaacttcccttgtcgagtgacatggtcgaaaaacagactgggaagaaagacaaggataaagtgtctctgactaaaactcctaaattggagaggggagatggaggaaaagaggtgcgggagcgggcttctaaacgcaaactgccattcacagcgggagccaatggcgagcagaaggactccgataccgagaagcagggccctgagagaaagagaattaaaaaggagcccgtgacccgtaaggctggcctactctttggcatggggctcagtggcattcgggcagggtacccactaagtgaaagacagcaggtagcacttcttatgcagatgaccgccgaagagagcgcgaatagccccgtcgatacaaccccgaagcacccgtcacagtccaccgtgtgtcaaaagggaacccctaacagtgcctctaaaacgaaggacaaggtcaacaaacggaacgagcgaggtgaaacccggctacacagggcagctattaggggcgatgctcgtaggatcaaagaattaatcagcgagggcgcagacgtgaacgtgaaagactttgcgggttggactgccctgcatgaggcttgcaatcgtgggtattacgatgtcgccaagcagctgttggccgcaggagctgaagtgaacaccaaaggccttgacgatgataccccccttcatgacgccgcaaataacggccactacaaagtcgtcaaactcctgttgcggtatggtgggaacccccagcagagcaatcggaagggggagacaccccttaaagtggcgaacagcccaactatggtaaatctgctgctgggcaagggtacttatacctcatcagaagagtcctctaccgaatcctcggaggaggaagatgcaccgagttttgccccttcctcttcagttgacggaaacaatacagattccgaattcgagaaaggtttgaagcacaaggctaagaaccccgaacctcagaaggctactgcccctgtgaaggacgagtacgaatttgacgaggacgatgagcaggatagagtgcccccagtcgatgataaacacctgcttaaaaaggactacagaaaggagaccaaatccaactccttcatcagcattcctaagatggaggtgaaaagttatactaaaaacaatacaatcgcccctaaaaaagcgtcccatcggatcctgagcgacacgtccgatgaggaggatgccagcgtgacggtcgggactggggaaaagctcagactgagtgcgcacacaatcctgcccggaagcaagacacgggagcccagcaatgcaaaacagcagaaggagaaaaacaaagttaagaagaaacgcaaaaaagagacaaaggggcgtgaggtcagattcggcaaacggtctgacaagttctgctcttccgagtcagagagcgagagctcagagtccggcgaagacgatcgagattcactcggttcaagtgggtgtttgaaaggctctccattggtgctgaaagatccttctctgttttcctctctgtctgctagttccactagctcacacggatcttctgctgcccaaaagcagaacccatctcacacagatcaacacacgaagcattggcggactgataactggaaaacgatctcttcccccgcttggtctgaagtgagctcactcagcgactcgacaaggactagactaactagcgaatccgattattccagtgagggctcttctgtggagtctcttaagcccgtacggaagaggcaggagcacaggaagagagcctccctgtcggaaaagaagtcgccttttttgagttctgccgagggggcagttccgaaactggataaggaaggcaaagtagtgaagaagcacaagactaaacacaaacacaaaaacaaagagaagggacagtgttctatcagccaagaattaaaacttaaatcttttacttacgagtacgaggatagcaaacagaagtccgacaaggcgatccttctagaaaacgacctgagcaccgagaacaaacttaaggtgctcaagcacgacagggaccattttaagaaagaggagaagttgtccaaaatgaagctagaggagaaagagtggcttttcaaagatgagaagagcctgaagcgaataaaagataccaacaaggacattagtaggagcttcagggaagaaaaagaccgcagcaataaagccgagaaagaaagatctctgaaggagaaaagtcccaaagaggagaaactcaggctgtacaaggaggagaggaaaaaaaagtccaaggaccggccatccaagctcgagaaaaaaaatgatctgaaagaagataagatatcgaaagaaaaagaaaaaatattcaaagaggacaaggagaagttgaagaaagagaaagtttaccgagaggactcggcatttgacgagtattgtaacaagaatcagttcctcgaaaacgaggacactaagttttccctgtccgacgatcagcgggatcggtggttcagcgacctctctgacagctctttcgacttcaagggtgaggactcctgggatagcccagtgacagactatagagatatgaaatcagacagtgtcgccaaactgatcttagaaacagtcaaggaggactctaaagaacgcaggcgcgatagccgcgcacgcgaaaaaagagattatagggaacctttttttagaaaaaaggaccgcgattacttggataagaactcagagaaacggaaagagcagactgagaaacacaagagtgtgcctggctatctgagcgaaaaagataaaaaacgccgagagtcagctgaagcaggacgggatcgcaaggatgcactcgaaagctgtaaagaaaggagggatggcagagcaaaacctgaggaggcacatagggaagaactgaaggagtgcggatgcgagtccggctttaaggataagtccgacggcgatttcggcaaagggctcgagccttgggagcggcatcacccggcaagggagaaggaaaaaaaggatggaccagataaggaacggaaggagaagacaaaaccagagaggtataaagagaaaagctctgacaaagataaaagcgaaaagagcattttggagaaatgccagaaagataaggagtttgacaaatgtttcaaagaaaagaaggacacaaaagagaaacacaaggatactcatggaaaggataaagagaggaaagccagccttgatcagggcaaggagaaaaaggagaaggcatttccgggaatcatctctgaagacttttcagaaaaaaaggatgataaaaaaggaaaggagaagtcatggtacattgctgacatctttacagatgaatctgaagacgacagggatagctgcatgggttctggatttaagatgggcgaggcttctgatctgcccagaaccgacggattgcaagaaaaggaggaaggccgtgaagcatacgctagcgatcgccacaggaagagttcagacaagcaacatccagagcgacagaaggacaaggagcccagggacaggaggaaggatagaggggcagcggacgcaggcagagacaaaaaggagaaagtgtttgagaaacataaggagaagaaggacaaggaatccaccgaaaagtataaggatagaaaagatagggcatcagtagattctacccaggataagaaaaacaaacagaagttacctgaaaaagcagaaaagaaacacgctgcagaagataaagcgaaaagcaagcacaaggaaaaatcagacaaggaacactccaaagagaggaagtctagcaggagtgccgatgcagagaagtcattacttgaaaagctcgaggaagaggctctccatgagtaccgagaggattcaaatgacaaaatcagcgaagtcagttctgactcctttaccgatagggggcaagagcccggattaacagcttttctcgaagtatcctttacagagccccctggggacgataagcctcgcgagagcgcatgtctgcctgaaaaactaaaggagaaggagcgccatcgacactcttcgtccagcagcaagaagagccacgaccgcgagcgcgcaaagaaggagaaggctgaaaagaaagaaaagggggaggattataaggaggggggttcgcgcaaagactctgggcagtatgaaaaagacttcctcgaagccgacgcatatggggtcagctacaacatgaaggctgatattgaggatgagctggacaaaactatagagctattcagcaccgagaagaaagacaagaacgattccgagagggaaccttcaaaaaagattgaaaaggaattgaagccctacggaagctccgcaataaacattttgaaggaaaagaagaagcgggaaaagcatcgggagaagtggcgcgatgagaaagagcggcatcgcgacaggcacgctgatgggttgctcagacatcaccgcgatgagctattgcgccaccacagggatgaacagaagccagccaccagagataaagactcccctcctcgcgttcttaaggacaagtccagggacgagggccctcgccttggcgacgccaagctgaaagagaaatttaaggatggcgcagaaaaggagaaaggagatcccgtgaaaatgagcaacgggaatgataaggtcgctcctagcaaggacccaggcaagaaagatgctcgacccagggagaagcttctaggcgacggcgacctcatgatgacgtccttcgagaggatgctctcccaaaaggacctagagatcgaggaaaggcataaaaggcacaaagagcggatgaaacagatggaaaaactgcgtcaccgcagtggagaccccaaactgaaggagaaagctaaacctgctgatgacggcagaaagaaggggctggacatccctgctaaaaagccccctgggttggatccccctttcaaagataagaagctcaaggagtccacacccattccacctgcggctgagaacaagctccaccctgcaagcggagctgacagcaaggattggctggcgggaccgcacatgaaagaagtactcccggcttccccaagaccggaccagtcgagaccaactggagtgccaacaccgacctcagtgctgtcctgcccatcttatgaagaggtcatgcacacacctaggacccccagctgctcagcagatgactacgcagacttggtgttcgactgtgccgattcacagcattccactcctgtgcctacagcgccaacgtcagcttgttctcctagttttttcgaccgtttttcagttgcaagttccggactgtccgaaaacgctagtcaggcgcctgcaagacctctcagtaccaacctctatcggagcgtctctgtggatatccggagaactcctgaggaagagttttccgtgggagataagctcttccggcaacagtctgtgccagctgcatcctcttacgacagccccatgcccccatcaatggaagatagagcacctttaccaccggtcccagccgagaagttcgcatgccttagcccaggctactactccccggattacggtctgcccagccccaaagtagatgccttgcattgtcctcctgctgctgtggtgaccgttaccccttctccggagggggtgtttagctccctgcaggccaagccttcacctagccctcgggcagaactcctggtcccttcccttgaaggcgctcttccacctgatctggatacgtctgaagaccagcaggcaaccgccgcaatcatccctcctgaaccttcttatctggagcccctcgatgagggccctttctcagccgtcattacggaggaaccggtggagtgggcccacccttcagaacaggcgctcgctagcagccttataggcggtacttcagaaaacccagtgtcctggcccgtgggaagcgacttgcttctcaagagtccccagagattccctgaaagtcccaaaagattctgcccagcagaccctttacacagcgcagcccctggtccattctcggcttcagaagccccatatcccgctcctcctgcctcccctgccccatacgcacttccagttgccgaacccggtcttgaggatgtcaaagacggcgtcgatgccgtcccggctgctatttctacatccgaggccgcaccatatgcacccccatctggtctagaaagtttcttcagcaactgcaagtcactccccgaggcacctttggacgttgctcctgagcctgcatgtgtggccgcagtggctcaggtcgaggccctcggccctctggaaaactccttcttggacggcagccggggtctgagccatctaggccaggtggaacccgtaccatgggctgatgcctttgccggtcctgaggatgacctggaccttgggcctttctctttaccagagctgcctcttcagactaaagacgcggctgacggcgaagcggaacctgttgaagagtccctagcacctcctgaggaaatgcctccaggcgcacctggcgtaatcaacggcggagatgtgagtacggtagtggccgaagaaccccctgcgctgcccccagaccaggctagcactcggcttcctgctgagctagaacccgagccttctggcgagcctaagctagacgtcgctctcgaggccgcagtggaagccgaaacagttcccgaggaaagggcgagaggcgacccagactcatccgtggaacctgctccggtgccgcctgaacagcggccactgggctctggcgatcagggagcagaggcggaggggcctccagccgctagtctgtgcgctccagacgggcctgcaccaaatactgtggcccaggcccaggcggctgatggcgcaggtcccgaagacgataccgaagccagtcgtgccgcagccccagctgaagggccaccgggaggcatacagcctgaagccgctgagcctaagccaaccgccgaggccccaaaggctcctcgcgtggaggaaatccctcaacgaatgaccaggaatagggctcagatgctggctaaccaaagcaagcagggacctcccccaagcgagaaagagtgcgcccctacaccagcaccagtgactagagcgaaggctagaggaagtgaagacgacgacgctcaggcacaacaccccaggaagcgccgttttcagcgatcaacacagcagctgcaacagcagctgaatacttcaacccagcagaccagagaggtcatacagcagacccttgctgccatcgtggacgctatcaaactggatgctatcgagccttaccattcagatagagctaacccttattttgaatacctgcagattagaaagaaaatagaagagaaaagaaagattctgtgttgtatcacgccccaggcccctcagtgctacgcagaatatgtgacatatactggctcgtacttgcttgatggaaagcctctgtcaaaacttcatatacccgtcattgccccaccaccatcattggccgaacccttaaaggagctctttaggcagcaggaggcagtacgagggaagcttagactgcagcatagtatcgaacgagaaaaactgatcgtgtcgtgcgaacaggaaatactgagagtgcactgtagagccgctagaaccattgcaaaccaggctgtgccgttttctgcctgcacaatgttactagattcagaggtttataacatgcctttagagtcacaaggcgacgaaaataaatcggtcagggatcgcttcaatgctcgtcagtttatcagttggctccaggatgttgatgacaagtacgatagaatgaagacttgcttgctcatgcgccagcagcacgaagccgctgccctgaacgccgtgcagcggatggagtggcaactgaaagtccaagaactcgaccctgcaggacataaaagcctgtgtgtgaacgaagtcccttccttctacgtgcctatggtggacgtaaatgacgatttcgttttgctgccagccta

SEQ ID NO: 214477 - DNA, 1317 bp, Artificial Sequence
  Description of Artificial Sequence: Synthetic coding sequence
tccgcaggcagggtcaacgaggatcgggtgaggagtcgcaccatgccaaagggtggttgcccgaaagcacctcagcaagaggagctcccactaagcagcgatatggttgaaaagcagacaggcaaaaaagacaaggataaggtctcgctcactaagacacccaagcttgaaaggggagatgggggtaaggaggtaagggagcgggcttctaagaggaagctgccttttaccgccggagcaaacggcgagcagaaagactcagacacagagaaacaaggccctgagcgtaagagaataaaaaaagagccggttacacggaaggcaggattacttttcggcatgggattaagcggcattcgagcgggttaccccctcagcgaacgccagcaggtggctctcctgatgcagatgacagccgaagagagcgctaacagtccagtggatacaacacccaagcatccttcccagtctactgtgtgtcagaaggggacccctaattctgcatccaaaacgaaagataaagtgaacaaacgcaacgagcggggtgagacacgattgcaccgcgcagccattcggggagacgcacgacggattaaggaactgattagtgagggtgcagacgtaaacgtgaaagacttcgcaggatggaccgcactccacgaagcgtgcaaccgcggttactacgacgtcgccaagcagctgcttgctgcaggggcagaggtgaatacgaagggcctggatgatgacaccccccttcacgacgcggcaaataacggacactacaaagtcgtgaaactgctcctgaggtacgggggaaacccacagcagtcaaatagaaagggtgagacaccactcaaggtggcgaattctcccaccatggtcaacttgctgctcggtaaaggaacatatactagttctgaggagtcttcaactgaatcttcggaagaggaagacgctccatcattcgcacccagttcatctgtggacggcaataacactgattccgaattcgagaagggcctcaagcataaagcaaaaaaccctgaaccacagaaggcaacagcccctgtgaaggatgaatatgaatttgacgaggacgacgagcaggaccgtgtaccacctgtcgacgacaagcatctcctgaagaaagactaccggaaggaaaccaagagtaactcattcatcagtatcccaaaaatggaaaaggtcactctcaaaattactcgtctgcaccagagaaagcgccctatcgtaagttgccaaacaaggaggaccagaagaacaagggttagcccgtggggacaagaacgttcatag

SEQ ID NO: 214478 - DNA, 6189 bp, Artificial Sequence
  Description of Artificial Sequence: Synthetic coding sequence
atgcctaaatctggtttcactaaaccgatccagtcagagaactcagactctgacagtaacatggtggagaaaccatatgggcgaaagtccaaggataaaatcgctagctactcgaagacccctaaaattgaacgctccgacgtaagcaaagaaatgaaggaaaagtcctccatgaaacgaaagctgcctttcaccatctcgccatctcgaaacgaggagagggacagcgacacagactctgaccctggacacacatcggagaactggggggaacggctgatatcaagctaccgcacgtacagtgaaaaggaggggcctgaaaagaagaagacaaagaaggaggccggaaataaaaaatcgacgcccgttagtattctgttcgggtaccctttatcagagcgcaagcagatggcccttcttatgcagatgactgctcgggataatagccccgattccacccccaatcatccatcacagaccactcccgcacagaaaaaaacgccaagttccagctcgcgccagaaggacaaggtcaacaagaggaacgagcgcggtgagacacccctgcatatggcagctattcggggtgacgtgaaacaggttaaagaacttattagcttaggcgcaaacgttaacgtgaaagactttgctgggtggacccccttacatgaggcatgtaatgtcggctactacgacgtagctaagattttaattgcagctggggcagacgtaaatacccaagggctcgatgacgataccccactgcatgacagtgccagctcaggccatcgggacatagtcaagctcttattgaggcacggcggaaatccgtttcaagccaataaacacggggaaaggccagtggatgtagccgagactgaggagctggagctgcttctcaaacgagaagtacctttgagcgatgacgatgagtcttatacggactctgaggaggcccagagcgtgaacccttcgtccgtagacgagaacatagattctgaaactgagaaggactcactgatctgcgagagcaagcaaatcttaccctccaaaactccattacccagcgctctcgatgagtatgaatttaaagatgatgatgacgaggagatcaataaaatgatcgatgatagacacatccttagaaaagagcagcgaaaagagaatgagcccgaggccgagaagacccacctcttcgccaagcaggaaaaggcgttttaccctaagagcttcaagtctaagaagcagaagccaagcagagtgctatattcgtccactgaatcaagtgacgaggaggcgctgcaaaataaaaaaatctctacatcttgctctgtgatcccagaaacatctaactccgacatgcagacaaagaaggagtatgttgtgagcggtgagcataaacaaaaaggcaaggtaaaaagaaaacttaagaaccagaacaaaaataaagagaatcaggaactaaagcaagaaaaagaggggaaggagaataccaggatcacgaacctgacggtaaacactgggctggattgtagcgagaaaacccgcgaagagggaaattttaggaaaagcttcagccccaaggatgatactagcctgcacctgttccatatctctactggtaagtctcctaagcattcttgtggactgtcagaaaaacagagcactccccttaagcaggagcacactaagacttgcctatccccaggctcttccgagatgagtttgcagcctgacctggttcgctacgacaacacagagagtgagttcctccctgaatccagctcagttaagagttgtaaacacaaagagaaaagtaaacaccagaaggactttcatttggagttcggagagaaatctaacgctaagattaaggatgaggatcactctccaacgttcgagaacagcgattgtacgctcaagaagatggataaagagggcaagaccctcaagaaacacaagttgaagcataaagagcgagagaaagagaaacacaagaaggaaatcgagggcgagaaagagaagtacaaaactaaagattccgctaaggagctgcagcgttctgtagaattcgaccgagagttttggaaggagaacttttttaagagtgacgagacggaggacctgttcctgaatatggaacatgaaagtcttaccctcgagaagaagtctaaactggaaaaaaatataaaggacgacaagtcaacaaaggagaaacacgtgtcaaaggaacggaactttaaggaggaacgggataagattaagaaagagtcagagaaatcgtttcgagaggagaaaatcaaagaccttaaagaggagagagaaaacatacctactgacaaggactctgaatttaccagcctcggaatgtccgctatcgaagaatctatcggactgcatcttgtggagaaggagattgatatcgagaagcaagagaagcacattaaggaatcaaaagaaaagcccgaaaagcgcagccagatcaaagaaaaggacattgagaagatggagagaaagactttcgaaaaggaaaagaaaatcaaacacgaacacaagtctgagaaggacaagcttgacctctcagagtgcgtggataaaatcaaggaaaaggataagctgtacagccatcatactgagaagtgccataaggaaggcgaaaaatctaagaatactgcagcaatcaagaaaaccgacgacagggagaaatcaagggagaagatggaccgcaaacatgacaaagaaaaaccagaaaaagagcgccacctagctgagtcaaaggaaaaacatctgatggaaaaaaagaataagcagagcgacaattccgagtactcaaagagtgagaaaggcaagaacaaagagaaggaccgcgagctggataaaaaggagaaatcgagagataaggaatctattaatattacgaacagcaagcatattcaggaggaaaaaaagagctctattgtggatggcaataaggcccaacacgagaaacccctgtccctgaaagaaaaaactaaggacgaacccctgaagaccccagacgggaaggagaaggataagaaggataaagatatcgaccgctataaagagagagacaagcacaaagacaaaatacagatcaactcactgctcaagctgaaatccgaggcagataagcccaagcctaagtcatctcctgcttctaaggatacgaggccaaaggaaaaacgtctcgtcaacgacgatttgatgcagacaagcttcgaaagaatgctctcccttaaggacctggagattgagcagtggcacaagaagcataaggagaagatcaagcagaaggaaaaggagaggctgcgcaaccgtaactgtttagaactcaaaatcaaagataaagagaagactaaacacacaccaaccgagtctaaaaacaaggagttgacgaggtctaaatcaagtgaagtgactgacgcctataccaaagaaaagcaaccaaaagatgccgttagtaacaggtcacaaagtgtggacactaaaaacgtaatgactttgggaaaaagcagcttcgtcagcgacaattccctaaaccggagcccacgaagcgaaaatgagaagcctggattatcctctcggtctgtgtctatgatctcagttgcgagttcagaggattcctgccacaccaccgttactacccctagaccacctgtagagtacgacagtgacttcatgttagagtcctcggaatcacagatgagcttcagtcagtctccttttttaagtattgcaaagagtccggctctacacgaaagagaattagacagcttggccgacctacctgagcgcatcaagcccccatatgccaatcggctgtcgacctcccatttgagaagctcgagcgtcgaggacgtcaaattgatcatttccgagggaaggcccaccatagaagtgaggagatgttcaatgccttcagtcatttgcgaacacaccaagcagtttcaaactatcagcgaggagtctaaccaggggagccttcttactgtgcctggggacacaagcccaagtcctaagccagaggtgttctccaatgtgccggaaagggacttgagcaacgtttctaacattcatagttcattcgccacttcacccaccggagctagcaactcaaagtacgtcagcgcggaccgaaatctgatcaagaatacagccccagtaaacactgtcatggactctccagtacacctcgagccctcatcgcaggtgggagtaatccagaacaagtcgtgggagatgccagtcgataggctagagacgctgagtactagggactttatctgtcctaattccaatattccggatcaggaaagcagtttacaatccttctgtaattctgaaaacaaggtgttaaaagagaacgcagactttttgagcctgcgccagacggagctgcccggaaactcctgtgcacaagatcccgctagtttcatgcctccgcagcagccgtgctccttcccctcccaatccctttctgatgcagagtccatatccaaacatatgtctcttagctacgtggccaatcaggaaccaggcattttgcagcaaaaaaacgcggtgcagatcatctcttccgcgctggatacagacaatgagagcactaaggataccgaaaacactttcgttttgggagacgtgcagaagactgatgccttcgtccccgtctatagcgacagtaccattcaggaagcgagcccgaactttgagaaggcttacaccctccccgtcttgcctagcgaaaaagattttaacggttcggacgcgtcgacacaattgaatacacactacgcattttctaagctcacttataaaagttcttccggccatgaggttgagaacagtacaacagacacacaggtgatctctcatgaaaaggaaaacaagctggagtccctggtcttgacccacttgagccggtgtgattccgatttgtgcgagatgaatgctggtatgcccaaggggaatctgaacgagcaggaccctaagcactgcccagaaagtgaaaaatgtctcctcagtattgaagacgaagagtctcagcagagcattttgtcttctctggagaaccattcccagcagagcacccagcctgaaatgcacaaatacggtcaacttgtcaaagtcgaattggaagagaacgcggaagatgataaaaccgaaaaccagatcccgcagagaatgacccggaacaaagctaacactatggccaaccagtctaaacagatactcgcctcctgcaccctgctctcagaaaaagactccgagtccagctcacccagaggcagaattcgacttacagaggatgacgacccccagattcatcatccgaggaagcgcaaagtatcacgggtcccccagcctgtgcaggtctccccttcgctattacaggccaaggagaaaacccagcagtctctggcagccatcgttgacagcctgaaacttgatgaaatccaaccatactctagcgagagggccaatccctattttgaataccttcacatccgtaagaagatcgaagaaaaaaggaaactcctatgctccgtgatcccacaagcaccccaatactatgacgaatatgtaacattcaacggtagctatctgttggacggtaaccccctatccaagatctgtattccaacgattactccccctccaagcttaagcgatccactgaaggagcttttcagacagcaggaggtggtgcgcatgaagctgaggttgcagcacagcattgagagggagaagctgatcgtgtctaacgagcaggaagtgctgagagttcactacagggcagcacggacacttgcaaatcaaactctgccctttagtgcctgcaccgtactcctagacgctgaggtctataacgtgcccctcgattctcaaagcgacgactcaaagacctctgtgagggatcggtttaatgctagacagttcatgtcgtggctccaggacgtcgacgacaagttcgacaagctcaagacatgtctgctgatgaggcaacagcacgaggctgccgctttaaacgccgttcaacggctggagtggcagctcaagttacaagaactcgaccctgccacatataaaagcattagcatttatgaaattcaggagttctatgtgccattggtagacgtgaacgatgatttcgaactgactcctatatac

SEQ ID NO: 214479 - DNA, 1317 bp, Artificial Sequence
  Description of Artificial Sequence: Synthetic coding sequence
atggtgaatgtgcctgaacttcttctcggacagtctccctctcggaacgacaccaagatcattaatagcgaagaagcccagtccgtcaacccctcctctgtggatgagaatatagattctgaaacagaaaaggattctctgatctgtgagtccaagcagatattgccatcaaaaacacccctgccgagcgctcttgatgagtatgagtttaaagatgacgatgatgaggagataaacaaaatgatagatgatcggcacattcttaggaaggaacagcggaaggagaacgagcctgaagctgagaaaacgcaccttttcgccaaacaggagaaagccttctaccccaaatccttcaaatccaagaagcagaagccatcccgagtcttgtacagttctaccgagagttctgacgaagaagccttgcaaaacaagaagattagtaccagttgtagcgttattccagaaactagcaactccgacatgcagaccaaaaaggagtacgtggtgtcaggagaacacaagcagaaaggaaaagtgaagcggaaactgaagaaccagaataagaacaaggaaaaccaggagctgaaacaggagaaggaagggaaagagaacactaggattaccaacctcaccgttaatacgggtctggactgctctgagaagaccagggaggaaggcaattttaggaagtctttctcaccgaaagacgacacctccctgcacctttttcacatctcaaccgggaaatcaccaaagcatagctgtggacttagcgagaaacagtctacccccttaaagcaagagcacaccaaaacctgtttgtcacccggttcttctgagatgtctctgcagccagacttggtgaggtacgataacaccgagagtgaatttctccctgagtccagcagcgtaaagagctgcaagcataaagagaagtccaagcatcagaaggattttcaccttgagttcggggaaaaaagcaatgccaagatcaaggacgaagatcactctcctactttcgaaaatagcgactgcaccctcaagaaaatggataaggagggcaaaacattaaagaagcataagctgaagcataaggaacgcgagaaggaaaaacataagaaggaaatcgaaggggagaaggaaaaatataagacaaaagatagcgctaaagaactgcagaggtctgtggaattcgacagagagttttggaaggaaaactttttcaagtctgacgaaaccgaagatctgttcctcaatatggagcacgagtcgctgacgttggagaagatcaaaatcggaaagaagcaccagaggtag

SEQ ID NO: 214480 - DNA, 6119 bp, Artificial Sequence
  Description of Artificial Sequence: Synthetic coding sequence
atgccgaagtccggttttactaaacctatccagtcggagaacagcgatagcgatagtaacatggtcgaaaagccatacggacgaaaatcaaaagacaagatagcctcttacagcaagaccccaaagatcgagcggagtgatgtgtctaaggagatgaaagaaaaatcttctatgaagcgaaaacttccatttactatatccccatcgcgaaatgaggagcgggattctgacacagagaaggaaggcccagaaaagaaaaaaactaagaaggaggctggaaataaaaagtcgacacccgtgtcaatcctctttgggtaccccctgagtgagcgcaaacagatggctctcctgatgcagatgaccgctcgcgacaattcgccagactccacacccaaccatccttctcaaacgacccccgctcaaaagaagactccctcatctagtagtcgccaaaaggacaaagtaaacaaaagaaacgaaaggggcgagacaccacttcacatggcggctatcagaggcgatgtgaagcaggtcaaggaacttatctcactcggagcaaacgtcaatgttaaggactttgcaggttggaccccccttcacgaggcctgtaatgtgggctattacgatgttgctaaaattctgatagcagcaggcgctgacgtgaatacacaggggctggatgatgacactccattacacgactcagcttcctcggggcaccgagacatcgtgaagctgctcctccgccatggaggtaacccgtttcaggcaaacaagcatggagaacgccctgtcgacgtggcagagacggaggaactggagctactgctaaaaagagaggtacccttatcggatgatgatgagtcatacaccgacagcgaggaggcacaaagcgttaacccgtcttcagtagatgaaaacatcgacagtgagaccgaaaaggatagcctgatatgtgagagcaaacagatcctcccctctaagactcctcttccatcagcgctggatgaatatgagtttaaggatgatgacgacgaagagataaataaaatgattgacgaccggcacatcctgaggaaagagcaacgcaaggaaaacgaacctgaggccgagaagactcatcttttcgctaaacaggagaaggcattctacccgaaatcctttaagtcaaagaaacaaaaaccctctcgagtcttgtactcatcgaccgagtcgtccgacgaggaggctcttcaaaacaaaaaaatatccacctcttgctcggtcattcctgagacatcaaactcagacatgcagacgaaaaaggaatatgtggtatctggagagcataaacagaaaggcaaagtaaagaggaagctgaaaaaccagaacaaaaacaaggagaatcaggaattgaagcaggaaaaagaggggaaagagaacactaggatcaccaacctaacagtgaatacaggtctggactgttccgagaaaacgagggaggaaggaaactttaggaaatcattttccccgaaggatgacacctccctgcacctgtttcatatttcaaccggaaagtctccaaaacacagctgcgggctgagcgagaagcaatcaaccccactgaagcaggaacacaccaaaacctgtttgagtcccggttcctcggaaatgagcctgcagccagatttggtgcgctacgataacacagagtccgagtttctccccgagtccagctcagtgaaatcttgcaagcataaggagaagtcaaaacaccagaaagattttcatctcgaatttggtgagaagtccaatgcgaagatcaaagatgaggaccattctccaacattcgagaattcagattgtacccttaaaaagatggataaggagggtaagacactgaagaagcacaaactcaaacacaaagaacgtgagaaggagaaacacaaaaaagagatagaaggggaaaaggaaaaatataaaacaaaggacagcgccaaggaactgcagcgctctgtggagtttgacagggaattctggaaagagaatttttttaagtccgatgagaccgaggacttatttctgaacatggaacatgaatccctgaccctggagaagaagagtaaactggagaagaacatcaaggacgacaaatcaactaaggagaagcatgtgtccaaggaaaggaacttcaaggaagagcgggataaaatcaagaaggagagtgagaagagctttcgtgaggagaagataaaggacctaaaggaggagagggagaatatccccaccgacaaggatagtgagttcacaagccttggcatgtccgcgatagaggagagcattggactgcacctcgtcgagaaagaaattgacatcgaaaaacaggagaaacatatcaaggagtcaaaggagaaacccgaaaagagaagtcagatcaaagaaaaggacatcgaaaagatggagcgtaagacattcgagaaagagaaaaaaattaagcacgaacataagagtgaaaaagataagctggacctgtccgaatgcgtcgataaaataaaagagaaggacaagctttatagtcaccacaccgaaaaatgccacaaggaaggggaaaaatccaaaaacactgcagctatcaaaaagacagatgatagggaaaaaagtcgggagaagatggacaggaagcacgacaaagaaaaacccgaaaaagagaggcacctggcggagagcaaggagaagcatcttatggaaaagaaaaacaagcagtccgacaacagcgagtacagtaaaagtgagaagggaaaaaataaagaaaaagatcgcgaactcgacaagaaggaaaagtctagagataaggagtccattaatatcaccaattctaagcacatccaggaggagaagaaaagttccatcgttgacgggaacaaggctcagcacgagaagcccctgtccctaaaagagaaaacgaaagatgaacctctgaaaacaccagatggaaaggagaaggacaagaaggacaaggacatcgatcggtacaaggagcgggacaaacacaaggataagatccagattaactcattgctgaagctgaagtccgaagcagacaaacccaaaccaaagtcttctcctgcttctaaggataccaggcctaaggagaaacgactggtgaacgacgatctgatgcagacctccttcgagagaatgctgagcctcaaagacctggagatcgagcaatggcataaaaagcacaaggaaaagataaagcagaaggaaaaggagcggctccggaacaggaattgcctggagctgaaaattaaggataaggaaaaaacaaagcacactcctactgagtcaaaaaataaggaactgactcgctctaaatccagcgaagtcaccgatgcttacacaaaagagaaacagcctaaggacgccgtaagcaatagatcccagtctgtggataccaaaaatgtgatgacactggggaaatcttcctttgtgtctgacaattcactcaacaggtctcctagatccgagaatgaaaagcccggattgtcatcccgatctgtctccatgatatctgtcgcctccagcgaagatagctgccacacaactgttacaacacccaggccgcctgtcgagtacgactcagacttcatgctagaatcttcagagtcccagatgagcttcagccagagcccatttctgagtatcgctaagtcgccagcgctgcatgagcgggagctagactcgctcgccgatctgcctgagcggatcaaacccccatacgcaaacaggctttctactagtcatctgagatcaagtagcgtggaggacgtgaaactgatcatttctgagggcagacctactatcgaggtccgccgttgttccatgccatcagttatctgtgagcatactaagcaattccagactatatccgaggaatctaaccagggatcattgttgacagtgcccggagacacatccccttccccaaagcccgaagttttctctaatgtgcctgaacgagatttgtctaatgtatcgaacatccatagttcgtttgcaacaagccctaccggagcatccaactcaaagtacgtgtctgccgacaggaacctcatcaagaatactgcgccagtaaacacggtgatggatagccctgtgcacctggagccgagctcacaggtgggagtaattcagaacaaatcatgggagatgcctgtggatcgactcgagaccttatccacccgcgattttatttgtcctaatagcaacatcccggatcaggaaagttcgttgcagagcttttgtaacagtgagaataaggttctgaaagagaatgccgactttcttagcctgagacaaacagagcttcctggtaactcctgtgcacaggaccccgcttccttcatgcccccacagcagccatgttcgttccctagccaaagtctgtccgacgccgaatccatttctaagcatatgtctcttagttacgtcgcaaaccaggagcccggaatacttcagcagaagaatgctgtgcagatcatttcgtcagccctggatactgacaatgagtcaacaaaagacaccgaaaacacatttgtgctgggcgatgtgcagaaaaccgacgcttttgtacccgtgtattcagattctactatccaggaggctagccccaacttcgagaaggcatatacactaccagtgctgccctctgagaaagacttcaacggcagtgacgcaagcacccaattgaacactcactatgccttctcaaaactaacttacaagagctctagcggacacgaagtggaaaattctaccacagacacgcaggtcatatcacacgagaaggagaataagctcgaatcccttgtactgacccatttgtctcgctgtgactctgatctgtgtgaaatgaatgctgggatgcctaaagggaatttaaatgaacaggatccaaagcattgtcctgagtccgagaaatgcctgttaagcatcgaggacgaagagtctcagcaatccattctgagtagcttggagaaccacagtcagcagtccactcaacccgagatgcacaaatacgggcagctcgtgaaggttgaactggaggagaatgcagaggatgataaaaccgaaaaccagatcccacagaggatgacgcgtaataaggcaaataccatggccaaccagtcaaagcaaatcctggcttcttgtacattgctgtcagagaaggattctgagtcgagcagcccacgtggcagaatacggctgactgaagatgacgacccacagattcaccatcccagaaaacggaaagtctcccgcgtcccacagcctgtgcaagtgtctccaagtttattacaggccaaggaaaaaacgcagcagagcttggctgctatcgtcgacagcctgaagctcgacgagatccagccttactcctcagagagggccaacccgtatttcgagtatttacacatccggaaaaagattgaggaaaagcgtaagcttttgtgctctgtgattcctcaggccccacagtactacgacgagtatgtgacgtttaacgggtcctatcttcttgatggtaacccactgtcaaagatttgtatcccaaccattacacccccaccatctctctcggacccattgaaagagctttttagacagcaggaagtggttaggatgaagctacgcctccagcactcaatcgaacgtgagaaattgattgtttccaatgagcaggaggtcctacgcgtgcattacagggctgccagaactctcgcgaatcaaacactccctttcagtgcctgtactgttttgctggatgccgaggtgtataacgtacctctcgattcacagagtgacgactctaaaacctccgtccgggatcgcttcaacgctcggcagttcatgagctggctgcaggatgtggatgacaagttcgataagctgaaaacctgcttactaatgaggcagcaacacgaggccgcagctctgaacgccgtgcagaggctggagtggcagctgaagctgcaagagctggaccccgcaacatataagagcatatctatctacgagattcaagagttttatgttccactagtcgacgtcaatgacgactttgaactgacacctatcta

SEQ ID NO: 214481 - DNA, 372 bp, Artificial Sequence
  Description of Artificial Sequence: Synthetic coding sequence
actgaagacttgttcctgaatatggaacatgagtccttgacattggagaaaaaaagcaagctggagaagaatataaaggacgacaaatccactaaggaaaagcacgtcagcaaggagcgaaattttaaagaggaaagggacaaaattaagaaagagtccgagaaatcttttagagaagggatgtctgcaatagaagagagcattgggctacatcttgtcgaaaaagaaatagatatcgagaagcaggaaaagcacattaaagaatctaaagaaaagcctgagaaaagatcacagatcaaggagaaggatattgaaaagatggaacgcaaaacctttgagaaaggaacaagttacatccgcattacacagtag

SEQ ID NO: 214482 - DNA, 993 bp, Artificial Sequence
  Description of Artificial Sequence: Synthetic coding sequence
atgcccaaatcagggttcaccaaaccgattcaaagcgaaaattctgacagtgattccaatatggtggaaaaaccctacgggaggaagagtaaagacaaaatagcatcttattcaaagacaccgaagatagagcgaagcgatgtttcaaaagaaatgaaggagaagtcctctatgaaaaggaagctgccctttacaataagtcctagtagaaatgaagagcgggattctgatactgattcagatcccggacatacctccgagaactggggggagcgattaatctcaagttatcgcacttattcagagaaagaaggtcccgagaagaaaaagaccaaaaaggaggccggaaataaaaagagcacccccgtgagtatcctcttcggataccctctttccgagcgtaaacagatggctttattgatgcaaatgacagcacgggacaatagcccagatagtacccccaaccatccttcccagacgaccccagcccagaagaagactcccagctcctcatctagacagaaagataaagtcaacaaacgtaacgaaaggggtgaaacacctctgcacatggctgctattagaggggatgtcaagcaggtgaaggaattaatctctcttggcgctaacgtgaacgttaaagattttgccggttggacccccttgcacgaagcatgtaatgtcgggtactacgatgtggccaaaatactcattgctgctggtgcagacgtgaatactcaagggctggatgatgacaccccgctccacgattctgcctcctctggccatagggacattgtgaaactcctcttgagacatggtggcaaccctttccaggcgaataagcatggcgaaagaccagttgacgtggctgagactgaggaactcgagctgctgctgaagagagaagtacctctcagtgatgacgatgaatcatacactggaagttcgtaccaatttgccggtaacgcgaagttatcaggagcatcatag

SEQ ID NO: 214483 - DNA, 1116 bp, Artificial Sequence
  Description of Artificial Sequence: Synthetic coding sequence
atgcctaaatccggattcaccaagccaatccagtcagagaatagcgactctgacagcaatatggtggagaagccctatggacgcaagtccaaagacaaaatagcctcttatagtaagacgccaaagattgaacgaagtgatgtgtcaaaggaaatgaaagaaaaaagcagtatgaagcggaaactaccgttcacgataagtcctagtaggaacgaagaacgggattccgatacagaaaaggaggggccagagaagaaaaagaccaagaaggaagccggtaacaaaaaaagcacgcctgtatccatactgttcggctaccccctgtcagagcggaagcagatggcattgctaatgcagatgacggccagagataattctccggacagtacccccaaccatccatcacagactacccctgcacagaagaaaacaccctccagttcaagtagacaaaaggataaagtcaacaaacggaatgagcggggagagacccctctgcatatggctgcgatacgcggtgacgttaaacaggtgaaagagctcatcagcttgggcgcaaacgtgaatgtgaaggacttcgctggttggacccctctgcatgaagcatgtaacgtaggttattacgacgttgcaaagatcctgattgcggcaggcgcagacgtgaatacacaggggttggacgacgacactcctttacatgattctgccagcagcggccaccgagatattgttaaactcctgctccggcatggaggcaatcccttccaggctaacaagcacggagagcgcccagtcgatgttgccgaaactgaagagctagagctgcttttgaaacgagaggtcccactcagtgatgacgacgagtcctatactgacagcgaggaagcccaaagtgtaaatccatcaagcgtggatgagaacatcgactctgagacggagaaggactcactgatttgtgaatccaagcaaattctgcctagcaaaacacccttaccttctgcccttgacgaatacgagttcaaggacgacgacgacgaggaaatcaacaagatgatcgacgatcgccacattctcaggaaagaacaacggaagaaaaagcgcaaggagaagaagtag

SEQ ID NO: 214484 - DNA, 984 bp, Artificial Sequence
  Description of Artificial Sequence: Synthetic coding sequence
atggcaaaagcccctagttgggcgggagttggagctctagcatacaaggcccctgaagccctgtggccagccgaagccgtaatggacggcacaatggaggatagcgaggcggtgcagcgggcaaccgcacttatcgagcaaagactggcacaagaggaggagaatgagaaacttcgaggggacgccagacagaagctgcccatggatcttcttgttttggaagacgagaagcatcatggtgcacagagcgcagccctgcagaaggtcaaagggcaggaacgggtccggaagacatcactggacttaagacgggagatcattgatgttggaggcatccaaaatctgatagagctgcggaaaaagcggaaacaaaagaaacgggatgctttggcagctagccatgagccaccacccgaaccggaggagatcactggacccgtagacgaggagacttttcttaaagctgctgtggaaggcaagatgaaggtgattgagaaattcctcgcagacgggggttccgcagatacatgtgatcagttccgacggaccgccctgcacagagccagcctggaaggccacatggaaatcttagaaaaactgcttgacaacggcgcaactgtggactttcaggacaggttggactgcacagccatgcactgggcttgccgcggtggacacctggaagtggtcaaactcctccagagtcatggtgccgataccaatgtgagagacaaggaaggggacactgcactccatgacgccgtcagactgaacagatacaaaatcattaaactactactcctgcacggggctgacatgatgaccaagaacctggctggcaaaacaccaaccgacctggtgcagctgtggcaggctgatacgagacacgctctcgaacaccccgagcctggcgctgaacacaatgggttggaaggcccaaacgattccggaagggagaccccgcagccagtcccagcccaatag

SEQ ID NO: 214485 - DNA, 1083 bp, Artificial Sequence
  Description of Artificial Sequence: Synthetic coding sequence
atggccaaggctcctagctgggctggcgtgggggcactggcgtacaaggcccctgaggcattatggccggctgaggcggtgatggatgggactatggaggacagcgaggccgttcaaagagccacagccctaattgagcagcggctagctcaggaagaagagaatgagaagctgaggggcgacgctcgccagaagctaccgatggacttgctggtgttagaggacgagaaacaccatggggctcaatcggccgcactccaaaaggtgaaaggtcaggagcgtgtaagaaagacctccctggacctgagacgagaaatcatcgatgtcggcggtattcagaaccttattgaacttcgcaagaagcgcaaacagaaaaaaagggacgcgcttgcagccagccacgaaccaccgccagagcccgaagaaatcacaggaccggtcgacgaggaaacatttctgaaagcggctgtcgagggaaagatgaaagtcattgaaaaattcctggccgatggaggttccgcagacacttgtgatcagtttcggcgtacggccttgcatagagcatcccttgaaggtcacatggaaatcctggaaaagctgctggacaacggtgcaactgtcgactttcaagatagactggattgcacagcgatgcattgggcttgccggggaggtcacttggaagtcgtcaagctactgcaatcccacggggcagatacaaacgtacgggataaactactgtcaactccactacatgtcgcagtgagaacgggccaggtggagatagtggagcactttctgtccctcggactggagatcaacgctcgggatcgtgagggcgataccgccctgcatgatgcagtccggctgaacaggtacaagatcataaagctgttgctgctccatggggcagacatgatgaccaaaaaccttgcagggaaaacacccacagacctggtgcaactctggcaggcggacacccgccacgcgttagaacatcctgagcccggagcagaacacaacggcttggaggggcctaatgacagtgggagagaaacacctcaacccgtgccagcccaatag

SEQ ID NO: 214486 - DNA, 1002 bp, Artificial Sequence
  Description of Artificial Sequence: Synthetic coding sequence
atggatggtaccatggaggactctgaagctgtgcagagagcaactgcactgattgaacagcgcctagcgcaagaggaggagaatgaaaagttacgaggagatgcccgacagaagctcccgatggacctcttagtgctagaggatgagaagcatcacggagcccagagcgccgcactgcagaaggtgaagggtcaggagcgagtacgcaagacgtctctcgatctccggagggagatcattgatgtgggcggaatccagaacttgattgagctccggaaaaagcgaaaacaaaaaaaacgggatgctctcgccgctagccacgagcccccacccgagccggaagaaatcacaggccctgttgacgaggaaaccttcctaaaagcggctgttgagggaaaaatgaaggtgattgaaaaattcctcgctgacggaggttcagcagatacatgtgaccagtttaggcggacggcccttcacagagctagcctggaagggcacatggagatcctggaaaagctgctcgacaacggcgctactgttgatttccaagatagactcgactgtactgccatgcattgggcctgtagagggggacatttggaagtcgtgaagctgttgcagagtcatggggctgatacaaacgttcgggacaaactgctttccacgcccctgcatgtggccgtaaggactggacaggttgagatcgttgaacactttctctcccttgggctggagatcaacgccagggatcgggaaggcgatacagcactgcacgatgctgttcgactgaaccgttacaagattataaagttactactcctgcatggagctgacatgatgacgaagaatttagcaggtaaaacccccacagatttggtccaactttggcaggccgacacgcgccacgctctggagcaccctgaacctggtgcagagcacaatgggctcgaaggacccaatgacagcggacgcgagacacctcagccagtaccggcacagtag

SEQ ID NO: 214487 - DNA, 903 bp, Artificial Sequence
  Description of Artificial Sequence: Synthetic coding sequence
atggacggtacgatggaagattccgaggctgtccagcgagccacggctttaatcgaacagcgtctggcacaggaagaagagaatgagaagctcagaggggatgccaggcaaaagctcccgatggaccttttagttttggaagacgagaagcaccacggggcacagagcgcggctttgcagaaagtgaaagggcaggaaagagtgcgcaagacaagtctggatctgcggagggagattatagatgttggcggaattcagaatctgattgagttgcgtaagaagagaaagcagaaaaagagagatgccctggctgccagtcatgagcccccaccagaacctgaagagattactgggccagtggacgaggagaccttcctaaaagcagccgttgaagggaaaatgaaggttattgaaaaattcctggccgacggaggcagcgctgacacctgtgatcagtttagaagaactgcgctacacagggcctccctagaaggccacatggaaattttggaaaagctcctggacaacggggctaccgtggatttccaagaccgtcttgactgcaccgcgatgcactgggcctgtcggggaggtcatttggaggtggttaagctgcttcagtcccacggagcagacactaatgtgcgcgacaaagagggggataccgccttacacgacgctgtgaggctgaacagatataaaataataaaattgctcttactccacggggcagatatgatgactaaaaacctggccggtaagaccccgacagacctcgtgcagctgtggcaggcagacaccagacatgctctagagcaccctgagcccggtgccgaacataacggactggagggtccaaatgactctggaagagaaactccccagcctgtgccagcacagtag

SEQ ID NO: 214488 - DNA, 918 bp, Artificial Sequence
  Description of Artificial Sequence: Synthetic coding sequence
atggacttcatctctattcagcaattagtttcgggcgagagggtcgaggggaaggtcctgggattcgggcacggcgtgccggatccaggcgcatggccaagtgattggaggcggggacctcaggaggcagtggcaagggaaaaactgaagctggaggaggagaagaagaaaaaattagagaggttcaactcgacaagattcaacctggacaatcttgccgacttggagaaccttgtgcagcgtcggaagaagagactgagacacagggtgccccctaggaaacctgagcctcttgtgaaacctcagagtcaggcacaggtggagccggttgggttagaaatgttcctgaaagctgcggcagaaaatcaggaatacctgattgacaagtacttaaccgatggcggtgatcctaacgcccacgataagttgcaccggacagcactccactgggcctgtctcaaagggcactctcagctggtcaataaactgctggttgccggagccactgtggatgcacgggacttactagatagaaccccggtcttttgggcttgtcggggtggacatctggtcatactgaagcagcttctgaatcagggcgctagagttaacgccagggacaaaatcgggtctacaccactccacgtggctgtccgcactcggcacccagattgccttgaacatctgatagagtgcggggcacatttaaacgcccaggataaggagggggatacagctctgcacgaagcagtccgtcatgggagctataaggccatgaaactactgctgctgtatggggcagagttgggggtgcggaatgctgccagtgtgactccagtgcagcttgccagagattggcagcggggtatccgagaggctctgcaagcccatgtggcccaccccagaacacggtgctag

SEQ ID NO: 214489 - DNA, 792 bp, Artificial Sequence
  Description of Artificial Sequence: Synthetic coding sequence
atggattttatttcaatccaacagctggtgagtggagaaagagtggaaggaaaggtgctcggattcggccacggagtcccggacccaggtgcctggccctctgactggaggaggggaccccaggaagctgtggccagagaaaagctgaagctggaggaggaaaagaagaagaaactggagcgattcaacagcacgagatttaaccttgacaacctcgctgatttagagaacttggtacagcggcgtaagaaacgtcttcgccatcgcgtgccaccaaggaagcccgagccgctcgtaaagctacaccgcacagctctgcactgggcttgcctgaaaggtcatagccagctggttaataaactgctcgttgctggcgcaaccgtggatgcacgtgatcttctggataggacacctgtgttttgggcttgccggggaggtcatttagttatcttgaagcagcttttaaatcagggggctagggttaatgccagagataaaatcggaagtacacctctgcacgttgccgtgagaaccaggcatccagactgccttgagcacctgattgagtgcggagcacatctgaatgctcaagataaagaaggcgacacggccttacatgaggcagtgagacacgggtcttataaggctatgaaattgttgttgctgtacggcgctgagcttggcgtgagaaacgccgcaagcgtcacccctgtgcagctggcccgagactggcaacgcggtatccgggaggcgctgcaggcacatgtcgctcatcccaggaccaggtgctag

SEQ ID NO: 214490 - DNA, 918 bp, Artificial Sequence
  Description of Artificial Sequence: Synthetic coding sequence
atggactttatctctatccagcaactggtgagcggagagagagtcgaggggaaagtactcggcttcggtcatggcgttcctgaccccggtgcttggccttcggactggcggaggggaccacaggaagctgtggccagagagaagctcaagctggaagaagagaaaaaaaagaagctggagagatttaacagcacacggtttaacctggacaacctggctgatctggagaatcttgtgcaacggagaaagaaacgccttcgccatcgggttccccctaggaagcctgaacctcttgtaaagccccagtctcaggcccaggtcgagcccgtgggactcgaaatgttcctgaaggctgccgcagaaaaccaggagtaccttatcgataagtacttaacagatggtggtgaccctaatgcccacgacaaattgcaccggaccgctttgcactgggcctgtctgaaaggccattcgcagctggtgaataaacttctcgttgcaggggctacggtggatgcaagagatctcctggacagaaccccagtgttctgggcatgccggggaggccatctggtgatcctcaagcagcttctgaaccagggcgcaagagtgaacgcacgggataagatcggaagtacgccactgcatgtggctgtaaggacccggcatcctgactgtttggagcacctcatagagtgtggcgctcacctgaacgctcaagacaaggagggagacactgcactgcatgaggctgtgcggcacgggtcttacaaggcaatgaaactgctgctgctgtacggtgcagagctgggcgtgaggaacgccgcttccgtcacgcccgtacaattggctagggattggcagcgcggaatccgggaggccctccaggcccacgtggctcatcctcgtacccggtgctag

SEQ ID NO: 214491 - DNA, 3804 bp, Artificial Sequence
  Description of Artificial Sequence: Synthetic coding sequence
atgaaccatatgtttcacatcaaaagacacagtatctctgcaggcactgacgcatataaaaagaccaagccgatacagaatctctttcagaaacccctctacgatcactgcagcgctaataactacaaaagcatggagccggagctggagaacgtgcggtccagcccccctaggggcgacaggacaagtaaggtctcactgaaggaggaactgcagcaggacatgcagaggtttaagaatgaaatcgggatgttaaaggtcgaatttcaagcgctcgagaaggaaaaagtgcagctgcagaaagaggttgaggaggagaggaagaaacacaggaacaacgaaatggaggtttccgccaatatccacgatggcgctaccgatgacgctgaggatgatgacgatgatgacggcctgatacaaaagcggaagtcaggagaaacagatcaccagcagtttcctaggaaagaaaacaaggaatacgcatcgagcggacctgctttgcaaatgaaggaggtcaagagtactgagaaagaaaagcggacctccaaagagtcagtgaactcgcccgtgttcgggaaggccagcctccttacaggcggacttctgcaggttgacgacgacagctctctatcagaaatcgatgaggatgaggggagacccactaaaaagaccagtaacgagaaaaataaggttaagaatcagatacaaagcatggatgatgttgatgacttgacacaatcctctgaaacggcttcagaggattgtgaattgcctcacagctcttacaagaactttatgctcctcatcgaacagcttgggatggagtgcaaagactccgttagtctgctaaaaatccaggacgccgcactgtcttgtgagcgattactggaacttaaaaaaaaccactgtgagctcctgaccgtcaaaatcaaaaagatggaagacaaagtcaatgtcctgcaaagggagctgagcgagactaaagagataaaatctcagctggaacaccagaaggttgagtgggagcgggaactgtgttcattgcggtttagtctcaatcaggaagaagagaagcggagaaatgccgacacactctacgagaaaatccgtgagcagttgaggcggaaagaagagcaatatcgaaaggaagtcgaggtgaagcagcagctggagctgtccctgcaaaccctggaaatggagctgcgaacagtgaagagcaacctgaatcaggtggtccaggagagaaatgacgcacaacgacagttgtcccgagaacaaaacgctaggatgctgcaggatggcatcctgacaaatcacttgtcaaagcaaaaggaaatcgagatggcccagaaaaaaatgaactctgaaaactcacacagccatgaagaagaaaaggatctcagtcacaagaatagcatgctccaggaggagattgctatgctgcgattggagattgacaccattaagaaccagaatcaggagaaggaaaaaaagtgcttcgaggatctgaagatagtgaaggagaagaatgaagatctccagaagaccattaagcaaaacgaggagaccctgacccagacaatttctcagtacaatggtaggctctcagtgttgactgccgagaacgcaatgctcaattcaaaactggagaacgaaaaacagtctaaggagagactggaagcagaagtggagagttaccattcccgcctagcagctgctattcacgacagggaccagagtgaaacctcgaagagggagttggagctggcattccagcgagccagagatgagtgcagccgtctccaagataagatgaatttcgatgttagcaacctgaaggacaacaacgagatcctatctcagcagctgttcaaaacagagagtaagcttaatagcttagaaatcgaattccatcataccagggacgccttaagggagaagactctgggactggagagggtccaaaaagacctgtcccaaactcagtgccagatgaaggagatggaacagaaatatcagaacgaacaggtcaaagtgaacaaatatattggtaagcaggaaagcgtggaagagcggctttcgcagctacagagcgagaacatgttgctgcgccaacagctggatgatgctcacaataaggctgacaacaaagagaaaacggtgataaatatccaagatcagtttcatgcgatcgttcaaaagctgcaggctgagtctgaaaaacaatctctgctgttggaagagagaaacaaggaacttatctccgagtgcaatcacttaaaggaacgacaataccaatacgaaaatgaaaaggcagagagggaggtcgtggttagacagctgcagcaggaattagctgacaccctgaagaaacaatcaatgtccgaggcgtctctcgaggttacaagcaggtaccgcattaacctcgaagatgaaacccaggatctgaagaagaaactaggccaaatccgaaaccagctccaagaagcccaggacagacacacagaggcagtgaggtgtgcagaaaagatgcaggaccacaagcagaaattagagaaagataacgcaaagttgaaggtcacggtgaaaaagcagatggataagatagaggaattgcaaaagaacctcctgaacgctaatctaagcgaggacgagaaagagcaactcaaaaaactcatggagctgaaacagagcctggaatgcaatttggaccaggagatgaaaaagaatgtggaactcgagcgtgagattaccggctttaagaacctgctcaagatgacgcgcaagaagctgaatgaatacgagaacggggagttctctttccatggcgacttgaagacgtctcagttcgagatggatatccagattaataagttgaagcacaagatcgacgatctgactgctgagctggaaactgccggatctaaatgccttcatcttgacacaaaaaaccagatcttacaggaagaactgctctcgatgaagaccgtccagaagaaatgcgaaaaactgcagaaaaataaaaagaagttggaacaggaagtcatcaacctccgatctcacattgagagaaacatggtggaattggggcaggtgaagcaatataaacaggagatcgaagaacgagctaggcaagagatagccgaaaagctaaaggaggttaatctttttttgcaggcgcaggcagcgagccaagagaatctggagcagtttagagagaataacttcgcgtcaatgaaatctcaaatggagctccggataaaagacctggaaagcgaattgagtaagatcaagactagccaggaggattttaacaaaacggaactggagaagtacaaacagctatacctggaggaactgaaggtgagaaaatctctctctagcaaactcaccaaaacaaacgagaggctggcagaggtgaataccaaactactcgtggaaaagcagcagagtcggtcattgtttacgactttgacgaccaggcccgtcatggaacccccttgtgtcggtaaccttaacaactctctcgatttaaatcgtaaacttatcccgcgagagaacctggtgattagtacgtctaacccgagagcatctaataactccatggagaactacctgagcaagatgcagcaggagttagagaaaaatattacccgggaacttaaggaggccgctgccgagttagaatcaggcagcatcgcgtctcctttgggaagcactgatgagtcgaaccttaatcaggatctggtgtggaaagcttccagagagtacgttcaggtcctgaaaaagaattatatgatttag

SEQ ID NO: 214492 - DNA, 5132 bp, Artificial Sequence
  Description of Artificial Sequence: Synthetic coding sequence
atgaagaaaatattcagcaaaaagggtgagagccctcttggcagttttgcccgaagacagcggtcctccgctggagggggtggcgagccaggcgagggggcatatagtcagcccggttatcacgtgcgcgaccgagacctggggaaaatccataaggccgcttccgccggaaacgtagctaaggtccagcagatcttactccttcggaagaatggcctcaacgatcgagacaagatgaatcgaacggccctccatctagcttgcgccaacgggcacccggaggtagttactttgttggttgaccgtaagtgccagctgaacgtctgtgataatgagaatcgcaccgcgttgatgaaagccgtgcagtgtcaggaagagaagtgtgcgactatactgttggaacatggggctgaccccaacctggccgatgtgcacggcaataccgcattgcactacgcggtctacaacgaagatatatccgttgcaactaaacttctcttgtacgacgccaatatcgaggctaagaataaggacgaccttaccccgctcttgctggcagtctcgggtaagaagcagcagatggtggagttcctgatcaagaaaaaagcaaatgtaaacgccgtcgataaacttgaaagcagccaccagctgataagtgaatacaaagaggaacgcataccaaaacactcaagtcaaaattctaacagcgtggacgaatccagtgaagattctctatcccgcctctcaggcaaacctggcgttgacgacagttggcctacttcagatgacgaggatctgaactttgacacgaaaaacgtgcccaagccttctctggcgaagttaatgacagcctcccagcagtctcggaagaacctggaggctacctatggaacagttcgaaccggaaaccggaccctctttgaggatagagattctgatagccaagacgaagtggtggtagagagcttaccaaccacctccattaaggtgcagtgttttagtcatcccacgtatcagtctccagatctgcttcctaaacccagccacaagtccctggccaacccaggattgatgaaggaagagccaaccaagcccggaattgctaaaaaggaaaatggaatcgatattatagaaagcgcgccattagaacagacaaataatgacaatctgacatacgttgacgaggtccataaaaataacagatctgatatgatgtccgcgctgggacttggacaagaggaggatatcgaaagcccatgggactctgaatcaattagtgaaaacttccctcaaaaatatgtggatcccttagccggagccgcagatggtaaagagaaaaatattggcaacgagcaggcggaggacgtgttctatatcccttcctgcatgagcgggtccaggaattttaagatggccaaactggaagacacaaggaacgtgggaatgcccgttgcacatatggagtccccggagaggtacctgcacctgaagccgactatcgagatgaaggactcggtgcctaataaggctgggggaatgaaagatgtgcagacttccaaagcagccgaacatgacctggaggtggcttcagaggaagagcaagagcgcgaggggtctgagaacaaccagccacaggtggaggaagaaaggaagaaacatcggaacaacgagatggaagtgagcgctaacatccacgacggggctacagacgacgccgaggacgacgacgatgacgatggcctcatccagaaacggaagtctggagaaaccgaccatcagcagttcccgagaaaggagaacaaagaatatgccagctcgggccctgccctccagatgaaggaagtgaagtcaactgagaaagagaaacggacctctaaggaaagcgtgaattcgcctgtgttcggcaaggcctccctgctcacgggaggactgctgcaggtagacgatgattcctcactgtccgaaatcgatgaagacgagggcaggccaactaagaagacgagcaacgagaagaataaggttaaaaaccagatccagagtatggacgacgtcgatgatctaacacagagctctgaaacagcctccgaagattgcgaactcccccactctagttataagaatttcatgcttcttatagagcagttggggatggaatgcaaggactccgtgagcctcctgaaaatccaagacgctgccctctcatgtgagcgcctcctcgaactaaagaagaaccactgtgagctactgacagtcaagatcaaaaagatggaagataaagtgaatgtgctccaacgcgagctgagcgagaccaaagagataaagtctcagctggaacaccagaaagtggaatgggagcgagagctttgtagcttgcgttttagccttaaccaggaggaagagaagaggaggaacgcagacactctctatgagaagattcgtgagcagctgcgacggaaggaggaacagtataggaaggaggtcgaggtaaaacagcagctggaattatccctgcagaccctggaaatggaactgcgcaccgtgaagagtaacctaaatcaggttgtgcaggagcgaaatgacgcccagcgccagctcagccgggagcagaacgctagaatgctgcaggacggtatactcaccaatcatctgtcaaagcagaaagagattgagatggcccagaaaaagatgaactccgagaacagtcactcccacgaggaagaaaaggatctctctcataaaaactccatgctccaagaagaaatagctatgttacggctggaaatcgatactatcaaaaatcagaatcaggagaaggagaaaaaatgcttcgaggacctgaaaatcgttaaggagaagaacgaagacttgcagaaaaccatcaaacagaacgaagagacactgactcagaccattagccagtacaatggcagactcagtgtgttgacggccgagaacgctatgctgaatagtaagctagaaaacgaaaaacagagtaaagagcgcctggaggctgaggtggagagttaccatagcaggctggcggctgcaatccatgatcgcgatcagtcagaaacatccaagagggagctcgaactggccttccagcgcgctagagacgagtgctcaaggctgcaggataagatgaatttcgatgtgtccaatctgaaggataataacgagattctatctcagcagctgttcaagaccgagtccaagctcaacagtctggagatcgagttccaccacacacgcgacgcacttagagagaagaccctgggactcgagcgtgttcagaaggacctgagccagacacagtgtcagatgaaggaaatggaacagaaataccaaaatgagcaggtcaaagtcaacaaatacattgggaagcaagagtccgttgaggagcgcctgtcccagctgcagtccgagaatatgctcttaaggcagcaattggatgatgcacacaacaaggctgataataaggagaaaaccgtcataaacatacaggaccaatttcatgctatcgtacagaagttacaagccgaaagcgagaaacagtccctgctgcttgaggagcgcaataaggagctcatctcagagtgcaaccacctgaaggaacggcagtaccagtatgaaaacgagaaggccgaacgcgaagtagttgtgcggcagctccagcaggagctcgccgacaccctgaagaagcaatcaatgagcgaggcctccctggaggtaacatctcggtacagaataaatctggaggacgagactcaggacctaaagaagaagctggggcagattagaaaccagctacaggaggcgcaggaccgccatacagaagctgtccgctgcgccgaaaaaatgcaagaccacaagcagaaattagaaaaggataatgccaagttaaaagtaacggtaaagaagcagatggataagatagaggaactgcagaaaaacctgctcaacgccaatctgtccgaggatgaaaaagaacaattgaaaaaactgatggaactgaagcagtccctggagtgtaatttggatcaagagatgaagaagaacgtggaacttgagagagagatcaccggctttaagaacctattaaagatgaccagaaagaaattgaatgagtatgaaaatggcgagttcagctttcatggcgatctcaaaacttcccagtttgagatggacatccagatcaataaattgaagcataaaattgatgacctgaccgccgagcttgagaccgcagggtccaagtgcctgcatctggacaccaaaaaccagattttgcaggaggagctgttgtctatgaagacagtccagaagaagtgcgaaaaacttcaaaagaataagaaaaaattggagcaggaagtcattaatctgagaagccacatcgagcgcaatatggtggagctagggcaggtgaagcagtataaacaagaaattgaggaacgggctcgccaggagattgctgaaaagcttaaggaagtaaaccttttcctgcaggcccaggctgcctcccaggagaatctggagcagtttcgcgaaaacaatttcgcatccatgaagtcccagatggagttgcgcattaaggacttagagtcagagttgagcaagataaaaacatcccaggaggacttcaacaagaccgagctcgaaaaatataagcagttgtacctggaagagctgaaggtccggaaaagcttgagctctaaactcacaaagaccaacgagcggctggccgaagtgaacacaaagttattggtcgagaagcagcagtcaaggagcctcttcaccacactgaccacccgacccgtgatggagcccccatgcgtggggaacctgaacaattcgttggacctgaaccgtaagctgattcctcgagagaatctggtgatcagcacgtctaatcctcgggcatcgaataacagtatggagaattatctttccaagatgcagcaagagctagaaaagaatattactcgtgagctgaaagaagccgcagcagagctcgagagcgggagcattgccagtccactcggcagcaccgacgaaagcaacctgaaccaggatctggtgtggaaagccagccgggaatatgtgcaggtactcaagaagaactacatgatcta

SEQ ID NO: 214493 - DNA, 5180 bp, Artificial Sequence
  Description of Artificial Sequence: Synthetic coding sequence
atgaaaaaaattttttctaaaaaaggtgaatcgccactaggctctttcgctaggcggcagaggtcctctgccggtggcggtggggagcctggtgaaggtgcctatagccaacctggataccacgtaagggaccgcgatctgggtaaaattcacaaggccgcttccgcaggcaatgtggcaaaggtccagcagattctcctgctccggaaaaacggattgaacgatagagataagatgaatagaaccgcactgcacctcgcgtgtgctaacggacatcctgaggtcgttacattgctcgtggaccgcaaatgccaattgaacgtctgcgataacgagaaccgcacagctctgatgaaagcagtccaatgtcaggaggaaaagtgtgccaccatcctgctggagcacggagcagatccaaatttagctgatgttcacggtaataccgcgctccactatgcggtgtataatgaagacatctcagttgctactaagcttctcctttacgatgctaatatcgaggcaaagaataaagacgacctgacgccactcctcctggcagtttctggaaagaaacagcaaatggtcgagttcttgatcaagaagaaagcaaatgtaaatgcggtggacaagctggaatctagccaccagttgatcagcgagtacaaagaggagcggatcccgaagcacagctctcagaattccaactctgtcgacgaaagctctgaagactctctgtcgtccctgttctactttattttctttgaaactaaatcttgcaccgtggctcaagctggagtgctgcagcatgacctgagcagtctgcagtcactgttaccgggttttactcagttcttttgtttgcacctgccaagcagttgggatcacagactgtctgggaaacccggagtggacgattcttggcctacatcggacgatgaggatcttaattttgacactaaaaatgtacctaaacccagcctggcaaaactcatgaccgctagccagcaatctcgcaagaatctagaagcgacctatggaacagtgcgaaccgggaatcgcactctcttcgaagatcgggacagtgattcccaggatgaagttgttgtcgagtcactgccaaccacctcaatcaaggttcagtgcttctctcacccaacttaccaaagcccagacttgctgccaaagccctcacacaaaagccttgcaaatccaggcctcatgaaagaagaacccaccaagcccggaattgccaaaaaggagaacggcatcgatataatcgagtctgccccattggagcagaccaataatgacaatcttacctatgttgatgaggtgcacaagaacaacaggtcagacatgatgagcgccttaggccttggccaggaggaggatatcgaatcgccctgggatagtgagagcatcagcgagaacttccctcagaagtacgtcgaccctctcgccggagctgcagacggcaaagagaaaaacattggaaacgaacaagctgaagaatcgccggaacgctatctacacctgaagcccaccattgaaatgaaggatagcgtccccaacaaagcagggggaatgaaggacgtccaaactagcaaggccgctgagcacgatctggaagtcgcctcagaggaagaacaggagcgcgaggggtccgaaaacaatcagcctcaggtggaggaggaacgaaagaagcacagaaataatgagatggaggtctctgccaacatccatgacggagccacagatgatgcagaagatgacgatgatgatgacggactgatccagaagcggaaatctggcgaaacagatcaccagcagtttccgcgaaaagagaataaagagtacgcgagttccggcccagctctacagatgaaagaggtgaagtccacagaaaaggagaagcgtacaagcaaagagagcgtgaactcacccgttttcggcaaagccagcctcctgactggcggattgttacaggtggacgatgacagctctctgtcagagatcgacgaggatgaaggaagaccaaccaagaaaacaagcaatgagaaaaacaaggtaaagaaccagatccagagcatggacgacgttgatgacctgactcaatcctccgaaactgcatcagaggactgtgagctgccacacagttcatacaagaacttcatgcttctgattgaacaattaggcatggagtgtaaggattccgtcagtttacttaaaatacaggacgccgctctcagttgtgaacgtctgctggagctcaagaagaatcactgcgaactcttgaccgttaagataaagaaaatggaagacaaagttaatgtcttacagcgggaattatccgagaccaaagagatcaagtcgcaactggagcatcagaaggtggaatgggagcgcgagctgtgctccctgcgtttctcgttgaaccaagaggaggagaagaggaggaatgctgacaccctttacgagaagataagggaacagctaagacgtaaggaagaacagtaccggaaggaggttgaggtgaaacagcaactggaacttagcttgcaaacactcgagatggaactgcgtaccgtcaagagcaatctgaatcaagttgttcaggagcgcaatgacgctcagaggcagttgtcccgcgagcagaacgctagaatgttgcaggatggaattctgacaaaccacttgtcaaaacagaaggaaatagagatggcccagaaaaagatgaattctgagaactcccactctcatgaagaagaaaaggatttatctcacaaaaattcaatgcttcaggaggagatagccatgctcaggctggagatcgacactataaagaatcaaaaccaggaaaaagagaaaaagtgctttgaagatctcaagatcgtgaaggagaagaacgaggatttgcaaaagactattaaacaaaatgaagagactcttacccagaccatatcccagtacaacggcaggctaagtgtcttgactgccgaaaatgctatgttgaacagcaaactcgagaatgaaaaacaatcaaaggagagattagaagctgaggtcgagtcataccatagtcgactggctgcagctatccacgatcgggatcagtctgaaacctccaagcgggagctggagttggctttccaaagggcccgagatgagtgttcaagattgcaggacaaaatgaatttcgacgtatccaatcttaaagacaataacgagattctgagccagcagctctttaagaccgagtccaaactcaacagtctcgaaatcgaattccatcatacccgcgacgccctgcgtgagaagaccctcggcttggaaagagtacagaaggatctgtcccagacgcagtgccagatgaaagagatggagcaaaagtaccagaacgaacaggtcaaagtgaataagtatataggcaagcaggagagcgtggaagagcgattgtctcagctgcaatctgaaaacatgttgttgaggcagcaattggatgacgctcacaacaaagcagataataaagagaagaccgtgataaatatccaggatcagttccatgcaattgttcagaaactgcaggccgagtctgaaaagcaatcactcttattggaggagcggaacaaagaactcatttccgagtgcaaccacctgaaggagagacagtaccagtacgaaaatgaaaaagccgaaagggaggtcgtggtcagacaactccaacaggaactggctgacaccctgaagaagcagtcgatgagtgaagcatcactcgaggtgacttcccgttacagaataaacctagaggacgagacccaggacctgaagaagaaactcggccagattagaaaccagcttcaggaagctcaggatagacacacagaggccgtccggtgcgctgagaagatgcaggaccataaacaaaaactcgagaaggataatgctaaattgaaggttaccgtaaaaaaacaaatggacaagatcgaagagctacaaaaaaatctgctgaacgccaatctgagtgaggacgagaaagagcagctcaaaaaacttatggaactcaagcagagcctggaatgcaatctggatcaggagatgaagaagaatgtggaactggaaagagagatcaccggtttcaaaaacctgctcaagatgactcgcaaaaagcttaatgagtatgagaacggcgagttctcatttcatggcgatctcaaaaccagccagttcgagatggatatacagatcaataagctgaagcacaagatcgatgacctgacggccgaattggaaactgccggaagtaagtgtctccacctcgacaccaaaaatcagatattgcaggaggaattgctgtccatgaagacggtccaaaagaaatgcgagaagctgcagaagaataaaaagaaactcgagcaagaggtgattaatctacggagtcacattgagaggaatatggtggagctgggtcaggtcaagcagtataagcaggaaatcgaggaacgggctcgacaagaaatagctgaaaagcttaaggaggtaaatttgttccttcaagcacaggcagcttcacaagagaacctagaacagttcagagaaaataatttcgcctcaatgaagagccagatggagcttcgaatcaaagatctggagtctgaactcagcaagattaagacgagccaggaggatttcaacaaaaccgagttagagaaatacaagcaactgtacctggaggagctgaaggtccggaaaagcttgtcatccaagctgacaaaaacaaatgaacgactggccgaggtgaatactaaactgctggtcgagaaacagcagtctcgttccttatttaccaccttgaccacccgaccagtgatggagcctccctgtgttggcaatttaaataactcactggatctcaaccgcaaattaatcccaagggaaaacctcgtgattagcacttcgaaccctagagccagcaataattccatggagaactatctgagcaaaatgcagcaggagctggaaaagaacattacccgagaacttaaagaagcagccgctgagctagaatcaggatcgatagcatctcccctgggttctaccgatgagtcaaacctgaatcaagacttggtatggaaagcctcacgggagtatgtgcaggtgctgaaaaaaaattatatgatcta

SEQ ID NO: 214494 - DNA, 642 bp, Artificial Sequence
  Description of Artificial Sequence: Synthetic coding sequence
tgatttagggagaataacttcgcatccatgaagtctcaaatggagctgcggataaaggatcttgagtccgaactgtcaaagataaaaactagccaggaggattttaacaagactgaacttgagaaatacaaacagttgtatttggaggaactgaaggtcaggaagtccctctcatccaagcttacaaaaaccaatgaaagactggccgaggtcaacaccaaactcctcgtagagaagcagcagtcgcgcagcctcttcaccaccttgacgactaggcccgtaatggagccaccttgcgttgggaatctgaacaacagtctggatctgaaccgtaagttgattccccgagaaaacctcgtgatatccacttcaaatcctagggcatccaacaatagcatggaaaactacctcagtaagatgcagcaggagctcgaaaaaaacataaccagggaactcaaggaagctgctgcagagttggaaagtggcagtatagccagtccacttggttcaacagatgaaagtaacctgaatcaagaccttgtctggaaagctagtcgcgaatacggaccttccgatgagacaccccatgattatgtgctgatgacagaccaatgtttgacttcccgcacagatctgcagtag

SEQ ID NO: 214495 - DNA, 3261 bp, Artificial Sequence
  Description of Artificial Sequence: Synthetic coding sequence
atgagcagagtctgcatcgtcgtgctggaggaagttgaggatgaatcaccagcctttattagcaaactgccccaggagaacaaaagcctccattcaccaccttccggtaacgtcctcgttcgttacccctcccttgtccaggcgatctttaacggcgaccctgacgaggtgcgggcattgatcttcaagaaagaggatgtcaactttcaggacaacgagaaacgcacaccactccacgctgcagcatacctcggcgatgctgaaatcatagagttgcttatcctgagtggggcaagagtgaatgccaaggacagcaaatggttaactccgctccacagagcagttgcatcttgcagcgaagaggcggttcaggttctgctgaagcatagcgccgacgttaatgctcgggataaaaactggcaaacaccacttcatatcgctgcagctaataaggctgtaaaatgcgctgaagccttagtaccccttctgagcaacgttaatgtgagcgacagagctggtcgtactgccctgcaccatgctgccttctctggccatggcgagatggttaaactgttgctcagccgaggcgctaacattaacgccttcgacaaaaaagatcgcagggccatacactgggccgcatatatggggcatatagaagtggtgaaattgctggtgtcccacggggctgaagtcacctgtaaagacaaaaaaagctatacacctctgcacgctgcagcctcttccggcatgatctctgtagtgaaatatctgctagacctcggcgtagatatgaacgagcccaacgcatatggcaacactccattacacgttgcttgctataacggccaagatgtggtggtgaatgaactgatcgactgcggggctatcgttaaccagaaaaacgaaaagggattcactccgttacacttcgccgcagccagtacccatggggctctatgtctggagcttttggtcgggaacggagctgacgtgaacatgaagtcgaaagacggtaaaacacctctgcacatgactgctctgcatgggcgtttctcccggagccagactatcatccagagtggcgcagtcatcgattgtgaggacaagaacggaaacaccccactgcatatcgcagcacggtacggacacgagctcctgattaacacacttatcacctctggtgccgataccgcaaagcgtgggatccatgggatgtttcctctccacctggccgctctgagtggtttttcagattgttgtcggaagctgctcagttcaggtttcgacatcgacaccccagatgattttgggcgaacctgtttgcacgccgctgcagccggtgggaaccttgagtgcctgaacctactgttgaatactggcgcagattttaacaagaaggacaagtttggcagaagtcccctgcactatgctgcagctaactgcaactatcagtgcctgtttgcattggtgggatcaggcgcaagtgtaaatgacctggacgagcggggttgcactccattgcattacgctgcaacatccgacactgatggaaagtgtcttgaatatctgctgcgcaatgacgcaaatccgggaattagggacaagcaaggctataacgccgttcattactccgctgcatacggacaccgactgtgcctccagttgattgcttcagaaacgcctctcgatgtgctgatggaaacctcaggcacagatatgctgagtgattcagacaatagagccaccatctcacccctgcatctcgcagcttaccatggccaccaccaggctttagaagtattggtgcagtcgcttttagacttggacgtgcgaaacagctcggggaggaccccactcgatttggcagcttttaaggggcatgtcgagtgcgtggatgtgctgattaaccagggcgctagcatactggttaaggactacattctaaaacggacaccaattcatgctgcagcgactaacgggcacagcgagtgtctgcgactgctaataggcaacgctgagcctcagaacgccgtggacattcaagatgggaacggccagaccccgcttatgctctccgtgctgaacggccacacagactgcgtgtactccctgcttaacaagggtgctaacgtggatgcaaaagacaaatggggaagaactgctctgcatcggggagccgtgaccggacacgaggagtgtgtcgacgcactcctgcaacatggggctaagtgcttactaagggacagccggggtcggaccccaatccacctgtcagcagcttgcggccatattggggtattgggggcattacttcagtctgccgcaagtatggacgctaatcctgccaccgccgataatcacggttatactgcactccattgggcttgttacaatggccacgagacttgtgtggagctgctgcttgagcaggaggtatttcaaaagacagaaggtaacgctttctccccactgcattgcgcagttattaacgataatgaaggggcagcggagatgttgatcgacaccctgggggcaagcatcgtcaacgcaactgactcgaaaggtagaacccctctccatgcagctgcatttaccgaccacgtcgaatgcctacagctcctgctgagtcacaacgcccaggtgaactctgtagacagtacaggcaagactcccctcatgatggcagcagaaaacggtcaaaccaacaccgtcgaaatgttagtgagcagtgcctctgccgaactgacactgcaggataacagcaagaacaccgcccttcacctagcttgttcaaagggtcatgaaacgtccgccttactcatcctagagaagatcacagatcggaaccttatcaacgctaccaatgcagccttgcagactcctctccacgtggctgccagaaacgggctcactatggtggtacaagagttgctcggcaaaggtgcatctgtattggcagttgacgagaacggttatacgccagccctcgcatgcgcaccaaataaagacgttgcagattgcctggctctaattttggcaaccatgatgccagtctcttcctcctccccgctgagctctctgacatttaacgccattaatcggtacaccaacacaagcaagaccgtctcatttgaagctctcccaatcatgcgtaacgagccctcatcgtattgcagcttcaacaatattggcggagagcaagagtatctgtacacggatgtcgacgaattgaatgactcggatagcgagacttattag

SEQ ID NO: 214496 - DNA, 3162 bp, Artificial Sequence
  Description of Artificial Sequence: Synthetic coding sequence
atggccttcttaaagctccgagatcagcccagcttggtgcaggccattttcaacggggatcccgacgaggtaagggcgctaatcttcaagaaggaagatgtcaacttccaggacaacgagaaacggacacctctgcatgccgctgcctatttgggagatgctgaaatcattgagctccttattttatccggcgcaagagtgaatgccaaagatagcaaatggttgactcctctgcatcgggctgtggcctcttgcagcgaagaagctgtgcaggtactgttaaaacatagcgcagacgtaaatgcaagggataagaattggcagaccccgctgcacatcgcagcagccaataaggcagtgaagtgtgccgaggcattagtccccctcctgagtaacgtgaatgtctccgaccgggcaggccgtaccgccttacaccacgcagccttctccggacatggggaaatggtcaaactcctgctgagtaggggcgctaacatcaacgcttttgataaaaaggaccgccgtgctatccactgggcagcatatatgggacacattgaagttgtaaagcttcttgttagtcacggggctgaggtaacatgcaaggacaagaaatcttatactcctctccatgcagccgcaagctcagggatgatttctgttgtgaaatatttgctggatcttggtgtggatatgaatgaaccgaatgcttatggtaacacaccattgcacgtggcttgttacaacggccaggatgtggtggtcaatgagctgatagactgtggcgcaatagtgaaccagaagaacgagaaaggcttcacacccctgcacttcgcggctgcgtccacgcatggggctttatgtctagagcttcttgtgggtaatggagctgacgtgaatatgaagtcgaaagacggaaagacccccctgcacatgaccgcccttcatggtcggttctctaggtctcagacaatcattcagagtggggcagtgattgactgcgaagataagaatggcaacacccccctgcacatcgccgctcggtacgggcacgagctcctcatcaacaccctgatcaccagcggtgccgacaccgccaaacggggaatccatgggatgtttcctctgcatctggctgcgctgtccggtttcagcgattgctgccgcaaactgctgagttccggttttgacatcgataccccggacgactttggacggacatgcctgcacgctgctgctgcgggtggtaacttggagtgtctgaacttacttctcaacaccggagctgacttcaacaagaaagataagttcgggaggtctccccttcactacgccgctgccaattgtaactaccagtgcctgttcgcccttgtgggtagtggcgcatccgtcaacgaccttgatgagcggggttgtacaccactccactacgctgccacaagcgacacagacgggaaatgtcttgagtatctgctaagaaacgatgctaatcccggtatccgcgataagcagggttacaatgctgtacactacagtgcagcatatgggcatagactgtgcctccagttgattgctagcgagaccccgcttgatgtgctgatggaaacaagcggcaccgacatgctgtccgacagtgataatagagccaccatctcgcctcttcatttagccgcatatcacgggcatcatcaagctcttgaggtgctcgtgcagtccctgttggatctagatgtccggaatagttcgggacggacccctctggatctggctgccttcaagggacatgtggagtgcgttgacgtacttattaatcagggagcaagtatactggttaaggactatattctgaagaggaccccaatccacgccgctgcaactaatggccattcagaatgtttacggctcctgataggaaatgccgaaccgcaaaacgctgttgatatacaggatgggaacggacaaacgccactaatgctgagcgtcctgaatggccacacggattgtgtgtactccttactgaacaagggcgctaacgttgatgcaaaggacaagtggggtagaactgctcttcacaggggcgctgtgacaggccacgaagagtgcgtggatgccctgctgcagcacggggctaagtgtttactgagagatagccggggtcggacccccatccacttgagcgctgcttgcggccatatcggagtcctcggtgcccttttgcagtcagccgcatcaatggatgccaacccagctacagctgataatcacggatacaccgcactccactgggcctgctataatgggcatgagacatgcgttgagctgctgttggagcaggaggtgtttcagaagactgagggcaatgctttcagcccactccattgtgccgtgataaacgataatgagggcgctgccgaaatgcttattgatacgttaggagcatctattgttaatgctaccgattctaagggacgaaccccgctgcacgccgctgccttcacagaccacgtagagtgcctccagctcctgctctcccacaacgcccaagtcaattcagtcgacagtacaggcaagacccctcttatgatggcagcagagaacgggcaaacgaataccgtcgaaatgttagtgtcatccgcgagcgcagaactcacactgcaggataattccaaaaataccgctctgcacttggcttgctcaaagggacacgaaacatccgctctcctgatattggaaaagatcactgaccggaatctgataaatgcaacgaatgccgctctgcagactcccctgcatgtagcggctaggaatggactcacaatggtagtgcaggagcttctgggcaagggtgctagcgtgctcgccgtcgatgaaaacggttacacgccggctctcgcttgtgcaccaaacaaagacgtcgcagactgtctggctctgatcctggctacaatgatgcctgttagcagcagttctcccctttcctctctaacttttaatgctatcaacagatacactaatacatctaaaacagtcagctttgaggcactgcctattatgagaaacgagccaagctcatattgcagcttcaacaacattggcggtgagcaggagtacctatatacagacgtagatgagctcaacgattctgactccgaaacatattag

SEQ ID NO: 214497 - DNA, 3162 bp, Artificial Sequence
  Description of Artificial Sequence: Synthetic coding sequence
atggcctttctgaagctgcgagaccagcccagcctggtacaggcgatattcaatggagatccagacgaggttagggctctcatattcaagaaggaggacgtgaactttcaggacaatgaaaagaggactccattgcacgccgcagcctacctcggcgatgcagagattattgagctgttgattctgagcggtgccagagtgaacgctaaggactctaaatggctgacccccttacatcgcgcagtggcaagctgttctgaggaggcggtgcaagtgcttctgaaacactccgcagacgtcaacgcacgcgataaaaactggcaaactcccctgcatattgcggcagcaaacaaagccgttaagtgcgcagaagccctcgtgcccctgctgtccaacgtgaacgtgagcgatcgggctggtagaaccgccttacaccacgccgctttttctggccatggggaaatggtgaagctccttctcagccggggagcgaacatcaatgcttttgataagaaggaccggagggctatccattgggctgcctacatggggcacattgaagttgtgaagcttttagtcagccacggcgcagaggtgacctgtaaggacaaaaagagttacacccccctgcatgcagctgcgagctcaggcatgataagcgtagtgaagtacctccttgatttgggcgtcgacatgaacgaacctaacgcttacggaaacaccccactccatgtcgcctgctataatggccaggacgtggttgtcaacgagctcatagactgtggggctatcgtgaaccagaaaaatgaaaagggttttacccctctacattttgccgcagcctccactcacggcgctctgtgtctggaactgctcgtgggcaatggggcagatgttaacatgaagagtaaagacggtaaaacgccattgcatatgactgcgctccatggcaggttctccagatcacagaccatcatccaatcaggcgctgttattgattgcgaggataagaatggcaatacgcccctgcacatcgccgcacggtatggacacgaactcctgataaatactctgattacatctggcgcagacaccgccaagaggggaattcatggaatgtttccgctccacctcgcagctctgtcggggtttagtgattgctgtaggaaattgctgagcagcggtttcgacattgacacccctgacgatttcggcagaacctgcttgcatgcggcagcggcaggaggaaacctggagtgccttaacctgctattgaatacaggcgcagacttcaataagaaggataaattcggcaggtccccactgcactatgctgctgcaaattgtaactatcagtgtctgttcgccttagtaggctcaggcgcatcggtcaacgatcttgacgaaagaggctgcacgcccctccactacgccgcaacctccgacactgatggcaaatgcttggagtatctgctgcgtaacgacgccaaccctggaataagagataagcagggctacaatgcggtgcattactccgccgcatatgggcacaggctttgcctgcagcttatcgcctctgaaactcctctggatgtgctcatggaaacatccgggaccgatatgctgtctgatagcgacaaccgtgccaccattagccctttgcatctcgcagcttaccatggacaccatcaggccctggaagtgctggtccaatcactgctggacctggatgtgcgaaacagctccggaaggacgccactggacttagcggcatttaaaggacacgtggaatgtgttgatgtgctcattaaccaaggcgcaagcattctcgtcaaagactatatactgaagcgaaccccgatccacgctgctgccactaacgggcatagcgagtgtcttagattgctcattggtaacgccgagccacaaaatgccgtggatatccaggatgggaacggtcaaacaccattgatgcttagtgttttgaacggccatacggattgtgtgtattcactgttgaataaaggggctaacgtcgacgcaaaagacaaatgggggaggacggccctccaccgtggagccgtgaccggccatgaagagtgcgtcgatgccttattacagcatggggctaagtgtctcctcagagattccagggggagaacccctattcacttgtctgctgcatgcggccatatcggcgtgctgggcgctctactgcagtctgccgcttcaatggacgcaaatcccgctactgccgacaaccacgggtacactgctttgcactgggcttgttacaatggccacgaaacctgtgtggagctgctgttagaacaggaagtgtttcagaagaccgagggaaatgcttttagccccctccattgcgctgtgattaacgataatgaaggagcggctgagatgcttattgacaccctgggcgcaagcatcgtgaacgccacggatagtaaagggaggacgcccctacacgcagccgcattcactgaccacgtcgagtgtcttcagctcctgctgtcccacaacgcccaggttaacagtgtggattcaactggcaagactccgctaatgatggctgcagagaatggacagactaacacagtggagatgctggtgagttccgcttcagcagaactgaccctgcaagacaactctaagaacacggctttgcatctcgcttgctcaaagggtcacgaaactagtgctctgctgattctggaaaagatcaccgatcgcaaccttatcaatgcaacaaatgccgctttgcaaactcctcttcacgtagcggctcggaatgggcttaccatggtggtgcaagaactgctggggaagggcgcttcagtgctggcagtcgacgagaacggctatacaccggcactcgcatgtgctccaaataaggacgtggctgactgcctggctctgatactggctacgatgatgcctgtcagcagcagtagccctctcagttcattaacctttaatgctatcaatcgatacaccaatacaagcaagactgtgtctttcgaggcccttcccataatgcgtaacgagcccagcagttactgttcattcaataacatcggcggagagcaagagtacttatacacagatgtggatgagttaaacgacagtgattccgagacctactag

SEQ ID NO: 214498 - DNA, 4026 bp, Artificial Sequence
  Description of Artificial Sequence: Synthetic coding sequence
atgactaagcggaagaagacgattaatttgaacattcaggacgcccaaaagcggacagccctgcattgggcatgcgtcaatggacatgaggaagttgtgacatttttagtcgacaggaaatgtcaactcgacgtcctggatggcgagcaccgcacccccttaatgaaagcccttcagtgccatcaagaagcgtgtgccaatatccttatcgacagtggggcagatatcaacctggtggatgtctacgggaatacagcactgcactatgccgtttattctgaaatccttagtgtggtggctaagctgctgtctcatggggcagtgattgaggtgcataacaaggcttctctcacaccgctcctcctgagcataacaaaacggtcagagcaaattgtggaattcctcttaatcaagaatgcaaatgccaatgctgtcaacaaatataagtgcacagcactgatgctggccgtctgtcatggctcatcagagattgtgggcatgcttctgcaacagaacgtggatgtttttgctgccgatatctgcggcgtaaccgcagagcactatgccgtgacttgtggtttccatcatattcacgaacagattatggaatatatacgcaaactgtctaaaaaccatcagaatacaaacccagagggaacctcagctggtacccccgatgaagcggctcccttagccgaacgcactccggataccgctgagtcgctggttgagaaaacccccgacgaagcagcgcctctggtggaacgtacgcccgatacggcagaaagcctcgtggagaaaacacctgatgaggcagcgagcctcgtggaagggacatctgacaaaatccaatgcctggagaaggctaccagcggcaaattcgaacagtcagcagaggagactcccagagagattaccagtccagcaaaggagacctcggagaaattcacctggcctgccaagggcagaccccgtaagatagcatgggaaaagaaggaggacaccccacgcgaaatcatgagtccagccaaggagacttcggagaagtttacctgggcagccaaaggcagacccagaaaaatcgcatgggaaaaaaaggaaaccccggtgaaaacagggtgtgtggcaagagtgaccagtaataagacaaaggtgctggagaaggggagatcaaagatgatagcttgccccactaaagagtcaagcacaaaagcttcagccaacgatcagcggttcccgagcgaatcgaagcaggaagaggacgaggagtacagctgtgattcccggagtctgtttgaaagctctgccaagattcaggtgtgcatccctgaatcaatctatcaaaaggtgatggagattaaccgtgaggtggaagagccacctaagaagccctccgcttttaagcccgcaatagagatgcaaaactcagtacctaacaaagcgttcgaactgaagaacgaacagactctgcgtgctgatccaatgttcccacccgaatctaagcagaaggattatgaggaaaatagctgggattccgagagcctgtgcgagaccgtatcacagaaagatgtctgcctgcccaaggccacacaccagaaagaaatcgacaaaattaatggtaagttggaagagtcaccaaataaggacggcctgttaaaggctacatgcggtatgaaagtgagtattccaacaaaggcactcgaactcaaggatatgcagacattcaaagccgagccaccgggaaaaccctccgcttttgagcccgcaactgagatgcagaagtctgtacctaacaaggccctggaactgaaaaatgaacagacactgcgggctgacgagattctcccttcagagagcaagcagaaggattacgaagaaaattcttgggacacagagtccctgtgtgaaaccgtgagccagaaggacgtctgcctccctaaggcggcacaccaaaaagaaatcgataagataaacggtaagctggaggggtcccccgtaaaggatgggttgctgaaggccaattgtggcatgaaggtgagcatccctacaaaggccctggagctcatggacatgcagacattcaaggcagagcctcctgagaaaccgtccgccttcgaacctgctatcgaaatgcagaaatccgtgccaaacaaagccctcgaactgaagaacgaacaaaccctgcgagcagacgagattctgccttctgaaagcaagcagaaagactatgaggagtcctcgtgggactcagagtccctttgcgagaccgtctctcagaaggacgtctgcctgccaaaggccacccaccaaaaagagatcgacaaaattaacgggaagctcgaggaatctcccgataacgacgggtttctaaaggctccctgtaggatgaaagtgtctatacccacgaaagcccttgagctcatggacatgcagacatttaaggctgagcctcctgaaaaacccagcgctttcgaaccggctatcgaaatgcagaagagcgttccaaacaaggccctggagctaaaaaatgaacagactctgagggccgatcaaatgtttccctccgaatccaagcagaaaaaggtggaggaaaattcttgggatagcgagtccctgcgtgagacggtcagccagaaagatgtatgcgttcccaaggctacacatcagaaggagatggacaaaatatccggaaagctggaggacagtacctctctgagcaaaatcctagatacagtgcacagttgtgaaagggccagagagctccagaaagaccattgtgagcaaagaacagggaaaatggaacaaatgaaaaaaaaattttgtgttttaaaaaagaagctcagcgaggcaaaagagatcaagagtcagcttgaaaatcagaaggtcaagtgggagcaggaactctgttcggtcaggcttaccctcaatcaggaagaggagaaaagaagaaacgctgacattttgaacgagaagatcagagaagagcttggcaggattgaggagcagcatcggaaagagctggaggtcaagcagcaattagagcaggctctccgcatccaggatatcgagctcaagagcgtcgaatctaatttaaaccaggtgagccatactcatgagaacgagaattatctcctacatgagaattgcatgctcaaaaaagagattgccatgctgaaactggaaatagctactttgaaacaccagtaccaagaaaaagagaataagtacttcgaggacattaagatcctcaaagaaaagaacgccgagttgcaaatgactctaaaactgaaagaggaatctttgacgaagcgggcatcccagtacagcggccagctgaaggtcttgatcgccgagaacactatgttaacctctaaactcaaggagaaacaagacaaggaaattctggaagccgagatcgaatcccaccacccaaggctggcatctgcggtacaagaccacgaccagatcgtcacctcccgtaagagtcaggagcctgcgttccatatcgccggagacgcgtgcttacagagaaagatgaacgttgacgtgtcatcaaccatctacaacaacgaggtgctgcatcagcctctgagcgaggcccagcgcaagtctaagagtctcaaaattaacctgaattatgcaggcgatgcactgcgtgaaaacacactcgtcagcgagcacgcacagcgtgaccagcgcgaaacccagtgccagatgaaagaggccgagcacatgtaccagaacgagcaggacaatgtgaacaagcatactgagcagcaggagtcactggaccagaaactgttccagcttcagtccaaaaatatgtggctgcaacaacaactcgttcacgcgcacaaaaaagccgacaacaagtccaaaattacaattgacatccatttcctggaaagaaaaatgcagcatcacctgctgaaggagaaaaatgaggagatttttaactacaacaaccacttaaaaaaccgaatctaccagtacgagaaagagaaggcagagactgaaaactcatag

SEQ ID NO: 214499 - DNA, 360 bp, Artificial Sequence
  Description of Artificial Sequence: Synthetic coding sequence
atggggacccgcaccttacaatttgaaatctccgatagtcacgagaaggaggaggacctgctgcacaaaaaccatctcatgcaggacgaaattgcccgtctacgtctggaaatccatactataaagaatcagatcttagagaaaaaatatttaaaagacatagagattattaagcgtaaacacgaggaccttcagaaggccttgaagcaaaacggcgagaaaagtacaaaaaccatcgctcactactcaggccagctgacagcccttaccgacgaaaataccatgctaagaagcaagctggaaaaggagaaacaatctaggcagagactaactaagtggaaccacaccatcgtggactag

SEQ ID NO: 214500 - DNA, 759 bp, Artificial Sequence
  Description of Artificial Sequence: Synthetic coding sequence
atgtcccaggcagccaaggcatccgcctctgcaacggtggcggtgaatccgggacctgacaccaaaggaaaaggggctccacctgccggaacgtccccttcaccgggtaccacactcgcacccaccacagtccctataacaagtgccaaagccgctgagctcccacctgggaattacaggctggtcgtgtttgagcttgagaatttccagggacgacgcgctgagtttagcggagaatgttcgaacctggctgatagaggcttcgaccgggtcaggtccattatcgtgtcagcaggaccatgggtagccttcgaacagtctaatttcaggggggagatgttcattttggaaaaaggcgaataccccagatggaatacttggagcagcagttacagatctgatagactgatgtcttttcgccctatcaaaatggacgctcaggagcacaaaattagcctcttcgagggcgcaaactttaaggggaacacaatcgagatccagggagatgacgcacccagtctttgggtgtacggcttttccgatcgggtgggcagcgtcaaggtgtcttctggtacttgggttgggtaccagtatcccggttaccggggataccagtatctgctggagccgggtgactttcgtcattggaacgaatggggggcattccagccccaaatgcagtcccttcggcgtcttcgggacaagcagtggcacctcgaaggcagctttcccgtgctagccaccgagccacctaaatag

SEQ ID NO: 214501 - DNA, 627 bp, Artificial Sequence
  Description of Artificial Sequence: Synthetic coding sequence
tagagagatgagttgagatgcaagattccagccggacggctgcggagagcagccagaccccatcgaagactggggcctactggcaaggaagtgcatgccctaaagcggcttagagattcagccaacgcaaacgatgtggaaactgtacagcagctactggaggatggggctgacccatgcgctgccgatgacaagggtcggacggctctgcacttcgccagttgtaatggtaacgatcaaattgtgcagctccttctggatcacggagccgacccaaatcaaagggacggccttgggaacactccgctgcacttagaatgttcccctcagctagttcccgctggcgcacgtgtggatgcgctggatcgtgccggtcgaaccccactgcacctggccaaatcaaagctcaatatccttcaagagggacatgcacagtgcctggaagccgttagactcgaagtcaaacagattattcacatgctgagggaatacctagaaagacttgggcaacacgagcagcgggaacgcctcgacgacctgtgcacaagactccaaatgaccagcaccaaggaacaagtggacgaggtgaccgacctgctggcttcttttacttccttgtccctatag

SEQ ID NO: 214502 - DNA, 2184 bp, Artificial Sequence
  Description of Artificial Sequence: Synthetic coding sequence
atgtcacagcaggatgcagttgctgccttaagcgagcgcttgctcgtggctgcatacaagggccagacggagaatgtggtgcagctcatcaataagggcgctagagtagccgtgacaaagcacggccgaacgcctttacacctggccgctaataaaggtcacctccccgtggttcagattttgcttaaagctggctgtgacttagacgtgcaggatgatggggatcagacagctctgcacagagccaccgtggtaggcaacactgaaatcatagccgctttgattcacgagggctgtgcactggatagacaggataaggatggcaatactgctcttcatgaggcttcttggcatggtttctcccagtccgcaaagttactcataaaggccggagccaacgtcttagctaagaacaaagccggtaacaccgcgctccacctggcatgccaaaattctcatagccagtctactagagttctcctgctggcagggtcccgcgctgacctgaagaacaatgcaggcgacacgtgccttcacgttgctgcccgatataaccatttatctataatccggctattattgaccgcgttctgctccgttcatgagaaaaatcaagccggagataccgcactccacgtggctgccgctttgaatcacaaaaaggtagcgaaaattctgttggaagccggtgctgacaccaccatcgtgaataacgcgggacagacgcccctcgagaccgcacgctatcacaataaccccgaggtggccctcctgcttactaaggcaccacaggtgttacgcttctcccgtggacggtctctgcgcaagaaacgagagcggttaaaggaggagcgtagggcgcagtctgtgccacgagacgaagtcgcccagtccaagggcagtgtatctgcgggtgatacacctagcagcgagcaggccgtggcccgaaaagaagaggcccgagaagagtttttgagtgcttctccagagccccgtgcaaaggacgatcggagaagaaaaagtcgtccaaaggtgagcgccttttccgaccccaccccgccagctgaccagcagcccggtcatcagaaaaatttgcacgcgcacaaccatcccaagaagaggaaccgccaccgctgttcctccccccctccccctcacgaattcagggcttaccagttgtacaccctgtataggggcaaggacgggaaggttatgcaagccccaatcaatggttgcagatgcgaacccctgattaacaagctagagaaccagctcgaggccacggtcgaagagatcaaagcagagctggggtccgtacaggacaagatgaatactaaactggggcagatggagaataagacccaacaccagatgagggtcctcgacaaactgatggtggaacgtttgtctgccgaacgcacagaatgtttaaaccgcctccaacagcatagtgacacggaaaaacatgagggggaaaagaggcagatcagcctggtggatgaactaaagacttggtgcatgctgaaaattcagaatttagaacaaaaactgtctggagacagtcgagcctgccgcgctaagtcaacccccagtacctgcgagtccagtaccggagttgatcagctcgtggttaccgccggacctgctgcagcctcggatagttccccccctgtggtcagacccaaagaaaaggccttgaactctactgctactcaacggttgcagcaggaactctcttccagtgactgcacaggatctagactgaggaacgtgaaggttcaaacagcactgctcccaatgaatgaggccgctcgcagtgatcagcaggccggaccgtgcgtgaaccggggaactcaaacgaaaaaaagcggaaaatccggccctacccgccatcgagcccaacagcctgcggcatcctccacatgcgggcagccccctcccgctaccgggtctgagcaaaccggccctcatatcagagacactagccaggccctcgagctgactcagtactttttcgaggcagtctctactcaaatggagaagtggtatgagcgaaaaatcgaggaggccagaagccaagcaaaccagaaagcgcagcaggacaaagccactctcaaggaacacataaagtccctcgaggaggagcttgctaaactgcgaacaagggtgcaaaaggagaattag

SEQ ID NO: 214503 - DNA, 2079 bp, Artificial Sequence
  Description of Artificial Sequence: Synthetic coding sequence
atgagtcagcaagatgccgtggccgctcttagcgagaggcttctggtcgcagcctacaagggccagacagagaatgtcgtgcagctgataaataaaggtgctagggtggcagttacgaagcatggcaggacaccacttcatctcgccgctaataaagggcacttacctgtggtacaaattttgctgaaggcaggctgtgacctggatgtacaagatgacggcgaccagactgctctgcatcgagccaccgtagttggtaacaccgagatcattgctgcgctcatccacgagggatgtgcattggatcggcaggataaagatggtaacacagcattgcatgaagcatcatggcacgggttttcccaatcagcaaagttgttaatcaaggccggagccaacgtgctggccaagaacaaagcgggtaatacagccttgcatttggcgtgtcaaaacagccattctcaatcaacccgggtacttctgctggccggttcccgcgcagatctcaagaacaatgccggtgacacctgcctgcacgtggccgcaagatataatcacctctccatcatccggctgctgctcaccgcattttgctcagtacatgaaaagaaccaagcaggtgatacggcccttcatgtggccgctgcgctgaaccacaagaaggttgcaaagatcttgctagaagctggagccgacacgaccatcgtgaacaacgcgggacagacaccattggagactgccaggtaccacaacaaccccgaagtggctctgttattaaccaaggctccccagggctccgtatcagccggagacactccaagcagcgaacaggctgtggctagaaaggaggaagcaagagaggaatttctgtccgctagtccggaaccacgcgctaaggatgaccgacgcaggaaatcaagaccgaaagtctccgcattcagcgaccccactccccctgctgatcaacagccagggcaccagaagaaccttcacgcccacaaccaccccaagaaaagaaatcgccaccggtgctcatccccgccacccccacatgagttcagggcttatcaactgtatacactctatcggggaaaggacggaaaggtgatgcaggccccaattaatggatgtaggtgcgaacctcttataaataaactggagaaccagctggaggctaccgtcgaagaaattaaagctgagctcggatccgtgcaggataagatgaacacaaaattgggtcagatggaaaacaaaacccagcaccagatgagagtcctcgacaaactaatggtggaaaggctgagcgctgaaagaactgagtgtctgaaccgcctgcaacagcatagcgataccgaaaagcacgagggcgagaaaagacagataagtttggtcgatgagcttaagacttggtgcatgcttaaaattcagaatctggagcaaaaactctctggggactctagagcctgtcgagcaaaatccacgccctccacgtgtgaaagctctacaggcgtcgatcagctcgtggtcaccgcaggaccagcggcagcctccgacagctcacccccagtggtgcggccaaaagagaaggcactgaactccaccgccacgcagcgcttgcaacaagagttaagctcctcagattgcaccggctcacgactccgtaatgtgaaggtacagactgcgctactacctatgaacgaagctgctaggtccgatcagcaggccggtccttgcgtgaatagaggaacccagacaaaaaagtctggtaagtcgggacctacgaggcaccgggctcagcagcccgcagcgagtagcacgtgcggccagcctccccctgctactggatcagagcagactgggccacatatacgcgatacctcacaggcgctggagctgactcagtactttttcgaggctgtctccacccaaatggagaagtggtacgaaaggaaaatagaggaggcacgatctcaggcaaaccagaaggcacagcaggacaaggccactctgaaagagcatatcaagagccttgaggaggagctggcaaaactgaggacaagagtacaaaaagagaattag

SEQ ID NO: 214504 - DNA, 2169 bp, Artificial Sequence
  Description of Artificial Sequence: Synthetic coding sequence
atgtctcaacaggacgccgtcgctgcactctcagagcgcctacttgtcgccgcatacaagggccaaaccgaaaacgttgtacagttaatcaataaaggggctagggtcgcagtgaccaaacacgggaggacccctctccatcttgctgctaataaagggcacctacccgtggtccagatcttactcaaggctgggtgtgacctcgacgtgcaggacgacggagatcagactgctcttcaccgcgctactgtggtcgggaataccgagataatcgcagcgctcatccacgaagggtgcgccctggacaggcaggacaaggatgggaatacagcgctgcacgaggcatcttggcacggcttctcccagagtgccaaacttctgataaaagccggagccaacgtcctagcaaagaataaggcaggaaacacggcgctgcacctggcatgccaaaattcccacagccagagcacaagagtcttgttgctcgcgggttcacgcgcagatctcaagaacaacgctggggatacgtgcctgcacgtcgctgcgagatacaaccacctctctattatccggctcctactgactgccttttgtagcgtgcacgagaagaatcaggccggagacaccgccctccacgtcgcggcagcacttaatcataaaaaagtggccaaaatcctcttggaggcaggcgcagatactaccattgtgaataacgctggacaaacccctctcgagaccgccagataccataataaccctgaggtagcgttgctcctgactaaggctccacaagttttacggttctcacgcggaagatccctgcgaaaaaaacgcgaaagactaaaggaagagagaagggctcagtctgtgcctagggatgaggtggcgcagagcaagggaagcgttagcgcgggagacaccccaagcagcgaacaggcggtcgcccgtaaggaggaggcccgagaagagttcttgagcgcatccccagagccaagggctaaggatgacagaagacgcaagtcacgccctaaagtcagcgcctttagtgaccccaccccaccggcagaccagcagccaggacaccaaaaaaacctgcacgcacataatcacccaaagaagcgtaatcgccaccgctgctcttctccaccacccccacatgaattcagagcttatcaactctacaccctgtaccggggtaaggatggaaaagtgatgcaagccccaatcaatggatgtcgatgtgagcctctcatcaacaaactggagaaccagctcgaggctaccgtggaggagataaaggcggaactgggtagcgtccaggacaaaatgaatactaagctgggtcagatggaaaataaaacccagcaccaaatgagagtactggacaagttgatggtcgagcgattgtccgccgagcgaaccgagtgtcttaatagactccagcagcactcagacactgagaagcacgagggggaaaaaagacagatctccttggtcgacgagctcaagacctggtgtatgctgaagattcagaatctggagcagaagctctctggcgactctcgagcttgccgagcaaaatccacaccttctacgtgcgtggaccagctggtagtgaccgcgggtcccgctgcagctagtgacagctctcctccagttgttcgtcctaaggaaaaagcactcaacagcaccgctactcagcggcttcaacaggagctgtccagctccgactgtaccggctctaggctccggaacgtgaaagtccagaccgcgctactccccatgaatgaagcagcccgatcggatcaacaagctggaccctgcgtcaacagaggtacccagacaaaaaagtccggtaaatctggaccaactagacatagagcccagcaacctgcagcttcatcaacatgcggacagccacccccagctacagggtccgagcagactgggccacacatccgggatacctcacaggctcttgaactcacgcagtacttcttcgaagccgtgtccacgcagatggagaagtggtatgagcgaaagatagaggaggccaggagtcaagccaatcagaaggcccagcaggacaaggcaactctgaaagaacatattaagagccttgaggaggaactcgctaagctgcgcaccagagtgcagaaggaaaattag

SEQ ID NO: 214505 - DNA, 528 bp, Artificial Sequence
  Description of Artificial Sequence: Synthetic coding sequence
atgtctcagcaagacgccgtggccgctctgagcgagcgcttgctggttgccgcttacaaagggcagactgaaaacgttgtgcaacttatcaacaaaggcgctcgtgtggcagttacgaagcacgggaggacccctcttcacctagctgcgaacaagggtcatctgcccgtggtgcagatcctcctcaaagccggatgtgatctcgatgttcaggatgacggagatcagactgcccttcatcgcgcaaccgtggttggaaacaccgagattatcgctgcactgatccacgagggatgcgcactggataggcaggataaagatggcaatactgctctgcatgaagccagttggcacgggttctctcagtctgcaaaactccttattaaagccggagccaacgtgctggccaagaacaaagcaggaaatacggcattgcatctcgcatgtcagaacagccactctcagtccacccgagtgttgctactggcagggtcaagagccgacctcaaaaataacgccggagattag

SEQ ID NO: 214506 - DNA, 243 bp, Artificial Sequence
  Description of Artificial Sequence: Synthetic coding sequence
atgagtcaacaggatgctgtcgcagctttgtctgagcggctgctggtcgcagcgtataagggtcagaccgaaaacgtggttcagctcatcaacaagggcgctcgcgtcgcagtaacaaaacacgggcgtacacccctgcatttggccgctaacaagggacatcttccggtcgttcagatcctgctgaaggcaggatgcgatctggacgtgcaggatgacggcgaccagactgcgctgcattag

SEQ ID NO: 214507 - DNA, 2184 bp, Artificial Sequence
  Description of Artificial Sequence: Synthetic coding sequence
atgtcccaacaggatgcagtggctgctctgtccgagaggctcctcgtagccgcatacaaggggcagacagagaacgtcgttcagctgatcaacaagggtgccagggtggccgtgaccaaacatggtcggaccccactccacctggccgctaacaagggacatttgcctgtagtccaaattttattgaaggccggatgcgatttagatgtgcaggatgacggcgatcagacagctctccacagagccacggtggtgggcaacaccgagatcattgcggctttaatccatgagggttgtgcactggacagacaagacaaagacgggaatacggcgttgcacgaggcctcatggcacggcttttcccaatctgccaagctcctgatcaaggcgggagctaatgtgctcgccaagaataaggcgggaaatactgccttgcatttagcctgccagaatagtcactctcaaagcacgagagttttacttcttgctggctctagggctgatttgaagaacaatgccggtgatacatgcctgcatgtagctgccaggtataaccacctgtccattattagactgctactaaccgccttctgttccgtgcacgagaaaaatcaggcaggtgatacagccttacacgtggccgcagctctgaatcacaaaaaggtggcaaagatcctcctcgaggccggtgctgatactaccattgtgaataatgccggacagactccactggagacagctaggtatcacaacaatcctgaagttgcacttctgctcactaaggctccgcaggtgttgcgcttttcccggggtaggtctcttagaaagaagagggagcggttaaaggaggagagacgagctcagagcgtgccaagagatgaggtggcccagagcaaaggcagtgtgtccgccggtgatacccccagtagcgagcaggccgttgccaggaaggaagaagcacgagaggaattcttgagtgctagccccgaaccccgtgcaaaggacgaccgacgcaggaaaagcagaccgaaggtgagcgcgttttctgacccgacgccacccgctgatcaacagcccggtcaccagaagaatctgcacgcccataatcacccaaagaaacgaaataggcataggtgctcttcacctcccccaccacacgaatttagggcttaccaattatacacgctgtaccggggaaaagacgggaaggtgatgcaggccccaataaacggctgtaggtgcgaaccgcttataaacaaattggaaaatcagctggaagctacggtggaggaaatcaaggcggagctgggaagcgtacaggacaaaatgaatacaaaactgggccagatggagaacaaaacacaacaccagatgcgcgtattagacaagctgatggttgaaagactgtctgctgaacgaaccgaatgtctcaatcgtctgcagcagcattccgataccgagaagcatgagggcgagaaaagacagattagccttgtcgatgagctcaagacctggtgcatgctcaaaattcaaaatctagagcaaaagttgtccggggattcccgggcatgccgggcaaagtcaaccccgagtacatgcgagtcctccaccggggttgatcagctggtggtgaccgccggacccgctgctgctagtgacagctcgcccccagtggtccgcccaaaggaaaaagcactaaacagtacagcaacgcaacgtctgcaacaagagctctcatccagtgattgtacagggtcaagactcaggaatgtgaaggtgcaaaccgcactcctccctatgaacgaagcggcaaggtccgaccagcaagcaggcccttgtgtaaatcgaggcacacagactaagaaatctggcaagtctggtccaacaaggcaccgcgctcagcagcccgctgcatcttccacttgcggacagccacccccagccaccggtagcgaacagaccggaccccacattcgagatacgtcacaggcactggagctgacccaatatttctttgaagctgtgagcacccagatggaaaaatggtacgagcggaaaatcgaagaggctcgatcccaggccaaccaaaaagcccagcaggacaaggctaccctcaaagagcacattaagtcccttgaagaggaactggctaaactcaggacccgggtccagaaggagaactag

SEQ ID NO: 214508 - DNA, 357 bp, Artificial Sequence
  Description of Artificial Sequence: Synthetic coding sequence
atgagccagcaggatgctgtcgcggctctgtccgagcggctgctggtggcggcttataagggccagacagagaatgtcgtccagcttattaacaaaggcgctcgggtggccgtaaccaaacatgggaggacgccccttcacctggccgcaaacaaagggcatctcccagtggttcagatcctcttgaaagccggatgtgatctcgacgtgcaagatgacggtgaccagacagcacttcatagggccaccgtggtgggcaacactgagataatagctgctcttattcacgaagggtgtgctctggaccgccaggacaaggatgggaacactgccctccacgaggccagctggcactag

SEQ ID NO: 214509 - DNA, 309 bp, Artificial Sequence
  Description of Artificial Sequence: Synthetic coding sequence
atgagccaacaagacgctgtagccgcactcagcgaacgtttactggttgctgcctacaagggccagacagaaaatgttgtacaactaatcaataagggggctagagtggccgttactaagcacgggagaacacccctccatctggcagctaataagggccacctgcctgtagtccagatcctgctgaaagctggttgcgaccttgacgtgcaggatgatggagaccagactgccttgcaccgcgcaacagtggtagggaatacagagatcatcgctgcgttgattcacgaaggatgcgcactcgactag

SEQ ID NO: 214510 - DNA, 1992 bp, Artificial Sequence
  Description of Artificial Sequence: Synthetic coding sequence
atgtcgcaacaggacgccgttgctgccctctccgagcggctgctcgtcgctgcttacaaagggcaaacggaaaatgtggtgcagctgatcaacaaaggggctagggtggcagtaaccaaacacggccgtactcctttacacttagccgctaacaagggccatctgcctgtggtgcagatccttctcaaggccggttgtgatcttgatgttcaggacgacggggatcaaaccgcacttcatagagctaccgtggtggggaataccgagattattgccgcactaatccatgagggctgcgccctcgacagacaagacaaggccggtaatactgcactgcacctggcatgtcagaattctcactcacaaagcactcgtgtcttgctactcgctggctccagagcagacttgaaaaacaatgctggtgacacctgcctgcatgtggccgcaagatataaccacctgagcataattcggctgctgctgaccgcattctgctctgtgcacgagaagaaccaggccggagacaccgctctccatgtggccgcagcccttaatcacaaaaaggtggctaagatcctgctggaggcgggtgctgacacgaccatcgttaacaacgtgctcagattctcccggggtcgatccctcagaaagaagcgggagagattgaaggaagagagacgcgctcagtccgttcctcgggacgaggttgcacaatctaaaggctcagtcagcgccggagataccccgagcagcgaacaggccgttgctaggaaggaggaagccagggaagaattcctcagtgcaagccctgagccccgagcgaaagatgataggagacgcaagtctcggccaaaagtcagcgctttctctgacccaaccccgccagccgatcaacagccagggcaccagaagaacctccatgcccacaaccatccaaaaaagcgcaatcgccacaggtgctctagtcctcccccaccgcacgagttccgtgcctaccagctgtacacgctgtaccggggaaaggacgggaaggtgatgcaagcccctatcaatggctgtagatgtgagccacttatcaacaagctggagaaccaattagaggctaccgtcgaggaaattaaggccgagctgggctccgtgcaggataagatgaacactaagctgggccagatggagaacaagacacagcaccagatgcgggtgctggataaactcatggttgagcgcctcagcgccgagaggacagagtgtttgaaccgacttcagcagcacagcgacaccgaaaagcatgagggcgagaaaaggcagatcagcctcgtagacgaacttaaaacatggtgtatgctcaagattcagaatttggagcagaaattgagtggggattctagggcttgtcgagctaaatctactccctcaacttgtgttgatcagttggtggttaccgcgggtcctgccgctgcctcagactcaagcccaccagtggtgcgacccaaggagaaggcactgaatagcacggctacccagcgcctgcagcaagagttatcatctagcgattgcaccgggtcaagactgcggaatgtgaaagtgcaaactgccctactgcctatgaacgaggcagcgagatcggatcaacaggcgggtccatgcgttaataggggcacacagacgaagaagagcggaaagtctggtccaacacgtcatagggctcagcagcccgctgcatcctctacatgcgggcagccaccacccgctactggcagcgagcagactggtcctcatattcgtgataccagtcaagccttagaacttacccagtacttttttgaggcagtcagtacgcagatggaaaaatggtacgagaggaagatcgaggaagcaagaagccaggcaaatcaaaaggcccagcaggacaaagccaccttgaaggagcacattaaaagtttggaggaggaactcgcgaaactcagaaccagagttcagaaggaaaattag

SEQ ID NO: 214511 - DNA, 765 bp, Artificial Sequence
  Description of Artificial Sequence: Synthetic coding sequence
atgaataagctcttttccttctggaaaaggaagaacgagactcggagccagggatataacctgagggagaaggacctgaaaaagcttcaccgggcagctagtgtgggtgaccttaagaaactaaaagaatatctccagattaagaagtacgatgtgaatatgcaggacaagaagtacagaaccccactgcatttggcttgcgctaatggccacacagacgtggtcctttttctgatcgagcaacagtgcaaaatcaatgtgcgcgatagcgaaaacaagagtcccctgatcaaggccgtgcagtgccaaaacgaggactgtgcaactattctcctgaattttggcgcagatcctgacctccgcgatattcgatataacaccgtgctccactacgcagtttgcggtcagtctttatcgctggtggagaaactgctcgaatatgaagctgacctagaggcgaagaacaaggacggttataccccgctcctggtggcagtgattaataacaatcctaagatggtgaagtttctgctggaaaaaggcgcagacgtcaatgctagcgataattatcaacgtaccgcgctgatcctagctgttagtggtgaacctccttgcctggtaaagttgttgctgcagcagggcgtggagctgtgttatgaaggtatcgtagactctcagctgagaaatatgttcatcagcatggtcctgctgcacaggtaccctcagttcacggcctcacacggtaagaaaaagcatgccaagtag

SEQ ID NO: 214512 - DNA, 825 bp, Artificial Sequence
  Description of Artificial Sequence: Synthetic coding sequence
atgaataaactcttctctttctggaaacgcaaaaacgagacacggtcccagggatataatctccgcgagaaggacctgaaaaaactccatagagccgcatctgtgggcgacttgaagaagcttaaagagtatctgcagattaaaaaatatgatgttaacatgcaagacaaaaaatactctgtggtacagtcttcccggtggttgctctcttacacaacacccttgaacgattttattcggactcctctacatcttgcgtgtgcaaacgggcatactgatgttgtgttgtttctgatagaacagcagtgcaagatcaacgtccgggactctgaaaacaaaagcccactcatcaaagccgttcaatgtcagaacgaggattgtgctactatcctgctcaacttcggcgctgatcctgacctgcgtgacattcgctataataccgttctgcattacgccgtctgtggccagagcctgtctctggttgaaaagcttctcgaatacgaagcagatctggaagccaagaacaaggatggatacacgccattgctggtggccgtgattaacaacaacccaaagatggttaaatttctgcttgagaaaggagcagacgtcaatgctagcgacaactaccagcgcactgccctaattttggccgtatctggcgagcccccttgcctagtgaagttactgcttcagcagggtgtggagctttgttacgaaggcatcgtggacagccagctgcgaaacatgttcatttcaatggtgttgctccaccgctacccgcaatttactgcatctcacggaaaaaaaaagcacgccaaatag

SEQ ID NO: 214513 - DNA, 606 bp, Artificial Sequence
  Description of Artificial Sequence: Synthetic coding sequence
atgcaagacaaaaagtaccggactcccctacacttagcttgcgctaatgggcacactgacgtcgtgctgtttcttatcgaacagcagtgtaagattaacgtacgggacagcgagaacaagtccccacttatcaaggccgtccaatgccagaacgaggattgcgccactattctgttgaatttcggcgcagatcccgatctgagggatattcgctataatacagtacttcattatgcagtgtgcggccagagtctgtccctggttgaaaagctcttggagtatgaggccgaccttgaggccaagaacaaggacgggtacaccccgttgcttgtggcagtcatcaacaataatcccaaaatggtgaaatttctgttggaaaaaggggctgacgtaaacgccagcgataattaccaacggacagctctgattctggcagtcagcggcgagcctccatgcctcgttaagctgcttcttcagcagggagtggagttatgttatgaaggtattgttgactcacagcttaggaacatgtttatctctatggttctgcttcatagataccctcagtttacggcaagccacgggaaaaagaaacatgccaaatag

SEQ ID NO: 214514 - DNA, 942 bp, Artificial Sequence
  Description of Artificial Sequence: Synthetic coding sequence
atggacacgagtacaaatcttgacatcggggcacagctgatcgtagaggagtgtccctccacatattctctcaccggaatgcctgacatcaagattgaacacccactggaccctaatagcgaagaagggtcggcacaaggcgtggcaatggggatgaaattcatcctgcccaaccgattcgatatgaatgtgtgttccaggttcgtaaaatctctgaacgaagaggattccaagaatattcaggaccaggtgaacagtgacctggaggttgcctccgtgttatttaaggccgagtgtaatattcacaccagtccttccccagggatccaggtgcggcacgtgtacacaccatcaaccaccaaacacttctcccccattaagcagtccactacgttgaccaacaaacatcgcggaaatgaagtgagcactacccctctgctcgcaaacagcctctccgtccatcagctggctgctcagggagaaatgctgtatctcgccactaggattgaacaggagaacgtaattaaccacacggatgaagaagggttcacacccctaatgtgggccgcagctcacggacagatcgcagttgtggaatttctgttacagaacggtgctgacccacagctcttaggaaaggggcgagagagcgcactaagtctggcctgctccaaaggctatacagacattgttaaaatgctgctcgattgcggggtcgacgtgaacgaatacgactggaacggaggaactccactactgtacgccgtgcacggtaaccatgtgaagtgcgtgaaaatgctgctcgagtcgggagctgatccgacaattgaaacggacagtggttacaatagtatggacctggcggtcgccttaggctaccgcagtgtccagcaggtgatcgaatcacacctgttaaagcttctgcaaaacatcaaagagtag

SEQ ID NO: 214515 - DNA, 1428 bp, Artificial Sequence
  Description of Artificial Sequence: Synthetic coding sequence
atggctgcttccgcccttcgaggtcttccagtggcgggaggaggagagtctagcgagtcagaagatgatggatgggagatcggatacttggacaggacatctcagaaacttaagcggttgctgccaattgaagaaaagaaggagaagttcaaaaaagccatgaccatcggcgacgtctctctagtgcaggagctgctggattcggggatcagcgtggatagcaactttcagtacggttggactcctctgatgtatgcagcaagtgtggctaatgcagagctcgtgagggtccttctggaccgaggcgctaacgcctcatttgaaaaagacaaacagtcgattctgattactgcatgttcagcgcatggctccgaggaacagattttgaagtgtgtggaacttcttctttctaggaacgctgacccaaatgtggcctgccggaggcttatgactccaatcatgtatgcagcccgagacggccatacacaggttgtcgccctgctggtggctcatggtgctgaggtgaacacccaggatgagaacgggtacacggccctgacttgggcagcgaggcagggtcacaaaaatattgttttaaaactcctggagttgggagctaataagatgctgcagactaaagatggaaagatgccgtctgagatagccaaaaggaacaaacaccacgagatatttaacttgctgtccttcacgctcaatccattggagggcaagctgcagcaactgacaaaagaagatacgatctgcaaaatccttacaacggacagcgacagggagaaggatcacattttttctagttatactgcattcggggatctggaagtcttcttgcacggcctggggctggagcatatgacagatctcctcaaggagcgagatatcaccctccgccatctgctgactatgcgcgaggacgaattcactaagaacggcatcacgtctaaggaccagcagaaaatccttgcagctctgaaggagctgcaagtggaggaaatacagttcggcgagctgtcggaagagaccaaactggaaatctctggcgatgagttcctgaactttctgcttaagctcaacaaacagtgcggtcacctgataacagcggttcagaacgtaatcactgagctcccggtgaactcccagaagatcactctggaatgggcttctccgcagaatttcacctctgtgtgcgaggaactcgtgaacaacgtcgaagacctgagcgagaaggtgtgcaagctgaaggaccttattcaaaaactgcaaaatgagcgggagaacgaccccacccatatccaattgcgggaggaagtgagcacttggaactcccgcatcctgaagcgcactgctatcactatttgtggattcggatttttgctcttcatatgcaagttgactttccaacgtaagtag

SEQ ID NO: 214516 - DNA, 1041 bp, Artificial Sequence
  Description of Artificial Sequence: Synthetic coding sequence
atggctatggttagcgaatttctgaagcaggcctggttcatagaaaacgaggaacaggaatacgtgcagaccgtaaaatcctctaaaggcggtccgggttctgcagtcagtccttatccaacatttaatccctcttccgatgtggccgcactgcataaggctattatggtaaagggtgtcgacgaggctactataatcgacatccttaccaaacgcaacaatgctcagcgtcagcagatcaaggccgcttaccttcaggagactggtaagcccctggacgagactttaaagaaagctctgactgggcacctggaagaggttgtgttggcactcctgaaaactcctgcccaattcgacgcagacgagctccgcgcagcaatgaagggactcggcactgacgaagacacactcattgaaatcctcgctagcagaaccaacaaagaaatccgtgacatcaatcgcgtatatcgggaggagctgaaacgagacctcgccaaagacattactagcgacactagcggcgattttaggaatgctctactgagtctggccaagggtgatagatccgaggattttggtgttaacgaggatctggcagacagcgacgcccgagccctctacgaagctggggagagaagaaagggcaccgacgtgaacgtgttcaatacgattctgactacccgtagctacccccagttacggagagtctttcagaagtacacaaaatactcaaaacacgacatgaataaggtgcttgacctggagctgaagggggatatcgagaagtgtctaactgccattgtgaagtgcgccacatcaaagccagcattctttgcagaaaaactgcatcaggcaatgaaaggagtaggtacgagacataaagctcttatccgcatcatggtgagcagaagcgaaattgatatgaacgatatcaaggccttctaccagaaaatgtacggtatttcactgtgtcaggctattctcgatgagacaaagggtgactatgagaagatcctggtcgctctgtgtggcggaaattag

SEQ ID NO: 214517 - DNA, 1041 bp, Artificial Sequence
  Description of Artificial Sequence: Synthetic coding sequence
atggccatggtgtctgagtttcttaagcaagcttggtttatagagaacgaagagcaggagtacgtccagacagtgaagagctctaagggcggacccggttctgcggttagcccgtacccaacctttaacccctcctccgatgtggccgctctccacaaagccataatggtcaagggggtggatgaagctacgatcattgacattctgaccaagcgaaacaacgcccaacgacagcagatcaaggcagcctatctgcaggagactgggaagccactggatgagaccctgaaaaaggcgctgacagggcatctggaggaggttgttcttgccctcctaaagacaccggcacaattcgacgcagatgagctcagggccgcaatgaaaggcctcggcaccgacgaggacacgctgatcgaaatcttagcaagccgtactaataaagagatcagagacatcaaccgcgtgtacagagaagagctcaagcgcgaccttgctaaagatatcacttcagacacatccggagacttccgcaatgccctgctatccctggcaaagggtgacagatccgaagactttggtgtgaatgaagacttggcagatagcgacgcccgtgcgctgtacgaggcaggcgagaggcgcaagggcacagacgtgaatgttttcaacactattctgacaacaagaagttacccccagctcagacgagtgtttcagaaatacaccaaatacagtaaacacgacatgaacaaagtgctcgacctagagcttaagggcgatattgagaagtgtctaacggcgattgttaaatgcgcgaccagcaaaccagcattctttgccgaaaaattacaccaggcaatgaaaggcgtcggaactagacacaaggcactcatcaggatcatggtttctaggtctgagatcgatatgaatgatatcaaggcgttctatcagaaaatgtacggcatttccctttgccaagctattctggatgaaactaagggggattacgagaagattctagtggcactctgcggtggtaactag

SEQ ID NO: 214518 - DNA, 348 bp, Artificial Sequence
  Description of Artificial Sequence: Synthetic coding sequence
atggccatggtgtcagagtttctcaagcaagcatggtttatagagaacgaggagcaagagtatgtacaaactgtcaaatccagcaagggaggacccggtagtgcggttagtccctatccgacattcaacccctcatctgatgtggccgcactccataaggcaattatggtaaagggggtagatgaagcgactataattgatattctcacaaagcgcaataacgcccagagacagcagattaaagcggcatatctgcaggagacaggaaagcccctggacgagacacttaaaaaggcacttaccggccacctcgaagaggttgttctggccctgttaaagacaccatag

SEQ ID NO: 214519 - DNA, 615 bp, Artificial Sequence
  Description of Artificial Sequence: Synthetic coding sequence
atgaacctgatactgcggtacacgttcagcaaaatggccatggtgagtgagttcctgaaacaggcttggttcatcgaaaatgaggaacaggaatacgtccagacagtaaaaagcagcaaaggcggtcccggatctgcagttagtccttaccccaccttcaaccctagctccgacgtcgcagctttgcacaaggcgataatggtaaagggggtcgatgaagctaccataattgatattctgacaaagagaaataatgctcagagacagcaaattaaggccgcttaccttcaagaaaccgggaagcccttagacgagaccctgaagaaggccctaacaggccacttagaggaggtcgtgctagctcttctcaaaacacccgctcaattcgacgcagatgaactgcgggctgcgatgaagggcttaggaactgacgaagatacactaattgagatcctggcaagtagaacaaacaaagagattcgagatattaacagagtctatcgtgaagagctgaaacgggatctcgcaaaggatattacttcagatacatctggcgactttcgaaatgccttactgtctttggctaaaggcgatagatctgaagattttggctag

SEQ ID NO: 214520 - DNA, 975 bp, Artificial Sequence
  Description of Artificial Sequence: Synthetic coding sequence
atgttctgtggagactacgtgcagggcacaatttttccggcacctaatttcaatcctatcatggatgcgcagatgttgggaggagctctccagggctttgattgcgacaaggatatgcttatcaacatactgacacagcgctgcaatgctcagcggatgatgattgccgaggcatatcagtccatgtatggacgcgacctaataggggatatgcgcgagcagttaagcgaccatttcaaagacgtgatggctgggttaatgtacccccctcccctttatgacgcccacgagctgtggcacgctatgaagggggtgggaactgatgagaattgcctgatagaaattctcgcttccagaaccaatggtgaaatattccagatgcgagaagcttattgtctacaatatagcaacaacctccaggaagatatatattccgaaacgagcggtcattttagagacacgctgatgaaccttgtgcaggggactcgcgaagaaggttatactgaccctgcaatggccgctcaggatgcaatggtgctttgggaggcatgccagcagaaaaccggggagcataaaacgatgttacagatgatactctgtaacaaaagttatcagcaactacggctggtttttcaagaatttcagaatatctccggccaggacatggtagatgcaattaatgagtgctacgatgggtactttcaggagctgcttgtcgccattgtgctgtgcgtgcgcgataagcccgcatacttcgcctatagactctattcagccatacatgattttggatttcataataaaactgtgatccggatcctcattgccaggagcgagatcgacctattgaccatccggaaacgctacaaagaacgatacggcaaatctttgtttcatgacattcgaaactttgcaagcgggcactacaagaaagccctcctcgcaatatgtgctggggatgctgaggattactag

SEQ ID NO: 214521 - DNA, 975 bp, Artificial Sequence
  Description of Artificial Sequence: Synthetic coding sequence
atgttttgcagcaatctcgtacaaggcaccatattccctgcacccaattttaacccaattatggatgcacagatgctgggcggagcactacaggggttcgattgcgacaaggacatgttaatcaatatcctgactcagcgttgcaatgcgcagagaatgatgatagccgaagcctatcaatccatgtacgggagagatttaataggagacatgcgtgaacagctctccgatcactttaaggacgtgatggcgggtctaatgtatcccccacccctgtacgacgcccatgaactgtggcatgccatgaagggtgtggggaccgacgaaaattgccttatcgaaatcctggcgtcgagaaccaatggcgagatctttcaaatgagagaagcctattgtttacagtacagcaacaatctgcaggaagacatatactctgagacaagtggtcacttccgggacaccctgatgaatctggtacagggcacaagggaggaagggtacactgatcctgcgatggctgctcaggatgctatggtcctgtgggaagcgtgccagcagaaaacaggcgaacacaaaactatgctgcagatgatcctgtgcaacaagtcttaccaacaattgaggttggtgtttcaagagttccagaacatttcgggacaagacatggtagacgccatcaatgaatgctacgacggatacttccaggaattactcgtcgccatcgtactgtgcgtgcgcgacaaaccagcttacttcgcatatcgtctgtatagtgcgatacacgactttggatttcataataagacagtcattcgaattctgatcgctcggtcagaaatcgacctgctaaccattcggaaaaggtacaaagagcgatacggcaagagcctgttccacgatattcgcaacttcgcctcaggccattataagaaggcccttcttgcgatttgcgctggcgacgctgaggactactag

SEQ ID NO: 214522 - DNA, 1518 bp, Artificial Sequence
  Description of Artificial Sequence: Synthetic coding sequence
atgtcatatcctgggtacccgcctccaccaggcggttacccccctgcagcccctggaggaggtccctgggggggtgccgcttatccaccccctccctcaatgccaccaatcggtctagacaatgtcgccacctatgctgggcaattcaatcaggattatttatccggcatggctgctaacatgagcggcacttttgggggtgccaatatgcctaatctctacccaggtgcccctggggctggctacccaccagtcccaccgggaggtttcggacagcctccaagcgcccagcaacccgtaccaccctacggaatgtatccccctcctggcggtaacccccctagtagaatgccgagttaccctccctatcctggggctcctgtgcctggtcaacccatgcctccacctggacaacagccccctggggcttaccctggacagccgcctgtgacgtacccaggccaacccccagtcccgttgccaggccaacagcagcccgtgccttcctatccaggctatcctggctcaggaaccgttacccccgctgtcccgccaacccagttcggctccaggggcactataacagacgctcccggatttgacccattgagggacgctgaagtactcaggaaggccatgaaaggttttggcaccgacgagcaagccatcatcgactgtctgggttctcgtagtaacaaacagcggcaacagatactgctttcttttaaaaccgcctacgggaaggatctgatcaaagaccttaaaagtgaactcagcggaaactttgagaaaaccattctggccttgatgaagacgcctgtgttgttcgatatctacgaaatcaaggaagccatcaagggagtgggcactgacgaagcatgtctgatcgagatactcgcttcccgctcaaatgagcatatccgggagctgaatagggcctataaagcggagtttaagaaaaccttggaggaggctatcagatcagatacatctggccattttcagaggctcctcatctccctctcccagggaaatagggacgagtccaccaatgtagacatgagtctggcccagagagacgctcaagaactttacgcagctggggagaaccggctcggtacagacgagtccaagttcaacgctgtcctgtgttccagaagcagggcccatctagtagctgtatttaatgagtaccagcggatgacaggcagagatatcgaaaaatcgatttgtagagaaatgagtggtgatctagaggagggcatgctggccgtcgtgaaatgcttgaaaaacacgcctgccttctttgccgagagactcaataaggctatgcggggagctgggactaaggacagaaccttgatacggattatggtaagtcggtccgagacagatctcctcgatattagatctgagtacaagaggatgtacggcaagtcactgtatcacgacatctctggagacacttcaggcgactaccggaagatcctcctgaaaatatgcggtgggaatgattag

SEQ ID NO: 214523 - DNA, 1518 bp, Artificial Sequence
  Description of Artificial Sequence: Synthetic coding sequence
atgtcgtacccaggataccccccacctcctggcggttacccccctgccgctcccggaggcggaccatggggtggggctgcctatcctccacccccaagtatgccgcctatcggcctcgataacgtcgccacctacgctggtcagttcaaccaggattacttgtctggaatggccgctaatatgagcggaacttttgggggagccaatatgcccaacttatacccaggggcacctggcgctggatacccacccgtccctcctggcggattcggacagcccccttcagcacagcagccagtccccccatatggcatgtaccctccgccaggaggaaatccgcctagtcgcatgccttcctacccaccctatccgggagccccagtccccggacagcccatgcccccaccgggtcagcaacctcccggagcatatcctgggcagcctccggtaacctaccctgggcagccccctgttcccctgccagggcagcaacagcccgtgccgtcatatcccggatacccaggaagcggtaccgtcacccctgccgtgcctccaacccagtttggatctcgtggcactattactgacgccccaggatttgatccgctgcgcgatgctgaggtcctccgaaaggcaatgaaggggttcgggacagatgagcaggcaattattgattgtctgggaagtcgctccaataagcaaaggcagcagatcctgctctccttcaagaccgcctacggaaaggaccttattaaagatcttaaatccgagctcagtgggaatttcgaaaaaacgatcttggcactaatgaaaacaccagtcctgttcgacatctacgagatcaaggaagccatcaagggggtgggtaccgatgaggcttgtcttatcgagattcttgcctctaggtctaatgaacacatccgggaactcaacagagcatataaagccgaattcaaaaaaaccctggaagaggctattaggagcgacacaagcggtcatttccagaggttgttaatttccttgagccaagggaatagagacgaatcaacgaatgtggacatgtccctagcccaacgagacgcccaggagctgtacgccgcaggagaaaatagactcgggacggatgagtctaagttcaacgcagtactgtgctcacgaagcagggcgcatcttgtggctgtgttcaatgagtaccagcgcatgaccggaagggatatcgaaaaatcaatttgccgagaaatgagtggagatctggaggagggaatgctggcagtcgtgaaatgtctgaaaaatacccccgcattcttcgccgagcgtctgaacaaggcaatgagaggcgcaggcaccaaggatcgaacccttattcgcatcatggtgagtaggtcagaaaccgacctgctggatattaggtccgaatacaaacgaatgtatgggaagtctctgtaccatgatatcagcggtgacaccagtggcgactacaggaaaatcctgcttaagatttgcggaggtaacgattag

SEQ ID NO: 214524 - DNA, 489 bp, Artificial Sequence
  Description of Artificial Sequence: Synthetic coding sequence
atgtcacttgcgcaacgtgacgcacaagaactctacgcggcaggggaaaaccgcctgggtaccgatgaatccaagttcaacgcggttctctgctctcggagccgcgcacacctcgtcgcagtatttaacgaatatcaaagaatgaccggacgggatatcgagaagagcatatgccgcgagatgtccggggacctggaagaaggaatgctggccgttgtcaaatgcctaaaaaacacgcccgcattctttgccgaaagactgaacaaggccatgcggggtgctgggaccaaggatcgcactctgataaggattatggtgtcccgctctgaaacggacctgcttgacatccgctctgagtacaaacggatgtatgggaaatcactgtaccatgacatcagctcaatctcgtgtatgccagcctcatatggacatctggaggaggccacctgtctggcactcaagttgctcagagtcgaaggcaatgactag

SEQ ID NO: 214525 - DNA, 1518 bp, Artificial Sequence
  Description of Artificial Sequence: Synthetic coding sequence
atgagctatcctgggtaccctcctcccccaggcggatatcctccagcggctcctgggggtggcccatgggggggagcagcatacccccctccacccagtatgccacctatcggtctggacaacgtggctacctatgctggccagtttaatcaggactatctgagcggcatggccgctaacatgagtggcaccttcggtggcgcaaatatgccaaatctgtatcccggagcacccggtgccggttacccacccgttcctcctggcggttttggacagccaccaagcgcacagcagcccgtgcccccttatggaatgtatcctcctcctggcggaaaccccccaagccgtatgcctagctaccctccctatcccggtgctcccgtgccgggacaacctatgcctccccctggccagcagccgccaggcgcttaccctggccagcccccagtaacttaccccggacagccaccagtgccattacctggccagcagcaacccgtgccgtcctatccaggatacccgggtagcggaacagtgaccccagcggttcctcccactcagttcggttcccggggtacaatcacagacgcacccggtttcgatccccttcgggacgctgaggtgctgcggaaggcgatgaaggggttcgggactgatgagcaggcaatcatcgattgcctcggtagccgttcaaacaaacagagacagcagatattgttatcttttaaaacagcatacggaaaggacctcattaaagatttaaaatctgagctgtctggcaactttgaaaaaactattcttgcacttatgaagacccctgtgctgtttgatatctatgaaataaaagaagcgatcaagggcgtaggcacagacgaagcttgcctcatcgaaatcctcgcttccagatccaacgaacatatcagggaactcaacagggcatacaaagctgagtttaaaaagacgctagaggaggccattaggtccgacactagtggtcatttccagagacttctaatttccctctcccagggcaaccgagacgagtcaactaacgtggatatgtcactcgcacagagggacgcccaagagctatacgcggctggcgaaaatcggctcgggaccgacgagtctaagttcaatgccgtcctctgctctcggtctagggcacacttggtggcagtctttaacgagtatcagcggatgaccggaagagacattgaaaaaagtatatgccgcgaaatgtcaggggatctcgaagagggcatgctggcagtggtgaagtgtctcaaaaatacaccggctttctttgccgagagactaaacaaggcaatgcggggagccggaactaaggaccgtaccttgatcagaattatggtgagccgatcagaaaccgatttactcgacattcgatccgaatacaagaggatgtacggaaagtccctgtaccatgacatcagcggagacacttcaggcgactatcgcaagatcctgctgaaaatctgcgggggaaacgactag

SEQ ID NO: 214526 - DNA, 1518 bp, Artificial Sequence
  Description of Artificial Sequence: Synthetic coding sequence
atgagctacccaggataccccccacctcctgggggatatcccccagcagcccctggcggtggcccttggggaggtgctgcctacccaccgcctccaagtatgccaccaatcggcctcgacaatgtggccacgtatgcgggtcagttcaaccaggattatctgagcggaatggctgccaacatgagcggcacctttggaggagccaatatgcctaatctataccccggagcccctggcgcaggctatccaccagtgcctcctggcggattcggacagccaccatcagcccagcagccagtaccaccctatggtatgtacccgccacctggcggtaatcccccatccagaatgccaagttaccctccctacccgggagctcctgtgcctggtcagccaatgcctccacccggtcagcagccgccaggcgcttaccccggtcagccccctgtgacctatcctggtcaaccccctgtaccccttcccggacagcagcagcccgtgccctcttaccctggctaccctggaagtgggaccgtgacccccgctgttccaccgactcagtttggtagtcgcggtacaatcacggatgctccagggtttgatccactgagagatgcagaagtgctgcgcaaagctatgaagggattcggcacagacgagcaggctattatagactgtctcggcagtcgctcaaacaagcaaagacaacaaattctgctgagcttcaaaaccgcctatggtaaggacctaattaaagacctgaagtcagagctcagcggcaactttgagaaaactattcttgcactgatgaaaactccagtgcttttcgatatctacgaaataaaagaagcaattaaaggagtggggacagacgaagcttgcttaattgagatattagctagccgctcaaatgagcatattagagagcttaaccgagcttataaagctgaatttaaaaaaacacttgaggaagctatccgctcagatacctccggccatttccagagactccttatcagtctcagtcaaggcaacagagacgaatcgactaacgtcgacatgagcctcgcacaacgcgatgcccaagagctgtatgccgctggcgagaatagactggggacggacgagtcaaagtttaacgctgtcctttgtagcagaagtcgtgcccatttggtcgccgttttcaacgaataccagaggatgaccggccgagacatcgagaaatccatctgccgggaaatgtccggcgacctggaggaaggaatgctcgcagttgtcaagtgtctcaaaaatactccggctttctttgctgagcgactgaacaaggcaatgcgtggagcgggtaccaaggacagaacactgattcgtattatggtgagtcggtctgagactgatctgcttgatattcgtagcgagtataaacggatgtatggcaaatcattgtatcacgatattagcggagacacaagcggagattatagaaaaatactgctgaagatttgtggagggaacgattag

SEQ ID NO: 214527 - DNA, 1518 bp, Artificial Sequence
  Description of Artificial Sequence: Synthetic coding sequence
atgagttacccaggttatcccccaccacctggcggttatccacccgctgcacctggtgggggtccatggggaggcgctgcctatcctccaccaccgtccatgcccccaatcgggcttgataatgtggccacctacgcgggacagtttaaccaggactatctttcaggcatggcagccaacatgagcggcacttttgggggagcaaatatgccaaacctgtatccgggtgcccctggagctgggtatccccctgtgcctcccggaggtttcggacagccccctagcgcgcaacaacccgtccccccttatggaatgtacccccctccgggtggcaatcccccttcacggatgccctcctacccaccatatcccggagcaccagtgcccggtcagccgatgccgccacctggtcagcaacccccaggagcttaccctgggcagcctcccgttacctacccgggacaaccacctgtgcctctgccaggacagcagcagcccgtgccctcttatcctggctaccctggctctgggaccgtgactcctgccgtgcctcctactcagtttggcagccgtggtactattaccgatgctccaggcttcgatcccctgcgagacgcggaagtgcttcgcaaggccatgaagggattcgggaccgatgagcaggctattatagattgcctgggtagcaggagcaacaaacagaggcagcaaattctcttaagcttcaaaacagcatacggtaaagatctcatcaaggatctcaagtccgaactatccggaaactttgaaaagacaatcctggctttaatgaaaactcccgtgctttttgatatctacgaaataaaagaagcaatcaaaggagtgggaacagatgaagcctgcctgatcgaaattttagcctcaagatccaacgagcatatcagggaactgaacagagcctataaggccgagttcaagaaaaccttggaggaggcgattaggtcggatacctctggacactttcagaggctgctgatctccttgagccagggtaaccgtgacgagtctacaaatgtggacatgtctctcgcacagcgcgatgcccaggaactgtacgcagcaggtgaaaatagactcggcaccgacgaaagcaagttcaacgccgttctctgttcacgctctcgagcacacttggtcgctgtctttaatgaataccagagaatgacaggcagggacatcgagaagagcatttgtagggaaatgagcggggacctcgaagaaggcatgctcgctgtcgtgaaatgcctaaagaacactcccgcattttttgccgagcggctgaacaaggcgatgcgaggggctggtaccaaggaccgaaccttaatcagaattatggtctctagaagtgagactgatctccttgatataagatcggaatacaaacgtatgtatggcaagagtttataccatgacatctctggggacacgtcgggagactatcggaagatcttgcttaagatttgcggaggcaatgactag

SEQ ID NO: 214528 - DNA, 1239 bp, Artificial Sequence
  Description of Artificial Sequence: Synthetic coding sequence
atgagaggcagcagcactcggacaatctcccgcgagtgctggcggctctgggccgctcccttatgtcctgcagcatgtagctccctgtgggatgtcagcacacccagaagaaagccaacactacaggacgcattgatctccgctattccatatccagggcaaccccctgtaacctaccccggacagccaccagttccccttccaggccagcagcagcccgtccctagttatccgggatacccagggtcaggaacggtcacaccagctgtgccgcctactcagtttgggtctcgtggtacaataacagatgccccaggattcgaccctttacgggatgctgaggtgttacggaaggcaatgaaaggcttcggtaccgacgaacaggctattattgactgcttaggatcgcgatccaataaacagcgacaacagattctgctgagtttcaagaccgcatatggaaaggatctaatcaaggatcttaaatctgaacttagcggaaatttcgaaaagactatcttagcactaatgaaaacacccgtgttgtttgatatctatgaaattaaagaagccatcaaaggggtgggcaccgacgaggcatgtctgatcgaaatcttagcaagccgcagtaacgaacatattcgagaattgaatagagcttataaggccgagtttaaaaagacattggaggaagctatccggagtgatacaagtgggcattttcaacgcctactcatctctctgagccaggggaacagagacgaatccacaaatgtggacatgtctttagcgcagcgcgatgctcaggaactatacgctgctggagagaatagactgggcaccgatgaatcgaagttcaatgctgtcctgtgttctcgcagtagggcccacctggtggcggtgtttaatgagtaccaacgaatgacgggaagggacatcgaaaaatccatctgtcgggaaatgtcgggcgatctagaagagggaatgctggcggtggtgaagtgtctgaagaatactcccgctttttttgctgagcgcctcaataaagccatgcggggtgccggtaccaaggatcgcaccctgatcagaattatggtttcgaggagcgaaaccgatttactggatatacgttcggaatacaaaagaatgtatggaaagagcctctaccacgatatctcaggagataccagcggagattatcgtaagatactccttaagatctgcggaggcaatgattag

SEQ ID NO: 214529 - DNA, 453 bp, Artificial Sequence
  Description of Artificial Sequence: Synthetic coding sequence
atgtcttaccctggatatccacccccaccaggcggatatccaccagccgcaccaggaggaggcccttggggaggagccgcttaccctccgccaccaagtatgccgccaatcgggctagacaatgtggctacatacgcaggccagttcaatcaagactatctgtctgggatggccgcaaatatgtcaggtaccttcgggggagcgaacatgcctaacctgtatccgggagccccaggcgctggatatcctcccgtgccacccggaggctttggccagccacccagcgctcagcagcctgtacctccttacggaatgtaccctcctcccggtggtaatccaccttcaagaatgccttcctatcctccctatcccggagcgccagtgccagggcagcccatgccccctccgggacaacaaccacccggtgcctaccctggacagccacccgtgtag

SEQ ID NO: 214530 - DNA, 1518 bp, Artificial Sequence
  Description of Artificial Sequence: Synthetic coding sequence
atgtcctaccctggctaccctcctccgcctgggggttatccacccgcagctccagggggaggaccctgggggggtgccgcttaccctccacctccgagtatgccaccaattggactagacaatgtggctacctacgcagggcaatttaatcaggattacctgagcggcatggcagctaacatgtctggaacatttgggggtgctaacatgcctaatctgtatccaggagctccaggcgcaggctatccccctgtgccaccagggggttttggtcagcctcctagtgcacagcagccggtgcccccttacggcatgtacccccctccaggcggtaatccaccatcaaggatgccatcctacccaccgtatcctggggctccagtccccggtcagccaatgcctccacctggccaacagccgccaggagcctacccaggccagccccctgtgacgtatcctggacaacccccagtgccactgcccggtcaacagcagcccgtaccttcgtatccagggtaccctgggagtgggaccgtcaccccagccgtgccccctacgcaattcggtagcagaggcacaatcaccgacgctccaggcttcgatccactccgcgacgccgaggttctgaggaaagcaatgaaaggattcggcacagatgagcaggccataatcgactgcctggggtccaggagcaacaagcagcgccaacagatactgctgtcattcaagactgcctacgggaaggatctcattaaggacctaaagtctgagctaagcgggaatttcgagaaaactattctggctctgatgaagacacccgtattattcgacatttatgaaatcaaggaagcaatcaaaggcgtcggtactgatgaggcttgcctcattgagatcctggcctccagatccaatgagcacatccgcgagctcaaccgagcatacaaagccgaatttaagaaaaccttggaggaggccatccgatccgataccagtggtcactttcagaggcttttgatttccctgtcccagggaaacagagacgaaagtacaaatgtcgatatgagtcttgcccagcgcgatgcccaggagttatacgcggcaggcgagaacagactgggtacggatgagagcaaattcaatgccgttctatgcagccgttcaagggcccacctggtggcagttttcaatgagtaccaaaggatgacggggcgtgatatagagaaaagcatttgcagagaaatgtcgggtgacctggaggagggcatgctcgccgtggtgaaatgcctgaagaacaccccagcatttttcgcagaacgtctcaacaaggcgatgcgtggggctggtaccaaagaccgtaccctgatacgtattatggtgagtaggtctgagactgaccttttagacatccgaagtgaatacaagagaatgtatggaaaaagcctctaccatgatatcagcggcgacacttctggtgactacagaaagattctgctcaagatctgcggcggaaacgactag

SEQ ID NO: 214531 - DNA, 615 bp, Artificial Sequence
  Description of Artificial Sequence: Synthetic coding sequence
atgagttatccgggttaccccccacccccaggagggtacccacctgcggcaccaggaggaggaccttgggggggagctgcttaccctccacccccatctatgccaccaatcgggttggacaacgttgccacttacgctggccaattcaatcaggattatctgagcggaatggccgctaacatgagcgggacttttggtggtgccaatatgcccaatctctaccccggtgcgccaggggctgggtacccgccagtgccacccggtgggttcgggcagccgccaagcgcgcaacagccggtgccaccatacggaatgtaccccccaccaggcggaaatccaccttccagaatgcctagttaccccccttacccaggtgccccagtccctggccagccgatgccgcctccgggacaacagcccccaggagcatatcctgggcagcctcctgtaacctatcctgggcagccccctgtcccgctgcctggtcagcagcagcccgtgcctagctaccctggatacccaggttccggtactgttacccctgccgtcccacctacacagtttggttctcgtggaaccatcacagacgcccctggatttgatccgttgcggtag

SEQ ID NO: 214532 - DNA, 447 bp, Artificial Sequence
  Description of Artificial Sequence: Synthetic coding sequence
taagagaaccgcctcggcaccgacgagagcaaatttaacgccgtgctctgttcacgatcccgcgctcacctggtggccgtctttaatgaatatcagcggatgaccggccgagacatcgaaaagtctatttgtagagaaatgtccggagacctggaagagggaatgttggccgtggttaagtgcctgaaaaacacaccagctttctttgccgagcggctgaacaaagcaatgaggggggctgggacaaaggacagaaccctgatccgcattatggtctctaggagcgagacggatttattggacatcagaagcgagtacaaacgaatgtacggtaagagtctgtatcacgatatttcatctatctcatgcatgcccgcatcgtatgggcacctcgaggaagccacctgtcttgcacttaaactcctccgagtcgagggaaacgactag

SEQ ID NO: 214533 - DNA, 1518 bp, Artificial Sequence
  Description of Artificial Sequence: Synthetic coding sequence
atgtcctatccaggatacccaccgccacctggtggatacccacccgctgcacccggtggaggaccctggggcggagcagcgtacccaccacctccgtcaatgccccctatcggccttgataacgttgccacctacgctggacaattcaatcaggactacttatcaggaatggctgccaatatgtcagggacattcggtggagctaatatgcccaatctgtatccgggtgccccaggagccggttaccctccggtcccacccggaggatttggccagccccctagcgctcagcaacccgttcccccatacggaatgtatccgcctcctggtgggaatccccctagccgtatgccgtcatatcccccttatcctggagcaccagtaccaggccagcctatgccaccacccggtcagcaaccaccaggtgcctaccccggacagccccctgtgacatatccagggcagccccctgtccccctgcccggacagcagcagcccgtaccatcctacccagggtaccccggttctggaactgttaccccagcggtgccacccacacaattcggctccagaggaactatcaccgacgccccaggatttgaccccctgcgggatgctgaagttctccgaaaggcaatgaaggggtttggcactgatgagcaggctataatcgattgtctggggtcacggtcaaataagcagcgccagcagattctcctgagcttcaagactgcctatgggaaggacctgattaaggatctcaagagtgagctctcgggcaactttgagaagaccatactcgctctcatgaagacccctgtcttgttcgatatctacgaaataaaagaggccattaaaggtgtcggcacagacgaagcttgtctgattgagattctggcatctcggtcaaatgagcatatccgcgagctgaaccgtgcgtacaaagctgaatttaaaaagacactcgaagaggcaatcagaagcgataccagcgggcattttcaacgattgctaatttctctgagccaggggaatcgcgatgaatccaccaatgtcgacatgtctctagcccagagagacgcgcaagaactgtatgccgctggcgagaacaggctgggaactgatgagtccaaattcaacgcagtgttatgttcacggtctagggcacacctagtggcggtttttaacgagtaccagcgcatgacggggcgtgatatcgagaaatctatttgccgagaaatgtccggcgacctagaggaagggatgctggccgtggttaagtgtctgaagaatacacccgcatttttcgcggaaagactgaacaaggctatgaggggcgctgggactaaggataggactctcattcggataatggtcagtcgatcagagacagatctgctcgacataagatctgagtacaagagaatgtatggcaagagcttgtatcatgatattagcggcgacacctcaggggattacaggaaaattttgctgaagatatgtggaggcaatgactag

SEQ ID NO: 214534 - DNA, 1419 bp, Artificial Sequence
  Description of Artificial Sequence: Synthetic coding sequence
atgcctccaatagggttggacaacgtcgccacttacgctggtcaattcaaccaggattacttaagcggcatggccgctaacatgtcaggcacgttcgggggtgctaatatgcctaacctctaccctggcgctccaggagcaggctacccccctgtcccgcctgggggattcggacaaccacccagcgcgcagcagcctgttcccccatatggtatgtacccaccacctggcggtaaccctcctagccgtatgccatcatatcctccatacccgggagctccggtccccggacagccgatgccgccacctggacaacagcccccaggtgcctaccctggacagccccctgtgacctaccccggacaacctccagtccctctgcctggacagcagcagccagtgccgtcataccctggataccccggatccggtactgtcacccccgctgtgccccctacccagttcggttccagaggaactataacggatgccccaggattcgacccattaagggacgccgaggtgctccgcaaagccatgaagggcttcgggacagacgagcaggccatcatagattgtcttgggagcaggtccaacaagcagcgtcagcagatcttgctgtcttttaagactgcctatggaaaggatcttatcaaagaccttaaatccgagttgtctggaaattttgagaagaccattctcgccttgatgaagacccctgtcctctttgatatttacgaaattaaggaagctatcaagggagtgggtacggacgaagcttgcctgatagagattctggcatcccgctctaacgaacacatcagagagttgaacagggcctataaagcagagttcaagaagaccctcgaggaggccatcagatctgatacaagcgggcacttccagaggctcctgatttccttaagtcagggaaacagggacgagagtaccaacgttgacatgtctctagcacagagggacgcccaggagttgtatgctgctggggagaatagactcgggaccgatgagagcaaatttaatgccgtgctttgcagccgtagtcgggctcatctagtggcagtctttaacgaataccagcgtatgaccgggcgagatattgaaaagagcatctgcagggagatgtctggtgacctcgaagagggcatgctcgcagttgtcaaatgtctaaaaaacacgcctgcgttttttgctgagcggttgaacaaagccatgcggggagccggaacaaaggatcggacacttattagaattatggttagtcgcagtgaaacggacttactggatattcgctctgaatacaaacggatgtacgggaaatctctctatcacgatattagcggtgacacctcaggcgattatcggaagatcctgctgaaaatctgtggcggaaacgactag

SEQ ID NO: 214535 - DNA, 1074 bp, Artificial Sequence
  Description of Artificial Sequence: Synthetic coding sequence
atgggaagacaactggccggttgcggagacgctgggaagaaagctagcttcaagatgtccactgttcacgaaatcctttgcaaactgtcactggagggcgatcattctaccccaccatcagcctacgggagtgtgaaagcctatacaaatttcgatgctgagagggacgcactcaatatagaaaccgccattaagaccaagggcgtggacgaagtcaccatagtgaatattctgactaatagatccaatgctcaaaggcaggacatcgcattcgcctaccagagacgcactaagaaagagctggcaagcgctctgaaatctgctctgagtggacacttggaaaccgtcattttggggctcctgaagacacctgcgcagtacgacgcttcggagctgaaggccagcatgaaaggactgggcaccgatgaggactcacttatcgaaattatctgctccagaacgaatcaagagttgcaggaaatcaatcgtgtttataaggagatgtacaagactgacttggaaaaggatataatctccgataccagtggcgacttccgcaagctaatggtagctctcgcaaagggcaggcgtgcagaagatggctcagtgatcgactatgagctaatagaccaggacgcacgcgacctgtacgatgccggagtgaagaggaagggaacggatgtgcccaagtggatcagtattatgacggaaaggagcgttccgcacctccagaaggtttttgataggtataaatcatacagtccttatgatatgcttgagagtatcaggaaggaagtgaagggagatctcgagaacgcatttttgaatttggtacaatgcatacagaataagcccctctattttgctgaccggctatacgatagtatgaaaggaaaagggaccagggacaaagttctcatcaggatcatggtgagccgatcagaagtagatatgctcaagatccgttctgagtttaagagaaagtatgggaagtccctgtactattatattcagcaagataccaaaggggactaccaaaaggctctcctttacctatgcggaggcgacgattag

SEQ ID NO: 214536 - DNA, 1020 bp, Artificial Sequence
  Description of Artificial Sequence: Synthetic coding sequence
atgagcacggtgcacgagatactgtgcaagttgagcctcgagggagatcactcgacccctccttccgcctacggaagcgtcaaggcatatactaacttcgacgccgagagagatgctctgaatatcgaaaccgccatcaagacaaaaggagtcgatgaagtaaccattgtgaacattctgacaaaccgttctaatgctcagcgccaagacattgcgttcgcctatcaaagacggacgaagaaggagctggcctctgccctgaagagcgcattaagcgggcatctcgaaacggtcatcctgggcctattgaaaactcccgctcagtacgacgcgtccgaattgaaggcttcgatgaagggcctcggtacagacgaagattccctcatcgaaatcatctgcagtcgcaccaatcaggaattgcaggaaattaaccgcgtgtacaaggagatgtataaaaccgacctcgagaaggacatcattagcgacacttcaggcgactttaggaagctcatggtggccctggcaaaggggaggcgagccgaagatgggtccgttatcgactatgagcttattgaccaggatgcccgagacctgtacgatgcaggcgtgaagagaaagggcacggatgttcccaagtggatttcaatcatgaccgagcgttccgtgcctcacctgcagaaagtgttcgacagatataagtcttactctccatatgacatgctcgagtccatccgtaaggaggtgaagggggatctcgagaatgcatttctgaacctggtgcagtgcattcagaacaaacccttatacttcgccgacagactgtacgacagcatgaaaggaaagggaacaagggacaaggttctaatccggattatggtgagtcgatctgaggtggatatgttgaaaataaggagtgaattcaagagaaagtacggtaaatcgttatattattatattcagcaggataccaaaggggactaccaaaaagcacttctctacctctgcggcggtgatgattag

SEQ ID NO: 214537 - DNA, 1020 bp, Artificial Sequence
  Description of Artificial Sequence: Synthetic coding sequence
atgtcaacagtgcacgagattctgtgcaagctctccctggagggagaccacagtacaccaccatcagcgtatggcagcgttaaggcctataccaattttgacgcagagcgcgacgccctgaacatagaaaccgcaatcaaaaccaaaggagtggacgaagtgacgattgtaaatatcctgacgaacaggtctaatgcccaacgccaggacatcgccttcgcttaccagagacgcactaaaaaggaacttgctagcgccctcaaatcagctctgtcagggcacctggagaccgtaatactgggtcttcttaagacacccgctcagtatgatgccagcgaactcaaggcctccatgaaggggctcgggactgatgaggactcactcattgagattatctgctcgcgtactaaccaggaactacaggagatcaatagggtgtacaaggagatgtataagacggacctcgagaaagacatcattagtgatacgtctggggacttcagaaaacttatggtcgcactggctaagggcaggcgagccgaagatgggagcgtcatcgactacgagctgattgaccaggatgccagggacttgtacgatgctggggtaaaaagaaagggcaccgacgtgccaaagtggatatctatcatgaccgagaggtcagtgccacacctgcagaaagtgttcgatcgttataagagctatagtccatatgacatgttggagtctattcgcaaggaagttaaaggcgatttagagaacgccttcctaaatctcgtgcagtgtatacaaaacaagcctctctatttcgcggacaggctttatgatagcatgaaaggaaagggcacccgggataaggtgctgatccgcataatggtgtctcgttccgaagtcgacatgctcaagatacggtctgagtttaagcgtaagtatggcaagtccctgtactactacatacagcaggacactaaaggagactatcaaaaagccctgttgtatctgtgtggcggagatgattag

SEQ ID NO: 214538 - DNA, 1020 bp, Artificial Sequence
  Description of Artificial Sequence: Synthetic coding sequence
atgtcgactgtgcacgagattctctgtaagcttagcctggagggcgaccactcaacgccacctagcgcatatgggagcgttaaggcctatacaaacttcgacgctgaaagggacgccctaaacatcgaaactgcaataaaaacaaaaggggtcgacgaggtcacaatagtgaacatcctgacgaaccggagcaacgcccagcgtcaggatatcgcctttgcataccagcggaggacaaagaaggaactcgcaagcgctttaaaatcagccttgagtggccatctggagactgtcattttgggtcttctcaagacccctgcacagtatgacgcatccgagttgaaagcctctatgaagggattgggaaccgatgaagacagtctcatcgaaataatctgcagccgcacaaatcaggagctccaagagattaatcgcgtctataaagagatgtacaagactgatttggaaaaggatattatcagcgatacctccggagacttcaggaagctgatggttgccctggccaagggaagaagagccgaggatggaagcgtcatcgattatgaattaatcgatcaggacgccagggacctgtatgacgcgggagttaagaggaagggaactgatgtgccaaagtggattagtattatgaccgagcgcagcgttccgcatcttcagaaggtcttcgatagatacaagagctattcaccatacgacatgttggagagcatacgcaaagaagtcaaaggagacttggagaatgcatttctcaatctagtgcagtgtattcagaataagccactgtatttcgctgaccggttatacgatagcatgaaggggaagggtacaagggacaaagtgctcattagaatcatggtgagcaggtccgaggtggacatgctaaagatccggtccgaattcaagcggaagtatggcaagtcactatattactatattcagcaagatactaaaggggactatcagaaagcattgttgtatctctgcggtggagatgactag

SEQ ID NO: 214539 - DNA, 246 bp, Artificial Sequence
  Description of Artificial Sequence: Synthetic coding sequence
atgtctactgtgcacgagatcctttgcaagctgtccttggagggggatcattccactccaccttcagcctacggttccgtgaaagcgtacactaactttgacgccgaacgggatgccctcaatattgaaactgccataaaaaccaagggcgtggatgaggtgaccattgtaaacatcctgacaaacaggtccaacgcccagagacaggatatcgccttcgcatatcagaggcggaccaaaaaatag

SEQ ID NO: 214540 - DNA, 531 bp, Artificial Sequence
  Description of Artificial Sequence: Synthetic coding sequence
atgtcaactgtccacgaaatcctgtgcaaactaagtctcgagggcgaccactctacccctccttccgcttatggatctgttaaggcctatacaaacttcgacgccgaacgggacgcactcaacattgagaccgcgatcaagacaaaaggagtggacgaggtaaccatcgtcaacatcctgacaaatcgcagcaacgcacaacgccaagatattgcttttgcataccagagacgcaccaagaaagagctcgcctccgccctgaaaagtgccctcagtggtcatcttgaaacagtgattctcggactcctgaaaacaccagctcagtatgacgcatctgagctgaaagcctctatgaagggtctgggaaccgacgaagattcccttatagaaatcatctgttcacggacgaaccaggagttgcaggaaatcaaccgagtatacaaagagatgtataaaacagacctagaaaaggatatcattagtgatactagcggagactttcggaaacttatggtggctctcgccaaatag

SEQ ID NO: 214541 - DNA, 144 bp, Artificial Sequence
  Description of Artificial Sequence: Synthetic coding sequence
atgagcactgtccatgagatcttgtgtaaattgtccctggagggggatcacagcaccccaccatcagcctacggcagtgttaaagcttatacaaacttcgacgcagaaagggatgccttaaatatcgagactgctatcaaatag

SEQ ID NO: 214542 - DNA, 405 bp, Artificial Sequence
  Description of Artificial Sequence: Synthetic coding sequence
atgagcaccgtgcatgagatactttgtaagctgtctcttgagggagatcatagtacccctccaagtgcatatggctcggtaaaggcatacactaattttgatgccgagcgggatgctttgaatatagagacagcaatcaaaaccaaaggcgtggacgaagtgactatcgtcaacatactgaccaatagaagcaatgcacagaggcaggacatcgcttttgcttatcagcgcaggacaaagaaagaactcgctagcgctctcaagtctgccctgtcgggccacctcgagaccgtcatcctggggctgctcaagactcctgcacagtatgacgcttcagaactcaaggccagtatgaaagggctgggaaccgacgaagactcactgatagagatcatttgttcttag

SEQ ID NO: 214543 - DNA, 402 bp, Artificial Sequence
  Description of Artificial Sequence: Synthetic coding sequence
atgagcacagtgcacgaaatactctgtaagttgtctctcgaaggcgaccacagcacccctccgtcagcatacggatcagtcaaggcatataccaacttcgacgcagagagggacgccttaaacatcgagaccgcaatcaagactaagggcgtagatgaggtgaccattgtgaatatactgaccaaccgatccaatgcgcaaaggcaggatatagctttcgcctaccaacggaggactaagaaagaactggccagcgccctgaaatctgccctaagtggccacctcgagacggttattctcggtctcctgaagacacctgcacaatatgatgcgagtgagttgaaggccagcatgaaggggctgggaactgatgaggactcacttatcgagataatttgttag

SEQ ID NO: 214544 - DNA, 450 bp, Artificial Sequence
  Description of Artificial Sequence: Synthetic coding sequence
atgagtaccgtccacgagatcctgtgcaaactgtcacttgagggtgatcactcgacccccccttcggcctacgggagtgtcaaggcctatacaaactttgacgccgagagggacgcgttgaatatagagactgccattaagaccaaaggcgtcgacgaagttacaatcgtgaacattcttaccaacaggagcaatgctcagaggcaggatatcgcttttgcctaccagaggaggaccaaaaaagagttggctagtgccctgaaatctgctctgtcagggcatctggaaaccgtcattctcggtctcttaaagacccccgcacagtacgatgctagcgagctcaaggctagtatgaagggcctggggacagacgaagatagcctaattgaaataatttgttctagaacgaaccaagagttacaggagattaatcgtgtgtacaaggaatag

SEQ ID NO: 214545 - DNA, 198 bp, Artificial Sequence
  Description of Artificial Sequence: Synthetic coding sequence
atgagtacagtccatgagatactgtgtaagcttagcctcgagggggaccatagcacgcctccctctgcatatggctccgtgaaggcctataccaactttgacgcagaaagagacgcgctgaacattgagacagctatcaaaaccaagggcgtcgatgaggtcactatcgtgaatatccttaccaaccgcagcaactag

SEQ ID NO: 214546 - DNA, 360 bp, Artificial Sequence
  Description of Artificial Sequence: Synthetic coding sequence
atgagcactgtgcacgagatactctgtaaactctcactggaaggggaccactccacccccccatcagcgtacgggagcgtgaaagcctacacaaacttcgacgccgaaagagacgccttaaacatcgaaaccgctatcaaaactaaaggtgtggacgaggtgaccatcgtgaacatcctgactaaccgctccaatgctcagcgacaggatatagccttcgcatatcagaggcgtactaaaaaagagctggcgagcgccctaaagtctgctctctctgggcacctggagaccgtaattctcggcctgcttaagactcctgcacagtacgacgccagcgaactgaaggccagcatgaaatag

SEQ ID NO: 214547 - DNA, 771 bp, Artificial Sequence
  Description of Artificial Sequence: Synthetic coding sequence
atgagcaccgtccatgagatcttatgcaaactgagtctggaaggtgatcatagcacacctccctcggcctatggcagcgttaaagcttacacgaattttgacgcagagagggatgctctgaatatagagacagctataaaaaccaaaggagtggatgaggtgacaattgtcaacatccttacaaaccgctccaatgcccagagacaggatatcgctttcgcctaccaaaggaggactaaaaaagagttggcttccgcactcaagtcagcactgagcggccatctcgaaaccgtaatcctggggctccttaaaactcctgctcagtacgacgcctcagaacttaaggccagcatgaaaggactgggtacagacgaagactccctgatcgagattatctgctcccggaccaaccaagagctgcaggaaatcaatagagtctataaagaaatgtataaaacagatctggagaaggatatcataagcgacacttcaggcgattttagaaaactcatggttgctctcgcgaagggccgacgggctgaggatggcagcgttatcgattacgagctcatagaccaggacgcacgagacctgtacgatgcgggagtgaaacgaaaggggaccgacgtgcctaaatggatttctattatgaccgagagaagtgtccctcatttgcagaaagtgttcgatcggtacaaatcatactctccttacgacatgttggaaagcattagaaaggaagttaaaggtgaccttgagaacgctttctag

SEQ ID NO: 214548 - DNA, 360 bp, Artificial Sequence
  Description of Artificial Sequence: Synthetic coding sequence
atgagcaccgtacacgaaatcctgtgcaagctctctctagagggagatcacagcacaccaccctccgcatatgggagtgtgaaagcttacacaaatttcgacgcagagcgggatgccctaaatatcgagactgcaatcaaaaccaaaggtgttgacgaagtgacaatcgtcaatatcctgactaatcgcagtaatgcgcagcggcaggacattgcatttgcatatcagcggaggacgaagaaggagctcgcctctgctctgaagtctgcccttagtggccacctggagacagtgatactgggtcttcttaagactcccgctcagtacgacgcaagcgaattgaaggcctccatgaaatag

SEQ ID NO: 214549 - DNA, 531 bp, Artificial Sequence
  Description of Artificial Sequence: Synthetic coding sequence
atgagcacagtgcacgaaattctgtgcaagctgtccctggagggcgaccactccactcccccttccgcgtatggctcagtaaaagcttacacaaacttcgatgccgagagggatgctctcaatatcgagactgctattaaaaccaaaggtgtggatgaggtgaccattgttaatatccttaccaaccgttctaacgcacaaagacaggatatagcgttcgcgtatcagaggcgtacgaaaaaggaactcgcttccgccctcaaaagcgccttgtccggacacctagagaccgtcatcctcgggttgctgaaaactcccgctcagtacgacgcgtctgagctcaaggccagtatgaaggggctggggaccgacgaggactctctgattgaaataatctgcagccgcacgaatcaggagcttcaggaaatcaatagggtgtataaggaaatgtataagaccgaccttgaaaaagacatcatttctgacaccagtggtgattttcgcaaactgatggtggcgctagccaagtag

SEQ ID NO: 214550 - DNA, 684 bp, Artificial Sequence
  Description of Artificial Sequence: Synthetic coding sequence
atgtccaccgtgcacgaaatcctgtgcaaactaagtctcgagggagatcatagcaccccaccaagtgcctacggatctgtgaaggcctataccaatttcgacgccgagagggacgccttaaacatcgagaccgccattaaaactaaaggcgttgatgaagttacaatagtgaatatcctgacgaacaggtctaacgctcagcggcaggacatcgctttcgcctatcagaggcgcacaaagaaggagctcgcttccgccttaaaatccgcactaagtggacacttagaaaccgtaattcttggcctgctgaagactccagcacaatatgatgccagcgagctgaaggcgtctatgaaaggcctggggaccgatgaagactcgctaattgaaatcatttgctccagaacaaaccaggagctccaggaaattaaccgcgtttacaaggaaatgtataagaccgatctcgaaaaggatatcatctcggataccagtggggattttcggaaactcatggtggctctcgccaaggggcgaagggcagaggacggctccgtcatcgactacgaactgattgaccaggatgctcgcgacctatacgatgccggtgtgaaacgtaagggcacagacgtgccaaagtggatttcgataatgaccgagaggtccgtcccccaccttcagaaatag

SEQ ID NO: 214551 - DNA, 531 bp, Artificial Sequence
  Description of Artificial Sequence: Synthetic coding sequence
atgtcgactgtgcacgagattctgtgtaagttgtctctggagggcgaccatagcactccaccatcggcatacggaagcgtgaaagcctacactaacttcgacgcggagagagacgctctgaacatcgagaccgccatcaagacaaagggcgtcgacgaagtgacaattgtcaatatcctgaccaacagaagcaatgcacagaggcaagatattgccttcgcctatcaaaggcgaacgaagaaggaattggcttctgccttaaaatccgcactgagcggccacctggagacggtgattctgggacttctaaagaccccagctcagtatgacgcctctgaattaaaagccagtatgaaagggctcgggacggatgaggattctctcatcgagatcatttgcagtcgtacaaaccaagaactgcaggagataaacagagtttataaagaaatgtacaagacggatttggagaaggacataatctcagacacgagcggagacttccgaaaattgatggttgcattagctaaatag

SEQ ID NO: 214552 - DNA, 333 bp, Artificial Sequence
  Description of Artificial Sequence: Synthetic coding sequence
atgagcacagtgcatgagatcttatgcaagttgtccctggagggggaccatagcacccctcccagtgcctatgggagcgtgaaagcgtacaccaatttcgacgctgagcgggatgcgctgaacatcgaaactgccatcaagaccaagggtgtggatgaggttaccatcgtgaacatcctgaccaacagaagcaacgcccagagacaagatatagctttcgcatatcaaaggcggactaagaaggagctcgcctccgctttaaagagcgccctctcggggcatcttgaaactgtgattctaggtctgctgaagaccccagctcagtacgactag

SEQ ID NO: 214553 - DNA, 972 bp, Artificial Sequence
  Description of Artificial Sequence: Synthetic coding sequence
atggcaagcatctgggtggggcatcgcggaactgtccgtgactatcctgacttctcaccgtccgtggatgccgaggcaattcagaaggctattcgtgggatcggcaccgacgagaagatgctgatttctatcctcaccgagcgatctaatgctcagcgacagctgatcgtgaaggagtatcaagccgcttacggtaaggaactgaaagatgatctgaaaggggatctgtccgggcattttgagcacttgatggtggcactcgtgactccgccagcagtctttgatgcgaagcagctgaagaagtccatgaagggggcaggcaccaatgaggacgcactcattgagatcctcaccactagaacaagtagacaaatgaaggatatttcccaagcctactacacggtttacaaaaagtctctcggagacgacatcagctccgaaaccagtggagattttagaaaagctctccttacgctggctgacggcaggcgtgacgagagtcttaaggtggacgagcacctggccaagcaggatgcacaaatactgtataaggccggtgagaaccggtgggggacagatgaggacaagtttaccgagattctttgcctcagatcatttccccaacttaaacttacgttcgatgagtaccggaatatcagccagaaggacatagttgatagcatcaagggagagttgtcagggcacttcgaggacttattgctggctatcgtcaattgtgttagaaatactccagcttttttggcggagaggctccacagggcactcaaggggatagggaccgatgagtttaccctgaatcgcatcatggtctctcgttccgagatcgatctgttggacatacgaaccgagttcaaaaagcactatggctattccctctattccgcaattaagtccgacactagcggcgattacgagattaccctgttgaagatctgcggaggtgatgactag

SEQ ID NO: 214554 - DNA, 405 bp, Artificial Sequence
  Description of Artificial Sequence: Synthetic coding sequence
atggcctccatttgggtgggccataggggtactgtgcgtgactaccctgactttagcccttctgtggatgccgaggccatccagaaagccatcaggggcatcggtactgatgagaagatgctcatcagcatcttaactgagcgctccaacgctcagcgacaactaattgtgaaagagtaccaggctgcttacggaaaggagctgaaggacgacttgaaaggcgacttatccggacactttgagcatctgatggttgcactggtcactccaccagccgtcttcgatgccaagcaactgaagaagtctatgaaaggcgctggaaccaacgaggatgccctgatcgagattttgacgactcgcactagcagacagatgaaagacatcagccaagcatactatacttag

SEQ ID NO: 214555 - DNA, 315 bp, Artificial Sequence
  Description of Artificial Sequence: Synthetic coding sequence
atggcgtccatttgggtcgggcacaggggtacggttcgcgattatcccgattttagtccttccgtggatgccgaggctatacaaaaggccattcggggaatcggcacggacgagaagatgctgatatcaattctgactgaacgaagcaacgcacagcgacagctcattgtaaaggaataccaggcggcatacggaaaagaacttaaggatgatttgaagggcgatttgagtgggcatttcgaacatctgatggtggctttagtgactcccccagcggtttttgacgctaaacagcttaagaagagcatgaagtag

SEQ ID NO: 214556 - DNA, 465 bp, Artificial Sequence
  Description of Artificial Sequence: Synthetic coding sequence
atggcttccatatgggtgggacatagggggactgtgcgggactatccagacttttccccttctgtggatgccgaggctattcaaaaggccattagagggatagggacggacgagaagatgctaattagcatcctgacagaaaggtccaatgcccaacgccagcttatagtcaaggagtaccaagctgcctacggaaaagagttaaaagatgatctcaaaggtgacctgagcggacattttgagcacctaatggtagccctggtgaccccccctgccgtgtttgacgctaagcagctgaagaaatccatgaagggcgctggtacaaacgaggacgcactaatcgaaatcctgactacaaggacttctaggcagatgaaagacattagtcaggcctactacaccgtttataagaaatcccttggagatgacatttccagtgagactagcggagatttccgcaagtag

SEQ ID NO: 214557 - DNA, 966 bp, Artificial Sequence
  Description of Artificial Sequence: Synthetic coding sequence
atggccatggcgacgaagggaggcacagttaaggctgcgtccgggttcaacgcaatggaggacgcacaaacgttgagaaaagctatgaaggggctgggaacggatgaagacgctatcatctctgtgctggcttatcggaacacagcacagcgacaggagataagaaccgcttacaagtcaacgattggtagagacctcattgacgacctcaaaagcgagctgagcggcaacttcgagcaggtgatagtcggcatgatgacccccaccgtgttgtatgatgtgcaagagcttcggagggctatgaagggggcagggacagatgaaggctgcctgattgagattctggcttcacgcacccccgaggagatccgtcggatcagtcaaacatatcagcagcagtatgggagatcacttgaggatgacatcagatccgatacgtcgttcatgtttcaaagggtgttggtttctctgagcgccggaggaagagatgaagggaactacctggacgacgcgctggtgcgacaagacgctcaggacttatacgaggctggggagaagaaatggggcacggacgaagtgaagtttttaactgtgctctgttctcgaaacagaaatcatctcctgcacgtgtttgatgaatacaaaaggatatcccagaaagacatagaacagtccatcaagagcgagaccagtggctccttcgaagatgcactccttgctatcgttaagtgtatgcggaacaaatctgcctacttcgcggagaagctgtacaaatctatgaaaggacttggtacggacgacaatacgctgatcagggtgatggtcagtcgtgccgaaattgatatgcttgacatcagggcccactttaagcggctgtacggcaagagcctatactctttcatcaaaggcgataccagtggggactacagaaaagtcctgttagtgttgtgcggcggagatgattag

SEQ ID NO: 214558 - DNA, 900 bp, Artificial Sequence
  Description of Artificial Sequence: Synthetic coding sequence
atggcaatggccaccaagggtggcaccgtaaaggcggctagcggtttcaacgcaatggaggacgcccagacactgcgtaaggccatgaaaggactgggaaccgacgaggatgcaatcatttccgtcctcgcctaccgaaacacagcccagagacaggagatcaggacagcttataagtccactatcggaagggatttgatcgatgacctcaagagcgagctgtcagggaattttgaacaaggtgcaggtaccgatgagggctgtttgatcgaaatactggcatctcggacaccggaggaaatccgcagaatttcccagacataccagcagcagtacggtcgtagcctcgaggatgacattcggagcgacacatcattcatgttccaaagggtattggtcagcctatccgccggtggaagggatgagggcaactatcttgatgacgccctcgtccgccaggatgcccaggatctttacgaggctggcgagaaaaagtggggcaccgacgaggtcaaatttctaactgtgttgtgttcaaggaacaggaaccacttgctgcacgtgttcgatgagtacaagagaatttcacaaaaagacattgagcagtctatcaaatccgagactagcgggtccttcgaggatgcgctactggcaattgtgaagtgcatgagaaacaagtcggcatacttcgcggaaaaactgtacaagtctatgaaagggctaggcaccgacgataacacacttattagagtgatggtcagccgagccgaaattgatatgctggacatcagggcacatttcaagcgattatacgggaagtctctgtactctttcattaagggagacacctccggagattatcggaaggtgctactggtcctttgtggcggagacgattag

SEQ ID NO: 214559 - DNA, 714 bp, Artificial Sequence
  Description of Artificial Sequence: Synthetic coding sequence
atgatgacccccactgtcctttacgacgtgcaagaactccgcagagcaatgaagggggctggaactgacgaaggatgccttattgaaatattggcctcgaggaccccagaggaaatacggaggatttctcagacctatcaacagcagtacggacggtcactcgaggacgatatccgaagcgacacaagctttatgttccaaagggtcttagtgtcactgagtgccggtggcagagacgaaggcaattatctggacgatgcgctcgttcggcaggacgcacaagacctatacgaagctggtgagaagaaatggggcaccgatgaagtgaagttcctgactgtgctttgtagccggaataggaaccatcttctccatgtgtttgacgaatataagcgaatctctcagaaggatattgagcagagcatcaaatccgagacatcaggatcatttgaggatgccctgttagcaatcgtcaaatgtatgaggaataaatccgcgtacttcgcagagaagttatacaagtctatgaaaggactcggcactgatgataatactctgatcagagtaatggtgagtagagccgaaatcgatatgcttgatatccgagcgcacttcaagcgcctgtatggtaaatcattgtatagtttcataaaaggcgacacatcaggggactacaggaaggtcttgctggtcctgtgcggcggagacgattag

SEQ ID NO: 214560 - DNA, 963 bp, Artificial Sequence
  Description of Artificial Sequence: Synthetic coding sequence
atggcgcaggtcctacggggaaccgttaccgactttcccggatttgacgagagagcagatgccgaaaccttgcggaaggccatgaaagggctcggaacggatgaagagtctatcctcactctacttacgtcgagatctaatgctcagaggcaggagatcagcgctgcattcaaaactctgtttgggagagacctcctggacgacctgaaatcagaacttaccgggaagtttgaaaaacttatcgtggcactaatgaaacccagcagactgtatgatgcttacgaactgaaacacgcgcttaaaggcgctggcactaacgagaaggttttgaccgagatcatcgcctcacggactcctgaagagctgcgtgcaataaaacaggtgtacgaggaggagtatgggagctcactggaagatgatgtggtgggggataccagcggttactaccagcggatgcttgtggtgctattacaggcaaatcgagaccctgacgctggcattgacgaggcgcaagtggaacaagatgcacaggccctgttccaggctggtgaacttaaatggggcaccgacgaggagaaatttatcactatctttggcacccggtctgtgagccacctgcgcaaggtcttcgacaagtacatgaccattagcggtttccagattgaggagaccatcgatagggaaacctccggcaatctagaacagctgctgctggccgtggtgaaaagtattcgtagcataccagcatacctagcagaaactctgtattacgctatgaaaggtgcgggaaccgacgatcacacacttatccgggttatggtttccaggtctgagattgacctgtttaatatccgtaaggaatttcggaagaatttcgcaacctccctgtattccatgatcaagggagacacctcaggcgattataaaaaggccctgctactgctctgcggtgaggatgattag

SEQ ID NO: 214561 - DNA, 2022 bp, Artificial Sequence
  Description of Artificial Sequence: Synthetic coding sequence
atggcaaaaccagcacagggggcaaagtataggggcagcatccatgactttcccggatttgaccctaatcaggatgcagaagctctctatactgcgatgaaaggcttcgggtctgacaaggaagcaatactggacattattacaagccgatccaaccggcaacggcaggaagtgtgtcaatcatataaatctctgtacggtaaagacctgatcgccgatctcaagtatgaattaacaggaaagttcgagaggctgattgtgggactgatgagacctcccgcatattgtgatgccaaggaaatcaaagacgcaatctctggaatcgggacagatgagaagtgccttattgaaattctcgcctctcgcacaaatgaacaaatgcaccagcttgtcgcagcatacaaggatgcctacgagagggaccttgaagctgatattattggcgatactagcggacattttcagaaaatgcttgttgtgctgctacaaggcaccagagaggaagatgacgtcgtaagcgaagatcttgttcagcaggacgtgcaggacctctacgaagcaggggagctgaagtggggtactgacgaagcacagttcatttacattctgggcaaccggtctaagcaacacctaagacttgtgttcgatgaatacctgaaaaccactggaaagccaatagaagccagtattcgtggggagttgtccggagacttcgagaaacttatgctggctgttgtcaagtgtattagaagcacccctgaatacttcgcagagcgattgtttaaggctatgaaaggcctcggcacccgcgacaacacattgatcagaatcatggtcagccgttctgagctggacatgttagacatcagagagatttttcgcactaagtacgagaagtccctgtactctatgatcaagaacgacacctccggagagtataagaagacattgttgaaactcagcggaggcgatgacgacgcagcaggtcagtttttcccagaagccgcacaggtggcatatcagatgtgggagctgagtgcagtggctagagtcgagctcaagggcaccgtccgccctgccaacgatttcaatccagacgcagatgccaaagcactccggaaggccatgaagggcctgggtactgacgaggacacaatcatcgatatcattacgcataggtctaacgtccagcggcagcaaattcgacagacctttaagtctcacttcgggagagaccttatgactgacctgaaatcggagataagcggagacctggctcgccttatactcgggttgatgatgcctcctgcacactatgatgccaagcagctgaagaaagctatggaaggagccggtacggacgagaaggctttgattgagattctggccaccagaaccaatgctgagattcgtgctattaatgaagcttacaaggaagactaccacaaatctctggaggacgctctgtcctccgatacatcagggcactttcgcaggattctgatctctctcgccacgggacatcgcgaagaggggggtgagaatctggatcaggcccgtgaggatgcccaagtagccgcagagatactcgaaatcgccgatactccgtccggcgataaaaccagtttggagactagattcatgacaatactgtgcacaaggtcctacccccacctgcggagagttttccaggagttcataaagatgacgaattatgatgtcgagcatactataaaaaaggagatgtccggggacgtgcgggacgcattcgtggctattgtgcaatctgtgaagaacaaacctctgttcttcgccgacaagctatataaatccatgaagggcgctggtaccgatgagaaaaccttgacccggatcatggtttcccggtccgagatcgacctactcaacatacgaagagaatttatagaaaaatatgataagagcctccaccaggctatcgaaggagatacaagtggcgatttcctaaaggctttactggccctctgcggaggcgaggactag

SEQ ID NO: 214562 - DNA, 2004 bp, Artificial Sequence
  Description of Artificial Sequence: Synthetic coding sequence
atggccaagccagcgcagggagccaagtacaggggaagtatacacgacttccccggattcgacccgaaccaggacgccgaagcgctgtatacagctatgaagggtttcggctctgacaaggaagctatcctggatatcatcaccagcaggtcgaaccgccagagacaagaggtgtgtcagtcctacaagagtctctatggaaaggatctgatcgccgatctcaagtacgagcttacgggaaagttcgagcgtctgatagtgggattgatgcgcccacctgcttactgcgacgcaaaggagattaaggatgccatcagcggtataggaactgatgagaaatgtttgatagagattctcgccagtcgaaccaacgagcagatgcaccagcttgtggctgcctacaaggacgcatatgaacgggacctcgaagcagacattattggcgacacctcaggtcatttccagaaaatgcttgtggtactcctgcagggcacccgggaggaggatgacgttgtctctgaggaccttgtgcagcaggatgtgcaggacctgtatgaggccggagagcttaagtggggcacagacgaggcccagttcatttacatattgggaaacaggtcaaaacaacacttacgccttgtgtttgatgaatatttgaaaaccaccggaaagcccattgaggctagtattcggggagagctcagcggggatttcgagaagctgatgctggccgtcgtgaaatgtatccggtccacacccgaatattttgcagaaagacttttcaaggccatgaagggcctgggtacaagagacaacacactcatcagaatcatggtcagcaggagtgaactcgacatgttggacattcgggaaatattccggaccaagtacgagaaatcactgtatagtatgatcaaaaatgatacgagcggcgaatacaaaaaaacgttactcaagctctccgggggtgatgacgacgctgctggtcaattcttcccagaagcagcgcaagtcgcgtatcaaatgtgggaactttcagcagtagcgcgagtcgagcttaagggaacagtacgacctgccaatgacttcaacccagatgcggacgcgaaggccctgcgtaaggctatgaaaggcctcggcacagatgaagacactatcatcgatataatcacacacagatccaacgtgcaacgccagcaaatacggcagactttcaaatcgcactttggcagagaccttatgactgacttgaagtctgaaatctctggggatctcgcccgtctaatccttggcctgatgatgccgcctgcccactatgatgcaaaacagctgaagaaagccatggagggagccggtaccgatgagaaagctctcattgaaattttagcgacaagaaccaacgcagagatccgcgctattaacgaggcttacaaggaggattaccacaaaagtctcgaagatgcacttagcagcgatacatcgggtcatttccgaagaattctgatcagtctcgcaactgggcaccgtgaggagggcggagagaatcttgaccaagccagggaggatgcacaggagattgccgacacccccagtggggacaaaacatctcttgagactcgttttatgactatcctgtgcactcgctcttacccccatctcagacgtgtttttcaagaatttattaagatgaccaattacgacgtcgagcacactattaaaaaggagatgtccggtgacgttagagacgcatttgtggctattgtacagtccgttaaaaacaagccactctttttcgctgataagctgtacaaaagtatgaaaggcgcaggtactgacgagaaaactcttacaagaatcatggtttctaggagcgagattgatttactgaacatccgcagagaattcatcgagaaatatgataagagtctacaccaggccattgagggtgatacctcaggggactttcttaaagctctactggcactctgcggaggagaagattag

SEQ ID NO: 214563 - DNA, 333 bp, Artificial Sequence
  Description of Artificial Sequence: Synthetic coding sequence
atggccaaaccagcccaaggcgcaaagtaccggggttccattcacgactttcctgggtttgatccgaaccaggacgcagaagcgttgtataccgccatgaagggcttcggttcagacaaagaggctattctggatatcatcacaagccgaagcaatcgacagagacaagaagtatgtcaatcttacaagtccctttatggcaaagatctgatcgccgatctcaaatatgagctgactgggaaatttgagcggctgattgtcgggctgatgcgccctcctgcatattgtgacgccaaagaaataaaggatgctatctctggaatcggcacttag

SEQ ID NO: 214564 - DNA, 1926 bp, Artificial Sequence
  Description of Artificial Sequence: Synthetic coding sequence
atgaaaggcttcggctccgacaaggaagcaattctggatatcatcaccagcaggtcgaataggcagaggcaggaagtatgtcagtcctacaagtctctgtacgggaaagatctgatagctgatctaaagtatgagttaacaggaaaattcgaaagattgatagtggggttgatgcggcctccagcatactgcgacgccaaggaaataaaggacgctatctccgggatcggcacggatgaaaagtgcctgatcgaaatactcgccagtagaacaaacgagcagatgcaccagctggtggccgcttataaagacgcctatgagcgggacctggaggcagacattattggcgacacttcaggacactttcaaaagatgttggtcgtcctgttgcaagggacaagagaagaagatgatgttgtttccgaggatttggtacagcaggatgtccaggacctctacgaagctggggaactcaagtggggcactgacgaagctcagttcatctacatcctaggaaaccgctcaaagcaacatctacggctggtgttcgatgagtaccttaaaaccaccgggaagccgatcgaagcttccattagaggggagctgagtggggactttgagaagctcatgctcgcagtcgtgaagtgtatccgctctacaccggagtattttgctgaacgtttgttcaaggcaatgaaagggctcggcacccgggataatacactgattcggataatggtttcgagatctgaattagacatgctggacatccgcgagatcttccgaactaagtacgaaaaaagcctgtacagcatgattaagaatgacactagcggcgagtacaagaaaacgctgttgaagcttagcggcggagacgacgacgccgcaggccagttctttcctgaggctgcccaagttgcgtatcagatgtgggagctgtccgccgtggctagagttgagctgaaaggcaccgtgcgtcctgcaaatgatttcaatccggacgcggacgccaaggctttgaggaaggcaatgaaggggcttggaacagatgaggatactattatcgatattattactcacagaagcaacgtgcagcgccagcagatacgccagactttcaagagccattttgggagggatctcatgactgatctgaagtcagagatcagtggagacctggcacggctgatcctagggctgatgatgcctccggcacattatgacgccaaacagctgaaaaaggctatggagggggctggaacagatgaaaaggccctcatagaaatcctggctacgcgaactaacgccgagatcagagcaataaatgaagcctacaaagaggactaccataagagcctggaggatgcgctttcgagcgataccagcggccattttcgtcggatcttaatctccttagcaacaggtcacagggaagaggggggagagaatttggaccaggcccgtgaggacgcgcaggtagcggctgaaatcctcgagatcgcagacacaccttccggagataagacttctctagagactcgctttatgaccatcctgtgcacgcggagctacccacacttgcggagggtttttcaggagttcatcaaaatgaccaactacgacgtcgaacatacaattaagaaggagatgtcaggagacgttagggacgcatttgtggcgattgtacaatctgttaaaaataaaccgctgttcttcgcagacaagctatacaagagcatgaagggcgcagggaccgatgagaagaccctgacacggatcatggtgtctagatccgagattgacctgttaaatattagacgggaattcatcgagaagtacgataagtcactccaccaagctattgagggtgatacaagcggggattttctgaaggccttactggcactgtgtggcggagaggactag

SEQ ID NO: 214565 - DNA, 1644 bp, Artificial Sequence
  Description of Artificial Sequence: Synthetic coding sequence
atgcatcagctggtggcggcatataaagacgcatatgagcgcgacctcgaggcagatatcatcggggataccagcggccattttcagaagatgctggttgttctcctacaggggacacgggaagaggatgacgtcgtatcggaggatcttgtccaacaagacgtacaagatctctacgaggccggagagctgaagtgggggaccgacgaagctcaattcatttatatcttgggcaataggagcaaacagcacctgagactcgtatttgatgagtatttgaagaccactgggaaacctattgaagcctcaatccgcggagaacttagtggcgactttgaaaagcttatgttagccgtggttaagtgcataagatctacccccgagtatttcgcggagagactattcaaggcgatgaaaggccttggcacccgggacaacacactgattcgaattatggtatcaaggagcgagttagatatgctcgacattagagagatcttccgtaccaagtatgaaaaatcactgtattcaatgatcaagaacgacaccagcggcgagtacaagaaaacccttctgaaattatccggaggcgatgacgatgcggctggtcaattttttccagaggctgcccaggtggcctaccagatgtgggagcttagcgccgtggcacgcgtggagctcaaaggaacagtgcggccagccaatgatttcaatcctgatgctgacgccaaagctctgcgaaaggctatgaaagggctcgggaccgacgaagatacgataatcgatattatcacacacagaagtaacgtacagaggcagcaaattcgtcaaactttcaaatctcattttggcagggatctcatgacagatttaaagagtgagatttcaggagacctggcccgacttatcctcggccttatgatgccgcctgctcattacgatgctaaacagttaaaaaaggctatggaaggcgcaggcaccgacgaaaaggctctgattgagatcttggcgacacgcaccaatgctgaaatacgcgcaataaatgaggcttataaggaagattaccacaaaagcctggaagacgctctgagttccgacacatctggccacttcagaaggattctaatctctctcgcaaccggacacagggaggagggtggcgagaatcttgaccaggctagggaagacgcccaggtggcagccgagatcctggaaattgctgacacaccttcgggggacaaaaccagcctggagaccaggttcatgacgatcttgtgcacaagatcatacccacacctgcgccgtgtgttccaggagtttattaaaatgactaactacgatgtcgaacataccatcaaaaaggaaatgtcgggcgatgtccgagacgctttcgtagccatcgtccagagtgtcaaaaacaagccattgttttttgccgacaaactgtacaagtccatgaaaggcgcaggaacagacgagaagaccctgactagaatcatggtcagccgttctgaaatcgatctgctcaatattcggcgagaattcatcgagaagtacgacaaaagcttgcaccaggcaatcgaaggcgatacctctggagacttcctgaaggccctgctggccttatgtggaggggaagattag

SEQ ID NO: 214566 - DNA, 1467 bp, Artificial Sequence
  Description of Artificial Sequence: Synthetic coding sequence
atgagttaccctgggtacccaccaaccggataccccccatttccgggttatccacccgctggccaggagagttcctttccaccctccggtcagtacccatatcctagtggattccctccaatgggagggggagcctatccacaagtgccctcctccgggtacccaggagccggaggctaccctgcaccagggggatacccagctccgggaggctacccgggagcacctcagccaggcggtgcacctagctatcctggagttcccccaggacagggattcggggtgccaccgggtggcgctggattctcagggtatccccagcccccatctcagagctatggcggtgggccagctcaggtgcctctgccaggaggcttccctggtggccagatgccatctcaatatccaggtggccagccgacctatccttcccagatcaacaccgattcttttagttcttacccagtgttcagtccggtgtctctggattatagcagcgagccagccaccgttactcaggttacacaaggaactattcggcctgcagccaatttcgatgccatccgggatgccgaaattctgcggaaggccatgaaggggtttggtacggatgaacaagccatcgttgacgtggtggccaaccggtccaacgaccagcgccaaaaaattaaagcggcatttaagacgtcgtatgggaaagacctcataaaggacctgaagagtgaattgagcggcaacatggaggagctgatcctggcactgtttatgcccccaacctattatgacgcctggtccctgaggaaagctatgcagggcgcaggcactcaggagagagtgctcatcgagatcttatgcacaagaacaaaccaggaaatccgtgagattgtaaggtgttaccagagcgagttcggccgtgaccttgagaaggacataaggtctgacacatctggtcacttcgagagactgctcgttagtatgtgccaggggaatcgggacgaaaaccaaagcataaatcaccagatggctcaagaggacgctcagcgcctgtatcaggctggtgagggaaggctcggcactgatgagagctgtttcaacatgattctggccaccaggtcatttccccagctcagggcaacgatggaagcttactctcggatggccaaccgggatttgctgtcaagtgttagcagggaattctcaggttacgtcgaatcgggccttaagacaattttgcagtgcgcgctgaacagacctgcgtttttcgcagaaagactctactacgccatgaagggtgcaggaacagatgactccactctggtgcgcattgttgtgacccggtctgagatcgacctggtgcaaatcaagcagatgttcgcacagatgtaccagaagacactgggcaccatgattgccggagacacaagcggcgactacaggcgccttcttttagcaatcgtggggcagtag

SEQ ID NO: 214567 - DNA, 1401 bp, Artificial Sequence
  Description of Artificial Sequence: Synthetic coding sequence
atgtcctacccaggctaccctccaacaggctatcctccatttcccggttatccaccagccggacaggaaagcagctttccacctagcgggcagtatccttacccatcagggttcccaccgatgggagggggagcctatccacaggttccttctagtgggtacccaggagcagggggataccccgcacccggtgggtatccggcaccaggcggatatccaggggcaccccagcccggaggtgctcccagctaccccggtgttcctccagggcaagggttcggagtcccgcctggtggtgcgggtttcagtgggtacccccagcctccttctcaaagctatgggggtggcccagcccaagtacccctccctgggggatttcctggtggtcaaatgcccagccagtatccaggtggccagccaacctatcccagtcagccagcaacagtcactcaagttacccaggggactatccggccagccgcaaacttcgacgccatccgggacgccgagatcctgagaaaggcaatgaaaggattcgggactgatgagcaggccatcgtggacgtagtggctaaccgctctaacgatcagcggcagaagataaaggcagccttcaagacaagctacggtaaggacttgattaaagacctcaaaagcgagttgagtggcaacatggaagagctgattcttgcactctttatgccacctacatattatgatgcatggagcctgcgaaaagctatgcagggcgcaggtactcaggaaagggtgctgatcgagattctttgtacaaggacgaaccaggaaataagagagatcgttcgttgttaccaatctgaatttggcagagacttggagaaggatatcaggagcgataccagtgggcatttcgagcgcctgctcgtctcgatgtgtcagggcaacagagacgagaaccagtccataaaccaccagatggcccaggaagacgcccagcgattataccaagccggtgaaggccgactgggcaccgatgaaagctgtttcaatatgattctggccaccagaagtttccctcagttaagagccaccatggaggcatattctcgaatggcaaatcgtgacctgttgagcagtgtgagtcgggagttcagcggctatgttgagtccgggctcaaaactatcctccaatgcgcgctgaatcggcctgctttctttgccgagaggctgtactacgcaatgaagggggctggcacagatgatagtacgctggtgcgtatcgtggtcacccgcagtgagattgatttggttcagattaaacaaatgtttgctcaaatgtaccagaagacactcggtacaatgatcgcaggtgatactagtggggattaccgaagactgctgcttgccatagtgggtcagtag

SEQ ID NO: 214568 - DNA, 435 bp, Artificial Sequence
  Description of Artificial Sequence: Synthetic coding sequence
atgtcgtaccctggctaccccccaacagggtacccaccttttcctggatacccaccagcaggacaagagtctagtttcccccctagtggacagtacccatatccgagtggatttccacccatgggaggaggcgcttatccccaagtgcctagtagtggctatcctggagctggcggatatcccgcacccggaggctatccagcccctggcggatatcccggtgccccacagcccggtggtgctccaagctaccccggtgtgcctcctggccagggtttcggcgttcctcctggtggcgctggttttagcggatatccacagcctccatctcaatcttatgggggaggtcctgcccaggtccctcttcctggcggatttcctgggggtcagatgccgtcacagtatccaggaggacagccaacgtacccaagctag

SEQ ID NO: 214569 - DNA, 1011 bp, Artificial Sequence
  Description of Artificial Sequence: Synthetic coding sequence
atgccctctcagtatccagggggacagcctacttacccaagccaacctgccacggtgacccaagtcacccaaggtaccatccggccagccgctaactttgacgccataagggatgcagagatactgcgtaaagcaatgaagggattcgggactgacgagcaggctatcgtcgacgtggttgctaacagatctaatgaccagcgccaaaaaatcaaagccgcattcaaaaccagctatggcaaggatctcattaaggacctgaagtcagaattatccggcaatatggaggagttaattctcgctctttttatgccaccaacgtattatgacgcttggagtttgcggaaagcaatgcaaggagccggaacgcaagagcgcgtcctcatcgaaatcctctgtactcgcaccaaccaggagatccgcgaaattgtgcgctgctaccagtctgaattcggtcgcgatctcgagaaagatatccgctcggacacaagcggtcactttgagcgcctgcttgtctctatgtgccagggcaatagagatgagaaccaatctattaaccatcagatggcccaagaggatgcccagcgcctttaccaagcaggcgaaggcagacttggcacggatgagagttgcttcaacatgattctggccactagatcatttcctcagcttagagccactatggaggcgtacagtcgcatggccaaccgtgatctgctctcttccgtgagtcgcgaattctccggatatgtcgagtcagggctgaagacaatcctgcagtgtgccctgaaccgaccggcattctttgccgagagactgtactacgctatgaagggcgcagggacagacgactccacgctggtacgtattgtggtcactcgttcagagattgacctggtgcagatcaagcagatgtttgcacagatgtaccaaaagactctgggaacaatgattgctggcgatacttcgggtgattaccgcagactcctactggcaattgtgggacagtag

SEQ ID NO: 214570 - DNA, 984 bp, Artificial Sequence
  Description of Artificial Sequence: Synthetic coding sequence
atggcatggtggaagtcatggattgaacaggaaggggtgacagtgaagtcctctagccacttcaaccctgacccagacgcagagaccctttataaggctatgaagggaattgggacaaatgaacaggccataatcgacgtgttaactaaacgctctaacacccagaggcagcaaatcgcaaagtcctttaaggcccaattcgggaaggacctgaccgagactctcaagagtgaactgtccggcaagtttgagcgcctgattgtggccctgatgtatccaccctatcggtacgaggcgaaagagctccatgatgccatgaaagggctgggaactaaagagggggtgattatcgaaattctggctagccgaaccaagaatcaactccgcgagataatgaaagcctatgaagaagactatggctcctcgcttgaagaggacatacaggcggacacttctggctatttggagaggattttggtgtgtctgttacagggtagccgagatgacgtgagtagctttgttgacccgggactagcactccaggacgctcaagacctgtatgcagccggagagaagatccgtggcacggacgaaatgaaattcatcacaattctgtgtactcggagtgccacccatctgctgagggtctttgaggagtacgaaaagatcgcaaacaagtcaattgaggacagcataaagtctgagacccacggctccctggaagaggccatgttgaccgtcgtgaaatgtacccaaaacctgcattcctatttcgcagagcggctgtattacgcgatgaagggagctggaacacgcgatggtaccttgatcaggaatattgtgtctcggtccgagatcgaccttaatctgattaaatgccactttaagaagatgtacggaaaaaccctgagttcaatgatcatggaggatacaagcggcgactataaaaacgcattgttatcactcgtagggtcagacccttag

SEQ ID NO: 214571 - DNA, 831 bp, Artificial Sequence
  Description of Artificial Sequence: Synthetic coding sequence
atggcctggtggaagtcttggatcgaacaagaaggcgtgacagttaagtcatcgtctcattttaacccggatccagacgctgagacactgtataaggcgatgaagggaatcggggttggctctcaactcctctcccaccaggctgctgccttcgcatttcccagcagcgctctgaccagcgtgtctccatggggacagcagggccacctttgctgcaatcctgccggtaccaatgagcaggcgataatcgatgtgctgacaaagcgatccaacactcagaggcaacagatcgcgaaaagctttaaggcgcagtttggtaaggacctgacggaaaccctcaagagcgagttgtccggcaaattcgaaagactgattgttgcactcatgtaccccccatacaggtacgaagccaaggaactccacgacgcgatgaagggaagcagagatgacgtcagctctttcgtagacccagggctggccctccaagatgcccaggatttatatgctgcgggagaaaaaataaggggaaccgatgagatgaagttcatcacaatcctgtgcaccagaagtgcaacccatcttctccgcgtgaagtgcacacagaatctgcatagctatttcgctgaacgtctctactacgcaatgaagggtgctgggactagggatgggaccctgattcgcaatatcgtgtctagaagcgagatcgacctcaacttgatcaaatgtcactttaagaagatgtacggaaagacactcagctcaatgattatggaagacacgtctggggactacaagaacgctcttctttctttggtggggagtgatccatag

SEQ ID NO: 214572 - DNA, 798 bp, Artificial Sequence
  Description of Artificial Sequence: Synthetic coding sequence
atggcctggtggaaaagctgggacctgactgagactctgaaaagcgaactctccgggaaatttgaaagactaatcgtagcgctgatgtatcctccatacagatacgaagctaaggagctacatgatgctatgaaaggtcttggtactaaggagggagtcatcattgaaatcttggcaagcagaaccaagaatcagctcagggagatcatgaaggcgtatgaagaggactacggtagcagccttgaggaggatatacaggctgacacctccgggtacctggaacgtatcttagtttgtctgctgcaagggagccgcgacgatgtctcttcgttcgtggatccagggctggccctgcaagacgcccaagatctctacgcagctggtgaaaaaatacggggtacagacgagatgaagttcatcactattctttgcaccaggtcggctacacacctgctaagggttttcgaggagtacgagaaaatcgcaaataaatcgatagaagatagcatcaaaagtgagacccatgggagtctggaagaggccatgctgaccgttgtgaagtgcacccagaacttgcatagctactttgcagagcgactgtattatgctatgaaaggagcgggaacccgcgatggcacacttatcagaaatatcgtctcacgcagcgagattgacctgaatttgataaagtgccatttcaagaaaatgtatgggaagacactgtcttccatgatcatggaggatacttcgggcgattataaaaacgcactcctgagcctggtggggtccgatccatag

SEQ ID NO: 214573 - DNA, 426 bp, Artificial Sequence
  Description of Artificial Sequence: Synthetic coding sequence
atggcctggtggaaaagttggatcgaacaggaaggcgtcacagtaaagtcgagcagccactttaacccagatcccgatgccgaaaccttgtataaggccatgaagggcatcggcactaatgaacaggcaatcattgatgtcctgacgaagcgcagtaacacccagcggcagcagatcgcgaaatccttcaaagcccagtttggcaaggacttgaccgagacgctcaaatccgagctgagcgggaagtttgagcgtctgattgtcgccttgatgtatccaccctaccggtacgaagccaaagaacttcatgacgcgatgaaaggactgggaaccaaggagggcgttataatcgagatcctcgccagtaggaccaagaatcagctccgggagattatgaaagcttacgaggaggggcagcaggggtag

SEQ ID NO: 214574 - DNA, 1038 bp, Artificial Sequence
  Description of Artificial Sequence: Synthetic coding sequence
atgtcagtcaccgggggtaagatggcccctagtcttacccaggaaattctgagccacctaggtctggcgagcaaaacagccgcttgggggactttagggaccctgagaaccttcctgaatttttccgtcgataaggatgcacagcgcttgctgagggcaatcacaggacaaggggtcgatcgttccgccattgtggacgtcctgactaaccggtcacgggaacagcgtcaactgatttcccggaattttcaggaaagaactcagcaagacttaatgaagtcattgcaggcggctctgtctggaaatctggaacgtattgtgatggcattgcttcaacccactgcccagttcgatgctcaagagctacgcaccgccctgaaagcttccgattccgcggtggatgtggctattgagatcttggcaactagaacccctcctcagctgcaggagtgtctcgccgtgtacaagcataatttccaggtagaggccgttgacgacataacctcagagaccagcggtattcttcaggatctgctgctagctctcgctaaaggcggtcgggatagttatagtggtatcatcgattataatctggcagagcaggacgtccaggccttgcaaagggccgaagggcctagtcgggaggaaacctgggttccagtgttcacccagagaaaccccgagcatctaatccgcgtgtttgaccagtaccagaggtcaacagggcaagagctcgaggaggccgtccagaacagatttcacggggacgcacaggtagcattactgggattggctagtgttatcaaaaacacacctttatattttgccgacaaactccaccaggccctgcaggaaacggagcctaattaccaggtcctgatccgaattctgattagcagatgcgagactgatttgctgtccattagagcagaatttcgcaaaaaattcgggaagtcactctacagttccctgcaggatgcagtgaaaggggattgtcagtctgccctactggccctctgtagagctgaggacatgtag

SEQ ID NO: 214575 - DNA, 1929 bp, Artificial Sequence
  Description of Artificial Sequence: Synthetic coding sequence
atgctgacacgcccttcccaggtgctattgaactcgctgtccgtggatcccgacgccgagtgtaagtatggtttgtactttagagatgggaggaggaaggtcgattatattcttgtgtatcaccacaaaaggccctctgggaatcgcacgctcgtgcgcagggtgcaacactctgacactccatctggggcacgcagcgttaagcaggatcaccccttaccgggtaagggtgcctcactggacgctgggtctggagagccgccaatggattatcacgaggacgataaacggttccgcagggaggaatatgagggcaaccttctcgaggctggtttggagcttgagagggatgaggacactaaaatccacggcgtcggctttgtcaaaatccatgcgccttggaatgtgttgtgtcgggaggctgagttcctaaaactgaaaatgccgaccaagaagatgtatcacatcaacgagacacgtggactgctgaaaaagattaattctgtcctgcagaaaattactgaccctattcagccaaaggtggctgaacaccgcccacaaactatgaagagactgtcttacccattttcccgcgaaaagcagcacttgtttgacttgtctgacaaggattcattctttgattccaaaacgagatccacgatcgtgtacgaaatcctgaaacgaactacctgtacgaaagccaaatattctatggggatcacaagcttactcgctaacggcgtgtatgcagccgcatacccactgcacgatggagattacaacggggagaatgtggaatttaacgataggaagttgctctacgaggaatgggcccgatacggagtgttctacaaatatcagccaattgatctggtccgcaaatactttggtgagaagatcggattgtacttcgcatggttgggagtatacactcagatgcttattcccgcatccattgtaggcataatcgtgtttctctacggatgcgcgaccatggatgagaacattccttccatggagatgtgcgaccaacgccataatatcaccatgtgtcctctgtgcgacaaaacatgctcctactggaaaatgtcgagtgcctgtgccactgcgagggcttcccacttattcgacaacccggcaactgtcttcttcagcgtgttcatggccctgtgggcagccacatttatggaacactggaaacgcaaacagatgagactaaattaccgatgggacttgaccggtttcgaggaagaggaggatcaccctcgtgcagagtatgaagctagagttctggaaaaaagcctcaagaaggaaagccgcaataaagagactgacaaggtgaagctgacatggcgcgatagatttccagcatatctgactaacctggtctccatcatcttcatgatcgccgtgacttttgccatagtattgggcgtcatcatctacagaatctcgatggctgcagccctggccatgaacagctctccttcagtgcggtcaaacatccgtgttacagtgacagcgacagctgtgatcattaatctagtcgtcataatcctgctcgacgaagtgtacgggtgcatagccaggtggctgaccaagattgaggtgcccaaaaccgaaaaaagcttcgaggaacgcctgatcttcaaagccttccttcttaagtttgtcaattcttatacccctattttctatgtggcgtttttcaaaggccgattcgttggaagacccggagactacgtctacatattccgcagctttaggatggaggaagtgacagagatccttttcattagtgggagccctttctgtttagcctacgacttatccactccatgcacgtgggaaaaacagttgcagcatatctgttccgcgaagtcttcaagatttttgagcttcctcctcgagacttttctgtttccctag

SEQ ID NO: 214576 - DNA, 2961 bp, Artificial Sequence
  Description of Artificial Sequence: Synthetic coding sequence
atgcgggtaaacgagaagtatagcacccttcctgccgaagaccggtcagtccacataatcaatatttgtgccatcgaggacatcggctacctcccctctgagggtaccctgttaaacagtttgtcggtggaccccgatgcggagtgcaaatacggactttactttcgagacggcagacgaaaagtcgattatatactggtgtatcatcacaaacgccctagcggcaaccgtacattagtcaggagggtgcagcactctgacacgccttctggggcacgctccgtcaaacaggaccatccattgccagggaagggcgctagccttgatgccggatccggggaacccccaatggactatcacgaggacgacaagaggttcaggcgggaggaatacgaggggaatctgttggaggccggacttgaactcgagcgggatgaagatacgaaaatccatggagtgggatttgtcaaaatccatgcaccttggaacgtgctgtgtagagaggctgagttcctcaaactcaagatgccaacaaaaaaaatgtaccacatcaacgagacacggggtctgctcaaaaagattaatagtgtgcttcagaaaattactgaccccatccagccgaaagtagccgagcatcggcctcagactatgaaaagactgtcctatccattctcaagggagaaacagcacttgttcgacctgagtgacaaagacagcttcttcgacagtaagaccagatccacaatcgtgtacgagatactcaagcgaaccacatgcacaaaggcaaagtattccatggggataacttctttgttagccaatggcgtttatgccgcagcctacccgctgcacgatggcgactacaacggtgagaacgtggagttcaacgatcggaagctgctctatgaggaatgggccaggtatggcgtgttttataagtatcagcctattgacctagtcagaaagtattttggggagaaaatcggtctgtactttgcttggcttggtgtgtacacacagatgcttatccctgcaagcatcgtaggcataatcgtttttctgtacggatgcgcaaccatggatgagaatatcccgagcatggaaatgtgtgatcagcgccataacatcacaatgtgtcctctctgtgataagacctgtagttattggaaaatgtcatccgcctgcgctactgcccgtgcctctcacctattcgacaatccagcaaccgtgtttttctctgtattcatggcactgtgggccgctacctttatggagcattggaaaagaaagcagatgagactgaactataggtgggacctaaccggctttgaggaagaggaggaggctgtgaaagatcatccacgcgctgagtatgaagcgagagttctcgagaagtcacttaaaaaggagtcaagaaataaggagaagcgtcgccacatcccagaggagagcactaataagtggaaacagagggtgaagactgccatggcaggagttaaattgaccgataaggttaagttgacttggcgtgacaggttccccgcatacctgaccaatctcgtgtcaattattttcatgattgccgtaaccttcgccatagtccttggtgtgatcatttacagaatctccatggccgctgctcttgcaatgaactccagtcctagcgttagatccaacatccgggtgaccgtgaccgctaccgccgtgattattaacttggtggtgattattttgctggacgaggtgtacggctgcatcgcccgttggctgaccaagattgaggtcccaaagacagagaagagcttcgaggagcgcctcattttcaaagccttcctgctgaagttcgttaactcgtacacacctatcttctacgttgcgttcttcaaaggaaggttcgtaggacgaccaggcgattacgtttatatctttaggtcttttaggatggaagagtgcgccccagggggatgcctgatggaactttgcattcagttgtcgattatcatgcttggtaagcaacttatccagaacaacttgttcgagatcggaataccgaaaatgaagaaactcatccgctatctgaagttgaaacagcagtctccacccgaccacgaggaatgtgtcaagcggaaacagaggtatgaagtggactataatttggagccattcgcaggcctgacacccgagtacatggagatgatcatccagttcggctttgtgacccttttcgtcgcatcctttcctctggcgcctctgtttgccttgttgaacaacattatcgaaatacggttagacgcgaagaagttcgttacagagctccgcagacccgttgctgttcgcgctaaagacatcggcatctggtacaacattctgcgtggtattggcaaactagcagtaataataaacgccttcgtgattagctttaccagcgacttcataccgaggctggtttacttgtacatgtattccaagaatggtaccatgcatggtttcgtcaaccatacactgtctagttttaacgtgagcgattttcagaacggaaccgcccctaacgaccctctcgatcttggctacgaggtccagatttgtaggtataaggattacagagagccaccctggtcagaaaataaatatgacatctcgaaggacttttgggctgtcttggcagcccgtcttgctttcgtgatcgtgttccagaaccttgtaatgttcatgtccgacttcgtcgactgggttattcctgatataccgaaggatataagccaacagatccacaaagaaaaggttctcatggtcgaactgttcatgcgagaggaacaagacaaacagcagctgttggagacatggatggagaaggagcggcaaaaagatgaacctccatgcaatcatcataacacaaaagcctgccctgacagccttgggtccccagctccttcacatgcttatcatggaggagtgctatag

SEQ ID NO: 214577 - DNA, 2523 bp, Artificial Sequence
  Description of Artificial Sequence: Synthetic coding sequence
atggattatcacgaagacgataagaggtttcggcgagaggagtacgaggggaacctactggaggcaggactcgaattagagcgtgatgaggacactaagatacatggcgtgggcttcgtcaaaatccatgcaccatggaacgtactatgcagagaagccgagttcttgaagttaaagatgccaactaaaaaaatgtaccacataaacgaaactcggggtttattaaaaaaaattaattccgttctccagaagatcaccgaccctatccagcccaaagttgccgagcacagaccacagactatgaaacgcttgtcttaccccttttctagagagaagcagcatctgtttgatttgtctgataaagattcttttttcgactcgaaaacaaggtctacaattgtgtatgagatactcaaacgcaccacttgcactaaggctaaatactctatgggtattacatccctgctcgcaaatggcgtgtatgctgctgcctacccactccatgatggggactacaatggcgagaacgtggagttcaacgaccgcaagcttctttatgaggaatgggcgagatacggagtgttttacaagtaccagccaatcgacctcgtgagaaaatactttggggagaagattgggttgtacttcgcctggctgggtgtatacacacagatgctgatccctgcgtcgatagtggggatcatcgtctttttgtacggatgtgccactatggatgaaaacattcccagtatggagatgtgcgaccaaagacacaacatcactatgtgcccactctgtgataagacctgtagctactggaaaatgtcaagcgcctgcgccacggccagggctagccatctgttcgacaatcccgcaactgtatttttctctgtatttatggctctgtgggcggctaccttcatggaacattggaaaagaaagcaaatgcgcttgaattatcggtgggacctgacaggattcgaggaggaggaagatcaccccagggctgagtatgaggcccgtgtgttagaaaaaagcctaaagaaggaatctaggaacaaagaaaccgacaaagtgaagttgacatggcgtgaccgcttccccgcatacctgactaaccttgtgtcaatcatttttatgatcgccgtgacattcgcaattgtactcggcgtgatcatttacaggatctctatggctgctgctctcgccatgaattctagccccagtgtgcgatccaacatcagagtgaccgtgacagcaacggcagtcattattaacctggtagtcatcatactactcgacgaggtatacggatgcattgctcgttggctcactaaaatagaagtacccaagactgagaagagtttcgaggagaggcttatcttcaaggcttttctgctcaaattcgtgaactcctatacgccgattttctatgtcgcattttttaaggggcgattcgtgggccgtccgggtgactacgtgtatattttccgcagctttcggatggaggaatgcgccccagggggatgtcttatggagctctgcatccagctcagcataatcatgctcggaaaacagctaatccagaataacctatttgaaatcggaataccaaaaatgaaaaagctgatcagatatttaaaacttaagcaacagtcgcctcctgatcatgaagagtgtgttaaaaggaaacagagatacgaagtggactacaatttagagcccttcgccggactgacgccagagtacatggaaatgatcattcaattcggttttgtgaccctattcgtcgcttccttccccctggccccactgtttgccctgcttaacaatataatcgagattaggttggatgcaaaaaaattcgtcacggaactcaggaggccagtggccgtgcgggctaaggatattggcatttggtacaacattctgcgtggcatcggcaagctcgccgtgatcataaacgcatttgttatcagcttcacatctgattttatcccaaggctcgtctatttgtacatgtattctaaaaacggaaccatgcatgggttcgtaaaccacaccctgagcagcttcaacgtgagtgactttcaaaacggtacggctccaaacgaccctctcgatttgggatatgaggtgcagatctgcagatataaagactaccgggaacccccatggtctgagaataaatatgatatcagcaaggacttttgggctgtactggcagctcgcctcgcatttgtcatagtgttccagaatctggtcatgtttatgtctgatttcgttgattgggtgatcccggacatccctaaggatatctcacagcagatccacaaagagaaagtgttaatggtggaactgttcatgcgggaggagcaggataaacagcagctgctcgaaacctggatggagaaggagcgccagaaggacgagcccccatgcaaccaccataatacaaaggcatgtccggactcgctaggctcccccgctcccagtcacgcgtaccatggcggtgtgctttag

SEQ ID NO: 214578 - DNA, 2523 bp, Artificial Sequence
  Description of Artificial Sequence: Synthetic coding sequence
atggactaccacgaagatgacaaaaggtttagaagggaggagtatgagggcaatctcctagaagccggtctcgaactggagcgcgacgaggatacgaagattcatggcgttggatttgttaaaattcacgcgccatggaacgtattatgtcgagaggcggaatttctgaaactcaagatgcctaccaaaaaaatgtaccatataaatgaaacccgtggccttctgaaaaaaatcaattctgtgctacagaaaataaccgatccgattcagcccaaagtggctgaacaccggccacagaccatgaagaggctttcttatcctttctcaagagaaaaacaacacctcttcgatctctcagacaaggatagcttctttgattctaagactaggtcaactatcgtctacgagatccttaagcggaccacctgcaccaaggcaaagtatagcatgggaatcaccagcctattggccaacggagtctacgcagcagcatatcctctacatgatggcgactataacggtgaaaacgtggagttcaatgacaggaagctcctgtacgaggagtgggccagatatggggtcttttataaataccagcctattgatctcgttagaaagtacttcggcgagaagatagggctgtacttcgcatggctgggcgtgtacacacagatgctgatccctgccagcatcgtgggaatcatcgtcttcctgtacggctgcgcgaccatggacgaaaacatcccttcaatggaaatgtgtgaccaacggcataacatcacaatgtgtcctctgtgtgataagacatgttcatattggaagatgtcctctgcctgcgccaccgccagagccagccatctttttgataatcccgcaaccgtgtttttcagtgtgtttatggccctgtgggcagcaacttttatggaacactggaaaaggaaacagatgaggctgaattatcgctgggatctcaccggcttcgaagaggaggaagatcacccccgtgccgagtatgaagctcgcgtcctggaaaaatccctgaagaaggaaagtagaaacaaggagaccgataaggtgaaactgacctggagggatcgatttcctgcatatcttaccaatttggtgtcaatcatattcatgattgccgttactttcgccattgtcctcggtgttattatctacagaattagcatggccgctgccttggccatgaattctagtccttcagtccgatccaatattcgtgtcacggtcactgcgacggcggttatcattaatctggtggtgattatactcctagacgaagtgtacgggtgtatagccaggtggctgacaaagatcgaggttcccaagaccgaaaaatcattcgaagagagactgatcttcaaagcttttctcttaaaattcgtcaacagctatactcccatattttatgtggcctttttcaagggcaggttcgtcggccgtcccggtgactatgtgtacatcttcagaagctttcgtatggaggaatgcgctccaggcggatgtctgatggagctgtgtattcagctttcgattataatgcttggaaaacagcttatccaaaataacctgttcgagatcggtattcccaagatgaagaaactgatcaggtacctcaaacttaagcagcagtctcctcccgatcacgaggaatgcgtaaagagaaagcaaaggtatgaagtcgactataatctggaacctttcgctggcctcaccccagaatacatggagatgatcatacagttcggattcgtcactctgtttgtggcctcatttccgttggcgccactgtttgcccttcttaacaatattatcgagatcagactggatgctaagaagttcgtaacagaactgcggcgaccagtggccgttcgcgcaaaagacatcgggatttggtacaatatactgcgtggcattgggaagttggccgttatcatcaacgctttcgttatttcttttacttcagactttatcccccgtcttgtctacctgtatatgtattcaaaaaacggcaccatgcacggttttgtcaaccatacgctctcctcattcaacgtgtcagatttccaaaatggaacagctcccaatgacccactagacctaggatatgaggtgcaaatctgtaggtacaaggactatagagagcccccatggtcggaaaataagtacgacatcagcaaggatttctgggccgtgctggctgccagactcgccttcgtgatcgtctttcaaaaccttgtgatgttcatgtctgattttgtggactgggtcatccctgatattcctaaggatatttcacagcagattcacaaggaaaaagtgctgatggttgagctgttcatgagggaagagcaagacaagcaacaactgttggaaacgtggatggaaaaggagagacagaaggacgagcccccatgcaatcaccacaacacaaaggcctgtccagactcactgggctctcctgccccatcgcacgcctatcatggaggcgtactgtag

SEQ ID NO: 214579 - DNA, 2961 bp, Artificial Sequence
  Description of Artificial Sequence: Synthetic coding sequence
atgagagttaacgaaaagtattctaccctgcccgcagaagataggtctgtgcatatcattaacatctgcgccatagaggatattggctacctcccctcagaagggaccttgctcaactctttgtcggtggacccagatgcagagtgtaagtacggcctgtattttagggacgggagacggaaagtcgactatatacttgtctaccatcataaaagaccttccgggaaccggaccctggtcaggcgggtgcaacactccgatacacccagcggagcgagaagtgtaaaacaggaccaccctctgcccggaaagggggcttcccttgatgccggatccggcgagccccctatggattaccacgaggatgacaaaaggtttcggagggaagagtacgaaggaaatctgctcgaagccggtcttgaactggaaagagatgaagacactaagatacacggggtgggtttcgtcaagattcatgccccatggaacgtcctgtgccgcgaagcagaattcctcaaattaaagatgccgacaaagaagatgtaccacattaatgaaaccagaggactgttgaagaagattaattccgtgttgcagaagatcacagaccccatccaacccaaagtggcagaacaccggccacagaccatgaagcgcttatcttaccccttttctagggaaaagcagcatctcttcgacttgagtgataaggattccttctttgactcaaaaacccggtcgaccatagtttacgagatactgaagcggacaacttgcacaaaggctaagtatagcatgggcatcacaagcttactcgccaatggagtttacgccgctgcctacccattgcacgatggcgactataacggagaaaacgttgagttcaatgacaggaagctgctgtacgaggaatgggccagatacggagtgttctacaaataccagccgattgatctggtgcggaagtatttcggagaaaagatcggactttatttcgcctggctgggtgtgtacacgcagatgctgataccagcttctatcgttggtattatcgtcttcctgtatggctgcgcaactatggacgaaaacatcccgtccatggagatgtgcgaccaacgacataatattacaatgtgccctctatgcgacaagacctgctcgtactggaagatgagctccgcttgtgccactgccagggcctcccatttgtttgataacccagccacggtatttttttcggtgtttatggccctctgggctgcaacttttatggaacactggaagagaaagcaaatgcgcctgaattaccgatgggacctgacagggttcgaggaagaggaaaaggccctcttggaccaccccagagccgagtatgaagccagggtcctggagaaaagcttgaaaaaggagagccgaaataaggaaaagagacggcacatcccagaagaatccacaaataagtggaagcagagagttaagaccgccatggcaggggtgaaactcacagataaagtgaaattgacttggcgtgacaggtttcctgcctacctaaccaatctggtctccatcatttttatgatcgctgtgacatttgcaatagttctgggggtcataatctaccggataagtatggcggcagccttagctatgaattcctcaccatctgttaggagtaacatcagagtgacagtcaccgccactgctgtcattattaacctcgtggtgataatcctgctcgatgaggtctatggctgtatcgccagatggttgacgaagatcgaggtccccaagacggagaagagtttcgaagagcggctgattttcaaagcattcctactgaagttcgtcaatagttacactcccatcttctacgtcgcctttttcaaaggacggttcgtggggagaccgggagattacgtatatatttttagatcattccgcatggaagagtgtgctccaggaggatgcttgatggaactgtgtatccagttatccatcataatgctggggaagcagcttattcaaaacaatctattcgagatagggatcccgaaaatgaagaagcttatcagatatctgaaactgaagcagcagtctccccctgatcatgaagagtgcgtgaaaagaaaacagaggtatgaagtcgactacaacctggaaccattcgccggactaactcccgaatatatggagatgataattcagttcggcttcgtgaccctctttgtcgcttccttcccactcgccccactgttcgctcttttgaacaatattatcgagattagacttgacgccaagaagttcgtaacagagctgcgcaggcccgtcgccgtgagggccaaagatattggcatctggtataacatcctcagaggaattggcaagctggccgtcatcattaacgccttcgttatcagtttcacgtccgattttatccccagactggtctacttgtacatgtatagcaagaatggtacaatgcacggatttgttaatcacaccctcagctcgtttaacgtcagcgacttccagaacgggaccgcacctaatgatcccctggacctaggttacgaggttcagatctgccggtacaaagactatagagaacccccatggtctgagaacaaatacgatatctccaaagacttctgggcggtgctcgcagccaggctagctttcgttatcgtgttccaaaatttggtaatgttcatgtctgatttcgtcgattgggtcatcccggatatcccaaaagacatttctcaacagattcacaaggagaaagttcttatggttgagctctttatgagagaggagcaggataaacagcagctactcgagacatggatggaaaaggaacgacagaaagatgagcctccatgcaatcaccacaataccaaggcttgtccagattccctgggaagcccagccccttcccacgcgtatcatggaggagtgctttag

SEQ ID NO: 214580 - DNA, 942 bp, Artificial Sequence
  Description of Artificial Sequence: Synthetic coding sequence
atgctagatgccgcaagtaaagcacgggaggctcccgaggccgctcctggctgggatgacccccagggcgagggtcgtcggggacggggagaaggtttgagttgggctgttggtcctcatcctgatcctggggtgttgatgcagggagaggtgtggagtggacggtttagtcatgccgtgatccagttcgggtttgtcacgctgttcgtggcctccttcccactcgctccacttttcgctctcctgaacaatattatagagatccggctcgacgcaaaaaagtttgtgaccgagcttagacgccctgtagctgtccgggctaaggacattggtatctggtacaatattcttcggggaattggcaagctggccgtgatcattaacgcttttgtcatctcctttacttctgactttatacctcggctggtctacctctatatgtattccaagaacgggacaatgcacggcttcgtgaatcacaccctatcaagtttcaacgtgtccgacttccaaaatggaacagcccctaacgatccattggacctggggtatgaggtccaaatctgtagatacaaggactaccgggagcccccatggtcggagaacaaatacgatataagcaaagacttttgggccgtcttagcagcccgactggcatttgtaattgtttttcagaatctggtaatgttcatgtcagattttgtagattgggtgatcccagacataccaaaagatattagtcagcagatccacaaggaaaaggtgttgatggtggagctattcatgcgcgaggagcaggacaaacagcagctgctcgaaacatggatggagaaagagagacaaaaagacgagccaccttgcaatcaccacaacactaaggcttgccctgacagcctgggctcccctgccccaagccatgcctaccacggtggtgtgttatag

SEQ ID NO: 214581 - DNA, 2235 bp, Artificial Sequence
  Description of Artificial Sequence: Synthetic coding sequence
atgaagcgcctttcgtacccattttctcgtgaaaagcaacacctcttcgacctgagcgataaggattcgttcttcgattcaaagacaagaagtaccattgtgtacgagatactgaagcggactacatgcaccaaggccaagtacagcatgggtatcacatccctcttagccaacggggtgtatgctgcagcttacccacttcatgatggcgattataatggcgagaatgtagagttcaacgacagaaaactgctttacgaggagtgggcccgatatggcgtattctacaaataccagcccatcgacctcgtaagaaaatatttcggcgagaagattgggctgtattttgcttggttaggagtttacacccagatgttaatacctgccagtatagttggcatcatcgtcttcctgtatggatgcgccaccatggatgagaatataccctccatggaaatgtgcgaccagcgacacaacatcactatgtgtccactatgtgataaaacgtgttcctactggaagatgtcatcagcctgcgccaccgcacgggcaagccatttgttcgataatccagcaacagtatttttttcggtttttatggccctctgggctgccacttttatggaacactggaaacggaaacagatgcggctgaattataggtgggacctcaccgggttcgaagaggaggaaaaagctctcctggaccaccccagagcagaatacgaggctagagtgctggagaaatcattgaagaaggaaagtcggaacaaggagacggacaaagtcaagcttacttggcgcgaccgtttccctgcatacttaaccaatctggtttctattatctttatgatagctgtgacttttgccattgtcctgggagtcattatttacagaattagtatggctgcagccttggctatgaacagcagcccaagtgtgagatccaatattagagttacagtcaccgctacagcagtgatcatcaatctcgtggtcatcatactgcttgatgaagtctacggctgcatcgcacggtggctgaccaagatagaggtgcccaagactgagaagagttttgaggagagactgatttttaaggctttcttgctgaagttcgttaattcctacacgccgatcttttacgtggcttttttcaagggaaggttcgttgggaggcctggagattacgtctacatatttaggtcttttcggatggaggagtgtgctccaggcggatgccttatggagctgtgcatccagctgtcaattatcatgcttggcaagcagctgatccagaacaatctgtttgaaattggcattcctaagatgaaaaagctgataaggtacctgaagttgaagcagcagagcccccctgatcatgaagaatgtgtgaaacgaaagcagaggtatgaggtggactataaccttgaaccattcgctggcctgacacctgagtacatggaaatgatcatccagttcggcttcgtaacccttttcgttgcaagttttcctctcgctccacttttcgctttgctaaacaacattatagagattcggctggacgctaaaaagttcgtgacagaactgaggagacctgttgcggtacgagccaaagacatcggaatatggtacaacattcttaggggtattgggaagctggctgtgatcatcaacgcatttgttattagcttcacctctgattttatacccagactggtgtacctctacatgtactcaaaaaatggaacaatgcacgggtttgtgaatcacaccctgagctcgttcaatgtgagcgactttcagaacggtacggccccaaacgatcctttagatcttggatacgaagtgcaaatttgtcgctataaagactatcgggagcccccatggtccgagaataaatacgatatatccaaagacttctgggctgtgctggctgctagactggcattcgtgatcgtgtttcagaacctggtgatgttcatgagtgactttgtagactgggtaattcccgacatacccaaggacatatcacagcagatccacaaggaaaaggttctgatggtcgaactcttcatgcgcgaggagcaagataagcaacagctgttggagacctggatggaaaaagagcggcagaaagatgaacccccatgcaaccaccacaataccaaagcctgtcccgatagcttaggtagccctgcgccaagccacgcctaccacggaggcgtcctgtag

SEQ ID NO: 214582 - DNA, 1983 bp, Artificial Sequence
  Description of Artificial Sequence: Synthetic coding sequence
atgaaggttaccctcagcgccctggatacgagcgaaagctccttcacccccttggtagtgatcgagctggcacaagatgttaaagaggagaccaaagaatggcttaaaaaccgaatcatagccaaaaagaaggatgggggagcccagttactttttaggcccctgctcaataaatatgaacaggagactttggagaaccagaacttgtaccttgtcggagcctccaagataaggatgttgttgggcgctgaggctgtagggctggttaaggaatgcaatgacaatacaatgagagcgttcacatacaggactagacaaaactttaagggtttcgatgataataatgacgatttcctcaccatggctgaatgccaatttattattaaacacgaattggaaaatttaagagccaaggacgagaaaatgataccgggatatccacaggccaagctgtacccaggaaagagcctcctgaggcgactgttgactagcggaatcgtgatccaggtgttccctctccacgactcggaggcgctgaaaaagcttgaagacacctggtacacgcgattcgcattgaaataccagccaatcgactctatccggggttactttggagaaactatcgctctgtactttgggttcctggagtacttcacctttgcgctcatacctatggcggtgatcggactgccatattatctcttcgtctgggaggactacgacaaatatgttattttcgccagcttcaacctcatttggagtaccgtaattctcgaattatggaagaggggctgcgccaatatgacttaccgttggggaactctgctgatgaagcggaaattcgaagagcctagacccggatttcacggagtccttggtattaacagcataaccggtaaggaagagcctctgtacccttcctataaacgccagctaaggatttacctggtctctcttcctttcgtgtgtttgtgcctgtacttttctctttatgtcatgatgatttactttgatatggaggtttgggccctcgggctacacgagaactctggttctgagtggacatccgttctcctgtatgtgccctccattatttacgctatagtgatcgagattatgaaccgcctgtacagatacgccgctgaatttttaacctcttgggagaatcacaggctggagtcagcttaccagaaccatctgatcctaaaagttttggttttcaattttctgaactgtttcgcttccttgttctatattgctttcgtgcttaaggatatgaagctgcttcgacagtctctggccacacttcttatcacctctcaaattctgaatcaaatcatggagagcttcctaccttattggctgcaacgcaagcacggtgtgagagtgaaacggaaggtgcaagccctcaaagccgatatcgatgcgaccctatacgagcaagttatattggaaaaggagatgggaacgtacttagggactttcgacgactacctggagctgtttttgcagtttggctacgtcagtttattcagctgcgtgtacccattagctgctgcattcgcagtgctgaataactttacagaagttaattccgatgcactgaagatgtgcagagtctttaagaggccattctccgagccatcggccaacattggcgtgtggcagctcgcttttgaaactatgtctgtgattagtgtcgtgacaaactgcgctctgatcgggatgtcgccacaggtaaacgctgtcttccccgaaagtaaagccgatcttatcctcatagtagtggcagttgaacatgctcttctggcccttaaatttatcctggccttcgcgatccccgacaagcccagacacatccagatgaagctggcaaggctcgagttcgagtctttggaggcgctgaagcagcagcagatgaagctcgtcaccgaaaatctgaaggaagaaccaatggaatcaggaaaagagaaagctacttag

SEQ ID NO: 214583 - DNA, 1413 bp, Artificial Sequence
  Description of Artificial Sequence: Synthetic coding sequence
atgaaagtaaccctgtcagcccttgacactagcgaaagttcatttactccattagtcgtaattgaacttgcccaagatgtaaaggaagagacaaaagagtggctcaagaacagaatcattgccaagaagaaggacggcggagcccaattattgtttcggcctcttcttaacaagtatgaacaggagaccctcgagaaccaaaatctgtaccttgtgggggcatctaagatccggatgctgctgggggctgaggccgtcggcctggtaaaagagtgtaatgataacacgatgcgcgcttttacttacaggacccgccagaactttaagggcttcgacgacaacaatgacgatttcctcacaatggccgaatgccaatttattattaagcacgaactagagaacttgcgtgcaaaggatgaaaagatgattccgggttacccacaggccaagctgtaccccggaaaatcgctccttcggaggctcttgactagtggcatagtgattcaagtcttccctctgcatgatagcgaagccttaaaaaagcttgaggatacctggtatacaaggttcgcgctgaaataccagcccatcgagaaccaccgactggagagcgcttaccaaaatcacctcattctgaaggtgctcgtcttcaactttcttaactgtttcgcaagcctgttctacattgcgttcgttttaaaagatatgaagctgttaagacagagccttgcgaccctacttattactagccagatactgaaccagattatggagtctttcctgccctattggttacagcgaaaacacggagtcagagtcaaacggaaggtccaggcgctgaaagcagacatcgatgctacactatatgagcaggtcattctggagaaagagatgggcacctacctcggcactttcgacgactatttggaactgtttctccagttcggctacgtgtcccttttcagttgcgtgtaccctctagccgcagccttcgcagtgctaaataactttacggaggtgaactccgatgcactgaaaatgtgtagggttttcaaacgccctttttccgaacccagcgccaacattggggtgtggcaattagcctttgagaccatgtcagtcataagcgtggtgacgaattgtgcactaataggaatgagtccccaggtgaacgccgtgttcccggagtccaaagcagacctgatcttgattgtggttgcagtcgagcacgcattactggcgctcaagttcatcctcgccttcgctattccagataaaccacggcacatacagatgaagctcgctaggctggagttcgaaagtctcgaagcgctgaagcaacagcagatgaaattggtgacagagaacctgaaagaagaacccatggagtccggcaaagagaaggcaacctag

SEQ ID NO: 214584 - DNA, 423 bp, Artificial Sequence
  Description of Artificial Sequence: Synthetic coding sequence
atgaaagtgactctgtccgccttggatactagtgagagtagcttcactcccctcgtggtgatcgagctagcccaggacgtaaaggaagagacaaaggaatggctgaaaaatcgcatcatcgctaaaaagaaagatgggggagcccagctactctttagaccactgctgaataaatacgaacaggaaacgcttgagaaccagaacctgtacctcgtcggcgctagtaaaatccgaatgttgctgggtgcggaagctgtgggcctcgttaaagaatgtaatgacaacaccatgagagccttcacgtatagaaccagacaaaattttaaagggtttgacgataacaatgacgacttcttaacaatggccgagtgccaattcatcatcaagcacgagctcgagaatttgagagccaaggacgagtag

SEQ ID NO: 214585 - DNA, 339 bp, Artificial Sequence
  Description of Artificial Sequence: Synthetic coding sequence
atgaaagttacactatccgctctggatacttcagaatcgtcattcacccctctggtggttattgaactggctcaggatgtgaaggaagagacgaaggagtggctgaagaatagaattattgcgaagaagaaggatggaggcgctcaactgttgtttcgaccccttcttaacaagtacgaacaggagactttggagaaccagaacctgtatctggtgggagcaagcaaaattagaatgctcctgggggctgaagccgtcgggcttgtgaaggagtgcaatgataacacaatgcgggctttcacctatagaacaagacagaacttcaagggctttgactag

SEQ ID NO: 214586 - DNA, 117 bp, Artificial Sequence
  Description of Artificial Sequence: Synthetic coding sequence
atgaaagtcacgctaagcgctctcgatacaagcgagtcatcctttaccccacttgtggttatcgaactcgcacaagatgtgaaggaggagaccaaagagtggttaaagaatcgttag

SEQ ID NO: 214587 - DNA, 405 bp, Artificial Sequence
  Description of Artificial Sequence: Synthetic coding sequence
atgaaggtaacactgtctgccctggacacaagcgaatccagcttcacccctttagtggtgatcgaactggcacaggatgtcaaggaagagaccaaggagtggctcaaaaacagaatcatagccaagaaaaaagatggtggcgctcaattgctgttcaggcccctgctgaacaaatatgaacaagaaactctggaaaaccagaatttatacctagtcggtgcctcgaaaattcgcatgcttcttggtgctgaggccgtaggtctggtgaaagaatgtaacgataacacaatgcgggcatttacataccggacaagacaaaactttaagggattcgatgataataacgacgactttctgaccatggcggaatgtcaatttatcatcaagcatgaactggaaaattag

SEQ ID NO: 214588 - DNA, 441 bp, Artificial Sequence
  Description of Artificial Sequence: Synthetic coding sequence
atgaaggtcactttatctgccctggacaccagcgagtccagcttcacaccgctagtggtaatcgaattggcccaggacgtgaaggaggagaccaaagaatggctgaagaatcgcataatcgccaaaaagaaggacggaggagcccaactgctgttcaggccattgcttaacaaatacgaacaggagaccctcgaaaaccagaatctctatctagtgggcgcatctaagatccggatgctcctgggagcagaggcggtaggactggtcaaggagtgtaacgacaatacaatgagggccttcacgtacagaacacggcagaacttcaagggattcgatgacaataacgacgatttcctgactatggccgagtgtcagttcatcatcaagcacgagctggagaacttgagagctaaggacgaaaagatgatccctggctactag

SEQ ID NO: 214589 - DNA, 426 bp, Artificial Sequence
  Description of Artificial Sequence: Synthetic coding sequence
atgaaagttaccctctccgccctggatacctccgagagttcatttacccccctggtggtgattgaactggcgcaggacgtcaaggaagagactaaggagtggttgaaaaatcgaatcattgctaagaaaaaagacgggggagcccagctcctttttagacccctgctgaataaatacgagcaagagacactcgagaatcagaacctgtatctcgtgggcgcaagtaagattaggatgctgttgggtgccgaagcagtcggtctcgttaaggagtgtaacgataacactatgcgtgccttcacatacagaacccgccagaattttaaggggtttgacgacaataacgacgacttcttaactatggccgaatgccagttcatcataaagcacgagctcgaaaaccttagagccaaggatgagaaatag

SEQ ID NO: 214590 - DNA, 1785 bp, Artificial Sequence
  Description of Artificial Sequence: Synthetic coding sequence
atgaaggttacactatccgcactcgatacaagtgagtcctcatttacacctttggtcgtcatcgaactcgcccaggacgttaaagaagagacgaaagagtggttgaagaatcgcatcatagccaagaaaaaagacggagataataatgacgactttctcacgatggctgaatgccagttcataatcaagcacgaactagaaaacctgcgcgctaaggacgagaagatgattcccggttatcctcaggccaagctatacccaggcaagtctctcttgagaagactcctcacctccggtattgtgatccaggtgtttcctctgcacgatagtgaagcactgaagaagttggaagatacttggtatactcgctttgctctgaagtatcagcccattgatagcatcaggggctactttggggaaaccattgcattgtactttggattcctcgaatatttcacattcgccttgattcctatggccgtcatcggtctcccttactacttgttcgtatgggaagattatgataagtacgtgatcttcgccagcttcaaccttatctggtctacagttatccttgagctctggaaacgaggctgtgccaacatgacttacaggtgggggacacttctcatgaaaaggaagtttgaggagcctcgcccaggatttcacggagtcctggggattaattccattactggtaaggaggagcctctgtacccttcatataagcggcagctgcggatttaccttgtctccctgccctttgtctgtctctgtctctacttttccctctatgttatgatgatatatttcgatatggaagtgtgggctcttggtttgcacgagaacagcgggtccgaatggacctccgtgctgctgtatgtaccgtccataatatatgccattgttatcgagataatgaataggttgtaccgctacgccgctgagtttctaacttcatgggagaatcaccggctggaaagtgcgtaccagaaccatttgattctgaaggtgctggtgttcaacttccttaattgttttgcctcgttattttatatcgcttttgtgctcaaagatatgaagctgctaaggcagtcccttgcaactttgcttattactagccagatactgaaccagatcatggagtcttttcttccatactggctgcagcggaagcacggagtcagagtgaaacgaaaagtgcaggctctgaaagcagatatcgacgccactctgtacgaacaggtaatacttgaaaaggagatgggcacttacctgggaacattcgatgattatttagagctgtttcttcaattcggttatgttagcctctttagctgcgtctaccctttagccgctgcattcgctgttctaaataacttcacggaagtaaattccgacgccttaaaaatgtgtagagtgttcaaacgaccgttctctgagccctccgcgaatatcggggtctggcagctagccttcgagactatgtccgttatctctgtcgtgaccaattgtgccctgattggaatgtccccccaggtgaacgctgtgtttccagagtctaaggcagatctgattttgatcgtggtggcagtggagcacgctcttctggctctgaagtttatcctggcatttgccatacctgacaagccccgtcatatacaaatgaagcttgctcgtctagaatttgagagcctggaagctctcaaacagcaacagatgaaactagttaccgaaaatttgaaggaggagcctatggagtccgggaaggaaaaagccacttag

SEQ ID NO: 214591 - DNA, 1884 bp, Artificial Sequence
  Description of Artificial Sequence: Synthetic coding sequence
atgaaagttactttgtccgctcttgacaccagtgagtccagcttcacccctctggtggttatcgaactggcccaggatgtgaaagaagaaactaaagaatggctgaaaaaccgcattattgccaagaagaaggatgggggtgctcagctcctgttccgacctctgttgaataagtatgagcaggagacactggaaaatcaaaacctgtacctcgttggagctagtaaaattcggatgcttctgggcgctgaggcagttggactggtgaaagagtgcaacgacaacacaatgcgggctttcacgtataggaccagacagaattttaagggtttcgacgacaataacgacgactttttgaccatggcagagtgccagtttatcattaagcacgagctcgagaacctgagggcaaaagatgaaaagatgataccaggatacccgcaggccaagctgtatcctgggaaaagtttactgagaagactgctgacatcaggtatagtgattcaggtatttcccttgcacgattccgaagccctgaaaaagctggaagatacatggtatactaggtttgccttgaagtatcagcccatcgatagcataaggggctactttggcgagacaatcgctctgtattttggatttttggagtattttacttttgccttaatacccatggcagtcataggactaccctattatctgtttgtgtgggaggattatgacaaatatgttatctttgcttcatttaacttgatctggtcaaccgtaattctggagctatggaaacggggatgcgctaatatgacttacagatggggcaccctgttgatgaaacggaaatttgaggagccgcgaccaggttttcacggggttttgggaatcaatagcataacgggcaaggaggaaccgctgtatccatcctataagagacagctaaggatttacttggttagcctgcccttcgtgtgtctgtgtctctacttctcactctatgtcatgatgatatacttcgacatggaagtttgggccttaggactgcacgaaaattctggttctgagtggacatctgtgctgctgtatgtccccagtattatttatgccattgtgatagaaatcatgaaccgactgtaccgatatgccgcagaattcctgacttcgtgggagaatcatagactggaatcagcgtaccagaatcacctgatcttgaaagtgttggtgtttaattttcttaactgttttgcttcgctgttttacattgccttcgtgctgaaggatatgaagctgcttcggcagagcctcgccaccctgctgataaccagtcagattttgaatcaaattatggagtccttccttccgtactggcttcagcggaaacatggtgttcgcgtgaagcggaaagttcaggctctgaaagcggatatcgatgccaccctgtatgagcaggtaattttggagaaagaaatggggacttacctggggactttcgacgactacctggaacttttcctccagttcggatatgtgagccttttttcctgtgtttaccccctggctgccgcttttgccgtcctcaataattttacagaagttaattccgatgctctgaaaatgtgccgcgtctttaagaggcctttcagtgagccctcggctaacattggcgtttggcagctcgctttcgaaactatgagtgtcattagtgtcgtgacaaattgtgccctcattggcatgtcccctcaggtgaatgccgtcttccccgagtccaaagccgacttgattcttattgtagtcgcggtggaagccgctagctgcaaactggtttcactgcctcggtatagctggtctacgaattctgtgcctggtacggtgattggtccaggcgtgtag

SEQ ID NO: 214592 - DNA, 1650 bp, Artificial Sequence
  Description of Artificial Sequence: Synthetic coding sequence
atgaaggtgaccctaagcgccctggatacttctgagtcgtccttcaccccactggttgtgatcgaattagcgcaagatgtcaaggaagagaccaaggagtggctgaaaaaccgtatcattgcaaaaaaaaaagacggagttaggcggctgttgacttccgggattgtcatacaggtgttccctctgcatgattccgaggctctgaaaaaattagaggacacgtggtatacgcggtttgcccttaagtaccagcctatagattccatcagagggtactttggggaaactatagccctgtacttcggctttctggagtacttcacattcgccctcataccaatggctgtgataggcctcccatattacctgttcgtgtgggaagactacgataaatacgttatattcgcctcattcaacctgatctggagcacagtcattctagaattatggaaacgaggctgtgccaacatgacctatcggtggggtacactgctgatgaaaagaaaatttgaggagccaagacctggattccatggggtactcggtataaattcgatcacgggtaaggaagaacctctgtaccctagctacaagaggcagctacgaatctacttggtcagccttccttttgtctgcctctgtctttacttttccctgtacgtgatgatgatctactttgatatggaagtgtgggccctgggccttcatgagaactcaggtagcgagtggacttcagtcctactttacgtgccatccatcatttatgctatagtgatcgaaatcatgaataggctttataggtacgcggctgaattcctaactagttgggagaaccaccggcttgaatccgcctaccagaaccatctgattttgaaggtgctcgtgttcaatttcttgaactgtttcgcctcactgttttatatcgcctttgttctgaaggacatgaagctcctgagacagagtctcgcaacgctgctcattactagtcagatcttgaaccagattatggagtcattcttaccatactggctgcagaggaaacacggcgtgagggtcaaacggaaggtccaggcactcaaagctgacattgatgcaacactctatgagcaagtcatcctggagaaggagatggggacctatctcggtacctttgatgactacctagagctgtttctgcagtttggttatgtgagcctcttttcgtgtgtctaccccctcgccgctgcatttgccgtgttaaacaattttacagaagttaactcagacgcattgaagatgtgtcgagtcttcaagaggcctttttccgaacccagtgctaacatcggagtgtggcagttggccttcgaaactatgtccgtcataagcgttgtgacaaattgcgccttgatcgggatgtctcctcaggtgaacgcggtatttcctgaatccaaagcggacttgatcttaattgtggttgccgtggaacatgcactccttgcacttaaattcatactcgccttcgcaatccctgacaaaccacgccatattcagatgaagttagcgagactggagttcgaatcccttgaggcgctgaagcagcagcagatgaaactggttacggagaacttaaaggaagagcctatggaaagcggaaaagagaaggcaacgtag

SEQ ID NO: 214593 - DNA, 2997 bp, Artificial Sequence
  Description of Artificial Sequence: Synthetic coding sequence
atgcctgaagatatccccctactgcccggttccccacgaagactcagtccgcaggcaggctcaaggggcggacaggggccaaagcacggacagcagtgtttaaaaatgcctggacccagagcaccaggcttgcagggcggaagcaatagagaccctggacaaccttgtggcggtgaaagcactagaagcagttccgtgatcaataactatttagatgccaatgagcccgtgagcctagaggccaggttatcaaggatgcatttccacgattctcagcgcaaagtggactatgtcctggcctaccactaccgaaaacgaggggtacacctcgcccaaggctttccgggtcactcactggctatcgtgtccaacggggaaactggaaaagaacctcatgctggcggaccgggagacatcgagctcggccctctggacgcgctagaagaagaaaggaaggaacagcgagaggaattcgagcacaacctgatggaagctggtctggaattagagaaggacctggaaaataaaagccagggttcaatttttgtgcgaattcacgccccttggcaggtcctggcccgtgaagctgagttcttgaaaataaaggtgccaacaaagaagatgtacgagattaaggctggaggtagtatcgccaagaagttcagtgcagccctccagaagctctcatctcacctgcaaccccgagtacccgaacatagtaataacaaaatgaagaacttgtcctatcccttcagcagagagaaaatgtacctttacaacatacaggagaaggacaccttctttgacaacgctactaggtcgaggattgtccacgaaattctaaagcgaactgcttgctcgagggcgaataatactatggggataaattctcttatcgcgaataatatatatgaagctgcctacccactccacgacggcgaatatgattcacccgaagacgacatgaacgatcgtaagctcctctaccaggagtgggcacgctacggcgtgttctataagtttcagccgattgacctgattcgcaaatattttggggagaaaattgggttatatttcgcctggctgggcctttacacttctttccttatcccctcctctgtaatcggcgtgatcgttttcttatatggctgtgctaccatcgaggaagatatcccatcacgggaaatgtgcgatcaacagaatgccttcacaatgtgtcctctctgcgataaatcctgcgattactggaacctgagctctgcctgcggtactgcccaggcctcccacctgtttgacaatcctgccactgtattcttcagtatattcatggctttgtgggccaccatgttcctggagaattggaaaaggctgcagatgaggctcggttacttttgggatttaaccggcatcgaagaagaagaggagcgcgcacaggagcacagcaggcccgaatatgaaacaaaagttagagaaaagatgctcaaggaatccaatcaaagtgcagtccagaaattagaaacaaacactacggagtgtggagacgaagacgacgaggacaagctcacctggaaggacaggttcccaggctatctgatgaactttgcatcgatcttgttcatgatcgctcttacgtttagtatcgtattcggtgttattgtctacaggattaccaccgccgcagcactgtctctgaataaagcaacccgtagcaacgtgcgggtcaccgtgactgcaaccgcagtgatcatcaacctggtggttatcctaattctcgacgaaatctacggcgctgtggccaaatggcttaccaagattgaagttcctaaaacagaacagacctttgaggagcgtctgattctgaaggcgttcttacttaagtttgtcaatgcttattcccccattttctacgtcgctttctttaaaggtcgtttcgtgggaaggcctggtagttacgtgtatgtctttgatggatacaggatggaggagtgcgcccctggaggatgcctaatggaactgtgtattcagcttagcattataatgctaggaaaacagctcattcagaacaatattttcgaaatcggcgtccctaagctcaaaaagctctttcggaagctgaaagatgagaccgaggccggagaaacggactcggcgcacagcaagcaccccgaacagtgggacctggactattctctggagccatacactggactgaccccggagtacatggagatgatcattcaattcggtttcgtgaccctctttgtcgcatctttccctctggcaccagtgttcgcacttcttaacaatgtcattgaagtgaggttggacgcaaagaagtttgtaacagaactgcggaggccggacgctgtgcgtaccaaggacatcggcatctggtttgatattctttccggcatcggcaaattttcagtgatttcaaacgcgtttgtgatagctattacaagtgattttattcccagactggtgtatcaatattcctattctcacaacggcaccctgcacggctttgtcaatcataccctctcctttttcaatgtctctcagctcaaggaagggacccaaccagagaattctcagtttgatcaagaggtgcaattctgtaggttcaaagactaccgcgaacctccatgggctcccaatccctacgagttctcaaaacaatattggtttatcctgagcgcacggctggccttcgttatcatctttcagaacctcgtaatgtttcttagcgtgctcgtcgattggatgatcccagacatccctaccgacattagcgatcaaattaagaaagagaaaagtcttctggtggatttttttctgaaagaggaacacgaaaagctgaagctcatggacgagccagctctgaggtcaccaggaggaggggacagaagtcgatccagggcggcatcatctgccccatctggccagagccagctcgggtctatgatgagttcgggatcccaacacactaatgtctag

SEQ ID NO: 214594 - DNA, 3000 bp, Artificial Sequence
  Description of Artificial Sequence: Synthetic coding sequence
atgcctgaggacattccactgctgccgggtagccctagacggctcagccctcaggcaggctcaagaggtggtcagggccctaagcatgggcagcaatgccttaaaatgcccggtcccagggctcccggactccagggcggttccaacagggatcccggtcagccatgcggcggagaaagcacaagatcatcaagcgtcataaacaactacttggacgcgaacgaacccgtgtctctggaagcacgactgagcagaatgcatttccacgatagccaaagaaaggtggattacgtgctggcctaccattaccgaaagcgaggtgttcatctcgcccaaggattcccaggccactctttggctattgtgtctaatggggagaccggtaaagaaccacacgccggtggtccaggcgatatagaactgggccctttggacgctctagaggaggagagaaaagagcaacgtgaggaattcgaacacaacttgatggaagcaggcctggaactagagaaagatctggagaacaagagccagggaagcatcttcgtaaggatccacgccccatggcaggtgctggctcgagaggcggagttcctcaaaatcaaagtccctactaaaaaagaaatgtatgaaataaaggctggaggcagcattgctaagaagtttagcgcagccctgcaaaaactgagctcccatttgcagccacgggtgccagaacattccaataataagatgaagaatctgagctatcccttctctagggagaagatgtacttgtacaacatccaggaaaaagatacattcttcgacaatgcaactaggtccaggatcgtgcatgagatcctcaagaggaccgcatgctcgagggctaacaatactatgggaattaactctctgattgctaacaatatttacgaagccgcatacccactgcacgatggcgagtacgactccccggaggacgacatgaatgataggaagctgttgtatcaagagtgggccagatatggggttttctataagttccaacccatcgatcttattcgcaagtacttcggggagaaaatcggattatacttcgcttggctcgggctctacacctctttccttattccctcttctgtcatcggtgtcatcgtttttctgtatggctgtgccactatagaagaggacatcccatcacgagagatgtgcgatcagcagaacgcattcactatgtgcccactctgcgacaaatcttgcgactactggaacctgtctagcgcctgcggaaccgcccaggctagccacctgtttgacaaccctgccacggtgtttttctccattttcatggctctgtgggcaacaatgtttctcgagaattggaaaagactccagatgagactgggctatttttgggatctgacaggaatcgaggaggaagaggaacgagcccaggagcacagccgtcccgaatacgagaccaaagtccgcgaaaaaatgctgaaggaaagcaatcagtccgccgtgcagaagttggagactaataccacggagtgcggagacgaagatgatgaggataaattgacatggaaggatagattcccaggatatctgatgaactttgcctcaatcctattcatgatcgcgttgacattctcaatagtgttcggcgtcatcgtttaccggattaccaccgccgctgcgttgagtttaaataaggcgacccgatctaacgtcagagtgacggtgacagcaaccgctgtaatcatcaacctagtagtgatcctgattctcgacgagatctatggcgcagtagcgaagtggttgaccaagattgaggtccctaagacagagcagaccttcgaggagcgtttgatcctgaaagcttttttgctgaagttcgtcaatgcttattcgcctatcttctacgtcgcgttctttaaggggaggtttgttggtaggcccggtagctatgtgtatgtgtttgatggataccggatggaggagtgtgctcccggtggctgtttgatggagctgtgtatacaactttccataataatgctcggcaaacaactgattcagaataatatcttcgagatcggcgtaccaaagctaaaaaagctgtttcgcaaattgaaagacgagacagaagccggtgagaccgattctgctcattccaagcacccggaacagtgggacctggactattctctcgaaccttacacagggctgacgccggagtacatggaaatgattatccagttcggcttcgtaaccctgtttgtggcatcattccccttggcacctgtcttcgcactgctcaacaatgtcatagaagtgcggttggacgccaagaaatttgtaactgaactgagaaggcccgatgctgtccgaactaaggacatcggtatctggttcgacattctttccggcataggcaaattcagtgtaatttccaacgcttttgtgatcgccatcacatcagactttattccacgcctggtctaccagtatagttacagccacaacggaactttacacggctttgtgaatcacaccctctcattctttaacgtttcccagctcaaggagggcacgcagcccgagaatagccaatttgatcaggaggtgcagttttgtagattcaaagattaccgggaacctccctgggcgcctaacccttatgagttttccaaacagtactggttcatcctctctgcccgactagcattcgttataatctttcaaaatttggtaatgttcctaagcgtattggtggattggatgatccctgacatcccaacagacataagcgaccaaattaagaaggaaaaaagcctgctcgtagatttctttctcaaagaagaacacgagaaacttaagttgatggatgagcccgctctgaggtccccagggggaggagaccggtcccgaagtagagcggcatcctccgctccatcaggacagagccagttaggcagcatgatgagttccggatcccagcacacaaatgtgtag

SEQ ID NO: 214595 - DNA, 3012 bp, Artificial Sequence
  Description of Artificial Sequence: Synthetic coding sequence
atggctacgcccggacctcgggatatcccactgcttcccggatcccctagaagactcagtcctcaggcagggtccaggggcggtcaaggacctaagcatggccagcagtgtttaaagatgccagggccacgggcacccggtttacagggtgggtcaaaccgagatccgggacagccgtgcggtggggaaagtacccgatcatcctctgtgattaataattaccttgacgccaacgagccagtgagcctggaggccagactgagtcgcatgcatttccatgacagccaaagaaaggttgattatgtgctggcctatcactatcgtaaaagaggtgtccacctggcccagggcttcccaggtcattcactcgctatcgtctctaacggcgagaccgggaaagagcctcatgccggagggccaggggacatcgagttggggccactggatgcactcgaggaggagcggaaagagcagcgggaggagttcgagcataacctgatggaggctgggcttgaactggaaaaggatctggaaaataaaagtcaaggttccatctttgtcagaatccacgcaccctggcaggtcttggcaagggaagcagagttcctcaagatcaaggtccccactaaaaaggagatgtatgagattaaagctggcggtagcattgctaagaagttctccgctgccttgcaaaagttaagcagtcacttgcagccacgggtacccgaacattccaacaataagatgaaaaatctcagctatccatttagtcgagagaaaatgtacctctataacattcaggaaaaggacacattcttcgataacgccacgcgcagtcgaattgtgcacgagattttgaagagaaccgcatgttctcgggctaataacaccatgggcatcaactctttaattgctaacaacatatatgaggccgcttatcccctgcacgatggggagtatgactctcctgaggatgacatgaatgacaggaagcttctctaccaggagtgggccagatacggtgtattctacaagtttcagcccatcgacctgatccgcaagtacttcggggagaagattgggttatattttgcctggcttggattgtatacatcattcttgattccctctagcgttataggtgtgattgttttcctgtatggatgcgccacgatcgaggaggatattccttcacgggagatgtgcgatcagcagaacgccttcaccatgtgtcctttatgtgataaatcttgcgactactggaacctcagctctgcatgcggcactgcccaagcctctcacttatttgacaacccagccactgtattctttagcatctttatggctctttgggccacaatgtttctagaaaactggaagagattacaaatgaggctgggatatttctgggaccttacagggattgaagaggaggaagagcgtgcacaggaacacagtcgacctgaatatgaaaccaaggttagagaaaaaatgctgaaggaaagcaaccagtccgccgtccaaaagctggagaccaacacgacagaatgtggggacgaggatgacgaagataagttaacgtggaaagacagatttcctggataccttatgaatttcgcctccattctttttatgatcgccctcaccttttccatcgtgttcggcgttatcgtgtatagaatcaccaccgctgccgcactgagtctgaacaaagctacacgcagtaacgtgagagtcacagtcactgcaaccgcagtgattatcaatctggttgtcattttgattctcgacgaaatctatggagccgtggcaaagtggcttaccaaaatcgaggtccccaagacagagcaaacgtttgaggagagacttatactcaaggctttcctgctgaagtttgtgaatgcatatagcccaatattctatgtcgcgtttttcaagggccgttttgttggcaggcctgggagctatgtctacgtcttcgacggatatcgaatggaagagtgtgctcctggcggttgtctgatggagttgtgtattcaactgagtattatcatgttaggtaaacagcttatccagaacaacatttttgaaatcggagtccccaaactcaaaaagctcttcagaaagctaaaggatgaaacggaagccggagaaacagattcagcccattccaagcatcccgagcaatgggatctcgactattcacttgagccatataccggactcaccccagaatatatggagatgattatccagtttggctttgttacactgtttgtggccagtttccccttagctccagtcttcgccctgctgaacaacgtgatagaggtgcgcctagatgctaagaagttcgtcaccgagctgaggaggcccgatgctgtcaggactaaggacatcggaatctggttcgatatcctgtctggaatcggaaagttctctgtgatcagtaatgcctttgtaatcgccattacatctgacttcattcccagactcgtgtaccagtactcatattcccataatggaacactgcacgggtttgtcaatcacaccctcagcttcttcaatgtgtctcaactaaaggaaggcacacagcccgagaatagccagttcgaccaggaggtccagttttgcaggtttaaggattaccgcgagcccccttgggcaccaaacccatacgagttctctaaacaatactggttcatcttatctgcgcgactggcgttcgtcatcatcttccaaaaccttgttatgttcctgtcggtgttggtggattggatgatccccgacatcccaaccgacatctccgatcagatcaagaaggaaaaaagcctcctggtagacttttttctcaaggaggaacacgaaaagctgaagctgatggatgagcctgctctccgcagcccaggcggaggtgataggtcacggtcaagggcagcctcatcggcgccatctggtcagtcccagctcggtagcatgatgtcttctggctctcagcatactaacgtatag

SEQ ID NO: 214596 - DNA, 261 bp, Artificial Sequence
  Description of Artificial Sequence: Synthetic coding sequence
atgtttctgtccgttctggtagactggatgatacctgatatacctaccgacatctcagatcagatcaagaaagaaaaaagtcttctcgttgactttttcttgaaagaagaacacgaaaagctgaaactgatggatgaaccagcattacgcagccccggagggggagatcgaagtaggtcgcgcgcagcctcaagcgccccttcaggccagagccagctcgggtcgatgatgtcttccggttcccagcacacaaacgtgtag

SEQ ID NO: 214597 - DNA, 3000 bp, Artificial Sequence
  Description of Artificial Sequence: Synthetic coding sequence
atgcccgaggatataccactcctgcctggcagccccaggaggctgtctcctcaggctggcagtagaggcggtcagggaccaaaacatgggcagcagtgtctgaaaatgccaggcccaagggcccctggcctgcaaggcggatcaaatagggacccgggacagccttgtgggggagaatccacccggtctagttcggtaatcaataactacttggacgcgaatgaaccagtttcgcttgaagctagactgtcccgcatgcatttccatgattcacagcgcaaagttgattacgtgctggcatatcactatcgaaagcgaggggtccacctggcccagggattccccggtcacagcttggccattgtaagtaatggcgaaaccggaaaggaaccgcacgccggaggtcccggagatattgagctaggccctctggacgccttagaagaagagagaaaagagcaacgagaggagtttgagcacaacctaatggaagctgggctggagctggagaaggacctggagaacaagagtcagggatcaatcttcgtgcgcattcacgctccctggcaagtccttgccagggaggcagaatttctcaagatcaaggttcctactaagaaagagatgtatgagatcaaggctgggggatctatcgccaaaaagtttagtgcagccttgcagaagttatcatctcacctgcagcctcgcgttccggagcactccaacaataagatgaaaaatctcagctacccgttttcacgagagaagatgtacttatacaatattcaggaaaaagatacttttttcgacaacgccacaaggtcacgtatcgtgcacgaaattttaaaacggacagcttgtagccgcgctaataatacaatggggattaatagccttatcgccaacaatatttacgaggccgcatatccactgcatgatggagagtacgattctccagaagacgatatgaatgaccgtaagcttctgtatcaggaatgggccagatatggcgtgttttataaatttcagccaattgatctgattcgcaagtattttggcgagaaaattggtctttatttcgcctggcttggcctgtacacttccttccttatccccagctcagtgatcggagtcatagtgttcttatacgggtgcgccaccatcgaagaggacatcccctcacgggagatgtgcgaccagcagaatgcctttaccatgtgccccctttgtgataaatcctgcgactattggaatttgagtagtgcctgcgggaccgcccaagccagccatctctttgacaatcccgcaacagtgttttttagcatcttcatggcactgtgggctactatgttcttggagaactggaagagattgcaaatgcgcttgggatatttttgggatttgaccgggatcgaagaggaggaaccgagggtgcaggagcactctagacctgagtatgagaccaaggttagggaaaaaatgctgaaagaaagcaaccaatcagccgtccagaagctggagactaatacaaccgaatgcggcgatgaagatgatgaagacaagctcacctggaaggatagatttccaggttatctgatgaactttgcctctatcctctttatgattgcccttacattctcaattgtctttggcgtgattgtataccgaatcacaacagcagccgcactctctctgaataaagcaacgagatctaatgtgcgggtgactgtgaccgcaaccgccgttattatcaacttagtggtgatacttatcctcgacgaaatttatggagctgtggctaaatggctgacaaaaatagaagtccccaagacagagcaaacttttgaagagcgactcattctcaaagcctttttgctgaagttcgttaacgcctattcccctattttctacgtagctttcttcaagggtcgatttgtagggagacctggatcctatgtctatgtgttcgacggctatagaatggaggagtgtgcccctggcggttgccttatggagttatgtatccagctgtcaatcattatgcttggcaaacagctgattcagaataacatattcgaaataggtgtgcctaaactcaaaaaactgtttcgtaagttgaaggacgagactgaagccggtgagactgatagtgcacattcaaaacatccagaacagtgggatttggattattcactcgagccgtacacaggccttacgccagaatacatggagatgataatccagttcggattcgtcacattgtttgtggcttcattcccactcgcacccgtgttcgccctcctcaataacgttattgaggtaagactggatgccaagaagttcgtcacggaactgagaaggccagacgctgtgcgaaccaaggacatcggcatttggttcgatatcctgtcaggaatcggtaaattctcagtgataagtaacgcattcgtgatcgctataacgagcgactttattccgcgtctggtctaccagtattcctacagccataatggcacgttgcatggattcgttaaccataccctgagcttcttcaacgtttcgcaactaaaagagggcacccagcccgagaattcccaatttgatcaagaagttcagttctgccggttcaaagactatcgagagcctccttgggccccaaacccgtatgagttcagtaaacagtactggttcatcctgagtgccaggttggctttcgtgattattttccaaaatttagtgatgttcctctcggtgctcgtggattggatgatccccgatataccaacagacatcagcgatcaaatcaaaaaagagaagagcttgctcgtggacttttttctcaaagaagaacacgagaagcttaaattgatggatgaaccagcactgcggtcgccgggagggggagatcggtcccgcagcagggcagcttcctccgctccctctgggcagagccagctcggatctatgatgtcaagcggctcccaacacaccaatgtctag

SEQ ID NO: 214598 - DNA, 2742 bp, Artificial Sequence
  Description of Artificial Sequence: Synthetic coding sequence
atgggggaccccgatcttctggaggtactcgccgaggagggtgagaaggtgaataaacatatcgactacagcttccaaatgtccgagcagtctctgagctcccgtgaaacatcttttctgataaatgaggagacaatgcccgcaaagaggtttaatcttttcctgagacgtcgccttatgttccagaagaaccaacagtcgaaggactcaattttcttccgggatgggattagacagatcgacttcgtcctgtcctatgtcgatgatgtgaagaaggatgcagaactgaaggcagaaaggcgaaaagagtttgagaccaatctccggaagacaggccttgaactggaaattgaagacaagagggatagcgaggacggacgaacctatttcgtaaaaatacacgcaccgtgggaggtcttagtgacctatgcggaagttttaggaattaagatgcctatcaaagaaagtgacattcctagaccaaaacacactccaataagttatgtccttggcccagtcaggctccccttatccgtgaagtaccctcatcccgagtactttaccgctcagtttagtcgacaccgccaagaactctttctgattgaggaccaggctacattcttcccctcctcatcaaggaaccgcatcgtttactacatcctctctaggtgtcctttcggcatcgaagatggaaagaaaagatttggtatagagcgacttttgaattccaacacatactccagtgcatatccactgcacgatgggcagtattggaagccctcagaaccgccaaaccccacaaacgaacggtatactcttcaccagaattgggcaagattcagttacttttacaaggagcagcctctagatctgatcaagaactattatggcgagaagatcggaatctactttgttttcttgggattctacacggagatgctattttttgctgcagtggtgggactggcctgtttcatttacgggctgctgagcatggaacacaacacgtccagcaccgaaatttgcgatcctgaaatcggtggccagatgataatgtgtcccttatgtgaccaggtttgcgactactggcgcctgaactctacttgtttagcttccaagttcagccacctgttcgacaatgaatcgaccgtattctttgctatcttcatgggaatatgggttaccctatttttggaattctggaaacagcggcaagccagattggagtacgaatgggacctggtagacttcgaggaggagcagcagcagctgcagcttcgcccagaatttgaagccatgtgtaaacaccgaaaacttaacgctgtgaccaaggagatggaaccctacatgcccctgtatacacggattccttggtactttctgtctggtgccacagtgactttgtggatgtctctggttgtgacgtctatggtcgctgtaatagtatataggctctcagtttttgccactttcgcctctttcatggaaagcgatgcatcattaaaacaggtcaaatccttcctgacacctcagatcacaacaagcctcactggatcctgtttgaacttcatcgtgatactcattttaaactttttttacgagaagataagcgcttggatcactaagatggagattcctcggacataccaggaatacgagagctccttgacccttaaaatgtttttgtttcagttcgtgaacttctattcaagctgtttctatgtggctttttttaaagggaagtttgtgggctacccaggtaaatacacatatttgtttaatgagtggcgctccgaggagtgtgatcctggcggatgtctgattgagctcactactcagctaactatcatcatgaccggaaaacagatcttcggcaatatcaaagaagctatttacccacttgccttaaattggtggcgccgaagaaaagcccgtacaaactccgaaaagctatattccaggtgggagcaggatcatgatctggagagttttggccctcttgggttattctacgaatacctggaaacagtcacccaattcgggttcgtcacactgtttgtggctagttttccacttgctcctctgctggcactgatcaacaacattgtggagatacgcgtggatgcctggaagctgaccacccaatatcgaagaaccgtcgcctcaaaggcccacagcatcggcgtgtggcaggacatcttatatggaatggctgtcctcagcgttgctactaatgcatttatcgtggctttcacctccgacatcattccaaggctggtgtactactatgcttattcaacaaatgctacccagcccatgacaggttacgtcaacaatagcctctccgtgtttttaattgctgattttccaaatcacacagcccctagtgagaagagagactttattacctgtagataccgagactacaggtacccacccgacgatgaaaataaatatttccataatatgcaattttggcacgtcctggccgctaagatgactttcataatcgtaatggaacacgtcgtgtttctagtgaaattcctgcttgcctggatgatcccggatgtccctaaggatgtggtcgaaagaattaaacgggagaagctcatgactattaaaatactgcatgacttcgagctcaataagctgaaagagaatctggggatcaactctaacgagttcgccaagcacgtaatgattgaagagaacaaagctcaattagcaaagtccaccctttag

SEQ ID NO: 214599 - DNA, 2733 bp, Artificial Sequence
  Description of Artificial Sequence: Synthetic coding sequence
atgaagaaaatgagcaggaacgtcctgctacaaatggaagaggaagaagacgatgacgacggcgatatcgtgctggaaaatctgggtcagactattgtgcctgacctcggttcactagaatctcaacacgatttcaggactccagagttcgaggaattcaatgggaaaccggacagtctgttttttaatgacggccagagaagaatcgactttgtgctggtatacgaggacgagagtcggaaagagaccaacaagaaaggcactaatgagaagcagcggcgaaaacgacaggcgtatgagtctaatctgatttgccacggtctgcagctcgaggctacacgtagtgtactggacgataaactggtgttcgtgaaggtgcacgccccttgggaggttctatgcacctatgctgagattatgcacatcaaactaccgctcaagcccaatgatctgaaaaaccgttcctcggcctttggtaccctgaattggttcactaaggtccttagcgttgatgaatccatcattaagcccgagcaagagttttttacggcaccattcgaaaagaaccggatgaatgacttctacatcgtcgatcgggatgctttcttcaaccccgctactaggtctcgcatagtctattttattctttcgcgggtgaagtatcaggttatcaataacgtatcgaaattcggcattaacaggctggtgaacagtgggatttataaggctgcctttcctctccacgattgcaaatttagaagacagtccgaggatccaagttgcccaaacgaaaggtatctgttgtaccgggaatgggcacaccccagaagcatctacaagaaacagcccctcgatctgataagaaagtactatggcgaaaagatcggtatctattttgcctggcttgggtactacacacaaatgctcttgctcgctgccgtcgttggcgtagcgtgcttcctatacggctatcttaaccaggacaattgtacatggtcaaaggaggtttgtcaccccgacatcggaggaaagatcatcatgtgccctcaatgcgatcggctctgccccttctggaagctgaatattacatgtgagagttcgaagaaactgtgcattttcgattcctttggcacactggtgtttgcagtgtttatgggagtttgggtgactctgtttctcgagttctggaaacggaggcaggctgaactggagtacgagtgggatacggttgaactgcagcaggaggaacaggctagaccagaatatgaagctcggtgtacacatgtggtcatcaacgagattacgcaggaagaagaaaggataccctttacggcctggggcaaatgtattagaattaccctttgtgcctctgcagtgttcttttggattcttttaatcattgcctcggtgatcggtatcatcgtgtacagactctctgtctttatagtgttctcagccaagcttcctaagaatataaatggcacggatcctatccagaaatatctgaccccccagaccgccacgtcgataacagcgagcattataagcttcatcattattatgatcttgaacaccatttacgagaaggttgcaattatgatcaccaactttgagctgcctagaactcagactgactacgaaaattctttgaccatgaagatgtttctgtttcagtttgtcaactactatagttcatgcttttacatcgcttttttcaaaggaaaattcgtgggataccccggagaccctgtgtattggcttgggaagtacaggaacgaagaatgtgacccaggaggatgcctgttagaacttactacccagctgacaattataatggggggtaaagcgatctggaacaatatccaggaggttttattgccgtggatcatgaatctcatcggccgttttcacagagtgagcggctccgagaagatcaccccacgttgggagcaagattaccacctgcagccaatgggcaaactcgggctcttctacgagtacctcgaaatgattatacagtttggtttcgtcactttatttgtggcctccttccctctcgccccactcctcgccctggtgaacaatattctggagatccgcgtcgatgcctggaaactcacaacccagtttaggagactggtgccagagaaggctcaggacatcggagcatggcagccaatcatgcagggaatcgccatactggctgtcgtgactaacgctatgattattgcattcacttccgatatgattcccaggctcgtttactactggtccttctcagtgcccccatacggagatcatacctcttacaccatggaggggtacattaataataccttgtccatattcaaagtggccgacttcaagaataaatctaagggaaacccatactcggacctgggaaatcataccacctgccgctacagagattttaggtatcccccaggccatccccaggagtataagcacaatatctactactggcatgtgattgctgccaaactcgccttcattattgtgatggagcacgtgatctactcagtcaaattctttatcagctacgccatcccggacgtgagcaaacgtaccaaatcaaagattcagagggagaagtatctgactcagaaattgcttcacgagaaccacctcaaggacatgacgaagaacatgggagtgatcgcagaaagaatgatcgaagccgttgacaacaatctccgcccaaaatccgaatag

SEQ ID NO: 214600 - DNA, 2790 bp, Artificial Sequence
  Description of Artificial Sequence: Synthetic coding sequence
atgaagaaaatgtctcgcaacgtcctgctgcagatggaagaagaagaagatgacgacgacggcgacattgtgctggagaacctggggcagactatcgttcccgacctggggtcgctggagtctcagcatgactttagaactcctgagtttgaggaatttaatggcaagcccgacagcctgttcttcaatgacggccagagacgaattgacttcgttctcgtctacgaagacgaatcacgaaaagaaaccaataagaagggcaccaatgagaagcagagaagaaagcgtcaggcgtacgaaagcaacctgatctgccacggactccagctggaggccacccgctctgttttagatgataagctcgttttcgtcaaggtgcatgccccttgggaggtgttgtgcacatacgcagagattatgcatataaagctgcccttgaagccaaacgatttgaagaaccgctcgtcggcgtttgggaccctgaattggtttaccaaggtactctccgtcgatgagtcgatcatcaagcccgagcaggaatttttcacggcccctttcgagaaaaacaggatgaacgatttctacattgtggaccgggacgcgttttttaaccccgctaccagatctcgaattgtctatttcatcttgtcaagggtgaaataccaagttataaacaacgtgtccaagtttggcatcaataggcttgtgaattctgggatctacaaggccgcatttcccttgcatgactgcaaattcaggagacaaagcgaggacccatcctgcccgaatgagagatatttgttgtatcgcgagtgggcccaccccaggtccatctacaaaaagcaaccattggatctgatccgcaaatactacggtgagaagatcggcatctactttgcctggctgggttattatacgcagatgctgctgctggctgccgttgttggcgtcgcgtgtttcttgtatggctacctcaatcaggacaactgcacctggagtaaagaggtgtgccatcccgacatcggagggaaaattatcatgtgcccccagtgcgatcgtctgtgccccttttggaaattgaacatcacctgcgagtctagcaaaaagctatgtatctttgactcattcgggacgttggtgttcgccgtttttatgggagtttgggtgaccctttttctcgaattctggaagcgtcgtcaggctgaacttgagtatgagtgggataccgtggaactccagcaggaggaacaagcgagacccgagtacgaagctcggtgtactcacgtagtgatcaacgaaattacacaagaagaggaaagaataccctttaccgcctggggcaaatgcattaggattaccctgtgcgcttcagccgtttttttttggattctgcttatcatcgcatctgttatcggaatcatcgtctacaggctcagtgtgtttatcgttttctcagcaaagctgcccaagaacattaacggcacagatcccatacagaaatacctgacgcctcagacggcgacatctatcacagctagtattatttcattcataataatcatgattttaaacacaatttatgaaaaagtggccatcatgattactaatttcgagctgccgcgaactcaaacggattatgagaattccttgactatgaagatgttccttttccaatttgtgaattactattcctcctgtttctatatcgctttctttaagggcaagttcgtggggtatcccggtgatcctgtttactggctgggtaaatatcgtaatgaggaatgcgaccccggaggttgccttctcgagttgactactcaactcactataatcatggggggtaaagcaatttggaacaatattcaagaggtcctcttaccctggatcatgaatctgattgggaggttccaccgagtgtccgggtcggagaagattaccccgagatgggagcaagattaccatcttcaaccaatgggaaaattaggccttttctacgagtatttagagatgataatacaatttgggtttgttactctctttgtggccagcttcccgctggcccctttgctggcactggtcaacaacattctggaaatccgggtggatgcttggaaactcacgactcaattcaggagacttgtgcccgaaaaggctcaagacattggggcttggcaaccaattatgcaaggcatcgcaatactagcagtggttacaaacgccatgatcatcgccttcacaagtgacatgatcccaaggctggtgtactattggtcttttagtgtgcccccatatggagaccacacaagctacacaatggaggggtatatcaacaacactttgtctatctttaaggtggccgactttaaaaataagagcaaaggaaatccctactcagacctgggcaatcataccacatgtcggtatagggatttcaggtatccccctggccatccccaggagtacaagcacaacatctattattggcacgtcatcgctgctaagctggcattcataatcgtgatggaatatctggcgctgctgccaaggttggggcactcaggaatgattctcgcgcattgtaacctgaggctacccgtggattgctgtatgtgttaccgatttgtcgatgagatccgtctgcttgagcagctgaccagcgacttcatagattccctatactacatcttctcgatatcgatcatctcaatcttttttagtgtcaccttcttttttctcctactgtccctaggccctacgccttgtttttccgtatcaaattttttgtcttag

SEQ ID NO: 214601 - DNA, 2790 bp, Artificial Sequence
  Description of Artificial Sequence: Synthetic coding sequence
atgaaaaagatgtcccggaacgtgctgttacagatggaggaagaggaagatgacgacgatggtgatattgtcctagagaacctcgggcagacaatcgttccggacttggggagtcttgaaagccagcatgactttcgcactcccgaatttgaggagttcaacggtaagcccgattcactcttttttaacgacggccaaaggcgtatcgattttgtgttagtgtatgaagacgaatcacgcaaagaaactaataaaaaggggaccaacgaaaagcagcggagaaaacggcaagcctacgagtccaatctaatttgccacgggctccagctcgaggctacccgatccgtcctggacgacaagcttgtcttcgtcaaggtacacgctccttgggaggtgctgtgcacatatgccgagattatgcacatcaaattacccctgaagcccaacgacctcaagaatagatcttcagccttcgggacacttaattggttcacaaaggtcttgtccgttgatgaatcgatcattaagcccgagcaagagttctttacggctcctttcgaaaaaaatcgcatgaacgatttctatatcgtggatagggatgcgttctttaatcctgcgacccgttccaggatcgtatacttcattctgtcacgggtgaagtaccaagtgataaacaatgtctccaaatttggaattaaccgcctggtcaactccggaatctacaaagcggcattccctctgcacgattgtaaatttaggaggcagagcgaggatccttcttgtccaaatgaacggtacttgttataccgcgaatgggctcatcccagaagtatttataagaaacagcctctcgatttgatacggaagtactacggggaaaagataggtatttacttcgcatggttaggctattatacacagatgttacttcttgccgctgttgttggcgttgcatgcttcctttatggttacctgaatcaagataattgcacttggtctaaagaagtgtgtcacccagacattggaggtaaaattataatgtgcccccagtgtgacagactctgtccgttctggaagctgaatattacgtgtgagagctcaaaaaagttatgtatctttgactcattcggcactttagtcttcgcggtgttcatgggcgtgtgggtcaccctgttcttagaattttggaagcgccgtcaagcagagctggagtacgagtgggataccgttgaattgcaacaagaggaacaggcacgcccagaatatgaggccagatgtacacatgtagtgataaatgaaatcacccaggaagaagagcggatccccttcactgcgtggggaaagtgtattcggattaccctgtgtgcttctgctgtctttttttggattctcctaatcattgcttcagtgatcggcataattgtgtaccggctgtcagtgttcattgtatttagtgccaagcttcccaaaaatatcaatggtaccgaccccatccaaaagtatcttacgccccagacagctacgagcatcaccgctagcatcatctctttcatcatcatcatgatactcaatactatttatgagaaggtcgcaataatgattactaacttcgaactgcctcgcacacaaactgactacgaaaattccctgactatgaagatgtttttgttccagtttgtaaattactatagttcatgtttttacattgccttctttaagggaaagtttgtcggatacccaggcgaccctgtttattggttggggaagtatcgtaatgaagagtgcgatcctggcggttgcctgctggagttgacaactcagctgacgattattatggggggtaaggctatctggaacaatatacaggaggtactgctgccttggattatgaatctgattggacgatttcatagggtttctggctcagagaagattactcccagatgggagcaagattatcatctgcaacctatgggcaagctgggcctgttctatgaatatctggagatgattattcagtttggcttcgtgacgctcttcgtcgctagcttccctctcgctcccctgctggcactggtcaacaatattctcgagatacgcgtagatgcttggaagctgactacccagtttaggcgtttggtacctgagaaggcccaggatatcggggcttggcagcccatcatgcagggaattgcaattctggctgttgtcactaatgcgatgatcatcgccttcacctccgacatgattccacggctggtgtactattggtcttttagcgttccgccttatggagatcacaccagctatactatggaaggctacatcaataacaccctgagtatatttaaggttgcagattttaaaaataagagtaagggtaatccctattctgacttgggcaaccatacaacgtgccggtatcgcgatttccgttaccctcctggacacccacaggaatataaacacaacatctattactggcatgtgatcgcagccaagttggctttcataatcgtgatggagtacctggctttactccccaggctaggacactccgggatgattctagcccattgcaatctgagactgcccgtggactgttgcatgtgctacagatttgtggatgagatccggctcctggagcaacttacatcagatttcatcgacagtctgtattatatattctcgatttctatcatttcaattttcttcagcgtgacatttttcttcttgctgcttagcctgggacctaccccttgcttctccgtgtcgaatttcctgagttag

SEQ ID NO: 214602 - DNA, 2679 bp, Artificial Sequence
  Description of Artificial Sequence: Synthetic coding sequence
atgttttgcgccgcagttctcgagaacctgggtcagaccattgtcccggaccttgggagcctggagagccagcatgatttccggaccccggagttcgaggagttcaacggcaaacctgatagcctctttttcaacgatgggcagagacgaatcgactttgtcctggtctacgaagacgagtctaggaaggaaactaacaaaaagggcacgaacgagaaacaacgccgtaagagacaggcctatgaatcaaatttgatttgtcacggcctgcagctcgaggcaacacgttccgtactggacgacaagctcgtgtttgtgaaggtccacgcgccttgggaggtcttgtgtacttatgcagagatcatgcatattaaactacctttgaaacccaacgacctgaaaaatcgcagctctgcattcggaacgctgaattggttcaccaaggtgctcagcgtggatgagagtattattaaaccagaacaagagttcttcacggctccttttgaaaagaaccgtatgaacgatttctatattgtcgacagagatgcgttcttcaatccagccacccggagccgaattgtatatttcattctgagccgtgtgaagtatcaggtaatcaataacgtgtctaaattcgggatcaataggcttgttaattccggcatttacaaagccgcttttccgctgcacgactgcaaatttcgcaggcagagcgaagacccatcctgcccgaatgaacgctatctgctttacagggaatgggcacatccccgatcaatctacaaaaagcagcccctggacctgattcggaagtactatggagagaaaatcggcatttactttgcatggctcgggtattacacgcagatgctccttctcgccgcagtcgtgggggtggcctgctttttatatggctatctgaaccaggataattgcacatggagcaaagaggtgtgccaccccgacatcggaggcaaaatcataatgtgtccccagtgtgatcgcctctgccccttctggaaactcaatattacttgtgaatcctccaagaagctgtgtatatttgattcgttcggaacgttggtcttcgcagtgtttatgggtgtctgggtcaccctgtttctcgagttctggaagcggaggcaggctgaactggaatacgagtgggacacagtggaacttcagcaggaggaacaggcacggcctgaatatgaagccaggtgtacccacgtcgtgataaatgagatcactcaagaagaggagcggatcccctttacagcatggggcaaatgcatacgcatcacattgtgtgcaagtgcagtgttcttctggattttgctgattattgccagcgtgattgggatcatcgtgtaccgactgagcgtatttattgtcttctctgctaagctgcctaagaacatcaacgggacggaccctattcagaagtaccttactccccagactgccacaagtattactgcctccattatcagttttattattattatgattctaaatactatctatgaaaaggttgctattatgataacgaacttcgagctcccacgcacacaaactgattacgaaaactcactgaccatgaagatgtttctcttccagttcgtcaactactatagcagctgtttttacatcgccttttttaaaggtaagtttgtggggtaccccggagatcctgtttattggctgggaaagtataggaatgaggagtgtgatcctggaggctgtctgctggagcttacaacacagttgacgatcattatggggggtaaagcaatctggaataatatccaggaggtattactgccctggattatgaatctaattgggcgtttccatagggtgtccggttctgagaagatcacacctagatgggagcaggactaccacctgcagccaatggggaaactaggactattctatgagtatctagaaatgattatccagttcgggtttgtgacgctctttgttgcctcgttccctcttgcccctctcctggcgctcgttaataacatccttgagatcagagtcgacgcttggaagttgacaacccagttccgcaggttagtgccggaaaaagcgcaggatatcggcgcttggcagccaattatgcaagggatagccattctggcagtggtcaccaacgctatgataatcgcctttacctccgacatgataccccgtctggtgtattactggagcttcagcgtgcccccatacggagaccacacttcttatacaatggaaggctacatcaacaatacactgtctatctttaaagtggcagacttcaagaacaagagcaagggtaacccctacagcgatcttggcaatcatacaacctgcagatacagagactttcgatacccacccggtcacccacaggagtacaagcataatatctactattggcatgtgatcgctgctaaactcgcattcatcatcgtgatggagcacgtgatctattccgtgaaattctttatctcttatgcaattcctgacgtttcgaagcgtacaaaatcaaagatacagagggagaagtacctaacccaaaagctcctgcatgagaatcacctgaaggacatgacaaagaacatgggcgttatcgcagagcggatgatcgaggccgtggataataacttacgtccgaagtccgagtag

SEQ ID NO: 214603 - DNA, 2796 bp, Artificial Sequence
  Description of Artificial Sequence: Synthetic coding sequence
atgaaaaagatgagtcgtaacgtgctcctgcaaatggaggaggaggaagacgatgacgacggagatattggagatgttcctgccagcagacggccattccttacgcctcacactcacttgccaagcagtctggtccttgagaatctaggccagactatcgtgcctgacctagggtctctggaaagccagcatgattttcgtacccctgaattcgaggaattcaatggaaagcccgacagcttgtttttcaacgatgggcagaggagaatcgacttcgtgctggtgtatgaggacgagagtcggaaggaaactaacaaaaaaggcaccaacgagaaacaaaggcggaagcgtcaggcttatgagagtaacctgatctgtcacggattgcagctggaagccacacggagtgttctcgacgacaagttggttttcgtcaaggtgcacgcgccatgggaagtcctgtgcacctacgccgaaatcatgcacattaagcttccactgaagcctaatgatctcaaaaaccgtagtagtgcttttggcaccctgaactggttcaccaaagtactgagtgtagacgagagcatcattaagcctgagcaggagttcttcactgccccattcgaaaaaaacaggatgaacgacttttacatcgtggatcgagatgccttttttaatcctgccacaagatcgcggattgtgtattttatcttaagcagagttaagtatcaggtaataaacaacgtatcaaagtttggaattaatcgtctggtcaacagtggaatctataaagcggctttcccattgcacgattgcaagttcagaaggcaatccgaagatccaagttgccctaacgagcggtacctactgtacagagagtgggcacacccacggagcatttacaaaaagcaaccactggacctgattagaaaatactacggggagaagatcggcatttattttgcatggctaggctattatacccaaatgttgcttctcgctgccgttgtcggcgtggcatgtttcctgtatggttatcttaatcaggacaactgcacttggtctaaggaggtgtgtcatccagatataggaggcaagattattatgtgccctcaatgcgaccgcctgtgcccattctggaagctaaacatcacttgtgagtcctccaaaaagctgtgtatctttgattcgttcggcacgcttgttttcgctgtgttcatgggggtctgggtgaccctgttcctagaattctggaaaaggcgccaggcagaactggagtatgagtgggacaccgtggagctccagcaggaggaacaggcccgtcctgagtatgaggccaggtgtacacacgtcgttatcaacgaaatcactcaagaagaagaaagaatccctttcactgcgtgggggaagtgcatccgcatcaccctgtgcgcgagtgctgtgtttttctggattttgctgatcatcgcctcagtgatcggaatcatagtgtatcggctgagcgtttttatcgtgttttctgccaaactgcctaagaacataaacgggactgacccgatccagaaatatttaaccccacagacagccacctcgattacagcctccattatcagttttatcattatcatgattctgaacacgatatatgaaaaggtggcaatcatgattacaaattttgagctgcctaggacccagaccgattacgagaacagcttaaccatgaagatgttcttatttcaattcgttaactactatagcagctgcttctacattgcatttttcaaaggtaaatttgtgggatatccaggggatcctgtatattggctgggaaagtaccggaacgaagaatgcgatccgggaggatgtttgttagaattgaccacacaattgactataattatgggcggtaaggcaatttggaacaatatccaggaggtactgctaccctggattatgaatctgattggcagattccacagggtgagtgggagcgagaaaattacaccccgttgggaacaggattatcacttgcagccaatgggcaaactggggcttttctatgaatatctggagatgattattcaatttggcttcgttactctgtttgttgcctctttcccactggcgccactgttggctttagtgaacaacattctggagattagagtggacgcctggaagctcaccacccagtttcggaggctcgtaccggagaaagcccaggacataggtgcttggcagccaataatgcagggcatcgctattctggctgtggtgaccaacgcaatgattattgccttcacatctgacatgattcccaggttggtgtactactggtctttctccgtgccgccatacggagatcacaccagctataccatggagggctatattaacaatactttgtctatcttcaaggtcgctgattttaagaataaatccaagggcaacccatactctgatcttggtaatcatacgacgtgcaggtatagagattttcggtatcctcctggccacccacaagaatacaagcataatatctactattggcacgttatagctgccaagttggccttcataatcgttatggaacatgtgatctatagtgtgaagttctttatcagctacgccatcccagatgtgagtaagagaacgaaatccaaaatacagcgcgaaaagtatttgacacagaaactcctacatgagaatcacctcaaggatatgacgaaaaacatgggggtcatcgccgagaggatgatcgaggctgtagataataacctaagacccaagtccgagtag

SEQ ID NO: 214604 - DNA, 501 bp, Artificial Sequence
  Description of Artificial Sequence: Synthetic coding sequence
atgatgctccactcagccctggggctgtgtctgttgctggtgacggtgtcttcgaacttagcaattgccataaagaaggaaaagaggcccccacagacactaagtcgcggatggggcgacgatatcacatgggtccagacttatgaggaaggccttttctacgcacaaaaatctaaaaagccactcatggtaatccaccatctggaggattgccaatattcccaggctctgaagaaggtgttcgcacaaaatgaggagattcaagagatggcccaaaacaagttcataatgctgaatctgatgcatgagaccacagacaagaacctgtccccagatggccagtacgttccacgcattatgtttgtggaccctagtcttactgttcgggctgatattgccggaagatattctaatcggttatatacttatgagccgagggatctcccgctgctgattgagaatatgaaaaaagctcttcggttaatacagtcagagttatag

SEQ ID NO: 214605 - DNA, 453 bp, Artificial Sequence
  Description of Artificial Sequence: Synthetic coding sequence
atgggtgccgcagtgttttttggctgtaccttcgttgccttcgggcctgcctttgccttgttcctgatcactgtggctggcgacccattgcgggtcattattttggtcgcaggcaaggccgacgaagggctggcctctctgtccgaggatggtcggtctccaatttcaatcagacagatggcctacgtctcagggctgtcctttggaatcatcagtggtgtgttctccgttattaacatactggctgacgccctgggtccaggagtggtggggatacacggagactcaccatattactttctgaccagcgctttccttactgccgctatcatacttctccacactttttggggggttgtgttcttcgacgcctgtgagcgtcgaaggtactgggcacttggtctggtggtcggcagtcatctgctgacatccggcctgacttttctgaattag

SEQ ID NO: 214606 - DNA, 744 bp, Artificial Sequence
  Description of Artificial Sequence: Synthetic coding sequence
atgggggctgcagtgttttttggttgcacctttgtcgccttcggccctgcttttgccttgttcctcattacagtggctggcgaccctcttagagtgataattctggtcgccggagcgttcttctggcttgtctcactgctgttggcatcggtcgtttggtttatcctggtgcacgtcaccgaccgaagcgatgctcgccttcaatacggtctgctcatattcggggctgcagtaagcgtgctcctgcaggaggtcttcaggtttgcctactataagctgctgaagaaggccgatgagggcctcgcctccctcagtgaagatgggagatcaccaatcagtattcggcagatggcctatgtatccggcctgagcttcggcatcatcagcggtgtcttcagcgtgattaatattctggctgatgctctcggacctggggttgtcggtatccatggggactctccttactactttttgacctccgctttcctcacagccgctatcatcctcttgcacacgttctggggtgtggtcttcttcgatgcgtgcgaacgcaggaggtattgggcgctgggcctggtggtgggatctcacctcctgactagcggtctgaccttcctcaatccctggtatgaagcatctttgctgcccatctacgcggtgactgtatctatgggcttatgggcatttataactgcagggggaagcttgagaagcatccaaagatcactgctttgcaaagattag

SEQ ID NO: 214607 - DNA, 798 bp, Artificial Sequence
  Description of Artificial Sequence: Synthetic coding sequence
atgggcgctgccgtattttttggatgcactttcgtagccttcgggccagcgtttgcattgtttctgattacagtggcaggcgatcccctgcgagtgatcattctggtcgcaggcgctttcttttggttggtaagtctccttctcgctagtgtagtctggtttatcctcgtgcacgtgaccgaccgatcggatgcccgacttcagtacggactactgatcttcggtgccgctgtgtccgtgctgctgcaggaagtttttcgcttcgcctactataagttgctcaaaaaagccgatgagggtctcgcgtccctgtccgaagacggtaggtctccaatctccatcaggcagatggcttatgtgtctggcctatctttcggcatcataagcggggtattcagcgtgattaacatactggctgatgcactgggacccggagtcgttgggatacatggagattcgccttactactttctaacctccgcctttctgaccgccgctatcattctgttgcacacgttctggggcgtagtgttcttcgacgcatgtgagcgtagacggtactgggctctgggactggttgtgggcagtcatctcctgaccagtggattgacattcctgaacccctggtatgaagcctcccttctgcccatctatgccgtgacggtgtctatgggattgtgggccttcatcacggctggcggttccctaaggtcaatccaacgctcattgctttgccgaagacaagaggattcacgggtcatggtgtatagcgctctgcgaatccctcctgaagattag

SEQ ID NO: 214608 - DNA, 588 bp, Artificial Sequence
  Description of Artificial Sequence: Synthetic coding sequence
atgggtgccgcagtcttcttcggttgcacttttgtggcctttggtcccgctttcgccctgtttctgattactgtcgcaggcgatccacttagggttatcatcctggtggcgggtcggtgcagtgccctgccaaccaccagttgtctgattagtgggctctctttcggaataatttctggcgtcttcagcgtcattaacatcctggccgacgccttaggacccggagttgtaggtattcacggggatagcccctattattttcttacatccgcttttctcaccgctgctatcatattactgcacaccttctggggagttgtgtttttcgacgcgtgcgagcgccgacgttactgggctctgggcttggtggttggttcgcacctgctgacctccggtctgactttcctaaatccgtggtacgaagctagtctgttgccaatttatgctgtcacagtttccatggggctgtgggccttcattacagcaggaggcagcctccgcagtattcagaggagtctactatgcagaagacaggaggattcacgcgttatggtctacagcgccctgcggatcccaccagaggattag

SEQ ID NO: 214609 - DNA, 774 bp, Artificial Sequence
  Description of Artificial Sequence: Synthetic coding sequence
atgacagccgcagtgttcttcggatgcgcctttattgcttttggccctgccttggcactctatgtctttacaattgcaacagagcctctcaggatcattttcctgatcgccggagcttttttttggctggtgtctcttttaatcagttccctggtgtggtttatggccagggtaatcatcgataataaagacggccctacgcagaagtacctgctgatattcggcgcattcgtttctgtgtacattcaggaaatgttcagattcgcctattacaagctgctgaagaaagcctcagaggggctgaaatctatcaaccccggagagacagccccatcaatgcgcttgttggcttacgtgagcggactgggcttcgggataatgagtggagtgttctcttttgtgaataccctctcggactccctgggtcccggtaccgtcggcattcacggcgactcaccacaattctttctgtatagtgcctttatgactctggttatcatactgctgcatgtcttttggggcatagtgttctttgatggatgcgaaaaaaaaaagtggggaatcctgctcatagtcctgcttacacacttgcttgtctctgcccagactttcatcagtagctactatggcattaatcttgctagcgcatttatcatccttgtacttatggggacatgggccttcctggctgcgggtggatcttgcagatcattgaaactctgcctcttgtgccaagacaagaatttcttgctgtacaatcagcgcagtcgatag

SEQ ID NO: 214610 - DNA, 246 bp, Artificial Sequence
  Description of Artificial Sequence: Synthetic coding sequence
atgaccgcggcagtgttcttcggctgcgcttttattgcatttggcccagccctggccttatatgtcttcacaatcgccacagagcctctgcgaattatcttccttatcgcaggcaggcgtgttgaaacttgcaaaaatacagaggccccagactgcgcttccccatctggcagtctcagcttcctcttggttggcgtctctactgacttcgttccctgtctagtacatggcaagtctcattattag

SEQ ID NO: 214611 - DNA, 651 bp, Artificial Sequence
  Description of Artificial Sequence: Synthetic coding sequence
atgacagccgctgtgttttttggctgtgcatttatcgccttcggccctgctctggctctgtatgtcttcaccatcgccacagagcccctcagaattattttcttgatcgccggagccttcttctggctggtgtcactgcttatttccagccttgtctggttcatggccagagtgattatagataacaaagatgggcctacacagaagtatttgctgatattcggcgcattcgtgtccgtttacattcaggagatgtttagattcgcttattacaagttattgaaaaaggccagtgaaggtttgaaaagcattaacccaggagaaacggctccatcgatgcggttactcgcttacgccttcatgacattggttataatcttactccacgtgttctggggcatcgtgttctttgacggctgcgaaaagaaaaagtggggcatattgttgatcgtgttactaacacacctcttagtgtctgcgcagacctttatttcctcctactacgggattaatctcgcttctgcatttatcatcctggttttaatgggaacttgggcgtttctggccgctggcggatcctgcaggtcactgaagctgtgtctgttgtgtcaggataaaaactttttgttgtacaaccagcggagccgctag

SEQ ID NO: 214612 - DNA, 1695 bp, Artificial Sequence
  Description of Artificial Sequence: Synthetic coding sequence
atggccacagccgagaggcgcgctctcggtatcggttttcagtggctttccctggcaaccctcgtgcttatatgtgccggtcagggcggacgacgggaagacgggggacccgcatgctacggagggttcgacctttactttatccttgataaatcaggaagtgtgctacaccattggaatgagatttattacttcgtggagcagctggcacataagttcatctcacctcagttgcggatgtccttcatcgtgttctcaacacggggtaccactctgatgaaactgaccgaggaccgagagcagatcaggcagggactcgaggagcttcagaaggttctgcccggtggcgacacctacatgcacgaaggattcgaaagagcatcagaacagatctactatgaaaaccggcagggataccgtacagcatctgtgattattgcgcttaccgacggcgaattacacgaagatctttttttctactctgaacgggaagcaaaccgtagtagggacctgggtgctatcgtgtattgcgtgggggtgaaggactttaatgagacacaactagcacgcattgcagatagcaaagatcacgttttccccgtgaacgatggtttccaggccctccagggcatcatacattcaatactcaaaaagtcatgcattgagatcctggcggctgagccatctactatttgcgcaggagagagttttcaagtcgtcgtgcgtgggaacggattccgacacgccaggaatgtagaccgggttctttgttcattcaagatcaatgatagcgttacactgaatgagaaacccttcagcgtcgaggatacatacctgctatgccctgccccaatccttaaggaggtgggcatgaaggcagccctgcaggtgtctatgaatgatggcctgtcttttattagcagctccgttattattactaccacacattgcagtgacggcagtatactggcaattgcacttttaattctgtttctgttattggcactggcactgctctggtggttctggccactgtgttgcaccgttattatcaaagaggtgccaccgccacctgcagaagagtctgaagaagaggacgacgatgggctccccaagaagaaatggcctaccgtcgatgcgtcttactatggcggaaggggggtgggcggaataaagcgtatggaagtgcggtggggggaaaagggaagcaccgaggaaggcgctaaactagagaaggccaaaaatgcccgtgtcaagatgccggagcaagagtatgagttcccagagccaagaaatctaaacaacaacatgaggcggccatcaagccccagaaagtggtacagccccattaaaggaaaactcgatgcactgtgggtgctcctgagaaaaggctacgatcgggtgtcagttatgagaccacaacccggagatacaggccgttgcatcaatttcacacgcgttaagaacaaccaaccagccaaataccccctgaataatgcttaccatacttcctcaccccctcccgctcctatctacaccccgcctcctcccgcaccacactgtccccctccccctccctcagctccaactccacccatcccaagtccaccctccacactgccccctccaccccaagcaccacccccaaatcgtgctccccctccaagccgacccccacccaggccatctgtatag

SEQ ID NO: 214613 - DNA, 1107 bp, Artificial Sequence
  Description of Artificial Sequence: Synthetic coding sequence
atggctacggcagaaagaagggcgttaggaattggctttcagtggctgagtctagcaactcttgtactgatttgtgctggccagggaggaagacgagaggacggaggccctgcgtgctacggcggatttgacctgtattttattctggacaagtctggttcggtcctccatcactggaatgagatttactacttcgtggaacagttggcccacaaatttatctccccccagctcagaatgagtttcatcgtcttttctacccggggtacaactctgatgaaactgacagaagatcgggaacagattagacaaggactggaagagctgcagaaagtgctcccaggaggcgacacctacatgcatgagggtttcgaaagagccagtgagcaaatctactacgaaaacagacaggggtatcggaccgcctcagttattatcgcacttactgacggagagctgcatgaagatctcttcttttattcagaaagggaggctaaccgctccagagacctgggagccattgtttactgtgttggtgtgaaagattttaacgagacccagctggcccgtatcgcggattccaaggatcatgtatttcccgttaatgatggcttccaagcgctgcagggcattatccattcaatactgaaaaagagttgcattgaaattctcgcagctgaacccagcaccatctgtgccggagaatcatttcaggtggtagtgagggggaatggctttagacatgcaagaaatgtcgatcgtgtcctttgcagctttaagataaacgattctgtcactctcaacgagaaacccttttctgtggaggatacttaccttctgtgccctgccccaattctcaaggaagttggcatgaaggctgcactgcaggtgtccatgaatgatggtctgtccttcattagttcctcagtgataatcacaaccacacattgcagcgatgggtccattctggctatcgccttgctgatcctgttcctgctgcttgccctggcactgctgtggtggttctggcctctgtgttgcacagttattattaaggaagtaccacctccccctgcagaagaatccgaggaaaacaagatcaagtag

SEQ ID NO: 214614 - DNA, 1002 bp, Artificial Sequence
  Description of Artificial Sequence: Synthetic coding sequence
atggccacagcggagcggagggccctcggtatcggcttccagtggctgtccttagccaccctcgttctgatttgcgccggtcaaggcggaaggcgagaggatggcggaccagcatgttacggtggctttgatttatacttcatattagataaaagcgggagcgttctgcatcactggaatgaaatctactactttgtggagcagctcgcgcacaagttcatttctcctcagctgagaatgagcttcattgtgttttcaacccgaggcaccaccctgatgaaactgacagaggacagggaacagatccggcagggcttagaagaactgcagaaggtgctgccaggcggagacacgtacatgcacgaggggtttgaacgcgcatcagaacaaatttactacgaaaataggcaaggctaccgcaccgcatctgtaataatcgctctgaccgatggcgaacttcatgaagatctcttcttctacagtgaaagagaggctaacaggtccagggacttgggagcaatagtgtattgcgtgggtgtgaaagattttaacgagacacagctggcacggattgcagatagcaaggatcatgtgttccccgtcaacgatgggtttcaggctttacagggcatcatccatagtattctcaaaaaatcgtgtatcgagatacttgctgcagagccaagcactatctgtgccggagagtctttccaggtggttgtgcggggaaatggctttcgacacgcaagaaatgtggatcgcgtgctatgttccttcaaaattaacgactccgtgactttgaatgaaaagcccttctctgtggaagatacctacctcctgtgccccgctccaattctgaaggaagtgggaatgaaagctgccctgcaggtgtctatgaacgacgggttgagctttatctcgagctctgtgatcataactacgacccattgctccctgcataagatcgcttcgggcccaaccactgccgcatgcatggagtag

SEQ ID NO: 214615 - DNA, 969 bp, Artificial Sequence
  Description of Artificial Sequence: Synthetic coding sequence
atggtggcagagcgctcgcccgcacggagtcccggttcatggctctttccaggcctctggttactggtgctgagtggtcctggagggctgctgcgtgcacaggagcagccttcatgtaggcgtgcatttgatctatacttcgttctggacaaaagtggcagtgtggccaacaattggatcgaaatctataattttgtccagcaactagcagaaagattcgtgagtccagagatgcgtctgtcattcattgtgttttcctctcaggccacaattattcttcccttgacaggcgaccgaggaaagatttccaaaggactcgaggacttgaagcgagttagcccggtcggagagacatacatacatgagggcctcaaattggccaacgaacagatccagaaggctggcggactgaaaaccagcagcataattatagcattgaccgacgggaaattagatggcctcgtacctagctatgcagaaaaggaggctaaaatctctcggtcccttggagcaagcgtatactgcgtgggagttctggacttcgaacaggctcaactcgagcggatcgccgatagtaaagagcaagtgttccctgtgaagggaggatttcaggctctcaaaggtataattaacagcattctggcccagagttgtacggaaatcctggaattacaaccgtccagcgtgtgcgtcggggaagagttccagatcgtgctcagtgggagagggttcatgctaggatcacgcaacggtagtgttctctgcacctacaccgtaaacgagacctacaccactagcgtgaagcctgttagcgttcagctgaatagtatgctgtgccccgctccaatcttgaataaggccggtgaatggggactcacagttacccaggctggggtgaaatggcacgatctgacccactgtactttcggacttagcggttcaggcgatcctcctacgagcgcctcctag

SEQ ID NO: 214616 - DNA, 1470 bp, Artificial Sequence
  Description of Artificial Sequence: Synthetic coding sequence
atggtggcagagaggagtcccgcaaggtctcccggtagttggctgtttcctggactctggctcctggtcttatccggccctggtggtcttctccgggcacaggagcaaccctcttgtagacgtgccttcgacctatacttcgttctggataagtccggatccgtcgccaacaactggatcgagatttataatttcgtccaacagctcgccgagcgctttgtctctcctgaaatgaggttatctttcatcgttttctcctcccaggccaccattattcttcctctgaccggagatcggggaaagatcagcaaaggattggaagacctgaagcgcgtttctcctgtcggagagacctacatacatgaaggcctcaagctggccaacgaacagattcagaaggccggagggctaaagaccagctcgatcatcatcgctttaactgatgggaaactggacggactggtcccctcatacgctgagaaagaagctaaaatatctcgctccctgggcgctagcgtgtattgcgtaggagtgcttgacttcgaacaggctcaactggagagaatcgccgacagtaaggagcaagttttcccagtgaaggggggatttcaggctttgaagggtattatcaacagtatcctggctcagtcttgcaccgaaattcttgaactccagcccagctccgtatgcgtcggtgaggaatttcaaattgtcctgtcgggacgtggattcatgctaggaagtagaaatgggtccgtgttgtgtacatataccgtcaacgagacatacactacaagtgtgaaacccgtctctgtgcagctgaactccatgctgtgtccagcgcctatcctgaacaaagccggagagacccttgatgtgtctgtcagcttcaatggcggaaaatctgtaatcagcgggagcctgatcgtgactgcgaccgagtgtagcaacggaattgccgctataatagtgatcctggtgctcctgctgttactcggcattggcttgatgtggtggttctggccgctctgttgtaaggtggtcattaaagacccccctccaccccctgctcctgcacccaaggaggaggaggaggaacctctgccgaccaagaagtggccaaccgtcgatgcatcatattacggcggaagaggcgtgggagggattaagcggatggaggtacgatggggggataaaggaagcactgaggaaggggctagactggaaaaggccaagaacgctgtggtgaagatccctgaggaaacagaggaaccgattagacccaggccacctcgcccaaaaccaactcaccagccccctcagacaaagtggtacactcctataaaggggcgtctggacgctctgtgggcgcttctgaggcgacaatacgatcgggtgtccctgatgaggccccaggaaggcgacgaagtatgcatttgggagtgcatcgagaaggaacttaccgcgtag

SEQ ID NO: 214617 - DNA, 1161 bp, Artificial Sequence
  Description of Artificial Sequence: Synthetic coding sequence
atggtggcagagcggagcccagcccgaagccccggatcttggctatttccaggcctttggctgctggtactctcagggcctggaggcctgctgcgagcccaggagcaaccttcctgcaggagggcttttgatttgtatttcgtcctggacaagtctggtagtgtggccaataattggatcgaaatatacaattttgtgcagcaattggccgaacgtttcgtaagtccagagatgcggcttagcttcatcgtattcagttctcaagccaccatcatactgccccttaccggggatcggggaaaaatctccaaaggtctggaagatttgaaacgggttagtcctgtcggggagacgtacattcacgaaggattgaagctcgctaacgagcaaattcaaaaggcagggggtttgaagacgtcttcaatcattatcgcactgactgacggtaaacttgatggactagttccgtcttacgccgaaaaggaagccaagatttcgagatctctgggcgcatcagtatattgtgtcggggtgttggattttgaacaggctcagctagagcggatcgccgacagtaaggagcaagtgtttccagttaaagggggtttccaggcactgaagggtataatcaatagctccaacggaatcgccgcaatcatcgtgatcctcgtgctcttattgctgctgggcattggtctgatgtggtggttttggccactgtgttgcaaggtggtgattaaagaccctccacctccgcctgccccagcacccaaggaagaagaggaagaacctttaccaacaaagaagtggcccacagtggacgccagctactatggtggacgaggagtcggcggaattaagaggatggaggtgcgctggggggacaagggttctacagaagaaggagctcggttagagaaggctaagaatgcagtggtcaagatcccagaagagacggaggaacctatacgcccacgaccaccgcgtcctaagccaacccatcagccaccgcagactaaatggtacacgccaataaaagggaggttggacgctctgtgggccttattaaggaggcaatacgatcgcgtttcactcatgagaccacaggaaggcgatgaagtctgtatctgggagtgcattgagaaggaactgaccgcgtag

SEQ ID NO: 214618 - DNA, 1467 bp, Artificial Sequence
  Description of Artificial Sequence: Synthetic coding sequence
atggtcgcggagagaagccccgctagatctcccggatcttggctatttccaggtctgtggcttctggtgctgtctggcccaggaggcctgctgcgtgcgcaggaacagccttcgtgtcgtcgtgccttcgatctttactttgtactagataagagcggatccgtggccaacaactggattgaaatctataattttgtacagcagctggcagaacgctttgttagcccagaaatgaggttgagttttatcgtgttcagcagtcaggcaaccattattctgccactgacaggagatagaggcaagattagtaaaggcttagaagatctgaaaagggtctctccggtgggtgaaacttatatccacgaaggtttaaagctggccaacgaacaaattcagaaagccggagggctgaagaccagttctattattattgccttgacggacgggaagctggacgggttggtgccctcttacgccgaaaaggaggccaagatttctcggtccctcggggctagtgtgtactgcgttggggtccttgactttgagcaggctcagcttgaacgcattgctgattccaaggagcaggtattcccggtcaaaggtggtttccaggccctcaagggaattattaatagtatcctggctcagtcttgcaccgaaatactagagcttcagccttcatccgtctgcgtgggagaggagttccaaatcgtgctctccggacgaggcttcatgctcggatcaaggaacggatccgttctttgtacatacacggttaatgagacctatactacaagcgtgaaacctgtgagtgtgcaactgaactcaatgctgtgccccgctccgattctaaataaggccggagaaaccctggatgtttctgtctcttttaatgggggaaagtctgtaatctccgggagtctcatagtgaccgccacagagtgtagtaatgggatagccgcaatcatcgtaatcctggtgctgctgctgctgctggggattgggctaatgtggtggttctggcccctatgttgcaaggtggtaatcaaggatccccctcctccccctgcaccagctcccaaggaagaggaagaagaacccctacccacaaagaaatggcccacagtggacgcatcctattatggaggacgtggtgtggggggaataaaacggatggaagtgcgctggggggataaggggtcaacagaagagggcgcacggctggagaaagccaaaaatgccgtggttaagatcccggaagagacggaggagcccatccgcccacggcctccgagaccaaagcctactcaccagccgcctcagaccaagtggtatacacctattaagggcagactagacgcactgtgggcccttttgagacggcagtacgaccgcgtgagcctcatgcgacctcaggagggcgatgaaggcagatgtattaatttcagcagagttcctagccagtag

SEQ ID NO: 214619 - DNA, 2217 bp, Artificial Sequence
  Description of Artificial Sequence: Synthetic coding sequence
atgcgcggtcctagcggggcactgtggctcctgctcgccctgagaacggtcctgggcggtatggaagttagatggtgcgccacctctgaccctgagcagcacaagtgcggaaacatgagcgaggcttttcgggaggccggaatacagccatctctgttatgtgtgagagggaccagcgctgatcactgcgtccagctcatcgctgcacaggaggcagatgccatcaccctggatgggggtgctatctacgaagccggaaaggagcacggcctcaagcctgtcgtgggagaggtttacgaccaggaggtaggtacctcctattatgccgtggccgtagttcggagatcttctcacgtgaccatcgacacactgaaaggggtcaagtcatgccacacaggaattaatcgcaccgtgggatggaatgtcccagttggctacttagtggagagcggcagactatctgtcatgggatgtgatgttctgaaggccgtgtctgactactttggtggctcttgcgtgcctggggcaggcgagacaagttactctgaatccctgtgccgtctgtgtcgaggtgacagttccggggagggggtctgcgacaaaagccctctggagaggtactacgactactctggggcattccgatgtctggccgaaggggctggtgatgtcgcctttgttaaacattctactgtgcttgaaaacaccgatggaaaaaccctgccatcatgggggcaagcgcttttaagccaggactttgagttgctgtgtagggacggcagtcgcgctgatgtaactgagtggcgacagtgccacctcgcgagggtgcccgctcatgccgtggtagtgcgggctgacacggacgggggactgatattcagactgctcaatgaaggacaacgcttgttttcccatgagggctccagtttccagatgttcagcagcgaggcatacgggcagaaagatctgcttttcaaggatagcactagtgaattagttcccatagcgacccagacttacgaagcctggctgggacacgagtacctccacgcaatgaagggcctcctctgtgaccccaatcggctccccccatacctgaggtggtgcgtgctgagtacccctgagatacagaagtgtggagatatggctgtggccttccggagacagagattaaagccagaaattcagtgtgtctctgctaaatcaccgcagcattgcatggagagaattcaggcggaacaggtagacgcagtgactctttccggagaagatatttacacagccggtaagacctacgggttagtgcccgctgctggagaacattacgctcccgaagacagctcaaactcgtactatgtcgtggctgtcgtgcgccgagattcgtctcatgccttcaccctggatgaactgcggggaaaacggtcctgtcatgccggattcgggtccccggcaggttgggatgtccccgtcggggctctgattcagcggggttttatccgccctaaggactgcgatgtcttaaccgctgtctcagaattctttaacgcgtcttgtgtccctgtaaacaaccccaagaattacccctcatctctatgtgctttgtgtgtgggagatgagcagggacgcaataaatgtgtgggcaacagtcaagaaaggtactacggctacaggggcgcattcaggtgtctcgttgagaatgcaggcgatgtggctttcgtcagacacacaacagtgtttgacaacaccaatggccacaacagcgagccttgggctgcagaactaagaagcgaagactatgaactgttgtgtccaaacggggctagagcggaggttagtcagtttgccgcttgcaatttggcccaaatccctcctcatgcagtgatggtacgccctgataccaatatctttaccgtctatggcctcctcgacaaggcacaagacctgtttggagatgatcacaacaaaaatggattcaagatgttcgattcctcaaactaccacggacaggacctgcttttcaaagatgcgaccgtccgggctgtgcccgtgggggaaaaaacaacatatagaggctggctgggattggattacgtggcagctttggaaggtatgtcaagtcaacagtgtagcggggctgccgctccggctcctggggctcctctgctccctttgctgctccccgctttggctgccagacttcttcctcccgcattatag

SEQ ID NO: 214620 - DNA, 909 bp, Artificial Sequence
  Description of Artificial Sequence: Synthetic coding sequence
atgagaggcccatcaggcgcactgtggttattgctcgcattgagaaccgtcctggggggaatggaggttcggtggtgtgcaactagtgaccctgagcagcacaagtgcggcaacatgtcagaggccttccgcgaggcagggatacagcctagtctcttatgcgttcgaggtacatcagccgaccattgtgtgcagctaatcgctgcccaggaggcagatgcaatcaccttggacgggggagcgatctatgaggccggaaaagaacacggtttgaagcctgtggtgggagaggtctacgatcaggaggtcggtaccagctattacgccgtagcggtggtcaggagaagttcacatgtgaccattgacaccctaaagggcgtcaagtcttgtcacactgggattaaccgtactgtgggctggaacgtccccgttggctacctggtagagagcgggcgattaagcgttatggggtgtgatgttctcaaggccgtttctgactacttcggaggcagctgcgtccccggagcaggggaaacttcctacagtgaatcactttgcagactgtgtagaggagacagcagtggagagggagtgtgtgacaagtcgccactggagcgttattatgattatagcggcgcatttcgatgtttagccgagggtgccggagatgtggcttttgtgaagcacagcacagttcttgaaaataccgatgagtctccctccagaagacagacatggacccgatccgaggaagaggagggtgagtgcccagcacatgaggaggccaggcgaaccatgcgttcttcggcaggccaggcgtggaagtgggctcctgtccatagaccccaggatgagtctgacaagggcgagttcggtaagagggctaagtccagggatatgctgggatag

SEQ ID NO: 214621 - DNA, 1395 bp, Artificial Sequence
  Description of Artificial Sequence: Synthetic coding sequence
atggattttcaacaccggcctggcggaaagacaggatctggaggcgtggcaagtagcagtgagtcaaacagggatcgacgcgagaggctgagacagttagctttggaaacaattgatatcaataaagacccgtatttcatgaaaaatcatttaggatcctatgaatgtaaactgtgccttactttacacaacaacgagggctcctatctggcacacacccaaggtaagaagcaccagactaacctggccagacgggcagcaaaagaagcgaaggaggctcctgcgcagcctgctccggaaaaagtgaaggtggaagtcaagaagttcgtgaaaattggacgaccaggatataaagttacaaaacaacgtgatagtgaaatgggtcagcagtctttgttattccagattgactaccctgagatcgccgagggaataatgccaaggcaccggttcatgtccgcatatgagcagcgtattgagccgcctgacaggcgatggcagtacctgttgatggcagctgaaccctacgagacaattgcttttaaggtgccaagcagagaaattgacaaagcggagggtaaattttggacacactggaatagagagaccaagcagttttttctgcaattccatttcaagatggagaaacccccagctcccccatctctgcccgctggcccaccgggagtgaagcggccaccccctcctcttatgaatggactgcccccacggcctccactgccagaatcacttcctccccctccccctggagggctgcctctccctcctatgcctccaactgggccagcaccaagtggccctcctggcccacctcagcttccaccacccgctccaggagtacacccccctgcccctgtggtccaccctccagcttctggagtgcaccccccagcccctggtgtgcacccccctgctcccggagtccaccccccagcccctggtgtccatccacctacttcaggggtccaccctccggctcctggcgtgcacccgcctgcaccgggagttcaccctcctgcacccggtgttcatccgccagccccaggcgtgcatccacctgcccctggagtgcacccgcctccaagcgctggagtccatcctcaggcgcctggtgtgcaccctgctgctcccgcagtgcacccgcaggcaccaggagtacaccctccggcacccggtatgcatccacaggcccctggcgtgcatccccaacccccaggcgtccatccatcagctcccggagtgcacccacagccccctggtgtgcacccgtcaaatcccggtgttcacccccctaccccaatgccgcctatgctgaggcccccactcccctctgagggaccaggcaatataccccctccaccccctacgaattag

SEQ ID NO: 214622 - DNA, 1437 bp, Artificial Sequence
  Description of Artificial Sequence: Synthetic coding sequence
atgctggggagtctgggactgtgggctctgcttcctaccgccgtagaagcgccaccaaatcgcagaacgtgcgtcttttttgaggctcccggtgtccggggttctaccaaaactctcggcgaactcctggatacaggcacggagctaccacgagccatccgttgtttgtattcccgctgctgtttcgggatctggaacctgacccaagatagggctcaagtagaaatgcagggttgcagggattcagatgaaccaggctgcgagtcacttcattgcgatccctcacccagggctcatccaagtcctgggagcacactgtttacctgttcatgcgggactgacttttgcaacgccaattactcccacctccctccacctggttctcccggaactcctggctcgcagggtccccaggccgctcccggagagtccatctggatggcgctggtccttctcgggttattcctgctccttcttctcctgttggggtccatcatactggcactcttgcagagaaaaaactaccgcgtacgtggagagcccgtacccgagccccgtccggattctggacgagactggtctgtggaactccaggaactgccagagttgtgctttagccaggtcatcagggaaggagggcatgcagtcgtatgggccggtcagctgcaaggaaagctcgtagcgattaaagccttccctcccagatcagttgcccagtttcaggccgagcgggcattgtacgagctacctggactgcagcatgatcacattgtccggtttataacggcttcaaggggaggccctggaaggctcttgtctgggcctcttcttgttctggagctgcacccgaagggtagcttgtgtcactacctaacccagtatacctcagattggggaagctccctgcggatggcgttatccttagcacagggattggcgtttctccacgaggaaagatggcaaaacggtcagtataagcccggtatcgcccatcgggatctgtcctcccagaacgtgctcattagagaggacggatcatgtgctatcggcgatctggggctcgcactggttctgcctgggctgacccagcctcctgcctggacccctacccaaccccagggacctgcagccataatggaggatccagatggcctgcgggagctgttagaggactgttgggacgccgacccagaagcccgactgacagccgagtgcgttcagcagaggctggccgcactcgcccatccgcaggagagtcacccattccccgaatcctgtccaagagggtgcccccctctgtgcccagaggactgcacgagtatccctgcacccacgatcttgccatgtcgccctcaaaggtctgcctgtcacttttccgtgcagcagggaccctgtagcaggaacccacagccagcttgtaccctcagcccagtctag

SEQ ID NO: 214623 - DNA, 1437 bp, Artificial Sequence
  Description of Artificial Sequence: Synthetic coding sequence
atgctgggctcattaggcctgtgggcccttctgccaacagcagtggaagcaccaccgaatcggcgtacctgtgtgtttttcgaagctccaggggtccgcggaagcaccaagacattgggagagttactcgacaccggcactgaactgccccgtgccatccgctgcctgtactccaggtgttgcttcggcatatggaatctgacacaggatcgagcacaggtggagatgcaaggatgccgagactccgacgaacccggatgtgaaagcctgcactgtgaccccagtccgcgtgctcacccctcacctgggagcacactcttcacttgttcatgtgggaccgatttctgcaacgctaactactcccatctgcctccgccaggctcacctggcaccccagggtcacagggaccgcaggcggcacccggtgagtctatctggatggcccttgtgctgctgggactctttttattgctcttgttgctactggggtccataattctggctctgctgcagcggaaaaactacagagtacgtggagagcctgttccagagccacgacccgacagtgggagggattggagcgtagaactgcaggaactgcctgaactctgcttttcccaggtgatccgggaaggagggcacgccgtagtgtgggccggacagttgcagggtaagctggtcgcgattaaggccttccctcctagaagcgtggcccagtttcaagctgagcgggctttgtatgaactgcctgggttgcagcacgatcatattgtgcggttcatcacagctagtagagggggtcccggtcggctgttgagtggacccctcctagtgttagaactgcacccaaagggctctctgtgtcattaccttactcagtatacatcagattggggctcatctttacgtatggcactgtctctcgcgcagggtctcgccttcttgcatgaagagcgctggcagaatggacagtacaaacccggaattgcccaccgggatctgtcctcgcagaacgtactgatcagggaggatggctcatgtgccattggcgatctcggtctggccctggtcctgcccggattgacccagccccctgcttggaccccaacacagcctcagggccctgccgctataatggaagccggtactcagagatacatggcgcctgagctcctggataagacgctggatctgcaagattggggaatggccctcagacgggcagatatctattctctcgcattactgctctgggagattctcagccgatgtcctgacttgaggcctgcagttcaccatcctagtaattggcccatgagacagaattgggctatcccgttaccccttatgagctacggtccatggcagtgtcgaaggggtggagtgccgacttcccacccacctggcgctgccctacctcagaccctcatgggatag

SEQ ID NO: 214624 - DNA, 1722 bp, Artificial Sequence
  Description of Artificial Sequence: Synthetic coding sequence
atgcttggatccctgggactgtgggcattactccccactgcggtggaagcaccacctaaccgaaggacctgtgtctttttcgaggctcctggtgtcagaggctctaccaagacactcggcgagctactagatacagggacagaactccctagggctatcagatgcctttacagtaggtgctgttttggcatttggaacttgacccaggaccgcgcacaggtagaaatgcaagggtgccgcgattccgatgagcctggttgtgaatccctgcactgcgatccgtcgccaagggcccatccttccccaggcagcacgttgtttacctgctcatgtggcaccgacttttgtaacgccaattactcccatctgcccccaccaggatcaccaggcactcccggatcccaaggaccgcaagccgctccaggcgagtctatctggatggcgctggtgttgttgggcttgttcttactgctgctgctgcttctcggcagcattatactggctctgctgcagcgtaaaaactaccgcgttcgaggtgagccagttccggagcctcgccctgactcaggacgagactggtcagtggaactgcaggagttgccggagctgtgtttcagccaagtaatccgcgaggggggacacgccgttgtgtgggccggtcagttgcaaggcaaactggttgccatcaaggccttcccccctagaagcgtggcccagttccaggcagagcgagcgttatacgagctgcccggtctgcagcatgaccacatcgtaagatttattacagcttccaggggcggtcctgggagactgctcagcggccctcttctcgttctggagcttcaccctaaaggcagtctctgtcattatctgacgcagtacacctctgattggggatctagcctgaggatggccctgagcctggctcagggtctggcctttctgcacgaagagagatggcagaatggacagtataagcctgggatcgcccatcgggacctttcttcacagaatgtgctaatccgcgaggatggctcatgcgcgatcggagatctcggattagctctggtgctgccgggtctaactcagcctccggcatggacacctactcagccacaggggccagccgctataatggaagctggtactcagcgctatatggctcccgagctgctggataagactctagatctgcaggactggggaatggcactcagacgagccgatatctacagcctggccctcctcctgtgggagatactgtcccgctgccccgatctgcgccctgacagttctccacctcccttccagctcgcttacgaagccgaactgggcaataccccaacatccgatgagctctgggccctggccgtgcaggagcgccgacggccttacatcccgtctacttggagatgcttcgcgaccgatcccgacggcctgcgggagctgctggaggactgctgggatgctgaccccgaggccaggttgacagcagagtgcgtgcagcagcgcctggccgcactggcacatccacaggagtcacatccattccccgagtcctgtccacgcggatgccctcccctatgtcctgaagactgcacgagtattcctgctccaaccatcttaccttgtcgccctcagcgatcggcctgccacttcagtgtccagcaaggtccctgcagcaggaatccccagccggcttgtaccctttcccctgtgtag

SEQ ID NO: 214625 - DNA, 1347 bp, Artificial Sequence
  Description of Artificial Sequence: Synthetic coding sequence
atgaaagggttcattgacgacgccaactatagtgttggacttctggacgaaggaactaacctggggaacgttattgataattacgtgtacgagcataccttaaccggtaagaacgctttttttgtcggtgatctggggaaaattgtgaagaagcacagtcagtggcagaacgtcgtcgcccagattaaacctttttacaccgttaagtgtaattcggcaccggctgtcttggagatccttgctgcccttgggacagggttcgcttgctccagtaaaaacgagatggcactggtccaggagttgggcgtgcctccagagaatataatttacatttcgccttgtaaacaggttagtcaaattaaatatgccgcaaaagttggggtaaacattttgacctgtgacaatgagatagaattgaaaaaaatcgcccgaaaccatcccaatgcaaaggtcctccttcatatcgccactgaggataatatcggcggagaggaggggaacatgaagttcgggactacactgaaaaactgccgacacctcttggagtgcgcgaaggagctcgacgtgcaaatcattggagtgaagtttcacgttagctctgcctgcaaggaatcccaggtgtatgtccatgcattgagtgacgctcggtgcgtcttcgacatggctggtgaaatcggattcacaatgaacatgcttgacatcggcggaggctttaccggcacagaattccagctggaggaggtgaatcacgtcatttccccgctgctggatatctattttcctgagggatctggcgtcaagattataagtgaacccggaagttactatgtctcaagtgcctttacccttgcagtcaacatcattgcaaaaaaagtggttgagaacgacaaatttccatctggcgtggagaagactggcagtgacgagccggcttttatgtactacatgaatgacggtgtatacggatcgtttgcttctaagttaagtgaggatttaaacaccattccagaggttcacaaaaagtacaaagaggacgagccactgtttacaagttccttatggggcccttcatgtgacgagctcgaccagatcgtcgaaagctgcctgctgcccgagcttaatgtgggtgactggctcatctttgataatatgggagccgacagctttcacgaaccgagtgccttcaacgattttcaacgtcctgcaatatattacatgatgtccttcagcgactggtatgaaatgcaagacgctggtataacctctgactccatgatgaagaatttcttctttgttcccagttgcatccaattgtctcaagaggactcttttagcgcagaggcttag

SEQ ID NO: 214626 - DNA, 1347 bp, Artificial Sequence
  Description of Artificial Sequence: Synthetic coding sequence
atgaagggatttatagacgacgcaaactactctgtcgggctgctcgatgagggcactaatctgggcaacgtcatcgataattacgtgtatgagcatactctcactggtaaaaacgcgttttttgtgggtgacctgggcaaaatcgtaaaaaaacatagtcagtggcagaacgtggtggctcagatcaagcccttttataccgtgaagtgcaactcagctccagctgtcctggaaattcttgctgccttagggacagggttcgcgtgttcctccaaaaatgagatggctctggtgcaggaactcggtgtgccccctgaaaacattatctacatatccccctgtaagcaggtatcgcagatcaaatacgccgctaaggtaggcgttaatatcttgacttgtgacaatgaaattgagttgaaaaaaatcgccaggaaccatcccaatgcaaaggtgctcctgcatatcgctactgaggacaacataggaggcgaggagggcaatatgaagtttggaacgaccctgaaaaactgcaggcaccttttagagtgcgcaaaggagctcgatgtgcagatcattggggttaaattccacgtgagctctgcttgtaaagagtctcaggtgtatgtgcatgccctgtccgacgcacggtgcgtgttcgacatggccggagaaatagggttcaccatgaacatgctggacatcggaggtggattcaccggaacagaatttcagttggaggaggtgaatcatgtgatttctccactcttggacatctactttcctgagggctcaggcgtgaaaattatctctgagccaggcagttattacgtgtccagcgcattcactctagcagttaacatcattgccaagaaggtggtagaaaatgacaagtttccctccggagtcgaaaaaactggatctgacgagcccgctttcatgtactatatgaatgacggcgtgtatggatcttttgcgagtaagctaagcgaggacctcaacacgattcccgaagtgcacaagaagtataaagaggacgaacctttattcactagttctctgtggggtcctagttgtgatgagctggatcaaattgtcgagtcttgcctcttgccagagttgaacgtgggggactggttgattttcgataatatgggtgcagattcctttcatgagcctagtgctttcaatgactttcagaggccagccatctactacatgatgtctttctcagattggtatgagatgcaggatgctggaatcaccagtgacagtatgatgaagaatttcttcttcgtgccaagttgtatccaacttagccaggaggacagtttctccgccgaagcctag

SEQ ID NO: 214627 - DNA, 102 bp, Artificial Sequence
  Description of Artificial Sequence: Synthetic coding sequence
atgaagggattcattgacgatgccaactactctgtggggctactggacgaaggtacaaatctaggcaacgtgatcgacaattacgtgtatgagcacacctag

SEQ ID NO: 214628 - DNA, 294 bp, Artificial Sequence
  Description of Artificial Sequence: Synthetic coding sequence
atgaaggggttcatcgacgacgccaattattctgtgggcctgctggacgagggtacaaacctgggcaatgtgattgataactatgtctacgaacatacactaacagggaagaatgcattctttgttggcgacctggggaaaatcgttaagaaacactcacagtggcagaacgtggtggcacagatcaaaccgttctacaccgtgaaatgtaatagcgctcctgcggtgctggagatactagccgcacttggaacaggatttgcctgtagctccaagaacgagatggccttgtag

SEQ ID NO: 214629 - DNA, 780 bp, Artificial Sequence
  Description of Artificial Sequence: Synthetic coding sequence
atgcggagggcagtcgcttacatggccatcaaaattgaagtgcagggtcaccagtccttcgctattccatctggaactttttggttgtggcgcagcctgctgtcccaggacaaggaacacccgagatatttgattcccgagttgtgtaaacagttttatcacttgggatgggtgacaggtaccggtgggggaattagcttgaagcatggcgatgaaatttatattgctccatcaggcgttcaaaaggaaaggattcagcctgaggacatgtttgtgtgcgacataaacgagaaggacatctccggccctagcccgtccaaaaaactcaagaagtcccagtgcaccccgctcttcatgaatgcttacactatgaggggtgctggagctgtaatacacacccatagcaaggccgcagttatggccaccttgctgtttcccggtagagagtttaaaatcactcaccaggaaatgattaaggggatcaagaagtgtaccagcgggggatattacaggtatgatgacatgctggtcgtccccattatcgagaacacacccgaggagaaggacttgaaagatcgaatggcacatgctatgaacgagtatcccgacagttgtgccgtcctggtgaggcgacatggcgtgtacgtgtggggagagacctgggagaaagctaagaccatgtgtgaatgctacgactatttgtttgacatcgccgtgtccatgaagaaggtcgggctggatccctctcagctgcctgtgggagaaaacggcattgtttag

SEQ ID NO: 214630 - DNA, 729 bp, Artificial Sequence
  Description of Artificial Sequence: Synthetic coding sequence
atgtctggttgcgacgccagagaaggggactgttgctcaaggaggtgtggggcacaagacaaagagcacccacggtatctgatcccggagctatgtaagcagttctatcacctcggctgggtcacaggaaccggcggagggattagcctgaagcatggggacgagatctacattgctcccagcggggttcaaaaggaaaggatccagccagaggacatgttcgtgtgtgatataaacgagaaagatatcagcggccctagccctagcaagaaactgaagaagtcccagtgtacgccactttttatgaatgcctacaccatgcgtggcgcaggggctgtgatccatactcactcgaaggcggctgtgatggccacccttctttttccaggaagagagtttaaaatcacacaccaagaaatgattaaagggattaaaaaatgcacttctgggggatactataggtacgatgatatgctggtggttcctatcattgaaaacacccccgaggagaaggatttaaaagatcgaatggcgcacgcaatgaatgagtatccagattcctgtgccgtactagtgagacggcacggcgtgtatgtgtggggcgaaacttgggagaaagccaagactatgtgcgagtgttatgattatctctttgacattgccgtcagcatgaagaaagtgggactggatcctagtcagctccccgtcggcgaaaatggtattgtctag

SEQ ID NO: 214631 - DNA, 234 bp, Artificial Sequence
  Description of Artificial Sequence: Synthetic coding sequence
atgaatcttaggctgtgcgtgcaagctctgttacttctctggttgtcccttacagcagtctgcggcggttccctcatgcccctgcctgacggaaatggactggaggatggcaacgtgcggcatttggtgcagcccagggggtccaggaatggcccaggcccatggcagggcggacgcaggaaatttaggcggcaacgtccacggctatcccacaagggacccatgcccttctag

SEQ ID NO: 214632 - DNA, 369 bp, Artificial Sequence
  Description of Artificial Sequence: Synthetic coding sequence
atgagtgccacctggtgctccccagagggacaggggatgggacaggggccaggccgtgaggtaggaggcaactccgcggcttctgggcctgccagccccattcgcgacccatgcctaagcgaggccggtctcaaagggcctccgtccgcccaccccagacggctgtgtctcttgcaccgccttgtgtgtttttccgggggattaacatctatccagctatccccaagaacctgttgtagccaccagtgggcacagcttttctcaccagcgtgttttccccagtggagagcacccggatgctccctggatgattcccggtccctcacccgtatccgtcccgtccatctccccggaccaagcttggattag

SEQ ID NO: 214633 - DNA, 369 bp, Artificial Sequence
  Description of Artificial Sequence: Synthetic coding sequence
atgtccgccacatggtgctccccggagggacaggggatgggccagggccctggccgagaggtaggtggaaattctgctgccagcggaccagcgagtccgattcgcgatccctgcctgtctgaggctggcctgaaaggccctcctagcgcacacccgaggcgattatgtctgctgcaccgccttgtttgcttctccggtgggctaaccagcattcagctgtctccacgcacctgctgttctcaccagtgggcacagctgttctccccggcttgcttcccacagtggcgcgctcccggttgctccctggacgactctcgctctctgacaaggatcagacctgtgcatctccccggaccctcattagattag

SEQ ID NO: 214634 - DNA, 303 bp, Artificial Sequence
  Description of Artificial Sequence: Synthetic coding sequence
atgaagctcctcgctgcaacagtactgctgcttactatctgttccttggagggcgctctggtcaggcgccaggccaaagagccatgcgtggaatccctagttagtcagtattttcagaccgtgaccgactacggcaaggatttaatggaaaaagttaagtccccagagcttcaggccgaagccaagtcctatttcgaaaaaagtaaggaacagcttacacccctcataaagaaagcaggcacggagctggtcaattttctgtcttactttgtcgagctggggacacagccagctacccagtag

SEQ ID NO: 214635 - DNA, 1191 bp, Artificial Sequence
  Description of Artificial Sequence: Synthetic coding sequence
atgttcctgaaagccgtggtgctcacactcgcactggtggctgtggctggggctcgcgcagaagtgagcgcagatcaggtggccacggtcatgtgggattacttctctcagctctcaaataatgcgaaggaagctgtggaacacctccagaagtcagaattgactcagcagttgaacgccctatttcaggataagttgggtgaggtcaatacatacgcaggcgaccttcagaagaaattggtgcccttcgccacagagttgcatgaaagactggctaaagattccgagaagttgaaggaagagattggtaaagagctggaggagctccgggcaaggctcctgccccacgccaacgaagtttcacagaagatcggcgataacctccgcgagctccagcaaaggttagaaccctacgccgaccaattgcgaacccaagtaagtacccaggccgaacagctgagacgccagctgactccgtatgcacagcgcatggagagagtcttacgggagaacgctgatagcttgcaagcgagtttgagaccccacgccgatgagctgaaagccaagatcgatcagaacgttgaggaattaaagggaaggcttaccccttacgctgacgaattcaaagtgaagattgaccaaactgtggaggagttaaggaggagcctcgctccctacgctcaggacacccaggaaaaactcaaccatcagctggagggccttacgttccagatgaaaaagaacgccgaagaactaaaggcgaggatttctgcctcagcagaggaacttcggcagcgcctagcacccttggctgaagatgtcagggggaacctccggggaaacactgaggggttgcagaagtcactcgctgaattggggggacaccttgatcagcaggtagaagaattccggaggagggtggagccatatggcgaaaatttcaataaagcccttgtccaacaaatggagcaactgcgtcaaaaactgggcccacatgccggtgacgtggagggccacctctcctttcttgagaaggaccttagggacaaggttaatagttttttctcaacattcaaagagaaagaaagccaggataagacactgtctctgcctgagctggaacagcagcaggagcagcaacaggaacagcagcaagagcaggttcagatgctggctccactcgagagctag

SEQ ID NO: 214636 - DNA, 1281 bp, Artificial Sequence
  Description of Artificial Sequence: Synthetic coding sequence
atggcgatcgctcagctggcgacggaatatgtcttcagcgacttcctgctgaaagagccaaccgagcctaagtttaaagggctcaggctggagctggctgtcgacaagatggttacttgtatcgctgtgggcctgcctcttctcttaatttccttggcttttgctcaggaaatctccataggcacacagatcagttgtttctccccatcgtcgttctcctggaggcaagccgctttcgtggatagctattgttgggcagctgtgcagcagaaaaacagcttgcagtcagagtcaggaaatcttcccctgtggctacacaaattctttccatacattctcttactctttgcaattctgctgtacctgccacccctcttttggcggttcgccgctgcacctcacatctgttcagaccttaaattcatcatggaggagctcgacaaggtgtacaacagagctatcaaggctgccaaatcagccagggatctcgacatgcgcgacggcgcatgctcagtgcccggagtgaccgagaatcttggccagtctctgtgggaggtctctgaaagccattttaagtaccccatcgtggagcagtacctcaaaacaaagaagaatagcaacaacttgattatcaagtacatttcctgccgtctgttgacgcttatcataatcctgctggcctgcatttatctgggctactatttttccctgagtagtctcagcgatgaattcgtctgctccatcaagagtgggattctgcgtaatgattctaccgtccctgaccaattccaatgcaaactgatcgccgtgggtatcttccagttgctgagtgtgatcaacctcgtcgtatacgtgctcctggcaccagttgtcgtgtacaccctctttgtgccttttagacagaagacagacgtgcttaaggtgtatgaaatcctgccaactttcgacgttctgcacttcaaatctgaggggtataacgatctgagtctttataacttgtttctggaggagaacatatcagaggtgaagtcttacaaatgtctgaaagtgctagagaatattaaatccagcggccaaggcatcgatcctatgttgttactaacaaaccttggaatgatcaaaatggacgtcgtggacggcaaaacgcctatgagtgcagagatgcgcgaggagcagggcaaccagactgcggagctgcaaggcatgaatatagacagcgagacaaaggccaataacggggagaagaacgcgcgtcagcgactgctcgattcaagctgctag

SEQ ID NO: 214637 - DNA, 489 bp, Artificial Sequence
  Description of Artificial Sequence: Synthetic coding sequence
atggcttcgatggctgctgtgttgacttgggctctggctcttctgagtgcgtttagtgccactcaggccaggaagggcttctgggattacttctcgcagacatcaggtgataaaggccgagtcgagcagatacatcagcagaagatggcacgcgagcctgccaccctcaaggatagtctagagcaggatctgaacaatatgaataaattcctggagaagctgaggcccctcagcggaagtgaagctcccagactaccacaggatccggtcggcatgcggaggcagttacaagaagaactcgaggaagtaaaggccaggctgcagccctacatggccgaagcccatgagctggtcgggtggaatctcgagggccttcgacagcagctgaaaccttacaccatggatcttatggaacaggtggccctgagggtgcaggagcttcaagagcagttgagagtggtcggagaagacaccaaggcccagctgtag

SEQ ID NO: 214638 - DNA, 1101 bp, Artificial Sequence
  Description of Artificial Sequence: Synthetic coding sequence
atggcgtctatggctgccgtgctgacatgggccctcgcccttctgtctgcgttttccgctacccaggcccgtaaaggattctgggattacttttcgcagacatcgggcgataaaggacgcgtcgaacagattcaccagcaaaagatggccagagagccagccaccctgaaagattcgcttgagcaggatctgaacaacatgaacaagttcctcgaaaaattgaggccactgtccggatcagaagctccgagattgccgcaggaccctgtgggaatgcgcaggcagctccaggaggaacttgaagaggtgaaggcccgtttacagccctatatggccgaggcccacgaactggttggctggaacctggaaggcctcaggcagcagttgaaaccatacactatggacctcatggaacaggttgctctgcgcgtgcaggaactgcaggagcagctgcgggtagtaggggaggacactaaggcgcagctcctgggcggtgtcgatgaagcctgggccttgctgcaggggctgcagagccgggtggtacaccacacgggccgatttaaagagctgttccacccttacgcggagagtctggttagcggtatcggaaggcacgtgcaggaactgcaccggtctgtcgctcctcacgctccggctagccctgcccgtctgagcagatgcgtgcaggtgttaagtaggaagctcacattgaaagctaaggccctgcatgcaagaatccagcaaaatttggatcagcttcgggaagagctgagcagggccttcgctggaacaggaaccgaggagggggctgggccagacccacagatgttatcagaagaagtgcgccagaggctccaggccttcagacaggatacatatctgcagattgcagccttcacacgagctattgaccaggagaccgaggaagttcagcagcagctcgcacctccgcctccgggacatagcgccttcgcgcctgagttccagcaaactgattcaggaaaggtgctttccaagttgcaggcccgattagatgacctctgggaggacataacacactccttacacgatcaaggtcactctcacttgggcgacccctag

SEQ ID NO: 214639 - DNA, 1074 bp, Artificial Sequence
  Description of Artificial Sequence: Synthetic coding sequence
atgaacccccagatccgcaaccccatggagaggatgtatagggacaccttttacgacaactttgaaaacgaacctatcctttacggtaggtcttatacttggctgtgttacgaggtaaaaattaaacgcggtaggtccaacctgttgtgggacactggcgttttccgaggccaggtgtacttcaagccccagtatcatgccgagatgtgcttcctctcctggttctgtggtaatcagctccccgcttacaaatgtttccagatcacctggttcgtgtcttggacaccttgccctgattgcgtcgctaagttggctgaatttttgtccgagcatccgaacgtgacgcttacaataagtgccgctcggttgtattattactgggaacgagactaccggagggcactatgccgactgtcacaggccggtgcccgagtgacaattatggactacgaagagttcgcatattgttgggagaacttcgtttataacgaggggcaacagtttatgccctggtataaattcgacgagaactatgcattcctccatagaacccttaaggagatattgcggtacctgatggatccagatactttcacctttaatttcaacaacgatccacttgtcctgagacgacggcagacatacctgtgctacgaggtcgagagattggataatggcacgtgggtgctgatggatcagcatatggggtttttgtgcaacgagctagaccctgcccaaatctaccgcgtcacatggttcattagttggagtccttgttttagttggggctgtgcaggagaggtaagggcgttcctccaggagaatactcacgttagactgcgtattttcgcagccaggatctacgactatgaccccctttacaaagaggctctccagatgctgcgggacgccggagcccaggtctcaataatgacatacgacgagtttgaatattgttgggacaccttcgtgtataggcagggttgcccattccagccgtgggacggattggaggaacactcacaggccctgtctggcaggctgcgggcaatcctacaaaaccaggggaattag

SEQ ID NO: 214640 - DNA, 306 bp, Artificial Sequence
  Description of Artificial Sequence: Synthetic coding sequence
atgaagccccattttcgcaataccgtggagaggatgtacagggacacttttagctacaatttctataatcgccctatcctctccaggaggaacaccgtatggctctgttatgaggtgaagacaaagggcccttcccgaccaagactggatgctaagattttccgcggacaggtgcctcggagctttataagagcaccctttcaagtgctctcctctccctttggccaatgcgctccaccccatggtacggcacaagtccagtggcccccacagctgactgcaggcagggagcagggtaggccctag

SEQ ID NO: 214641 - DNA, 381 bp, Artificial Sequence
  Description of Artificial Sequence: Synthetic coding sequence
atggcctcagcctccactcaacccgcagcgctctctgctgaacaagctaaggtggtactggccgaggtgatccaggctttcagtgcgcctgaaaacgcagtgagaatggacgaagcacgggacaacgcttgcaacgatatgggcaaaatgctgcaatttgtgttgcccgtggcaactcagatccagcaggaggttatcaaagcgtatgggttctcctgcgacggggagggagttctaaagtttgcccgactcgtcaaaagctatgaagcccaagaccctgagatcgctagtttgagtggtaagctgaaagccttattcctcccacccatgaccctgccaccgcatggtcccgcagccggagggtccgtggcagcttcatag

SEQ ID NO: 214642 - DNA, 675 bp, Artificial Sequence
  Description of Artificial Sequence: Synthetic coding sequence
atggctcaaaaagaggaggcggctgttgcgaccgaagccgcaagccagaacggggaagatttagaaaacctagacgatcctgagaaactgaaggaactcattgagctgcccccatttgaaatcgtcactggagagcgcctgccggcaaacttttttaagtttcagttccgcaacgtcgagtattcctccggacggaataagacattcctttgctatgtcgtcgaagcacaggggaagggcggacaggtgcaggccagcagagggtatctagaagacgagcacgcagccgcacacgccgaagaagcgttcttcaataccatattgcctgcctttgacccggcactgcgctataacgtaacctggtatgtgagcagtagtccgtgtgcagcctgtgcagatcggatcataaaaaccctgtctaagacaaagaacttgcgactcttgatccttgtcggtcgtctcttcatgtgggaagagcctgaaatccaggccgctcttaagaaactcaaagaggcaggctgtaagctgagaatcatgaaaccccaggacttcgagtacgtctggcagaacttcgtggagcaagaagaaggagagtccaaagccttccagccctgggaggatatacaggaaaacttcctctactatgaagagaaactggcagatatcctcaagtag

SEQ ID NO: 214643 - DNA, 393 bp, Artificial Sequence
  Description of Artificial Sequence: Synthetic coding sequence
atggcccagaaagaggaggctgctgtcgctactgaagccgctagccaaaacggcgaagacttagagaacctggatgacccagagaagctgaaagagttgatcgaactgccaccttttgaaatcgtaaccggcgaaaggctccctgcaaacttcttcaagtttcaatttcggaacgtggagtactcttcgggcaggaaactgagttccacaccctcatgtcagccctctacacagccgtgcggcaccatgagtccaggtatgtgcccgccagccccagtccagcgtgttctgaccgctctgtccaagcctctggctcggcctagaacctgcgtgtgcagcttctggtgggtggacagttcttgcggccgtagccgcaggtctagattgctgtag

SEQ ID NO: 214644 - DNA, 600 bp, Artificial Sequence
  Description of Artificial Sequence: Synthetic coding sequence
atggaggcttccccagccagcggccctcggcacctgatggacccccatatttttacttctaatttcaataacggcattgggaggcacaagacctacctgtgctacgaggtggaaaggctggacaacgggacaagcgtgaagatggaccaacatagaggcttcctgcataaccaggcaaaaaatctgctgtgcgggttctatggacgccacgccgaattaaggttcctcgatctggtgccttccctgcagctcgacccagcacagatctatagagtgacttggtttatctcatggtctccatgctttagttggggctgtgccggtgaggttagagccttcttgcaggaaaatactcatgtcagactgaggatttttgcagctcgcatttatgattacgacccactgtacaaggaggcactgcaaatgttaagagatgctggcgctcaggtgagtatcatgacctatgacgaatttaagcactgctgggacactttcgtagatcaccaaggctgcccatttcagccttgggatggcttagacgagcactcgcaggctctttccgggagactgcgggcaatacttcagaatcagggtaactag

SEQ ID NO: 214645 - DNA, 600 bp, Artificial Sequence
  Description of Artificial Sequence: Synthetic coding sequence
atggaagcaagtccagcctcaggtcctcggcacctgatggacccgcacatattcacatcaaactttaacaacggcatcggcaggcacaagacttatctctgctacgaagtggagcgactggataacgggacctcggtgaagatggatcagcatagaggatttttgcataaccaggccaagaatctcctttgcggtttctacggaaggcacgccgaactgaggttcttggacctggtgccctcactccagctggatcccgctcagatttaccgtgtgacctggtttatttcctggagcccctgtttcagctggggttgcgccggagaagtaagagcattcttacaggaaaatacgcacgtgcgcctccgtatcttcgccgctcggatctacgactatgatcccctatacaaggaggccctccaaatgctgcgcgatgctggcgctcaggtgtctataatgacctacgacgaattcaaacactgctgggacacatttgttgaccatcaaggctgcccattccagccgtgggatggtctcgacgagcatagccaggccctgagcgggaggctgcgcgctattctgcaaaaccagggcaattag

SEQ ID NO: 214646 - DNA, 1149 bp, Artificial Sequence
  Description of Artificial Sequence: Synthetic coding sequence
atgaacccccagatcagaaatccaatggaacgcatgtatagggacacattttacgataacttcgagaacgagcctatcttgtatggaaggagttacacgtggctatgttacgaggtgaagattaaaagaggcaggtctaacctgctgtgggacaccggggtgttcagagggcaggtgtactttaagccccagtatcacgccgagatgtgtttcctctcctggttttgcggcaatcagctgcccgcttataaatgcttccagataacatggttcgtaagctggacaccatgccctgactgcgtggctaaactagccgagttcctttcagaacaccccaacgtgactcttacaatctctgctgctaggttatactattactgggagcgggactatcggcgtgcactctgtaggctttcccaagcaggggctcgcgtgaccattatggactacgaggagtttgcgtactgttgggagaattttgtgtacaatgagggtcagcagttcatgccttggtataagtttgatgaaaattacgcatttctccatagaaccctaaaggagatcctgcggtacctaatggaccccgacactttcacctttaattttaataacgacccattggtgctcagaagaagacagacttacctttgttatgaggtagagcgcctggataacgggacctgggtcctgatggatcagcatatgggctttctgtgtaacgaggccaaaaacctgctctgcggcttctacggaaggcacgctgagcttagattccttgatctggtccccagtttgcaactcgaccctgcccaaatttaccgggtcacatggtttatttcgtggagcccttgcttttcgtggggttgcgccggagaggtgcgcgcttttctgcaggaaaacacccacgtgcgcctgcgcattttcgcagccagaatttacgattatgatccactctataaggaggcattgcagatgctgcgggatgcaggggcacaggtctcaatcatgacctatgacgagtttgaatattgctgggacaccttcgtttatcgccaggggtgccccttccagccatgggacggactggaagagcactcacaggctctgtcgggcagactacgcgctattctgcagaatcaaggcaattag

SEQ ID NO: 214647 - DNA, 573 bp, Artificial Sequence
  Description of Artificial Sequence: Synthetic coding sequence
atgaatccacagatcagaaaccccatgaaggccatgtaccctggcaccttttattttcagtttaagaatctttgggaggccaatgacaggaacgaaacctggctctgtttcaccgttgaaggtattaagagacggtctgtggtgagttggaagacaggggttttccgtaaccaggttgattccgagactcactgtcacgccgagagatgtttcctcagttggttttgcgatgacattctgtctcccaacacaaagtaccaggttacctggtatactagttggagtccatgccccgactgtgccggagaagtggcagaatttcttgccaggcattcaaatgttaacctgacaatcttcaccgccagattgtactattttcagtatccatgttatcaggagggcctgagaagcttgagccaggaaggcgtggcggtggaaatcatggactatgaagactttaaatactgttgggaaaatttcgtgtacaacgacaacgagccatttaagccttggaaaggcctgaagaccaacttccgcctgctgaaaagacgtctccgagagtctcttcagtag

SEQ ID NO: 214648 - DNA, 1122 bp, Artificial Sequence
  Description of Artificial Sequence: Synthetic coding sequence
atgaaaccccatttccgcaatacggtggagagaatgtaccgcgatacgttctcctacaatttttacaaccgtcccattctcagtcgccgaaacaccgtctggctatgctatgaggtaaagactaagggcccatctcgacctaggttagatgctaaaatcttcagaggccaagtttactctcagccggagcaccacgcggagatgtgcttcctgtcatggttctgtggaaaccagttacctgcatataaatgcttccagattacgtggttcgtgagctggaccccttgcccagattgcgtcgccaagctagctgaatttctggcagagcacccgaacgttactcttactatttccgctgctaggttatactactattgggagcgggattacaggcgagctctctgccggttgagtcaggctggggcacgagtgaagatcatggatgatgaggagttcgcctactgctgggagaatttcgtttactcagaagggcagccattcatgccctggtataagtttgatgacaactatgcgttcttgcaccgcacattgaaggaaatcctccgcaaccccatggaggctatgtacccccacatattctactttcactttaagaatctgaggaaggcgtacggcaggaacgagtcttggctgtgctttacgatggaagtggtcaaacaccacagccctgtcagttggaagagaggagtattcaggaaccaggtggatcctgagacacactgccacgcggagcggtgttttttgagctggttctgtgacgatatactctcccccaacaccaattatgaggtcacttggtacacctcatggtcgccctgccctgagtgcgccggagaggtggcagagtttctggcgaggcactcgaacgtgaacctcaccatcttcacagcacgtctgtactacttttgggacaccgattaccaggaaggtttgcgctccctttctcaagaaggagctagtgtcgaaattatggggtataaagattttaagtactgttgggagaactttgtgtacaatgatgacgagccgtttaagccctggaagggcttgaaatacaactttctattccttgattccaagctgcaagaaatccttgagtag

SEQ ID NO: 214649 - DNA, 1155 bp, Artificial Sequence
  Description of Artificial Sequence: Synthetic coding sequence
atgaagccccactttcgtaacaccgtggaacgtatgtaccgcgacacctttagctataatttctacaatcgtccaattttgagccgacggaatacagtgtggctctgctatgaggtaaagacaaagggaccttcccgacctccgttggacgccaaaatatttcggggacaggtgtattccgaactgaaatatcaccccgagatgcgtttctttcactggttctcaaaatggcggaagctgcatcgcgaccaagagtatgaagttacatggtacatctcttggtccccatgtaccaaatgtacccgagatatggcaacgtttctggcggaggatccaaaggtgacactgaccatcttcgtggcccgtttgtattatttctgggacccagactaccaagaggcattgcgcagcctgtgtcaaaagagggacggaccaagagccaccatgaagatcatgaactatgacgaattccagcactgctggtctaagtttgtgtattcccagcgcgagctgttcgaaccttggaacaacctgccaaaatattatattttgctccacatcatgttaggcgaaatcctgcgccattcaatggaccccccaacctttacttttaactttaataatgagccgtgggtccggggaagacacgagacgtatctgtgctatgaagtcgaaagaatgcacaatgacacttgggtcctgttaaatcagagacgaggcttcttgtgcaatcaggccccacataagcatggctttctagaagggagacacgcagaactgtgctttctggacgtgattccattctggaaactcgatttggaccaagattatagggtgacctgttttacctcctggtctccgtgtttcagttgtgcacaagagatggcgaagtttatctccaagaataaacacgtgagtctctgtatttttaccgcacgtatctatgacgatcaggggaggtgccaagaaggcctgagaaccctcgccgaggcaggcgcaaagatttctatcatgacgtactccgagttcaaacactgctgggatactttcgtggatcatcagggatgcccgtttcagccatgggacggattggatgaacattctcaggacctcagcggcagactgagagctatcctgcagaaccaggagaattag

SEQ ID NO: 214650 - DNA, 1155 bp, Artificial Sequence
  Description of Artificial Sequence: Synthetic coding sequence
atgaaaccacatttccgcaatacggtggagcgaatgtacagggacacattcagctacaacttttacaataggccaatcctgtctcgcaggaacactgtgtggctctgctatgaggtaaaaacaaagggaccctctcggccaccactggacgcaaagatattccggggtcaggtctactccgaattaaaatatcacccagagatgaggttttttcattggttctccaaatggagaaaattacaccgcgatcaagagtatgaggtgacctggtacatatcatggtccccctgcacaaagtgtactagagacatggctacctttctagctgaggaccctaaagtaactctgacaattttcgttgctcggctctactatttctgggacccagactatcaggaagctctgcggtccctgtgccagaaacgcgacggccctagggctactatgaaaattatgaactacgacgagttccagcattgctggagtaaattcgtgtatagtcagagggagttgttcgaaccatggaataacttgcctaaatactacattttactccacatcatgctgggagaaatcctgaggcattcaatggatccccctacttttacattcaacttcaataatgaaccttgggtgcgcggaagacacgagacctatctatgttacgaggtggagcggatgcataacgatacttgggtgttactgaaccaaaggcgtgggttcctctgcaatcaggcgcctcataaacatggatttttggaagggcgacacgcagaactctgttttctcgatgtcattcccttctggaaacttgatttggatcaggactacagagttacatgttttaccagttggagcccatgcttttcatgtgcccaggaaatggccaagttcatctccaagaacaaacacgtgtctctctgtatcttcacggcgagaatttacgacgaccagggacgctgccaggaaggcttacggactctcgcagaggccggagccaagatctcaataatgacatactcagaattcaaacactgctgggacaccttcgtggaccaccagggatgtccctttcagccatgggatggattagacgaacacagccaggatttgtcgggcaggcttcgggcaattctacagaaccaggaaaactag

SEQ ID NO: 214651 - DNA, 549 bp, Artificial Sequence
  Description of Artificial Sequence: Synthetic coding sequence
atggccttgttgaccgccgaaacttttaggttgcagttcaataacaagcggagacttcggcgaccatactaccctcgaaaggctctcttatgctaccagctgacaccacagaacggcagtacgcctacccgcggttacttcgagaataagaaaaaatgtcacgctgaaatttgcttcattaacgagataaaatcaatgggactggatgagacccaatgctaccaggtgacttgctatctgacctggagcccatgttcgagctgtgcatgggaactcgtagatttcatcaaagcccacgaccacctgaatctgggaatttttgctagccgcctctattatcattggtgtaagcctcagcagaagggcctgagactattatgcggatcccaggtgccagtcgaggtgatgggctttcctaaattcgctgactgctgggagaactttgtagaccatgagaagccccttagttttaatccatataagatgctcgaggagctagacaagaattcccgtgcaatcaagaggaggctggagagaataaaaagctag

SEQ ID NO: 214652 - DNA, 603 bp, Artificial Sequence
  Description of Artificial Sequence: Synthetic coding sequence
atggctttgctaacagcagaaactttcagactgcagttcaataacaaacggcgtcttaggcgaccctattacccacgaaaggcgttgctgtgctaccagctcactccccaaaatggcagcacacctacacggggatacttcgaaaataagaagaagtgccacgccgaaatttgttttattaacgagatcaagagcatgggccttgacgaaacccagtgctaccaggtgacgtgttacctaacatggtccccttgtagttcttgtgcgtgggagttagtggactttatcaaggctcacgaccatctcaatctcgggatcttcgcttccaggctgtattatcactggtgcaagccgcagcaaaaggggctgcggttgctctgtggctctcaggtgcctgtggaggtcatggggtttcctaagttcgctgattgttgggagaacttcgtggatcacgagaagcctttgagtttcaacccgtacaaaatgttagaagaactcgacaaaaactcacgggctattaaacggaggctggagcggatcaaaatcccaggtgtccgcgctcaggggaggtatatggatatattatgtgatgctgaagtgtag

SEQ ID NO: 214653 - DNA, 465 bp, Artificial Sequence
  Description of Artificial Sequence: Synthetic coding sequence
atggccttgctcactgctgaaacattccggctgcagtttaacaacaagagacggctgcgacgcccttactaccccagaaaagctcttctatgctaccagcttaccccccagaatggatcgacccctacaaggggttacttcgaaaataagaaaaaatgccatgctgagatctgctttattaacgagattaaaagcatgggattggacgagactcagtgctaccaggtcacctgttatctcacctggagcccttgtagttcttgtgcctgggagttggtggacttcataaaggctcacgatcatctcaacctggggatatttgccagcaggctctactaccactggtgcaagccccagcagaaaggcttgagactgttgtgcggctcacaagtcccagtcgaggtgatgggattccctaattccaggggcacttgcgccggaagtctccacggctatatcgtttag

SEQ ID NO: 214654 - DNA, 552 bp, Artificial Sequence
  Description of Artificial Sequence: Synthetic coding sequence
atggccttgttgactgctgagactttccgcctccagtttaacaacaaaaggcgtctgcgacgcccatattacccccgaaaagccttactctgctatcagctcaccccgcagaatggatccacaccgactcgcggttacttcgaaaataaaaagaagtgccacgcggagatttgctttataaacgaaataaaaagcatgggactggatgaaacgcagtgttaccaggtaacttgctacctcacctggtctccctgctcctcctgtgcctgggagctggtagattttatcaaggctcacgatcatttaaacttgggcatctttgctagccggctctactaccactggtgcaaacctcagcaaaaaggcctacggttactgtgtggatcccaagtcccggttgaagttatggggttcccgaagttcgcggattgctgggaaaactttgttgaccacgagaagccgttatcatttaacccttacaagatgctggaggaactggacaaaaacagcagagctatcaagcggagactagaaaggataaagcagagctag

SEQ ID NO: 214655 - DNA, 1104 bp, Artificial Sequence
  Description of Artificial Sequence: Synthetic coding sequence
atggagcctatttacgaggagtatttggcaaatcacggtacaattgtgaagccatattattggctgagcttctcgctggattgcagtaattgtccctatcacatcaggaccggcgaggaagcacgagtgagcttgactgagttctgtcagattttcggttttccttatggcacaacgttcccacaaactaagcatcttacattctacgagctgaaaaccagtagcggaagcctggttcagaaaggccacgcttccagctgtacaggcaattacatccaccctgagtcaatgctgttcgagatgaacggctacctggattccgcaatatacaacaatgattctatccgtcacataatactatatagtaacaattctccatgtaatgaagctaaccactgctgcataagcaaaatgtacaatttcctcatcacctatcctggcataactctatctatttatttttcacaactttatcatactgaaatggactttccagcatcagcctggaatcgggaagccctgcgtagcttggcatctttatggcccagggtggtgttgtcacctatcagtggcggaatctggcacagtgtccttcactcgttcattagcggtgtgagtggatctcacgtgttccaacccattctcactggacgagcactggcagaccgacacaacgcttacgagatcaacgccataaccggcgtcaaaccttactttaccgatgttctcctgcagaccaagagaaatccaaacacgaaggcccaggaggccctagaaagctatcctctgaacaatgcatttcccggtcagtttttccagatgccatccggccagctccagccgaacttgccgcctgacttgcgtgcccctgtggtgtttgtgctggtccctctgagagatttgccacctatgcacatgggccagaatccgaataagccacgaaatatcgtgcgccacctcaacatgccacagatgtcattccaggaaacaaaggacttagggcgattgcccactggccgtagcgtggagatagtcgagataacggagcagttcgcttcgagcaaggaggcagatgagaaaaaaaaaaagaaaggtaaaaaatag

SEQ ID NO: 214656 - DNA, 252 bp, Artificial Sequence
  Description of Artificial Sequence: Synthetic coding sequence
atgcgattgtttctcagtctgccagtcctcgtagtggtccttagcatcgtcttagagggccctgccccagcccaaggcacacccgatgtatcatcggcgctggacaaattaaaagagttcggaaatactttggaggataaagcgagggaactgatcagccgcattaagcaatcggagctgtccgctaagatgcgggaatggttttcagaaaccttccagaaggtgaaggagaagctgaagattgatagttag

SEQ ID NO: 214657 - DNA, 306 bp, Artificial Sequence
  Description of Artificial Sequence: Synthetic coding sequence
atgggaactcgtctcctcccggctttgtttctggtgctcctcgttttggggttcgaagtccaaggcacacagcaacctcagcaggacgagatgccatccccaactttcctgacgcaagtgaaggagtctcttagctcttactgggagagcgccaagactgccgctcagaacttatacgagaagacttatctaccagcggtggatgagaagctcagagacctgtactccaaaagtacagccgcaatgtctacatatacaggcatattcacagatcaggtccttagcgtgttgaagggtgaggaatag

SEQ ID NO: 214658 - DNA, 384 bp, Artificial Sequence
  Description of Artificial Sequence: Synthetic coding sequence
atgagtctgctgagaaacaggttgcaagccctcccagctctgtgtttgtgtgtgctggtcctggcctgcatcggagcatgccaaccggaagctcaggagggaaccttgtccccccctcctaaactgaaaatgagtcggtggtccttggtccggggacgaatgaaggaactgctggagacagtggtaaatcgcacgcgcgacgggtggcaatggttttggtctccctctaccttccggggatttatgcagacgtactatgacgaccacttaagggaccttggaccccttaccaaggcttggtttctagaatctaaagactcgctcctaaaaaaaactcactctctgtgtcctcggctggtctgcggcgataaggaccagggatag

SEQ ID NO: 214659 - DNA, 1101 bp, Artificial Sequence
  Description of Artificial Sequence: Synthetic coding sequence
atggccagtatggctgcagtcctcacctgggcccttgctttgctcagcgctttctccgccacccaggcgaggaagggcttctgggattacttctcacagacatccggcgacaagggacgagtcgaacagatccaccagcagaaaatggctagggaacccgcaaccctgaaagatagtctggaacaggacctgaacaatatgaacaaatttctagaaaagctgcgcccactgagcggcagcgaagccccacggctgccacaggatccagttggaatgaggagacagcttcaggaagagttggaagaggtgaaggctcgcctgcagccgtatatggccgaagcccatgaactggtgggatggaacctggaagggctgcggcagcagctgaagccatatacgatggatctgatggagcaggtagccctcagagtccaagagcttcaggaacagctgagggtggttggggaagacactaaagctcagttgcttggtggcgtggatgaggcatgggctctgcttcagggactgcagagcagggtggtgcatcatacaggtaggttcaaggagctgtttcatccgtacgccgagtcactcgtcagcggcattgggaggcacgtgcaagagctgcataggtccgtcgccccacacgcacctgcgagcccagctcgcttgagtcggtgtgtgcaggtactaagtcgcaaacttactctcaaggccaaagctctgcatgcccgaatccagcagaatctggatcaactgagggaggagttgtcacgggcttttgctggaactggtacggaggagggggctggaccagatccccagatgctgtccgaggaggtcaggcagagactacaggcctttagacaggacacatacctgcagatcgcagctttcacccgagccatcgaccaagaaacagaggaggtacagcagcagctggctcctccccctcccggacattcggcattcgcccctgagttccagcagaccgacagcggaaaagtcctatctaaactgcaggcaaggcttgatgatctgtgggaagatataacgcatagcctccacgaccagggccactctcaccttggagacccttag

SEQ ID NO: 214660 - DNA, 354 bp, Artificial Sequence
  Description of Artificial Sequence: Synthetic coding sequence
atgggaacttggggtgcacctcacagaaccctgccgtgccggaatagaggcgctatgcagccgagagtactgcttgtagtcgccctcctcgcacttctggctagtgctcgcgcttccgaggctgaagacgcttctcttctgtcctttatgcagggttatatgaaacacgccactaaaacagccaaggacgccttgagctccgtccaggaatcacaggtcgcgcaacaagcccgaggatgggttacagatggattctcctctctcaaggattattggagcaccgtgaaggacaagttttctgagttctgggacttggaccccgaggttagacccacttccgctgtggccgcttag

SEQ ID NO: 214661 - DNA, 168 bp, Artificial Sequence
  Description of Artificial Sequence: Synthetic coding sequence
atgcaacctagagtcctgctggttgtggcgctattagccctcctagccagcgccagggcttctgaagcggaggatgcctcattactatccttcatgcaggggtacatgaaacatgcaacaaagacagccaaggatgcactgagctccgttcaggagagccaggtgtag

SEQ ID NO: 214662 - DNA, 384 bp, Artificial Sequence
  Description of Artificial Sequence: Synthetic coding sequence
atgagcctcctgagaaaccgcctccaagcccttccggcattgtgtctttgtgtgttggtgctcgcctgtattggagcgtgccagccagaggcccaagaaggaactctgagcccgcctccaaagcttaaaatgagcaggtggtcactcgtgcgcggaaggatgaaggagttgctggagacagttgtaaacaggaccagagacggttggcagtggttctggtcaccatctacgttcaggggatttatgcaaacatattacgacgatcacttgagagacctggggcctttgaccaaggcctggttcctcgagtcaaaagatagccttctcaagaaaactcattctctttgtcctcgtctggtctgcggagataaagatcagggatag

SEQ ID NO: 214663 - DNA, 384 bp, Artificial Sequence
  Description of Artificial Sequence: Synthetic coding sequence
atgtcgctgctccgaaacaggctgcaggcacttcctgccctatgcctgtgcgttctcgtcctggcgtgtatcggcgcttgccagcctgaggcacaagaggggactcttagtccgccaccgaagctcaaaatgtctagatggtctctggtgcggggtcgaatgaaagagctcctcgaaaccgtggtgaaccgcactagagatggctggcagtggttctggagcccctccacgtttcgtggattcatgcagacatattatgacgaccacctcagagatcttggacccctgaccaaggcctggtttctggagtctaaagactcactgctcaagaaaacccacagcctctgccctcggctggtgtgcggcgataaggaccagggctag

SEQ ID NO: 214664 - DNA, 570 bp, Artificial Sequence
  Description of Artificial Sequence: Synthetic coding sequence
atggtgatgttactacttttgctgagtgctttagccggtttgtttggtgcagcggaaggacaggctttccatctcgggaaatgccctaatccacccgtccaagagaacttcgatgttaataagtaccttggcaggtggtatgagatcgagaaaatcccaacaacatttgaaaatggtcggtgtatccaggccaattattctctcatggagaatggcaagatcaaggtgctgaatcaggaactgcgcgctgacggtacagtgaaccaaattgagggggaggccacaccagtgaatctcactgaacctgccaaactggaggtgaaattctcatggttcatgccctccgccccatactggattctggcgactgactacgaaaattatgccctggtctactcctgcacgtgtatcattcagctgttccacgtcgatttcgcttggattctcgccaggaacccaaacctgcctcctgaaacggtcgatagccttaagaacatattgacatccaacaacatagacgttaagaaaatgacggtcacagatcaggttaactgccctaagctttcctag

SEQ ID NO: 214665 - DNA, 450 bp, Artificial Sequence
  Description of Artificial Sequence: Synthetic coding sequence
atggtaatgcttctgcttctgctatccgccctggccggtctttttggagctgcagaagggcaggcctttcacctgggtaagtgtcctaatccacctgttcaggagaatttcgatgttaacaaatatctgggacggtggtacgagatcgaaaagattccaaccacttttgaaaatgggagatgtattcaagctaactatagcctgatggagaatggaaaaatcaaagtgctaaaccaggagttgagggctgatggtaccgtcaatcagatagagggtgaggctactcccgttaatctgaccgaacccgctaaactggaagttaagttcagctggttcatgccctcagctccttattggattctcgctacagactatgaaaactacgccctggtgtactcctgcacctgcattatccagctgttccacgtggatttcgcctggattctgtag

SEQ ID NO: 214666 - DNA, 954 bp, Artificial Sequence
  Description of Artificial Sequence: Synthetic coding sequence
atgaaagtgttatgggccgcactgctggtaaccttccttgctggttgccaagcaaaggtcgagcaggctgtggagaccgagccagagcctgaactgaggcagcagacagagtggcaaagtggccagcgttgggagctggccttaggcagattctgggactacttacgctgggtgcaaaccctgagcgaacaggtacaggaagagctcttgagttctcaggtcacccaggagctccgcgcattgatggacgagacgatgaaggagctcaaggcttataaatcagaactggaagagcagctcaccccagtcgccgaagaaacgagggcacggctatctaaagaacttcaggccgctcaggctcgtctgggcgcagatatggaggacgtgtgtgggaggctggtgcagtaccgtggcgaggttcaggccatgctggggcagtctacggaggagctacgggtgagactggcctcacatctgcggaagttgaggaaaagattgttgcgagacgccgatgaccttcagaaacgactggctgtgtaccaagccggagcacgggaaggcgctgaacggggattaagcgcgatccgagaaaggctgggccctttagttgagcaggggagggtgcgagccgcaactgtgggctcgctggcaggacagccgttgcaggagagggcacaggcatggggagaacggttgcgggctaggatggaggaaatggggtcacgtacgagagatagacttgatgaggttaaagaacaggtcgccgaggtccgggctaagctggaggagcaggctcagcaaattagattacaggccgaggcttttcaggctagactgaagagctggtttgaacccctggtggaagacatgcaaagacaatgggctggattggtggagaaggtacaggctgctgttggaaccagtgctgctccagtaccttccgacaaccattag

SEQ ID NO: 214667 - DNA, 660 bp, Artificial Sequence
  Description of Artificial Sequence: Synthetic coding sequence
atgaaagtgctgtgggccgctctgctagtgacattcctggctggttgccaggctaaggtggaacaggccgtggagaccgaacccgaaccagaactccgtcagcagacagagtggcaatccggtcaaaggtgggaactggccctaggcagattctgggattatttgcgctgggttcaaacactgtccgaacaggtgcaggaggaactgctgtcctctcaggtcacacaggagcttagagcactaatggatgagacaatgaaggagctcaaagcctataagtctgagctcgaagaacagctcacccctgttgcagaagagactagggccagactatccaaggaactccaggctgcccaggccagattgggggcagacatggaagatgtgtgcggcaggctagtgcagtaccgaggcgaggttcaagccatgctgggacagtccactgaagaattgagagtgagactggcgtctcatctgcgcaaactgcgaaagcggctgttgcgggatgccgacgatcttcagaaaagactagctgtgtatcaggctggtgctcgggagggcgctgaacgcggtcttagcgcaattcgggaacgtctgggaccactcgtcgagcagggacgtgtgcgggctgctaccgtagggtctttagcgggtcagtag

SEQ ID NO: 214668 - DNA, 867 bp, Artificial Sequence
  Description of Artificial Sequence: Synthetic coding sequence
gaagtaaaggacgtgctgccccaggaacctgttaggtcagctgtgggcggaaccggaatgtccagtggggcaagcaggaagtcctgggaccccggaaatccttggccacccgattggcccatcactggccgtaagatgaaggtgttgtgggccgcactgttggtgacttttttagccggttgccaagctaaagttgagcaagccgtcgaaaccgagcctgagccggagctgagacagcaaacagaatggcagtccggccagcgttgggagctggctctcgggcgtttctgggattaccttcggtgggtgcaaaccctgagcgaacaggtgcaggaggaattgttgagctcgcaggtcacccaggaattgagagccctgatggacgagactatgaaagagctcaaggcctataagagcgagctggaagaacaattgactcccgtggcagaggaaacgcgtgccaggttgagtaaggagctccaggcagctcaggcccgactcggtgcagacatggaggacgtatgtggcagactggttcagtataggggcgaagtacaggccatgcttggtcagtcaaccgaagagcttagagtccggttagcctcccaccttcgaaagttaagaaagcggctgctgagggacgcagacgatcttcagaaacggctcgccgtgtaccaggccggagccagggaaggagctgagcgaggcctctctgccattagggagcgcctcggcccactggtagaacagggtagagtgagggccgctactgttggttctctagcaggccagcctctgcaggaacgtgcccaagcctggggggaacgcctgagagctagaatggaggagatgggcagtcgcacgtag

SEQ ID NO: 214669 - DNA, 651 bp, Artificial Sequence
  Description of Artificial Sequence: Synthetic coding sequence
atgaaggtactgtgggccgcactcttggttacattcctggcaggctgccaggccaaggtggagcaagccgtggaaacagagcccgaacctgagcttcggcagcagacagagtggcaaagtggacaacgctgggagctcgctctcgggaggttctgggactatcttcgttgggtgcaaaccctttccgaacaggtgcaggaagaactgctatcctcgcaagtgacacaggagcttagggctctgatggatgaaaccatgaaggaattgaaagcctataaatctgagttagaggaacagcttacaccagtggccgaggagacccgcgcacgactcagcaaggagctacaggccgctcaggctcgcctgggagcagacatggaggatgtttgcggccgtctggtgcagtaccgtggtgaggttcaggcaatgctgggacaaagcacggaagaactcagggtgcggctcgcttctcacctgagaaaattgcgcaagcgtctgctccgcgatgccgatgatctgcagaaaagactggctgtgtaccaggcaggtgccagagagggtgctgagcgcggtctgtcggccatcagagagagattaggaccactcgtcgaacagggccgagtgagggctgccaccgtaggctctctgtag

SEQ ID NO: 214670 - DNA, 10593 bp, Artificial Sequence
  Description of Artificial Sequence: Synthetic coding sequence
atggcaaaggaggaggatgaggagaaaaaggctaaaaaaggcaaaaagggcaaaaaggccccagagccagaaaaacctaagcggagcttaaagggaacatctaggctcttcatgggttttagggataggacccccaagatctcaaaaaaggggcagttcagatcagcctctgcatttttttggggcctccacaccggaccccagaaaacaaaacgaaaacgtaaggctaggaccgttctcaaatcgacgtcaaagttgatgacacagatgcgcatgggaaaaaagaagcgcgctatgaaagggaagaaaccctctttcatggtgattcggttccctggccgaagagggtatgggagattgcgtcccagggctcgctctctgtctaaagcttctaccgctatcaattggctgaccaagaaattcctactgaagaaggccgaggagtctggctccgaacaggctactgttgatgcctggcttcagagatcttccagtcgaatggggtctcggaaactaccctttccatcaggggctgaaatattgcgcccagggggtagacttcgccgatttcccagaagcaggtcaatatatgctagtggagaacccctgggcttcctaccttttgaagatgaggctcctttccatcattctgggtcaaggaagtctctgtacgggttggagggatttcaggacctgggagaatactatgactatcatcgcgatggtgatgactactatgaccggcaatccctccatagatacgaggagcaggagccttacctggctgggctcggcccttattcccccgcttggcctccttatggtgaccattactacggctaccctcccgaggacccgtacgactattatcaccccgattactacggcggtccttttgatcccggatatacctacggatacggctatgacgactatgagccaccttacgcgcctccatctggatactcgagcccctactcatatcacgacgggtatgagggggaggctcatccttacggatactatctcgacccgtatgctccgtacgatgcaccttacccgccttacgacctgccctaccacacaccttacgacgtcccttattttgatccttatggtgttcactacaccgtgccgtacgccgagggggtatatggcggtggggacgaggccatctatccccctgaagtgccctacttttaccctgaggaatcagcatcggctttcgtctatccgtgggtgcctccgccaatcccgagccctcataacccatatgctcacgctatggacgatatagccgagctggaagaacctgaggacgccggagtggaacgccagggcacctcctttcgcctgccctcagccgctttcttcgaacaacaaggcatggacaaaccggctcgaagtaagttgagtctgattcgcaagtttagactgtttcccagacctcaggttaagctatttgggaaggaaaagctggaggtccccttaccacctagcctggatatcccactgcccctgggagacgccgatgaagaagaagatgaagaggagctacctcctgtgagcgctgtgccttacgggcacccattttggggctttctgaccccacggcagaggaatttacagcgcgcactgagcgcgtttggcgctcaccgtgggctcgggtttggcccagaattcggccgaccagttccccgaccagcaaccagcctggctcgattcctgaagaagacattgagcgagaaaaagccgattgcacggctgcgtggctcccagaaagcccgagctggtgggcctgcagtgagagaagcggcatacaaaaggtttggctacaaacttgccggtatggacccagaaaagccaggcacccctatcgttctgagacgcgctcaaccgagggcacgtagctcgaatgacgccaggcggcctcccgctcctcaacccgcacccagaaccctctcgcactggtctgccctgctgtcgccaccagtaccgccaaggccgccttcttctggcccacccccagcccctcctctgtcacctgcgctgtctgggctgccccgacccgcttctccatacggatcactgaggcgccacccgcctccatgggctgcacccgctcacgtaccaccggctccacaggcgtcttggtgggccttcgtagagcctcccgcagtaagtccggaagtaccacctgacctgctcgcttttccaggacccaggcccagctttcgcggatcaagaagaaggggggcagccttcggattccccggtgcatcgccaagagccagtcgccgtcgggcatggagcccactggcctctccccagcccagcctcagatcctctcctggccttggctattgtagccccttagctccgcctagtcctcaacttagcttaagaaccggcccttttcagcctccatttctccctcccgcacgacgtccacgatcactgcaggaaagccccgcacctcggagagccgcagggaggctgggacctccgggtagccctcttcccggttcccctagacctccctctcccccattgggcttgtgccattcgccacgaagaagcagcctgaatctgcccagccgacttcctcacacttggcgtcgactgtccgaacccccaacgcgagccgttaagccgcaggtgcggctcccatttcacagacccccaagagctggagcttggcgtgctccgctcgagcatagagagtcccccagggagccagaggactcggagaccccctggaccgttccacccctcgcaccttcgtgggacgtagatatgcctcctacacagcggccacctagcccctggccgggaggcgcagggtcccgccgaggcttttccagacctcccccagtgcctgagaatcccttcctgcagctgctggggcctgtgccttcacccaccctgcaacctgaggaccctgcagccgacatgaccagagttttcctgggcaggcaccacgagcctggacccggacagttgaccaaaagtgcagggccaactccggaaaaacctgaggaagaggccaccctcggggaccctcaattgcctgctgagacaaaaccccctacacccgctccacctaaagatgtgacaccaccaaaggacataacgccacctaaggatgtcttgcctgagcaaaaaaccctgcgcccaagcctcagctacccacttgccgcatgtgaccagactagagcgacgtggcccccatggcaccgatgggggacgctccctcaggcagccgctcctttggctccgatcagggcccctgaaccgctgccaaagggtggcgaacgcaggcaagctgcgcctggtcggtttgccgtggtcatgcccagggtgcaaaaattgtcaagctttcagcgagtgggccctgctaccctcaagcctcaggttcaaccaatccaggaccccaaaccacgtgcttgttccttaagatggagttgtctctggcttcgagccgacgcatatggcccatggccacgggtccatactcatcctcagagttgtcatctaggaccaggagctgcatgcctgagcttgcgcggaagctgggaggaggttggcccaccaagctggaggaataagatgcattccatccggaacttgccaagcatgcgctttagggaacaacacggcgaagacggagtggaggatatgacgcagctagaggatctacaggagactactgtgctgtccaatctgaagattcggttcgaacgaaatttgatctacacgtacataggcagcatccttgtttctgtgaacccctatcagatgtttggaatttatggaccagagcaggtgcaacagtataatggcagggccttaggcgaaaatccccctcacctcttcgctgtagctaatttggcattcgctaagatgttggatgccaagcagaaccagtgcattattatctccggggagtcagggtccggcaagaccgaagcgaccaaactgatattacgatatctggctgcaatgaaccagaaacgggaagttatgcagcagattaaaatcctcgaggccacgcctttgctggagtcattcgggaacgcgaaaacagtcaggaacgataattcgagtcgatttggaaagtttgtcgaaattttcttggaggggggagtgattagcggagcaattactagtcaatacctgctcgaaaaaagtcgtatagttttccaggcgaaaaatgaacgaaattatcatatcttttatgaactactggcaggtctccctgcccagcttcggcaagcattctccctgcaggaagccgagacctattattatttgaatcagggcggtaattgcgagattgccggaaaatctgacgccgatgactttcggagactgcttgccgcaatggaagtcctagggttcagcagcgaagaccaggattctatttttcggattcttgcttccatcctgcatttgggcaatgtttacttcgagaagtacgaaacagacgctcaggaagtcgcttccgtggtgtcagcccgagaaattcaagccgtggccgagctgttgcagatcagtcccgaggggctccagaaggctatcacttttaaggtcacagaaacgatgagagagaagatattcactcccttgacagttgaaagtgcggttgatgcacgagacgcgattgctaaggttctgtacgccctgctgttctcctggctcatcacccgagtgaatgctcttgtgtccccacgccaagatacactctcaatcgccatcctggacatttatgggttcgaagatcttagttttaacagtttcgaacagttgtgtatcaactatgccaacgaaaacctgcaatacttgttcaacaaaatcgttttccaggaagagcaggaagagtatatacgtgaacagatagattggcaagagatcacttttgccgataaccagccgtgcatcaatttgattagtctgaaaccgtacggcatcctgcgaattctcgatgaccaatgttgctttcctcaggctacagatcatactttcctgcagaaatgccactatcatcacggcgctaaccctctgtactccaagccaaaaatgcctctgcctgagttcacaatcaagcattacgcagggaaggttacttatcaggtgcacaagtttttggacaaaaatcacgaccaggtgagacaggacgtgctggacttgttcgttcggtcaaggacgagagtggtggctcacctctttagctctcacgcacctcaggccgctcctcaaagattgggcaagtcctcgtctgtgacgaggctttataaagcacataccgtagcggcaaagttccagcagtcactcttggacctggtggaaaagatggagcgctgcaacccgttatttatgaggtgcttgaaaccaaaccataaaaaagaacccggactgtttgaacccgatgtggtaatggctcaattgcgatattcaggtgtcctcgagactgtgagaatacgcaaggagggctttccagtacggctgccttttcaagggttcatcgatagatactgctgtctcgtggccctcaaacatgacctccccgctaatggggacatgtgcgtgtctgtgttgagccggttgtgcaaggtgatgcctaatatgtatcgggttggcgtgagcaagctgtttctgaaagaacacctctatcaactgttggagtctatgagagagcatgtattaaatcttgccgctctcactctgcagcggtgcctgcgtgggttctttatcaagcgtcgattccgctcattgagacacaagataattttactgcaatcccgagctcggggatatctggctcggcaaaggtatcagcaaatgagacgttcattagtcaaatttaggtctcttgtacatgcatacgtctcgcggaggcgatacctgaagctgcgcgctgagtggagatgccaggtggagggagctctcttgtgggaacaggaagagttgtccaaaagagaggttgtggcggtcggccacctcgaggtgccagccgaactcgctggtctattgcaagccgtcgcaggactcggccttgcacaggtgccacaagtagcgcctgtaaggactcccagattgcaggcggagcctcgcgttacactgcctctggatattaataactacccaatggcaaagttcgtgcagtgccactttaaggaaccggcttttggcatgctgacggtgccactcagaacacctctgacacaacttccagcagagcaccatgctgaggccgtctccatcttcaagttgatcttacgtttcatgggggatcctcacctgcacggcgcacgcgaaaacatctttggcaactatatcgtgcagaaaggtctggcagtgccagagctgagagatgaaatattggcacagcttgctaatcaggtgtggcacaatcataatgcccataatgccgaacggggttggctgctgttagcagcctgcctgtcaggtttcgccccatcaccatgttttaataagtacctgctcaagtttgtctccgattacggccgtaatggatttcaggcggtatgtcaacatcggctgatgcaggcaatgggcagggcgcagcagcaagggtcgggcgcagccagaacactgcctccgacacagctggaatggaccgcaacctacgagaaggcgtctatggctcttgatgtcgggtgcttcaatggcgatcagtttagctgcccagtgcattcttggtctaccggggaagaggttgccggtgacattctgaggcacagaggtctcgctgacggttggagaggttggactgtggctatgaaaaatggtgttcagtgggcagaacttgcgggtcatgattacgtcctggatctcgtgagcgacttggaattgttacgagatttcccccgacagaagtcttattttatagtagggaccgaaggaccagccgcttctaggggtggacctaaggtcgtctttggaaacagctgggatagcgacgaggatatgagcactagacctcagccacaggagcacatgcctaaggtcctcgattccgatggatacagctctcacaatcaggatggcactaacggcgaaaccgaggctcagcgcggaacagctacgcatcaggagtctgatagcctcggcgaacctgccgtgccccataaaggcctagattgttatctcgattctctgtttgatcccgtgctgtcctatggagacgctgacctagaaaagcccactgccatcgcctacaggatgaagggaggcggacagcccggagggggaagtagttccgggacggaggatacccccagaagacctcctgaaccaaagcctatcccagggctagatgccagtactctcgctcttcagcaggcatttattcataaacaagctgtcctactggctcgagagatgaccctccaggccacagcgcttcagcaacagccactgtccgccgctttgcgttctctccccgctgaaaagcctccagcccctgaagctcagccaacatctgttggcactgggcctcccgcaaagcctgtactactcagagctactccaaagcctcttgcaccggctccactcgcgaaggctccacgtttgcctatcaaacccgtagcagcacccgttctcgcccaggaccaggcctcccccgagactaccagtcctagtccggagctggtgcggtactcaaccctgaactcggaacatttccctcagcctacacagcagatcaaaaacatcgttaggcagtaccagcagcccttcaggggagggcgtcctgaggccctgcgcaaggacggcggaaaggtttttatgaaacggcctgacccccatgaggaggctctgatgattctcaaaggtcagatgactcacttagccgcagccccaggcactcaggtgtctagagaggcagtggctctggtgaaacctgtgacttcggcgcctaggccctctatggcccctacaagcgctctacctagccgctctctggagccaccagaggaactgactcaaacgcgcctccataggctgatcaatccaaatttttatggataccaagacgccccatggaagatttttctcagaaaagaagtgttttatcccaaagactcatactcccaccccgtccaactggatctcctatttcgacaaatactccatgacacactgtccgaggcctgtctgcgtatctcagaggatgagcgtctgcggatgaaagccctgttcgctcagaaccagcttgacacccaaaagcccctagtgactgagtccgtgaagcgcgctgtggtaagcacagccagagatacgtgggaggtgtacttcagcagaatcttccccgcaaccggctctgtgggaactggggttcaattgttggccgtgtcccacgtgggcatcaaactcttgcgaatggtgaaaggcggtcaggaggcaggcggtcagttgagagtgttgcgcgcttattctttcgctgacatactttttgttacaatgccaagccagaatatgctggagtttaacttggcatccgaaaaagtcatactcttttcagcaagggcacaccaagtgaagaccctggtcgacgacttcatcctcgaactcaagaaggactccgactacgtcgtcgccgttcgcaacttcctgcccgaagaccctgctctcctggccttccataaaggagacattatccatcttcaacctctggaaccaccccgtgtaggctattctgctgggtgcgtcgtgagaagaaaagtggtttatcttgaagaactgcgccgtcgcggacctgattttggttggaggttcgggaccatccacggcagagtcggaaggtttccatctgaactggtgcagcccgctgcggcacccgactttctgcagttgcccaccgagcccggtcggggtcgggctgcggctgtggccgcagccgtggctagtgccgctgcagcacaagaggtcggacgacgccgtgaagggcctcccgtgcgagctagatcagccgatcacggcgaggacgcactggcactgcccccttatactatgctggaattcgctcagaaatactttagggacccacagcggagaccccaggacggcttgcggctgaagtcaaaggaacccagggagagtcggacactggaagatatgctctgctttacaaaaacgccactacaggaatccctcattgagttgtcggattcctctctgagcaagatggcgacagatatgttcttggctgtcatgaggtttatgggtgacgctcccctgaaaggccagagtgatctggacgtgctgtgtaacctcctaaagctgtgtggggatcacgaggtcatgcgcgatgagtgttactgccaggtggtcaaacaaatcacagacaatactagctcaaaacaggactcgtgccaaagggggtggagactgctctacatcgtgaccgcgtaccatagttgctcagaagtgcttcatccgcacctaacaaggtttctccaagatgtttctcgtactccaggattaccatttcagggcatagcaaaggcctgcgaacaaaaccttcaaaaaacactgcgtttcggaggtcgcctggagctgccttccagcatagagctccgggcaatgttagccggaagatcaagcaagcgccagttattcctccttcctggcggactggagcgccacctgaaaattaagacatgtacggtcgcactggacgttgtcgaggaaatttgcgccgagatggcgctcaccagacccgaagcttttaacgagtacgtaatattcgtggtaactaaccggggtcagcacgtctgcccattgtctaggcgcgcttatatcttggatgtcgccagcgaaatggaacaggtcgatggcggatacatgttatggtttcggcgagtgttgtgggatcagcctttaaagtttgagaacgaactgtatgtaaccatgcactataatcaagtgctgcctgactatctcaagggcttgttttcctccgttcccgcttcccgtcccagtgagcagctgctccagcaggtgtcgaaactcgccagcctccagcaccgcgcaaaagaccacttttatctgccctctgtgcgggaagtgcaggagtacataccagcccagctttatcggaccaccgccggatctacatggttgaacctggtgtcccagcataggcaacagacacaagccctgtcgcctcatcaggcgagagcccagttcctcggacttctgtccgctcttcctatgtttggttcctctttctttttcattcaatcctgttcaaacatcgccgtgcctgctccttgtatcttggctatcaatcataatggccttaatttccttagcacagagacacacgagctcatggtgaaattccctctcaaagaaatccagtctacccgaacacagcgacctactgccaactctagctatccctatgttgaaatcgccctgggcgatgtggccgctcagcggacactgcagcttcagctggagcagggcctcgaactgtgcagggtggtggctgtacacgttgaaaatctgctgtcagcccatgaaaaacgcctgacactaccaccctcggagatcaccctgctatag

SEQ ID NO: 214671 - DNA, 840 bp, Artificial Sequence
  Description of Artificial Sequence: Synthetic coding sequence
atgtttcgagccccatgtcaccggttaagagcgaggggtacgcgcaaggccagggccggtgcctggaggggttgcacattcccctgtctgggtaaaggaatggaaagacctgctgcaagagagccacacggcccagatgccctgagacggttccaaggattgctgctggaccgacggggtcgactccatggccaagtcctgcgcttgcgggaagtagccaggagactggagcggctaaggcgtaggtctctggtggctaacgtcgcaggtagcagcctctccgccacgggagccttagcagctatagttggcctgagtctgagtcccgtgacgttgggtaccagcctgctggtctccgccgtgggtctcggagttgctacagccggtggggcagtaactattactagcgacctgagtttaatcttctgcaactcccgggaacttcgcagagtccaggagattgcagctacctgtcaagaccagatgcgcgagatcctgtcatgcttagaatttttttgtaggtggcaaggctgtggggatcgacagctcctccagtgcgggaggaacgccagcatcgccctctataactccgtgtattttatcgtcttttttggctcccgaggctttctgatacccagacgagccgagggcgacaccaaagtaagccaggccgtcctcaaggccaaaattcaaaagctcgctgaatccttggagtcttgtacaggcgctttggacgaattgtcagagcagctggaaagccgcgtgcaactgtgtacaaaatcttcgagaggacacgacctgaaaatcagcgccgatcaacgagcagggctgttcttttag

SEQ ID NO: 214672 - DNA, 747 bp, Artificial Sequence
  Description of Artificial Sequence: Synthetic coding sequence
atgggaatggaacgtccagctgcacgggagccacatggcccagacgcgctgcggaggttccagggcctccttctagaccggcgtggaaggttacacgggcaagtcctgcggcttcgagaggtggccagaaggctggagcggttaaggcgcagatctctggtcgctaacgtggccggaagtagcttaagcgcaacgggggctctcgcagcaatcgtgggtctgtctctttcccctgtcacgctgggtacaagtctgctggtctcagccgttgggctgggcgtcgccactgctggcggagccgttaccattacgtcagatttgtctctcatcttctgcaatagcagggagctccgcagagtgcaggagattgccgctacatgccaggatcagatgagggaaatcctctcatgtctggaatttttctgcagatggcaaggctgcggcgaccgacagctgctgcagtgtgggcgtaacgcaagtatcgctttatataacagcgtctatttcatcgtatttttcggtagcagaggctttctcatccctcgcagggctgagggcgacacaaaggtgtctcaggccgtactgaaagcaaaaatacagaagctcgctgaatctctcgaatcttgtacaggagcactggacgaactgtccgaacagctggagtcccgggtgcagctatgcaccaaatcttcacgcggacatgacctgaagatttccgctgaccagcgagccggactgtttttctag

SEQ ID NO: 214673 - DNA, 1245 bp, Artificial Sequence
  Description of Artificial Sequence: Synthetic coding sequence
atgcgcttcaaaagccacactgtagaacttcggagaccctgcagcgatatggagggggcagccctgcttcgcgtaagcgtgttgtgtatctggatgtcggcactgttcctcggcgttggagtgcgggctgaagaagctggagctcgcgtacagcagaatgtgcccagcggtacggacacgggcgatccgcagagcaaacccctgggcgactgggctgccggaaccatggatccagaatctagcatcttcatagaagatgctattaaatacttcaaagaaaaggtgtccacccagaacctcttactcctcctgaccgacaatgaagcgtggaacggatttgtcgcggctgccgagctgccaaggaacgaagctgacgagctaaggaaggcattggacaacctggccaggcaaatgatcatgaaggataaaaactggcacgacaaaggccagcagtaccgcaactggttccttaaagaattccccaggttaaaatccgagcttgaagataacattagacggctgcgggcactggctgacggggttcagaaggttcacaagggcaccacaatcgcgaacgtcgtgtctggctctctgagcatttctagcgggatcctcaccctggtcgggatggggctagcccctttcaccgagggcggaagcctcgtgctgctggagcctggaatggagctgggcatcacagccgcactcactggcatcacatccagcacgatggattacggtaaaaagtggtggacacaagctcaggcccacgatcttgttatcaagtcattggacaaacttaaggaggtgagagagtttctgggcgagaacatttccaacttcctttcactagccggtaacacgtaccagttaactagggggattggtaaggatatcagggctttacggcgagccagggcaaacctccagtccgtccctcacgcctcagctagccgcccacgagtgaccgagccaatttccgccgaatcgggcgagcaggtggaacgagtaaatgagccgtctatccttgaaatgagcaggggcgtgaaattaacagatgtcgcccctgtcagtttctttctcgttctcgatgtggtttacctcgtttatgagtcaaaacatttgcacgaaggtgcaaagtctgagaccgctgaagaattgaagaaggtcgctcaggagctcgaggaaaagctgaatatccttaacaacaactacaaaatattacaggccgatcaggagctgtag

SEQ ID NO: 214674 - DNA, 834 bp, Artificial Sequence
  Description of Artificial Sequence: Synthetic coding sequence
atgatcatgaaagataaaaattggcacgacaagggacaacagtaccggaattggtttctcaaggagtttcctcgcctcaagagcgagctggaggataatattcgtcggctccgagccttggcagacggggtacagaaggtccacaaaggaactacaatcgcaaatgtcgtcagtggctctctgtctatcagttctggcatccttactcttgtcggaatgggactcgccccttttaccgaaggcggatcgctggtgttgctcgagccaggcatggagctgggaattaccgctgcactgactggtataacctcaagtacaatggattacggaaagaagtggtggacacaggcgcaggctcacgatctcgttattaaaagcctcgacaagcttaaagaggtcagggaattcctcggggagaatatttccaattttctttccctggctggcaacacatatcaactaacaagagggattggaaaagacatccgagcactgcggagagctcgagcaaatctgcagtctgtccctcacgccagcgcgtccaggcctcgggtcaccgagcctatctccgccgaatccggagagcaagtggagagagtgaacgaaccctctattctcgagatgagtagaggcgttaagctcacagacgtcgccccagtcagcttcttcctggttcttgatgttgtgtacctggtctatgagtccaaacatctgcacgaaggtgctaaatccgaaactgctgaagaactgaaaaaagtggcccaggaactggaagaaaagctcaatattctgaacaacaactacaagatcctccaagccgaccaagaactttag

SEQ ID NO: 214675 - DNA, 1197 bp, Artificial Sequence
  Description of Artificial Sequence: Synthetic coding sequence
atggaaggcgctgccctgctgagggtttccgtcctttgtatctggatgtcagccctcttcctgggcgtgggcgtgagggctgaagaagccggtgcacgagtgcagcaaaacgtgcctagtgggacagatacaggagaccctcagtctaagcccctgggtgattgggccgcaggaacgatggacccagaaagcagcatttttatagaagatgcaatcaagtatttcaaggaaaaggtgagcactcaaaacctcctcctgctgcttaccgacaacgaagcgtggaacgggttcgtggcggctgctgaactgccacgaaacgaagccgacgagctgaggaaggcactggataatctggcacggcagatgataatgaaagataaaaattggcacgacaagggtcagcaatataggaattggtttctaaaagagtttcctaggctgaaatccgaacttgaggataacatcagacgcctgagggcactcgcagacggagtgcagaaggtccataaaggaaccaccattgcaaatgtggtttccgggagtttgtccataagttcaggaattctgaccctggtcggcatgggcttggctccctttaccgaaggcggatcgttagtgttattggagcccggtatggaactggggattactgccgcactgacagggattacaagctctactatggattatgggaagaagtggtggacacaggcccaggcccatgatctcgtaattaagagccttgacaagcttaaggaggtgcgagaatttctcggggagaacattagcaacttcctgtccctggctggtaatacctaccagttaactaggggaattggaaaagacattcgtgcattacggcgtgcccgtgctaacctgcagagtgtaccccatgcaagcgccagccgccctagggtgaccgaaccgatcagtgccgaaagcggcgagcaggtcgagcgggtcaatgagccgtctatcttggagatgagcaggggtgtaaagctaactgacgtggccccagtctcttttttcctcgtgctggatgtcgtatacctcgtttacgagtccaagcacctacatgaaggagcaaagtcagaaacggctgaggagctgaagaaggtggcccaggagctggaagaaaagcttaatatcctcaataataattataagattctgcaggctgaccaagaactctag

SEQ ID NO: 214676 - DNA, 1197 bp, Artificial Sequence
  Description of Artificial Sequence: Synthetic coding sequence
atggagggcgctgcgctgttaagggtgtctgtgctttgtatttggatgagcgcactgtttctgggcgtgggcgtccgagctgaggaggccggagctcgcgtacagcagaatgtcccctccggtaccgacacgggggaccctcaaagcaaacctctgggggactgggccgctggaaccatggaccctgagtcctccatcttcatcgaagatgccattaagtacttcaaggaaaaagtgtcaactcagaacctcctcctgctgctaaccgataatgaggcctggaatggcttcgttgccgctgccgagctgccgagaaatgaggccgatgaactaagaaaagccctggacaacttagctcgccagatgattatgaaggacaaaaactggcatgacaaaggccagcagtaccggaattggttcttgaaagagttcccccgtctgaagtccgaactggaggataacatcaggcgcctcagagcgctcgccgatggggtacagaaggtacacaagggaactaccatagcaaatgtggttagcgggtcgctctctatttcaagcggaattctgactctggtgggcatgggattagccccttttacggagggtggctcccttgtgctgttggagcctgggatggagttggggatcacagccgctcttacaggcatcacctcctctaccatggattacgggaagaaatggtggacgcaagcacaggcccatgatctggtgattaagtcactcgataagctgaaggaagtccgcgaatttctaggtgagaacatttccaattttctgtccctcgccggtaatacataccaactaacccgcggaattggaaaagacatccgcgctcttaggagggcccgagctaatctccagtccgttcctcacgcatctgcatcgcggcctagagtaactgagcctatttccgccgagtccggagagcaggtcgaacgcgtcaatgagccatcaatcttggagatgtcacgcggagtgaagctgacggatgtggcgccagtgtcttttttcctggtcctagacgtagtctatcttgtctatgaatccaagcacctccacgagggggctaaatccgagaccgccgaggagctgaagaaggtagcacaagaactcgaagaaaagctcaatatcctcaataacaattacaagatcctgcaggccgaccaagagttatag

SEQ ID NO: 214677 - DNA, 1197 bp, Artificial Sequence
  Description of Artificial Sequence: Synthetic coding sequence
atggaaggggcagcactcctgagagtctccgtgctttgcatctggatgagcgccttattcctgggtgtgggagttcgggctgaagaggccggagctcgcgtgcaacaaaatgtgccctccggaactgacaccggagatccccagtcaaaacctctgggagattgggcagccggaaccatggatcccgaaagcagcatttttatcgaggatgccatcaaatacttcaaagagaaggtgtctacccagaatctgctgctcctgctaaccgacaatgaggcttggaatggtttcgtggcagcggctgaactaccccgaaacgaggccgatgagttgagaaaggccctggataacttagcaaggcagatgatcatgaaggacaaaaattggcacgacaaaggccaacagtataggaactggtttcttaaggaattcccgaggcttaaatctgagctcgaagataacatcagaagattgcgcgcactcgccgacggagtccagaaggtgcataagggaaccacaatagctaatgtcgtgagcgggtccctgtctatctcctcaggaatactaacactggtgggcatgggactggcaccctttaccgagggcggaagcctggtcctgcttgagccgggaatggagctagggatcaccgcggctctgaccgggatcacatcctctactatggattatgggaaaaaatggtggactcaggctcaagcccacgatctagttattaagagcttagataaactgaaagaagtcagagagtttctcggcgaaaatatttccaactttcttagcctggccggaaatacctatcagctcacaaggggcatcggcaaagatatcagagcgctgcgcagagccagagccaatcttcagtcagttcctcatgcgtccgccagccgccctagggtgaccgagccgattagcgctgaatcaggtgagcaggtggagagagtcaatgaaccaagcatcctggagatgtccaggggcgtcaaactgacggacgttgcacctgtttctttttttctcgtccttgacgttgtttacttggtgtacgaatctaaacacctgcacgaaggtgctaaatctgaaaccgccgaggagttgaagaaggtagcccaagaacttgaggagaaactcaatatactgaataataactacaagattcttcaggcagatcaggagttgtag

SEQ ID NO: 214678 - DNA, 1197 bp, Artificial Sequence
  Description of Artificial Sequence: Synthetic coding sequence
atggagggagccgctctgctgcgtgtttccgtcctttgtatctggatgtctgccctgttcttaggagtgggcgttagggctgaggaggcaggtgccagggtgcagcagaacgtgccctcaggcacagatactggagatccccagagcaaaccccttggcgattgggcggctggcaccatggacccagaaagctcgattttcatcgaggacgcgattaagtactttaaggagaaggtctccacgcagaacctgctccttctccttactgacaacgaggcatggaatggcttcgtcgccgctgccgagctgccacgcaacgaggcggacgagttgaggaaggccctggacaatcttgcccgtcaaatgatcatgaaagacaagaattggcacgacaagggacaacagtatagaaactggttccttaaggagtttcctagactgaaatccgaactcgaagataatattagaaggctaagagcccttgcagatggagtccaaaaagtccataagggcacaaccattgcaaacgtcgtgagcgggagcctctctatcagtagtggaatcctcacactggttggcatggggcttgctcctttcactgaggggggaagtctggtgctgttggaacccggaatggagctcggaattacagcagcactgacggggattacaagcagcaccatggactatggaaagaagtggtggacccaagcccaggcgcacgacctggtgataaaatccctggacaagttgaaggaggtccgcgaatttctgggcgaaaatatttctaactttctaagtcttgccggaaacacctatcagctgacccggggaattggtaaagatatcagagcgctccgtcgtgccagggccaacctgcagtccgttccccacgcttcagcaagccgacccagagtgactgaaccaataagtgctgagtctggcgaacaggttgaacgggtgaacgagcctagtatacttgagatgtctaggggcgttaaactgacggatgtcgcacccgtgagcttcttcttagttctcgatgtggtctatctggtctacgagagcaagcacctgcatgaaggagcaaagtcagaaaccgcggaggaactcaagaaagtggcgcaggagttagaggagaaattaaatatcctgaacaataactataagatcctgcaggccgaccaggagttatag

SEQ ID NO: 214679 - DNA, 1143 bp, Artificial Sequence
  Description of Artificial Sequence: Synthetic coding sequence
atggagggtgcggctttgctgcgcgtcagtgtgctgtgtatttgggtgcagcagaatgttccctccgggaccgatactggggatccccagtccaagccattaggggattgggcggctggcaccatggacccagagtcttctattttcatcgaggacgccataaagtactttaaggaaaaggtgtccacccagaacctacttctgcttcttaccgataacgaggcttggaatggttttgtggccgctgccgagctgcctcgcaatgaagcagacgagctgagaaaggcattggataacctggcacgacagatgataatgaaggacaagaattggcatgataagggtcaacagtaccgtaactggttcctgaaggagttccctcggttgaagtccgaactcgaggacaacattcggagactgcgcgctctcgccgatggggtccaaaaagtccacaagggcacaactattgcaaatgtggtgtccggaagtctgtctatcagcagtgggatcctgacactagtgggtatgggcctcgctccttttacagagggcggatcactggtgctcctggagccaggtatggagttaggaatcaccgctgctctgaccggcatcacatcatccaccatggactatggtaagaaatggtggacacaggcccaggcccacgacctggtaatcaaaagcctcgacaaacttaaagaagtgcgtgagtttctcggcgaaaatatttctaatttccttagtctagccggaaatacgtaccagctaacaagaggaattggaaaagacatcagagctctaagacgggctagagcgaaccttcagtctgttccgcacgcgagcgcttcccgtccaagggtgaccgagccaatcagtgctgaaagtggtgaacaggtggagagggtcaatgaaccatcaatcctggaaatgtcaaggggcgtgaaacttaccgacgtcgcgccagtgtctttcttcttggtcctagacgtagtgtatctggtgtatgaatctaagcacctgcacgaaggagcaaagtctgagactgctgaggagttgaagaaggtcgcacaggagctggaggaaaagttaaacattctgaataataattacaagattttacaggcagaccaggagctctag

SEQ ID NO: 214680 - DNA, 483 bp, Artificial Sequence
  Description of Artificial Sequence: Synthetic coding sequence
atggagggggctgctctcctaagggtgagtgtcctgtgtatttggatgtctgccctgttcttgggtgtaggggtgagggctgaggaggctggtgcacgcgtgcagcagaacgtgccctcgggcacggataccggcgaccctcaaagtaagcctctgggcgactgggccgctggaactatggatcctgaatcgtctatctttatagaagacgcaataaaatactttaaggagaaagtttctactcagaatctgttgctgctcctgactgataacgaggcatggaatgggtttgtggctgcagctgagttacctcggaacgaagctgatgagctgagaaaggctcttgacaatctcgcccgacagatgatcatgaaggacaaaaattggcacgataagggtcagcagtaccggaactggtttctcaaagaatttcctcgcctgaagagcgagctggaggataatatccggaggctccgagcctag

SEQ ID NO: 214681 - DNA, 426 bp, Artificial Sequence
  Description of Artificial Sequence: Synthetic coding sequence
atggaaggggcagccctgctgagggttagtgtgctgtgcatttggatgtctgcacttttcctgggggttggagtgcgtgctgaggaggccggagcaagggttcagcaaaacgtcccctcaggaacggatactggagacccgcagagcaaaccactaggggattgggccgctggcactatggaccctgggcctgccggttctaggggcgattcaggcgagccttgtaccctgaggcccgcttgccgtggtcagagacagcatggaggcgcatccaggatctccgccgaaggacccgcacccatgcccagacgaaggactcccagtaccgcacatctgcgcgtgcctaagacctcgcggagaaatttgctgtgcatgagagccgtaagcctgttgagaatgccactttcaatctcccgcaagaagtag

SEQ ID NO: 214682 - DNA, 357 bp, Artificial Sequence
  Description of Artificial Sequence: Synthetic coding sequence
atgaggttcaagtcccatacggttgaactcagatctactctgtcacaaccactgttttcgtgcagtagaaggcgcccttgctctgacatggaaggggctgccttgctgagggtctccgtgttgtgcatttggatgagtgctttgttcctgggtgtgggcgtcagagccgaggaagctggggctcgggtgcagcagaacgtgcctagcggtactgataccggggacccacagagcaaaccactgggggactgggccgctggaactatggatccagagtcatccattttcatcgaagatgctataaaatatttcaaggaaaaggtctctacacagaacctgctgctgctgctgacttag

SEQ ID NO: 214683 - DNA, 426 bp, Artificial Sequence
  Description of Artificial Sequence: Synthetic coding sequence
atggagggtgccgcacttctgcgcgtgtcagtgctctgtatttggatgtccgctttgttcctgggggttggcgtcagagccgaggaagccggtgccagggtgcagcagaatgtcccaagcgggacagatacaggcgatccacagtctaagcccctgggagactgggccgcaggcactatggacccgggtccggcaggaagccggggtgactccggagagccctgtaccctgaggcctgcttgccggggtcagcggcagcatggcggagcatcccggatttctgcagaggggcctgccccaatgcctaggagaaggaccccatcgacagcccacttacgggttccaaagacgtcccgcaggaacctactgtgtatgcgtgctgtctctctccttcgcatgccgctgtctatttctcgcaagaagtag

SEQ ID NO: 214684 - DNA, 1014 bp, Artificial Sequence
  Description of Artificial Sequence: Synthetic coding sequence
atgaaccctgaaagctcaatcttcattgaggactacttgaaatatttccaagatcaagtcagtcgtgaaaatctcctgcagttgctgaccgatgacgaggcctggaatgggtttgttgcggcagccgagttaccccgagacgaggctgacgagctccgcaaggcactgaataaactagcatcacacatggtgatgaaagacaagaaccgtcatgataaggaccagcaacatagacaatggttcctaaaggaatttccaagactgaagcgcgagctggaggaccatattagaaagctgagggctttggctgaggaagtcgagcaagtgcacagaggaacaactatcgcaaatgtcgtaagtaacagcgtaggcacaacttcaggtattcttacactgctcggactcggcttggcaccatttactgaagggattagttttgtactgctggatactggcatgggcctgggtgccgctgccgcagtagcagggataacctgttctgtggtggagttagtcaacaagctcagggccagggcgcaggcgcgaaaccttgaccagagcgggactaacgtcgctaaagtgatgaaagaatttgtcgggggtaacaccccgaacgtgctgacgctggtggacaattggtaccaggttacgcagggcattggtagaaacattcgggcaattcgacgggcaagggccaacccacagcttggcgcttacgccccacctcctcacatcattggtagaatctcagctgagggcggtgaacaggtcgagcgcgttgtcgaagggcctgcacaagcaatgtcacgtggcactatgattgtgggtgctgcgactgggggaattttacttctgctcgacgtggtctccttggcctacgaaagtaagcacctgcttgaaggcgcaaagtctgagtccgctgaagagctgaaaaagcgggcacaggaactcgaggggaaactgaatttccttacaaagatccatgaaatgctgcagcctggacaggaccagtag

SEQ ID NO: 214685 - DNA, 1014 bp, Artificial Sequence
  Description of Artificial Sequence: Synthetic coding sequence
atgaaccctgaatccagtatttttattgaggattacctaaagtactttcaagaccaggtatcccgggaaaacctgcttcagttattgacggacgatgaggcatggaacggtttcgtggccgctgcagagctgccaagggacgaagctgatgagctgcggaaagcgctgaacaagcttgcctctcacatggtcatgaaagacaagaatagacatgacaaggaccagcagcacagacaatggtttctgaaagaattcccacgactgaaacgtgaactggaagatcacattagaaagctgcgcgcactggccgaggaggtggaacaggtacatcgcggaaccactatcgccaatgttgtatcaaacagtgtgggaactaccagcggcattctgaccctactggggttaggattagccccatttactgaaggaatctctttcgtactcttggatacagggatgggcctaggcgcagcagccgcagttgccggtatcacttgcagcgttgtggagctcgtgaacaaactacgggctagggcccaagcccgaaacttggaccagagcgggacaaacgtagctaaggtgatgaaagagttcgtggggggaaatacaccaaatgtgctcacgctcgtcgataattggtaccaggtgacccagggaatcggtaggaacatacgagccatccgccgagctcgagccaatccacagttgggagcctatgctccccctccacatatcataggcagaatatccgcagagggcggagagcaggtcgaaagggtagtggaggggcctgctcaggctatgagccgcggtaccatgattgtgggagcagccaccggaggaatattgttattgctggatgtggtgtcactggcttatgaatccaagcacctccttgaaggagctaagtctgaatccgcagaggagctgaaaaagcgcgctcaagagctcgagggcaaactgaattttctcacaaaaatccacgaaatgctgcagcccggacaggaccagtag

SEQ ID NO: 214686 - DNA, 1350 bp, Artificial Sequence
  Description of Artificial Sequence: Synthetic coding sequence
atgcatagctggacttgggaccctcattcctctgagcaattggatctggctcaatcgctctcagaggaagatccactgagcagccttagggggtctatacagcctcagccccctgcagaagcccctgacaagggtggctctcaggccaacaacgaccccggtgggtgggacccgggatgttcctcttcccaggtcctgggtcgcacgcgcggaccatgcctcggggtccgagtgagggaggaagaggccggtactcgtgttaaggaaaacctgcctgtgtggactgtgacgggagaattgcaaggtaaacccctgggtaatccggcagccggtacaatgaatcctgaaagtagtatattcatagaggactatctcaagtactttcaggaccaggtgtcaagggagaatctcctccaactcctaacggatgatgaggcttggaatggcttcgtggccgctgccgagctgcccagagacgaggccgatgaattacggaaagccctgaataaactggcctcccacatggttatgaaggacaagaaccggcatgacaaggatcagcagcaccgtcagtggtttcttaaggagtttcccagactcaaacgagagttggaagaccatattcggaaacttagggccctcgctgaagaggtagagcaagtgcaccgcggaacaactatcgccaacgtggtatctaactctgtggggacaacgagtggtatcctgactctgttgggcttaggcctggccccattcactgagggcatttcctttgtcctgctggacacggggatgggcttgggtgccgctgccgctgtcgcaggcattacatgctcagtggtggaactggttaataagctcagagccagggcccaggctagaaacttggaccagagtggtactaatgttgccaaagttatgaaggagttcgtgggcggtaacactccaaacgtgctgaccttggtggataattggtatcaagtgacacaggggataggcaggaacattcgagctattcgtcgggctcgcgcaaacccccagctaggtgcctacgcgccaccaccgcatattatcgggagaatctccgccgagggtggagagcaggtggagagggtagtagaggggccagcccaggctatgtcccggggaacaatgatcgtaggggcagcgactgggggtatcctgctgctgctggatgtggtctctctggcttatgagagcaaacacctgctggaaggagctaagagtgagagtgcggaagaactgaagaagcgggctcaggagcttgagggtaaactgaatttcttaaccaagattcacgagatgcttcagcctggacaagaccagtag

SEQ ID NO: 214687 - DNA, 225 bp, Artificial Sequence
  Description of Artificial Sequence: Synthetic coding sequence
atgaacccagagtcaagtatatttatagaggattacttgaagtacttccaggatcaggtgagtagggagaacctgctccagctgctgacagatgacgaggcatggaatggattcgtcgcagcagccgaattacctagagacgaagcggatgagcttcggaaggccctgaacaagttagcttcccatatggtgatgaaggacaagaacaggcatgataaagactag

SEQ ID NO: 214688 - DNA, 387 bp, Artificial Sequence
  Description of Artificial Sequence: Synthetic coding sequence
atgaacccagaatcgtctatcttcattgaagactatctgaaatactttcaggaccaagtgagccgcgagaatctgttacagctgttgacagacgatgaggcctggaatggctttgtggccgcagccgaactgccgcgagacgaggctgatgagctccgaaaagctctaaacaaactggcttctcatatggtcatgaaggacaagaataggcacgataaagaccagcagcacagacagtggttcctaaaggagtttccgaggctcaaacgggaactggaggatcacataagaaagcttcgagcgttggcggaagaagtggagcaggtccatcggggtacaactatcgcaaacgttgttagcaactctgtcggcacaactagcggctag

SEQ ID NO: 214689 - DNA, 1209 bp, Artificial Sequence
  Description of Artificial Sequence: Synthetic coding sequence
atggggctgggccagggctggggttgggaggcctcttgcttcgcgtgtttgatcaggtcttgctgccaggtggtgacctttaccttcccgttcggtttccaagggatttcccaaagccttgagaatgtttcaggatactacgccgacgcgagattggaggtcgggtctacccaattgcgcaccgcaggcagttgtagtcactccttcaaaagatcttttctcgaaaaaaaacgcttcacagaggaggccacaaaatatttccgggaacgggtgagccccgtgcacctgcaaatcttgctcacgaacaatgaggcctggaagcggtttgtgaccgccgctgaactgccgcgagatgaagcagacgcgttatacgaggcactgaagaagttaagaacgtatgctgccatagaggacgaatacgtacaacagaaagacgaacagttccgggagtggtttctgaaagagttcccacaggtcaaacggaaaatccaggaatctatagagaagttgcgcgctttggctaatggaatcgaagaagtgcatcggggttgcacaatctcgaacgtggtctcttcatctaccggtgctgcctccggcatcatgagtctcgcagggctcgtactcgccccttttaccgcagggacaagcttggctctgacggctgccggagtgggcttgggcgcagcctctgcagtaaccgggattacaacgtccatcgttgagcatagctatacttccagcgcagaagcagaagcatctagactgacagcgacatctatcgatagactaaaagtgtttaaggaagttatgagggatatcactccaaatctactaagtctcctcaacaattactatgaagcaacacaaacgattgggtccgagatcagggccatccgccaggctagggctcgcgcacggctccccgtgacaacttggcggatatctgccggttcaggcggtcaggccgagcggaccattgccggaactactcgcgcagtttcacgaggggcacggattttaagtgctacaacctccggtattttcctggccctcgatgtggtgaatctcgtgtacgaaagtaaacatcttcatgagggagctaagtccgcaagcgccgaggagctccgacggcaagctcaggagctggaggagaacctgatggaactaacgcaaatttatcagagactcaatccgtgccacacccactag

SEQ ID NO: 214690 - DNA, 609 bp, Artificial Sequence
  Description of Artificial Sequence: Synthetic coding sequence
atgtctctcgccggactagtgcttgctcctttcactgctggcacaagcttggccctgacagcagccggagtggggctgggtgcagcatcagcggtgaccgggattaccacttcgatcgtggagcactcctacacatcctccgccgaggccgaggcatctaggcttaccgccacttcgattgacagattgaaggtctttaaagaggtgatgcgagacatcactcctaacttgcttagtcttttgaataattactatgaggccacccagacaattggttctgaaatcagggctatccggcaggccagagcacgggctcggctacccgttaccacctggcgcatctctgcaggcagtgggggacaggcagagcgtacaatcgccggtacgacccgagccgtctctaggggcgcacggatcctctctgctactacatccggcattttcctggcactggacgtggttaatttggtatatgagtccaaacacttgcacgagggagcaaagagcgcttcagccgaagagttgagacggcaagctcaggagctcgaagaaaacctgatggaacttacccaaatttatcaacggctgaacccctgtcatactcactag

SEQ ID NO: 214691 - DNA, 609 bp, Artificial Sequence
  Description of Artificial Sequence: Synthetic coding sequence
atgagtctcgcaggcctagtgttagctcccttcacagcaggaacatctctggccctcacagccgcaggtgttggcctgggggcagcaagcgcagtcaccggcattacgacctctatcgttgaacattcatataccagctcggctgaggctgaagcatcgaggcttaccgcgactagcattgataggctgaaagtttttaaagaggtgatgagggatattacccctaaccttctgtccctactcaacaattattacgaagccacacaaaccatcgggtctgaaatccgggctattcgccaggcccgtgcccgtgctcgcttgcccgtgacaacttggcggatcagcgccggaagtgggggtcaggcagaaagaaccatcgccggaacaacccgagctgttagcaggggagcgcgaattttgagcgccaccacatctggaatttttctcgccttggatgtggtgaatctggtgtatgagtccaaacacttacacgagggggcaaagagtgcgagcgcggaggagctgcggagacaagcgcaggaactggaggaaaatctgatggagctaactcagatatatcagcgccttaacccatgtcacacgcactag

SEQ ID NO: 214692 - DNA, 996 bp, Artificial Sequence
  Description of Artificial Sequence: Synthetic coding sequence
atggatagcgaaaagaaacggttcacggaggaggccactaagtacttcagggagcgtgtgtcgcctgtgcacctccaaatcctcttgaccaacaacgaggcctggaaaaggttcgtcaccgccgcagagcttccacgggacgaggctgatgccctctatgaggcccttaaaaaactacggacttacgccgcaatagaagatgagtatgtgcagcagaaggatgagcagtttcgggaatggtttttgaaagagttcccgcaggtgaaacgtaaaattcaggagtcaattgaaaaactccgagcgcttgctaacgggatcgaagaagtccaccgaggctgtaccattagcaacgtggtgtcctcttctaccggcgctgccagcggaattatgtccctggctggactcgtgttggcgccattcaccgccggaacttccctggccctcacagcagcaggagtcgggctcggggctgctagtgctgtgactgggatcacaacttctatcgtcgagcatagctacactagttccgccgaggcggaagcctcaagactcactgcaacttccatcgataggctcaaggtgttcaaggaagtgatgagagacatcacccccaatctgctgagcctactgaacaactactacgaggcaactcagacgataggaagtgaaattagggctattagacaggctagggcgcgagcccgtctccccgtgactacttggcgcatctctgccggaagcggcggacaggcagagcgcaccatagccggtactaccagggccgtctcgagaggagccagaattttatccgctactacttcaggcatttttttagctttagatgtggtgaacctggtgtatgagtctaagcacctgcacgagggggcaaaatcagctagcgccgaggaactaagaagacaagcccaggagttggaggaaaatctgatggagttgacccagatataccagagactgaatccatgccacacccattag

SEQ ID NO: 214693 - DNA, 609 bp, Artificial Sequence
  Description of Artificial Sequence: Synthetic coding sequence
atgtcactggccggactggttctggccccatttacagccggtacttctttagcgctcaccgctgccggagtaggtctgggcgcagcttccgcggtgactgggatcactacaagcatcgtagagcacagctacacatccagcgccgaagctgaagcatctcgcttaacagctacgagcattgaccggctcaaggtgtttaaagaggtgatgcgagatattacaccaaacctgttgagcctgctaaacaactactatgaagccactcagactatcgggtctgaaattagagcgattcgacaggccagagcacgtgctaggctgcccgtgacaacctggcgaatatccgcaggctctggagggcaggcggagcggacaattgcgggaaccaccagggctgtatcaaggggcgctagaatactgagcgcaactacctccggtatctttctcgctctcgatgtggtcaatcttgtttacgagtccaagcatctgcacgaaggagctaaatccgcttctgccgaagaactaaggcggcaggcccaggaactcgaagaaaacctgatggagctcacccagatatatcagagactgaatccgtgccacactcactag

SEQ ID NO: 214694 - DNA, 324 bp, Artificial Sequence
  Description of Artificial Sequence: Synthetic coding sequence
atgggtagctgggtacaactgattacatcagttggcacaagtgggttattcctcggcgtcagggttcgggaggagggggctggaatgcgttgcagcaagacgatccaggcaggccaatggctggactcaagcaaagggccattgggaccatcccccccacctgtcccgacggcaggatatagttcgagcttctgcgtgcactacgtgaatctacttccgggagtcctggtgctcagtgtgacttcacagtacccccacttaagtatggccctttgtcagctggccgctcatgactggccacggctgtcatgtgtgtgcgtgtag

SEQ ID NO: 214695 - DNA, 1044 bp, Artificial Sequence
  Description of Artificial Sequence: Synthetic coding sequence
atgggcagttgggtacaacttattacctccgtgggtgtgcagcagaatcatcccggttggacggtggcgggacaatttcaggagaagaagcgctttaccgaagaggtgatcgagtactttcaaaagaaggtgtcaccagtgcacctcaaaatcttacttactagcgatgaggcctggaaacgatttgtgagagtggcagaactcccaagggaggaggccgacgctctttacgaagcactaaagaacctaaccccctatgttgccattgaagataaggatatgcagcagaaggagcaacaatttagggaatggttcttgaaatttccacaaatccgatggaaaatccaagagagtattgagcgactgcgagtcatcgctaacgaaatcgagaaagtgcatagaggctgtgtgatcgccaatgtggtgtctggttctacaggaatcttgagtgttatcggggttatgctcgccccattcaccgcaggcctgtctttgtccattacagcagccggtgtgggcttaggtatcgctagcgctacagccggaatcgcttcaagtatcgttgagaacacctacaccagatctgcagaacttaccgcgtcaaggcttacggccacatcaactgaccaactggaggctctgagagatatcctaagagatatcacaccgaacgtgctctcattcgccctggacttcgacgaagcaaccaaaatgattgctaacgatgttcacaccctgcgccgtagtaaggctaccgtgggaagacccctgattgcgtggagatatgtgccaatcaatgtggtcgagacccttcggacacgtggggctcccactagaatcgtccggaaggtggctagaaatttgggcaaggcaacctccggcgtgttagtcgtcctagatgtggtgaacctagtccaagattctttagatcttcacaaaggagccaagagcgagagcgccgagagcctgcgacagtgggcccaagagctagaagagaacctcaatgaactgacccacatccaccagtcgctgaaggcgggatag

SEQ ID NO: 214696 - DNA, 1053 bp, Artificial Sequence
  Description of Artificial Sequence: Synthetic coding sequence
atggagggcgcagcactgctgaagatcttcgtcgtgtgcatttgggtgcagcagaaccaccccggatggaccgtagccggtcagtttcaagagaagaagaggttcacagaggaggtcatcgagtattttcagaaaaaggtgagcccggtgcaccttaagatcctgctcaccagtgacgaagcttggaagaggttcgttagggtcgcagaactgcctcgggaggaggccgacgctctgtacgaagctctgaagaacttgactccttatgtggcaatcgaggacaaagacatgcagcagaaggagcaacaattccgtgagtggtttctgaaattcccacagatccgctggaaaatacaggaaagcatcgaaaggctaagagtcatagcaaacgaaatagagaaagtgcacagagggtgtgtaatcgcgaacgtcgtctccggctctaccggcattctctcagttattggcgtgatgcttgccccattcacagccggactttccctgtcgatcaccgccgctggggtgggattgggcattgcctctgcaactgccggaatcgcttccagcattgtcgagaacacgtatacccggagtgctgaattaactgcatcccggctcaccgctacttcaactgaccaactggaggcgctgagagatatcctaagggatatcacccctaacgtgctctcattcgctctcgacttcgacgaagccacaaagatgatcgcaaacgacgttcacactttgcgacgatcaaaagccaccgtgggcaggccactaattgcctggagatacgtaccaataaatgtggtggaaaccctgcgcacacgcggagccccaacaagaatcgttagaaaagtggcgagaaacctcggaaaagctacatcaggggtcctggtggtgctggatgtcgtcaaccttgtgcaggactctctcgatcttcataaaggggcaaagtcagaaagtgcagaaagtctgaggcagtgggctcaggagcttgaagagaaccttaatgagctgactcacatccatcagagtctgaaggccggttag

SEQ ID NO: 214697 - DNA, 393 bp, Artificial Sequence
  Description of Artificial Sequence: Synthetic coding sequence
atggagggcgcagctctcctcaagatttttgtggtttgcatatgggtgcagcaaaatcaccccggatggactgtcgcgggacagtttcaggaaaaaaaaagattcacagaagaagtaatcgaatacttccagaaaaaggtgagtcccgtgcatctgaagatacttcttacctccgatgaagcctggaagaggttcgtccgggtggccgagttgccgcgagaggaggctgacgctctctacgaggccctgaagaatctcacaccatacgtggcgatcgaagacaaggatatgcagcaaaaggaacagcagttcagagaatggtttctgaaggtgtccagtaatcaaatggaggactctggagtgcatcggaaggccagctgtcactgcaaatag

SEQ ID NO: 214698 - DNA, 384 bp, Artificial Sequence
  Description of Artificial Sequence: Synthetic coding sequence
atggggtcctgggttcagctgataactagtgtgggcgtgcagcagaatcaccccggatggaccgtagcagggcagtttcaggagaagaaaagattcactgaggaggtaatcgaatactttcagaaaaaagtgtcaccggtgcacctaaagatcttactcaccagtgacgaggcctggaaacgttttgtgagggtggcagagctgccacgcgaggaggcagacgctctctacgaggccctaaaaaacctgaccccttacgtggcgatagaagataaagatatgcagcagaaagagcagcaattcagagaatggtttctgaaggtgtcctccaaccaaatggaagattcaggggtacacagaaaggcgagctgtcactgcaagtag

SEQ ID NO: 214699 - DNA, 198 bp, Artificial Sequence
  Description of Artificial Sequence: Synthetic coding sequence
atgggatcctgggtgcaacttattacctccgttggagtccagcagaaccacccaggctggacggttgcgggtcagtttcaggagaagaagagatttacagaggaagtgatcgaatatttccagaagaaagtgagtcctgttcacctgaaaatcctgctcacatccgacgaggcctggaagcgctttgtgagagtgtag

SEQ ID NO: 214700 - DNA, 384 bp, Artificial Sequence
  Description of Artificial Sequence: Synthetic coding sequence
atgggttcctgggtccaactgattaccagcgttggcgtccaacagaaccatcccggatggactgttgcaggccagtttcaggaaaagaagcgtttcactgaggaagttatcgagtattttcaaaaaaaggtctccccagttcatttaaaaattctgctcacaagcgacgaggcgtggaaacgttttgtgagggtcgctgaattgccgagggaagaggccgacgctctctacgaagcacttaaaaacctgacaccatatgtggcaatcgaagataaagatatgcagcagaaagagcagcagtttcgcgaatggttccttaaggtgtccagcaatcagatggaggatagtggcgtacacaggaaggcatcttgccattgtaagtag

SEQ ID NO: 214701 - DNA, 183 bp, Artificial Sequence
  Description of Artificial Sequence: Synthetic coding sequence
atgggatcatgggtgcagctcatcacttcagtgggggtacagcagaatcacccaggctggactgtcgccggacagtttcaggaaaaaaagaggtttacagaagaggtaattgagtactttcagaaaaaggtaagtccggtgcatctaaagatcctgctaacatcagacgaagcctggaagtag

SEQ ID NO: 214702 - DNA, 219 bp, Artificial Sequence
  Description of Artificial Sequence: Synthetic coding sequence
atgggcagctgggtgcagctcattaccagtgtcggagtgcaacagaaccaccctggctggaccgttgcaggccagttccaagagaagaaaaggtttactgaagaggtgatcgagtactttcagaaaaaggttagcccagtgcacctgaaaatccttttaacatcagacgaagcatggaaacgcttcgtcagggtagccgagctgccacgggaggagtag

SEQ ID NO: 214703 - DNA, 213 bp, Artificial Sequence
  Description of Artificial Sequence: Synthetic coding sequence
atgggatcgtgggtgcagcttattacctctgtcggagttcaacaaaaccacccagggtggacagtggccggacagtttcaagagaagaagaggtttacggaggaagtaattgagtactttcagaaaaaggtatctccagttcatttaaagatcctgctgacctccgacgaggcatggaagagatttgttcgggtcgccgagctgcccagatag

SEQ ID NO: 214704 - DNA, 1302 bp, Artificial Sequence
  Description of Artificial Sequence: Synthetic coding sequence
atgccttgcggcaaacagggaaacctacaggtgcctggttctaaggtgttgccagggctcggcgaaggctgtaaagaaatgtggttgcgcaaagtgatctacggaggcgaagtatggggcaagtcgccagagccagagtttcccagcctggttaacctgtgtcaatcctggaaaatcaataatcttatgagtaccgtacatagtgacgaggcgggaatgctgtcttatttcctcttcgaagagttgatgaggtgcgataaggattccatgcccgatggaaatctgagtgaagaggagaaactgtttttgagttactttcctctccacaagtttgagttggaacagaatatcaaagagcttaacacccttgcagatcaggttgataccactcacgaactcctgaccaaaacatccttggtggccagcagttcaggggctgtgtctggcgtcatgaatatccttggccttgcacttgcgcctgtaaccgcgggtgggtccctgatgctcagcgctacaggaaccgggcttggtgcagccgctgccatcacaaatatcgttaccaatgtcctcgagaatcgttccaactccgctgccagggataaggcaagtaggctcggcccactgaccacctctcacgaggccttcggcggtatcaattggagtgagatcgaagcggcagggttctgcgtgaacaaatgcgtcaaagcgattcaggggatcaaagacttacacgcctatcaaatggctaagagcaacagcggtttcatggccatggtcaaaaatttcgtggccaagcggcatatccctttttggacggcacggggtgtccaacgggcttttgaggggacaacacttgcgatgactaatggtgcatgggtcatgggggctgcaggggctgggttcttactgatgaaagacatgagttccttcctgcagagttggaagcacttggaagacggcgcaaggacagaaactgcagaggagctccgggctctggccaagaagctggaacaggaactagacaggctgactcagcaccaccgacatctaccgcagaaggcttctcagacttgttcgtcctctcggggaagggcggtgagaggaagccgggtggtgaagcccgaagggagcaggagccccctcccttggcccgtggtggagcaccagcccagactggggcctggagtggccctgcgtacacccaagaggacagtatctgcccctcgaatgctgggtcaccagcctgccccacctgcgcctgcgaggaaaggcaggcaggctcccggaaggcacaggcaatag

SEQ ID NO: 214705 - DNA, 1032 bp, Artificial Sequence
  Description of Artificial Sequence: Synthetic coding sequence
atggataaccaggctgagcgtgagtcagaggccggagtagggttacagagagatgaggatgatgctccattatgcgaagacgtggaattgcaggacggcgatctgagtccggaggagaaaatcttccttagggaatttccaaggttgaaggaagacctcaaaggcaacatcgacaaactcagagcacttgctgacgacatcgacaagacgcataagaaatttacaaaagcaaatatggttgccacgtctacagcagtgataagcggggtgatgagccttctcggccttgccctggcccctgctactggaggtggaagcctcctgctgtccactgcagggcagggcctggctaccgccgctggcgttacctcaatagtctctggcacactggaaagaagtaaaaataaggaagcacaggccagagccgaggacatcctaccgacatacgaccaggaggacagagaagacgaggaggagaaagccgactacgtgacagccgctgggaaaataatatataatttgcggaacaccctgaagtacgctaaaaaaaatgttcgcgctttctggaagttgagagccaaccctcggctggccaacgccacaaagcgactgttgaccactgggcaggtttctagccggtcgcgtgtgcaggtgcaaaaggctttcgctggtaccacgttagctatgaccaagaatgccagggtgctgggaggcgtgatgtctgctttctctctgggatacgacctcgcaacgctgagcaaggagtggaagcatctgaaagagggcgctaggacgaaattcgccgaggagctgcgagccaaagcacttgagctcgagaggaagctaacagagctcacccagctttataagtccctgcagcaaaaggtgcgatcgcgagccaggggtgtcggcaaggatctgaccgggacatgtgagacagaggcatactggaaggagctgcgtgagcacgtgtggatgtggctttggttgtgcgtctgtctttgcgtgtgcgtctatgttcagtttacctag

SEQ ID NO: 214706 - DNA, 540 bp, Artificial Sequence
  Description of Artificial Sequence: Synthetic coding sequence
atgtttaaggtgattcagcgtagtgtggggccagcttctttgtccctcctgacttttaaggtgtatgctgctcccaaaaaggattcccccccaaagaactctgtcaaggtggacgaattgagcttgtactcagtgcctgagggccagagcaaatacgtcgaagaagctagatcccagttagaagagtccatcagccagttacgacactactgtgaaccatacactacctggtgccaaactgccatgacgatctccaaaatgcacttgctctttttccccagactcggggtcatcggtttcgccggattaatagggcttttgctcgccagaggatccaagatcaaaaagttggtttatccccctggttttatgggccttgccgcttcgttgtactacccacaacaggctatagtgttcgctcaagtgtctggagagcggctgtacgactggggcctaaggggatatatcgtgattgaggatctatggaaggaaaattttcaaaagcctgggaatgtaaagaattcccctgggacgaagtag

SEQ ID NO: 214707 - DNA, 597 bp, Artificial Sequence
  Description of Artificial Sequence: Synthetic coding sequence
atgtttaaagtgatccaacgtagtgttgggcctgctagcctttcccttttaaccttcaaggtgtatgcggcaccgaagaaggatagtccccctaagaacagcgtgaaagtagatgaattgagcctctactcagtacctgaaggtcaaagcaagtacgtcgaggaggctcgatctcagctcgaagagagcatatctcagctgcgccactattgcgaaccgtatactacttggtgtcaagaaacttactcccagacaaaacccaaaatgcaatccctggtgcagtggggactcgattcctatgattacctccagaatgctcccccaggattctttcccaggttaggcgttataggctttgccggtttgattggactgctcctggccagaggttcaaaaataaagaaacttgtgtatccaccaggcttcatgggactcgccgcttccctctattacccccagcaggccatagttttcgcccaggtgtcgggcgaacgactgtatgattggggcctgcgtggctacatcgtgattgaggatctgtggaaggagaatttccaaaaacctggtaatgttaaaaattcaccgggtaccaaatag

SEQ ID NO: 214708 - DNA, 537 bp, Artificial Sequence
  Description of Artificial Sequence: Synthetic coding sequence
gtatacgctgccccaaagaaagattctcctcccaagaactccgtcaaggtggacgaactcagcctgtacagtgttcctgagggccaatctaaatatgttgaagaggctcgctctcaactagaggagtcaatttcccagctgcgacactactgtgaaccgtatacgacctggtgtcaagagacttactctcagactaaacctaagatgcagagcctcgttcagtgggggctggacagctatgattacctccagaatgccccacccggattcttccccaggctgggggtaattgggttcgcagggcttattggactactgttggcccgaggcagcaagatcaagaagttggtctatcccccaggtttcatgggactcgctgccagcctgtactacccacaacaggccattgtgtttgcgcaggtgagcggagaacgcttgtacgactgggggcttagggggtacattgtgatcgaagacctgtggaaagagaatttccagaaacccggtaatgtcaagaacagcccaggaacaaaatag

SEQ ID NO: 214709 - DNA, 1332 bp, Artificial Sequence
  Description of Artificial Sequence: Synthetic coding sequence
atggacaggctcggacccttctcaaatgatccaagcgataaacctccctgcagaggctgctctagctatttaatggagccctatataaagtgtgccgaatgcggccctccgccttttttcctgtgtctgcagtgcttcactagggggtttgagtacaagaaacaccagagcgatcacacctacgagattatgacgagtgatttccccgttctggacccatcatggaccgcccaggaggagatggccttgctggaggcagtaatggattgtgggttcggcaattggcaggatgttgcaaatcagatgtgcacaaagaccaaggaggagtgcgagaagcattatatgaagcacttcatcaacaatcccctattcgcttccaccctcttgaacctcaagcaagccgaggaagctaaaaccgctgacactgcaatcccttttcacagtacggatgatccacccagaccgacctttgactcattgctaagcagggacatggctgggtatatgccagctcgtgcggacttcattgaagaatttgataactatgcagaatgggatttgagagatattgacttcgtggaggacgatagcgacatactgcacgctcttaagatggccgtggtcgatatttatcatagtagactgaaagaacgacagagaagaaaaaaaattataagagatcatggactgattaacctgaggaaattccagctgatggagcgcagatatcctaaagaggttcaagatctatatgagaccatgagacgcttcgccagaattgtgggccctgtggagcatgataagttcattgagtctcacgcccttgagtttgaattacgtagagaaattaaaagactgcaggagtaccgcacggctgggattaccaacttctgtagcgccagaacctatgaccacctcaagaaaacccgtgaggaggagagactgaagcgcacaatgttatctgaggtcctccagtatatccaagacagtagtgcatgtcagcagtggctgaggagacaggctgacatagatagtggcctatctccctccatcccaatggcgtctaatagcggacgccgttcagctccccctctcaacttgacggggctgccgggtactgagaaactcaatgagaaagaaaaagaactgtgtcagatggtacgccttgtgccaggggcttatctggagtacaagtccgccctcttaaatgagtgtaataagcaggggggactccgcttggcgcaggccagagccctgattaaaattgacgtcaacaaaacaaggaaaatttacgacttcttgattagagagggttacatcaccaagggctag

SEQ ID NO: 214710 - DNA, 978 bp, Artificial Sequence
  Description of Artificial Sequence: Synthetic coding sequence
atggtacctagagaagccccagagagcgcccaatgtctgtgcccgagtcttactatccctaatgccaaggatgtgctgagaaaacgacacaagcggcgaagccgtcagcaccagagattcatggcccgtaaggcactgctccaggagcagggtctcttaagtatgccgcctgagccaggaagtagcccactcccgacgcccttcggcgcagcaactgccactgaggccgcatcctctggcaagcagtgcctgagggcgggatcaggctccgcaccctgttcacggagaccagctcccggaaaagcaagcggacccttgccctcaaagtgtgtagccatcgactgcgagatggtcggaaccggcccacgcggacgtgtgagcgagctggctagatgcagcatcgtatcttaccatggcaatgtcctgtacgacaaatatatccgccctgaaatgcctatagccgattatcgcaccagatggtccgggataaccagacagcacatgcggaaagcagtgcccttccaggtagcacagaaggaaatactgaagctgctcaaagggaaagtggtagtgggacatgccctccataatgactttcaggcgctgaagtatgtgcatccccgatcccagaccagagacaccacctacgtacctaatttcctatcagagcctggacttcacactcgcgctcgtgtgtcactgaaggacctcgcgctccagctgctgcacaagaaaatccaagtaggacagcacggtcacagctcagtcgaggatgctacgacggcaatggaactctaccggctagtggaggtccagtgggaacagcaggaggcacgatctctgtggacatgcccggaggaccgggagccagacagctcaacagatatggagcaatatatggaggatcagtattggccggacgacttggctcatggtagccggggtggggctcgggaggcgcaggaccggcgaaactag

SEQ ID NO: 214711 - DNA, 984 bp, Artificial Sequence
  Description of Artificial Sequence: Synthetic coding sequence
atggtgccacgcgaagcccctgagagtgctcagtgtctttgtccgtccctgactatcccgaacgcgaaggacgtccttcgcaagcggcacaaacggcgtagccgacaacaccagcggtttatggctaggaaggccctcctgcaggagcagggcttactttcaatgccgccagaacccggatcaagtcccctcccgacccctttcggcgcagccaccgccaccgaagccgctagcagtggcaagcaatgtctgagggctggttcaggatctgcaccatgttcaaggaggccggctccaggcaaggcctcaggccctctgccgtctaaatgcgtagccattgattgcgagatggtgggaaccggacctcgagggagggtgtcggagctagcacggtgctcaattgtatcataccacggaaacgtcctgtatgacaagtacatcaggccggagatgccaatagccgattaccgcacccgctggagcgggatcaccaggcagcacatgcgcaaggctgtcccatttcaggtcgcccagaaagagatcctgaagctattgaagggcaaggttgttgttggtcacgctcttcacaacgatttccaggccctgaagtacgtacaccctcgatctcagacacgggacacaacctatgtcccaaacttcctgtctgagcctggattgcacacgcgagccagggtctcacttaaagatctcgccctccagctactgcacaaaaagattcaagtgggtcagcatggacactcgtccgtcgaagatgctaccacagcgatggaactgtaccggttggtcgaagttcaatgggaacagcaagaagcaaggtctctgtggacatgcccggaggacagggaaccggactcgagcacggatatggaacaatatatggaggaccaaagtacccagtattgggccctcaaacaaaagagcgagaaacaagactcaggcctgaacagcggagcttttgtatag

SEQ ID NO: 214712 - DNA, 1515 bp, Artificial Sequence
  Description of Artificial Sequence: Synthetic coding sequence
atgcccacagtcgaagagctttatcgaaactacggcatcctggcagatgcaaccgaacaggtgggtcaacacaaggacgcatatcaggttatcctcgacggcgtcaagggcggtactaaagagaagaggctcgcggctcagttcatccctaagtttttcaagcattttccagaattggcagattctgctatcaacgcacaactggacctctgcgaagatgaagacgtgtctatcaggaggcaggctattaaggagctcccccaattcgcaacaggagagaatctgccgagagtagcagatatactcacacaactgctgcaaaccgacgatagtgcagagtttaatttagtgaacaacgccctactgtccattttcaagatggacgctaaggggactcttggtggcctgttttcgcagatactgcagggcgaggatatcgtccgagaaagggctatcaaatttctgtccacaaagctgaagactctgccagacgaggtactgacaaaagaagtagaagagttaatcctcacagagagcaaaaaagtgcttgaggacgtgaccggagaagaattcgtgctgtttatgaaaattctatctgggctgaaatcgctgcagaccgtcagtgggcgtcaacagctagtcgagctggtcgccgagcaagccgatttggagcagacatttaaccccagcgacccagactgcgtagatcggctgttgcaatgtacgcgtcaggccgttccgctattttctaaaaatgttcattccacccgcttcgtaacttatttctgtgaacaagtgttacctaacctaggcactctgaccactcccgtggagggcctcgacattcagctcgaggtccttaagctgctcgctgagatgtcatcattttgtggagacatggagaaactcgagacaaacctcaggaaactttttgacaaactgctggagtacatgcccctccctccggaagaggcggaaaatggcgaaaacgccggtaatgaagagcccaaactacagttctcttacgtcgaatgccttttgtatagctttcatcaactgggaagaaaactacctgatttcctgactgcaaaactaaacgccgaaaaactcaaggacttcaagatccggctgcaatacttcgcccgaggtctgcaggtctacataaggcagctgaggctcgcactgcagggaaaaactggggaggccttgaaaacagaggaaaataaaattaaggtagtggctctcaagatcaccaataatatcaacgtccttatcaaagatcttttccacatcccaccatcatacaaatcgactgttacgctatcctggaaacctgtacagaaggtagagataggccagaaacgggcaagtgaagatacaacctctggctccccacccaaaaagagttccgccggaccaaagagagatgccagacaaatctacaatcctccatctggaaaatattcatctaaccttggaaattttaactacgaaagaagcctccaagggaagtag

SEQ ID NO: 214713 - DNA, 1353 bp, Artificial Sequence
  Description of Artificial Sequence: Synthetic coding sequence
atgcctaccgttgaagagctgtaccgcaactacggaattctggctgacgcaaccgaacaggtcggacaaatcaggcggcaggccataaaagaacttccccaattcgctacaggggagaatctgcccagggtggctgacattctcacccagcttttgcaaaccgatgacagcgcggagtttaacttggtgaataacgctttgctgagcatcttcaagatggatgccaaaggtacattgggagggttgttcagccagattctgcagggtgaagatatcgtgcgcgagagggcgattaagtttctctctacaaagttgaagaccctacccgatgaagtgcttaccaaggaggttgaagaactaattctgaccgaaagtaagaaggtgctggaggatgtgactggtgaggaatttgtcctgtttatgaaaatactgtcagggctcaaatcattacagaccgtttctggcagacaacagctggtggagctcgtcgccgaacaagcagaccttgagcagacctttaacccatcggatcctgactgcgttgaccgcttgctgcagtgtacgaggcaggccgtaccccttttcagcaagaacgtgcactcaaccaggtttgtgacttatttctgtgagcaggtgctgcctaatttgggcactctgactactcccgtggaagggctcgatatccagctggaggtgctgaaactgctagccgaaatgtcttccttctgcggtgacatggagaaactagagaccaaccttcgcaagctctttgacaagttactggaatacatgcctctgcctcctgaagaagcagaaaatggggagaacgcaggaaacgaagaacctaagctccagtttagttatgtggagtgcctcctgtacagttttcatcagctgggacgtaaacttcccgattttctgacagctaagcttaacgccgaaaaactcaaggactttaaaatcagattgcagtacttcgcacgtggcctgcaggtctacattagacaactgagactggcgctccaaggcaagacaggcgaggccttgaaaacagaagagaacaaaataaaggtagtggcgctgaaaataacaaataacattaatgttctgataaaggatttgttccacatcccccctagctataaaagcaccgtgacactgtcctggaaacccgttcagaaagtggagatcggtcagaagcgcgctagcgaagatacaacttctggatctcccccaaagaagtcttcagctggccctaagcgggacgcacggcagatatataatccccctagcggtaaatattcttccaatctcggcaatttcaattacgaacgcagcctccaaggaaaatag

SEQ ID NO: 214714 - DNA, 1575 bp, Artificial Sequence
  Description of Artificial Sequence: Synthetic coding sequence
atgcctaccgtggaagaattgtaccggaactatgggatcctggccgatgctactgaacaggtaggtcagcataaggatgcataccaggtcattcttgacggcgttaaggggggaacaaaagagaagaggctggcggcacagttcattccaaagttcttcaagcatttccccgagctcgccgattccgcaatcaatgcacagttagatctctgtgaagacgaagacgtcagtattcgtcgccaagccatcaaggagctgcctcagttcgctactggggaaaatttgccgagggtggcagatatactaacacagctgctgcaaaccgatgactcagccgaattcaacctggtgaacaatgctctgctctccattttcaagatggacgcgaaaggaaccctgggcggactttttagccagatcctgcagggagaagacatcgtgcgcgaacgggcaattaagttcctgagtaccaagctgaaaactctcccagatgaagtactgactaaggaggtcgaagagctcattctcaccgagtccaagaaagtgctggaggatgtcaccggcgaggagtttgtcctcttcatgaagatcctgtctggattgaagtccctgcagactgtttcaggacgacagcagctggtggagttggtggccgagcaggccgacctcgagcaaaccttcaaccctagtgaccctgactgcgtggaccgccttctccagtgcactcgccaggcagtgccactttttagcaagaacgtccattccactcgcttcgtcacttatttttgtgaacaggtgctgcctaatttgggcacccttaccaccccagtcgagggcttggatattcagctcgaagtcctgaagctgctggcagaaatgtcaagcttttgtggagacatggaaaagctggaaaccaacctccggaagctgtttgataagctgttggagtacatgccccttcctcctgaagaagcagaaaacggtgagaacgccggaaatgaggagccaaagctgcagtttagctatgtggagtgtttattatatagctttcatcaacttggcagaaagctgcccgactttctcacagctaaactgaacgctgagaaactgaaagattttaagatacggcttcagtactttgccagaggcctgcaggtgtacattcggcaactgcgtctcgctctgcaggggaagactggcgaggcactgaaaactgaagaaaataagataaaagttgtggcacttaagattacaaacaacatcaacgtgctcattaaagacctgtttcatatccccccaagctacaagagcaccgttacgctgtcctggaagcccgtccagaaagttgagataggccagaagcgtgcctcagaagacaccacatcgggatcccctcccaagaagtcaagcgccggacccaagagggatgcaagacagatttataaccctccctccgggaaatatagctccaatctgggtaacttcaactacgaacagcgaggagccttcagaggcagccgcggaggtcgtggctggggtacgagaggaaataggtctagagggagactgtactag

SEQ ID NO: 214715 - DNA, 1533 bp, Artificial Sequence
  Description of Artificial Sequence: Synthetic coding sequence
atgccaacagtcgaagagctgtatcgaaactacggcatactggccgatgcaacagaacaggtggggcaacacaaagacgcatatcaggtcatcttggatggagtgaagggcggaactaaggagaagcgcttggccgcacaattcattcctaagttcttcaagcactttcctgaattagccgatagtgccatcaatgcccagcttgacctgtgtgaagatgaagatgtgtctattcgccgtcaggctattaaggaattgccacaatttgccaccggtgaaaatcttcctagggtggccgatatactgacacagctcctccagaccgatgattctgctgaatttaacctggtgaataacgccctgttgtcgatatttaaaatggatgcaaaagggacactcggcggactcttctcccagatcttgcaaggggaggacatcgttcgcgagcgtgctattaagttcttgtccaccaagctcaagaccctaccagacgaggttcttactaaggaggtggaggaattgattctgacagagtcaaaaaaagtcctggaagatgtgaccggagaggaattcgttctctttatgaagatcctctccggcctcaaaagtcttcagaccgtgtccgggagacagcagctcgtggaactggttgctgaacaggcagacctggaacaaaccttcaatccatccgatcccgattgcgtcgaccgtctgctgcagtgcaccagacaggccgtgccactcttcagcaaaaacgtccactcgactcgatttgtaacatatttttgtgagcaggtgttgccgaatctcggaactctcacaacccctgtggagggccttgatatccagctcgaagtgttaaaactgctggccgagatgtctagcttctgcggggacatggaaaaacttgagacgaatctcaggaaattgtttgacaaacttttagaatatatgcctctgccacctgaggaagctgaaaacggagagaatgcagggaacgaagagccgaaactccagttctcttacgtggagtgcctgctgtatagcttccaccaattgggcagaaaattgccagactttctcacagctaaacttaacgccgagaagttgaaggacttcaaaatcaggctgcagtattttgcccgagggctgcaggtgtatatccggcagctgagacttgccctccaggggaagactggcgaggccctgaagacagaagagaataaaatcaaggtcgttgctctaaagattacgaataacatcaatgtcctaattaaggacctctttcatataccgcctagttataagtccacagtcaccctgtcctggaagcccgtgcagaaggtcgagatcggccaaaaacgggcaagcgaggatactaccagcggctctccccctaaaaagagcagcgctggacccaaacgcgatgctaggcagatatacaaccctcccagtggaaagtactctagcaacttgggcaatttcaattacggagagcgctttaggttgggaacaagaaacatgcgcgattag

SEQ ID NO: 214716 - DNA, 1089 bp, Artificial Sequence
  Description of Artificial Sequence: Synthetic coding sequence
atgcaggctgaaagaggagcccgaggcggtcgcggtcggaggcctggacgcggaagaccgggaggcgaccgtcactccgagaggccaggcgcagccgctgccgtggcccgtggagggggaggaggcggaggcggtgatggtggaggtagacggggtcggggacgtggcagaggtttccgcggagccaggggcggtcgcggaggcggaggggcaccacgcggatctagacgcgaacctggcggatggggcgcaggggcttccgcgccagtcgaagacgacagcgacgcagaaacatacggagaagaaaatgacgaacagggcaactactctaagcgtaagattgtcagtaattgggaccgctatcaggacatagagaaagaagtgaacaacgaatccggcgagtcccagcggggaaccgatttctctgtgttgctgtccagcgcaggagatagtttctcacaattcaggttcgccgaagaaaaagaatgggatagtgaagcgtcttgcccaaaacagaacagtgccttctacgttgacagcgagctccttgtacgtgcattacaggagctgccgctctgtctcagacttaatgtggcagcggaactggttcagggtacagtgccactcgaggtgcctcaagtgaaaccaaaaagaaccgatgacggcaagggcctcgggatgcagctgaaggggccacttggtcctggaggacgcggacccatcttcgagttaaaaagcgtggctgccggatgtccagttctgctggggaaagacaatcctagtccaggaccttcgcgcgacagtcaaaagcccacaagtcctcttcagtccgccggtgaccacctcgaagaggagctagatctgttgcttaatttggacgcccctataaaagagggagataatattctccctgatcagacaagtcaggacctgaagtcgaaggaggacggcgaagtggttcaggaggaggaggtgtgcgcgaagccctccgtaactgaagagaagaacatggaacctgagcagccaagcacctcaaagaacgtgaccgaagaggagctggaggactggttggactccatgatatcatag

SEQ ID NO: 214717 - DNA, 4125 bp, Artificial Sequence
  Description of Artificial Sequence: Synthetic coding sequence
atgtccagctccttcttcaatcccagctttgccttttcttcccacttcgaccctgacggagcaccactgtcagaactctcctggccatcatcgctggcagtcgttgccgtctcattctccggcctgttcgcggtaatagtgctgatgctagcatgcctctgttgtaagaagggtggcatcggtttcaaagaatttgagaacgccgagggcgatgagtatgccgcagatttagctcagggatcacctgctaccgccgctcagaacggcccagatgtgtatgtactgccccttactgaagtgagcctgcccatggctaagcagcccggtaggagcgttcaattgctcaagtcaacagacgttggacgccactctctcttgtaccttaaggagatcgggagaggatggtttgggaaggtgtttttgggcgaggtcaactctggtatctctagcgcgcaagtggtggtcaaagaactgcaggcctcagcctccgtacaggagcagatgcaattcttggaggaagtgcagccataccgagccctcaagcacagtaaccttctgcagtgcttagcccaatgcgcggaagtgactccgtatctgttggtgatggaattttgtcccttaggcgacctaaaaggctacctgcggagttgccgggtggcggagagcatggctccagacccacgcactctccagcggatggcttgcgaggtggcatgcggtgtcctgcaccttcaccggaacaactttgtccacagcgacctggccctccggaactgtctgctgacagcagacctgactgtgaagattggcgactacggtctcgctcattgtaagtatcgggaagattatttcgtcactgcagatcagctgtgggttccattacgctggatcgcccctgaacttgtggatgaggtgcactctaatctgttggtcgtggatcaaaccaagagtgggaacgtatggagcctcggggtgactatctgggaactgtttgaactagggactcaaccgtacccacaacacagtgaccagcaagtgctcgcatataccgttagggaacagcagctgaaactgcccaagccccagttacaattgaccctttctgatcgctggtatgaagttatgcagttttgttggcttcagcctgaacaaaggccgactgcagaggaggtacacctcttattgagctatctctgtgccaaaggggctacagaagctgaggaggagttcgagcgccgttggaggagcctcaggcccggaggaggcggtgtcggcccaggcccaggcgctgccggaccaatgctcggcggtgtggtggaactcgctgctgcctcttcatttccgcttctggagcaatttgccggtgatgggttccatgctgacggagacgacgtcttgaccgtgactgagacatccaggggcctgaactttgagtacaaatgggaagctgggagaggagctgaagcgttccccgctaccctatcacccggaaggaccgcgagactccaggagctgtgtgcccctgacggcgctccgcctggcgtggttcccgtgctaagcgcccactcaccctctctaggctctgagtattttatccggctggaggaggcagctcccgcagctggccatgatcctgactgtgcaggatgtgccccttcgcctcctgctactgcggaccaggacgacgacagtgatggttccacagccgcatcccttgctatggaacctttactgggccatgggccacccgtggacgtgccatggggacgtggcgaccactaccctagaagatcactggctagagatcccctgtgcccatccagaagtccatctccttccgccggacccctcagtttagcggaagggggtgctgaggatgcagactggggcgtggccgctttttgtccagccttttttgaggaccccctgggtacttcccccctgggctcctcaggagctccacctctcccactgaccggagaagacgagctggaagaggttggagcccgtagagcggctcagagaggacattggagaagtaacgtgtctgccaacaataatagtggaagccgttgtccggaaagttgggaccctgtcagcgccggtggacatgccgaggggtgcccctctcctaagcaaaccccccgagctagccctgagcccggatatccgggagagccactgctgggcctgcaagccgcttctgctcaggaaccgggttgctgcccaggcctgccgcacttgtgttctgcacaaggcctggccccagctccttgcctcgtgacaccttcctggactgaaaccgccagcagcggaggggaccatccgcaggctgagccgaagttagccaccgaggcagaaggcactacgggaccccgactgcctctgccctctgtgccttcgccatcacaggagggcgctcccctcccaagcgaagaggcctctgcccctgatgccccagacgccttgccagactcccctacgccggctactgggggtgaggttagcgctatcaaactagccagcgcactgaacggtagcagctcatcgcccgaggtggaggccccttctagtgaagacgaggacacagcagaggcaacttctgggattttcactgatacaagctctgatgggttgcaagctaggaggcctgacgtcgtacctgccttccgatccttgcagaagcaggtgggtacacctgacagcctggacagtcttgacattcccagttccgcaagtgacgggggatacgaggtattctcaccatcagctacagggccatccgggggtcagcccagggcacttgactccggatacgacactgaaaactacgagtccccagagttcgtccttaaggaggctcaggaggggtgcgagccccaagcgttcgccgagctggccagcgagggtgaaggtccagggcctgaaaccaggctcagcactagcctgagcggacttaacgagaagaatccctaccgtgattctgcctatttctccgacctggaggctgaagccgaagccactagtgggcctgaaaagaagtgtggtggggacagggcccctgggccagaactgggcctgccatcgacaggacagcctagcgagcaggtttgtttacgcccaggggtgtccggcgaagcacaaggttctggtccgggagaggtcttgcccccactcctgcagctagagggctccagccctgaaccatccacttgccctagcggcctggtgccagagcccccagaaccccaaggacccgcaaaggtgcgacccggaccttctccatcctgctcacagttctttttgcttacacctgtgccattgaggagcgagggcaattcttccgagttccagggcccacccggacttctgtccgggcctgcccctcagaaacgtatgggaggacctgggacacccagggcaccactcaggttagccctcccagggctccctgcagctctggaggggagaccagaagaggaggaggaggactctgaagatagtgacgagagcgacgaggagttgcggtgctattctgtgcaggaaccatcagaggattctgaggaggaggccccagctgtccccgttgttgtcgctgaatctcaatccgctcgaaatttacgctctctgctcaaaatgcccagtttgctgtccgaaaccttttgcgaagatctggagagaaagaaaaaagccgttagcttcttcgacgatgttactgtgtatctctttgatcaggagtcacctacgagggagctgggggagccgttccccggtgcaaaggagtcccccccaacattcttacgcggttctccaggcagccccagcgccccaaatagacctcaacaggctgacggctctccaaacggaagcacagcagaggagggcggtggattcgcgtgggacgatgacttcccactcatgaccgctaaggccgctttcgcgatggccctggaccctgcagctcctgccccagctgccccaaccccgacacccgctccattctcgaggtttaccgtttcccctgcacccacatcccgcttctcaatcacccacgtgagcgacagtgatgctgaaagtaagcgcggaccagaagccggagccggaggagaatcgaaggaggcatag

SEQ ID NO: 214718 - DNA, 2640 bp, Artificial Sequence
  Description of Artificial Sequence: Synthetic coding sequence
atgagttcgagttttttcaatcccagctttgccttttcatctcactttgatccggatggggctccactgagtgagctctcttggccttcctccctggctgttgttgccgtgtcgttttcggggctctttgccgtgattgtactcatgctggcttgcctatgctgcaagaaaggcggtattggatttaaagagtttgagaatgccgagggggacgaatatgctgcggatctcgcccagggatcacccgcaacggccgcacaaaacggacccgacgtatatgtcctgccactgactgaggtgtccctgcctatggccaagcaaccaggtaggtccgtgcagctcctgaagtcaactgacgttggccgacactccctcctctatctgaaggagattggtagaggctggtttggaaaagtgttcctgggcgaggtgaattccggaatcagtagtgcccaagtcgttgtgaaggaacttcaagctagtgccagcgtgcaggagcagatgcagtttctcgaggaagtgcagccttacagagcattgaagcattcgaatctgctgcagtgcctcgcccagtgtgctgaggtgacgccataccttcttgtgatggagttttgcccgctaggggacctcaagggctacctgcggtcctgcagggtggctgagagcatggctcccgatccacgaacactccagcggatggcatgcgaagtggcctgtggtgttctccacctgcaccgtaacaattttgtacactcagatctggcccttcgtaactgcctcctgaccgctgaccttaccgtgaaaattggtgactatggactggcccattgcaagtatagagaggactacttcgtgaccgcagaccagctgtgggtccccctacggtggatcgctcctgaacttgtcgatgaggtgcactcaaacctgctcgtagtggatcagacaaagagcggcaacgtttggagccttggtgtcaccatatgggagcttttcgagctcgggacacagccttacccacagcatagtgatcagcaggtcctggcatacacagtccgcgagcagcagctcaaactgcctaagccgcagctccaactgaccttgtccgaccgatggtatgaagtgatgcagttttgctggctgcagccagagcagcggcctaccgccgaggaggtccatctgctgctgtcctacctgtgtgccaaaggagcaaccgaggccgaggaagaatttgaaaggaggtggaggagtttaaggcccggtggaggaggggtgggcccagggcctggggctgccggtcccatgctggggggagtggtagagctagctgcggcatcgtctttcccccttttggaacaattcgctggggacggatttcatgctgatggcgatgatgttctaaccgagctttgtgcaccagatggcgcaccgcctggagtggtgcccgttctgagtgctcattccccatcactgggctctgagtatttcattaggttagaagaagccgctccggctgcaggtcatgatcctgattgcgcagggtgtgctccctcacctccggcaactgccgaccaggacgatgatagcgacggctctacagccgcaagcctggccatggagccgctcttagggcatgggccacccgtggacgttccttgggggagaggcgaccattatccgagaaggtctctggctcgcgatcccctgtgccctagccgcagtcccagtccatcggcaggaccgttatcactggcagaaggcggagctgaggatgctgattggggagtggcagccttttgccctgctttttttgaagacccactgggaaccagccctctgggctccagcggcgcaccacctctcccgcttacgggagaagatgagttggaggaggtcggggctcgacgggcagcacaacgcggtcactggcgaagcaatgtgagcgccaataataacagcggatctaggtgccctgagtcttgggacccagtctccgcaggcggacatgccgagggctgtccttcccccaaacagacacctcgcgctagtccagagcccggatatccgggtgaacccttgcttgggctgcaggccgcttctgctcaagaacctggatgttgtccaggcttaccacatctctgttcagcccagggcctagcaccagccccttgtctggtgactcccagctggaccgagaccgccagttctggtggagaccacccacaggcagagcccaagctggcgacggaggctgaggggaccactggcccacggctgcctctgccatctgttcctagtccctctcaagagggcgctccccttccaagtgaagaagcctcggcgccagacgctcccgacgccctgcctgacagccccactccagccactggtggtgaggtttctgcaataaaactggctagcgccttgaatggcagctctagctcccccgaggtggaagccccatctagcgaagatgaggatacagccgaagctacttcagggatattcacagataccagttccgacggtttgcaggcacgaaggcctgacgtggtgccagcatttagaagtcttcagaaacagtggcctcagagggaggaatccctccctcgcctctgcctcctgttgcgccctcgaggttag

SEQ ID NO: 214719 - DNA, 3984 bp, Artificial Sequence
  Description of Artificial Sequence: Synthetic coding sequence
taacatcaggtgaaggtgcagggatgctggggaaggtggcgctggcaggagttcgaaaacgcagagggcgacgagtacgcagctgacctcgcccagggttccccagcaacggcggctcagaatgggcctgatgtctacgtgcttcccctcacagaggtgagcctccctatggcaaaacagccgggtagaagcgttcagctgctcaagtccaccgacgtggggaggcattccctgttgtatctgaaagagatcggcaggggatggtttggtaaggtctttcttggagaagtcaactccggaatcagttcagcccaagtcgtggtgaaggagttgcaggcgtccgcaagcgtgcaggagcaaatgcagttcctggaggaggtccaaccctacagagccttgaagcactcaaacctgctccagtgcctggcacagtgtgccgaggttactccctatttgttagtaatggagttctgccccctcggagacctcaaagggtacctccggtcttgtcgagttgccgagagtatggccccagaccctcggacactccagcggatggcctgtgaagtcgcttgtggcgtcttgcatctgcataggaataactttgtccactcagatctggccttgaggaactgcttgctgacagctgatttgaccgtcaagatcggcgactatggactcgcacattgtaagtaccgcgaagactatttcgtgaccgcagatcagttatgggttcccctgaggtggatcgctcctgagctggtggatgaagtccatagcaacttactggttgtggatcagactaagtcaggtaacgtatggagcctcggcgtgaccatctgggagctgttcgagctaggcacacaaccctacccgcagcattctgaccagcaggtactggcctacaccgtacgcgagcagcaactcaagttacccaagccccagctccagctgaccctctccgaccggtggtacgaggttatgcagttctgctggctgcagccagagcaacgccctaccgccgaggaggtccatctgctgctaagctatctgtgcgccaagggagccacagaggctgaagaggaattcgagcgcagatggcggtcgttgcgcccagggggaggcggagtgggacccggaccaggtgccgctgggcctatgctggggggagtggtggagctggcggcagcatcctcattcccactcctagaacaattcgctggagatggattccacgcagacggggacgatgttcttactgtcaccgagacatcccggggactcaacttcgagtacaagtgggaggcagggaggggagccgaggccttcccagctaccctgtcgccaggtcgaacggcccgtctccaggagctttgcgccccagacggcgcaccgccaggcgtcgttcctgtgcttagtgctcacagcccatcattgggcagtgagtatttcatccgcctcgaggaagctgccccagccgctggacatgatcctgactgtgccggttgtgctccctcacccccagccacagccgatcaagatgacgacagcgatggatccactgccgcttcactcgcaatggagccgttgttaggccatgggccaccggtagacgtgccatggggcaggggggaccactatcctaggaggtccctggccagggatcctttatgtccaagtcggtctccctccccctcagctgggcctctgtccctggctgaggggggtgcagaggacgccgattggggcgtcgcagccttctgcccggcatttttcgaggatccgctgggaacttcacccctggggagcagcggggcaccgcctctgcccttgaccggagaagatgagctcgaagaggttggggctaggagggcagcccagcgcggacactggcgtagcaacgtgtctgctaataacaactccggctcccggtgcccagaatcatgggaccccgtgagtgccggtgggcacgctgaggggtgtccatcccctaagcagacaccacgggcttctccagagccaggctaccccggtgagcctctcctgggacttcaagctgcttctgctcaggagccaggctgttgccctgggctgccacatctgtgcagcgcccagggattggctccagcaccatgccttgtgactccttcttggaccgaaacggctagcagtggaggggaccacccgcaggccgaaccaaagctcgccacagaagccgagggaactaccggcccacggttgccactcccttctgtaccctctccctcacaggagggggcacccctgccaagcgaagaagctagcgctcccgatgcacccgacgccctccctgatagccccaccccagcaactggcggagaggtctcagccattaaactggcctctgccctgaacggatcttcaagctcccctgaggtcgaggctccgtccagcgaagacgaggacacggccgaggccacaagcggcatctttacagacacatcctctgacggcctccaggcacgacgtcctgacgttgttccagcattcagatcactgcagaagcaggtgggaacacctgactctttggacagtctggatatcccgtcaagtgcttcagacgggggttatgaggtgtttagcccctccgctacgggaccaagcggtggccagccaagagcccttgattctggttacgacactgaaaattacgaaagcccggaattcgtactgaaggaagcccaagaagggtgtgagccccaggcgttcgccgagctcgcgtcggagggcgagggaccaggcccagagactagactgagcacatctctgtctggactcaacgaaaagaatccataccgcgactctgcatatttctctgatttggaagcagaagccgaagccacctctggacctgagaagaagtgtggtggagatcgagcccctggacccgaactgggcctgccctctaccgggcagcctagtgaacaggtttgcctgcggccaggagtgtccggtgaggcccaagggagtggacctggagaagtgctgcctccgctcctgcagctcgaagggagcagccccgaaccatccacttgccccagcgggctggtacctgaaccaccagaacctcagggcccagccaaggtgagacccggtcctagcccaagctgcagtcagttttttttgcttactccggtgccactgcggagtgaaggtaattctagtgagtttcagggcccaccaggacttttgtccgggcctgcaccccagaaacgcatgggtggccctgggacgccacgggcacctctgaggctggctttacccggactgcccgcagctctggagggtcgccctgaagaagaggaggaagatagcgaggatagcgacgaatccgatgaggaattgcgctgttactccgtgcaagaacccagcgaggactctgaagaggaggccccagccgtccctgtcgtagttgccgagagtcagtctgcgagaaacctgcggtcattgctgaagatgccatcgctgctttctgagaccttctgcgaagatctggaaaggaagaagaaggcagtaagcttctttgatgacgtgacagtgtatctgtttgaccaggagagccctacgagggaactcggagaacctttccccggtgcaaaagagtctcctccgacatttcttcggggatcacccggatcccctagcgcccctaacaggcctcaacaggctgatggatccccaaatggctcaacagccgaggaggggggagggttcgcctgggatgacgatttcccactgatgacagctaaagccgcatttgcaatggcacttgatccagccgcacctgctcctgccgcaccgaccccgaccccagcaccgttttctcgcttcactgtgtctccagctcctacttcacggttttcgattacccacgtgagtgattccgacgccgaatccaagcgaggccctgaagccggagcaggtggcgaatccaaagaagcctag

SEQ ID NO: 214720 - DNA, 417 bp, Artificial Sequence
  Description of Artificial Sequence: Synthetic coding sequence
atggaggaggaggccgagactgaggaacagcaacgcttcagctaccagcaacgtttaaaggcagctgtgcattacaccgtgggatgcctgtgcgaagaggtggcgctcgataaagaaatgcaattctctaaacagaccattgcagcgatatccgagctcaccttccggcagtgcgaaaactttgcgaaggacctagaaatgttcgcaaggcacgctaaaaggacaacaatcaacactgaggacgtgaagctgttggctagacgttcaaatagtctgctaaaatacatcacggataaaagcgaagagatcgctcagattaacctagaaagaaaagcgcagaagaagaagaagtctgaggacggtagtaaaaacagccgacaacctgccgaggcaggcgtggtggaatccgagaattag

SEQ ID NO: 214721 - DNA, 495 bp, Artificial Sequence
  Description of Artificial Sequence: Synthetic coding sequence
atggaggaggaagctgaaacagaagagcaacagcgattcagttaccaacagaggctgaaggcggcagtgcactacacagtcgggtgcctctgcgaggaagtggctcttgataaggagatgcagttcagcaagcaaactatcgcagctatctccgagctcaccttccgtcagtgcgagaatttcgctaaagatttggaaatgtttgctagacacgcgaaacggaccactatcaacacagaggacgtgaagttgctggcacggaggagcaatagcctgcacatgcaagaagctgccggaatcagaaagtcatctctgttgaccttcctggcctggtggtttgagtggacctctcaagcttccgcaggcccactgataggagaggaggccagggaggtcgcacggcgtcaagaaggcgcacccccacagcagtctgctcggagggacagaatgccttgcagaaactttttctggaagaccttttcctcctgtaaatag

SEQ ID NO: 214722 - DNA, 234 bp, Artificial Sequence
  Description of Artificial Sequence: Synthetic coding sequence
atggaggaggaagccgagaccgaggagcaacaacgcttcagctatcaacagcgcctgaaggccgcagtgcactatacagtggggtgtttgtgtgaagaggttgccttagacaaggaaatgcaatttagcaagcagaccatagcagcaatctctgaattgacattcaggcaatgcgaaaatttcgcaaaagatcttgagatgttcgcaagtatttgtcgaaagagacaggaatag

SEQ ID NO: 214723 - DNA, 921 bp, Artificial Sequence
  Description of Artificial Sequence: Synthetic coding sequence
atgtcaaatgttaacttgagtgtctctgacttctggcgggtcatgatgagagtgtgttggctggtccgccaggattctcgacatcagcgcattcgcctgccccatctggaagctgtggtgataggtagagggccagaaacaaaaataaccgacaagaagtgttcccgccagcaggtccagcttaaggcagagtgcaataagggatacgtaaaggttaagcaggtaggagtcaacccgacttctattgatagtgtagttattggaaaagatcaggaagtcaaactccagcctggccaggtgttacacatggtcaacgaactctacccttacatcgtggagttcgaggaagaggctaaaaaccctggccttgagacccacaggaagcgcaaaagatcaggaaacagtgattcaattgagcgcgacgctgcccaggaagcggaagctggcacaggcttagagccagggtccaattctggacagtgttccgtgcccctgaaaaaaggcaaagacgctccaatcaaaaaggaaagcctgggtcactggagccagggtctgaagattagcatgcaggacccgaagatgcaggtttacaaggacgaacaggtggttgtgatcaaagataagtatcccaaagctcgataccactggttggtgctcccatggacatctatttcaagcttgaaagcggtcgcacgcgagcacctcgagctgctcaaacacatgcatacagtcggcgagaaggtgatagtcgacttcgccggatcatcaaagctgagatttcgactggggtaccatgccatccccagcatgtctcacgtgcacctccacgtgataagtcaggacttcgattctccctgtctcaagaacaaaaaacactggaattccttcaataccgaatatttcttggagtctcaggaatag

SEQ ID NO: 214724 - DNA, 1014 bp, Artificial Sequence
  Description of Artificial Sequence: Synthetic coding sequence
atgagcaatgttaacctaagtgtgtccgacttctggagagttatgatgcgagtatgttggctagtgagacaagattccagacaccaaaggataagactaccccacctggaggccgtggtgatcggtcgcggacctgagactaagatcactgataagaaatgttcccggcaacaggtccagctaaaggcagaatgtaacaaagggtatgtgaaagtaaagcaggtgggcgtgaatccgacatcaattgactcagtcgtcattggcaaagaccaggaggtgaagctccagcctggtcaagtccttcatatggtcaacgaactgtacccctatattgtcgaattcgaggaggaggcaaaaaaccctgggctggagacgcatcgaaagagaaagcgtagcgggaattctgatagtatagagcgggatgccgcacaagaggccgaggccggaacaggcctggaaccgggtagtaatagcgggcaatgttcggttccactaaagaagggcaaggatgctccaatcaagaaaaaggtttataaggacgaacaagtcgtggtgatcaaggacaaatatcccaaagcacggtatcactggttggtgctgccgtggacatctatctctagtctgaaggcggtggccagagagcacttagaactgttgaagcatatgcatacagtgggagagaaggtgatcgtggatttcgctggctcgtcaaagctaaggtttcggctgggatatcatgctattcccagtatgtctcacgttcacctccatgtgatctctcaggattttgattcgccatgcttgaaaaataaaaagcattggaatagtttcaatactgagtactttctggagtcacaggctgtgatcgagatggtgcaggaggctggcagggtgaccgttcgggacggcatgcccgagctgttgaaacttccgcttcgctgccatgagtgccagcagcttctcccatcaatcccgcagctaaaggagcacctgagaaagcattggactcagtag

SEQ ID NO: 214725 - DNA, 1029 bp, Artificial Sequence
  Description of Artificial Sequence: Synthetic coding sequence
atgatgagagtttgttggctagtgagacaagactcccgccatcagagaatacgacttccacacctggaggctgtcgtaattggaagaggtcctgagacaaagattaccgataaaaagtgttcccgacagcaggtccagctgaaggcagaatgcaataaaggctatgtaaaggtgaagcaagtaggagtcaaccctacatcgattgacagtgtggtcatcgggaaggatcaggaggttaagcttcagcccggtcaggtgttacatatggtgaacgaactctacccttacatcgtggagtttgaggaggaggcgaaaaacccaggcctagaaacccacaggaagcggaagcgctctgggaatagtgactctattgagagagacgccgctcaggaagcagaggcgggaaccggccttgaaccaggcagcaactctggccagtgttctgtgcctctcaaaaaaggcaaagacgcaccgatcaagaaagagagccttggtcattggagccagggactcaaaatcagcatgcaggatcccaagatgcaggtctacaaggacgagcaggtcgtggtgatcaaggacaagtaccctaaggctcgatatcattggttggtccttccatggacctccataagttctcttaaagcagtggctcgcgaacacttagaattgttaaagcatatgcacactgtgggagagaaagtgatcgtggacttcgcagggtcatccaagctgaggtttcggctggggtatcatgcaatcccatccatgtcacatgtgcatctgcatgtgatctcacaggactttgacagcccttgcctgaagaacaagaagcactggaatagtttcaatacggaatacttcctggagagccaagctgtcatcgagatggtgcaagaagccggtcgagtgacagtacgggatggcatgccagaattactcaagcttccactgcgatgtcacgaatgtcagcaactcctacccagcattccacagctcaaggagcatctgcggaagcattggacacagtag

SEQ ID NO: 214726 - DNA, 1071 bp, Artificial Sequence
  Description of Artificial Sequence: Synthetic coding sequence
atgtcaaatgtgaatttgtcggtcagcgatttctggcgcgttatgatgagagtttgctggttggtgcgccaagattccaggcaccaaagaatacgccttccacacctggaggcagtcgtgataggcaggggcccagagaccaagatcaccgacaaaaagtgctcccggcagcaagtgcagctgaaggccgagtgcaataagggctacgttaaggtgaaacaagtgggagtgaaccccacttccatcgatagcgtggttattgggaaggaccaggaggtcaagttacagcccggtcaggtcttgcatatggtgaatgagttgtacccttacattgtggagttcgaagaggaggccaagaatcccggtttggaaacccatcgtaagagaaaacgcagtggtaattcagactccattgaaagggacgctgctcaagaagcagaggccggaactggtctggagcccggatctaactcagggcaatgtagcgtgccactgaagaagggtaaggacgctccgataaaaaaagagtccctgggacactggtcacagggcctcaaaattagcatgcaggatccaaaaatgcaggtctacaaggacgagcaagtagttgtcatcaaggacaagtaccccaaggcccgttatcattggcttgtactcccttggacatcaatcagcagcttgaaggccgttgccagagagcatttagaactcctgaagcatatgcacactgtgggtgagaaggttatagttgattttgccggatcctcaaaactgcgcttcaggctcggctatcacgctatccccagcatgagccacgtccacctacacgtaatctctcaggatttcgacagtccctgtctgaaaaacaaaaagcattggaactcttttaacacagagtatttcctggaatcccaggcagtcattgagatggtgcaggaggcgggtcgtgtgacagtcagggatggaatgcccgagctccttaagctgccattgagatgccacgaatgccagcagctgctcccctccatacctcaactgaaagagcatttaaggaaacattggacacaatag

SEQ ID NO: 214727 - DNA, 921 bp, Artificial Sequence
  Description of Artificial Sequence: Synthetic coding sequence
atgagcaatgtgaacctttctgtgagtgacttctggagagtcatgatgagggtgtgctggctggtccggcaagattcccgtcaccaaaggataaggctgccgcatctcgaagcagtggtcatcggacggggtcccgaaaccaaaattaccgataaaaagtgcagtcgacagcaggtccagctcaaggccgagtgtaacaaagggtacgtgaaagtgaaacaggtcggcgtgaatccaacttccatcgatagtgtagtaatcgggaaagaccaagaggttaagctgcaaccgggtcaagtcctacacatggtgaatgaattatatccatacatcgttgagttcgaggaggaagccaagaaccctgggctggaaactcacaggaagaggaaacggtctggtaacagcgactcaattgagagggacgctgcccaggaggccgaggctggaaccggcttagaacctgggagcaactccgggcaatgcagcgtgccccttaagaaaggtaaggatgcccctatcaaaaaagaatctttgggtcactggagccagggcctgaagattagcatgcaggacccgaagatgcaggtgtataaagatgagcaagtggtggtcataaaggacaagtatccaaaggctcggtaccattggcttgtgttaccatggacaagcattagctcactcaaagccgtcgctcgagagcatctggagctcctgaaacatatgcatacagtcggagaaaaggtgattgtggacttcgccggtagcagtaagcttaggttccgtctgggctaccacgccatacccagtatgtcccacgtacatctccacgtgatcagccaggacttcgatagcccgtgcttgaagaataagaaacattggaattcttttaataccgagtactttctcgaatcacaggagtag

SEQ ID NO: 214728 - DNA, 855 bp, Artificial Sequence
  Description of Artificial Sequence: Synthetic coding sequence
atgtctaatgtaaatctgagcgtctcagacttttggagagtgatgatgcgggtgtgctggttggttaggcaagattccaggcatcagcgtataagacttccacacttggaagccgtggtgatcggcagaggacccgaaacaaaaattaccgataagaagtgtagtcgacaacaggtgcagcttaaagcagagtgcaacaaggggtatgtgaaagtaaagcaggtgggggttaatcctacctcaatcgacagcgtggtaattggaaaggaccaggaggtcaagctccaacccggacaggtgctgcacatggaatccttgggacattggagtcagggtctcaagatcagtatgcaggaccctaagatgcaggtctacaaggacgaacaggtcgtggtcatcaaagataaatatcccaaagctcgctaccattggttagtgctcccttggacaagtatctcttccttaaaggccgtggcgagggaacacctggaactcctgaaacacatgcacactgttggcgaaaaagtgatcgtggacttcgccggttcctctaagttgcggttcagactgggatatcacgccattccgtccatgtcccacgtgcacttgcacgtgatcagccaagattttgactctccgtgtctcaagaacaaaaaacactggaattctttcaatactgaatacttcctggaatctcaggccgttattgagatggtacaagaggcagggagagtgaccgtccgggacggcatgcctgagctgttgaagctccctctgaggtgtcacgagtgccagcagctgctgcctagcatcccgcagctgaaggaacatctgagaaagcactggacacaatag

SEQ ID NO: 214729 - DNA, 579 bp, Artificial Sequence
  Description of Artificial Sequence: Synthetic coding sequence
atgatgagggtgtgttggcttgtacgacaggatagtaggcaccaacggatcaggctgcctcacctcgaagccgtggtgatcgggaggggccctgagacgaagatcactgacaaaaagtgcagtcggcaacaggtgcagcttaaggccgagtgcaacaagggttacgtgaaggtcaagcaggtgggggtgaatcccaccagcatcgatagcgtggtgattggaaaagaccaggaagttaagctgcaaccaggtcaggtcctccacatggttaatgaactgtacccatacattgtagaattcgaagaggaagccaagaatcccggactggagactcacaggaagagaaagcgatcagggaatagcgattccatagaacgcgatgctgcgcaggaggccgaagctgggaccggacttgagccaggtagcaattcagggcagtgctcggttccactgaaaaagggaaaggacgctcctattaaaaaggaatctcttggccactggtcacagggactgaaaatatcgatgcaagaccctaagatgcagccttgcacatccagctgtgaccagcccggtttttag

SEQ ID NO: 214730 - DNA, 1029 bp, Artificial Sequence
  Description of Artificial Sequence: Synthetic coding sequence
atgatgagagtttgctggctcgtgcgacaggactcccgccatcagcgcattagactgccacacctggaagctgtagtgattggaagagggcctgagaccaagatcactgataagaaatgctccaggcagcaggtgcagttgaaggcagaatgtaacaaaggctacgtgaaagtgaaacaggttggggttaatcccacaagtatcgactcagtggtgattggcaaagatcaggaggtgaaactccagcccggacaagtgcttcatatggtgaacgagctgtatccgtatattgtagaattcgaagaagaagcgaagaacccagggctggaaactcacaggaagcgaaagcggtcgggcaatagcgacagcattgagcgagatgccgctcaagaggctgaggcgggaacagggttagaacctggatcaaattcaggacaatgttccgtgccactgaagaagggaaaagacgcacccataaagaaagagtccctcggacactggagccaggggctgaaaatcagcatgcaggacccgaagatgcaggtctataaggatgaacaggtggtcgtgattaaagataagtatccaaaggccagatatcactggttggtgctcccttggaccagcatctccagccttaaggctgtcgctcgagagcatttagagcttctgaaacacatgcatactgtgggcgagaaagtgatcgtggactttgctggatcaagcaaactgaggtttcgcctcggctaccacgccattccaagcatgtcccacgtccacctgcacgttatatctcaggactttgatagcccctgcctgaagaacaaaaaacactggaatagcttcaacacagaatatttcctcgaatctcaggcagtgatagagatggtgcaggaggctggtagagtgactgtccgcgacggcatgcctgagctgctcaagctcccactacgctgccatgaatgtcagcagctcttgcctagtatcccacagctcaaggagcatctgaggaagcactggacccagtag

SEQ ID NO: 214731 - DNA, 909 bp, Artificial Sequence
  Description of Artificial Sequence: Synthetic coding sequence
atgagcaacgtgaacctgtctgtgagcgatttttggcgggtaatgatgcgcgtgtgttggctcgtgagacaggattctaggcatcagcgaatccgcttgccccacctggaggccgtggtaatcggtcgaggccctgagactaagatcacggacaagaaatgttctcgacaacaagaattcgaagaagaggctaagaatccgggactcgagacccatcgcaagaggaaaaggagcggtaactcagattccattgagagagacgccgcacaggaagccgaggccggtacaggcctggagccaggttccaattcaggacagtgctccgtacctttgaaaaaaggcaaggatgctcctataaagaaagagtcactgggtcactggtcacagggcctgaagatctcaatgcaggatcctaaaatgcaggtgtacaaagatgaacaagtagtggtgatcaaggacaagtaccccaaggcacgctatcactggttagttctgccctggacatccatttcctctcttaaggctgtggctagggaacacttggaattattaaagcacatgcacaccgtgggcgagaaggtaatcgttgatttcgctggttctagcaagttacggtttcgactgggctaccacgccattccatctatgtcccacgttcacttgcacgttatttcacaggacttcgactctccttgcctgaagaacaagaagcattggaacagtttcaacaccgagtactttctggaaagccaggccgtcattgaaatggtccaagaggctggcagagtaaccgtgcgggacgggatgcctgagctgctgaaactgccgctccggtgccacgagtgtcaacagctgctccctagcattcctcagctgaaggagcatcttagaaaacattggacacagtag

SEQ ID NO: 214732 - DNA, 1029 bp, Artificial Sequence
  Description of Artificial Sequence: Synthetic coding sequence
atgatgcgggtgtgctggttagtgcgccaggatagcagacatcagagaatccgcctaccacatcttgaggcggttgtgatcggcagagggcctgagactaaaattaccgataaaaagtgtagtcgtcagcaggtacagctgaaagctgagtgcaacaaaggatatgtgaaagtcaagcaggtaggcgtaaatcccacatcaattgattccgtggttattgggaaagaccaggaagtgaaactgcagcccggacaggtgcttcacatggttaacgagctgtacccctacattgtggagtttgaagaggaggctaagaatcccggactcgagacacaccgaaaacgtaagcgcagcgggaacagcgattctatcgagcgagacgccgctcaagaggctgaggccggtactgggctggaaccgggaagtaatagcggacagtgtagtgtcccacttaagaaaggtaaagacgcacctatcaaaaaggagtcacttggccattggtcccaaggactaaagatctctatgcaagaccccaagatgcaggtttacaaggacgaacaagtggtagtgataaaggacaaatacccgaaggcaaggtatcactggttagttttaccgtggacttcgattagtagcctaaaggccgtggcacgagagcacctggagctgttgaaacacatgcatacagtgggagaaaaggtgattgttgattttgctggctcctccaaacttaggttcaggttaggatatcacgctatcccttcaatgagccacgtccatcttcacgttatttctcaagattttgactccccttgtctaaaaaacaagaaacattggaactcttttaataccgaatactttctggagtctcaggccgtcatcgagatggtgcaggaagctggcagagttactgttcgggatggaatgcctgaacttctgaagcttcctctgagatgtcatgagtgtcagcagctgctgccctctatccctcaactgaaggagcacttgcgtaagcactggacacagtag

SEQ ID NO: 214733 - DNA, 687 bp, Artificial Sequence
  Description of Artificial Sequence: Synthetic coding sequence
atgtatattatcgcccaatgcgtgggcgctatcgtggccactgccattctaagtggtataacctcctcactgactggaaattcccttggcagaaacgatttggcggacggagtgaacagtggtcagggcttgggcatcgaaatcatcggaacactccagctggttctgtgcgttcttgccactactgataggcggcgtagggacctagggggtagcgcacctctagcaatcggcctgagcgtggcactgggccatcttctcgctattgactacactggttgtgggatcaaccctgctcggtcctttggatcagccgttataacacacaatttcagtaaccattggattttttgggtgggaccgtttatcggcggagccctggcggtactgatctacgactttattttagccccaaggtcatctgatctaaccgatcgcgtgaaagtgtggaccagtggccaggtggaagagtacgaccttgacgccgatgatatcaactcccggagctttttgggtaccaaaatctatcagtttacacacagtctggaagtggtggaagaggtgaaggaaagggatcctcccgcatccaggccatctgagcacgatggtcggtgtgccagaaagtcacctcttgccccaaagctgctgaccgatagccccgcacaagtaccaggtattctgccatag

SEQ ID NO: 214734 - DNA, 810 bp, Artificial Sequence
  Description of Artificial Sequence: Synthetic coding sequence
atggccagtgagtttaaaaagaagctgttctggcgcgctgtggtggctgaattcctagcgactactctgttcgtatttatctctatcgggagcgcactcggctttaaataccccgttgggaataatcagactgctgtgcaggataatgtgaaagtaagtctggcgtttggactgagcatcgctacgctggcccagagcgtgggccacatatctggtgctcatctcaaccctgccgtcacactggggctgctcttgtcatgtcagatttccatcttccgagcactgatgtatataatcgcacagtgtgtcggggctatcgtggccacagcgatactaagtggaattacttcctcacttactgggaactctctgggtcgaaacgatctcgccgacggcgtcaattccggccagggattggggattgagatcatcggaactttgcagcttgtcttatgtgtgctggccactacagaccgaaggagaagagatctgggcggatctgcacctctagccattggtctgtctgttgcgcttggacacctgctggccatagattacacaggctgcgggataaacccagcaagaagttttggtagcgcggtgattactcataatttctctaaccattggattttttgggtgggaccctttattggaggagcgctcgctgtgctgatctacgacttcatcttggctcctcggagttcggatctcaccgaccgcgtcaaagtctggaccagcggtcaagtggaggagtacgacctcgacgcggacgatatcaactcccgcgtagagatgaaacccaagtag

SEQ ID NO: 214735 - DNA, 657 bp, Artificial Sequence
  Description of Artificial Sequence: Synthetic coding sequence
atgttttggacgttcggctacgaggctgtctcaccggcaggaccctctcacctgttcgcttccctccttctgggtgtgctgctgactatcacttttatgcctggggctaggcccctgcccttggtgctcgtcccccaaaatacactagcctggatgcagttggatgccaaggcccctgcccatccgagacctctccagcttctggggagagtgggaccgggttctaggcaactcgctgacggcgtaaattcaggtcaaggccttggcatcgagataattggcaccttacagttggtgctgtgcgtccttgcaaccactgataggcgtaggagagatctggggggaagcgctcctctcgctatcggcttgtccgtggccctcgggcacctgcttgcaattgattacaccggctgcggaataaatcctgctagaagttttgggtctgccgttattacccacaatttctctaatcattggattttttgggtggggccattcatcggcggagctctggccgttctgatttatgactttattctcgctccccgatcctccgatctgactgatagagttaaggtctggacttcaggccaggtagaggagtacgacctggatgcagacgacatcaattctagagtggaaatgaagcctaagtag

SEQ ID NO: 214736 - DNA, 465 bp, Artificial Sequence
  Description of Artificial Sequence: Synthetic coding sequence
atgcagtccggcatgggatggaatgttcttgatttttggctggccgatggggtgaattctggtcaaggtcttgggattgaaatcattgggaccctgcaactagtcctctgtgtgctcgctaccacagatagacgcaggagggatcttggcggaagtgcgccattagcgattgggctttctgtggccttgggtcatctcctggcaatcgattacactggctgtggaataaacccggctcgcagctttggaagcgcagtgataactcataacttctctaatcattggattttctgggtggggccttttattggcggtgcgctagcggtcttgatctatgatttcatactggcccctaggagttccgaccttacagaccgggtgaaagtctggacatcgggacaggtggaggagtatgaccttgatgcagacgatatcaacagtagggttgaaatgaaaccaaaatag

SEQ ID NO: 214737 - DNA, 765 bp, Artificial Sequence
  Description of Artificial Sequence: Synthetic coding sequence
atggcctctgaatttaagaagaaactgttctggagagccgtcgtggcggaatttttggctaccactttgttcgtttttataagcatcgggtctgccttgggatttaagtatcctgttggaaataatcagaccgcggtgcaggataacgtgaaagtcagtctagcgttcggtctctcaatcgcaacccttgcgcagtctgtcgggcacattagtggggcacacctgaatccagccgtaactttgggacttttactgtcttgtcagatctctattgtggccaccgccatactcagcggcatcacaagctcgctgactggtaattccttggggcgaaacgacttagcagatggtgtaaattccggccagggactgggcattgaaattattggaacactccaactggtcctgtgtgtcctggccaccaccgatcggcgaagacgtgaccttgggggaagcgcgcctctcgctattggactctccgtagcccttgggcatctgctcgccattgactataccggctgcggaattaacccggctcggagctttggatcagctgttataacacacaacttttccaaccactggatcttctgggtcggcccttttataggcggtgccctggctgttctgatttacgacttcatcctcgctcctagatcttctgacctcacagaccgagtgaaagtttggacttccggacaagtagaggagtatgatctggatgctgacgatattaactccagagtggagatgaagccaaaatag

SEQ ID NO: 214738 - DNA, 990 bp, Artificial Sequence
  Description of Artificial Sequence: Synthetic coding sequence
atgtgccaggtcggctgctttctgaaaacacctcgttttcctatttgggttgtgtgttcggaaagccacttcagcattctgttttctctgcaaccaggactcctcagggactggaggactgagcgcctcttcgacttatattactacgacgggctggcaaatcagcaggagcaaatccggctgacgatcgacaccactcaaaccattagcgaggacaccgataatgatctggttccgccactggagctgtgcatccgcaccaacataggatcggccctggggtttaagtatcccgtcgggaataatcagacagcagtccaggacaatgtgaaggtctccctggcttttggcttgtctattgcaactctggctcagtcagtggggcatatttctggcgcacacttgaacccagcagtgactctcggtttgttattaagttgccaaatttctattttcagggcgctgatgtatataatcgcccagtgcgtcggcgctatcgtcgcaaccgccatcctgtccggaatcacttccagtctcacaggtaattctctgggcagaaatgacctggcggacggcgtgaactccggccagggcctgggcattgagattattggtaccctgcagctagtgctgtgtgtgctggccacaactgatcggcgtcgcagagatctcggtggctctgcccctcttgcgattgggctgtctgtcgcattgggacacctgctggcgatcgattatacaggttgtggaatcaatccagcacggtcgttcgggtccgccgttatcacacacaacttctccaatcattggatcttctgggtgggcccattcattggaggggctctggcagtattgatctacgacttcatcctggcccctagaagctcagatctgactgatcgagttaaggtatggacatccggacaggtggaggagtacgatttggatgccgacgatatcaatagccgggtggaaatgaaacctaagtag

SEQ ID NO: 214739 - DNA, 561 bp, Artificial Sequence
  Description of Artificial Sequence: Synthetic coding sequence
atgccaggagcccgtcccctgcctctggtgctcgtgccccagaataccctcgcttggatgcaactcgatgcaaaagctccggcacatcccagacccctgcagttactggggagggtggggccaggctctcgtcagctggccgacggggtgaacagcgggcaaggattgggaatcgaaataatcggaactcttcagctggtcctatgcgttctggccacaacagacaggaggcggagggacttggggggatcggctcctctggcaattggtttaagcgtggccctcgggcatttgttggcaatcgactatacagggtgcggtatcaaccctgccagaagtttcggatcggcagttatcacacataatttttctaatcactggattttctgggtgggcccattcatcggaggagctctggctgtcctcatttatgattttattcttgcccctcggtcttccgatctgactgatcgcgtcaaggtttggaccagcggccaggttgaagaatacgatctggatgccgacgacataaactctcgagtcgaaatgaagcccaagtag

SEQ ID NO: 214740 - DNA, 816 bp, Artificial Sequence
  Description of Artificial Sequence: Synthetic coding sequence
atgtctccgcttctgggtctgagatccgagcttcaggatacctgtacaagcttaggcctgatgctgtccgtcgttcttcttatgggattagccagggtggtggctaggcagcaactccataggccagtagctcacgcctttgtgttggagttccttgccactttccagctgtgctgttgcacacatgaactacagttgctctccgagcaacatcccgctcatccgacatggacgttgactctggtttacttttttagcctggtccacggcctgacgctcgtggggacttcttccaacccttgtggagtaatgatgcagatgatgctggggggaatgtctccagaaacgggtgcagtccgactcctggcccaacttgtgtccgctctgtgtagcaggtactgtacctccgccttatggtccctgggtctgacccagtaccacgtctcagagcgaagctttgcgtgcaaaaaccctattcgggtggatctcttgaaggcagtcataaccgaggctgtgtgctcttttctgttccattcagctctgctgcatttccaagaggtccgtactaaactaagaattcacctattggccgcacttatcaccttcctggtgtacgctggcggttcattaacaggggctgtctttaacccggcactcgctctcagccttcattttatgtgcttcgatgaagcgttcccgcagttttttattgtctactggctggcccctagtctgggaattcttctgatgatcctgatgtttagtttcttcctaccctggctgcataacaatcacacaattaataagaaagagtag

SEQ ID NO: 214741 - DNA, 888 bp, Artificial Sequence
  Description of Artificial Sequence: Synthetic coding sequence
atggcaggactgaatgttagcctgtcgttctttttcgcgacattcgcgttgtgtgaggctgctaggcgggcaagcaaagcactccttccagttggcgcttatgaggtgtttgcccgagaggccatgagaacacttgtcgagctgggaccatgggccggagacttcggccctgacttactgctgacgctgctctttttgctattcctcgcccacggcgtcactttagacggtgcgagcgctaatcccaccgtctccttgcaagaattcctcatggcagagcagtcgctgccaggcaccctgctgaagctggccgctcagggccttggcatgcaggcagcgtgtaccctgatgagactgtgttgggcgtgggagttgtccgacctccatttgttgcaatcattgatggctcaatcttgctcatccgcgctgcgtacatcggttcctcatggagctctggtggaggcggcttgcgccttttgtttccacctcacacttctgcatctgcggcactccccacctgcctacagtggcccagccgtggccctccttgtcacagtcacggcgtacactgctggccctttcacaagcgctttcttcaatcctgcgctggcagcttcagtaacttttgcctgttcaggccacactttattagaatatgtacaggtttactggctcggaccccttactggcatggttctggcagtgctgttacaccaggggcgacttccccatctgtttcaacgaaatctcttctacgggcagaaaaataagtatcgggctcccagaggtaagcccgctccagcctcgggggatacccaaacgcccgctaaggggtccagcgtcagggaacctggcagaagcggggtggagggaccacattcatcttag

SEQ ID NO: 214742 - DNA, 798 bp, Artificial Sequence
  Description of Artificial Sequence: Synthetic coding sequence
aatcaacccgcacccgctctaagtcctcaggtcagctgccgtcattcctcttccggtggacccggacgatggcaagagttcctgatggccgagcagtccctcccaggcaccctgctgaagctcgctgcccaaggcctagggatgcaagccgcatgtactctgatgagattgtgttgggcctgggagctgtccgacctccacttgctgcagtctctgatggctcaaagttgctcatccgccctgaggacatcagttccacacggggcactggtggaagccgcatgcgctttctgttttcacctcacactgctccatcttaggcacagcccccctgcctattctggacctgccgtcgcccttctggtcaccgtcaccgcatatacagccggacctttcacctccgcgttctttaatccagctttagcagctagcgttactttcgcttgcagcggccatacccttttggaatatgtacaggtgtattggctggggcctctaactgaagaacaacacggcgaagtgatggagccaccgttggggcctcgcagcggcgactccggcccatggttacagcgacccaggtggtctccccatctgctgctccacctcctaagcgatacgcgcttgcatctgaccgaggtgccagagggccagttgggcagttatggtattctggaggcctttttctctttttgctggctgtatacaggtgaagtttctggagccatgccacagcctcccctgggagggaaggatcggtcatggggtagcttacggcacctggccctgcgttggtag

SEQ ID NO: 214743 - DNA, 924 bp, Artificial Sequence
  Description of Artificial Sequence: Synthetic coding sequence
atggccggactgaacgtgtctctttcctttttcttcgcaacatttgccctgtgcgaggcagccagacgcgcttcaaaagctttactgcccgtgggagcctacgaggtattcgctcgtgaggctgtgggcgcagtacagctgggcccttgttgcctggaaatgagaaccctggttgagttaggtccatgggctggcgacttcggtccagacttgctgctgaccctgttatttctcctgttcctagcccacggagtgacgctggatggtgcttcggcaaatcctactgtgtctctgcaagagtttctaatggccgaacagagcctcccaggaacccttctcaagcttgccgcacaaggtctgggtatgcaggctgcctgcaccctgatgcgtctgtgttgggcctgggaactaagtgaccttcacctgcttcagagtctgatggctcagagctgctcctctgcccttcgtacctctgttccccacggagctctggtcgaagcagcatgcgctttttgctttcacctgactctcctacacctgcgtcacagcccacctgcttactcgggacccgcagtggcgctgctcgtgaccgtcacagcgtataccgcaggaccctttacttctgccttctttaaccctgctctggctgcaagcgtgacctttgcttgttctggccacacactcctggaatatgttcaggtgtactggctgggacccctgaccggaatggtactagcggtcctgcttcaccagggcagactgccccatctgttccaaaggaatcttttttatggacaaaaaaataagtatagagccccaagaggaaagcccgctcccgcaagcggggacacgcagacaccagctaagggcagctctgtgcgtgaacccggaagaagcggggtagagggaccacattccagttag

SEQ ID NO: 214744 - DNA, 816 bp, Artificial Sequence
  Description of Artificial Sequence: Synthetic coding sequence
atgtgggagctgagaagtatcgcgttcagcagagcggtgttcgctgagttcctcgccaccctgctttttgtcttcttcgggctgggctcagcactgaattggcctcaggctctgccctcagttctgcagatcgctatggcctttggcttgggtataggtaccctagtgcaggcacttggccacatcagcggcgcacacatcaacccagctgtgactgtggcatgtctggtaggatgccatgtttcagttttgagggctgcattttacgtagccgctcagctgttgggggcagttgcaggggctgccttactccatgagattaccccagctgacatcagaggtgatttagctgtcaatgcattgtctaacagcacaaccgcaggccaggctgttaccgtggaactattcctcaccctgcagctggtcctctgcattttcgcgtccacagacgagcggagaggtgagaaccccggtactcctgccctttcgattggcttctccgtggcactcggtcaccttctgggaatccattataccggatgctccatgaatcccgcacgctccctggcaccagccgtggtgactgggaagttcgacgaccattgggtcttctggatcgggcctctggtgggggctatcttggggagtctgctgtacaactatgtcctgtttccccctgccaagagcctgtcagagcggctcgccgtgctgaagggactcgagccagataccgactgggaggagagggaagtgagaaggcgacagtccgtggagctgcatagtccccagagccttcccagggggactaaggcttag

SEQ ID NO: 214745 - DNA, 879 bp, Artificial Sequence
  Description of Artificial Sequence: Synthetic coding sequence
atgggaagacagaaggaactggtctcccgctgcggcgagatgctccatattaggtaccgcctcctgaggcaggccttggcagagtgcctcggaacattgattctggtaatgtttggctgtgggtcagtagctcaggtggtactatccagaggaacgcatggtgggttcctcacgatcaatcttgcgttcggcttcgctgtgaccctcgggatcctcattgcaggacaggttagtggagctcatctgaaccccgctgtcacctttgccatgtgttttctggcgagggaaccgtggataaagctgcccatctatacgctggcccagacattgggagctttcttaggagcagggattgtctttggtctttattacgatgcgatttggcactttgcagataaccagttattcgtgtctggaccaaacgggaccgccggaatctttgcaacttacccttcggggcatctggacatgataaatggattttttgaccaattcatcggaactgccagtcttatcgtctgcgtcctggccatagtcgacccctataacaacccagtccctcgcggattggaagcttttacggtcggcttggtcgttttagtgatcggaacaagcatggggtttaactccgggtacgcagtcaatccagcacgggatttcgggcctaggttatttacagccctcgctggctggggcagcgccgtcttcactacaggtcagcactggtggtgggtgccaattgtctcacccctactaggcagtattgccggagtcttcgtgtatcagctgatgatcggatgccacttggagcaacccccaccatccaacgaagaagagaacgtgaagctggcccatgtaaagcacaaggaacaaatatag

SEQ ID NO: 214746 - DNA, 840 bp, Artificial Sequence
  Description of Artificial Sequence: Synthetic coding sequence
atgggccgacagaaagagcttgtatcccgttgcggcgagatgctgcacatccgctatcggctcttgagacaggctcttgcagaatgccttggtacactgatcctggtgatgttcggctgcgggagcgtcgcacaggtggtgctctcacgcggaacacacggaggatttctgaccattaacctggcctttggttttgccgtcacactgggcatactgatcgctgggcaggtgtccggcgcacatctgaacccagcagttaccttcgcaatgtgtttcctagctcgcgagccttggatcaaacttccgatttacacacttgcccaaacattaggcgcatttcttggagcgggaatcgtgttcggcctatactatgatgctatctggcacttcgccgataaccagctctttgtttcaggcccaaatgggacagccggtatcttcgcaacatacccttctgggcatctcgacatgatcaacggcttctttgatcaggacaggccggctctagttgtcggcgcacaccgcgtgcctaccccgggtttgcactgcggctgcttaagagtcccggctgacgacagacttccgcctggagcggctcctacccttcagcgaggccgagaatgcgaggctggcccttgtgaagcacagggcgcagatttatctggtcagggcagccccctccgatgccccggtctggagcaccctctcacagtacaaggacctctccctagatctccgctgcatgaccctccattccaggccaaggaacttcccatctatccccacccaactacggcacctagcggatttcccctcgacttggcgcaaatcgccccatag

SEQ ID NO: 214747 - DNA, 972 bp, Artificial Sequence
  Description of Artificial Sequence: Synthetic coding sequence
atgtccgatcgcccaaccgcacgcaggtggggcaagtgtggtccactctgcacacgggaaaacattatggtagccttcaagggagtgtggactcaagccttctggaaggccgtgactgctgaatttttggccatgctgattttcgtattactgtcattgggaagtacaataaattggggcggaactgagaagcccctgccagtggacatggttctgatctccctgtgcttcgggctctctatagccacaatggtgcagtgcttcggacacatttccggaggacatatcaaccctgcagtgactgtcgcaatggtgtgcaccaggaagattagtattgccaaatccgtcttctatatcgctgctcaatgcctgggtgccataataggtgctggtatattatacttggtcacacctccaagtgtcgttgggggactgggtgttaccatggttcatggaaacctaaccgctggacacggattactcgtagagctgatcatcacattccagctcgttttcacgatctttgcatcatgtgattcaaaaaggaccgacgtgacaggctcaatcgccctggccatcggattcagcgttgccatcgggcatctgttcgcgatcaactacacgggcgcatccatgaacccggctcgaagctttggtccagcagtgattatggggaattgggagaaccattggatctactgggtgggcccaatcattggagccgtcctggcaggcggactgtatgagtacgtcttttgcccggatgtggaattcaagcgtcggtttaaggaggctttttcaaaggccgcacagcagactaaaggcagctatatggaggtcgaagacaatcggagccaagttgagaccgacgatctcattctaaaacctggcgtcgttcatgtgatagatgtcgatagaggagaagagaaaaagggtaaggaccagtccggggaagttctgtcttcagtgtag

SEQ ID NO: 214748 - DNA, 660 bp, Artificial Sequence
  Description of Artificial Sequence: Synthetic coding sequence
tgcaccttggcaggagagggcatgtccgacaggccaactgcacgcagatggggcaagtgcggccctctgtgcacgagggaaaacatcatggttgcattcaagggagtctggacgcaggcattctggaaggcagtaacagctgagtttcttgccatgctcatcttcgtcctcctgagcctgggttccacgatcaattgggggggaaccgagaaacctctaccagtcgacatggtcctgatctctctttgtttcggcctgagcattgcaaccatggtgcaatgctttggtcacatttctggcggacatattaatccagctgtgacagtggccatggtctgtacacgcaaaatcagtatcgctaagagtgtgttttacattgctgcccagtgcgttggtcccatcatcggagcggtgctggcagggggactgtacgagtatgtgttctgcccggatgttgagtttaaaagaaggttcaaggaggcatttagcaaggctgcgcagcagactaagggatcttacatggaagtggaagacaaccggtcacaggtagaaactgatgacctcatcctgaaaccgggtgtcgtgcatgtcattgacgtggatagaggtgaagagaaaaaaggaaaagaccaaagtggcgaggtcttgagctctgtctag

SEQ ID NO: 214749 - DNA, 912 bp, Artificial Sequence
  Description of Artificial Sequence: Synthetic coding sequence
atgagcgaccgcccaacggcccgaagatgggggaaatgcgggccactttgtacaagagagaacatcatggtcgcttttaagggcgtgtggacccaagcattctggaaagccgtgactgccgaattcctagctatgctaatttttgtgctactcagcctgggctccacaattaattggggcggaaccgagaagccactgcccgtggatatggtgctgatatccttatgcttcggacttagcattgctacgatggtttgcacccgcaaaatatcaatagccaaatcggttttctacatcgccgcacagtgcttaggggcaattatcggagccggaattctgtatctcgttactcctccaagtgtggtggggggactgggggttacaatggtccacggaaaccttacagcaggccacggattgctcgtcgagctcatcattacctttcagctcgtgttcacaatttttgccagttgcgactcaaagaggacagatgtgaccggctcaattgccctggctataggattttccgtcgccattggccatctgttcgccatcaattatacaggggcttctatgaacccagccaggtcattcggcccagccgtaatcatgggcaactgggaaaaccactggatctattgggtcggcccaattataggcgcagtgctagcaggcggtctctatgaatatgtgttttgccctgacgtagagtttaaaagacgctttaaggaggctttctccaaggcagcccaacagactaaagggtcctatatggaggttgaggacaacaggtcccaggtagagacggacgatctgattctcaaaccgggagttgtgcacgtcattgacgtagatcgaggcgaagaaaagaaggggaaggaccagtcaggtgaggtcttgtcatccgtttag

SEQ ID NO: 214750 - DNA, 849 bp, Artificial Sequence
  Description of Artificial Sequence: Synthetic coding sequence
atggatgctgtggagcccggagggaggggttgggcgtctatgctggcttgccgcttatggaaagcgatctcgcgcgcactgtttgccgagtttttggctacaggactctatgttttcttcggggtgggcagcgtaatgcggtggcctactgcattaccatcagtcttgcagattgccatcaccttcaacttggtgaccgcaatggccgtccaggtcacctggaaggcctctggagcccatgcgaatcccgcagtgaccctggcattcctggtgggcagccatatatcactgcctcgtgccgttgcttatgtagccgcacagctcgtaggcgctacggtgggggctgccttgttatacggtgttatgcctggggacattcgcgagacacttggaataaatgtggtacgcaatagcgtctcaactggccaggccgttgctgtagagcttctgctgacattgcagctcgtgctttgcgtgtttgcctccaccgatagccgccaaacctcaggctcacctgctaccatgatcggtatttcagtggcattgggccatctgattgggattcactttaccggctgtagtatgaatcccgctaggtccttcgggcctgccatcataatcggaaagttcactgtccattgggtattctgggtggggcctctgatgggagctctcttggccagcctcatctacaattttgtgttgtttccagataccaagactctggctcagcgattggctatcctgaccggcacagttgaggtggggacaggagccggtgccggagcagaacccctgaaaaaggaatcacaaccaggatccggggcagttgaaatggagagcgtttag

SEQ ID NO: 214751 - DNA, 1029 bp, Artificial Sequence
  Description of Artificial Sequence: Synthetic coding sequence
atggtgcaggcttcgggccaccggaggtctaccaggggatcaaaaatggtgagttggtccgttattgcaaaaatacaggagatcctgcaacggaaaatggtacgagaatttctggcggaattcatgtcaacctatgtgatgatggtgtttggcctcggaagtgtggctcacatggtgctcaacaaaaagtatggttcctatttaggcgtcaacctgggcttcgggttcggggtgacgatgggggtgcatgtggccggaagaattagtggcgctcacatgaacgccgcagttaccttcgctaattgtgcactgggacgggtgccttggagaaagtttccggtatatgtgctcggccagtttcttggttccttccttgctgccgctacaatttatagcctcttctacacagcaattctacatttctctggcggtcagttgatggttactggaccggttgctactgcaggtattttcgcgacatacctccctgaccatatgacactgtggcggggttttctgaacgaggcctggctgactggcatgcttcagctgtgcctgtttgccataacagaccaagaaaataacccggctctccccggaaccgaggcgctcgtgatagggatacttgtagttataataggcgtgtctctgggcatgaacaccgggtatgcgatcaatccctcgcgcgaccttccccctagaatctttacatttatcgcaggctggggtaaacaagtcttctctaatggcgaaaattggtggtgggtacccgtggtcgctcccctactgggcgcataccttggagggattatctatctggtgttcatcggctcaaccattccgcgtgaacctttgaagctcgaagatagcgtggcatacgaggatcatgggattaccgtgttacccaagatgggcagccatgaaccgacgataagccctctcaccccagtctccgtgtcccctgcaaaccgtagctctgtccacccagcccctcccctccacgagagtatggctctcgagcacttttag

SEQ ID NO: 214752 - DNA, 651 bp, Artificial Sequence
  Description of Artificial Sequence: Synthetic coding sequence
atggtgctcaacaagaagtacgggtcttacctcggggtgaaccttgggttcggattcggggtgaccatgggggtccacgtggccggtaggatcagcggagcacacatgaatgcagccgtgacattcgccaactgcgctctcggtcgagtgccatggcgaaagttccccgtctacgtgctcggccaatttcttgggtcgttcttggcggcagctactatttattcactgttttacacagccatccttcatttttcagggggtcagctaatggtgactggacccgtggcaaccgccggaatttttgcaacttatttgccggaccatatgacactgtggcggggatttctgaacgaggcgtggcttaccggtatgttgcagctatgtcttttcgccatcacagaccaagaaaacaacccggcacttcccggaacggaggcactggtcatcggaatcttggtggtcatcatcggagtctctctcgggatgaataccggctacgccatcaacccttcccgggacctgcctcccaggattttcactttcatcgccggatggggaaagcaggtgtttcggtggcaccatctgcccggactgcactggctgcaccaccctaccggggctccagagatcggtggtttctgcggagtttag

SEQ ID NO: 214753 - DNA, 582 bp, Artificial Sequence
  Description of Artificial Sequence: Synthetic coding sequence
atgggatgggctacctttacagaccagggggaagagggattagaaccttcaggaccctggaagacctcccacacacgagcacacatgaacgctgcggttacctttgccaattgcgcattggggagagtaccttggcggaagttccccgtttatgtacttggccagtttcttgggtcatttctcgccgcagctaccatctactcattattttacacagccattctccacttctcaggcggtcagctgatggtcactggcccagttgccactgcgggaatcttcgctacttatttaccagatcacatgaccctttggagggggtttctcaacgaggcttggctcaccggcatgctccaactgtgcctatttgctatcaccgatcaggagaacaacccagccttgcctggaaccgaggctctcgtgattgggatcctcgtagtaattattggggtgtctctggggatgaacaccggctacgctataaacccctcaagggacctgcccccaagaatctttacatttattgccggatggggaaaacaggtgtttagatactgtccttgccctgggcctttcctttag

SEQ ID NO: 214754 - DNA, 771 bp, Artificial Sequence
  Description of Artificial Sequence: Synthetic coding sequence
atgggtagcggacattgccttcgctcaactcgtggctccaaaatggtgtcatggagcgtcatcgctaagatccaagagattcttcagagaaaaatggtaagggaattcctcgcggagtttatgagcacttatgtgatgatggtgtttggacttggcagcgtggcccatatggtgttaaataaaaaatacggctcatatctgggtgtgaacctggggtttgggttcggagtcaccatgggagtccatgtggcgggtagaattagtggggctcatatgaatgctgccgttacttttgcaaattgtgcccttggtcgcgttccgtggagaaaatttcccgtctacgtgctgggtcaatttttggggagtttcctggcggctgccaccatttactctctgttctacaccgcaatccttcacttttccgggggtcagctcatggtgaccggccctgtggctacagcaggcatcttcgccacttatctgccagatcacatgacattgtggcgcggatttctgaatgaagcctggcttactggaatgctgcaactgtgtcttttcgcaatcacagatcaagagaataaccccgctctgcccggtacagaagctctggtaatcggtatcctagtcgtgattataggtgtctcactcggaatgaataccgggtatgctattaacccttctcgcgacctgccaccgaggatttttactttcatcgctgggtggggcaaacaggtattccgctattgcccctgcccaggtcccttcctctag

SEQ ID NO: 214755 - DNA, 1026 bp, Artificial Sequence
  Description of Artificial Sequence: Synthetic coding sequence
atgggctccggtcactgtttacggagtacccggggatctaagatggtatcctggtcagtcattgccaaaatacaagagatcctgcaaagaaaaatggtgcgtgaattcttggctgagtttatgagtacttatgtaatgatggttttcggactcggctctgtggcccatatggtgttgaataaaaagtacggatcgtacctgggggtgaacctggggtttggctttggcgtgaccatgggcgtacacgtcgctgggcgaatctctggagcgcatatgaatgcagctgtgacattcgctaactgcgccctggggcgagtgccgtggcgcaaattccctgtctacgtgctgggccagttcttgggatcgtttctagccgctgctacaatttactctctattctatactgccattctgcacttttcaggcggtcagttaatggtgacgggacccgtagccacagcaggcattttcgcaacatacctgcctgatcacatgactctatggcgcggatttctgaatgaggcctggttgactgggatgcttcagctctgtctgttcgcgattacagatcaagagaacaatccagcacttcccggaacagaggcattggtgatcggtatcctggtggtcataattggagtgtctttgggcatgaataccggatatgccatcaatccaagtagggacttgccccctagaatttttacatttatcgcaggctgggggaaacaagtcttcagcaacggcgaaaattggtggtgggttcccgtcgtagctcctctgcttggggcttatctcggaggaattatttatctggtgttcatcggaagcaccatacctagagagcccctgaagctcgaggattctgttgcctacgaagatcacgggatcacagtcctgcccaaaatgggatcccacgagccaacaatttctcccctgacacccgtctccgttagtccagccaatcgctccagcgtgcatccagctccgcctctacacgagagtatggccctcgaacacttttag

SEQ ID NO: 214756 - DNA, 513 bp, Artificial Sequence
  Description of Artificial Sequence: Synthetic coding sequence
atgaatgccgcagtgactttcgcgaattgcgcccttggcagagtgccctggagaaagtttcctgtatatgttctgggccaatttctgggatctttcttggcagcagctactatctatagcctgttctacactgccatcctgcacttctctgggggacagctgatggtgacggggccagtggcaacagccggtattttcgcaacttatctgccggatcatatgacgctgtggaggggtttcttgaacgaagcctggctcactggcatgcttcagctttgtctgttcgctattaccgatcaagaaaacaatcctgccctgcctggtactgaggcactggttattggcatcctggtggtgattataggtgtgagccttggtatgaataccggatatgctatcaatccgagccgggatctaccccctcgcattttcacattcatcgcgggatgggggaaacaggtcttttcaaacggggaaaactggtggtgggtccctgtggtggccccactctag

SEQ ID NO: 214757 - DNA, 426 bp, Artificial Sequence
  Description of Artificial Sequence: Synthetic coding sequence
ctgttttacaccgccatcttgcacttctcaggcggtcagctgatggtcacaggacccgtggcaacagctggaatcttcgcaacctaccttcctgaccacatgacactctggagaggttttctgaatgaggcgtggctcacggggatgctgcagctttgcctgttcgcaattactgatcaagagaataaccctgccctacccggaaccgaggcccttgtaatcggaatacttgtagtaattatcggggtcagcctgggcatgaacactggctacgctatcaatccatcccgggatttgcccccacggatttttacttttattgccggatggggtaagcaggtctttagatggcatcacctgccaggcctccattggctgcatcacccaacgggcgctcctgaaattggtggattttgtggagtttag

SEQ ID NO: 214758 - DNA, 498 bp, Artificial Sequence
  Description of Artificial Sequence: Synthetic coding sequence
atgaatgccgcagtgactttcgctaactgcgcactaggtcgtgtaccctggaggaagttccctgtgtacgtcttaggacagtttctgggctcctttctggctgctgcaaccatttactccttattctatacagcaattctgcatttttccggaggccagctgatggtgacaggtcctgtggccaccgctggaattttcgcgacgtacctgcctgaccatatgaccttgtggcgtgggtttcttaacgaggcatggctcaccggcatgctgcagttatgcctcttcgcaattaccgaccaagagaataaccctgccttgcccggaacagaggcacttgttatcggcatactggtggtaatcatcggggtgtcgctcggaatgaacacgggctacgccattaatcctagccgagatttgccccctcgcatatttacgttcatagccggatggggcaaacaggtgttcagatattgtccatgtcccggacccttcctgtag

SEQ ID NO: 214759 - DNA, 774 bp, Artificial Sequence
  Description of Artificial Sequence: Synthetic coding sequence
atggtgcaagctagcggtcatcgacggtccacaagagggtccaaaatggtgagctggtcagtgattgcgaagatccaggaaatcctccaacggaaaatggtacgcgaatttctagcagagttcatgtccacctacgtcatgatggtatttggcctgggatctgttgcacacatggtcctgaataaaaaatacggctcatacctgggcgtaaatctcgggttcggtttcggagtgaccatgggggtccatgtcgcaggaaggatctccggcgctcatatgaacgccgctgttacattcgcaaattgcgcattgggcagggtcccatggcgcaagtttccagtttatgtgctgggccagtttctgggatcttttttggctgccgctacaatttactctttgttctataccgccatcttacatttcagtggcggacagctgatggtgaccggccctgtggccaccgcaggcatttttgcaacctacctgccagaccacatgacattgtggcgtggttttctgaacgaagcgtggttaactggcatgttgcaactctgtctgttcgcaatcacagatcaggagaacaaccctgcgctgcctggcaccgaggccctcgtgattggcattctggtggttataatcggggtgagtctcggtatgaacaccggctatgccatcaatcccagccgtgacttgcccccacggatcttcacgttcattgccggatggggcaagcaagttttcaggtactgtccatgcccaggcccatttctctag

SEQ ID NO: 214760 - DNA, 426 bp, Artificial Sequence
  Description of Artificial Sequence: Synthetic coding sequence
atgaacgccgctgtgacgttcgccaactgtgctcttggtagggtgccttggcgaaagttcccggtatatgtgctgggccaatttttaggctccttcctcgcagccgcaaccatatactctctcttttactccgtcgccgatagagatgctccggctgtttctctgcggcatcacggacccggtgagcagcccagcacagcaaggaaccggggagctggagacaggcatcctcggggacatcacaggggggttccttggcatgagcataggatttgccaccaacccgttcccggacccgctcctcctcatttgcatctccattgttggttgggccagaccgggctccaggtcctgccactgccacgccctattccactgagcttcagtgtcggccctctgtgcgtggagggctggggcgttatgtag

SEQ ID NO: 214761 - DNA, 1602 bp, Artificial Sequence
  Description of Artificial Sequence: Synthetic coding sequence
atgggcagcaggtgcctgaatccaccaccgcctgcccatagcgataccacagggaaggattctttcggcaacatcaggggcgctgaaaccgggcagggcgcttctgcctgtagcgtgacaagcgcaagggtgacctgtggcgcaggctcggagccccattctcacagaaatcccggtatctccgcccaggttggcctggccccaagctacggggctgcacggggtagaagacgaccgctggctctgcagcagagccctcaggaacggcgtcatgtgggatggaatagcactcgtggcctgctaccagcatctcttcccggaacagcaagtagtcagtctgcaagcgcaaccgcgtccgcggcactcccgttgaaggtgacgggtccactggcccgtaacccgacacctccatggactgctgccgctgcgctcgctacaaggggacagagacctgaaaaaggtctgttccccggaccggctcccttcagtctgggaaagaggaaacggggtagaggtcgaacgtgggaacggagacggagagtgagtatcgaaactagtacatgcttcaggccagggtgtgaaaggctcggcgcagccgctggggcaaacctctcccaattagcttcctcacagcgtcctttgcgagagcgctgggtactctacacaataattatggctgccgctggcgctcctgacggaatggaagaaccgggaatggacactgaagccgaaacggtcgccacagaggcacccgcacgtcccgtgaactgcctggaggcagaggcagctgctggggcagccgctgaggattctggcgcagccagaggatccctgcagcctgccccagcacaacctccaggcgatcctgctgcgcaggcgtcagtgtccaatggtgaagatgccggtggcggagccggaagggaactagtggacctaaagatcatatggaataaaactaagcacgatgtaaagtttcccctggattctacaggtagcgagctgaagcagaaaatccatagtattactggactcccgccagccatgcagaaagtgatgtacaaaggtctggtgccagaggacaaaacccttagagaaattaaagttacttccggagccaagatcatggtggtgggtagcacaatcaacgatgttctcgctgtaaacacacccaaagatgctgcccaacaagacgcaaaagcggaggaaaataagaaagaacccttatgccgacagaagcaacataggaaagtgctagataaaggcaaacccgaagatgtgatgccttccgtcaaaggagcacaggagcgtcttccgacagtgcccctcagcggtatgtataataaaagcggagggaaggtacgacttacatttaagctggaacaggaccagctttggattgggacaaaagaaagaacagagaaactgccaatgggctccatcaaaaacgttgtgagcgagcctatcgaaggacatgaagactatcatatgatggcattccagttagggccaaccgaagccagctactactgggtgtactgggtccccacacagtatgtggatgcaatcaaggatacggtgctggggaagtggcaatacttttag

SEQ ID NO: 214762 - DNA, 9198 bp, Artificial Sequence
  Description of Artificial Sequence: Synthetic coding sequence
atggaggaaaagcaacaaatcattcttgccaaccaagatggtggaaccgtggctggcgctgcccctacgttctttgtgatcctgaagcaacccggtaacgggaagaccgaccagggtatactcgttacgaatcaggatgcatgtgccctcgcgtcatctgtcagctccccagtaaagagcaaagggaagatttgcttacctgctgattgcactgtcgggggtatcactgtgacgcttgacaataactctatgtggaacgagttctaccacagatccacggaaatgatccttactaaacaaggcagaaggatgttcccgtactgtagatattggattaccggacttgatagcaacctcaagtacatactggtgatggatatttcaccagttgacaatcatcgatataagtggaatggcaggtggtgggagcccagcggaaaagcggagcctcacgtcctgggacgagttttcattcaccctgaaagccccagcactggtcactattggatgcatcagcctgtgtccttctacaagctgaagctgactaacaatacgctggaccaggagggccacattatcctgcacagcatgcataggtatctgcctagactacacctagtgcccgctgagaaagccgtcgaagtgatccaactgaatggtcccggagtgcatactttcactttcccccagacagaattcttcgccgtgaccgcttatcagaacattcagattactcagctaaaaattgattataatcccttcgccaaaggctttagagatgacggactgaataataagccacagcgcgacggcaaacaaaagaactcatcagaccaagagggtaacaatatcagctcctcatccggccaccgtgtccgtctcaccgaaggccaggggagtgaaatccagcccggagatttggatccgctgagtagaggacacgaaacttctggaaagggtttagagaaaacgagtctcaacattaaacgcgattttctgggcttcatggacactgacagtgctctttccgaggtaccccaattgaaacaggagatctcggagtgccttatcgcgagcagctttgaggacgatagtcgcgtagcctctcctctggaccagaatggctcttttaatgtagttattaaggaagaaccacttgatgattacgattatgagctcggcgagtgtcctgagggcgtcactgtcaaacaagaggagaccgatgaggagacagatgtgtacagtaacagtgatgatgatcccattttggagaagcagctgaagcgccataacaaggtcgacaacccagaagccgaccacctctccagcaagtggttaccttcttctcctagcggtgtagccaaggcaaaaatgtttaaactggatacaggaaagatgcccgttgtgtacttggagccttgcgcagtgacaagatctactgtgaagattagtgagctccccgataacatgctatccacaagtagaaaagacaaatcatccatgcttgccgagctggaatatctgcccacttacatcgagaacagcaatgagaccgccttctgcctgggaaaagaaagcgagaacggcctgcggaaacattctcctgacctgcgcgtggtccaaaagtatccccttctgaaggagcctcaatggaaatatccagatattagtgatagtataagtacagaacgtattttggacgatagtaaggactcggtaggcgacagtctttccgggaaggaagatctgggcagaaagagaaccacaatgcttaagatcgctacagctgctaaagtggtgaatgctaatcagaatgcatccccaaacgtgccaggcaagagagggaggccaaggaagttgaaactctgcaaggccggaaggccccctaaaaacaccggcaagtccttaatctctactaaaaatacaccagtcagccccggaagcaccttcccagatgtcaaaccggatctagaggatgttgatggcgtactattcgtgagcttcgagagcaaagaggctctcgacatacacgccgtggacgggactaccgaagaatcaagcagcctccaggctagcaccacaaacgactccggatatcgcgctcggatctctcagctggagaaggaactcatagaagacctgaaaacactgagacacaaacaagtaatccacccaggactgcaggaagtcggcctgaaactgaactctgtagatccaacgatgagtatcgatctgaagtacctaggcgtccaactgccgctcgccccagcgaccagcttcccgttctggaatttgacgggaacgaatccagccagtccggatgctggctttccctttgtgagtaggactggcaagacaaatgacttcaccaagattaagggctggcgcggtaagttccactcagcctccgcaagtcggaatgaggggggaaactccgaaagctctctgaagaatcgatccgcattttgcagcgacaaactagacgagtatttggaaaacgagggcaagctaatggagaccagtatgggatttagcagtaatgccccaactagtccggttgtgtatcaactgcctactaagtctacctcctatgttcgcactctagactctgtgctgaaaaagcagtctacgatcagcccatctacgtcgtactcactcaagccgcactctgtgcctcccgtgtcccggaaggctaaatcgcagaaccgccaagcgaccttttctggcaggacaaagagctcttacaaatctatcttgccttacccagtgagccccaaacaaaagtacagccacgtaatcctgggggacaaggttaccaaaaattcctccgggatcatttcggaaaatcaagccaataacttcgtagtccccaccttggacgaaaatatcttcccaaagcagatctcactcagacaggcacagcagcaacaacagcagcagcagggctcaagaccccctggactgtcaaagtcccaggtaaagctgatggatctcgaggattgcgccttgtgggaggggaaaccacgcacttatatcaccgaggagagggcagacgtatccctgactactttgctgacagcgcaggcgtcgctgaaaacaaaacctattcataccatcatccgaaagagagctccaccgtgtaacaacgacttctgccggctgggttgcgtgtgtagcagcctcgcgcttgaaaagagacagccagcacattgtagacggcctgattgtatgtttggttgcacttgtcttaaacgcaaggtggtccttgtgaaggggggttctaaaacgaaacattttcagcgaaaggcggcacacagagatcccgtattttatgacaccttaggggaggaagccagagaggaagaagaggggattcgtgaagaagaggagcagcttaaagagaagaagaagaggaagaaactcgagtacacaatctgcgaaactgagcccgaacagccagtgagacattaccctctctgggtgaaggttgaaggtgaggtcgatcctgagcctgtgtacattcccacgccttccgtaatcgaacccatgaagcccctgttactgccccagccggaggtgctgtcacccacggtgaagggtaagttgttaaccggtatcaagagccctcgcagctacacacctaaaccaaaccctgtaatccgcgaggaggacaaagacccagtgtacctgtattttgaatccatgatgacctgtgccagagttcgggtctatgaaagaaagaaagaggaccagaggcagcctagtagtagctctagcccctccccctccttccaacagcagactagctgtcattcttcacccgaaaaccataacaacgccaaagaaccagactctgaacagcaacccctaaaacagttgacatgtgacctcgaggatgactcagataagctccaggagaagtcctggaagtcaagttgcaacgagggagaatcatcttctacctcatacatgcatcagcggtcaccaggaggccctaccaagcttattgagatcatcagcgattgcaattgggaagaagacagaaacaaaatactgtcaatattgtcccaacatatcaattccaacatgccacagtcccttaaagtcgggtccttcatcatagaactggctagccagagaaagtcacgtggcgaaaagaatccacccgtgtattccagcagagttaagatctccatgccgtcatgtcaggatcaggatgatatggctgaaaaaagtggctcagaaacccccgacggcccactaagtcctggaaagatggaagatataagcccagtgcagactgatgcgctggactccgtcagggagcgtctgcacgggggtaaaggactaccgttttacgccggtttgtctccagccggtaaactcgtggcatataaacgcaaaccttctagcagcacaagtggactgattcaggtggccagcaatgccaaagtcgctgcctccagaaaaccacgcacattactcccgtccacttccaattccaaaatggcctcatcttctggcacggccactaacaggccaggtaaaaacctgaaggcatttgtgcccgctaaacgccctattgcggcaaggccctcgcccggaggggtgttcacacaatttgtaatgtcgaaagtaggagccttacaacagaaaatccctggtgttagcaccccacagaccttggccggtactcagaagttcagtatcaggccttccccggtgatggtcgtgactcccgttgtttcatccgaacctgtgcaggtgtgtagtcccgttacagccgctgtcacaaccacaactccacaggtctttctcgagaatactacggcggtgacccccatgactgcaataagtgatgtcgagacaaaggaaaccacctacagctccggtgcaacaacgacaggagtcgtggaggtcagcgagacaaacacaagtacctccgtgacctctacccagtccacggctactgttaatctaacaaagaccaccggcatcacaacccctgttgcctcagttgcttttcctaagtcactggtggctagtccctcaactatcaccctgccagtggcttctacagcttccacttctctggtggtggtgacagccgctgcatcaagtagcatggtcaccacgcccacctcatcattgggctccgtccctattatactctcagggattaatggcagtccaccggtcagccagcgccctgagaatgccgctcagattcctgtggcgacccctcaggtttcacctaatactgtgaagagggccggacctcggctgctgctaatcccagtccagcaaggctcccccactctgaggccggtgagcaacactcagctgcaaggccataggatggtattgcagccggttcggtccccaagtggaatgaatcttttccggcatccaaacggacaaattgtgcaactgttgcctctccatcagctgcgcggaagcaatacacagcccaatctccagcccgttatgttccggaatccaggaagtgtcatgggaatccggctcccagccccaagtaagccaagcgagacgcccccatcttcaacttctagttcagccttcagtgtgatgaaccctgtgatccaggccgtcggtagtagtagtgccgtcaatgttatcacgcaggccccatctctcctgtcctctggtgcgagtttcgtgtctcaggcgggtacgctcaccttgaggattagcccgcctgagccccaatcatttgcctcgaaaacaggctctgagaccaaaataacatattcgtctggagggcaaccagtgggtacagcaagtctgatacctttacagtctggttccttcgcactgctgcagcttcctggccaaaagccagtcccctctagtattctgcaacacgttgcttccctacagatgaagcgggagtcccaaaaccctgaccaaaaagacgagacgaactccattaagagagaacaggaaaccaagaaggtcctgcagtccgaaggggaagctgtagaccccgaggctaacgtgataaagcagaatagcggcgcagcgacaagtgaggaaactctgaacgattccctggaagatcggggagaccatttagacgaggagtgtctcccagaggaaggttgtgctacagtgaagcctagcgagcacagttgtatcaccgggagtcacacggaccaggactacaaagatgtgaacgaagaatacggcgctagaaaccgtaaatccagcaaggagaaagtggcagtgctggaggtgcggactatctcagagaaggcatcaaacaagacagtgcagaatctctccaaggtgcagcatcagaagctgggcgatgttaaagtggagcaacaaaaaggattcgataaccccgaagagaacagtagtgaatttcctgttacgtttaaagaagaatcaaaattcgaactctcggggtcgaaggtcatggagcagcagtcgaatcttcagcccgaagccaaagagaaagagtgcggggatagccttgagaaagatcgggagagatggagaaagcaccttaagggcccactgacgcggaaatgtgtcggcgcatcccaggagtgcaaaaaggaagccgacgagcaactcataaaagagaccaaaacgtgccaggagaacagcgacgtgtttcagcaggagcagggcatttccgacctcttgggcaagagcgggatcaccgaggacgccagggtgctcaagaccgaatgcgattcctggagccgcattagcaatccatctgcgttctctatcgttccgcgacgagccgcaaaatcctctcggggaaatggccacttccagggacaccttctcctgccgggagaacaaatccaacctaagcaggagaagaagggagggaggagtagtgccgattttacagtgctcgacttggaagaggatgacgaagacgacaatgagaagacagatgacagcattgacgagattgtcgacgtggtctccgattaccaatctgaagaagtcgatgacgtcgaaaaaaataattgcgtggagtatattgaggatgatgaggagcatgttgatatcgaaactgtggaggagctctcagaagagatcaacgtcgcccacctgaagaccactgctgctcatacccagtcatttaagcaaccgagttgcactcatatctccgctgatgagaaagctgctgagcgaagtaggaaggcaccgcctatccccctaaagctcaagcctgattattggtccgataagctgcaaaaagaagccgaagctttcgcatattataggcggacacatacagccaacgaacggagaagacggggtgagatgcgggatctgttcgagaaactgaagataacgttgggcctgctccattctagcaaggtaagcaagagcctaattttgaccagggcattttccgagatacaagggctgactgatcaggctgacaaactcattggacagaagaatttattgacccggaagaggaatatcctgatccgaaaggtgagctctctttcaggcaaaacggaggaagtggtgttgaagaaactagaatacatctatgcaaaacaacaagccctggaagcccaaaagcgtaaaaaaaagatgggcagcgacgaattcgacataagtcctcggataagcaagcagcaagaaggatcttccgcttcaagcgttgacctagggcaaatgttcataaataatcgccgaggcaaacccctcatcttatccagaaaaaaagatcaggcaacggagaatacgtccccactcaataccccgcatacttcagccaacctggtgatgacgcctcaaggccagcttcttactctaaaaggacctctgttcagtgggcctgtggtggctgtaagtccagatcttttggaatcagacttaaaaccccaggtggccggatcagcggtggccctgcccgaaaacgatgatctgttcatgatgcctaggattgttaacgtaacaagtctagcaacagagggcggactggtggatatggggggaagtaaatatcctcatgaggtgcctgattcaaagccctctgaccacctaaaagatactgttaggaatgaagataattccctagaggacaagggccgtataagttcccggggaaaccgagacggtcgagtgaccctcggaccaacccaggtgttcctggcaaacaaagattccgggtaccctcaaatcgtggacgtttccaatatgcaaaaagcgcaggagttcttgcccaagaagatttcaggggatatgcggggtattcagtacaagtggaaggagagtgaatcacggggtgaacgggtgaagtcgaaggacagtagttttcataagttgaaaatgaaggacctgaaggacagcagtatcgaaatggaattgcggaaggtaactagcgccattgaagaggcagccctagattcatctgagctactgacaaatatggaggacgaggacgatacggatgaaactctgacctccctgttgaacgaaatcgccttcctgaaccagcagctgaacgatgattctgtcggactcgccgaactcccaagctccatggataccgaattcccaggcgacgccaggcgcgcattcatctcgaaggtgccccctgggagtagggctaccttccaggtggaacatctgggcaccggcttgaaagagctgcctgacgtgcaaggggagagcgattcaatttcaccattacttttacatctagaagatgatgacttttcggaaaacgagaaacaattagccgagcctgctagcgagcctgatgtcctgaagatagtcatcgactctgaaataaaagatagcctcctctcaaacaagaaagcaattgatggcggaaaaaacacctctgggctgcccgcagaacctgagtcagtgtccagccccccaaccttacatatgaaaaccggcttggaaaattctaattcaacggataccttgtggcggccaatgcctaagctggcgcctctggggctgaaagttgccaacccatcctccgacgctgacggccagtccctgaaggtgatgccatgcttagccccaattgcagccaaagttggatccgttggacacaagatgaacctgaccgggaacgaccaagaggggagggagagcaaggtgatgcccacattagcccctgtggtggcaaagctcggcaactctggagcatcgccttcgagcgctggaaaatag

SEQ ID NO: 214763 - DNA, 888 bp, Artificial Sequence
  Description of Artificial Sequence: Synthetic coding sequence
atgcagccagagggtgctgagaaaggcaaatctttcaagcagagactcgtcttgaaaagctctctggcaaaagaaacattgagtgaatttctggggactttcatactcatcgtactcgggtgtggctgtgtggcacaggccattctgagtagaggcaggtttggaggtgttattaccataaacgtaggcttttcaatggcagtcgcaatggccatctatgtggccggtggagtgagcgggggtcacataaatcccgcagtgagccttgcaatgtgtctgttcggccgaatgaagtggttcaagctgcccttctacgtgggcgcacagttcctcggcgcatttgtgggggcagcaactgtgttcggaatttactatgatggtctgatgagctttgcaggtggcaagctgctaatagtgggcgagaatgcaactgcccatatctttgcgacctatccagcaccctatctgtccctggctaacgctttcgcagaccaggtcgtagccaccatgatcctactgatcatcgtgtttgccatttttgatagtagaaatctaggcgcaccacgaggcttagagccaatcgcgattggactcctcataatcgtcatcgcctcttctcttggactcaacagcggatgcgcaatgaatccagccagggacctcagcccacgcctattcacagcactggctggatggggcttcgaagtttttagagccggaaacaacttctggtggatcccggtggtgggaccccttgtgggggctgtaattggaggtttgatttacgtgctcgtgattgaaatccatcatcccgagcctgacagtgtgtttaagacagagcagtctgaggacaagcctgaaaagtacgagctgtcggtgatcatgtag

SEQ ID NO: 214764 - DNA, 1992 bp, Artificial Sequence
  Description of Artificial Sequence: Synthetic coding sequence
atggggaggtataggattagagtcgccacaggcgcttggctctttagcggtagctataatagggtgcagctctggctggtaggcacgagaggggaagcggaactggaattgcaactcaggcctgccaggggagaggaagaggagttcgaccacgacgtggctgaggacctggggcttctgcagttcgtgagactccgaaaacaccattggttggtcgatgatgcctggttctgtgacagaatcacggtccagggtcccggtgcatgcgctgaagtcgcgttcccatgctatcgttgggtccagggagaagatattctctcattgccggagggcaccgcaagattgccaggggataacgcacttgatatgttccaaaaacatagggagaaggagctcaaggacagacagcagatctactgttgggccacctggaaagagggactgccgctgaccatagcagctgaccgaaaggatgatctgccacccaacatgaggttccacgaggaaaaaaggcttgatttcgaatggactctgaaagcaggggcacttgagatggctctgaaaagggtgtacaccctgctcagcagttggaattgcttagaagacttcgatcagatcttctggggccagaaaagtgcccttgccgagaaggttcggcagtgttggcaggatgacgagttgttctcctatcagttcttaaacggtgccaacccaatgttgttgagaagatctactagcctgccatcccggctcgtcctgcctagtggaatggaggaacttcaggctcagctggagaaggagctgcagaatggcagcctattcgaggcagacttcattctgctggatggaattcccgctaatgtcatccggggagagaagcagtatcttgccgcaccgctggtaatgctgaaaatggaaccaaatggcaaactccagccaatggttatccagattcagccccctaacccaagctccccaactccaacgctgttcctcccctcagacccccctctggcatggttacttgcaaagtcctgggtgcggaactccgatttccagctccacgagatccaataccatcttctcaacactcatctggtggccgaggtgatagcagtggctacaatgcggtgtcttcccggactgcaccctatcttcaaattcctaattccacacattcggtacactatggaaatcaataccagagcgagaactcagctaatctccgatgggggtattttcgacaaggccgtgagcaccggcggagggggtcacgttcagttgctgcgtagagccgcagctcagctcacatattgcagtctgtgtcctcccgacgacctcgctgacaggggacttctgggcctgcccggtgctttgtacgcccacgatgctcttcggctgtgggagatcattgccaggtatgtggagggaattgtgcacctgttttatcagcgggacgacatcgttaagggggatccggaactgcaagcctggtgccgagagatcacagaggtgggcctgtgccaggcccaggaccgtgggttccctgtgagctttcagagccagtcccaactgtgccactttctgactatgtgtgtatttacatgtactgctcagcatgccgcaatcaatcagggacagttagattggtatgcgtgggtgccaaacgcaccatgtactatgcgtatgccgcctcccacgacaaaagaggatgtgacgatggccacagtgatgggcagtctccccgatgtgcgccaggcctgcttgcagatggctatcagttggcatctgtctcgccgacaaccagacatggtccccttggggcatcataaagagaaatattttagtggacccaagcctaaagctgttttaaaccagtttcgcactgacctggagaaacttgagaaagaaattacagctcgaaatgaacagctcgattggccctatgagtatctgaaacccagttgtattgaaaatagcgtgactatctag

SEQ ID NO: 214765 - DNA, 2106 bp, Artificial Sequence
  Description of Artificial Sequence: Synthetic coding sequence
atggctacatataaggtgagagtagccactggaaccgatctgctttcaggcacaagagactcaatctccttaacaatcgtgggcactcaaggggaatctcacaaacaactcctgaaccattttggacgcgacttcgcaaccggcgctgttggtcagtacaccgtacagtgccctcaggacctaggagagctgatcattatcaggctacacaaggagagatacgcctttttccccaaagatccatggtattgtaattacgtgcagatctgtgcacctaacggaagaatctaccattttcctgcttaccagtggatggacggctatgaaacactggcacttcgcgaagccaccggtaaaaccactgctgatgacagcttgccagtgctgcttgaacacaggaaggaggagattagagctaagcaagacttttatcattggagagttttcctgcccggactgccgtcttatgtgcatatccctagctaccggccacctgtgcgtagacacagaaacccaaacagaccagaatggaatgggtacatcccgggttttcccattctcatcaatttcaaggccaccaagtttctcaatctgaacctacgatattcatttctcaagaccgcatcattcttcgtgcgattgggccctatggccctcgcctttaaggtaaggggactgcttgactgcaagcatagttggaagcggttaaaggacatcaggaagattttccccggaaagaaaagtgtagtgtctgaatacgtcgccgagcactgggcagaagacacatttttcgggtatcagtacctgaacggtgtgaacccaggacttattagacgctgtactcgcattccagataagttcccggtgaccgacgacatggtagccccttttctgggcgaaggtacatgcctccaagctgagcttgaaaagggcaacatttacttggcagattatcggatcatggagggtattccaaccgtagagctgtccggaagaaagcagcatcactgcgcccctctgtgtctcttgcattttgggcctgaggggaagatgatgcccatcgccattcagctgtcacaaacaccaggcccagactgtccaattttcttaccctccgacagcgagtgggactggctccttgccaagacctgggtgagatacgccgagttttatagtcacgaggccattgcccaccttctggagactcatctcatcgccgaagccttttgcctagcactgcttcggaatctgcctatgtgtcaccccttgtacaaactgcttataccccatacccggtacacggtgcagataaattctatcggaagggctgttctcctgaacgagggcggactatcagccaaggggatgagcttaggggtggagggctttgctggcgtcatggtgcgcgctctatcagaactcacttatgatagtctgtacctgccaaatgatttcgtggagaggggagtgcaggacctaccaggatactattacagggatgacagcctcgcagtgtggaacgccctcgagaaatacgtcacagaaatcattacatactactaccccagtgatgctgcggtagagggggaccccgaactccaatcatgggtgcaagaaattttcaaggagtgcctgctgggaagggagagcagcggcttcccccgatgtctgaggactgtacctgaattgatccggtatgtcaccatagttatttacacttgttcagcaaagcatgcagcagtgaacactggccagatggagtttacagcatggatgccgaacttcccagctagcatgagaaatcccccaattcaaaccaaagggctgaccactctcgagacgttcatggacacgctccctgacgtaaagactacttgcattacactgctggtgctgtggaccttaagtcgcgaacccgatgaccggaggcctctgggacattttccggatattcacttcgtagaagaagcaccaaggcgctccattgaggctttcaggcagagactgaatcagatttcacacgatataaggcagcgcaataaatgtcttcccattccgtattactatctcgatcctgttctgatagagaatagtattagcatttag

SEQ ID NO: 214766 - DNA, 1989 bp, Artificial Sequence
  Description of Artificial Sequence: Synthetic coding sequence
atgggcctatatcggatccgcgtttctaccggcgcttctttatacgccggaagcaacaaccaggtgcagctgtggctggtggggcaacacggtgaggctgctctgggcaaaagactgtggcctgccagaggcaaggagactgaacttaaagtcgaagtcccagagtacctcggacctctgttgtttgtcaaattgaggaaacgccacctcctgaaggacgatgcctggttttgtaattggatatccgtgcagggccctggcgcaggcgacgaagtgcgatttccttgttaccggtgggtggaaggtaatggtgtgttgtccctgcccgaaggaactgggagaaccgttggggaagacccacaggggcttttccaaaagcatagggaggaggagctagaggaacggaggaaactctaccgctggggtaattggaaggacggactcatcttgaacatggctggcgcaaagctatacgacctccctgtggatgagagattccttgaagataagcgagtcgactttgaggtctctcttgcaaaaggtttggccgacctcgcaatcaaggattccctgaacgtcctgacttgttggaaagatctggatgactttaatcggattttctggtgtggacaatcaaaactggccgaacgggtgcgtgactcctggaaggaggatgcattgttcgggtaccagttcctcaacggggcaaaccctgtcgtgctgcgcaggagcgctcatctgccagccagactcgtgttccctcctggaatggaggaactccaagcccaattggaaaaggaactggaggggggaaccttattcgaagctgatttcagcctcctcgatggaattaaggctaacgtcatcttgtgctcgcagcagcatctggccgctcctctggtgatgttgaagctgcagcccgatggcaagctgctgcctatggtgattcaactccagctaccacgaactgggagcccccctccgccactgttcctgcctacagacccccctatggcatggctcttggccaagtgctgggtcagaagctccgactttcagctgcatgagcttcagtcccacttattgaggggccaccttatggctgaggtgatcgttgtagctacaatgaggtgccttccgagcattcacccaatattcaaacttatcatcccccacctccggtatacgttggagatcaatgtccgggctaggactggcctagtgtccgacatggggattttcgatcagatcatgtccaccgggggaggcggtcacgttcagttgttgaagcaggctggagcttttctcacgtattcctcattctgccctccagacgatctagccgaccggggtctgctgggagtcaagagcagcttctatgcgcaggatgccctcagactttgggagattatctatcgctacgtggagggcattgtaagtctccactacaagacggacgtagccgtgaaagatgacccagaacttcagacctggtgcagagagattaccgagattgggcttcagggcgctcaggatcgcggatttcccgtgtctcttcaggctagagatcaggtgtgccattttgtcaccatgtgcatctttacttgcaccggacagcacgcctcggttcacctcggacaactggactggtattcctgggttcccaatgctccttgtaccatgcggttgcctccccctactaccaaggacgcaaccttagagactgtcatggccacattacccaatttccaccaggctagtctgcagatgtctatcacttggcagctgggcagacgacagcctgttatggtggcagtgggccagcatgaagaggaatatttcagcgggcctgagccgaaggccgtcctcaaaaaatttcgagaagaacttgccgctctggataaggagatcgagatcagaaatgcaaagctagatatgccctatgagtatctcagaccttccgttgtggaaaattcggtggcaatttag

SEQ ID NO: 214767 - DNA, 2055 bp, Artificial Sequence
  Description of Artificial Sequence: Synthetic coding sequence
atgctgaagaggaatgaatcccaatggctggcccagcggaggcgctccgaaacttccctgtcaaaaatgggcctctatcgcatacgggtgagtaccggcgctagtctatacgcgggttccaacaaccaggttcagctctggctcgtgggccaacatggggaagctgcccttggtaaaaggctgtggcctgctagaggcaaggaaaccgagcttaaggttgaagtgccggagtacctgggaccattgctgtttgttaagctgcgtaagaggcaccttctgaaggatgacgcttggttttgtaattggatttcagtgcagggcccaggagccggtgacgaagtgcggtttccatgctatcggtgggtcgaaggcaacggggtgctgagcctgccggagggaaccgggcgaaccgtcggcgaagacccccaggggctgtttcagaaacatagagaagaagagctggaagaaagacggaagctgtataggtggggcaactggaaagacggtctaatactcaacatggccggtgccaagctctacgacctgcctgtcgacgaacggttcctggaggacaaaagggtcgactttgaggtgagcctggcgaaaggtctggctgatctggccattaaagacagtctaaacgtgcttacttgctggaaggatctggatgatttcaatcggatcttttggtgcggccagtctaagctcgccgaaagggttagagatagttggaaggaggatgccctgttcggataccagttcctgaacggggcaaaccctgtggttcttcgacggagcgcacacctgccagccaggttggtgttccctcccggtatggaggaactccaggcccaactggaaaaggagctggaaggtgggactctcttcgaggcagatttcagccttctggacgggatcaaagccaacgttatcctttgctcccaacagcatctagccgcaccattagtgatgttgaagctgcaacccgatgggaagcttctgcctatggtcattcagctccagttaccacggacggggagcccacctcccccactcttcctgcccaccgacccaccgatggcttggctgttagccaaatgctgggtgaggagcagtgattttcagctgcatgaactgcagtcccatctcctgcggggacacctgatggcggaggttatcgtcgtagctaccatgcgatgccttccatctattcatcccatctttaaactgattatcccccaccttcggtatacactggaaataaacgtaagggctcgaactggcctggtctcggatatggggatattcgatcagatcatgagtaccggtggcggaggtcatgttcagctccttaaacaggcgggagccttcttaacttatagttcattttgtccacctgacgacctggccgacaggggattactaggggtgaaatccagcttctacgcccaggatgctctgcgcctgtgggagatcatctacaggtatgtagaggggatcgtgtcattacactataaaacagacgtagccgtaaaggacgatccggaactccaaacatggtgcagagaaatcacagagattgggctgcagggagcacaggataggggctttccagtttctctgcaggccagagatcaggtatgtcatttcgtgacgatgtgtatcttcacctgcactgggcagcacgcgagcgtgcacctcgggcagctggattggtattcctgggtgcccaatgcaccctgcaccatgcggctgcctccccctacaacaaaggacgctactctggaaaccgtgatggccacactcccaaacttccaccaggccagtttacaaatgagcatcacttggcagctcgggagacgacagcccgtgatggttgctgttgggcagcacgaggaggagtattttagcggacccgagcccaaagccgtgctgaaaaagttccgggaggaattggctgccctcgacaaggaaatcgaaatccgtaacgcgaaactggacatgccatatgagtacctgaggccctcggtagtagagaactctgtggcaatttag

SEQ ID NO: 214768 - DNA, 1989 bp, Artificial Sequence
  Description of Artificial Sequence: Synthetic coding sequence
atgggcctttacagaatcagagtatcaactggagcatctctgtacgcaggctctaataatcaggtgcagctctggctcgtgggtcagcatggagaagccgcactgggaaagcgcctgtggcccgcacgaggcaaagagactgaattaaaggtggaggtgcccgaatacctggggccattgctgtttgtaaaacttaggaagcgacacctcctgaaagacgacgcctggttttgtaattggatatctgtgcagggtccgggagccggagacgaagttaggttcccttgctaccgctgggtggaaggcaatggagtgttaagcttgccagaaggcaccggcaggacagtgggagaggaccctcagggcctcttccagaagcatcgggaggaagagctggaggagagacggaagctttacagatggggaaactggaaagatggcctcatattgaatatggccggagccaagctatatgatctccctgtcgacgagcgctttctggaggataaacgcgttgacttcgaggtctcactggcaaaaggacttgccgatctcgcaattaaagatagtctcaatgtgctcacctgctggaaagacctggacgactttaaccggattttctggtgcggtcagtccaagctggcggaacgcgtgcgggatagctggaaggaggatgctctctttggttatcaattcctgaacggagctaacccagtggtgctcaggaggagcgcccacctgcccgctcgtttggtgttcccccctggaatggaggagttgcaggcgcagctggagaaggaactcgagggcggaaccttattcgaagccgatttcagtttactcgatggcatcaaggccaacgtgattctttgctcgcagcagcatctggccgcacccttagtaatgctgaagctgcagcccgacggcaaactcctgcctatggttatccagttgcagctgccaagaactggctccccaccccctccccttttcctcccgacagacccaccgatggcctggctccttgcaaagtgttgggtccggtcttcagattttcagctccatgaattgcagtctcatctgttacgagggcacctgatggcggaagtaatcgtggtggcaacaatgaggtgtcttccgtccatccatccaatattcaagctgataatccctcacttgagatacactctggagatcaacgtaagagcgaggaccggtttggtgtccgatatgggcatttttgatcaaatcatgagcacaggaggcggtggtcatgtccagctgctgaaacaggcaggggcattcctaacatatagtagtttctgtcctcctgatgatctcgccgacaggggcctcctgggcgttaagagtagtttctatgctcaggacgcccttaggctttgggaaatcatctacaggtatgttgagggcatcgtgtccctgcattacaagacagatgttgcggttaaggatgatcccgagctacaaacctggtgtcgcgagattaccgagataggtctgcaaggcgcacaagatcggggattccctgtgtcactgcaggccagggatcaggtctgtcactttgtaacaatgtgcattttcacttgtactggccagcatgcttctgtccacttgggccaactagactggtactcgtgggtcccaaatgcgccttgcactatgagacttcctcccccaacgaccaaggatgcaactctcgaaacagtcatggccaccctaccaaacttccaccaagctagtcttcaaatgtctatcacgtggcagctgggacggagacaacctgtgatggtcgccgtgggtcagcacgaggaggagtatttttccggccctgaacccaaggcagttctcaaaaagtttagagaggaattagctgcccttgataaagagattgagatccgaaatgcaaagctggacatgccgtacgaatacctgaggccgagcgtggtcgaaaattccgtagccatatag

SEQ ID NO: 214769 - DNA, 486 bp, Artificial Sequence
  Description of Artificial Sequence: Synthetic coding sequence
atggaccaggaaactgttggtaatgtagttttgctggccattgtcacacttatcagtgtggttcaaaatggattttttgcccacaaagtggaacacgagtcaaggacccagaacggacgatcctttcagcggactggtactcttgcatttgagagagtgtatacagcgaaccaaaattgcgtggatgcctaccctacatttttggctgtgctctggagtgctggtcttctgtgttcccaagtaccagctgcattcgccggactgatgtacctcttcgtgcgccagaaatactttgtggggtatttgggggagcgcacacagagcactcctggctacatcttcggaaagagaatcatattatttctgttcctgatgtctgtggctggcatatttaactactacctgatctttttcttcggctctgattttgagaactatattaagaccatcagtactactatctcgcccctgctcctgataccttag

SEQ ID NO: 214770 - DNA, 2532 bp, Artificial Sequence
  Description of Artificial Sequence: Synthetic coding sequence
atgccccgaggagcatttagaccatgtctccccgcactctacttcgctttcctgacgtgccctacgccagagcagcggatgtccggcactcaggcgccagatatccatttaggcgagcccgctcgagggacaggttgtgtacggggaaaacaaactagcatcagggttcaagactgcggccgtagagaagaggcaagagccgcatctagagagttaaggagggaaaaggcacaggaacaccccagagaaagctgggcccacccccaaccgtaccccgctccacaaccactcgctctcagaccagagacacaaccgtgccccgcatgcagatcatcccccccagggagactactcttacgtccagctctcccgggtcacccctttttactcccgattatggctgtgtaccgtttgtgtgtgaccactggcccatacctccgggctggcaccctcgataatataagtgtcaccctcgtgggtacatgtggcgagtcacccaaacagagactggatcgcatgggcagggacttcgctcctggatccgtccagaagtataaggtgagatgtacagccgagctgggagagctgctccttctcagggtgcacaaagagcgttacgcattcttcagaaaggactcctggtactgctcccgtatttgtgtaactgaaccagacggcagtgtttcacattttccatgctaccagtggatagagggatactgtaccgtggagcttagaccagggaccgctcggacaatctgccaggattctctgcctctgttgctagaccaccgaacacgggagctgagggcaagacaagagtgttatcggtggaagatttacgctcctggctttccctgcatggtagatgtgaacagctttcaggaaatggaatctgacaaaaaatttgcgctaaccaagactaccacctgtgtggaccagggtgattccagcggcaacaggtatctaccagggtttccaatgaagatcgatatcccttctttaatgtacatggaacccaacgtgagatacagcgccactaagaccatttcactcttatttaatgcgattcctgcatctttagggatgaagctcagaggactgttagaccgcaaaggatcttggaagaagctggacgacatgcagaacattttctggtgtcataagacctttacgactaagtatgtcaccgaacactggtgtgaggatcatttttttggatatcagtatttgaacggcgtgaacccagtgatgttacactgcattagctcactcccttctaaattaccggtgaccaatgacatggtggcaccgctgcttgggcaggacacctgccttcagacagaacttgagagaggcaacatttttttagccgactactggatccttgccgaggcccctacacactgtctcaacggaagacaacagtacgtggcagctcccctgtgcctgctgtggctgagtccccagggagcactagttcccctagcaattcagctgtctcagacccctgggcctgacagcccgatcttcttgcctactgactccgaatgggactggctgctggccaagacatgggtgcggaacagcgaatttctcgttcatgaaaacaacacacacttcctttgcacacatctgttgtgcgaggccttcgcaatggcgacactgcgacagcttcctctttgccatcccatttacaagttgcttcttccacacactaggtataccctacaggtaaacactatcgcccgagcaaccttactgaaccccgaagggcttgtggatcaggtcacgtcaatcggaaggcaagggttaatatacctaatgagcacggggctggcccactttacatatacgaatttctgcctgcccgactctctccgcgcaaggggggtactggcaatcccaaactatcactacagggacgacggactgaaaatctgggccgctattgagagttttgtctctgagatagtggggtactactaccccagcgacgcatctgtgcagcaggattcagaactacaggcatggactggcgaaatcttcgcacaggcctttctgggcagagagtcgtctgggttcccaagcagactatgcacccccggtgaaatggtcaaatttttaaccgcgattattttcaactgtagtgcccagcacgctgcagttaactccggccagcacgatttcggggcttggatgccgaatgcccctagctccatgcgccagccaccccctcagaccaagggcactaccacactcaagacatacctggacacgctcccagaggtaaatatttcctgcaacaatcttctgctgttctggctcgtgagccaggaacccaaggaccaacgacccctcggcacatacccagacgaacactttaccgaagaggcccctcgcagatccattgcagccttccaatctcgtttggcccaaatcagtcgggacatccaggagcgcaaccagggacttgctctgccctacacttatcttgacccacccctcattgaaaactctgtgtcgatctag

SEQ ID NO: 214771 - DNA, 2604 bp, Artificial Sequence
  Description of Artificial Sequence: Synthetic coding sequence
atgggcaggaacagatcctgggggaccctgggaagtggccgtacatccacaccaggtcaccagtcagggcctctcacccgaaggcgggctgtgtcacagctgtatcgtaggtatttgttgttcagtatctctgcaagcgaccctagcctgcgcagtgggacacaggccccagatatacatctcggagaacctgcacggggtacaggttgcgtccgaggcaagcagacctccattcgtgtacaggactgtggcagacgagaggaagcacgggcagccagcagagagcttcgtcgggaaaaagctcaggaacacccgcgtgaatcttgggctcacccccagccttaccctgcccctcagccactcgccttaagaccagagacccagccatgtccagcctgccgaagctcacctccaggaagactattgcttcgtcctgctctgcctggacacccattcctgctccccatcatggctgtctacaggttatgcgtgacaaccgggccttatctgcgcgcaggaaccttggacaacatttcagtgacgctagtaggtacttgcggcgagagtcctaagcagcgacttgacaggatggggagagactttgccccaggctctgtgcagaaatataaagttagatgtacagctgaacttggggagctactcttgctgcgcgtgcacaaggagcgttacgccttctttcgaaaggattcttggtattgttctcgaatatgcgtgaccgagccagacggatctgtatcacacttcccctgctatcagtggatcgagggctactgtacagttgaacttcgtcccggaaccgcccgaaccatttgtcaggatagtttaccattgctgctggaccatcgcacgcgagaattaagagctagacaggagtgttaccggtggaaaatttatgcacccggtttcccttgtatggtcgatgtgaacagttttcaggagatggagagcgataaaaagttcgcgttgactaagacaaccacatgcgtggatcagggggatagcagcggaaaccggtacctgccaggttttccgatgaaaatagatattccatccttgatgtatatggaaccgaacgtgcgatattcagccacgaaaacaatctcgttgctttttaatgccatccccgcatccttgggcatgaaacttagggggctgctcgatcgtaaagggagttggaagaaactggacgatatgcaaaatatcttttggtgccataaaaccttcacaaccaagtacgtcaccgaacattggtgtgaagatcacttttttgggtaccagtacctaaatggagtgaatcccgttatgctgcactgcatctcctcattgccctctaagcttccagtgaccaatgatatggtggctcctttattgggtcaggacacctgtctccaaaccgagcttgaaagaggaaatatcttcctggcggattattggattctggctgaagccccaacccactgtctcaatgggagacaacagtacgtcgctgcgcctttgtgtctactgtggctctctccgcagggagctttagtccctctggcaatccagttgagtcagacccctggcccagactccccaatctttctgcccaccgattctgagtgggattggctcctggccaagacttgggtccgtaactccgaattcctggtccacgaaaacaatacacacttcctgtgcactcacctgctctgtgaggctttcgccatggctaccctcaggcagctgccactgtgtcaccctatctacaaattgttgctgcctcatacacgatacacattacaggtgaacacaatagccagagccacgttgctgaacccggagggtctcgtggaccaggtcacctccataggccgacaaggtttaatttatttaatgagcacaggtctggctcacttcacatatactaacttctgcctgccagattccctgagggccaggggggtgctagctataccgaactaccactacagggacgacggcttgaagatctgggcagctattgagagttttgtgtctgaaatagttggatattactatcctagcgacgcctcagtgcagcaagactccgagttacaagcatggactggagaaatcttcgctcaggcttttctgggcagggagtcctccgggtttccatcccggctgtgtacaccgggagaaatggtcaagttcctgaccgcaatcatttttaactgctccgctcaacatgccgcagtcaatagtgggcaacatgactttggcgcttggatgccaaacgccccttcctccatgcgccagccccctccacagacaaaaggcacgacgactctcaagacatacttggacacactcccggaggtgaacatctcatgtaataacttgctgctgttctggctcgtctcccaggaacccaaagatcagagacctctgggaacataccccgacgagcattttacagaggaggccccaagaaggtccatcgccgcattccagtcacgactggctcagatttctagagacatacaggagcgtaaccagggtttagcgcttccatatacttatctagaccctccgctgatcgaaaattccgtgtccatctag

SEQ ID NO: 214772 - DNA, 2136 bp, Artificial Sequence
  Description of Artificial Sequence: Synthetic coding sequence
atggctgtctacaggctttgtgtcaccaccggtccctatcttcgtgcaggcaccttggacaacatctctgtgactctggtcgggacttgcggggagtcccccaaacagcgcctcgaccggatggggagagacttcgccccaggctccgtccagaaatataaggtgagatgcactgccgaactcggtgagctgcttctcctcagagtccataaggagcggtacgctttctttagaaaagattcatggtattgctcacgcatttgcgtgaccgagcctgatggctcagtgagccatttcccttgctaccagtggattgaggggtactgtaccgtagagttacgcccaggcacagcaaggacaatttgtcaggatagcctaccgctgttgctggaccatcgtacccgggagcttagggctaggcaggagtgttatcgatggaaaatttacgcccctggatttccttgcatggtcgacgtgaacagttttcaggagatggaatctgacaaaaagtttgccctaactaagactaccacctgcgtcgatcagggggatagctctggcaatcgctatcttccaggcttccccatgaagatcgacatcccttcactcatgtacatggaaccgaacgtccggtacagcgcgaccaagaccatatctctactctttaatgccattcccgcaagcttgggcatgaagctgaggggactattagacaggaaaggcagctggaaaaagcttgatgatatgcagaacatattttggtgccacaagacattcactacaaagtatgtcaccgagcactggtgcgaggaccacttctttggatatcagtacctcaacggcgtgaaccctgtcatgttgcactgcatctcgtccttaccctcaaagctgcctgtcaccaatgacatggtagccccactgctcggccaggatacatgtctgcagactgagctggagaggggcaatatctttttggcagactactggatattggccgaagctcctacgcattgtctgaacggaagacagcaatatgtagccgcacccctctgcttactttggctgtcaccccaaggagcattggtgcctttggctatccagctgtcccagacccctggccctgacagccctatcttcctgccgacagactcagaatgggattggctgcttgcaaaaacctgggttcgcaactctgagttcttagtgcatgaaaacaatacacactttctttgtactcaccttctctgtgaggcttttgctatggcaacactacggcagctccctttgtgccatccaatatacaaactcctgctgcctcatactcgctacaccctgcaggttaacactatcgccagggctacattactgaatcccgaggggttggtggatcaggtgacaagcattggcaggcagggattaatctacctcatgagtacagggctcgcccatttcacctacactaacttctgtctgcctgatagcctcagggccagaggtgtcctggccatccctaattaccactatagagatgacggactgaaaatctgggcagctatcgagagctttgtgtcggaaatcgtcggctattactacccgagcgatgcgagcgtccagcaggactcggaactgcaggcttggaccggagagatctttgctcaggcgttcctcggcagagaatcttctggcttcccctcccggctatgcacacccggtgaaatggttaagtttctgaccgccattatctttaattgtagtgcgcagcatgccgctgttaactcggggcagcacgactttggtgcttggatgccaaatgctccatcgtccatgcggcaaccaccccctcaaacaaagggtactaccacactgaaaacgtatttggatacgctaccagaagtgaacataagctgcaacaacctgcttctgttttggctggtgtctcaggagccaaaagaccagcgcccactaggaacatacccagacgagcatttcaccgaagaggcccctcggagatcgattgcggctttccagtctaggctcgctcagattagcagagacatccaggagcggaaccaaggccttgccctgccttacacttacctggatcctccactaatcgaaaacagcgtctctatctag

SEQ ID NO: 214773 - DNA, 759 bp, Artificial Sequence
  Description of Artificial Sequence: Synthetic coding sequence
atggaaccacaatcaatgaaaggccagaaacgcccattcggaggtccatggcgcctgaaagttctcgggggacctccttggctgaggagaactctgcccaagcttgggcgtccaaaagaggccccagtagcgaggatgagtacccagagcacccacccgctcaaacctgaagcccctcgactgcccccaggaatcccggaaagtccttcctgtcagcgcaggcatacgttgcctgcttctgagtttaggtgtctcacccccgaagatgccgtgtcagccttcgagatcgaaagggaagcttttatttccgtgctgggcgtctgtccactgtacctggatgagatcagacactttctcacactgtgtcccgagcttagcctcgggtggtttgaggagggctgtttggttgcattcatcatcggctctctatgggataaagaacggctgatgcaagagtctctgacacttcaccggtcaggaggacacatcgcgcacttacacgtgctggctgttcaccgggcatttagacagcaggggagaggaccaatcttgctgtggcggtatctgcaccaccttgggtctcagccagcggtgcgacgggcagcactaatgtgtgaagacgctctcgtccccttctatgagcgcttctcgtttcacgccgtggggccatgcgctatcaccgtaggatccttgacattcatggagctccactgcagcttgaggggtcacccatttctgaggcggaactccgggtgttag

SEQ ID NO: 214774 - DNA, 624 bp, Artificial Sequence
  Description of Artificial Sequence: Synthetic coding sequence
atgagcactcagtcgacacatcctctgaagccagaggcccctagactcccccctggcatccctgagtccccgagttgccagcgaagacatacccttcccgcaagcgagttcagatgcctgacacctgaggatgctgtgtctgctttcgagatcgagcgggaggctttcatctcagtgctgggggtctgtcctctttacttggatgagattcggcacttcctaacgttgtgccccgagttatcgttggggtggtttgaagagggctgtctggttgctttcattattggctccctttgggataaagaacgactcatgcaggagagcctgacgcttcatcgctctggcggacacatcgctcacctgcatgtactggccgtgcatcgggctttccgccagcaaggaagagggcctattcttctctggcgctatctccaccacctgggctcacagccagctgtgagacgcgctgccctgatgtgcgaagacgctctggtgcctttctatgaacgcttcagctttcatgccgtgggtccctgcgctataaccgtaggtagcctgacgtttatggagctacactgctccctgaggggccacccttttctcaggaggaactcaggctgttag

SEQ ID NO: 214775 - DNA, 1536 bp, Artificial Sequence
  Description of Artificial Sequence: Synthetic coding sequence
atggtgttgctggccgctgcagtatgtaccaaggccggtaaggctattgtttcgcgacagtttgtggaaatgacaaggacccgtatcgagggattattagccgcattccccaagttgatgaatactggcaaacagcacacgtttgtcgaaacagagtccgttaggtacgtgtatcagcccatggagaagctgtacatggtcctgattaccaccaagaacagtaacattctggaggaccttgaaaccctgagactgttttctcgagttataccagaatactgcagagctctggaagaaaatgaaatatcggagcattgcttcgacctgatcttcgcgttcgacgagattgtggccctcggctaccgcgagaacgtgaacctagcccagattcgcactttcaccgagatggatagtcacgaagagaaagtgttcagggccgtgcgggagacccaggaacgggaagccaaggccgagatgagacgtaaggccaaggagctgcaacaggctcgtcgggatgcagagcggcagggcaagaaggctcccggtttcggaggcttcggctcttccgctgtctctggtggcagtacagctgctatgatcaccgaaactataatcgagaccgacaagcccaaggttgctccagcccctgccaggccgtctggcccttcaaaagctctgaagctgggcgcaaaaggaaaggaagtggataactttgtggataagctaaagagcgagggggaaaccatcatgtcttctagtatgggaaagcggactagtgaggccactaagatgcatgcacctcctatcaatatggaatccgtgcatatgaagattgaggaaaaaattacactcacctgcggcagggacggcggactgcagaacatggaactgcatggcatgatcatgctcaggatctccgacgacaagtacgggcgtatcaggttacacgtggaaaatgaggacaagaaaggggtacagctgcagacccatccaaatgtggacaagaaactcttcacagcggaatctctaattggccttaagaaccccgaaaaaagctttcccgtgaatagtgatgtgggggtcttaaagtggcggttgcagaccaccgaggaatcttttattcccttgacaatcaattgctggccaagcgaaagtgggaacggctgtgatgtgaacatcgaatatgaacttcaggaggataatcttgagcttaacgatgtggtgatcacgatcccgttgcctagcggtgtgggcgcacctgtcattggagaaatcgatggcgaatatagacacgattcccgaagaaacactctggagtggtgcctgcccgtaattgacgccaaaaataaaagcggtagccttgagttttccattgcgggacagcccaacgacttttttcctgtgcaggtctcatttgttagcaagaagaactactgtaatattcaggtcactaaagttacccaggtcgacggaaacagtcccgtgcgattctccaccgagactacgttcctggttgacaaatacgagatactgtag

SEQ ID NO: 214776 - DNA, 1659 bp, Artificial Sequence
  Description of Artificial Sequence: Synthetic coding sequence
atggccgaatgcaacctggtagctatcctcatttctagcattgataaccctctggacaagaatctggataatgggggtaactcctgcttagactttcgacctctgaactcctttagtcagccccaagtgctgctagctgccgcagtgtgtacaaaggctggaaaggccatcgtatctcgccagttcgtggagatgacccggacaagaatcgaagggctcctggcagcctttccgaagctcatgaacaccgggaaacagcatactttcgtcgagacagagagcgttcgatatgtgtaccaacctatggagaagctctatatggtgctgattacaaccaagaactctaatatattggaggatctggagactttaagattatttagtcgtgtaataccggagtattgtcgtgcgctggaggagaacgagatctctgagcattgtttcgatctcatctttgccttcgatgaaatcgtggctctggggtatcgggagaacgtaaatttggcccagatccggacctttacagagatggactctcatgaagaaaaggttttcagagcagtgagagagacccaggaaagggaggcaaaggcggagatgcggaggaaggctaaggagttgcaacaagcccgtagggatgcggagcgtcagggaaagaaggcgccaggcttcggtggattcggatcctccgcagtttctggcggatctactgccgcaatgatcactgagaccatcatagagacagacaaaccaaaggtggctcctgcccctgcccgaccttctggcccaagcaaagccttaaagctaggggcaaaaggaaaggaggttgataattttgttgataagctgaagagtgaaggggaaaccataatgtccagctctatgggtaagcgcacatccgaggctaccaagatgcacgcccctccaataaacatggaatctgtccacatgaagatcgaggaaaaaattactctgacgtgtggcagggatggcggtctacagaatatggagcttcacggcatgattatgctgcggatctccgacgataagtacgggagaatccgactccacgtagaaaatgaagataagaagggagtccaacttcagacacaccccaacgtagacaaaaagcttttcaccgccgagtcgctaattggccttaaaaaccctgagaagtctttccctgtcaattctgatgtgggcgtcctgaagtggcgcctgcagacaacagaggaaagcttcataccccttacgatcaactgctggccctcagagtccgggaacggctgcgatgtcaatatcgaatacgaactccaggaagataatctagagcttaacgacgtggtgattaccatcccgctccccagtggcgtcggagcaccggttatcggtgaaatagacggcgagtacaggcacgattctagaaggaatactctggagtggtgcctgccagtgatcgatgcgaaaaacaaaagcggatctctggaattctctattgccggacagcctaacgacttcttccctgtgcaagtctcattcgtctccaaaaaaaactattgcaacattcaggttactaaagtaactcaggtagacggcaactcacctgtacgcttctccaccgaaaccacgtttctcgtcgataagtatgagatcctttag

SEQ ID NO: 214777 - DNA, 1272 bp, Artificial Sequence
  Description of Artificial Sequence: Synthetic coding sequence
atgatccccgaatactgcagagctcttgaggagaatgagatttccgaacattgtttcgatctgatcttcgcctttgacgagatcgtggcactagggtacagagaaaacgtaaatttggcgcagatacgtacttttacagaaatggatagccatgaggaaaaggtatttagggccgtgagagaaactcaagagcgcgaagccaaggctgagatgcggcgaaaagccaaggagctgcagcaggccaggcgggacgccgaacgtcaagggaaaaaggcgccaggctttggtggattcggcagctcagcggtcagtggaggctcgaccgcagccatgatcacagagacaatcatcgagaccgataagcccaaagtggcccctgcccctgcaaggccgtccggtccttccaaagctctgaaacttggggcaaagggcaaggaagtagataactttgtggataagctcaagtcagagggcgagaccatcatgagctcctcaatgggaaagaggacatcggaggccaccaaaatgcacgctccccctatcaacatggaaagtgtacacatgaagattgaggagaaaattaccttgacttgtgggcgagatgggggattgcagaacatggagctccacggaatgatcatgctgcggataagtgatgacaaatatggccgtattagactccacgtagagaacgaggacaaaaaaggcgttcagctccagactcaccccaatgtcgacaagaagctgttcacagcagagagcttgattggtcttaagaatcccgaaaagtcattccctgtaaattctgacgtgggggtgctgaaatggcgccttcagaccacagaggagtcattcattcccctaaccatcaactgctggccatctgagagcggcaacggttgtgacgtgaatattgagtacgagttacaggaagataacctggaactcaatgatgtcgtgataactatccccttaccgtccggagttggagcccctgttatcggggaaattgatggagagtacagacatgatagccgtagaaatacactagaatggtgtctgccagtgattgacgcgaagaataagtctggctcactagagttttctatcgccggtcagcccaacgactttttccctgtgcaggtttcattcgtgagcaaaaagaactactgcaatatccaggtcacaaaagtgacacaggtagatggcaatagccccgtgcgcttctctacagaaacgacatttttggtggacaagtatgaaatactttag

SEQ ID NO: 214778 - DNA, 570 bp, Artificial Sequence
  Description of Artificial Sequence: Synthetic coding sequence
atggtccttcttgcagcagccgtgtgcactaaagccggaaaggctattgtgtcccggcaatttgtggagatgacccggactaggattgagggtttgctggctgcattccctaaactcatgaatacaggtaagcagcacactttcgtggaaactgagagcgtccgctacgtgtaccagcctatggagaagctgtatatggtcttgatcactactaaaaactctaacatcctggaagatctggagacactacggctcttttcgagagtcattcccgagtattgtagggctctcgaggaaaatgagatatccgaacactgttttgatctgatcttcgctttcgacgaaatcgtggccctgggatatcgcgaaaacgtaaacctcgcccagattaggacattcacggagatggactctcacgaggagaaagtctttagggccgtccgggagacccaggagcgcgaagctaaagctgaaatgaggcggaaggctaaggaactgcaacaggctcagtctgtaggtattactgggatgtctcaccacgcccagttgttactctactttaatccgtag

SEQ ID NO: 214779 - DNA, 2223 bp, Artificial Sequence
  Description of Artificial Sequence: Synthetic coding sequence
atgaccgtaaagctggatttcgaagagtgtctgaaggattcgcccagattcagagcatcaatagaactggtcgaggcagaagtgtctgagctggagacacgcttggaaaagttgttgaagctgggaactgggctgctcgagagcggacgacattatttagccgcatcccgggcatttgtggtcgggatatgtgatctggccaggctcggaccaccagaaccaatgatggctgagtgtctcgagaagttcacggtttcactgaaccacaagctcgactcccacgcagagctgctagacgcaacacaacacacgctgcaacagcagatccagacccttgtgaaggagggattgagaggcttcagggaagctcgacgcgatttttggagaggggctgagtctctggaagccgctttgacccacaatgccgaggtgccacggcgtcgagctcaggaagcagaagaggccggtgcagcattacgcaccgctcgggcaggttatagaggtagggcactggattacgccctccagatcaatgtcattgaggataaacggaagttcgacattatggagtttgttcttcgcctggtggaagcacaggctacccattttcagcagggacatgaagagctgagtcgcctgtcgcagtaccgcaaggaactaggggctcagctgcatcaactcgtcctgaattcggcacgagagaagcgggacatggagcaacgccacgtgctcctgaaacagaaggagttggggggagaggagccagagccctctttgagagaagggccaggaggacttgtcatggaggggcacctatttaagagggcatccaacgcctttaagacttggagccgcagatggtttaccatccagtccaaccaactcgtctatcagaaaaaatacaaggatccggtaacggtggtagtagatgatttaagactgtgtactgtcaaactatgtcccgacagcgagaggagattctgctttgaggtggttagcacgtccaagtcttgtttactgcaggcagactccgaaaggctgcttcagctctgggtgagtgcagtccagtcgtctattgccagtgctttttctcaagctaggttagatgattctcccagaggacccggtcagggatccggccacttggctataggctccgcggctactctgggaagcggtggcatggctaggggcagggaaccgggtggggtgggccacgtcgttgcacaggtccagtctgtcgacggcaatgcgcagtgttgtgattgtcgcgaacctgctcctgagtgggcgtctattaacctgggggtgaccttgtgcatccagtgttctgggattcatagaagcttaggggttcacttcagtaaggtccgttcactgacactggattcgtgggaacctgagctcgtaaaactcatgtgcgagctaggtaacgtcattattaatcagatttatgaggccagggtcgaagctatggccgtcaaaaagcccggaccaagttgctcacggcaggagaaggaggcctggatccatgctaaatatgtggagaaaaaatttttgacgaagctgcctgagattagaggaagacggggaggtcggggacggcctcggggacagccacccgtgccaccgaagcccagcataaggcctcgcccaggatccttacgctcaaaacccgaaccaccgtctgaggatctaggctcactccacccaggggctctattatttcgggctagcggtcatcctccgtcattaccaacgatggctgatgctctggcccacggcgcagacgtcaattgggttaatggagggcaggacaacgccacaccccttatccaggcaaccgctgcaaacagtctcctagcttgtgaattccttctacagaatggtgccaatgtaaaccaggctgactccgctggccgtgggccactgcatcatgccacgatactggggcacacagggctcgcttgtctgtttttaaagcggggagcggatctcggagcgagagacagcgaaggaagagaccctctgacaatagcgatggagacggcgaacgcagacattgtcaccctgctgcgactggcgaagatgagggaagcagaggccgctcagggccaagcaggagacgaaacttacttggatatctttcgggacttctcccttatggcctctgatgacccagagaaactttcgcgtagatctcacgatctccacaccttatag

SEQ ID NO: 214780 - DNA, 2337 bp, Artificial Sequence
  Description of Artificial Sequence: Synthetic coding sequence
atgaagatgacagttgactttgaggaatgtctgaaagattcccctcgctttcgggctgctctggaggaagtggaaggagacgtggcggagctcgaactcaagctggataaattggtcaagctttgcatcgcaatgatcgataccggaaaagcgttttgtgtggccaacaaacagttcatgaatggcatacgggatcttgcccagtattcgtccaatgatgcggtcgtagaaacatccttgacgaagtttagcgatagcctccaggaaatgatcaactttcacacaatacttttcgatcagacccaacgaagtattaaggcccagctccagaactttgttaaagaggatcttcggaaatttaaagacgccaagaagcaattcgagaaggtttccgaggagaaggagaacgctttggtgaagaacgcgcaagttcaaagaaacaaacaacatgaggtagaggaagcgaccaacattctgacagcaacccgtaagtgttttaggcacatagctctggattacgttctacagattaacgtgctccaatccaaaaggaggtccgaaatcctgaaaagcatgctctcattcatgtacgcccatcttgcattctttcaccaagggtatgaccttttttccgaattagggccatatatgaaggacttgggggctcagttggacagactcgtagtagatgcagctaaagaaaaaagggagatggaacagaaacatagtactattcaacagaaggacttcagctccgatgacagcaagctggagtacaacgtcgatgccgctaatggcattgttatggagggctatcttttcaagagggcatcaaatgcgttcaaaacttggaaccggaggtggttcagcattcagaacaaccagctggtataccagaaaaagttcaaagataaccctacggttgttgtcgaggatctccgcctttgcaccgtgaaacattgcgaggacattgagcggagattttgttttgaagtggtcagcccaacaaagtcttgtatgttgcaggctgacagcgaaaagcttcgacaggcctggattaaagcggtacagacctctatcgctactgcgtatcgggaaaaaggtgacgagtctgaaaagcttgacaaaaaaagcagcccctctactgggtcactggactcgggaaacgagagcaaggagaaactcctcaaaggggagtcagcacttcagcgcgtccagtgtatccccggaaacgcctcatgctgtgactgtgggctcgccgaccctaggtgggcctcaattaacctgggaattacattatgcattgaatgtagtgggatacatcgttctctgggagttcacttctccaaggtccgatcgctcacccttgatacatgggaacctgaactcctcaagctgatgtgcgagctggggaatgacgtgatcaaccgggtatatgaagccaacgtggaaaaaatgggtattaaaaaacctcaaccgggacagcgccaggagaaagaagcttacatcagggccaaatacgtcgaacgcaagtttgtggacaaatacagtatctctttaagccctcctgaacagcagaaaaaattcgtttctaagtcttcagaagagaaaagactgagcatctctaaattcggaccaggcgatcaggtcagggcatcagcccaaagctcagtgcggagtaatgactcaggaattcagcaaagcagtgacgatgggagggaatcccttcccagtactgtatcagctaactcactctacgaacccgaaggcgaacggcaggacagctctatgttcttggacagcaagcatcttaatcctggactgcagctgtatcgggctagctacgagaaaaacttaccaaaaatggccgaagcattggcgcacggcgctgacgtaaactgggctaatagcgaggaaaataaggcgaccccgctgattcaggccgtgcttggcggttccctggtgacatgtgagttcctattacaaaacggagccaacgtcaatcagcgggatgtccaaggcagaggcccacttcatcacgcaaccgttctggggcacactggccaggtatgtcttttcctgaagagaggcgctaaccagcacgcgaccgacgaggaggggaaggaccccctgtcgatcgccgtagaggctgccaacgctgatattgtgaccctgctgcgtcttgccagaatgaacgaggagatgcgcgagtccgagggcctatacggacaaccaggggatgagacgtaccaggatatcttccgagatttcagtcagatggccagcaacaaccctgagaaactgaatcgctttcagcaagattctcagaagttttag

SEQ ID NO: 214781 - DNA, 3618 bp, Artificial Sequence
  Description of Artificial Sequence: Synthetic coding sequence
atgacgaagaaggaggagcctccacccagcagggtgcctcgcgctgtgcgggtggcaagcctgttgtcggaaggtgaggaattgagcggcgacgaccagggcgacgaagaggaggatgaccatgcctacgaaggcgtgcctaatggaggatggcacacgtcttcactgtctctctccctgccatcaaccatcgctgctccgcaccccatggatggtccacccggtggctccactccagtgacaccggttattaaggcagggtggctggataaaaacccacctcagggctcctacatttaccaaaaacgttgggtgcgacttgacaccgatcacttaagatactttgacagcaataaggacgcatactccaagcgattcatttccgttgcatgcatctctcacgtggcagctattggggatcagaagttcgaggtgataaccaataatcgcaccttcgcgttcagggcagagtccgacgtggagaggaaagagtggatgcaggccctacagcaggctatggccgagcagcgtgcccgagcccgtctgagcagcgcttacctgttgggcgtgcctggctccgaacaacccgaccgcgcagggtctctggaactgagaggattcaaaaacaagctttacgtcgccgtggttggtgataaggtgcagctgtataagaacctggaagaataccacctcgggatagggattacatttatagatatgtccgtgggcaacgtgaaggaagtggatcgcagatcgttcgacttgaccactccataccgcattttcagcttttccgctgacagcgagctggagaaggagcagtggcttgaagccatgcagggcgcaatagctgaagctctctccactagcgaggtcgcagagaggatctgggccgctgctccaaatagattctgtgctgattgcggagctccccagcccgattgggcctccatcaacttgtgcgtggtgatctgcaagcgctgcgccggagagcaccggggtttgggtgccggagtgtctaaggtgcgcagcttaaagatggaccgaaaggtatggacggaaacactcattgaactgttcctccagctgggaaatggggcaggtaaccgcttttgggccgctaacgtccctccaagtgaggctttacagccctcaagctcaccctcaacccgacgttgtcacctggaggcaaaataccgcgaagggaaatatcgccgatatcacccattattcggaaatcaggaggaactcgacaaggcactatgtgctgctgtcacaacaacggacctcgctgagacccaggcactgctcggatgcggcgctgggattaattgcttctccggagacccagaagctcccacaccccttgcgttggcagagcaagctggacagactctacagatggagttcttgagaaacaatagaactacggaagttcctcgcctggatagcatgaaacctctcgaaaagcattactctgtggtcttaccaaccgtttcccattctgggtttctctacaagactgcttctgccggtaagcttctgcaagatcgcagggcaagagaagagttttctcgccgttggtgtgtgctgggagacggcgtgctgtcatatttcgagaacgagcgcgctgtaacccctaacggcgaaatccgtgcctccgaaatcgtatgccttgccgtgccccctcccgatacacatggattcgaacatacatttgaggtttataccgaaggagagcgcctgtatctcttcggcctcgagtctgccgaacaggctcacgaatgggtcaagtgcatcgcaaaagcattcgtacccccattggccgaagacctactcgccagagactttgaacggttgggccgactgccatataaggcagggctgtccttgcagcgcgcacaggaaggctggtttagcctgtccggctccgagcttagagcagtgtttcccgaggggccatgtgaggaacccctccagctgcggaaactgcaagagttatctattcagggcgattctgaaaaccaagtgctagtccttgttgagcgtaggaggaccctttatatacagggcgagagacgcctggatttcatgggctggcttggggcaattcagaaagccgctgccagtatgggcgacacactctctgaacaacagttgggggactctgatattcctgtgatcgtctatcggtgtgtggactacattacccaatgtggcttaaccagcgagggaatttatcgtaagtgcggacagacctctaagacacagcgcctgctggagagtcttcgacaggatgcgcgttcagtgcacctcaaagagggcgagcagcacgtagatgatgtcagtagtgctcttaaaaggttcctgcgcgatctgcccgacggactatttacaagagctcagaggttgacgtggttggaagccagcgaaatcgaagatgaagaagagaaggtcagtcgctacagggaacttcttgtcagactccctcctgtcaaccgtgcaacagtaaaagcacttatctctcacctttattgtgtccagtgtttctctgacacaaatcagatgaatgtgcataacctggccatagtgtttggacccactctctttcagacagatgggcaagattacaaagccggtagagtggtggaagatctcattaaccactacgtggttgttttctcagtcgatgaggaggagttacggaagcagagggaggagatcaccgccatagttaagatgcgcgtggcaggaacagcttcaggcacccagcatgcgggagatttcatatgcaccgtgtatttagaggagaagaaggctgaaaccgagcaacacataaaggtccccgctagcatgactgcggaggaattgacgctcgaaattctggatcggagaaatgttggtatccgggagaaagattactggacatgtttcgaggttaatgaaagagaggaagccgaacgacctcttcacttcgcagaaaaggtccttccgattctccacggtctgggaactgactctcacctggtggtgaagaagcaccaggctatggaagccatgctcctgtatctggcatctagggttggagataccaagcatgggatgatgaagtttcgtgaggatcggtccttgttgggcctgggactcccatccggcggatttcacgaccggtattttatcctcaattcatcctgtctgcgtctctacaaggaggtgcgatcacagcgtccatggtccggcgctccagagacaagccatcgccctgagaaggaatggcctatcaaatctcttaaggtgtatctcggggtgaaaaagaagctgcggccacccacttgttgggggtttaccgttgtgcacgagaccgaaaagcacgagaaacaacagtggtatctttgttgcgatacccagatggagctgagggagtggtttgcaacttttctcttcgtgcagcatgatggactggtgtggccttctgagccgtcccgcgttagtcgcgcagttccagaggtgaggctggggtctgtctccctgatccccctgcggggaagtgagaacgaaatgcgtcggagtgtggcagccttcactgcagatcccctgtccttactgaggaacgtctag

SEQ ID NO: 214782 - DNA, 1884 bp, Artificial Sequence
  Description of Artificial Sequence: Synthetic coding sequence
aagtgctgggccgtctgggtgggtgcggtgtggacagagggagcttggcagcccagggtgggggtgatttgcggcctaaagggccgaatgacattatctgggtcccgcggacaggaggagccgccaccatctagagtgccaagggctgtcagagtggcttcactcttgagcgagggggaagagttatcaggggatgatcaaggcgatgaagaagaagacgaccacgcttatgagggcgttccaaatggcggatggcacaccagctctctttcactcagccttccctcaacgatcgcagcccctcatccgatggacggccctccaggaggtagtacgcctgttacccctgttatcaaggccggttggctagacaagaatccaccacagggttcctatatatatcaaaaacgctgggttcgactggatacggaccatctgagatacttcgactctaataaggatgcatacagcaaacgctttataagtgtggcttgcattagtcacgtggccgctattggcgatcagaaattcgaagtgattacaaacaatagaacatttgccttcagggcggagagcgacgtggaacgaaaggagtggatgcaggcccttcagcaggcgatggccgaacagagagcgcgtgcacgattgagtagcgcctatttactgggagtgcctggaagcgagcagcccgatcgggcaggttctctggaactaaggggcttcaaaaacaaactgtatgtagcagtggttggcgacaaagttcaattatataagaacctggaggaataccacctcggcatcgggatcacctttattgacatgtccgttggaaatgtcaaggaggttgaccgcaggagttttgacttaaccaccccctacagaatcttcagcttttccgcagatagcgaactggaaaaggagcagtggctggaagccatgcagggggctatcgctgaagccctgtctacttcagaggtcgctgagagaatttgggctgctgcccctaataggttttgcgctgactgtggcgcaccccagccagactgggctagtatcaacctgtgcgtggtgatttgcaaacgctgcgctggcgagcaccgcggactgggcgctggcgtctccaaggtgaggtctctgaaaatggaccgcaaggtgtggaccgagacattaatcgaactgttcctgcagctaggcaatggagccggaaatcgcttttgggccgctaatgtcccgccatctgaggctctccagcctagctcaagtccatctacacgacggtgccacctggaagccaagtaccgggaaggcaaatacaggaggtaccatccactgttcggaaatcaggaggagcttgacaaagctctatgtgcagccgttacaactacggacctggctgagactcaggcacttctcggctgcggcgcaggtatcaactgtttttctggtgaccctgaggcacctactcctttggcgctcgccgagcaggcaggacagactctccaaatggagttcttaaggaataataggaccaccgaagtcccccgactggactccatgaaaccactggagaaacactatagcgttgtattgccaacagtgtctcacagtggcttcctgtataagacagcttccgcagggaagctgctgcaggacagaagagcaagagaggagttctcacggaggtggtgtgttttgggagatggcgttctgtcgtactttgaaaacgagagggccgtgacgcctaacggtgagatcagggcgagcgaaattgtgtgcctagcagtccccccacctgacacccacggcttcgaacacactttcgaggtgtataccgagggcgaacggctgtatctgtgggcgggagagtgcggggctggatcctag

SEQ ID NO: 214783 - DNA, 4320 bp, Artificial Sequence
  Description of Artificial Sequence: Synthetic coding sequence
atggcggaagccggagacgctgccctctctgtggctgaatggctgagagccctgcacctggagcagtataccgggctctttgaacagcacgggctcgtatgggcgactgagtgccaggggcttagcgacactcgcctgatggacatgggtatgctgttacccggacacagaaggaggattctggctgggctgctaagggcacatacctcccccgcacccgcaccgaggccgaccccacgacccgtgcctatgaaacggcacatattccgcagtcctcccgtgcccgctacgcctcctgagcctctgcctaccaccactgaggacgaaggactccctgcagctcctcccatcccgccacgccgttcatgcctcccccctacatgtttcactacccctagtacagcggcacccgacccagtgttgccacccctgcccgctaaacgtcacttggctgagttatccgtgccccctgtcccccctcgcaccgggcctccgcgacttctggtctcacttccaaccaaggaagaggagtcccttcttccatcactaagtagtccgccacagcctcagtctgaagagccactgagtactcttccccaaggcccacctcagccaccatcaccacctccctgcccacccgagatacccccaaaacccgtgcgactttttccagagtttgatgattcagactacgacgaagttcctgaggaaggcccaggagccccagccagggtgatgacaaagaaggaggagcctcctccctcccgcgtgcctagggctgtgcgtgtagcttcgctactatctgaaggggaggaacttagcggagacgaccagggcgatgaggaggaggacgatcacgcatatgaaggcgtccctaatggtggctggcatacctcaagtttgtccctgtcactacccagtaccatagctgccccacacccaatggacggcccacctggcggttctactcccgtcactcccgtgatcaaggcgggttggcttgataaaaatcccccacaggggagctatatctatcagaagaggtgggtcagacttgacactgatcacctgagatatttcgactcaaataaggacgcttacagtaaacgctttatcagcgtggcctgcatcagccacgtcgccgctatcggcgaccaaaagttcgaagtcataacaaataatcgtacgtttgcctttagagccgagagcgacgtggagcgcaaggagtggatgcaagccctccagcaggctatggcggagcagcgggctagagccagactgtcgtcggcctatttgttaggcgtacctgggtcggagcagcccgacagagcaggtagtctagaactgagaggtttcaaaaataagttgtatgtggcagtggtgggcgataaggttcagttgtataaaaacctggaagaataccacctcggcataggcattacctttatcgacatgagcgttggaaacgtgaaggaggtggaccgcaggtcctttgatctgacgactccgtaccgaatattttcattttctgcagatagtgagctagaaaaagagcaatggcttgaagcgatgcagggcgctatcgcagaagctctgagcacgtctgaggttgccgaaagaatatgggcagctgcccctaacagattctgcgccgattgtggtgcgcctcagcctgactgggccagcatcaacctgtgtgtcgtcatttgcaagaggtgtgcaggggagcatcgtggattgggggctggtgtctctaaggtgcgcagtttaaagatggaccgcaaggtatggacagaaacattgattgagctctttttacagcttggcaatggtgctggcaacagattttgggccgcaaacgtgccaccttccgaggccctccaaccgtcatcctcaccaagcactcgccgatgccacctggaagcaaaataccgtgagggaaaataccgcagataccatcccctgtttggtaaccaggaggaacttgataaggccctatgcgcagctgtgacaactacagacctcgcagaaactcaggccctgctaggctgtggagccggtattaactgcttttccggggacccagaagcacccactcccctggccttggctgagcaggccggacagactttacagatggagtttctgcgcaacaaccgcactacggaagtcccacgcctggactcaatgaagccacttgagaaacattattcagtagtactgcctaccgtatcacacagtgggtttctgtacaagactgcgtccgcaggtaaactgctccaggacaggagggccagggaggagttttccaggagatggtgtgtgctgggagacggggtgctgagctacttcgagaatgaaagagccgttacacccaacggagagatccgtgcaagtgaaattgtgtgcttagctgtgccccctcctgacactcatgggtttgagcacaccttcgaggtctacactgaaggtgaaaggctctacctgttcggcctagaaagtgccgagcaggcgcacgaatgggtgaaatgtattgccaaggccttcgtgcccccactcgccgaggacctgctagctcgtgactttgaaaggttaggacggctgccctacaaagccggtctgagcctgcagcgtgctcaggagggatggttttctctgagcggctcagagttgcgcgctgtctttcctgaaggtccatgcgaggagcccctccagttacgaaaactgcaggagttgtccatacagggtgatagcgagaatcaagttctcgttcttgtagagcgtcgacgcactctctacatccaaggagagcgcaggctcgatttcatggggtggctcggagctattcagaaagcagcagccagcatgggcgacacactgagtgagcagcaattaggagattctgacataccagtcatcgtctaccgctgcgttgactatataacgcagtgtggcctgacctctgaaggcatttacaggaaatgtggccagacatccaagacccagcgcttgttagagagtttgcgccaagatgctcggagtgtccacctgaaagagggagaacagcatgttgatgacgtctcttcagccctgaagagatttctgcgcgacctgccagacggactgttcactagagctcagagactgacatggctggaggcttcagagattgaagacgaagaagagaaagtgtcgagataccgtgagctgcttgtgcgactgccacccgtcaaccgcgcaactgttaaggcactgatctctcacctctattgtgtccagtgtttttccgataccaaccagatgaacgtacacaatctagctatagtgttcggtccaaccctcttccagacagatggtcaagattataaggcaggcagagtggttgaagaccttataaaccattacgttgtcgtgtttagtgtagatgaggaggaactgcgcaagcaaagggaggaaataacggccatagtgaaaatgcgggttgctggaaccgccagcggcacacagcatgctggagattttatctgcactgtgtatttggaggaaaaaaaggcagagacagagcagcacataaaggtgccagctagcatgaccgcggaggagctaacactggaaattttggataggagaaatgttggcatcagagaaaaagactattggacatgtttcgaagttaacgagagagaagaggcggagcggccattacatttcgccgagaaagtgctgccaatattgcatggactcggcactgacagccacctggtggtcaaaaagcatcaggcaatggaggcaatgctactctacctcgcctcccgggtcggggacactaaacacggaatgatgaagtttcgcgaggatcgctcccttctcggccttggcctgccgtcaggaggctttcacgatagatacttcattctcaactcctcatgcctccgtctctataaagaggtccgctctcacagaccagaaaaagagtggcccattaagtcgctgaaggtgtaccttggagtaaagaaaaagttgcgcccaccaacctgctggggtttcaccgtggttcacgagacagaaaagcacgaaaaacagcaatggtacctgtgttgcgatacgcagatggagctgcgcgaatggtttgctaccttcctttttgtgcaacacgacgggctggtatggccgtccgaaccatctcgtgtgtcgcgcgcagtgcccgaggtgcgcctgggctcggtgagtctcatacccctccgaggcagcgaaaacgaaatgaggcggtctgtggccgcattcacagccgaccccctcagcctgctgaggaacgtgtag

SEQ ID NO: 214784 - DNA, 3633 bp, Artificial Sequence
  Description of Artificial Sequence: Synthetic coding sequence
atgacactgtcagggagcagagggcaggaggagccgcctccatctagagtgcctcgagccgtgcgcgtggcaagcctgttatccgagggcgaagaattgtcgggagacgatcagggagatgaggaagaggacgatcatgcctacgaaggcgtgcccaatgggggatggcatacgagctcactcagcttatcactgccctcaactatagctgcaccacacccaatggacggccctccaggcggaagcacacccgtcacaccggtcataaaagcgggttggctggataaaaacccgccacaagggtcctatatctatcagaagagatgggtcaggctggacacggaccatctgagatacttcgactctaacaaagatgcttatagcaagcgctttatttctgtcgcctgcatctcccacgttgctgctatcggcgatcagaagttcgaagtgataaccaataacaggaccttcgcatttcgcgcagaaagtgacgtagaacgcaaggagtggatgcaggctctgcagcaggcgatggctgaacagagagctcgagctaggctgtctagcgcctatctcttaggggtgccgggttccgaacagccagacagagctgggtcccttgaactgcggggattcaaaaataaactgtacgtcgccgtcgtgggggataaggtgcagctctacaagaatctggaagaataccatcttggcatagggattacgtttatcgacatgtccgtcggcaacgtcaaggaggttgatcgaagatccttcgacttgaccactccctatcgtatttttagctttagtgccgacagcgagctggagaaagagcagtggctggaagctatgcagggtgctatcgccgaggctctttcaacctcggaagtagctgaacgaatctgggctgccgctcctaaccgcttttgcgctgattgtggggcacctcaacccgactgggcctctattaatttgtgtgttgttatttgcaaacggtgcgccggagagcatcgcggtcttggagccggtgtgtcgaaagttagaagtctcaagatggaccgaaaggtctggacagaaaccctcattgagttgtttctgcagctgggcaacggggctgggaatcggttctgggcggctaatgtccctcccagtgaagctctgcagccaagctctagtccaagcacccgaagatgccaccttgaggcaaaatacagggaggggaaatataggcgctaccatcctcttttcggcaatcaagaagaactggacaaggcgttgtgcgccgctgttactactacagacctcgcagagactcaggcactgctggggtgtggtgctggtatcaattgtttctccggcgatcccgaggcacccacccctttagctctagcagagcaggccggacagaccctgcaaatggagttcctacggaataaccggaccactgaagtgcccaggctcgattcgatgaaacccctcgagaagcactatagtgtggtcctcccaaccgtgtctcactccggattcctgtacaaaaccgcatccgccggtaagctcctccaagatcgacgagccagagaagaatttagccgcagatggtgcgtcttgggagacggggtgctgtcctacttcgagaatgaacgcgctgtgacgccaaacggcgaaattcgcgctagcgagatcgtgtgtctcgccgtaccacctcctgatacgcacggctttgaacacacattcgaagtctatactgagggggaacggctgtacctttttggactggaaagcgccgagcaagcacacgagtgggtcaaatgtatcgccaaagcatttgtgccgcctctggccgaagatctgttggctcgcgactttgaacgcctaggcaggctaccctacaaggccggactgtctctgcagcgggcacaagaaggctggttcagtctttccggaagcgaactccgggcagtttttccagaggggccatgcgaagaaccacttcaattgcgcaaactccaggagctctccattcaaggtgattccgagaaccaggttctggtgcttgtggaaagacgtcgcacactgtatatacagggagagcgcaggcttgactttatggggtggttaggggcaatccagaaagccgctgcaagtatgggcgacacactcagcgaacagcagttgggagacagcgacatacccgtgattgtgtatcgctgcgtcgactacatcacccagtgcggcttaacctcggaagggatctaccgtaagtgtggccagacctccaagacacagcggctgttagagtctcttaggcaggatgccaggtctgtgcatctgaaggagggcgagcagcatgtcgatgatgtgtcgtctgcattaaaaagattcctgagagacctacccgacggcctgttcacacgtgcccaacgactaacctggctcgaggcctcggagatcgaagatgaagaagagaaagtgtcccgctaccgcgaactgcttgttcggctgccaccagtgaatcgggctacagtgaaggccctcatttcacacctgtattgtgtgcagtgtttttcagatactaaccagatgaatgtgcataatctggcgattgtgtttggcccaactctcttccagaccgatggccaggattataaggccggtagggtcgtggaggacctgattaaccactacgttgttgttttctccgtagacgaggaagaactgcggaagcagcgggaggaaatcactgctatcgtgaagatgagagtagcaggaacagcctcaggaacccaacatgctggcgactttatatgtacggtttatctggaggagaaaaaggctgaaacagaacagcacatcaaagtacctgccagtatgactgcggaggagctcaccctggaaattctcgatagacgcaacgtaggaatccgcgaaaaagactactggacatgctttgaagtgaacgaacgtgaggaggcggagagaccactgcattttgctgagaaggtcttgcctattttgcatgggctgggaaccgactcccatctcgtggtcaaaaagcaccaggccatggaggccatgctgctctatcttgcgtccagggtgggagacactaaacacggaatgatgaaattcagggaggaccgatcactcctggggttaggcctgccgagcgggggtttccacgatcgctactttattctgaattcttcgtgtttgagactgtacaaagaggtacgtagccagcgaccgtggtcgggcgctcctgagactagccaccggccagaaaaagaatggcctatcaagtcactgaaggtgtatctcggagttaaaaagaagcttaggcccccaacctgctggggtttcacggtggtgcatgaaaccgaaaaacacgagaaacagcagtggtatctctgctgcgacacccagatggagctaagggaatggttcgctacctttctattcgtgcagcacgacggattagtgtggccttctgaacccagccgcgtttctagagcagtgcccgaagtcagacttggttcagtgtctctcattcctctcaggggaagcgagaatgagatgaggcgcagcgtggcggcattcaccgcggaccccctgtccctgctgcggaacgtgtag

SEQ ID NO: 214785 - DNA, 4353 bp, Artificial Sequence
  Description of Artificial Sequence: Synthetic coding sequence
atggctgaggccggagacgccgctttaagtgtcgcagagtggttgcgcgctctccacctggaacagtataccggactgtttgaacagcacggacttgtctgggccacggaatgtcagggcctgagcgatactcgccttatggacatgggtatgctattgcctggccatcggcgtaggattcttgccggacttctgcgagctcatacctccccagctccagcaccaagacctacgcccagacccgtgccaatgaagcgtcatatattcaggtctccgccagtacccgctactccgcctgaacctctccctacaaccacagaggatgagggcctcccagccgcaccgcctatccctccccgaaggtcctgtttgccaccgacctgcttcactacccctagcactgctgcccctgaccccgtgcttcccccactgcctgccaaacggcacttagcagagctatcagtgcctcccgtaccacccaggaccggcccaccaaggctgctggtctccctcccaactaaggaagaggagtcgctgttgccttcactgtcaagcccgcctcagccccagtcagaggaaccgctgtccacccttccgcaggggcctcctcagccaccaagccctccaccatgccccccagagattcccccaaagcccgtgagactgtttccagagttcgacgattccgattacgacgaggttccggaagagggtcctggggctccggcacgtgttatgactaaaaaggaggaacctcctccatcccgggtgccgagggccgtaagggtggcctctttgctctcagagggagaagagctgtcaggcgacgaccagggtgatgaagaggaagatgaccatgcatacgagggagttccaaatggcggatggcatacctcatcgctgtccctcagccttccctctaccattgcggcaccacaccccatggacggaccaccgggtgggtccactcctgtgacgccggtgatcaaggccggatggttagataagaatcctccacaggggagctacatctaccagaagcgctgggtcagattggataccgatcacctgcggtattttgattcaaataaagatgcctactctaagcggttcatttccgtggcatgtatctctcacgtcgctgcaatcggtgatcagaaatttgaggtgatcactaacaaccgcacattcgcctttcgtgccgagtccgatgtggagcgaaaagagtggatgcaggccctccagcaggccatggcagagcagagagctcgtgccagactgtcctcggcctacctgctgggtgtgcccggttcagagcaacccgatcgggctggtagtctggagttacggggatttaagaacaagctctacgtagccgtggtgggggacaaagtccaactgtacaagaaccttgaagagtatcacctcggaattggtatcactttcattgacatgtccgttggcaacgtgaaggaagtcgatagacggtcattcgacctaacgacaccctataggatcttcagtttcagtgccgactccgagctagaaaaagagcagtggttggaggcgatgcaaggagcaatcgctgaggcactatctacatctgaggttgccgaacgaatatgggcagccgctcctaaccgtttctgtgccgactgtggagccccacagccggactgggctagcattaacctgtgtgtcgtcatctgtaagcgctgtgcgggagagcataggggactgggtgctggagtaagcaaggtccgaagcctgaaaatggacaggaaggtgtggaccgagacactgattgagttgtttctgcagctggggaatggtgccggtaacaggttctgggcagcgaatgttccaccatcagaggctttgcaaccaagttctagcccctctacgcgcaggtgtcatctggaggctaagtacagggaggggaagtatcgaaggtatcaccccctgtttgggaatcaggaagagcttgacaaggctttgtgtgcagcggttactacgaccgatctggcggaaactcaggccttgctgggatgtggggctggcattaattgtttttctggagatccagaggcaccaaccccgttagcactcgcggagcaggcagggcagacgcttcagatggagttcctcaggaacaaccgcacgaccgaggtgcctaggcttgactcaatgaagcctctggagaagcattattctgtagttttgccaaccgtttcccatagcggcttcctctacaagacggcgtcggccggtaaattgctccaggacaggagggcaagggaggagttttctagacgatggtgcgtgctcggagacggggtcctgagttacttcgagaatgagagagccgtcacacccaacggtgaaataagagcctcagagatcgtgtgtttagctgtgcctccacccgacacacacgggtttgagcacacattcgaagtatacaccgaaggggaacgactgtatttatttggtctggaaagcgccgagcaggcccacgagtgggtcaaatgcattgccaaggcttttgtgccacccttagccgaggacctgctcgcaagagactttgagaggctgggcagactgccctataaagcaggcctgtctcttcagcgtgcacaggagggttggttctccttgagcggttcggagttacgtgcagtttttccagaaggcccttgcgaagagcctctgcagttgcgtaaactccaggagctgtctattcagggtgattcagagaatcaagtgctagtcttagtcgagagacggcgaacactgtacatccagggcgagcgacggctggactttatgggctggctgggagcaattcagaaggccgcagcctccatgggcgataccctctccgagcaacagctgggcgattccgatataccagtgatcgtgtatcgctgcgtggactacataacacagtgtggcttaacctccgagggaatctacaggaaatgcggccagacaagtaagacacagcgattgttggagtctctgcggcaggacgcaagaagcgtgcatttgaaagagggcgagcagcatgtggacgacgtgtcttctgctctaaaaagattcctccgggacctccctgacgggctgtttaccagagcccagcgcctgacctggctggaagcgtctgaaatcgaggacgaagaggaaaaggtgagccggtatagggagctgctggtgcggctgccccctgtgaatcgggctaccgtgaaggctctgattagccatctctattgtgtgcagtgcttctccgatacgaatcagatgaatgtgcacaacttggctatcgtgtttggccctacactgtttcaaaccgacggacaggactacaaggcgggtagagtggtggaggacctgatcaaccactatgtagtcgtgttttcagtggacgaagaagaactgcgaaagcagcgcgaggaaatcacggccatcgtaaaaatgcgggtggcaggaacggccagcggcactcagcacgccggtgacttcatatgcaccgtctatttggaggagaaaaaggcggagaccgaacagcatattaaggtgccagccagcatgacagccgaggagctcactcttgagattttagatagacgaaatgtcggtatcagagaaaaagactattggacctgttttgaggtgaatgagcgcgaggaggccgaacgacccctgcacttcgccgagaaagtcttgccgattttgcacggattgggaactgattctcacctggtggttaaaaaacatcaggcaatggaagctatgctgctctacttggcatctcgtgtgggcgatacaaagcacgggatgatgaaattcagagaggataggtcgctgctggggctgggcctgccttcaggcggattccatgacaggtactttatcctgaactcttcctgcctccggctgtacaaagaagtgaggagtcagcggccatggtcaggcgctccagagacatcccaccgacctgaaaaagaatggcccataaagagtctaaaggtgtacctgggtgtaaaaaagaagctccgccctcccacatgttgggggttcactgtcgtccatgaaacagaaaaacatgaaaaacagcagtggtacctttgttgtgatacacaaatggagttgagggaatggttcgccacattcctctttgtacagcacgacgggctcgtctggccatcggaacccagccgtgtgagtcgggcagtgcctgaggttcgcctgggatctgtgtctttaattccccttcggggatccgagaatgagatgagacggtcagtcgccgcattcacggctgaccccctgtccctactgcgaaatgtgtag

SEQ ID NO: 214786 - DNA, 3402 bp, Artificial Sequence
  Description of Artificial Sequence: Synthetic coding sequence
atgacgaagaaagaggagccccctccctccagggtgccacgagccgtgagagttgcctcacttctcagcgagggagaggaactgagcggggatgaccagggggacgaagaggaggatgatcacgcttacgaaggcgtcccaaacggtggatggcacacatcgtctctgtccctttcgcttccttcaactatcgccgcaccccacccaatggacggacctccaggcggatccacgccggtaacacccgttatcaaggccggatggctcgataagaatcccccacagggttcctacatctatcagaagagatgggtgcggttggataccgaccatctgcgctacttcgatagcaacaaagatgcatattcgaaaaggttcatatccgtggcgtgcatatcccatgtggcagctattggcgaccaaaaattcgaagtaatcactaacaataggacatttgcgttcagggccgaatccgatgttgagcgcaaagagtggatgcaggcactgcagcaggccatggcagaacagagagctagggctcggctaagttcagcctatctgctgggagttccaggcagcgagcagcccgatagagcgggttcactagaactgagaggattcaaaaacaagttatatgttgccgtcgttggcgacaaagtccagctgtacaagaacctcgaggagtatcacctgggcattggcataacgtttatcgacatgtccgtcggtaatgtgaaagaagtggaccgcagaagcttcgacctcacgactccatataggatttttagtttttctgctgacagtgagcttgagaaagagcagtggcttgaagctatgcagggagctattgcagaggccctgagtacatcagaagtcgctgaacggatatgggctgctgctccgaatcgcttttgtgccgactgcggggctcctcagccagattgggcctcaataaacctgtgtgtggtgatttgtaagaggtgcgctggcgagcaccggggtttgggcgcaggggtatcgaaggtacggtcgctgaagatggaccggaaggtctggaccgaaaccctcattgaagcattgtgcgcggcagtaactacgactgatcttgcggaaactcaggctcttctgggttgcggagcgggtatcaactgtttctctggagaccctgaagcccctactcctctggccctggccgaacaggcgggacagactctgcaaatggaattcctgcggaataatcggacaactgaggttcccagacttgacagtatgaaacccctggagaagcactatagtgtggtgctaccgacagtttctcattccggctttctgtacaaaaccgccagcgccggtaagcttctgcaagatcggcgagccagagaagaattcagccgcagatggtgtgttctcggggacggggttctttcttactttgagaacgagcgtgcggtaacgccaaatggcgaaatccgcgctagtgagattgtttgcctagcggtgccccctcccgatacccacggattcgaacatacctttgaggtgtacacagagggagaacgtctctatctgtttggcctcgaaagtgccgagcaggctcatgagtgggtcaaatgtattgccaaggccttcgtcccacccctggcggaggacctgctcgctcgggacttcgaacggctgggacggctgccatacaaagccggattaagtcttcaacgggctcaggaaggatggtttagcctgtccggctctgagctgagagccgtgttccccgagggcccatgcgaggaaccactgcagttgcgaaagctgcaggaactgtctatccaaggcgactctgaaaaccaggtgctcgtgctggttgaacgcaggcggaccctgtacatacagggggagaggcggctggactttatgggttggttgggagccatccagaaggcagccgcaagcatgggcgacacattgagtgagcagcagctgggcgattcagacataccagttatcgtgtaccgctgcgtggattatattacccagtgtggtcttacatctgaagggatctatcggaagtgcggccagacatcaaagacccagcggctcctagagtccttgagacaagacgccagatccgtgcatctgaaggagggagagcaacatgttgacgatgtgtcttcagccctgaaaaggttcttgcgggaccttccagacggtcttttcacacgagctcagcggcttacatggttagaagccagcgaaattgaggacgaggaggagaaagttagtcggtaccgtgaactgttggtgagactcccccctgtcaatagggctactgtgaaggccctgatctcccacctgtattgcgtgcagtgtttctcagacaccaaccagatgaacgtgcataatttggcgatcgtgtttggacccaccctcttccagacggatggccaggactacaaggctggccgtgtggttgaggacctgatcaatcactacgtagtggtgttttccgtggacgaagaagaactgaggaagcagagagaggagattaccgccattgtcaagatgagagttgctggaacagccagcggtacccaacatgcaggcgacttcatctgcacagtctatctggaggagaagaaagcggaaacagagcagcacatcaaggttccggcatctatgactgcagaagagctgacgttggagattctggacagacgcaacgttggcatccgggaaaaagactactggacttgtttcgaagttaatgagcgggaggaggctgagagaccattgcatttcgccgagaaagtgttacccatcctgcatggcttggggaccgacagtcatctggtggtgaaaaagcatcaggcaatggaggctatgctgctctacctggcgagtagagtgggcgacaccaaacatggaatgatgaagtttagggaggaccgctcccttctgggcttgggacttcccagtgggggattccatgaccgctacttcattctcaactcctcttgcctgcggctctacaaggaggtgaggtcccataggcccgaaaaagaatggccaatcaaatcactgaaggtatatcttggggtgaaaaagaagctgagaccccctacctgttggggcttcaccgtagtccatgagacggagaagcatgaaaaacaacagtggtatctgtgctgcgatacacaaatggaattgcgagagtggttcgcaacctttctgtttgtgcagcacgacggtcttgtgtggccgagtgaaccgtcaagggtctctagggcagttcccgaggtccgactcggcagcgtgagcctgatccccttaagaggaagtgagaatgagatgcggaggtctgtagccgcttttacggcagaccctttaagcctgcttaggaatgtgtag

SEQ ID NO: 214787 - DNA, 4320 bp, Artificial Sequence
  Description of Artificial Sequence: Synthetic coding sequence
atggcagaggccggtgacgcggcattgtcagtggccgagtggcttagagccctgcacttagagcaatataccggactatttgaacagcatggcctcgtgtgggccactgagtgtcaagggctcagcgataccagactgatggacatggggatgctgctcccaggtcacaggcggcgtatactagccggtctcctgcgagcccatacgtctccggctcccgcaccacgcccaacccctaggcccgtcccaatgaagcgccacattttccgatctccgcctgtgcccgctacaccgccagaaccactgccaaccaccacagaggacgagggattgccagcggcaccaccaattccccctaggcgcagttgcttgcctcctacatgtttcaccactccgtccacggcggcacccgatcctgtgcttcccccactacctgctaagcgccacctggccgagctaagcgtgcctccagtcccgcctcggacaggtcctccaaggttgctcgtgtccctgcctacaaaggaggaagagagtctactgccaagcctgagttcgccgccacagcctcagtccgaagagcctctgagtacgctaccacagggcccaccccaaccgccttccccccctccatgcccgccagaaatcccacccaagcccgtcaggctcttcccggagtttgatgattcagattatgatgaagtgcctgaggaaggcccaggcgcacctgcaagggtcatgactaagaaggaggaacctcctccctctagagttccacgggcagtgcgcgtggcatctttattaagtgagggcgaggaactctcaggggatgaccagggggacgaggaagaggacgatcacgcctacgagggagttcctaacggcggttggcacacttccagcctcagtctctcactgccatcgaccattgccgctccgcaccctatggacggcccaccagggggatccactccagttaccccagtgataaaggcgggatggctggataagaacccacctcaagggtcctacatctaccagaagaggtgggtgcgccttgataccgatcatcttagatatttcgacagtaacaaagacgcctattctaagcgcttcatatcagtggcctgcatcagccacgtggcggctatcggggaccagaaattcgaggtgatcactaacaatagaaccttcgctttccgcgctgagtcggatgtcgagagaaaagagtggatgcaggccctgcagcaggccatggcagagcagcgggcacgagctcggttatcctctgcatatttactgggggtgcctggaagtgagcagcctgatcgtgccggtagcctggaattgagaggattcaagaataaactctacgtagctgtggttggagataaggtgcaactctataaaaatctggaagagtaccatttgggcatcggcatcacttttatcgatatgtcagtgggcaacgtgaaagaggtggatcgacgttcatttgacctcacaaccccctatcgaatcttctcttttagtgctgactcagagctcgagaaagagcagtggctcgaagccatgcagggcgcaatcgctgaagcactgtcgacttccgaggtggctgaacggatttgggccgcagccccaaacagattttgtgctgattgcggggcaccacagcccgattgggcgagtattaacctgtgtgtggttatatgtaagcggtgtgcaggagagcatcgcggattgggtgctggtgtctcaaaagtcagatctttaaaaatggataggaaggtgtggaccgagactctgatcgagctgtttctgcagctgggcaacggagccggaaaccgcttttgggcggctaacgttccaccttcggaggccctccagccatccagctcacccagtacacggaggtgccatctggaggccaaatacagagagggcaagtaccgacgttaccaccctttattcggcaaccaggaggagttggataaggcgctttgtgccgctgtcacaactacggacctggctgaaacccaggcactgctcggctgtggagccggaattaactgcttcagcggcgaccccgaagccccaacaccactcgctctggcagagcaggctggtcaaacactccaaatggagtttctaagaaacaatcgaacgaccgaggtccccagattagacagcatgaagcccctggagaaacactactccgtcgtccttccgaccgtctctcactctggattcctctacaagacagcttcagcgggaaagctgctccaggataggcgcgctcgagaagaattcagcaggcgctggtgcgtgctaggtgacggcgtgcttagttactttgagaatgagcgcgcagttacaccaaatggcgagatccgagctagcgaaatagtctgcttggccgtgccacccccagatacccatggcttcgaacacacctttgaagtctatactgagggggagcggttatatctgtttgggctggagtccgccgaacaggcccacgagtgggtgaagtgcatcgccaaagccttcgtaccccctttagctgaagacctgctggccagggattttgaaaggctcggtcgcctgccatacaaagccggactgtccctgcagcgcgctcaagaggggtggttcagtctaagtggaagcgagctgcgagctgtattcccagaaggcccatgcgaggaaccactgcaactgagaaagctccaggagctctctatccaaggcgactctgaaaaccaggtgctcgtgttggtcgaaagacgcaggaccctctacatacagggggaaaggaggttggatttcatgggttggttgggcgcaattcaaaaagccgctgcctcaatgggagatacactgagcgaacagcagcttggggactctgacatcccggtcatcgtgtatagatgcgtggattacattacccaatgtggcctgacatctgagggcatatataggaagtgtggacagacatcgaaaacacagaggttacttgaaagtctgcgtcaggatgcccgatcggttcacctgaaggagggtgaacagcatgtggatgatgtcagtagtgctcttaagcgctttttgcgagatctgccagatggcctcttcaccagagcccagaggctgacctggcttgaggctagtgagatagaggacgaggaagaaaaagtgtcacgctacagggagttgctcgtgaggttgcctcctgttaatagagcgacagtaaaggcactgattagccacctgtactgcgtgcaatgtttctcagataccaaccagatgaacgtgcataatctggcgatagtcttcgggccaaccctgtttcaaacggacggccaagattataaggccggtagggttgtggaggaccttatcaatcactatgtagtggtcttcagcgtggacgaagaggagctcagaaaacagagagaggagattacagccatcgtgaagatgcgagtcgccggaactgcatccggaacacagcacgctggcgacttcatttgcaccgtctatctggaagagaaaaaagccgaaactgagcagcatatcaaggtgccagcctcgatgaccgcggaagagcttacattagagattctggatcgcagaaatgtggggatcagagaaaaggactattggacatgttttgaggttaatgagcgggaagaagctgaacgccctctccatttcgctgagaaagtgctgccaattcttcacggcctgggcactgacagtcaccttgtcgtgaaaaagcaccaggccatggaggctatgctgctgtacctggcatcacgagtgggcgatacgaagcacgggatgatgaagttccgagaagatcggtccctgctgggcctgggcctcccctctggagggttccacgacagatacttcattctgaactccagttgtttgcgactgtataaagaggtccgctctcatagaccagagaaagagtggcccattaagtcacttaaggtttacttgggcgtcaagaaaaagctgcgccctcctacgtgttggggcttcacggtggtgcatgaaactgaaaagcacgagaaacagcaatggtacttgtgttgtgacactcagatggaacttcgggagtggttcgccacctttttgttcgtccagcacgacggcctggtgtggccatctgagccatctcgcgtgtcccgcgcagtgcccgaagtgcggctggggtctgtgagtctgataccattacgcggtagtgagaatgaaatgcgcagatcagttgccgcatttaccgccgatcctctctctcttctcaggaatgtgtag

SEQ ID NO: 214788 - DNA, 5115 bp, Artificial Sequence
  Description of Artificial Sequence: Synthetic coding sequence
atgtcatcagtctccgaagttaacgtagacattaaggattttcttatgagcatcaacctggagcagtacttactacacttccacgaaagtggcttcacaaccgtgaaggactgcgccgcaattaacgacagccttctgcaaaaaataggaatctctccaactggccatcgacgccgaatcctcaagcaactacagataattctgtccaaaatgcaagacatccctatctacgccaacgtgcataaaaccaagaagaatgacgacccaagtaaagactaccacgttccttcctctgaccagaacatctgtatagaactgtctaactctgggtctgttcagacatctagccctccacagctggaaaccgtgcgaaaaaatttggaggactccgatgccagcgttgagcgttcacagtatccccaatcagacgataagctgagtcctcctaaacgcgactttccgacagcagaggaacctcacctaaatctgggttctctgaacgacagccttttcggatccgacaatatcaagatcgagagccttatcacaaaaaaaaccgtggatcacactgtggaagagcagcagacagaaaaagtaaagcttataacagaaaacttgtcaaagcttcccaatgcagatagcgagtgcctgagttttgtgggttgctcaaccagcggaacaaattcaggaaatggcaccaatggcttgctcgaaggctcacctcccagcccgtttttcaagttccaaggcgagatgatcgtcaatgacttgtatgtgccttccagtcccattctcgcgcctgttagaagccggagcaaactcgtgtctcggcctagcaggtctttcttactcagacatagaccagtacccgagatcccgggtagcaccaaaggcgtgagcgggagctactttcgagagaggcgtaatgtcgccacctctacagaaaaaagcgtagcatggcagaactccaacgaggaaaacagctcaagcatattcccgtatggcgagacctttctttttcaacgcctggaaaactcgaagaagaggagcatcaaaaacgagttcctgacccagggtgaagctctaaagggcgaggctgctaccgcaaccaactccttcattattaagtcaagcatatatgacaatagaaaggaaaaaatcagtgaagacaaggtggaagatatctggattcctcgggaggacaaaaataattttctcatcgatacggcaagcgagtctgaatattccacagtggaggaatgtttccaatctctgaggcgcaagaattctaaagccagcaagtcccggacccaaaaagccctgatcctcgattccgtcaaccggcattcctaccccctgtccagcacctcaggcaacgctgacagctcggctgtgtcatcacaagccatttccccctacgcatgcttttatggagcgtccgccaaaaaggtgaagagcggatggctggataagctctctcctcagggcaaacgtatgtttcagaaacgctgggtgaagttcgacggtctcagtatcagctactataacaatgagaaagaaatgtatagcaagggaatcatcccactgagcgccatcagcactgttagggtgcaaggggataacaaatttgaagtggtgaccacgcaaagaacgtttgttttccgcgttgagaaagaggaggagagaaatgattggatctccattcttttaaatgccctcaagtcccagtcgttgacgtctcagtcccaagcagtggtgacccctgagaagtgcgggtatctggaacttcggggatataaagccaaaattttcaccgttctgagtgggaatagtgtgtggctgtgtaagaacgagcaggatttcaagtcgggtctgggaataacaataatcccaatgaatgttgccaatgtgaagcaggtggatcgaactgtgaagcagagctttgaaattattacaccatacaggagcttcagcttcacagcagagaccgaaaaggagaaacaggactggattgaggccgtgcagcagagtatcgcggaaaccctgtcagattacgaggtggcagaaaagatttggttcaatgaaagcaaccgaagttgtgctgattgtaaagcacccgacccagattgggcatccatcaatctctgcgtggtaatctgtaaaaaatgtgctggccagcatcgctcactggggccaaaagactccaaggtcaggtccctgaagatggacgctagcatctggtccaacgagctcatcgagctctttattgtgattggaaacaaacgtgccaacgatttttgggccggaaatctacaaaaggatgaagaacttcacatggattcccctgtggagaaacgtaaaaactttatcacccagaagtacaaagaaggtaagtttagaaagactcttctcgcctcacttacgaaggaagagctcaataaggctctgtgcgctgcagtcgtgaagcccgacgtactggaaaccatggcgctgttgtttagtggggctgatgtcatgtgtgccactggtgatccagtccacagtacgccgtatttgctcgccaagaaggccggtcagtccttacaaatggaatttctctaccacaataaattctccgattttccgcagcatgacatacactcagaaggcgtgctctcccaggagtccagtcagtccacctttctctgtgatttcctgtaccaggcacctagcgccgcaagtaagctttcatctgaaaagaaattactcgaagaaaccaataaaaaatggtgcgtgctggaagggggattcctaagttactacgagaacgacaaaagtactacccctaatggaactattaatattaatgaagtcatctgtctggctatccataaggaggacttttatctgaacaccgggcctatatttatcttcgaaatctaccttcccagcgaacgcgtgttcctgtttggtgcagaaacgagccaggcccagcgcaagtggacagaagcgatcgctaagcactttgttccgctgttcgctgaaaacctgacagaagccgattatgacctcataggacagcttttctacaaagattgccacgcactggatcaatggaggaaaggctggtttgcgatggataaatcttcactacatttttgcctgcagatgcaagaggtgcagggtgatcgaatgcacctaaggcggctgcaagaattgactatcagtacaatggtacagaacggggaaaaattggacgtgttactgctggtggaaaaggggagaactctttacattcatgggcatacgaagctggacttcactgtttggcacacagctatagagaaagccgcaggtacagatggaaatgcattacaggaccaacaactttcaaagaatgacgttcccatcatcgtcaattcttgtatcgctttcgttactcagtatggcctgggctgtaagtatatctaccagaagaatggggaccccctccatatttcagagctcctggagtccttcaagaaagatgcacgatcgttcaagttgcgggcaggaaagcaccagctcgaggatgtgaccgccgtgctcaagagctttttgtctgacatcgacgacgccctgctgaccaaggagctttacccctattggattagcgccctggacactcaagacgataaagaaagaattaagaagtatggtgcatttatccgctctcttcccggtgtgaaccgtgccactcttgctgccatcatcgagcacctgtaccgggtccagaagtgctctgagatcaaccacatgaatgcccataacttagccctggtgtttagtagctgcttgtttcagaccaaaggccaaaccagtgaagaggttaacgtgattgaagatctcatcaataattatgttgagatctttgaagtcaaggaggatcaagtcaaacagatggatatcgaaaatagcttcatcacgaagtggaaggacacgcaggtttctcaggcaggagaccttcttattgaagtgtacgtggagaggaaagagccagactgcagtattattattcgcattagccctgttatggaagcggaggaactcactaatgatatattggcaatcaaaaatattatcccgaccaagggggacatctgggccacttttgaagtgatcgagaacgaggagcttgagaggccgcttcattataaggagaatgtgctcgagcaggtgctcagatggtctagcctggccgagcctggctctgcgtatctggtcgtcaaacgatttctcactgcagacaccatcaagcactgttccgacaggtccacactgggttcaattaaggagggtatactcaagatcaaagaggagcccagcaagattctcagcggtaacaaattccaagacaggtacttcgtgctcagagatgggtttctgttcctatataaagacgtcaaatcatccaagcacgacaaaatgttcagcctgagttcgatgaagttctaccgaggggtgaaaaaaaagatgaaaccccctacgtcttggggtctgacagcatattccgagaagcaccattggcacttgtgctgtgactctagtagaacccagaccgagtggatgacatcaattttcatcgctcagcatgagtatgatatctggcctccagcaggaaaggaacgcaaacgcagtattaccaaaaatcccaagatcggcggactgccactcattcccatccaacacgaggggaacgctactctggctaggaaaaacatagagagtgcgagagccgaactggagaggcttcgactatccgagaaatgcgataaagagtccgtggatagctcactgaaggagagagctagtatggtcgcccactgccttgagcacaaagacgataaactgcggaaccggcctcgcaagcaccgcagctttaattgcctggaggacaccgagcccgaagcgcctctggggcagcccaagggccacaagggcctcaagaccttgcgaaaaacagaggacaggaactccaaagccaccttggatagcgatcacaaactccccagccgcgtgatcgaggagctgaacgtggtgctgcaacgtagcagaaccctgccaaaggagctgcaggacgaacagatcttgaaatat

SEQ ID NO: 214789 - DNA, 144 bp, Artificial Sequence
  Description of Artificial Sequence: Synthetic coding sequence
atgtcaagtgtttctgaagtgaatgttgacatcaaagactttctcatgagtatcaatctggaacagtacctgctccatttccacgaaagcggcttcacaactgtgaaggactgtgcagccatcaatgacagcctgctgcagtag

SEQ ID NO: 214790 - DNA, 3399 bp, Artificial Sequence
  Description of Artificial Sequence: Synthetic coding sequence
atgagaagctcagccagccgtttgagctctttctcatcccgcgattccctctggaaccgaatgcccgatcaaattagcgtttccgaatttatagcggagactactgaagattacaattctcctactacctcctcctttaccacgcgacttcataattgcaggaacactgttacactgcttgaggaagctctcgaccaggaccgcactgccctgcagaaggtcaagaagtccgtgaaggcaatttataactcaggccaggaccacgtacaaaacgaggagaattacgcgcaagtcctggataaatttggcagcaatttcctctcaagggacaaccctgacctgggaacagccttcgtgaagttttctacgcttaccaaggaactgtccactctgctgaagaacctcttgcagggcttgtcacacaatgtgatcttcacattagactcactcttaaaaggggatctgaaaggggtcaaaggcgatctgaagaaaccttttgacaaggcctggaaggattatgaaacaaaattcacaaagatcgagaaggaaaaacgagaacatgcgaagcaacatggtatgatccggacagagattactggtgctgagatcgccgaggagatggagaaagaaagacgcttgtttcaattgcagatgtgcgagtacctgataaaggtgaatgaaatcaagaccaaaaaaggtgtcgacttgctacagaacctgattaagtactaccacgctcagtgcaacttcttccaggatggcctaaaaaccgcagacaagctgaaacaatacatagagaagctggcagcggatttgtacaacatcaagcagacccaggatgaggaaaagaagcagcttactgccctgcgggaccttatcaaaagctctttacaattggatcagaaggaggcacggcaagactcccaatccagacagggcggttattcaatgcatcagttgcagggaaataaagagtatggaagtgaaaagaaagggtacctacttaaaaaaagtgatggcatcaggaaggtttggcagcgcaggaaatgtagcgtgaaaaacggcatcctgaccataagccatgctactagcaatcggcaaccagcaaagcttaatctcctgacctgtcaggtcaaacctaatgctgaggacaaaaaaagctttgacctgatttctcataacagaacctaccacttccaagccgaggatgaacaggactacgtggcctggatatctgtgctgacaaactccaaggaggaagcactgaccatggcattcaggggggaacagagcgctggagagaactctcttgaagacctgaccaaggcaatcatcgaggatgttcagcggcttcccggaaatgatatctgttgtgactgtggctcttccgagcccacttggctgagcacaaacctggggatactgacatgcattgagtgttccggcatccacagagagatgggggtccatatcagcaggatacaatcactggagctagataagttagggacatccgaactactcttagccaagaatgttggcaacaacagctttaacgacattatggaagcaaatctgccatcaccttctccgaaacctacaccttctagtgatatgaccgtgcgtaaagaatatatcaccgccaaatatgtcgatcataggttctccagaaaaacctgctcgacatcgtcagctaagctcaatgagctgctcgaggccatcaaatctcgcgacctgttagccctgatccaggtgtatgcagagggtgtcgagctgatggaaccccttttggaaccaggtcaagagctaggagaaacagccttgcacctcgctgtgcgcactgccgatcagacgagtctgcaccttgtcgacttcctggttcagaactgtggaaatcttgataaacagaccgcattggggaataccgtgctgcactattgttccatgtattcaaagcctgagtgtctgaaactgttgctacggtctaagcccacggtggatattgtgaatcaggctggagaaaccgccctggacatcgcaaagcgcttgaaagctacacagtgtgaagacctgctctcccaagctaaatcggggaagtttaatccacatgtacacgtggagtatgagtggaatctacgccaggaagagatcgacgagagtgacgatgacctcgacgacaaaccatctcctattaaaaaagaaaggagtcccaggccacagtcattttgccatagctccagcattagccctcaggacaagttagcgttaccaggcttcagcactcctcgcgacaagcagcgactgtcctacggggcatttaccaatcagatattcgttagcacatccaccgactctccgactagcccgacaaccgaggctccacctttgccaccaagaaacgctggtaagggcccaaccggccctccgtccacccttcccctgtctacgcagacctcctcaggttcatccacacttagcaagaaacggccacccccacctccgcctggtcacaagaggacactgagcgacccgccttcccctctcccccatgggccaccgaataaaggtgccgtgccatggggaaacgacggtggacccagcagttccagcaagaccactaataaatttgagggtctgtcgcagcagagcagcacaagcagcgctaagacagctctaggaccccgtgtcctccctaaactccctcaaaaggttgccttaaggaagaccgatcatcttagtctggataaggctaccattccaccagaaattttccagaaaagctcccagcttgccgaactgccccaaaagcccccacctggtgacctgccacctaagccgactgaattagcccctaaaccacagatcggagacctgccgccaaagcccggtgaactacctcctaagcctcagctgggggacctgcccccaaagcctcagttaagcgacttgcctccaaaacctcaaatgaaagatctcccaccgaagcctcagttaggtgacctgctggctaagagccaaaccggggatgtttcccctaaggcgcagcagccctctgaggtgaccctgaagtcccatcctctcgacctctccccgaacgtgcagtcccgagatgcaatccaaaaacaggcttctgaggactcgaatgatctcacccctactcttccagaaaccccggtgcccctgcctagaaaaatcaacactgggaagaataaagttcgccgagtgaagacaatctatgactgccaggcagacaatgacgacgaactcacgttcatagaaggagaagtgatcatcgttacaggggaagaagaccaagaatggtggatcggacacatcgagggccagcccgagcggaaaggtgttttccccgtcagcttcgtgcacatcctgtctgattag

SEQ ID NO: 214791 - DNA, 3390 bp, Artificial Sequence
  Description of Artificial Sequence: Synthetic coding sequence
atgaggagcagcgccagccggctgagctcttttagcagccgtgattctctttggaaccggatgccggaccagatatctgtgtccgagtttattgctgaaactaccgaagattacaatagcccaaccaccagctcgtttacaaccaggctccacaactgtcggaatactgttaccttactcgaagaagccctggatcaagatcgtacggcccttcagaaagttaaaaaatctgtgaaggctatatataatagcggccaggatcacgtgcaaaacgaggaaaactatgcccaggtgctcgacaagtttggtagcaatttcctttccagggacaaccccgatctgggtacagcctttgtaaagttctctacactgacaaaagaactttcgacgctactcaagaacctgctccagggcctctcacacaatgtgatcttcactctggacagtctcctgaaaggagacctgaagggcgttaagggcgaccttaagaagccttttgataaggcgtggaaggactacgaaacaaagttcactaagatcgagaaggaaaagagagaacatgctaagcaacatgggatgatccgcacggaaatcacaggggctgagattgcggaggagatggaaaaagaaaggcgcttgtttcagttgcagatgtgcgagtatctgattaaagttaatgaaattaagactaagaagggtgtggacctactgcagaatttaataaagtactatcacgcccaatgcaattttttccaagacgggctgaagacggctgacaagctaaagcagtacatcgagaaactagcggctgacctgtacaacattaaacaaacgcaggacgaagaaaagaaacaacttacagccctcagagatctcattaagtcttcactgcagctggaccaaaaagaggactcccagtccaggcaggggggatactccatgcatcagctccagggcaacaaggagtacggctctgagaagaaaggatatctgttgaaaaaatccgatggaattcgaaaggtgtggcaaaggagaaagtgttctgtgaaaaatgggatcctaactatttcccacgccacaagcaataggcagcccgctaagctgaaccttttgacttgccaggtaaaacccaatgctgaagacaagaagtccttcgatctgattagtcacaataggacataccactttcaggctgaggacgagcaggactatgttgcctggatctccgtcctgaccaactccaaggaggaggccttaaccatggcttttcgaggcgagcagtccgccggtgagaattctctggaagatctgaccaaggcgatcattgaagacgttcaaaggctccctggaaatgacatatgctgcgactgcggttcttctgagccaacttggcttagcacaaaccttggaattttaacgtgtatagagtgttccggcatccaccgcgagatgggcgttcacatatccagaatccaatctctggagctggataaactcggcacctctgagctgctccttgcaaagaacgtcggaaacaactcatttaatgatatcatggaggccaacctgcctagcccctctccaaagcccactcccagctcggacatgacagtcagaaaagaatatatcacagctaagtacgttgaccatagattctctaggaaaacgtgctctacgagcagtgcgaagctcaatgaactattagaggctataaagagcagagatctactggcattgatccaggtgtatgccgagggagtcgagctgatggaacccctgctggagccaggacaggagctgggggaaaccgccttacacctggctgtgcgcaccgcagaccagacatccctgcacctcgtggactttctggttcaaaattgtggtaacctggacaagcagacggcactcgggaacaccgtgctccactattgtagcatgtacagtaaacccgaatgcctgaaactgttacttaggtccaagccaactgtagacattgtgaaccaggctggcgagacagctttggacattgctaaaagactcaaagccacacagtgcgaggatttattgtctcaagccaaatcgggtaaatttaatcctcacgtccatgtggagtacgagtggaatctcagacaggaagagatcgatgaatccgatgacgacctcgatgataagccctcacctattaaaaaggagaggtcgcctagaccccagagcttttgtcatagcagctctattagtcctcaagacaaactcgccctccccggtttctcgacccctagagacaagcagcgattgtcatatggagcctttacaaaccagatttttgtttccacatccacagactctcctacaagcccgactaccgaagccccaccacttccaccgagaaatgcaggtaaaggcccaactggcccacccagtaccctgccgctgtctacccagacctcatccgggagcagcacgctctctaagaagcgacctcctccccctcctcccggacacaaaaggacacttagtgatccaccttcaccactgccacatggccctcctaacaagggggcagtaccgtggggaaatgatgggggaccaagcagttcctccaagaccaccaacaagttcgaggggctgtcccagcaaagctccactagcagtgcaaaaacggctctcggccctagagtcctgccaaagcttccccagaaagtggcactgcgtaagacagaccatttatccttagacaaagccacaattcctccggagatctttcagaaaagttctcagctcgcagagctgcctcagaagccccctccaggtgacctcccacctaagccgactgaacttgcgcctaaaccgcagatcggcgaccttccacccaaaccaggcgaattaccccctaagcctcaactcggtgatctccctccaaaaccccagctctctgatctccccccaaaaccccagatgaaggatctgcctccaaagcctcagttgggtgacttgcttgcgaagtctcagaccggggacgttagtcctaaggcccagcagccaagtgaggtgacccttaaatcccatccgttggatctgagtccaaatgtccagtctcgagacgccattcagaagcaggcctccgaggattccaacgatctcacgcccacccttcccgaaactccggtcccccttcctagaaaaatcaataccgggaaaaacaaagtgagaagggtcaagaccatctatgattgtcaggcagataacgacgacgagctcacgtttattgaaggcgaggttataattgttactggagaagaagaccaagaatggtggatcggacatatcgaaggccagcctgagagaaagggcgtattcccagtgagttttgttcatatactgtctgattag

SEQ ID NO: 214792 - DNA, 3390 bp, Artificial Sequence
  Description of Artificial Sequence: Synthetic coding sequence
atgcgatcctctgcttccagactctccagcttttcgagtcgggacagcttatggaataggatgcccgaccagatttcggtgtctgaattcatcgccgaaaccaccgaggactataatagccctactactagctccttcactacccgattgcataactgccgaaatacagtgacacttttggaagaggcgctggaccaggatcggacagccctccagaaggtcaagaagtcggttaaagccatttataacagcggccaggaccacgtccagaatgaggaaaattacgcccaggtgttggacaagtttgggtccaatttcctgtcaagggataaccctgatctgggcaccgcattcgtgaaattcagcacactaactaaagagctgagcaccctgctgaagaacctcctccaaggactaagccacaatgtcattttcacattggacagcttgctgaaaggggacttgaagggggtgaagggcgatctaaagaagccctttgataaggcgtggaaggactatgagaccaaattcacaaagatcgagaaggagaagagggaacacgctaaacagcatgggatgattcgcactgaaatcactggcgcagaaatcgccgaggagatggagaaagagcgtcgactcttccagctccagatgtgcgagtatctgatcaaggtgaatgagatcaaaacgaaaaagggcgtagaccttcttcagaatctcataaaatattaccatgcccagtgcaactttttccaggacggactcaagacagcagacaagttgaagcagtatattgaaaagctggcagctgacctgtataatatcaagcagacccaggatgaagagaagaagcagctcactgccctgagggatcttattaagtcctcactgcagcttgaccagaaagaggactcacagagcaggcaggggggttattctatgcatcaactgcaggggaacaaggagtacggttccgagaagaaggggtacttgctaaagaaatccgatggcatacgcaaggtttggcagcggagaaagtgctccgtcaaaaacgggattctcactatttctcacgcaacctctaaccgccaaccggcaaaactgaacctgctcacctgtcaggtgaagcctaacgcagaggataaaaagtctttcgatctaatctcccacaatcggacctaccattttcaggcggaggatgagcaagactacgtggcatggattagtgtgctgaccaactctaaggaggaggcccttaccatggccttcagaggtgaacagagcgctggcgagaacagtttagaggacctgacgaaggctatcatcgaggacgtccaacgcctgcccggaaacgatatttgctgcgactgcggatcatccgagcccacatggctgtctaccaacctcggcatactaacttgcattgaatgttcgggtattcacagagaaatgggggtgcacatttcccgcatccagtcgttagaactggacaaactcggcacctccgagctgctccttgccaaaaacgtggggaacaatagcttcaatgacattatggaggcgaatctgccctctccgagtcctaaacctaccccctcttcagatatgaccgtccgcaaagagtatatcactgctaaatatgttgaccaccgcttcagccgcaagacttgctccaccagctccgcgaaattgaatgaattactagaggccatcaaatctagggacctcttggctcttattcaagtgtatgcggagggggtggaactgatggaaccgttgttagaaccgggacaggagcttggagagaccgccttgcacctggccgtgcggaccgccgaccagactagtctgcatttggtcgactttctggtacaaaattgtgggaacctggacaaacagactgccctcgggaacacggttctgcactattgctcgatgtatagtaaacccgagtgcctcaaactcttgctgcgttccaaaccgacagtcgacatcgtcaatcaggcaggtgagacagccttagatatcgccaagaggctgaaggctacccagtgtgaggatctgctaagccaggccaaatccggaaaatttaacccccatgtgcacgtagagtacgagtggaaccttagacaggaggaaatcgatgaaagtgacgacgacctagatgacaagccgtctccaatcaagaaggagagatcccctcggccacagagcttctgccacagttccagtatatccccccaggataaattagcactaccagggttttccacacctagagacaagcagcggctttcgtatggtgcattcactaaccaaatctttgtctccacctctaccgatagtcccacgtcgcctactactgaggctcctccacttcctccccgtaatgccggaaagggtccaactgggcctccttctactctgcccctctcaactcagaccagtagcgggagctccacactctctaaaaaacgccctcccccaccaccaccaggacacaagcggaccctctctgatcccccatcaccacttccccacggaccaccaaacaaaggggcagtgccatgggggaacgacggcggaccaagcagttctagtaagacaactaataaattcgaggggttgtcacagcaaagcagcacctcatcagccaagaccgccctagggccacgggtgctgcccaaacttccccagaaggtcgcactgcggaagaccgaccacctaagtctcgataaagctaccatccctccagaaattttccaaaagagtagccagctggctgagttgcctcaaaagccccctccaggagatctgcccccaaagcctactgaactggcccctaaaccgcaaatcggcgacctcccacccaaaccaggtgaattgcccccaaagccgcagctcggggatttacccccaaaacctcagctctctgacctgccgcctaagccgcagatgaaggatctgccaccaaagccccaactgggcgatttactggcaaaaagccaaacaggagatgtcagccctaaagctcagcagcctagtgaggtgactctgaagtcccacccactcgacctctcaccaaacgtgcagtcaagagacgccattcagaaacaggcttcagaggatagcaacgacctgactcccacacttcctgagacacctgtgcccctcccaagaaaaatcaataccggaaagaataaagtccgcagggttaaaacaatttatgactgtcaggccgataacgatgacgaactcacatttatcgagggggaagtgatcattgtaactggagaggaggaccaagaatggtggatcggacatattgaaggccagcctgagaggaaaggagtattcccagtgagctttgtgcacatcctatccgactag

SEQ ID NO: 214793 - DNA, 1065 bp, Artificial Sequence
  Description of Artificial Sequence: Synthetic coding sequence
atgtccctgagggggtccctgtctagacttctccaaacccgcgtacattctattcttaagaaatcagtccactctgtggccgtgataggcgcacccttttcccagggccagaagcgcaagggcgtcgagcacgggcctgccgctataagggaggcagggcttatgaagaggctttcatcgctggggtgccatctgaaggatttcggagatctcagctttactccagtacccaaggacgacttatataacaacctgattgtaaaccctcggtctgtcggactggcaaatcaggaactggctgaggtggtcagccgggcagtctccgacggctactcttgtgtgacactgggtggtgaccatagcctggccatcgggaccatttctgggcacgctaggcactgcccagatttgtgtgtggtgtgggtggacgcacatgcggatataaacacacctctaacaacctctagcgggaacttacacgggcaaccagtgagtttccttttgagggaactgcaggataaagtaccacagctgcctggattttcgtggattaagccgtgtatatccagcgcatccatcgtgtacataggactgcgagacgtagacccccctgagcactttatcctgaaaaactacgacattcagtactttagtatgagggatattgatagactgggtatccagaaagtcatggagcgtacatttgatctgctgattggcaaaaggcaacggccaattcacctttcatttgacatcgacgcgtttgaccctacgctagctccagctactggaactccagtggtgggtggcctgacctatagagagggcatgtacatcgcagaggagatccataatacaggcctgctgtccgccctggacctggtggaggtgaacccgcagcttgccacctctgaggaggaggcaaaaacgaccgctaacctggccgtcgatgtcatcgcctctagtttcgggcagacgagggaaggcggtcatatcgtgtacgaccagctgccgacaccatccagcccagacgaatcagaaaaccaggccagggttaggatttag

SEQ ID NO: 214794 - DNA, 207 bp, Artificial Sequence
  Description of Artificial Sequence: Synthetic coding sequence
atgaaattaaacgagaaatttagcgagggttggcgcaaacctaacgcctcgtggaaatcttcatgtagcaagaacagctccgatagagataaattgtctttgccgcacaagaaactggagcggggatcttggcgcgtatggcaaccccgtagtaccctgtgtcgaacactggacaaaacagaagaagagagggccaaaagagagtag

SEQ ID NO: 214795 - DNA, 429 bp, Artificial Sequence
  Description of Artificial Sequence: Synthetic coding sequence
atgaagttgaacgaaaaattcagcgagggctggcgaaagccgaacgccagctggaaatcgtcctgtagtaagaatagctcggacagggacaaattaagcctcccacacaaaaagctcgagagaggcagttggcgggtatggcagcccaggtctaccctgtgtagaactctggacaaaacagaggaagagcgtgccaaacgagaggagctggagcgcatactggaggaaaacaatcggaagatcgcggaggctcaggcgaaactcgcggaagaacagctgagaatcgtggaagagcagagaaaaattcatgaagaacgcatgaagctcgagcaggagagacaaagacagcagaaagaagaacagaagatcattcttgggaaaggtaagagtaggcctaagttgagtttcagtctgaaaacccaggactag

SEQ ID NO: 214796 - DNA, 822 bp, Artificial Sequence
  Description of Artificial Sequence: Synthetic coding sequence
atgggtcgttcaaggtctcggtcatcatcacgttccaagcacacaaagtcttctaagcataataaaaagaggagccgatctagaagtcgatctagagataaggagagagtacgaaaacgatctaagagcagggaatcaaagagaaacaggaggagagagtcccgctccagatcaaggtcaaccaacactgccgtcagccggagagagcgcgaccgcgagcgcgcttcttctcccccagacaggattgatatcttcggtagaactgtgtccaaacgcagttcactggacgagaagcagaagcgggaagaggaggagaaaaaggctgaattcgagcgtcaacgcaagattcgccagcaagagatcgaagagaagcttatagaagaagaaaccgctcgccgagtagaagagctggtggcaaagagggtggaagaggaactagagaaaaggaaggacgaaattgaacgcgaggtgctgagaagggtcgaggaggctaagagaattatggaaaaacagttgctggaagaacttgagcggcagcgacaagctgagctggcagctcaaaaggcccgagaggaggaagagcgcgctaaaagagaggaattagaaagaatcttggaggagaataatcgcaaaatagcggaggcccaggcaaagttagcagaggagcagctgcgcattgtcgaggagcagcgcaaaattcatgaagagcggatgaagctcgagcaagagcggcagagacagcagaaggaagaacaaaaaatcatccttggtaaaggaaaatcaagacccaagctgagttttagcctgaaaacccaggattag

SEQ ID NO: 214797 - DNA, 672 bp, Artificial Sequence
  Description of Artificial Sequence: Synthetic coding sequence
atggggagatcaaggtcacggtcttcatctcggtcaaagcacacaaaatcttcgaagcacaacaaaaaaagggcctcctcccccccagatcgtatagacattttcggtcggaccgtgagcaaacgcagttcactcgatgagaagcagaaacgcgaggaggaggaaaaaaaagctgaattcgagcggcagcgcaaaattagacagcaggaaatcgaggagaagctcatagaagaagagactgccaggagagtggaggaactggtcgccaagagagtcgaagaggagctggaaaagagaaaggatgagattgaacgcgaggtgctccgacgcgtagaagaggccaagcgaattatggaaaaacagctgcttgaggagttagaaagacagagacaggccgagcttgctgctcagaaagcccgtgaagtcaccttaggcagactggagtcacgcgactccccctggcagaacttccagtgctgggtgctcccgccagcacagtttcggaagcggtggaacaccgactacttaattccgttctctagcaagctgaacatagctgccaaagtcaactttctggcatatagcgaagttctcaccgacaacctgaaagttgggagtttttacaaaacatactcccgtatcctcttcgacctgatggaactcgctatctag

SEQ ID NO: 214798 - DNA, 495 bp, Artificial Sequence
  Description of Artificial Sequence: Synthetic coding sequence
atgccggacactatgctgccggcttgctttttagggctgctggctttctcaagcgcctgttactttcagaactgtcctcgaggaggtaagcgggctatgtccgatcttgagttaagacagtgtctcccttgtggcccaggaggcaagggaagatgctttggaccctctatctgctgcgccgacgagcttggctgctttgtcggcacagcggaagcattgagatgtcaggaggaaaactatcttccatccccgtgtcagagtggccagaaggcgtgtggcagcggcggaaggtgcgctgcattcggggtgtgctgcaatgacgagagctgtgtgacagaacctgagtgcagggagggctttcaccgcagggctcgagcctcagaccggtcaaatgccacacaactggacggtccggcaggggcattgctgttgcgattagtgcagttggctggggctccggaaccgttcgagccagcccaaccagacgcttattag

SEQ ID NO: 214799 - DNA, 1257 bp, Artificial Sequence
  Description of Artificial Sequence: Synthetic coding sequence
atgcgcttaagtgcaggcccagacgccggtccctccggcaactcaagcccttggtggccgctcgccacaggtgcgggtaacactagtcgcgaggctgaggcgctgggtgagggaaatgggccacctcgtgacgttcgcaatgaggagctcgctaagctcgagatcgccgtgctggctgtgaccttcgcagtcgctgtgcttgggaacagctctgtcttgctggctctccaccgaacaccccgaaagacttcccgtatgcatctcttcatcaggcacctgtccttggcagacttggctgtggcattctttcaggttctgccacaaatgtgttgggacatcacctacaggttccgtggcccagactggctgtgccgagtggtgaagcatttacaagtttttggtatgtttgcctccgcctacatgcttgttgtcatgacagccgataggtacatcgcagtctgccatcctctgaagacactccagcaacctgcccgtcgatctcggcttatgatcgctgctgcatgggtactgagctttgtgcttagcacccctcagtatttcgtgttctccatgattgaagtcaataacgttacgaaggccagagactgctgggcaacttttatacagccatggggctcgcgcgcatatgtcacatggatgaccggaggcatttttgtcgctccggtggtcatcttaggtacatgctacggtttcatctgttacaacatttggtgtaatgtgcggggaaagacagcaagccgccagtctaagggtgccgagcaggctggggtcgcattccagaaaggatttctattggccccttgtgtttcttccgtgaagagtattagtcgcgcaaaaattcgcacggtgaagatgacatttgtcatcgtaacggcctatattgtgtgctgggctccctttttcattatccagatgtggtcggtgtgggatccaatgtctgtgtggaccgaatccgagaatcctacaattacaataacggcattgctcgggtcattgaactcatgctgtaatccttggatatatatgttcttcagcgggcatctacttcaggactgcgtccaaagcttcccctgttgtcagaacatgaaggagaagttcaataaagaagatactgactcaatgtctcgccgacaaaccttttattccaacaatagatcccctactaattccaccggaatgtggaaggactcccctaagtcttcaaagtctattaagtttatcccggtctcaacttag

SEQ ID NO: 214800 - DNA, 1275 bp, Artificial Sequence
  Description of Artificial Sequence: Synthetic coding sequence
atggacagcgggcctctctgggatgctaatccaaccccaagagggacacttagtgctcccaacgctacgacaccctggctgggacgagacgaggagcttgccaaagtggagatcggcgtgctcgcgactgtactggttcttgccaccggaggcaacctagccgtgctcctcacactgggccaactcggtagaaaaaggagcaggatgcatcttttcgtgttgcatctggcactgactgacttggccgtggccctattccaggtcctcccccagcttctgtgggatatcacttacagattccagggaccagacctgctgtgtcgcgcagtgaagtacctgcaagtcttgtccatgttcgcctccacctacatgctgctggccatgacactagataggtatctcgcagtctgccatcctttacgctcactgcagcagcctggccagtctacctacctactcattgccgctccttggttgctcgccgcaatattctccttaccccaggtttttatctttagcctgcgcgaggtgatccagggttccggtgtactggattgctgggcagactttggttttccgtggggaccccgtgcctaccttacatggacaacccttgctatatttgtactgccagtgacgatgctgaccgcgtgttatagcctgatctgtcacgagatttgtaaaaatctcaaagttaaaacccaggcctggagagtcgggggtggcggatggagaacctgggaccgtccttcccctagtactcttgccgcaactacccggggtttaccatcaagggtgagttcaattaacactattagcagggctaagatccggaccgtgaaaatgactttcgtgatagtactagcatatattgcttgttgggccccattttttagcgtccagatgtggtctgtgtgggacaagaacgcacccgacgaggacagcactaacgtggcctttacaatttctatgctcctcgggaatttgaattcctgctgtaacccttggatttatatggggtttaactcccacctgctgcccagacccttgcgacacttggcatgttgtgggggtcctcagcccagaatgcgacgccgactgagcgatggatccctttcttcgcggcacactactctcttaaccagaagttcctgtcctgctacactctcactgagtctctcactgacactcagcggccgtcccagaccagaagaatccccgagggatctagagctggcagacggagagggaactgcagagacgatcatcttctag

SEQ ID NO: 214801 - DNA, 1116 bp, Artificial Sequence
  Description of Artificial Sequence: Synthetic coding sequence
atgctcatggcatcaacaaccagtgccgtgcccggacaccctagcctcccgtcactcccgagcaattcttctcaggagcggccactagataccagggatcctctccttgccagggcggagctcgcgctgttgtctatcgttttcgtcgccgtcgccttaagcaatggactcgtgttagccgctctcgccaggagaggtagacgcggacactgggcaccaattcatgttttcattgggcacctgtgccttgctgacctcgccgtcgcacttttccaggttttgcctcagctggcttggaaggccaccgacaggtttcggggtccggatgctctgtgtcgcgcagtgaaatacctgcaaatggtcggaatgtacgcttcctcatacatgatcctggcaatgacactcgataggcaccgggctatttgtcggccaatgttggcatatcgtcatggttccggcgcacattggaatagacccgttttggtggcatgggccttttcgctcctgctgagcctcccccagctttttatcttcgctcagagaaatgtcgagggaggctccggggtcaccgactgctgggcctgctttgcagaaccctggggcagacggacatacgtgacgtggattgccctgatggttttcgtcgcccctaccctaggcattgctgcttgtcaggtcttgattttccgggaaattcacgcctccctcgtgcctggcccttccgagaggccaggagggagaagaaggggacgcagaactgggtccccgggtgagggcgctcacgtcagtgcagccgtagccaagacagttcggatgacactcgttatagttgtggtgtacgtgctgtgctgggcaccattcttcctcgttcaactgtgggccgcatgggatcctgaggcgccactcgagggggctccattcgtgctgctgatgctcttggcttcattaaattcttgcacaaacccgtggatctacgcttctttttcctcatccgttagctctgaactccggtccttgctctgttgcgcaagaggcaggactcccccatcacttgggcctcaggacgaaagttgtacaactgcatctagctccctggcgaaggatacttcctcttag

SEQ ID NO: 214802 - DNA, 1116 bp, Artificial Sequence
  Description of Artificial Sequence: Synthetic coding sequence
atgttgatggcctcaactacctcagctgtgcctggacacccaagccttccaagtctgccaagtaattcatcgcaggaaaggccattggacacacgggatcccctcctggctcgcgctgagttggcccttttgtctatcgtgttcgtggcagtcgcgctttccaacggactggtcctggctgcactcgcgagacggggtagaagagggcactgggcccctatccacgtctttatagggcacctgtgccttgccgacctggccgtggccctctttcaagtgctgccccagctggcctggaaggccacagatcgctttagaggtcctgatgctctctgccgggctgtgaagtatctccagatggtgggtatgtacgcctcctcgtacatgatcctcgctatgactctggatagacacagagctatctgccgcccaatgctcgcctatcgacatggatctggagcccattggaataggccagtacttgtcgcatgggcattctctctgttgctctccttgccccagctttttattttcgcccagcggaacgtcgagggagggagcggcgttacggactgctgggcatgttttgcagagccttggggaaggagaacttacgtcacctggatcgcactgatggtgttcgtggcgcctaccttaggcattgcagcttgccaggtgttaatctttcgagaaatccacgcctccctcgtgcccggtccctctgaacggcctggaggccgaaggcggggacgaaggacagggtcaccaggcgagggggcacacgtgtcagcggcagtggctaagacagtgagaatgacacttgtaatcgttgtggtatatgtgctctgttgggctccatttttcttggtccagctctgggcagcatgggatcctgaggccccactggaaggggcacccttcgtcctcttgatgctgctagcttcactgaactcttgcaccaatccctggatctatgcgagcttttcgtcaagcgtttcttctgagctaaggagccttctgtgctgcgccagaggcagaacccccccatctctgggtccgcaagatgagtcatgtaccactgcgtctagttctctggccaaggacaccagttcttag

SEQ ID NO: 214803 - DNA, 930 bp, Artificial Sequence
  Description of Artificial Sequence: Synthetic coding sequence
atgctgatggcttcgactacaagtgcagtgccaggacaccccagtttgccatctctgccaagtaacagttctcaggagcggcctcttgatacacgagaccctctgctggctcgcgcagaattggccctgctctccattgtgttcgtggctgttgccctgagcaatgggcttgttctggcagccctggcacgcagggggaggcgtggccactgggctccaatacatgtgtttattggacacctgtgcctggctgatctggcagtcgcgctatttcaagtgttgccacagctagcatggaaagccactgatagattcaggggtcccgatgccctgtgtcgcgcagtgaaatacctccagatggtgggcatgtatgcttctagctacatgatcttggccatgaccctggacagacatcgagctatctgcaggccaatgctggcctaccgccatggaagcggtgcgcattggaaccgccctgtgctggtcgcttgggctttttccttgctgctttcccttccacagcttttcatttttgcccagcgtaacgtcgaaggcggtagcggagtgacggattgttgggcgtgttttgccgaaccttggggccgacgcacgtatgtaacctggattgctctgatggtcttcgtggcccctacattgggaatcgccgcatgccaagttctcatatttcgcgagattcatgctagcttagtgcccggaccttctgagcggccaggtggcaggcgcagaggacgtcggacaggctccccaggggagggagcacacgtgtccgccgctgttgccaagactgtgcggatgactctggtcatcgtcgtggtgtacgtgctgtgctgggctcccttctttctcgtgcagctttgggctgcctgggatcctgaggctccgttagaaggagggtgttccagaggctag

SEQ ID NO: 214804 - DNA, 1005 bp, Artificial Sequence
  Description of Artificial Sequence: Synthetic coding sequence
atgggaagacgctcctccgatacagaggaagagagccgcagcaaaagaaagaagaaacatcgcaggcgatctagttcctctagcagctccgactcccgaacctactcgagaaagaaaggaggccgaaagtcccgcagtaagtctcggagttggtccagggatctgcagcctcgcagccacagttacgaccgtaggcgcaggcatcgtagcagttctagctctagctatggttcccgcagaaaacggtcacggtctagatctcggggacgcggtaagagctaccgggtccagcgatcaagatcaaagtcacggacaagacgctctcggagcaggcccaggctgcggtcgcacagtagatcgagcgagagatcatcccatcggagaacaagaagcaggagcagggatcgcgagcgacggaagggtagagataaagagaaacgtgaaaaagaaaaagataaagggaaagataaggagctgcacaacatcaagagaggcgaatccgggaacataaaagcaggcctcgagcacctgccccctgcagagcaagcaaaagcaagactgcagctggtcctggaggccgctgccaaagccgatgaagccttgaaagccaaagagagaaatgaggaagaggccaaaagacggaaggaggaagaccaggctaccttggttgagcaggtaaagcgagttaaggagatcgaggctatcgagagcgacagctttgtgcagcagacctttcgctcgtctaaagaggtgaagaaatctgtcgaaccatcagaagtgaagcaggccactagtacctcaggtccagctagtgctgtcgccgatcctccgtcaacagagaaggaaatagacccgacaagtatccctactgcaattaagtatcaggacgacaatagtttggcacacccgaacctgttcatcgagaaggccgacgccgaagagaagtggtttaagcgcctgatcgcgctgcggcaggagcggctgatgggttctccggtcgcctag

SEQ ID NO: 214805 - DNA, 831 bp, Artificial Sequence
  Description of Artificial Sequence: Synthetic coding sequence
atgggtagacgctcaagtgacacggaagaggagagccgaagcaagcgaaaaaagaagcatcgcaggcgctccagctctagctcaagtagcgattctcgcacttacagccggaaaaaaggcggaagaaaatcccgctcaaaatcccggtcatggtcccgggatttgcagcccaggtctcacagctacgatcgccgtagacgacaccgatcgtcctctagttcttcatatggttcccgacgaaagcgaagcagatcacgcagtaggggacgcggaaagagttatcgggtgcagcgaagccgaagtaaatcacgtacgcggagagagagcggaaatatcaaggcgggtctcgaacatctgcctcccgctgagcaagccaaagcccgactgcagctcgtcctcgaggccgctgctaaggcagacgaagccctcaaagctaaagaaaggaatgaggaggaggcaaaacggcgaaaagaagaggaccaggccacgttggttgaacaggtgaaaagggttaaagagatcgaggcaattgagtctgacagcttcgtgcagcaaacatttcggtcaagtaaggaagtcaaaaagtcagttgaacctagcgaggtaaagcaggcaacctcgactagcggacctgcatccgctgtagccgatcccccaagtaccgaaaaggagattgatcctacctctatccctacagccatcaaatatcaggatgacaattccttagcccatcccaatctgttcattgaaaaagcagacgctgaagaaaagtggtttaagcgcttgatcgcccttcggcaggaacgcctcatgggtagtcctgtagcctag

SEQ ID NO: 214806 - DNA, 831 bp, Artificial Sequence
  Description of Artificial Sequence: Synthetic coding sequence
atgggtcggcgatcctccgataccgaagaggaatctcgctccaagaggaaaaaaaaacataggagacgatcctcgtctagcagctctagtgattcgagaacctactccaggaaaaaaggaggcaggaagtcccggagtaaaagcaggtcctggagtcgggatctgcagccgcgtagccattcctacgaccgtagacggaggcacaggagcagttctagcagcagctatgggtcaaggcggaaaaggagtagatcacggagcagggggcgtggtaagtcataccgggtgcagaggtccaggtcaaagagcaggactcggagagagtcaggaaatattaaagcaggactcgaacatctaccacctgccgaacaggccaaagcacggttacagcttgttctggaagctgcggctaaagccgatgaagccctcaaagccaaagaacgcaacgaggaagaggccaagcgtagaaaagaagaagatcaggcaactctagtagaacaggtgaagagggtgaaggagattgaagcaatagaaagcgattcatttgtacagcaaacatttagatcttcgaaagaagtgaaaaagagcgtcgaaccctctgaagtaaaacaggcgacaagcacctcaggaccagcgagcgctgtggccgacccgcctagcaccgagaaggagattgaccctacatctatacccaccgccataaagtaccaagacgataactcgctggctcacccaaacctcttcatcgaaaaggccgatgccgaggagaaatggttcaaaagactgatcgcccttcggcaagagaggctgatgggcagccccgtggcatag

SEQ ID NO: 214807 - DNA, 612 bp, Artificial Sequence
  Description of Artificial Sequence: Synthetic coding sequence
atggggcgacgctcttcagacacggaggaagagtctcggagcaagcgcaagaagaaacaccgaaggaggagcagctcttcttccagctcagactcccgtacttatagtagaaagaaaggcggaagaaagagtcgcagcaaatcccgctcctggtctagggacctccagcctaggagccattcatacgacagaagacgccgtcatcgaagctcctccagctccagttatggcagccggaggaaacgctccagatcacgctcccgagggagagggaagagttatagagtgcaacgctctaggagcaagtcacgaacaaggcgtagcaggagtcggccacgccttcggtcccacagccggtcctccgaaagaagtagccacaggagaacacgttccaggtctcgggaccgggagaggcgtaaggggcgtgacaaggagaaacgtgaaaaagagaaagataagggcaaggataaagaactacacaacataaaaagaggggagtccggaaacataaaagccggattggaacacttgcccccagctgaacaggccaaggctcgactccaactcgtcctcgaggccgcagctaaagctgacgaggcgctgaaagcgtag

SEQ ID NO: 214808 - DNA, 585 bp, Artificial Sequence
  Description of Artificial Sequence: Synthetic coding sequence
atgggtcgacggtcttccgatactgaggaagaatcacggtctaagcgaaaaaaaaagcaccgcaggaggagctctagctcctcttcaagtgactctaggacttattccagaaagaagggcggtcgcaagagtcgtagtaagtcgcgatcttggagcagagacctgcaaccacgcagccattcctatgatcggaggaggcggcatagatcctcttcctcttcatcctacggttcccgcaggaagaggtcacggtcgcgcagcaggggcaggggaaagtcgtatcgtgttcagcggagcagaagtaagtctagaactagaaggtctagaagccggccacgcctgcgctcccacagccgctcctccgaaaggagctctcacagacgtacgcgcagcaggtctcgggatcgcgaaaggagaaaaggtagagacaaggagaagcgtgagaaagagaaggacaaagggaaagacaaagaactgcataacattaagcgcggagaatcggggaacatcaaagctggactggagcatctgccgcctgctgagcaggcaaaggcacgactccagctggtcctcgaggcagcttag

SEQ ID NO: 214809 - DNA, 1005 bp, Artificial Sequence
  Description of Artificial Sequence: Synthetic coding sequence
atgggcagaaggtcgtccgacacagaggaggagagcagatcgaagagaaaaaaaaagcatagaagacgatcgagctcctcttcttcgagcgacagtcgcacctattccagaaaaaaaggaggcagaaaatccaggtccaaaagcagatcatggtctcgcgacttacagccccgttcccactcttatgaccgaagacgaaggcataggagctcgtctagtagcagctatggaagccgcaggaaacgcagcagaagtcgttcccgtggaagaggcaagtcctacagggtgcagcgaagcagaagcaagtctagaaccaggaggagcagatcccgacctcgcctgagatcgcatagtcgcagttccgagcgttctagtcaccggagaactagaagccgctctagagacagagaacgtcggaagggtcgggacaaagagaaaagggaaaaagagaaggacaagggtaaagacaaagagttacataacatcaaacgcggagagtccggaaatatcaaggcagggttggagcatttaccacctgccgagcaggctaaagctcgtctgcagctcgtcctcgaagccgcagcaaaggccgatgaggctcttaaagcaaaggaacgaaacgaagaagaagctaagcggagaaaggaggaggatcaggccacgctggtagagcaggtgaaacgcgtgaaagagatagaggccatcgagtccgacagtttcgtccaacaaactttcaggtcgtccaaagaagtgaagaaaagcgtcgagccatcggaggtgaagcaggctacgtcaacctctgggcctgcgtcagctgtggctgacccgccatccaccgaaaaggaaattgatcccacatcaattcccaccgcaatcaagtatcaggatgacaactccctcgcacacccaaacctctttattgaaaaggccgacgccgaggaaaagtggttcaagagactgatcgccctgcggcaagagagattaatgggcagtcctgttgcttag

SEQ ID NO: 214810 - DNA, 498 bp, Artificial Sequence
  Description of Artificial Sequence: Synthetic coding sequence
atggggcgtcggtctagcgataccgaggaggaatcacggtccaagagaaagaagaaacaccggagacgatcaagtagctcatcaagctctgattcgcggacttattccagaaagaagggcggacgtaagagccgcagcaagagtcgtagttggtcccgcgatctgcagccacgttcccacagttatgaccggagacgtcggcataggtcatcgtcaagttcaagttatggcagtcggcgtaagcggtcacgcagccgctcaaggggtcgtggcaagagttaccgggtccaaaggtcgagatcaaagagccgaacacggaggtctaggagccgcccaagacttcgcagtcactcacggtcttctgaaagaagctcgcataggcgaactcgttccagatcccgagaccgggaaagacggaagggaagggacaaagaaaaaagggaaaaggagaaggataaggggaaggacaaagagctacacaacataaaaagggggtag

SEQ ID NO: 214811 - DNA, 948 bp, Artificial Sequence
  Description of Artificial Sequence: Synthetic coding sequence
atgaggaaccggatggccccagagaacccgcaacctgacccatttattaacaggaattacagtaacatgaaggtgatcccaccacaggaccctgcgtcgccgagcttcacccttttgtcaaagttagaatgctccggcaccgtaagtgcgtactgcagccttaatttgccaggttccaccgacccccctacttccgcatcccgggttgcagccaccacagctattagaagacggcacaaggaacgcacgagcttcacccaccaacagtatgaggagctggaggccttgttcagtcagacaatgtttcctgaccgaaatctgcaggaaaagttggccctacgcctggacctcccagaaagtactgtaaaagtctggttccggaatcgcagattcaaactgaaaaagcaacaacagcagcaatccgctaagcagcgtaatcagatacttccaagcaagaagaatgttcccacaagccccaggactagcccctctccgtacgcattcagcccggtgatctccgacttttattcttctctcccgtcccagcctctagatccgtcaaattgggcatggaacagtacttttactgagtcaagtacatctgacttccagatgcaggatacacagtgggagcgcctcgtggccagcgtacccgcactgtactcggacgcctatgatatctttcagataatagagctctataaccttcccgacgagaacgaaataagctccagtagttttcactgtctatatcagtatttgtcacccaccaaatatcaggttggcggacagggatcaagtctctcgatctttgcagggccagcggtcggcctgagtcccgctcagacatggcctaatatgacttcccaggccttcgaagcatattctttgactgatagcctggagttccagaaaactagcaatatggtggatctggggtttctctag

SEQ ID NO: 214812 - DNA, 4700 bp, Artificial Sequence
  Description of Artificial Sequence: Synthetic coding sequence
atgacagctgacaaagataaagacaaagacaaagaaaaggaccgagatcgcgatagggaccgagagcgggaaaagagggacaaagctagggagtccgaaaacagcaggccacggagatcctgcaccctggagggcggtgcaaaaaactatgccgaatctgaccattctgaggacgaagataacgacaacaattcagccacagccgaagagtcaactaagaagaacaagaagaaacccccaaaaaaaaagtcacgctacgaaaggactgacacaggagagatcacatcttacattactgaggatgatgtggtgtatcgacctggggattgcgtctatatcgagtcacggaggccaaacactccatattttatttgctcaatccaagattttaagttagtacataattcacaggcctgttgccggtccccaacccccgcactatgcgatcctccggcatgctccctgcctgtagcttcccagcctccccagcacctgagtgaggccggacggggtcctgtcgggagtaagagagaccacctcctgatgaacgttaagtggtattataggcaatctgaggtgcctgatagcgtttatcagcatctggtccaggatcgacacaatgagaatgactccggacgggagctggtaattaccgatccagtgattaaaaatagagagttgttcattagcgactatgtagatacctatcacgcagccgctttgcgaggaaagtgcaatatcagtcacttttccgatatatttgctgccagggagtttaaagcccgtgtggacagtttcttttacatactgggatataaccctgagacaaggaggctcaatagcacacaaggcgagattagggtgggcccatctcaccaggctaaactcccagatctccagcctttcccctctccagatggggataccgttacccagcacgaagagctggtctggatgcctggcgtgaacgattgtgatttgctgatgtacttaagagcagctcggagcatggcagcattcgcagggatgtgcgatggagggtcaacggaggatgggtgtgtcgccgcttcaagagatgacacgactttaaatgcactgaacaccctgcatgagtcgggttacgatgcgggaaaggccttgcagagactcgttaaaaagcctgtgccaaaactgattgaaaaatgctggacagaagacgaggtgaaacgctttgtcaaaggcctcaggcagtacggtaagaactttttcaggattcgtaaggaactcctccctaataaagagactggagagttgatcacgttctactattactggaaaaaaacacctgaagctgcttcctcccgagctcaccgcagacatcgaaggcaagctgtgtttcgcagaatcaaaacacggacagcaagtacacccgtgaatacaccttctaggccgcctagttcagaatttttagacctaagctctgccagcgaagatgattttgattctgaggattctgaacaggagcttaaggggtatgcatgccgacattgttttacaacaacttctaaggactggcaccatggcggtcgtgagaatatcctactatgtacggattgtcggatacattttaaaaaatacggcgaactcccaccgattgagaaaccagtggatccacctcccttcatgttcaaacctgttaaagaggaagacgatggactcagtggcaagcatagcatgcggactagaaggtcccgtggctctatgagcacactacgctccggtcggaagaaacagccggcttccccggatggcagaaccagtccaattaatgaagacatacggagctcaggtcgcaattccccatcagcagcttcaacttcctctaatgatagcaaggccgaaactgtgaaaaagtccgcgaagaaggtcaaagaagaagcctctagccctttgaaatctaacaagcggcagcgcgaaaaggtggcctcagataccgaagaggcagaccggacatctagcaagaagacaaaaactcaggagatctcccggcctaattctcctagtgagggggagggcgagtcaagcgacagccgatccgtgaacgatgagggaagcagcgaccctaaggacatagaccaggacaatcgcagcacctcacctagtattccttccccccaagataacgagagtgatagcgattctagtgctcagcagcaaatgctgcaagctcagcccccagccctgcaggctccaacgggcgtgactccagcaccttcaagcgctccgccaggaaccccacaactgcccaccccaggcccaacaccatctgctactgcggttccgcctcagggtagtccaaccgcaagtcaggctcccaaccagccccaggctcccaccgctccagtaccgcacacccacatccagcaggctccagccttgcatccccaaagacctccaagcccacaccctccccctcatccgagcccccaccctccactgcaaccactgaccgggtccgcaggccagccaagcgcgcctagccatgcacaaccccctcttcacggtcagggccctcctgggcctcactcactgcaggctggacctctcctgcaacatcctgggccaccacagcctttcgggttgccacctcaggcgagtcaggggcaagcgccactcgggaccagccctgcggcagcctatccccacaccagtctacagctccccgcttctcagtcagcgctccagtcccaacagccgccacgggaacaaccactcccacctgcccctctcgccatgccccacatcaagcctcccccaacaacccccataccacagctcccagcccctcaggctcacaagcaccccccacatttgtccggcccttctccattctccatgaacgctaatttgccaccaccccctgcactgaaacccttgtcctctctgagcacccatcaccccccttctgcacatcccccacccttgcagctaatgccacagagtcaacctctccccagctccccagcacagccacccggactaacacagagtcagaacctgcctcctcctccagcttcccacccccctactggattgcatcaggtagcccctcaacccccattcgcacagcacccgttcgtgcctggagggcctcccccaatcacaccaccaacgtgtccgagtacatctactccgccagcgggtccgggaacaagcgcccagcctccctgttccggagcagctgcatccggtggcagtatcgccggtggaagtagttgccctctgcctactgtacagatcaaggaggaggctttggacgacgcagaagagccagagtctccacctcctccgcctaggagcccgtcacctgaacccacggtcgtcgacaccccatcccacgccagccagagcgccaggttctacaaacatctcgatcgcggatacaactcttgtgcgagaaccgatctctattttatgccccttgccggatccaagctcgctaagaagcgggaagaggccatcgaaaaagcaaaacgagaagccgaacagaaggcacgagaagagagggagcgagagaaagaaaaggagaaggagcgcgaacgggaaagagagagggagcgagaggcagagagagcagctaaagccagctcgagtgctcacgagggcagattaagtgatccccagctgtctggtcctggacatatgaggccttccttcgagccccctccaacgaccatcgctgccgtgcctccgtatattggacctgacactccagctcttcgaaccctgtccgagtacgccagacctcacgtaatgtccccaacaaacaggaatcatccgttttacatgcccctgaatccgaccgacccgttgctggcataccacatgcctggcctttataatgtggatccgacaataagggaacgggagctacgggagcgcgaaatacgcgaaagggaaatcagggaaagggagctcagagagcgaatgaaacctggatttgaagtaaagccgccagagttggatccactgcatccagccgcaaaccctatggagcactttgccagacacagtgcccttactatcccccctaccgccggtcctcatccctttgcctcattccaccctgggcttaatcctctcgagcgggaacggctggccttggccggacctcagttgcggcctgagatgtcttatcccgaccggctggcggcagagaggatacacgctgaaaggatggcatccctcacctctgacccactcgccagacttcagatgttcaatgtgacccctcatcatcatcagcactcccacattcattctcatctgcatctgcaccagcaagaccccctgcaccaaggatctgccggtccagtccaccctcttgtggaccccttgaccgccggaccccatctcgccaggtttccgtacccacccggtactctgcccaacccactccttggtcagccccctcacgaacatgagatgctccgacatcccgtttttggtacaccgtaccccagggatctgccaggcgctatcccaccgccaatgagtgccgctcaccagttacaggccatgcatgcccagagcgccgagctgcagcgcttagctatggagcagcagtggttacatggacaccctcatatgcacgggggacatttgccatcacaggaggactactactctcggctgaaaaaggagggcgataaacaattgta

SEQ ID NO: 214813 - DNA, 3897 bp, Artificial Sequence
  Description of Artificial Sequence: Synthetic coding sequence
atggacgacccttttagtccctgtagacgcctaaatagcacacaaggcgaaatacgtgttgggccttcccaccaagcaaagctgcccgacctgcagcccttcccctctcctgacggcgacactgttacacaacatgaggagctggtttggatgcctggagtcaacgattgcgatctgcttatgtatttgcgcgctgcccgtagcatggctgcatttgctggaatgtgcgatggtggatcaaccgaggatggttgcgtggcggcttccagggacgataccacactcaacgccttaaacacattacacgagtccgggtacgatgcaggaaaggcactgcagaggcttgtgaagaagcctgtccccaaattgatcgaaaagtgttggacagaggacgaagtgaaacggtttgtgaagggactgcgacagtatgggaaaaactttttccgcattcggaaagaactactgccaaacaaagaaactggcgaactaattaccttctactattattggaaaaagacacccgaggctgcctcttctcgcgctcacaggcggcatagaaggcaggctgtattccgaaggatcaagacccgaaccgcttccaccccagtgaataccccgtctcggcctcccagcagcgagttcctcgacctgagctccgcatcagaagacgattttgattccgaggatagcgagcaagagttaaaggggtatgcatgccgtcactgcttcactactaccagtaaagattggcaccacggaggcagggagaacatactgctctgcacagactgtaggatccacttcaagaagtatggggagctcccccctattgaaaaacccgtggatccccctcccttcatgttcaagcccgtcaaggaggaagacgacggtctatctggcaagcactccatgagaacacgaagatcccgcggatccatgagtaccctgagaagcggacggaagaagcaacctgcttcacctgacggtagaacttcaccgattaacgaagatattagaagctccgggcgaaattctccatcagctgctagcactagttcaaatgactccaaggcagagactgtgaaaaagtctgccaagaaggttaaagaagaggcatcatccccactgaaaagcaataaaaggcagcgcgaaaaggtggcttcggacaccgaagaagccgataggaccagcagtaagaaaacaaaaacccaagagatctctcggcctaactctccctcagagggtgagggcgagtccagcgattctaggtcagtgaacgacgagggctcgtctgaccctaaggacatcgatcaggacaacaggagcacctcaccgtccataccatccccacaagataacgaaagcgatagcgattcttcagcgcagcagcagatgcttcaggcacagccacctgctctgcaggccccaacaggcgttactcccgcaccatcatccgcccctcctgggacacctcagctgcccactcccggtccaacaccgtctgcgacagccgtgccaccgcaaggctcacctacggcatctcaggccccaaatcagccacaggctccaactgcgcctgtcccacacacccacatccaacaggccccagcccttcatccacagaggcctccatccccccatcctccaccccacccgtccccccaccctcctctccagcccctgaccggctccgcaggacagccttccgccccttctcatgcacagcccccacttcatggtcaggggccacccggaccacactcactacaagcgggtccactccttcagcaccccggacccccacagccgtttgggctgcctccccaggcaagccaggggcaggccccactcggcaccagtccagcagccgcttaccctcacacctcattacaactcccagcgagccaatcagcccttcagtctcagcagcctcccagagaacagccccttcctcctgccccactcgcgatgcctcatattaagcccccacctaccacacctatcccacagttgcctgctccacaggcgcataaacaccctccgcacctgtccggtccctcccctttctcgatgaacgctaacctgccgccacctcccgctttgaaaccgctctcctcactgagtacccaccacccgccaagtgcacacccccctccactgcagttaatgccacagagtcagcccctgcctagctccccagctcaaccgcctggcctgacccagtctcaaaacctgccacctccacctgcatcccaccctcccactggtctgcatcaggtcgcacctcagccccctttcgcacagcacccttttgtgcccggaggcccacccccaattacaccacctacatgcccgtcgactagcactcccccagcaggtcccggtactagcgcacaacctccatgttctggtgctgccgcatccggtggaagcatcgctggtggctctagctgcccccttccaacggtccagattaaagaggaggctctggacgacgcagaagaacccgaaagccccccaccacctccacgttccccctcacctgaacccactgtcgtcgacacaccatcacacgcgagccagagcgccaggttttacaagcatctggacagaggttacaactcgtgtgcgaggacagatttatacttcatgccgctcgctggctcaaagctggccaagaaacgggaggaggctatcgagaaggccaaacgggaagcagagcaaaaggcgcgagaagagcgagagcgtgagaaggaaaaggagaaggagagagaacgggagcgagagcgtgagagagaagccgagcgagcagctaaggccagttcttccgcccacgagggaaggcttagtgatcctcagctgagcggcccaggccacatgaggccatccttcgagccccctcccactacaatcgctgccgtgcccccttatattggccctgacactccagccctcagaactctgtccgagtacgcacggcctcacgtgatgtcccccaccaaccgcaatcatcccttttatatgcctcttaaccctaccgaccccctactggcttatcatatgcctggactgtacaatgtggaccccacgattagagaaagagagttgcgcgagagagaaattagagaaagggagatacgcgaacgagaactgagggagcgaatgaaacccggattcgaagtcaaacctcccgagcttgaccccctgcaccctgccgctaacccgatggagcacttcgctcgccattcggctttgactatcccacccaccgcagggcctcacccattcgcaagctttcatccaggcctcaaccctcttgaacgagaacggctggcccttgcagggcctcaactccggcctgaaatgtcttatccagatcggctggccgcagagagaattcacgccgagagaatggcctctctgacctccgaccccctagccaggctgcagatgtttaacgtcaccccacatcatcaccagcatagccatattcacagtcacctacacctccatcaacaggacccccttcaccagggctcagccggacctgtccatccgctcgtggacccactcacagcagggcctcatctcgcaaggttcccgtatccccctggcaccctaccgaatcccttgctcggtcagcccccacacgagcacgaaatgttacggcaccccgtcttcggaactccctacccaagggatctcccaggcgcaatccccccacccatgtctgccgctcaccagttgcaggccatgcacgcacagtcagcagagctccaaagactcgctatggagcagcagtggttgcacggccacccacatatgcacgggggtcacctgccaagccaagaagattattactcccgactgaaaaaagaaggcgacaagcagctatag

SEQ ID NO: 214814 - DNA, 4701 bp, Artificial Sequence
  Description of Artificial Sequence: Synthetic coding sequence
atgactgcggacaaagataaagacaaagacaaggaaaaagatagagatcgggatcgcgatagggagcgggaaaagagagacaaagctagagagtccgagaattcgcgaccacgccgatcttgcaccctagaaggaggcgcaaagaattatgcagagtctgaccacagtgaagatgaggataacgacaacaacagtgctaccgcggaagagagcacaaaaaaaaacaagaagaagccaccaaaaaagaagtccagatacgaacgtaccgacacaggtgaaattacgagttacattaccgaggacgatgtcgtgtatcggcctggagattgtgtctacatcgaatcccgacggccaaataccccttacttcatttgctctattcaggactttaagctggtgcacaacagccaggcgtgctgtaggtcccctacccccgctctgtgcgatccccctgcctgttctcttcctgtggcgagtcagcccccacagcatctcagcgaagctggacgaggccctgtgggcagcaaacgtgatcacctcttgatgaacgtcaagtggtactaccgccagagcgaggtgccagattctgtgtaccagcacctggttcaggaccggcacaacgagaatgattctggcagggaactcgttataaccgaccccgtgattaaaaacagggaactcttcatctcagactacgtagacacgtatcacgccgctgccctgaggggcaaatgcaacatttcacacttctccgatattttcgctgcgagagaatttaaagccagagtcgatagctttttctacattttgggctataaccccgaaacaaggcgccttaacagcacccagggcgagatccgggtcgggcctagccaccaagctaagctccccgacctgcagccattccccagtccagacggcgataccgtgacccagcacgaagagttagtgtggatgcctggagtgaacgattgtgatctcctcatgtacctgcgagcagctaggtccatggcagccttcgccggtatgtgtgacggagggtccaccgaggacgggtgtgtggcagcctcaagagatgacactaccctcaatgccctgaatactttacatgaaagtgggtatgatgccggtaaggccctgcagcgtctcgtgaaaaagccagtgcccaaactgatcgagaaatgctggactgaagatgaggtcaagaggtttgtgaaagggctccgccaatacggcaagaacttctttcgaataaggaaagaacttctgcccaacaaagagaccggcgagttaataacattttattactactggaagaagacacctgaagctgcctcttcccgagctcatcgtcgccaccggagacaagccgtgttcagacggatcaaaacaagaacagcgagcacaccagtgaataccccctcccgacctccttcgtccgagttcttggacctttccagcgccagtgaggacgatttcgacagtgaagactctgaacaagagctcaagggctatgcatgtagacactgttttacgacaacaagcaaagattggcatcacggagggagagagaatatcctcctatgtactgactgcaggatccatttcaagaaatacggtgagctgcctcccatagagaagcctgttgacccaccacctttcatgttcaaacctgttaaagaggaagatgatggccttagcgggaagcatagtatgcgcactcggagaagtcgcggtagcatgagtacactgaggagcgggcgaaagaagcaaccagctagtcctgatggcagaaccagccctataaacgaagatataaggtctagtggcaggaacagtccctcagccgctagcacatcttctaacgacagcaaagcggagactgtcaaaaaatctgccaaaaaggtaaaggaggaggccagttcacccctgaagagtaacaagagacagagggaaaaggtagctagcgacacggaggaggcagataggacatcatcgaagaagacaaagacgcaggagatttctcgcccaaattcaccaagcgaaggcgaaggggaatcaagcgattcaaggtctgtaaacgacgaagggagcagcgatccaaaggatatcgaccaggataatagatcaacaagccctagcatcccttcaccccaagataatgagagtgactccgactcttctgcacagcagcagatgctccaggctcagcctcctgccctccaggctcctactggcgtgacgcctgctccgtctagtgccccacctggcaccccacaactgccaacccccggtcctacgccgtctgccacggcagtacctccccagggctcacctaccgcgtcccaggcccctaaccagcctcaagcccctacagcacccgtgccccacacccatatccagcaggctccggctctgcacccacaaagaccaccaagtccacaccctccccctcacccctcgcctcacccccctctccagcccctcactggatcagccggtcagcctagcgctcccagtcatgcccaaccccctctgcacggccagggacctcctggaccccactctctgcaagccggaccacttctgcagcaccccggaccccctcagccctttgggcttcctccccaggcctctcagggacaagcacccctgggtactagtccagctgctgcatacccacacacgtcactccagctaccagcctcccagtcagctctccaatctcaacagcctcccagagagcagcccctcccccctgctcctctggctatgccgcatatcaaacctcctccaacaacacccatcccgcagctgccggcaccacaagcccacaagcatcccccacaccttagcgggccaagtcccttttctatgaatgctaacctgcctccaccacccgcactcaaaccattatcctccctgagcacacatcaccccccttccgcccaccctccccctctgcagcttatgccgcagagccagcccctgccctcctcacctgcccagccccctgggctgactcagagtcagaatctacctccccctcccgcttcccacccgccaacgggactgcaccaggtggctccgcaacctccctttgcgcagcatcccttcgtgcccggaggacctccgccaatcacaccccctacctgtcccagtaccagcacacctcccgctgggccaggaacttccgcacagccgccatgctcaggggctgcagcttccggcggatcaatcgccggtggctcctcatgtcccctgccaaccgtacagatcaaagaggaagcactcgacgatgccgaggagcccgagtcccctccgccaccaccaagaagccctagcccggagcctactgtcgtggatacaccatctcatgcctctcagagcgcccgtttctataaacacttagaccgtggctacaactcgtgtgctcgcactgatctatactttatgcctttggcagggagcaaattggccaaaaagagagaggaagcaattgaaaaggctaagagggaggccgagcagaaagctcgcgaagagagggagcgggaaaaggaaaaggaaaaagagagagaaagagaacgcgagcgggaaagggaagctgagcgcgctgccaaggcgagctcttccgcacacgaggggaggctgtccgatccacagctcagcggacccggacacatgcgacccagtttcgagccgccacctactactatcgctgcagttcctccctacatcggcccagacaccccagctctcaggacactgtcggagtacgctagaccacacgtgatgagtccaacaaatcggaatcaccccttctacatgcccctcaacccgaccgacccactgctggcgtaccatatgccaggtctgtacaatgtggaccctaccatcagggaaagggagctgagggagcgggagatccgggagagggaaattcgggagcgggagttaagggaacggatgaagccaggattcgaagtcaaacctcctgaacttgaccctctgcatcctgccgcaaaccccatggaacatttcgcccgtcactctgcactgacgatcccacctacggcaggaccccatcccttcgcatctttccatcccggtctcaatcccctcgagcgcgaaagactcgccctcgctggaccacagctgcggcctgaaatgagctaccccgatcgccttgcggcagagagaatccatgccgagcgtatggcgagcctcacatccgaccccttggcacggttgcagatgtttaatgtgactccacatcatcatcagcactcacacatacactcacaccttcacctgcatcaacaggatccactgcaccaaggaagcgctggccctgtacaccctctggtggaccctctcactgccggtccacacctagctcgctttccctaccctcctggaacattacccaatcccctcctgggccagccccctcatgagcacgagatgctgcgacatccagtgttcgggacaccctaccctcgggatctgcccggtgcaattcccccaccgatgagcgccgcacatcaacttcaagcaatgcacgcgcaatccgctgagctccagcgactggccatggaacagcagtggttgcacggtcacccacacatgcacggtgggcatcttccgtctcaggaagattactactcccgattgaaaaaggagggggacaaacagctttag

SEQ ID NO: 214815 - DNA, 3039 bp, Artificial Sequence
  Description of Artificial Sequence: Synthetic coding sequence
atgtttaaacccgttaaagaggaggatgacggtctgagcggcaagcacagcatgcggaccagaagatcccggggatctatgtcgactcttcgtagtggtcgaaaaaaacaaccggcatccccggacggtcggactagccctataaacgaagacattcgttcctcgggcagaaactcaccctcggccgcatcaactagcagtaacgactcgaaagccgagaccgtgaaaaaatccgcgaagaaagtaaaagaggaggcaagcagtcccctcaagagtaacaaaaggcagcgtgagaaagtcgcctccgatacagaggaggccgaccgcacatcctccaagaagaccaaaacgcaggaaatcagtcggcctaattctccgtctgagggcgagggggagtctagcgacagcaggtcagtgaacgacgagggcagctccgacccaaaggacattgaccaggacaacaggtctacgagtccgagtatccccagcccacaggacaacgaatctgatagcgactcctctgcccagcagcagatgctgcaagcacagccaccagccttgcaagcaccgaccggggtgactccggcacctagtagcgccccacctggcactccacagctgcccacgccaggaccaacaccaagcgctactgccgtcccaccacagggatcaccgacagctagtcaagctcctaatcaaccacaagcaccgacagctcccgtaccccatacgcacatccagcaggctcccgctctccatccacagagaccaccctccccacacccaccaccccacccatcaccccatccaccactgcagccccttaccgggtccgccggtcaaccatctgccccttcccacgcccagcctccgttacacgggcaaggcccacctggccctcattcactgcaggcgggaccgctgctccagcaccccggaccccctcagccgttcggcctgccgcctcaggcatctcagggccaggcgccacttggcacgtctcctgccgctgcatacccccacacatctctgcagctccctgcttcacagtcagctctccagagccaacagccccctagggaacagcctctaccgcctgctccactagcaatgccacacatcaagcctccacctaccacccctattccgcagttgccggctccccaggctcataaacaccctccccacctgtctggccctagcccttttagcatgaacgccaacctgccgcctcctcccgcactcaagccgctgtcctccttaagcacacaccatccaccctctgctcatccccctccccttcagctgatgccacagtcccaaccactacctagtagtcccgcacaaccgccagggctgacccagtcccaaaacctgcccccaccacccgcttcacaccctcccaccggcttgcaccaggtggcccctcaacctcccttcgcacagcacccgtttgtaccagggggacctcccccaattaccccccctacttgtccctctacatctacccctcccgctggccctggcaccagcgcacagcccccttgctccggggcagccgcaagtggcggttcaattgccggaggctcctcatgtcctctaccgacagtgcagataaaggaggaggccctcgacgacgctgaggagccagaatcccctcccccacctcctcgttccccaagtcctgaaccgaccgttgttgacactccatctcacgcctcccagagtgcaagattttacaagcaccttgacaggggctataatagctgcgcccgaactgatttgtacttcatgcccctggctgggagtaagttggccaaaaagagggaagaggccattgagaaagcaaagcgagaggcagaacagaaagcgagagaggaaagggaacgcgagaaggaaaaggaaaaagagcgggagagggagagagaacgggagagagaggctgagagagcggctaaggcctcatcttcagctcatgaaggcagactttctgatccccagctgtctggacctgggcacatgagacccagctttgaaccccctccaactactatcgctgctgtccccccttacatcggccctgacacacccgctctcagaaccctgagtgagtatgcccgtcctcacgttatgtctcctactaataggaatcaccccttctatatgccactcaatcccaccgacccacttcttgcgtatcacatgccaggtctgtataacgtggacccaaccatcagagagcgggagttacgcgagagagagattcgggagcgggagattagagaacgtgagcttagggaaaggatgaaacctgggttcgaagtgaagcctcccgaacttgaccctcttcaccccgcagcaaacccgatggagcatttcgccaggcactccgccctcacaatccccccaaccgcgggacctcacccatttgcaagcttccaccctggccttaacccactcgagagggagagactagcgttagcaggccctcaattgaggcccgagatgtcctacccggacaggctcgccgctgaaagaatccatgccgagaggatggcttcccttacctccgatccgttggcgaggctgcagatgtttaatgtcaccccacaccaccaccaacattcccatatccatagtcacctccaccttcaccagcaggaccccctccatcaggggtctgccggtcctgtgcatcctttggtggaccctctcacagctggtcctcacttggccaggttcccttatccacctgggacactaccaaatcctctcctggggcagccaccccacgagcatgaaatgcttcggcatcctgtatttggcacaccctaccctcgagacctacctggggcaattcctcctcccatgtccgctgcccatcaattacaggccatgcatgcccagagtgctgagctacaacggctggccatggagcaacagtggttgcatgggcacccacatatgcatggcggacacctgccctctcaagaagattactactcgcgactgaagaaggaaggggataagcagctctag

SEQ ID NO: 214816 - DNA, 1953 bp, Artificial Sequence
  Description of Artificial Sequence: Synthetic coding sequence
atggccagcggagaacattctcctgggagtggcgctgcgaggcgtccgctgcattccgcacaggctgtcgacgtagctagcgcttccaacttccgggcatttgagttattgcatcttcatctagatctccgagcagagttcggtccacccggtccaggggctggttctaggggcctaagtggcactgccgtgctcgacctgcgatgcctcgagcctgagggcgctgcggagttgcgactcgactcccacccctgtctggaggtgacggccgctgccctccgcagagagagacccggtagtgaggagccacctgccgaaccagttagcttctacactcagcccttctcccactacggacaggcgctctgcgtgagctttccacagccctgtcgtgccgctgagcggctccaggttctgctgacctaccgcgtcggggagggcccaggtgtctgctggttagctccagagcagaccgctggcaagaaaaaaccttttgtgtacacccaaggtcaagctgtgctcaatcgggcattttttccatgttttgacacgcctgctgtcaaatataaatacagcgccctgatagaagtgccggatggattcaccgctgtgatgagtgccagtacctgggaaaaaagaggcccaaataagttcttcttccagatgtgccagccaatacccagctatctgatcgctctggctattggagatcttgtcagtgctgaagtgggccctcgaagcagggtatgggccgaaccatgtctgattgatgcggctaaagaagaatacaacggagtgattgaggagttcctggccaccggcgagaaactttttggcccatatgtttggggacgttacgacctgctctttatgcctcctagtttccccttcggcggtatggaaaatccgtgcctgactttcgtcacaccatgtctccttgccggtgaccgatcactcgctgatgttattatccacgaaatctctcactcctggttcggaaatctggtgactaatgctaactggggcgagttctggctcaatgagggatttaccatgtacgcccagaggagaatttctacaatactgtttggagcggcttatacctgcctcgaggctgctacaggccgagctctgttgcgccagcatatggacatcacaggggaggagaatcctcttaataaactgcgtgtgaagatcgaaccaggggtggatcctgacgacacctataacgaaacgccatacgagaaaggcttttgcttcgtgagttacctggctcacctggtgggagatcaggatcagtttgactcattcctgaaggcatacgtacatgaattcaagtttaggtctatcctggctgacgactttttagatttttatctggaatactttcccgaattgaagaaaaagcgagtggacatcatcccgggattcgaatttgaccgatggctgaacactcctggatggccaccttacctgcctgacctttctccgggtgattccttaatgaagcctgccgaggaattggctcaactgtgggccgctgaggaactcgacatgaaggccatcgaggcggtcgcgattagtccctggaaaacttatcaactggtgtattttttggacaagatactacaaaagagtccactcccaccaggtaatgttaagaaactcggggatacatacccatccatcagcaatgcgagaaatgcagaactacggctgcgatggggtcagatagttctgaagaatgaccaccaggaggatttttggaaagttaaagaatttctccataatcagggaaagcagaaatacactctaccattgtatcatgcaatgatgggagggagtgaagtggcacaaactctcgccaaggagacatttgctagcaccgccagccagctgcattctaacgtggtaaactatgtacagcagatcgtggcacctaaaggatcttag

SEQ ID NO: 214817 - DNA, 1836 bp, Artificial Sequence
  Description of Artificial Sequence: Synthetic coding sequence
atggcctctggagaacattcccctggcagcggggctgcccgtcggccattgcacagtgcccaggcagtcgacgtggcatctgcatcaaatttccgggctttcgagctgttacatctgcatctggacttgagggccgagttcggacctccagggccaggtgccggttcacgtggtctgagcgggactgcagtcctcgacctccgatgcctggagcctgaaggcgctgccgagctgagactcgattcacacccctgcttggaagtaaccgccgcagctctgcgtcgcgagcgccctggttcagaagagccgcctgctgaacctgtgagtttctacactcagccttttagtcactacgggcaagccctgtgtgtcagctttccccagccttgtcgcgcagctgagcggctgcaggtccttctcacataccgtgtgggcgaaggaccgggagtgtgctggctggcacctgagcaaacagctggaaagaaaaagcctttcgtgtatacacaagggcaagctgtcctgaatagagctttcttcccttgcttcgacacccccgcagtcaaatacaaatattcagcactcatcgaagtgccagatggctttactgctgtcatgtccgccagtacctgggagaaaaggggaccgaacaaatttttcttccagatgtgccagcctatcccctcctacctgattgcattggcgatcggagaccttgtgtccgcggaagtgggtccacgctacgacctgttgtttatgcctccaagctttccattcgggggaatggagaatccctgcttgacgttcgtgactccatgtttgctcgccggtgatcgcagtctggccgacgtcatcatccacgaaattagtcatagttggttcgggaatctggtgaccaacgccaactggggtgagttttggctgaacgaggggttcactatgtatgcacagagaagaatttcaaccattctattcggtgctgcatacacctgtctggaggcggcaactggtagggcactcctacgccagcacatggacatcaccggagaggaaaaccccttgaataagctacgcgtgaagatagagccaggggttgaccctgatgatacatacaacgaaactccatacgaaaagggattttgttttgtgtcataccttgctcacctggttggcgatcaagaccagttcgatagcttcttgaaggcttatgttcacgagtttaaatttcggagcattctggccgacgacttcctggacttttatctcgagtacttcccagagcttaagaagaagcgtgtggatattatacccggtttcgaattcgacaggtggctcaatacccctggttggccaccctacttgccggacctgagccctggcgacagcctcatgaagccagctgaggagctggcccaactctgggccgctgaagagctcgatatgaaggcaatcgaggcagtcgccatctccccctggaaaacataccagctcgtgtatttcctggacaaaatcttgcaaaagagccctctgccacctgggaatgtaaaaaaactcggcgacacataccctagcatcagcaatgcccgtaatgctgaactccggctcaggtggggccagatcgtcctcaagaacgatcaccaggaggacttttggaaagtgaaagagttcctgcataatcaaggcaaacagaaatacactctgcccctgtaccacgccatgatggggggtagcgaggttgcccagacgctcgccaaggaaactttcgcttctactgcaagccagcttcatagcaacgtggttaattatgtacaacaaatcgtagctcccaagggaagttag

SEQ ID NO: 214818 - DNA, 1035 bp, Artificial Sequence
  Description of Artificial Sequence: Synthetic coding sequence
atgacctgctgttcctgcacaagcttgtctgctctgctagacttctgggctgaagtctgctggctggccccagagcagacagccggtaaaaagaaaccctttgtgtacacacagggtcaggccgtcctcaaccgtgcatttttcccatgcttcgatacacctgcagtgaagtacaaatactcagccctgattgaggtccctgacggctttacagctgtgatgtcagcgtcaacgtgggaaaaaagaggacctaacaaatttttcttccagatgtgccagcctatcccctcttatctgattgccttagctatcggagacctggtgagcgcagaagtgggacctaggagccgggtgtgggctgaaccgtgccttattgatgccgctaaagaggaatacaacggggtgatagaagaatttttagcaaccggcgagaaacttttcggtccctatgtgtggggcagatatgacttgctcttcatgccacccagctttcctttcggcggaatggagaatccttgccttacatttgtgaccccatgtctcttggccggagacaggtccctcgcagatgttataattcacgaaattagtcatagctggtttggcaatctggtaaccaacgctaactggggtgaattttggcttaacgagggcttcaccatgtatgcccagcggaggattagtacaatcctgttcggagccgcttacacttgcctggaggcggctaccggaagagctttgctgcgtcagcatatggacataaccggggaagagaatcccctgaataaactgagggtcaagatagagcctggggtggatcccgacgacacttataatgagacaccgtatgaaaaagggttctgtttcgtgtcctatttggcacacttggtgggggaccaggaccaatttgatagcttccttaaggcttacgtgcacgaattcaagttcaggtcgatcctggccgacgattttttggacttctatctagaatatttccctgagcttaagaaaaagagggtggacatcattccctag

SEQ ID NO: 214819 - DNA, 507 bp, Artificial Sequence
  Description of Artificial Sequence: Synthetic coding sequence
ctgattgatgccgcaaaggaggagtataacggcgttattgaggaatttctggctactggcgagaaactgtttgggccatacgtctggggcagatatgacctcctgttcatgcctccctccttcccttttgggggaatggagaacccctgccttacatttgtgaccccatgcttacttgcaggcgaccgcagcctggcagatgtgatcattcatgagataagccacagctggtttggtaatttggttaccaacgccaattggggcgaattctggcttaacgaagggtttacaatgtacgcgcagaggcgaatttcaaccatactattcggagtagacccagatgacacttacaacgagaccccatacgagaagggtttctgcttcgtgagttaccttgcccatttagtgggcgaccaggaccaattcgacagctttctgaaggcctatgtgcacgaattcaagtttcggtctattttggcagatgactttcttgacttctacttatag

SEQ ID NO: 214820 - DNA, 1485 bp, Artificial Sequence
  Description of Artificial Sequence: Synthetic coding sequence
atgtcggctaccaggagcgcttatatggaagaagaaggagtattccacttccatatggagcaccctgtgcctgcctatctggttgcgctggtcgccggtgatctgaaacctgccgatattggcccaaggtcacgtgtctgggcggaaccgtgtctcttgcccacagcgacttctaaactgagcggagctgtggagcagtggttgagtgccgctgagcgtctgtacggaccctacatgtggggtcggtacgacattgtgtttcttcctccttctttccccattgtggcaatggaaaatccatgcctgaccttcattataagcagcatcttggaaagtgacgaatttctcgtgatagatgtcattcatgaagtggcccattcttggttcggcaatgccgtaaccaacgcaacttgggaggaaatgtggctgagtgaaggactggcaacctacgctcagcgtcgtatcactaccgagacatacggcgcagcatttacatgtctcgagactgcatttcggctggatgcactgcacagacagatgaagttactgggagaagattctcccgttagcaaattgcaggtgaagttggagcccggtgtcaatccctcacacctcatgaatttgttcacatacgagaagggatattgcttcgtgtactacttgtctcagctatgcggcgaccctcagaggtttgacgattttctgagggcctatgtggaaaaatataaattcacaagtgtggttgcccaggacctcttggattcctttctttctttcttccccgaactaaaggagcaatctgtcgattgccgggcaggcctggaattcgagcgttggctgaacgctactggccctcccttggctgagccggatctctctcagggaagcagccttacccggcctgtggaggcactcttccaactatggactgcagagcctttggaccaggctgcagccagcgcttcagccatcgatatatctaagtggcgcacttttcaaaccgctttgttcctggatcggctactagacggatcgccactccctcaagaggtggtgatgtctctgagtaagtgctacagctctctcctggactcaatgaacgccgagattcggattcgctggctacagatagttgtgcggaatgattactatcccgacctccaccgcgtgagacgtttcctggaatctcagatgagtcgtatgtacacgattcctttgtacgaggatctttgcacaggggctctgaagtcctttgcactggaagtgttttaccagacacagggcagactgcatcctaatctaagacgcgctatccaacagatcctcagtcaggggctcgggagctctaccgagcccgcatctgagccgtctactgagttgggcaaggctgaggcagacaccgatagtgatgcccaggcactgctgctcggcgatgaagctccaagctcagccatttctctgcgggacgtcaatgtgtctgcttag

SEQ ID NO: 214821 - DNA, 1236 bp, Artificial Sequence
  Description of Artificial Sequence: Synthetic coding sequence
atggaggttaatcccccaaaacaggagcatcttctcgctcttaaggttatgcgtctaactaaaccaactctgtttacgaacatccccgttacttgtgaggaaaaagacctccctggtgatctgtttaaccagctcatgcgggacgatccctctaccgtgaatggagctgaggtgcttatgttaggcgagatgctgacacttccacagaacttcggaaatatcttccttggtgaaactttttcttcatatatcagcgtgcataatgacagtaaccaagtggtcaaggacatcttggttaaagcggacctgcagacctcctctcagcgactgaacctcagcgccagcaacgccgctgtagccgagctcaaacctgactgctgcatagacgacgtgattcatcacgaagtcaaagaaataggtactcacatccttgtgtgcgcggtctcctataccacccaggccggagagaaaatgtacttcaggaaattcttcaagtttcaggttttgaagcctcttgatgtgaagacgaagttttacaacgcggagacagacgaggtcttcctggaagcccagatccagaacatgaccacatcccccatgtttatggaaaaggtcagtttagaacccagcatcatgtacaacgtgacggagctcaactccgtcagtcaggccggagagtgcgtatcaacatttggatcgagagcatatctccagcctatggatacaaggcaatacctctactgtttgaaacctaaaaatgagtttgctgagaaggccggtatcattaagggagtgaccgtgatcggaaagctggatattgtttggaagactaacctgggtgaaagaggcagactgcagacctcacagctccagcgcatggcaccaggctacggtgacgtacggttgtcactcgaggccattcctgacactgtcaatctcgaggagcccttccatattacctgcaagattaccaactgctcagaaagaacaatggacctggtactggaaatgtgtaacactaactctattcactggtgcggaatcagtgggcgtcagctgggcaaactgcacccatcaagctccttgtgcctggcccttacgttactcagttcagtgcagggactccaatcaatatcaggcctcagactaacagacacctttctgaaaagaacctacgagtatgacgatatcgcacaggtctgcgtggtgtcaagtgccatcaaggtggagagttag

SEQ ID NO: 214822 - DNA, 1365 bp, Artificial Sequence
  Description of Artificial Sequence: Synthetic coding sequence
atgcacgtaggccacctccgcagtacgatcataggggagagtatctccaggctgttcgaattcgcgggttatgacgtattaaggctcaaccatgtcggagattggggaacacagttcggtatgcttatcgctcatctgcaagacaagtttcctgattacctgactgtgagtccgccaattggagatctgcaggtgttctataaagagagcaagaagcggttcgataccgaggaggagttcaaaaaaagagcctaccagtgcgtggtgctcctgcagggcaagaatccagacatcacgaaagcctggaaactgatctgtgatgtgtcaaggcaagagctcaataagatctatgatgctctagatgtctctttgatcgagcgaggggagagcttttatcaggatcggatgaatgacattgttaaggagttcgaggacaggggcttcgtgcaggttgacgatggcagaaagatcgtttttgtgccgggatgtagcatccctctcacaatcgtcaagtctgacggtggatacacatatgatacaagcgacctagccgcaatcaaacagcggctgttcgaagaaaaagcagacatgatcatttacgtggtcgataacggtcaatcggttcatttccagacaatcttcgctgccgcacagatgattggctggtacgatccaaaagttactagagtgttccacgcaggctttggggtcgtgctcggtgaagacaagaaaaagttcaagacaaggtctggagaaacagtgcggctgatggatctgcttggcgaaggcctcaaacgaagtatggataaactgaaggagaaagaacgagacaaggtcctgactgcggaggagcttaatgcagcacaaacctctgtggcgtatggctgtattaaatatgccgatcttagccataaccgattgaatgactatattttttcattcgataagatgctggacgacaggggcaacactgccgcttatttgctgtacgccttcaccagaatccgaagcattgcgagacttgccaatatcgatgaagagatgcttcagaaggccgctcgcgaaaccaagattcttcttgaccatgagaaggaatggaaactcggacggtgcattctgcgctttcctgaaatccttcagaagatcctcgatgatctgttcctacatactctatgtgactacatttacgagctcgcaaccgcttttactgagttctacgactcttgctactgcgtcgaaaaagatcgccagactggtaagatcctgaaagtgaacatgtggaggatgttgttatgcgaagccgtggctgccgtcatggccaaaggttttgacatattgggcatcaagcccgtgcagcggatgtag

SEQ ID NO: 214823 - DNA, 618 bp, Artificial Sequence
  Description of Artificial Sequence: Synthetic coding sequence
tttcaaagtgttgagtcttccactagaaaactggaccatatcaacatctgttctagtaatttccccaagcgcagttttgctctcgtgacgcaagccggagtgcagtggcataatctagattccctgcagagccctccaccgggatttaagcgtttcccatgtctgtctctgccctcctcgtgggactgcagggaagttgcagatttccaactatcagtagatagtctgctcgagaaagacaacgatcattctcggccagacattcaagtgcaggcaaaacgccttgccgagaaattaagatgcgatacggtggtctccgaaatctcgacgggacaaaggacagtgaactttaagattaatcgcgagctgctgactaaaacagtgctgcagcaggtcatagaagacggttccaagtacgggctgaaaagcgagctcttttccggcctccctcagaagaagatcgtagtagagtttagctcccctaatgtcgccaaaaagttccatgtgggccacctgcggtccaccattataggaaattttatcgcgaacctgaaggaagccttgggccatcaggtgatcaggattaactatctgggcgactgggggatgcagttttag

SEQ ID NO: 214824 - DNA, 1737 bp, Artificial Sequence
  Description of Artificial Sequence: Synthetic coding sequence
atggcctgtggctttcgccgagcgattgcctgccagctctctcgcgtgctgaacctcccacccgaaaatctaataacttcgattagcgccgtgccaatttcacagaaggaggaggtcgcagatttccaactcagcgtcgactctctactggagaaagacaatgaccactccaggcccgacatccaggtccaggccaagaggctcgccgagaagctgcggtgcgacacagtcgtgtctgagatctctaccggacagcgcactgtgaacttcaaaatcaatcgagagctgctgactaaaactgtacttcagcaagtcatcgaggacgggtccaagtacggtctgaagtcagagctgttttccggactccctcagaaaaaaatagtggtggagttctcttccccaaatgtagcaaagaagttccacgttggacacctgcgctccaccataatagggaacttcattgccaatctgaaagaggccctggggcaccaggtgattagaattaattatctgggcgattggggcatgcagttcggattgctaggaaccggtttccagctcttcgggtacgaggagaagctacagtcaaaccccctgcagcatctcttcgaggtgtacgtgcaggtcaataaggaggctgccgacgacaagagtgtcgctaaagcggcacaggagttcttccagaggctggagctgggggatgtgcaggctctgagcctctggcaaaaattcagggacctctcaatcgaggaatacatacgagtgtacaaacgcctcggcgtgtacttcgatgaatattctggagagagcttttacagagagaagtcacaggaagtgttgaagctcctggaatctaagggcctgctgctcaaaaccatcaagggtactgctgtagtggatctaagtggtaatggagatccaagcagcatttgtacggtgatgcgaagcgatggcacatctctttacgccactcgcgacctcgcagcagctatagatagaatggataaatacaacttcgacacaatgatctacgtcacggacaaaggccagaaaaaacacttccaacaggttttccagatgctgaagatcatgggatatgattgggccgagaggtgccagcacgtgccgtttggggtcgtccagggcatgaagacccgcaggggggatgtgacatttttagaagacgtgctgaacgagattcaactgcggatgttgcagaatatggccagcatcaagacaacaaaagagctcaagaatcctcaagagaccgccgaaagagtgggcttagcagccctgatcatccaggatttcaaaggcttgttgctgagtgactacaaattcagctgggatcgcgtgttccagagccgtggtgacacaggagtttttttgcagtacacccatgcaagattgcatagcctggaggagacgttcggttgtggatacctgaacgactttaataccgcctgcctccaagagccacagagtgtgagtattttacagcatctcctgagatttgatgaggtgttgtataaatcatcacaagatttccaaccacgccatattgtgtcttatctgctaactctttctcatctggccgcagtagctcataaaactcttcaaataaaggacagcccacccgaggttgccggagctcggcttcatttgtttaaggcggtgaggtctgtgctggcaaacggcatgaagctgttgggcatcacccccgtttgccgtatgtag

SEQ ID NO: 214825 - DNA, 621 bp, Artificial Sequence
  Description of Artificial Sequence: Synthetic coding sequence
tagttccagtcagtggagtcgtctacccggaagctggatcatatcaacatctgctcttccaatttcccgaaacggtcattcgccctcgtcacacaggcaggcgtacagtggcacaacttggatagcctccagagtccgccaccaggatttaagagattcccttgcctgtccctgccatcttcttgggattgccgcgaggttgccgacttccagctttctgtcgattccctgctggagaaagacaacgaccactcccggccagacattcaggtccaggcaaagcgactggctgagaagcttcggtgcgacaccgtggtgtccgaaatctctacaggacaacggaccgtgaacttcaaaattaatagggagctcctaaccaagaccgtcctgcagcaagttatagaggacggcagtaagtacggtctcaagtccgagctgttcagcgggctgccacaaaagaagatcgtggtagagttcagctcacccaatgtggcaaagaaatttcatgtaggtcacctgcgctcgacaatcatcggcaatttcatcgccaacctaaaggaggctcttgggcatcaggtaattaggatcaattatctgggcgactgggggatgcaattctag

SEQ ID NO: 214826 - DNA, 1482 bp, Artificial Sequence
  Description of Artificial Sequence: Synthetic coding sequence
atgagcgtggacatgaattcccaaggatcagactcaaatgaggaggactatgatccaaactgtgaagaagaggaggaggaggaggaggatgacccaggggatatcgaggattactacgtgggcgtggcctccgacgtcgaacagcagggggctgatgcattcgatccagaggagtatcagtttacctgtcttacgtataaagagtctgagggcgctctaaacgaacatatgacttccctggcatccgtccttaaggtatcccactcggtagccaagctcatcttggtgaatttccactggcaggtttcagagatcctggataggtataaaagtaacagtgctcagctcctggtggaggcccgagtgcagcctaacccatcaaaacacgttcccacatctcatccccctcatcactgcgctgtgtgcatgcaatttgtccgaaaagaaaacttgctgtcactcgcctgccaacaccagttctgtagatcctgctgggaacagcattgttcagttttggttaaggatggcgtcggtgttggcgtgtcctgtatggcacaggactgccccctgcgcacccccgaggactttgtttttcctctactccctaacgaggagcttcgcgagaagtaccggcgttacctttttcgtgactacgtggagtcacattatcagctgcaactatgtcctggtgcagattgtccaatggtcattcgagtccaggaaccccgagcaagaagggtgcagtgtaacagatgcaacgaggtgttttgttttaagtgcaggcagatgtatcatgccccaactgattgcgccacaatcagaaaatggttaactaaatgtgccgacgactcggagactgctaattatatcagtgcacataccaaagactgtcctaagtgtaacatttgcatcgagaaaaacggcggatgcaatcacatgcagtgcagcaagtgtaaacacgatttctgttggatgtgcttgggggactggaaaacccatggtagtgagtactacgaatgctcacggtacaaggagaatcccgacattgtcaatcagagccagcaagcacaagccagagaagcgctgaaaaaataccttttctattttgagcgctgggaaaaccataataaaagcctgcaactggaggcccaaacataccaacgaattcacgagaagatccaggaacgggtgatgaacaatctgggcacctggatcgactggcagtatttacagaacgccgctaagcttctggccaagtgcaggtacactctgcagtatacatatccatatgcgtattatatggagtctgggcctcggaagaagttattcgagtaccaacaggcgcaactggaggccgaaatcgagaatctgtcatggaaggtcgagcgggctgattcctatgatcgtggtgatttggagaatcaaatgcacattgctgagcaaaggcgtcggacgctgctcaaggactttcatgacacctag

SEQ ID NO: 214827 - DNA, 954 bp, Artificial Sequence
  Description of Artificial Sequence: Synthetic coding sequence
ggaatcaccggggtttcctgcatggctcaagactgccctctgaggacccctgaggatttcgtatttcctcttctgccgaatgaagagctgcgcgagaaatacagacgctacctgtttagggactacgtggaatcacactatcagctgcagttgtgcccaggcgctgattgtcctatggtgattcgggtgcaagagccacgcgcacgcagagttcagtgcaatcgctgcaacgaggtgttctgtttcaagtgtcggcagatgtaccacgctcctacagactgcgccactatcaggaagtggctgacaaagtgtgccgacgacagcgagactgcgaattatattagtgctcacaccaaggattgtcccaaatgcaatatctgtattgaaaagaatgggggttgcaatcacatgcagtgctccaagtgtaagcacgatttctgctggatgtgcttaggtgactggaaaacccatggctccgaatactacgagtgcagtcgttataaggagaacccagacatcgtgaatcagtcacagcaggcccaggcccgtgaagctttgaagaaatacttattttacttcgaacgttgggagaaccataacaagtctcttcagctggaggcgcagacctaccaacgcatccatgagaaaatccaggaacgagtaatgaataatctcgggacttggatcgactggcagtatctacaaaatgctgctaagctgctagcaaagtgccggtatactctgcagtacacttacccctatgcttactatatggagtccgggccacgcaaaaagttgttcgagtaccagcaggctcagctagaggcggaaatcgaaaatctatcatggaaggtcgaacgggcagacagctacgataggggggacctggaaaaccaaatgcacatagctgaacagcggaggcgcactctcctcaaggacttccacgacacatag

SEQ ID NO: 214828 - DNA, 1233 bp, Artificial Sequence
  Description of Artificial Sequence: Synthetic coding sequence
tcggtagacatgaacagtcagggaagtgatagtaatgaagaggactacgaccctaattgtgaggaagaggaggaggaagaggaagatgaccctggcgatattgaagattactacgtgggcgtagcatctgatgtggaacagcagggcgcagatgccttcgatcctgaagagtaccagttcacatgtctgacttacaaagagagcgaaggcgctctgaatgagcacatgacaagtctcgctagcgttttaaaagtaagtcatagcgttgccaagctcatcctcgtgaattttcactggcaggtgagtgaaattcttgaccgctacaaatccaatagcgcccagctgcttgtggaggctcgcgttcagccaaaccctagcaaacatgttccaaccagtcatccaccacaccactgcgctgtctgcatgcagttcgtgagaaaagagaaccttctgtcgctggcctgtcagcaccaattttgtaggtcctgctgggaacagcattgctctgtccttgttaaagacggggtgggagttggtgtgtcttgtatggcacaggactgcccattaaggaccccagaggactttgtttttcctcttctgcccaatgaggagcttcgggagaagtatcgaagatatctttttagggactacgtggagtctcactaccagctgcaactgtgccccggagcagactgccccatggtaattagggtccaggaaccgagagcaagaagagtacaatgtaatcggtgtaatgaagttttctgttttaaatgcaggcagatgtatcacgcacctactgactgcgcaactatacgaaagtggctgacaaagtgtgccgacgactcagaaactgccaattacataagcgcccacaccaaggattgccctaaatgtaacatctgtatcgagaagaatggcggatgcaatcacatgcagtgtagtaaatgtaagcacgatttttgctggatgtgcctaggggactggaagacacacggcagcgagtattacgaatgtagcagatataaggagaaccctgatatcgtcaaccagtcccaacaggcacaggcaagagaggccctgaaaaagtacctgttttatttcgaaaggctagaaaacttgtcgtggaaggtagaaagagcagactcttatgacaggggagacctcgagaatcagatgcacatagcagagcaaagaaggcgcactctgctcaaagatttccatgatacatag

SEQ ID NO: 214829 - DNA, 1482 bp, Artificial Sequence
  Description of Artificial Sequence: Synthetic coding sequence
atgtcagtggatatgaatagtcagggttccgatagcaatgaggaagattacgatccaaactgtgaggaggaagaagaagaggaagaggacgatccaggagatatagaggactactacgtcggtgttgctagcgacgtcgaacagcagggggctgatgcttttgatccagaggaataccaattcacatgtctgacttacaaggaatcggagggggcactcaatgaacacatgacaagtcttgcctccgtcctcaaggtaagtcactcagtcgccaagcttatacttgtaaattttcattggcaggtgtctgaaatcctggaccggtacaagtcaaatagcgcacagctactggttgaggcaagagtgcagcctaatcccagcaagcacgtcccaacctctcatcctcctcaccactgcgccgtttgcatgcaatttgttcgaaaggagaacttgctctccctagcttgccaacaccagttctgcaggtcttgctgggaacagcactgtagtgtattggtgaaagatggggtgggcgtcggcgtttcctgcatggcacaggattgtcctctgcgcacgccagaggactttgtatttccactgcttcccaatgaagaattaagggaaaaatatcggcgatatctttttagagattacgtggagtcacactatcaactgcaactttgcccaggagcagactgcccgatggttatccgggtgcaggaacctcgcgcacggagagtccagtgtaatcgatgtaacgaagtattttgttttaagtgtcggcaaatgtaccacgctcccaccgattgtgctaccatccggaagtggcttaccaagtgcgctgatgattccgagaccgcaaactatattagcgctcatactaaagactgcccgaaatgcaatatctgcattgagaagaacggagggtgtaatcacatgcagtgctccaagtgcaagcatgacttttgctggatgtgcctaggtgactggaagactcacggttctgagtattatgaatgtagtcgttacaaagagaaccctgatattgtaaaccagtcccagcaggctcaggccagggaggcactgaagaagtacctcttctacttcgaaagatgggaaaaccacaacaaaagcttgcagctggaagctcagacctatcagcgaatccacgaaaagatacaggagagggtcatgaacaaccttggaacctggattgactggcagtatctccagaacgcggcaaaattgctggcaaagtgtaggtatactttacagtacacatacccctatgcatattacatggagtccggccctcggaaaaaactttttgagtatcaacaagcccagctggaggccgaaatcgaaaacctttcatggaaggtggagagggcggatagctacgaccggggtgacctggagaatcagatgcacattgccgaacaaaggcggcgtactctactgaaggatttccatgacacatag

SEQ ID NO: 214830 - DNA, 1584 bp, Artificial Sequence
  Description of Artificial Sequence: Synthetic coding sequence
ttgagacgagcggcatcaggcccactcgctccttccctgccccctcctcgacctccaaggcgccatcagcctagcaatgccaaccggagatcctgggggggagcggctgccaggggagcaggggcaagacctgccagtggccatcagccagagccagagcgcgagccgggaccgagaaggccaagacctctgcccgcatccgcctcagtgcgtcgggctcctgcgcgaagggccatggactcagacgaggggtataattatgagttcgtgaatgaagtcattcaaaaccccgctacaatcaccaggatcttactaagccacttcaattgggacaaagaaaagctgatggaacggtacttcgacgggaacctagagaagcttttcgctgagtgtcacgtcatcaacccctctaaaaagtcacggacgcggcagatgaacactagatcttctgcacaggacatgccgtgtcagatctgctaccttaactaccctaattcctattttaccggactcgaatgcggccataaattttgtatgcagtgttggagcgagtatctgacaaccaagataatggaggagggtatgggacaaaccatctcatgccctgcccatgggtgcgatatactggtggatgacaacaccgtgatgcgattgattacagactccaaagtgaaactcaaataccagcacctgattacgaactctttcgtggaatgcaacaggctcttgaaatggtgcccagccccagattgccaccatgtggttaaagtacagtatcccgatgcaaagccagtgcgatgcaagtgtggcagacaattttgcttcaattgtggcgaaaactggcatgatcctgttaaatgcaagtggttaaagaaatggatcaaaaagtgcgatgatgatagcgaaacctctaactggatcgcggctaatacaaaagagtgtccaaaatgtcatgtgacaatcgagaaagatggaggttgtaaccacatggtgtgcagaaaccaaaattgcaaagctgagttctgctgggtctgcctgggtccatgggagcctcacggtagcgcatggtataattgcaaccgatacaacgaggacgatgctaaagctgcccgagatgcacaggaacgatcgagggcagctctgcagcgttacttattttattgcaaccgctatatgaaccatatgcagagcctacgcttcgagcataagctgtatgctcaggtaaagcagaagatggaggaaatgcaacaacacaacatgagttggatcgaagtgcagtttctgaagaaggctgtcgacgtcctatgccagtgccgggctaccctgatgtacacatacgtgtttgctttttacttaaaaaaaaataatcagtctatcatctttgaaaataatcaagcggacctcgagaacgccacggaagtgctgtcaggttacctggagcgagacatctcccaggacagtctgcaagatatcaagcagaaagtccaggataagtacagatattgcgaatcgaggcgcagggttttactgcaacatgtgcatgaagggtatgagaaggatctctgggagtacatcgaggattag

SEQ ID NO: 214831 - DNA, 1674 bp, Artificial Sequence
  Description of Artificial Sequence: Synthetic coding sequence
atggactccgatgagggctacaattatgagtttgacgaggacgaagaatgcagcgaggaggatagcggcgctgaggaagaagaggacgaggacgatgacgagcctgatgatgacacgctggacttgggcgaagtggagttagtagaacctggtctcggcgtgggaggggaacgagatggcttattatgcggggagaccgggggaggcggaggctccgctctcggaccaggaggcggaggaggtggtgggggtggcggtgggggaggcggaccagggcatgagcaggaggaagattaccgttatgaagtgttgacggctgaacagatcctccaacatatggtcgaatgcatccgggaggtcaacgaagttatccagaatccagccaccatcaccagaatccttcttagccattttaattgggacaaagagaaattgatggagcgctatttcgacgggaatctggaaaagctctttgctgagtgccacgtgattaacccatctaaaaagagcagaaccagacagatgaacacacgaagcagcgctcaggatatgccctgtcagatctgctaccttaactatcctaacagttatttcacagggctagaatgcggccacaagttttgtatgcaatgttggagtgagtatttgacaaccaagattatggaagaggggatgggacagacaatctcctgtccagctcatggatgcgatattctcgtggacgataatactgttatgcgcttgatcactgactcaaaggtcaagcttaagtaccagcacctgattaccaactcatttgtggaatgcaaccggctgctcaaatggtgcccagctccagactgccaccacgtggttaaagtgcagtaccctgatgcaaagcccgttaggtgtaaatgtggcagacaattctgtttcaactgcggggaaaactggcatgaccccgtgaaatgcaaatggctgaaaaagtggataaaaaagtgcgacgatgatagcgagacgtcgaactggattgcggcaaatacaaaagagtgtccaaagtgtcacgtgaccattgaaaaggatggcggttgcaaccatatggtgtgcagaaaccagaactgtaaagccgagttctgctgggtgtgtcttggtccatgggagccacacgggtcagcctggtacaactgcaataggtacaacgaggacgacgccaaggcagcgagggacgctcaagaaaggagccgcgctgcgttgcaacgctatctcttctactgtaaccggtacatgaaccacatgcagagtcttaggttcgagcacaagttgtacgcacaagtgaaacagaaaatggaggagatgcagcagcataacatgagctggattgaagttcagtttctgaagaaagcggttgatgtgctgtgtcagtgccgagccacgctcatgtacacatatgtgttcgccttttacctcaagaagaacaatcaatccattatttttgagaataaccaggctgacctggaaaatgccacagaagttctgtcaggatacctggaaagggacatttcacaggatagccttcaggacatcaaacaaaaagtacaggacaagtataggtactgcgagtcccgacgacgggtcctactccagcacgtgcacgaggggtatgagaaagacctctgggagtatatcgaggattag

SEQ ID NO: 214832 - DNA, 1689 bp, Artificial Sequence
  Description of Artificial Sequence: Synthetic coding sequence
atgagcaatcagtatcaagaggagggctgtagcgaaagaccggaatgcaagtccaaaagccctactctgctgtcctcatattgcattgactccatactcggcaggagatccccttgcaagatgagacttctgggcgctgcccaatcgctgccggctcctcttacatctcgcgcagatccagagaaggcagttcagggcagtcccaaatcaagttctgccccttttgaggcagagctgcacttgcctccgaagctcaggaggctctatggacccggaggtggcaggttattacaaggggctgctgcagctgccgctgctgccgcagcagcagcagccgctgccgctacagccactgccggtccgcgtggtgaagctccaccccctccccctcctacggcacggccaggagaacggccagacggagccggtgcggctgcagctgccgcagccgctgcagcggctgcctgggacactctgaagattagtcaggcaccacaggttagcatatccaggagcaaatcatatcgcgagaatggggcaccattcgtaccaccacccccagcccttgatgagcttggcggtcccggaggggtgacccacccagaagagagactcggggtcgccggaggtcccggatccgcacccgctgccggaggcggtaccggcactgaggacgacgaggaagagctactggaggatgaggaggatgaagacgaggaagaggaactgctcgaggacgacgaggaagagctcctggaagatgacgccagagcgctcttaaaggaaccccgacggtgtccagtggccgctactggggcagtagcagcggcagcagctgcagccgttgctacagaaggcggtgagttatcgccaaaagaagagttgttattacaccctgaggacgccgaaggcaaggatggcgaagatagcgtgtgtctttccgcaggcagtgattcagaagagggccttctgaaaagaaagcagcgaaggtaccgcactacgttcacttcttaccaattggaagagttggagcgggcattccagaaaacccactaccccgacgtgttcacccgcgaagaactggctatgaggctcgacctcactgaggccagggtgcaggtgtggtttcaaaacaggagagctaagtggcgcaagagagaaaaggccggtgcgcaaactcatccacctgggctgccttttccaggacccctttccgccacgcatccactgtctccctatctcgacgcgtcgccctttcctccacaccatcccgcacttgactccgcttggaccgctgcggctgctgctgctgctgccgcttttcccagcctacctccgccaccagggtccgctagcctccctccatctggcgctccactgggtcttagtacgttccttggggcagccgttttcaggcatccggcatttatttctcccgcttttggcaggctgtttagtactatggctcctctaaccagtgcaagtactgcggcagcgcttctgcggcagccgacacccgcagtcgagggggcagtcgctagtggcgctctagccgaccccgctaccgctgcggcagacaggcgtgcatcctctatagctgctctaaggctcaaggccaaggagcacgccgctcagctcactcagcttaatatcttgcccggaacctctactgggaaggaggtctgctag

SEQ ID NO: 214833 - DNA, 1032 bp, Artificial Sequence
  Description of Artificial Sequence: Synthetic coding sequence
atgggaggacctcggggagccggttgggtagctgccggactcctgctcggggcaggcgcatgctactgtatctaccggttgacacggggtagaaggcggggtgatagggagctcgggattagatcatccaaatctgctggcgcactagaggagggaacaagtgagggtcagctgtgcggtcgctctgcgagaccgcaaactggaggcacatgggaaagccaatggagtaagacctcccagcccgaggacttaaccgatggttcttatgatgatgtgctaaacgcagaacagttgcaaaaactcctgtacctgctggagtccactgaggaccccgtgattatcgaaagggcccttatcaccctgggcaataatgccgcattctcggtgaatcaagctatcatccgggaactgggtggcatacccatcgtggctaataaaattaaccactccaaccagtcgatcaaggaaaaagctctcaatgccttgaataatttgtcagtgaacgtggagaatcagattaaaattaagatttatatctcccaagtttgcgaagacgtgtttagtgggccactgaactcagccgttcagctcgcgggtctgacactgctgaccaacatgaccgtgaccaacgaccatcagcacatgctccactcctacattacggacttgtttcaggtgttgctgaccgggaatggcaacaccaaggtccaagtgctcaagctgctactgaatttgtccgagaaccccgcaatgacggaggggctccttcgagcccaggtggactcatctttcctgagcctgtatgactcccatgtggctaaggagatcctgcttagggtcctgactttgttccagaacatcaagaactgcctaaaaattgaaggtcatctggcagttcagcctacttttacagaaggctctctgtttttcctcctccacggagaggagtgcgcgcagaaaatccgagctctggtggatcatcacgacgctgaagtcaaggaaaaagtggtcactatcatccccaagatatag

SEQ ID NO: 214834 - DNA, 855 bp, Artificial Sequence
  Description of Artificial Sequence: Synthetic coding sequence
atgggaggaccgagaggagccggatgggtggcagcagggctactcttaggcgcaggcgcttgctattgcatctatcgccttacccgaggcagacgtcggggagatcgcgagctcggcatccggtctagcaagagtgctgaggacctcacagacgggtcctacgacgatgtcttaaatgctgagcagttgcagaagctgctttaccttctggagagcactgaggacccagtgatcattgagcgcgcactgatcaccctcgggaataacgcagccttctctgtgaaccaggccattatcagggaactcggagggattcccatcgtggcgaacaaaatcaaccactccaaccaatctatcaaagaaaaagcccttaatgccttgaacaatctgagcgtgaatgtggaaaaccaaattaagattaagatctacatttcccaggtatgtgaggatgtttttagtggccctctgaattctgcagttcagctggcaggattgacgctgttgactaatatgacggtcactaacgaccatcaacacatgctgcacagttatattacagatctgtttcaagtgctgctaaccggtaacggaaacaccaaagtcgatagcagctttttgtccctatacgatagtcatgttgccaaggaaatactcctgcgagtgttgactctgtttcaaaatatcaaaaactgcctaaaaattgagggacacctcgcagtccagcccacctttaccgaaggctccctgttctttctacttcacggggaagagtgtgctcagaagatccgggctcttgtcgaccaccacgacgcagaggtcaaagagaaggttgtcacaattattccgaaaatttag

SEQ ID NO: 214835 - DNA, 855 bp, Artificial Sequence
  Description of Artificial Sequence: Synthetic coding sequence
atggggggacctagaggggcaggatgggtggctgccggtctcctcctgggcgcaggggcttgctactgtatctacagacttaccaggggcaggcggagaggcgaccgggagttgggcatccgctcctccaaatccgcaggggctctggaggaggggacatctgagggtcaattatgcggacgtagcgctaggccacagactggtggcacatgggaatctcaatggtcaaagacaagccagccagaagacttaaccgatggaagctatgacgatgtcttgaacgcagaacagctgcagaagctgttatacctgctggaaagcactgaggatcccgtcatcattgagagggctctgattacgctaggaaacaacgccgcttttagcgtgaaccaggccatcatccgcgagctcggcggtattcctattgtcgccaataagatcaaccattcaaatcagtcaataaaagaaaaggcattgaatgctctcaataacctctccgtgaatgtggagaatcaaataaagatcaaagttcaggtcctgaaactccttctgaacctttctgagaatccagctatgactgaggggctcctgcgggcacaggtggactctagctttctctctttgtacgactcccacgtagcgaaggagatcctcctgcgtgttcttacactctttcagaatattaaaaactgtctcaaaatagaaggccacctggctgtgcagccaaccttcaccgagggctctctcttttttctgttacatggcgaagagtgcgcccaaaagatccgtgccctcgtggaccaccacgatgccgaagtcaaggagaaagttgtcacaattattcctaagatctag

SEQ ID NO: 214836 - DNA, 927 bp, Artificial Sequence
  Description of Artificial Sequence: Synthetic coding sequence
atggggggtcccagaggcgcaggatgggtggcagccggtctgctgttgggtgccggagcttgttactgcatatatcgcttgacccgtggacgcaggcgaggagatcgagaactcggtatccgcagctcaaagtctgccgaagacctgacagatggaagctatgatgacgtgctcaatgccgaacagcttcagaagcttctgtacctcctggagagcacggaggatcccgtaatcattgagagggcccttatcacacttggaaataatgctgcctttagcgtcaatcaggctattatcagggagctgggaggtattccgattgtagccaacaagattaaccattctaaccagagcattaaagaaaaggccctcaatgctctcaataatctctctgtcaatgtcgagaatcaaataaaaataaaaatatacatctcccaggtatgtgaagacgtattttcggggccactcaatagcgccgtgcaacttgctggccttacattgttgactaatatgacagtcactaatgatcatcaacacatgctgcactcttatattacagatttatttcaggtcctgttgactggcaatgggaacacgaaagttcaggtccttaaactcctcttaaacctgagtgagaacccagcgatgaccgaaggtctactacgagcgcaggtagatagctccttcctttccttatacgacagccatgtcgcgaaagagatcctgctccgcgttctgacgttgttccagaatatcaaaaattgtctgaagatagaaggacacctggctgtccaaccgacgttcactgagggctcactgtttttcctgctacatggcgaagaatgtgcccagaaaattcgcgctcttgtagatcatcatgacgctgaggtgaaagagaaggtggtgaccatcattcctaaaatttag

SEQ ID NO: 214837 - DNA, 750 bp, Artificial Sequence
  Description of Artificial Sequence: Synthetic coding sequence
atgggtggacctcggggagcagggtgggtggccgcaggcctgctcctcggcgcaggcgcatgttactgcatctatcggttgacacgagggaggaggcgaggcgacagagagctgggcattagatcaagcaaatccgccgaggacctaacggacgggtcttatgatgatgttttgaacgcggagcagctacagaaactgctctatttactagaatcaactgaggaccctgtcataattgaacgcgctcttatcaccctgggcaacaacgccgctttctccgtgaatcaggccatcattcgggaactgggaggcataccaatagtagccaataagataaatcattcgaaccagagcattaaggaaaaagccctgaatgcgctcaacaatctttcggtaaacgtagaaaaccagattaaaattaaagttcaggtactgaagctgcttctgaacctatccgagaaccccgcaatgaccgaggggctgcttcgagcccaggtcgacagctcctttctcagcctatacgatagccacgtcgctaaggaaattctccttagggtgttgaccctgtttcagaatataaagaattgtctcaagatcgagggacacttggccgtgcagcccacgttcaccgaagggtctctattttttctcttacacggcgaggaatgcgcgcaaaaaatcagagctctcgttgatcatcacgacgccgaagtgaaagaaaaagtcgtcacaatcatccctaaaatctag

SEQ ID NO: 214838 - DNA, 678 bp, Artificial Sequence
  Description of Artificial Sequence: Synthetic coding sequence
atgggcggacctagaggtgcaggctgggtggccgcaggtctcctgctgggagccggagcctgctattgtatttaccgactgacaagaggaaggcgtagaggcgatagagagctcggcattaggagcagcaaatctgcagaggatctgacggatgggtcctatgacgacgtgctgaatgccgaacagctccagaaattgctgtatctcttggagagtactgaggaccccgtgatcatcgagcgagccctgatcactttgggcaacaatgccgctttctctgtgaaccaggctatcatccgggaacttggaggcatccccatcgttgcaaacaaaataaatcatagtaaccagtccatcaaagaaaaagccctgaatgctctcaacaacttgtccgtaaatgtggagaatcagataaagattaaggtggactcctcttttttgtccctatatgactctcatgtcgctaaagaaattctcttacgagttctgaccttgtttcagaatattaaaaactgtctaaaaattgagggacacctggccgtgcagccaacattcactgagggctcgcttttttttctgctccatggggaggagtgtgcacaaaagatcagggccctcgtagaccatcacgatgccgaagttaaggaaaaagtggttacaatcatcccaaaaatctag

SEQ ID NO: 214839 - DNA, 1362 bp, Artificial Sequence
  Description of Artificial Sequence: Synthetic coding sequence
atgggaagaacaagggaagcgggttgcgtagcagctggggtcgtgatcggagccggagcatgttattgtgtgtatcggctggcttggggacgcgacgagaacgaaaagatctgggacgaagacgaggagtcaactgatacgtccgaaattggtgtggagaccgttaaaggcgctaagacaaatgcaggtgccggaagcggcgcaaagttacagggcgattccgaagtgaaacccgaggtaagtctggggctagaggattgccctggtgtgaaggaaaaggcacattctggaagccattcaggcggaggcttggaggcaaaagctaaggccttgtttaacacccttaaggagcaagcctccgcaaaggctggaaagggggctcgagtaggcaccatctccggcaatagaaccttagcaccatcgctgccatgccccggaggtagaggcggaggctgccacccgactcgcagtggctccagggccggaggcagagccagcggaaaaagtaaggggaaggccagatcgaagtctactcgcgctcccgcaaccacctggcccgttcggcgaggcaagtttaacttcccatacaagatagacgatattctgtctgccccagatctgcagaaggtacttaatatcctggaacggaccaatgaccctttcattcaagaagtcgcgctggtgacgctggggaacaatgccgcatactccttcaaccaaaacgcgatccgcgaactcggaggggtccctatcatagcgaagctgattaaaacaaaagatccaatcattagagagaagacatacaatgccctgaacaatttgagcgtgaatgccgagaatcaggggaaaataaaaacatatattagccaggtgtgcgatgacacaatggtgtgtaggttggatagcgccgttcagatggccggactgcggttgctcaccaacatgaccgtgacaaaccactaccaacatttgctgagctactctttccccgatttcttcgccttacttttcctgggtaaccacttcaccaagattcagataatgaaactgataattaatttcaccgaaaatccagctatgacaagggaattggtgtcatgcaaggtgcctagcgaattgatttctctcttcaacaaagagtgggacagagagatcttgctgaacatcctgaccctgttcgagaacattaatgataacatcaaaaatgagggattggcttctagtaggaaggagtttagtaggagctcactctttttcttattcaaggagtccggcgtgtgcgtgaagaagattaaagcactggccaaccataacgacctggtcgtgaaagtgaaggtgttaaaggtactcaccaagctgtag

SEQ ID NO: 214840 - DNA, 477 bp, Artificial Sequence
  Description of Artificial Sequence: Synthetic coding sequence
atggtttgtcgcttagatagcgccgtacagatggccggtctgcggttgctcaccaacatgactgtgacaaaccactaccagcatttactgtcttactccttcccagatttcttcgcactgctctttctaggcaatcacttcacaaaaatccagataatgaagctcatcataaacttcacagagaacccggctatgacacgtgaactcgtgagctgcaaagtaccctctgaactaatctctttgtttaataaagagtgggatcgtgaaatcctgctcaacatcttgaccctattcgagaatattaacgataatattaaaaatgaagggctggcctctagtcgtaaagaattttcaaggtcttcactgttcttcttgtttaaagagagtggagtctgtgttaagaagataaaggcgcttgctaaccacaatgacctggtggttaaggtgaaggtgctgaaagtgctcaccaaactgtag

SEQ ID NO: 214841 - DNA, 1899 bp, Artificial Sequence
  Description of Artificial Sequence: Synthetic coding sequence
atgtcaagagttagggacgcgggatgtgtggctgcaggaatcgtaatcggggcaggggcttggtactgcgtgtacaagtatacccgagggcgagaccaaacaaagaagagaatggctaagccgaagaatagagcagtcgctggcaccggagcacgcgctagggccggtctcagagctggatttactattgatctgggcagtggcttttcacctccgacacctgtgcgcgctgaagccgaggaccgcgcacaggatgaggcttctgccctagatacggtcggcgctgaggccgttgctcccgcagccagtagcgcggaggcccagtctggagccggaagccaggcccaggaggccgatggcgcaggcgtcggacctaaagcggaatcggttgtcggtgcggctatggcctctgccatagcgcctcccccaggcgtgacagaagccctaggggcagccgaggctcccgctatggcaggtgctcccaaggtggccgaagctccacgggaggcggagacaagtagggccgcagtcccacccggaaccgtcgtgccaacagaggccgctgcaccgaccgaagtcacagagggacccggtgtggctgcacctacgaaagtggcagaggcacctggtgtagctagcccaaccgaagcggcagaggctcccgttcccgctacaccgacgggtgctgcggcacctacaggggctgccgaaagccctggcactagcgggtcacccagaacagctgtggtgcctggcacatcagcggctaagaaagcgacccccggtgcacacacaggcgcaattccgaaggctacctcggccaccggtgccgttccaaaggggggaggcaaaggagtgacccggagcaggaatgggggaaaaggaaaggggaagaaatccaaggtggaagttgacgaattgggtatgggttttcgccctggggacggggcagcagctgctgcggcagcgtctgcaaatgggggacaagccttcttggctgaagtaccggatagtgaggagggagaatccggatggaccgacacagagagcgattctgattctgaacccgaaacacagcgcagggggagagggaggcggccagtagccatgcagaagcggccattcccttatgagatcgacgagatcctcggggtgagggatctgcggaaggtcctggcacttcttcagaagtctgacgacccctttattcagcaagtcgctcttctgacactaagtaataacgcaaactactcgtgcaatcaggaaacgatacggaaactcgggggactgcctattattgccaatatgattaataagactgatcctcatattaaagagaaggcccttatggccatgaataacctgagcgaaaactatgagaaccagggcagactccaggtttatatgaacaaagttatggatgatattatggcctccaatctaaactcagcggtccaggtggttgggttgaaatttctgactaacatgaccataactaacgactatcagcacctgctggttaactcaatcgctaacttcttcaggctgctttcgcaggggggagggaagattaaggtagagattctgaagatcctgtcaaatttcgccgagaaccctgatatgctgaaaaagttactttctactcaggtccccgcttcgttttcgtctctctacaattcttatgtggagagcgaaattctgatcaacgccctcacactgttcgagatcatttacgacaatctaagagctgaggtgttcaactatcgcgagttcaacaaagggagcctgttctatctgtgtaccacctccggggtgtgcgtgaaaaaaatcagggctctagccaatcatcacgacctgttggtgaaagtgaaagtgatcaagctggtgaacaagttttag

SEQ ID NO: 214842 - DNA, 1899 bp, Artificial Sequence
  Description of Artificial Sequence: Synthetic coding sequence
atgagccgcgtaagagacgccggatgtgttgcagctgggatcgtaatcggggcaggtgcatggtattgtgtctataagtatacccgcggacgcgatcagactaagaagagaatggctaagcctaagaatcgcgctgtagcaggaactggggcacgcgctagagccggactgagggctggatttacgatcgacttgggctccgggttttctccacctacgccggtcagagccgaggcagaggaccgggctcaggatgaagcatccgcactggacaccgttggcgctgaggccgtggctcccgctgccagctccgccgaggcccagtctggcgcaggcagccaagcccaggaggctgatggagctggggtggggcctaaagcagaaagtgttgtgggagccgcaatggcttctgcaatcgcccctccccctggtgtgaccgaagcacttggtgcagctgaggccccagctatggctggggctcccaaggtggcggaggcccctcgggaagccgagacatcaagagcagccgtgccccctggcactgtcgtacctaccgaggcggctgctcccaccgaagtgaccgagggaccgggagttgcagccccaacaaaagtggcagaagctcccggagtcgcatctccaaccgaggcggctgaagctccagttccagcaacacctacaggagctgcagcaccaacaggtgctgctgagagcccagggacatcaggatcccctagaacagcggtggtgccagggacatctgccgcaaagaaagcgacccctggggcacacacgggtgccatcccaaaagcaacctccgcaactggagccgtgcccaaaggtgggggtaagggggttactaggtctcggaacggcggtaaaggcaagggcaaaaaatctaaggttgaggtggacgaattgggcatgggatttaggccaggcgatggcgctgccgcagctgccgctgcctccgctaatggcggacaggcatttctggcagaggtaccagattcagaagagggggagtctggctggacggacactgaatctgactcggactccgagccagaaacacagcgtcgcggaaggggtcgcagacctgtggccatgcagaagcgccctttcccctacgaaatcgacgaaatcttgggcgttagggacctgcgcaaggtcctggccctgttgcagaagtcggacgaccccttcattcagcaggtagccttgcttaccctttcaaataatgcaaactacagctgtaatcaagagaccattagaaagctaggaggcttacccataattgccaatatgattaataaaactgatccacatattaaagaaaaggccctgatggcgatgaacaacctgtctgaaaactacgagaatcagggccgtctccaagtctatatgaacaaagtgatggacgatataatggcctcgaatctcaacagtgccgtccaagtggttggcctgaagttcctgacaaacatgaccatcactaacgattaccagcatctgctcgtgaacagcattgcgaactttttccggctgctgtctcaaggagggggtaagatcaaggtggagattctcaagatcctttccaacttcgcagagaacccagacatgctgaagaaacttttgagtacgcaggtgccagctagcttttcctcactgtacaatagttacgtggagtccgagatattaattaatgccctcactctttttgagatcatctacgataatttacgggctgaagtcttcaattaccgcgagtttaacaaaggaagcctgttctatctttgtacaactagcggtgtatgcgtgaaaaagatccgggcacttgcgaatcatcacgacttgctggttaaggttaaggtaattaaactggtgaataaattttag

SEQ ID NO: 214843 - DNA, 1899 bp, Artificial Sequence
  Description of Artificial Sequence: Synthetic coding sequence
atgagccgggtgagggacgccggatgtgtggccgcaggcatagtcattggcgctggtgcgtggtactgcgtgtataagtatactcggggacgggaccagacgaaaaaacgtatggctaaaccgaagaacagggccgtagccggaaccggagctagggccagagccggtctccgcgcaggctttacaatagatctcggcagtggtttcagtcctccaacacccgtaagagccgaggccgaggatcgtgcccaggacgaggcatccgccctagataccgtaggcgctgaggcagtcgccccagccgcaagttctgcagaagcacagtctggagcaggatcacaagctcaggaagctgacggcgcaggcgtgggccctaaagcggaatccgtggttggggctgccatggcttctgctattgctcctccccctggggtaacagaggccctgggtgccgcagaggcaccagccatggctggcgcaccaaaagtggccgaggcacctagagaggcagagaccagcagggccgcagtgcctcctggaacggtcgttccaaccgaagcagccgctcccactgaggttaccgagggacctggtgtagccgctcctacaaaagttgccgaagcaccaggtgtggcctcccctaccgaggccgcagaggccccagtgcctgcgactcccaccggagccgctgcccctactggcgcagcagaatcacctgggacctccgggtctcccagaaccgcagttgtgcctggaacctccgctgcaaagaaggcaaccccgggagcacacactggggctattcccaaagctaccagcgctacgggagcagtaccgaaagggggaggaaaaggggtcacccgctctaggaatgggggaaaagggaaaggcaaaaagtctaaagtcgaagtggacgagcttgggatgggctttaggcccggagacggggctgccgctgccgcagccgctagcgctaacggtgggcaagcttttctcgctgaagtgccggatagcgaggagggagaatctgggtggactgacaccgaatctgactccgactcagagcccgagacccagcggagaggtagaggtagacgtcccgttgcgatgcagaaacgtccttttccctacgaaattgacgagattctcggcgtgagggacttgcggaaggtgctggccctgttgcaaaaatccgacgatccattcatccagcaagttgctcttctgactcttagtaataatgctaattactcatgtaaccaggaaacaattcggaaactggggggtctacctattatcgcaaacatgattaacaaaacagaccctcatatcaaagagaaggccctcatggccatgaataacttaagtgaaaactacgaaaaccaaggtcgcttgcaggtctatatgaataaggtgatggatgatatcatggccagtaacctgaatagtgctgtgcaggtcgtgggtctgaagtttcttacaaatatgaccataacaaatgattaccaacatctcctcgttaatagcatcgcgaatttctttcggttactttcacaggggggaggaaaaatcaaggtggagatcttaaaaatcctgtccaacttcgccgagaacccggatatgcttaaaaagcttttatcaacccaggtgcccgctagcttctcatccctgtacaactcctatgtggaatccgaaatactaattaacgcactaacgctgttcgagataatatatgacaaccttcgggcagaggtttttaattatcgcgagttcaataaaggctcactcttctacctttgtaccacctctggcgtctgtgtaaagaagatccgagccctggcgaaccatcatgatctattggtgaaggtgaaggtcatcaagctggtcaataagttctag

SEQ ID NO: 214844 - DNA, 504 bp, Artificial Sequence
  Description of Artificial Sequence: Synthetic coding sequence
atgtcccgggtcagggatgccggttgtgtggcagcaggcattgtgatcggcgctggggcatggtactgcgtttacaaatacacacgcggaagggaccagaccaaaaagcgtatggctaaacccaagaacagggctgtcgccggaaccggagcgagagctcgggcaggactgcgagcaggtttcacaatcgatcttgggtcggggttttcaccacccacaccggtcagggctgaagctgaggaccgtgcccaagacgaggcatccgctctcgatacagtcggggctgaagccgtggctccagccgcttctagcgcagaggcccagtcaggagccggatcccaagctcaggaggcagatggtgcgggtgtgggcccaaaggctgagtcagtggtcggcgcagcaatggcctcagctattgccccacccccaggcgtgaccgaggctctgggcgctgctgaggcccctgcaatggccggtgcacctaaggtggccgaggcgccatag

SEQ ID NO: 214845 - DNA, 189 bp, Artificial Sequence
  Description of Artificial Sequence: Synthetic coding sequence
atgtctcgcgtcagggatgccggatgcgtcgccgctggcatagtaatcggcgctggagcgtggtattgcgtgtataaatacactagaggtcgagaccagacaaagaagcgtatggccaagcccaaaaaccgcgctgtcgcaggcacaggagccagagctcgcgcaggacttcgcgcagggttcacgtag

SEQ ID NO: 214846 - DNA, 498 bp, Artificial Sequence
  Description of Artificial Sequence: Synthetic coding sequence
atgagtagggttcgagatgccggatgcgttgcggcaggtatcgttattggcgcaggcgcttggtactgcgtgtacaagtatacccgtgggagggatcagaccaaaaagcggatggctaagcccaagaatcgtgccgtggccggaacaggtgcgcgtgctagggccggactaagggcagggttcactatagacctaggtagcgggtttagcccccctacgcccgtcagggctgaggcggaagatcgggctcaggacgaagcctctgccctggatacagtcggggctgaggctgtagcgccagcagcttcgtctgcagaagcccaatcgggagctggatcacaggcacaggaggccgatggtgccggagttggaccaaaagccgaaagcgtggtgggcgcagctatggcttcagccattgcccctcctccaggtgtgactgaggcgttgggcgctgcagaggcccctgcgatggccggagccccaaaggtcgcagaatag

SEQ ID NO: 214847 - DNA, 318 bp, Artificial Sequence
  Description of Artificial Sequence: Synthetic coding sequence
atgtctcgcgtgagagatgccggatgtgtagccgctggaattgtgatcggcgcaggcgcatggtattgtgtgtataaatacactcggggtcgagaccagactaagaagcggatggccaagccaaagaaccgcgcagtcgcagggacaggcgcacgggctcgggcaggattgagagccggattcaccatcgatctgggatcaggcttctcaccaccgacacctgtgcgcgcagaagctgaggaccgtgcacaggacgaagcatccgctctcgacactgttggtgcagaggccgtggccccagccgcatcctcagcatag

SEQ ID NO: 214848 - DNA, 282 bp, Artificial Sequence
  Description of Artificial Sequence: Synthetic coding sequence
atgagtcgcgtccgcgacgccggatgcgttgctgccggaatcgtgatcggggctggggcttggtactgcgtctacaagtacacccgcggaagagatcaaacgaagaaaaggatggcaaaaccaaaaaatcgcgcagtagcaggcactggggctcgtgcccgtgctggccttcgcgcaggatttactatcgacctcgggagcggtttttcccctcccacaccagtcagggcggaagcggaggaccgagcccaggacgaggcaagtgctttggacactgtgtag

SEQ ID NO: 214849 - DNA, 1140 bp, Artificial Sequence
  Description of Artificial Sequence: Synthetic coding sequence
atggggtatgccaggaaggtcggctgggtgacagcgggtttggttatcggagccggagcctgttactgcatctaccgacttactaggggaagaaagcagaataaagaaaagatggcagagggtggcagtggtgatgtggacgatgctggtgactgttccggggcaagatataacgactggagcgatgacgacgacgacagcaacgagtccaaatctattgtgtggtaccccccttgggcacgcatcggtacagaggccggaacccgggctagagccagagcaagggccagggccacacgggctcgacgtgcggtgcagaagcgggcatctcctaatagcgatgatactgtcctctcaccacaggaattgcagaaagtgctgtgtcttgtggagatgagtgaaaaaccttatatccttgaggccgctctcattgctctgggcaacaatgcggcatatgctttcaatcgggacattatcagggatctcgggggtctgcctatagttgctaagattttgaatacgcgcgaccccatcgtgaaggagaaggcacttatcgtgctgaacaaccttagtgttaatgccgaaaaccagcggaggctcaaggtatatatgaatcaagtgtgtgacgatacgatcacctcccggttgaactcctctgtgcagctggcgggtctgcgcctgcttactaatatgactgtgacaaatgagtaccagcacatgctggcaaattccatctccgatttttttagacttttcagcgcaggaaatgaggagactaaactgcaagtgttgaaactgctcctcaatctagccgagaacccggctatgacaagggagttgctgcgggcacaagttcctagctccttggggagtctgttcaataaaaaggagaataaagaggttatcctgaagctgcttgtaattttcgagaatatcaacgataacttcaagtgggaggagaacgagccaacccaaaaccagtttggcgagggcagcctattctttttcctgaaagagttccaagtgtgcgccgacaaagtcctagggatcgagtcccatcacgatttcctggtgaaagtgaaagtaggtaagttcatggccaagctggcagaacatatgttcccaaagagtcaggaatag

SEQ ID NO: 214850 - DNA, 1140 bp, Artificial Sequence
  Description of Artificial Sequence: Synthetic coding sequence
atgggatacgctcgtaaagtcggatgggtgaccgctggccttgtaatcggagctggggcatgttactgtatttatcgactgacgagaggccgtaaacaaaacaaggaaaaaatggctgaagggggatctggcgacgtcgatgatgccggagactgtagcggggctagatataatgactggtccgatgatgacgacgactctaacgagagtaaaagtatcgtgtggtaccccccttgggccaggatcgggacggaagctggaactagagctagagctcgggcaagggccagggccactagagcacgcagagctgtgcagaagagggcttctccgaactctgatgacaccgtgctcagcccccaagagcttcagaaagtcctgtgcctggttgaaatgtcagaaaagccatatatcctggaggccgcactaattgctctgggcaacaacgcagcttacgcgttcaaccgagatataatacgcgacctggggggtctccctatcgtggctaagattttgaacaccagggatcccatagtgaaagagaaagccctgatcgtcttaaacaatctgtcagtaaatgctgagaatcaaaggcgcctaaaagtatacatgaatcaggtgtgcgacgacacgattactagccgattgaacagctccgtccagttagccggtctgcggcttttgacaaacatgaccgttaccaatgagtatcagcatatgctggccaatagcatttccgatttcttcagactgttttctgccggaaatgaggagacaaaattgcaggtcctcaagcttctactaaacctcgcggagaaccccgctatgacaagggaacttctgagagcacaggtgccatcctccctcggaagtttgttcaataagaaggaaaacaaggaagttatcctgaagttacttgtcattttcgagaacataaacgacaacttcaaatgggaagaaaatgaacccactcaaaaccagtttggcgaagggagtctcttctttttcctcaaggaatttcaagtgtgcgccgacaaggtcctaggtatcgagagtcaccatgattttctggtgaaggtcaaagtgggaaagttcatggcaaagctggcagaacatatgtttccaaagagccaggagtag

SEQ ID NO: 214851 - DNA, 2889 bp, Artificial Sequence
  Description of Artificial Sequence: Synthetic coding sequence
atggaggattgcaacgtgcacagcgccgcttccatcctcgcttctgtgaaggagcaggaggctcgatttgagaggctgacaagagccctggagcaggaaaggcggcacgtcgccctgcaactggagcgtgcacaacaacctggcatggtgtctggaggaatgggatccggacagcctcttcccatggcatggcagcagctggtgctgcaggagcagtctccaggatcccaggctagcttagccaccatgcccgaagcgccagacgtgctggaagagaccgttaccgttgaggaggatccagggaccccaacaagtcacgtatctatcgtgacttccgaggacggcaccacaaggcgcactgagacgaaagtcaccaaaacagtaaaaacggtcaccacccggaccgtccgccaagtgcccgttggacctgacggtctccccctacttgatggaggtccccctttaggacccttcgcggatggagctttggatcgtcattttctgcttagaggcggagggcctgtagccacactttcacgggcttacttaagttcaggagggggtttccctgagggacctgagcctagagacagtccctcttacggttcactcagtcgcggactgggcatgcgcccacctcgcgctgggccattgggccctgggcctggcgacggatgctttaccctcccaggccacagggaagccttcccagtgggcccagagcccggacctcccggtggacgttccctgccagaacgatttcaggccgaaccttatgggttggaggatgatactcggagcttggccgcagacgacgagggagggccagaactggagcccgactatggaaccgcgacgagacggcgaccagagtgcgggaggggcctacacaccagggcttacgaagacacagccgacgatggcggagagctcgcagatgagcgccctgcatttccaatggtgacagccccacttgcacaacctgagaggggctctatggggagcctggatcggctggtcagaagaagccctagcgttgactcggcacgaaaagagcctagatggcgggatcccgagcttcctgaggtgctggcaatgttacgccatcccgtggatcccgtgaaggccaatgcagccgcttatctgcagcatctttgtttcgagaatgagggcgtcaaaaggagggtccggcagttacgaggattgccactgctcgtcgcattattggatcaccctagagccgaagtgcgaaggagggcatgtggcgctctacgaaatttgagctacggcagagacacagacaataaggccgctataagggactgcgggggagtcccggcactggtgcggctgctgagggccgctagggacaatgaggtccgcgaactggtgacaggcaccctgtggaacttgagctcgtacgagccattgaaaatggtgatcattgaccacgggctccagacgcttactcacgaagtaatcgtgccccattccgggtgggaaagggagccaaatgaggatagcaagccccgtgatgcagagtggaccaccgtgtttaagaacacgtcaggatgtcttcgaaatgtgagctcagacggcgctgaagcaaggcggaggcttcgggaatgtgagggcctggtggatgccctgctgcacgccctgcagtctgccgtaggaagaaaggatactgataataagtccgtggaaaactgcgtgtgcattatgcgaaatctctcctatcatgttcataaagaagtccccggtgctgatcggtaccaggaagccgagcctgggccactgggtagcgctgtcgggagtcagagaaggagaagagatgatgcgtcctgtttcggcggtaaaaaggcaaaagaggagtggtttcaccagggtaagaaggatggggagatggataggaattttgataccctggatctccccaaaaggaccgaagcagcaaaagggttcgagctgctgtaccagccggaagtagtgaggctttacctgagtctgctaaccgagagtcgcaattttaacactttggaagctgccgctggtgcccttcaaaatctctcagctggcaactggatgtgggccacttacattcgagcgacagtcaggaaggagcggggtttgccagtgctcgttgaacttctgcaatccgagacagataaagtcgtaagagcggtggccatcgccttgcgaaatctatcattagaccgcaggaataaggacctcatcggtagctatgccatggctgagctcgtgaggaatgtgcgcaacgcccaggcaccacctcgaccgggagcatgtctcgaggaggacactgttgtggccgttcttaatactattcatgagatcgtcagcgatagcctggataacgctcggtccctgctgcaggctagaggtgtgccggctctggtggcactggtcgctagtagccagtctgtgagggaagcaaaagcagcctcccatgtgttacagaccgtttggagctacaaagaactgcgcggaactctccagaaggatggatggaccaaggcgagattccaatccgcagcagccactgctaaggggccaaaaggcgcactgtcgccaggcggtttcgatgacagcactctcccactcgtggacaaaagcctcgagggagaaaagacagggtctcgggacgtgatcccaatggatgctttgggcccagatgggtactccactgtcgaccgcagggagagacggcctcgcggagcatcctctgctggagaagccagcgaaaaggaacccctgaagctcgatcccagtcggaaagcgcctcccccagggccttcaagaccagcagtccgtctggtggatgccgtaggtgatgcaaaaccgcagcctgtggatagctgggtgtag

SEQ ID NO: 214852 - DNA, 2700 bp, Artificial Sequence
  Description of Artificial Sequence: Synthetic coding sequence
atgcctgctgagctcagacaagaacagtctcctggctctcaggcctcactcgcaactatgcctgaggccccagacgtgctggaggagactgtgacagtggaagaagatccaggtacaccaaccagccacgtgagtattgtaacaagtgaagacgggacaacaagacgtaccgagacgaaggtgaccaaaaccgtgaaaacagtgactacaagaacagtgaggcaggttccagtcgggcctgatggtttgccactgctggacggcggtccccctcttgggccattcgccgatggcgcattggatagacatttcctactgcggggtggcggacctgtagccacgttgtcccgggcttacttaagtagtggcggtggcttccctgagggcccagaacccagagattcaccgtcctatggaagcctgagtagaggacttgggatgcgcccacccagagcaggccctctggggccaggacccggtgacgggtgcttcacacttccaggccatcgagaggctttcccagtggggcctgagcccggaccacctggcggacggtcattacccgagcgatttcaggccgagccttatgggctggaggacgatacacgttcattggccgctgacgatgaaggcggaccagagctggaacccgactacggcaccgctacacgcaggcgacctgaatgcggcagagggttgcacactagagcctatgaggatactgcagatgacgggggagagctagcagacgagcgccctgcttttcccatggtaacagctccactggctcagccagaacgaggctccatgggcagcctcgacagactggtgcgccgttccccaagcgttgactctgcaaggaaagaacctcgctggagggaccctgagttgcccgaggtacttgccatgcttcgccatccagtggatccagtcaaagccaatgccgcagcttatctccagcatctgtgtttcgagaacgagggcgtgaagaggcgcgtccggcagttacgtggtctacccctgctggtggctttgctggatcatcctagggccgaagtgcgccgtcgcgcatgcggagccctgaggaacctcagttacgggagagacaccgacaataaagctgccataagagactgcggtggggtgccagccctggtgcggctgctccgggcagctcgcgataacgaagtgcgtgagctcgtcactgggacactctggaatctttccagctacgagccactgaagatggtcatcatagatcatgggttgcaaaccttaacccatgaggtgatagttccccattctggttgggagcgcgaaccaaacgaagattcaaaaccaagggatgctgagtggacaactgtgtttaaaaacacaagcggctgtttgaggaacgtgagctcagatggggctgaagcacgaaggcggcttcgggagtgcgagggcctggtcgacgcattactgcacgcgctgcaatccgctgtaggacggaaagacactgataacaaaagcgtagagaactgtgtctgtattatgcggaacttgagctaccacgttcacaaagaagtgccaggagccgatagatatcaggaggcagagcctgggcctctggggagcgctgtgggatctcagcgaaggcggagagatgacgcatcctgcttcggaggcaagaaggctaaggaggagtggtttcaccagggaaaaaaagacggggagatggatcggaattttgacaccctggatttgcctaaacggacagaagccgcaaagggttttgagctgctatatcaaccagaggtcgtcaggttgtatctgtcgcttctaaccgaaagcaggaattttaacacactggaagctgcagcgggtgcattgcagaacctctccgccggaaactggatgtgggcaacgtatatacgtgcgaccgtccgtaaagagcggggtctgcctgtcttggtggagttactacagtccgaaaccgacaaagtagttcgggctgtggccatcgcgttacgaaacctgagcctggacagacgcaacaaggacctgatcggcagttatgccatggctgagctcgtccggaatgttagaaacgcgcaggctcccccacgcccaggagcttgtctggaggaggacaccgttgtggcggtgcttaatacaatccacgaaatagtgagcgatagtcttgacaatgctcggtcactcttgcaggccagaggggtcccagctctggtggcacttgtcgcgtcatcacagagtgtccgcgaagcgaaagccgcttcccatgtcctccaaacagtttggagctataaggagcttagaggcaccctccaaaaagatggttggacgaaggcaagatttcagtcagccgctgcaacggccaaggggcctaagggcgctcttagccccggaggatttgatgacagtaccctgcccctggtcgacaagagtcttgagggggaaaaaactgggtcccgggacgtgatccccatggatgcccttggtcctgacggatattcaacagtggaccgtagagaacggaggccacgtggggcttcctccgccggtgaagcttcagagaaggaacccctcaagctggatccatcccggaaggctccacctcccggtccgagccggccagctgtgcggctggtggacgctgtcggagatgcaaagccacagccagtggactcgtgggtctag

SEQ ID NO: 214853 - DNA, 2700 bp, Artificial Sequence
  Description of Artificial Sequence: Synthetic coding sequence
atgcctgctgagctgaggcaggaacagtctcctgggagccaggcaagcctggctaccatgcctgaagcaccagacgtcttggaggagacagtgactgttgaggaagatcccggtaccccgacatcacatgtgtcaatcgttacttcagaggatggtacgacaagacggactgagaccaaggtaaccaagactgtcaagactgttaccacaaggacggtgcggcaggttcctgtgggacccgatggcctacctctgctggacggaggcccacccttgggcccatttgcagacggagccctggaccggcattttctgctgagagggggtgggccagttgctacgctcagtagggcttatcttagctcagggggaggctttcccgaaggcccagagcctcgggatagcccaagctacggatccctgtctaggggcctggggatgcgtccgccaagagctggacccctgggtccgggtcctggagacggctgttttacactgccaggtcatagggaagccttccctgtcggcccagaacctggccctccaggcggacgctctctgcctgagcggtttcaagcagagccgtatgggctggaggacgatactcgcagcctggctgcagacgacgaagggggtccggaactggagccagactatgggactgctaccagaagacgccctgaatgtggaagaggcttacacacccgggcatacgaggacacggctgacgacggtggcgaacttgccgatgaacggcctgctttcccaatggtgaccgcaccactcgcccagccagagcggggttctatgggatctcttgaccgactggtgcggcgaagtccttccgtggatagtgcgagaaaagagccacgctggcgcgatccggaactgccggaggtgctcgcgatgctccgacatcctgtggatccagtcaaagcaaacgccgctgcctacctgcagcatctttgcttcgagaatgaaggagtgaagcgccgtgttagacagttgcgaggtcttcccctgctggtggctttgctcgatcatcccagagccgaagtgagacgcagagcctgtggcgcactaaggaacctttcctacggtcgggacaccgacaataaagcggcaatcagggactgcgggggagtgcccgctttagtaaggctgctgagggctgccagggacaatgaggtgagggagctggtgaccgggaccctgtggaatctgtcctcttatgaaccactcaagatggttatcatcgaccatggcctgcaaactctgacccacgaagtgattgtgcctcactccggatgggaaagagagcctaacgaagacagtaagcctcgagatgctgagtggacgaccgtgtttaaaaacacatctggctgtctgcgcaatgtgagttctgacggagcagaggccagacgtcgtctgagggagtgtgaaggcttggtggatgcgctgctgcacgcccttcaatctgcagtcggacggaaggacacggacaataaaagcgttgagaactgcgtctgtattatgaggaatttgtcttatcacgtccacaaagaggtgccgggtgcagataggtaccaggaggctgagcccggtcctctgggcagcgctgtgggatcccagcgacgtaggagggacgacgcctcttgttttgggggaaagaaagctaaagaagagtggttccaccaagggaaaaaggacggtgaaatggaccggaattttgacactctcgacctgccaaaaaggacagaggccgcaaaggggttcgagctcctctatcagcctgaggtcgttaggctttatctctccctgctcaccgagtctcggaatttcaacactctagaggccgcagctggtgccctgcagaatctttccgccggaaactggatgtgggctacatacatccgcgcaacagttagaaaagagcgtgggctacctgtactggtggagctgctgcagtcagaaactgataaagtcgtgagggctgtggccatcgccctgagaaacctgagtctcgataggcgcaacaaagacctcatcggatcctacgccatggccgagctggtgagaaatgtgcgaaatgcacaggcgccaccgagaccaggcgcttgcctagaggaagacactgtagtcgccgtcctgaataccatccacgagatcgtgtccgactctttagacaatgccaggtctcttctgcaggcacgaggggttcccgctctggtggccctcgtagcctcttctcagtcagtcagggaggccaaggctgcaagtcacgtactgcagactgtgtggtcttataaagagctacggggtactctgcagaaagacgggtggacaaaggcacgctttcagtcggcagccgctaccgcaaaagggcctaagggcgctttgagccccggtgggttcgatgatagcaccctcccccttgttgacaagtcacttgagggagagaagacgggtagccgggatgtcatcccaatggacgccctcggtcccgatggttactccacagtcgacaggcgggagcgcaggccgcgaggggcatcttccgccggagaggcctccgaaaaggaaccccttaaactcgatcctagcagaaaagcaccaccacctgggccttcccgcccagccgtgcggctcgtagacgctgtgggtgacgccaaaccccaacctgtggactcttgggtctag

SEQ ID NO: 214854 - DNA, 2871 bp, Artificial Sequence
  Description of Artificial Sequence: Synthetic coding sequence
atggaggactgcaatgtgcattccgcggctagcatacttgcttcagtgaaggagcaagaggcccgatttgagcgcctcacccgcgcactggagcaggaaaggcgccacgtggctctccagttggagagagcccagcaaccgggtatggtgtcaggaggaatggggagcgggcagccactgccaatggcctggcagcagctcgtacttcaggaacagtctcctggctctcaagcatctctggccacgatgcccgaagcgccagacgtgctagaagagaccgtcacagtggaagaagaccctggcacgcccacttctcatgttagcatcgtgacctcagaggacgggaccacccgccgaactgagactaaagttactaaaacagttaaaaccgtgaccacccgcacagtgcggcaagtcccggttggccctgacgggcttcctcttctcgacggtgggcctcctctaggtccgttcgccgatggcgcactggatagacatttcctgttacgcggtggcggtcctgtagccaccctgtcccgtgcatatctttctagtggcggtggcttccccgaaggtccagagcccagagatagcccatcatacggttccctgagccggggactcgggatgaggccccctcgcgctggcccactgggtcctggacctggcgacggatgcttcactctgcccggtcatagagaagcatttccagttggccctgagcccggtccacctggcggacggtcacttcctgaaaggttccaggccgaaccatatgggctggaggacgatactcggagtctggcagctgacgatgaaggtggccctgagctagagccagattatggtaccgcaaccagaagacgaccagagtgcggcagaggcttgcataccagagcctacgaagatactgctgatgatggcggtgagctagccgatgagaggccagcttttcctatggtgacggctccgcttgcccaaccagaaagggggtccatgggctccctggacagacttgtccgacgcagcccctcggtggacagtgcacgcaaagagcccagatggcgggaccccgagctgcctgaggtgcttgccatgctcaggcatccagtggaccctgtgaaagcaaatgccgcagcatacttgcagcatttgtgttttgaaaatgaaggcgtgaagcgcagagtccgccagttgcggggattgccccttttggtggcactattggatcacccacgagctgaagtgagacgaagggcatgcggcgcattgcgcaacctctcctatggacgtgacactgacaataaggctgctatccgagattgtggcggagtcccggctctcgtgcggcttctgcgagctgctcgggacaacgaagtgcgtgaactcgttacaggcacgctctggaatctcagctcctacgagcccctcaagatggtgatcatagaccacggcctgcagactctcactcacgaggtcatcgttccccatagcgggtgggagcgagagccaaatgaagacagcaaacctagggacgcggagtggaccacagtttttaagaacacatccgggtgcttgcgcaacgtctctagtgacggagctgaagcccgacggagactgcgcgaatgcgagggactggtggacgcattgcttcatgctctccaatccgccgtcggaaggaaggataccgacaacaagagcgtcgaaaattgtgtgtgcataatgagaaacttgtcataccacgtgcataaggaggtccccggtgccgacagataccaagaggcggaacccggacccctgggtagtgcggtcggaagccaacgtaggcgacgggacgatgcgtcctgttttggtgggaaaaaagcaaaaggcaagaaagatggtgaaatggaccgcaactttgacacactagacctgcccaagagaaccgaggccgctaaaggctttgaactgctgtatcagccagaggtagttagattatacctcagtctgctcaccgagagcaggaactttaacacactggaagctgccgctggcgctctgcaaaatctttctgctggcaattggatgtgggccacttatatccgggctacagtgagaaaagagcggggactcccggtgctggtcgagctcctgcagagcgagactgataaagtggtgcgggctgtcgcgattgccctgagaaatctgagtttagataggcgaaacaaagatttgattgggtcttacgctatggccgagctggtgaggaacgtccgcaatgctcaggcccctcccaggccaggggcatgtctcgaggaagacactgtcgtggctgtgcttaacacaatccatgagatagtgtctgattctctcgataatgcccgtagcctacttcaggctaggggagtgcccgcactggtggctctcgtggccagctctcagtctgtccgggaggccaaggcagcttcacatgtcttacagaccgtgtggagttacaaagagttgaggggcacactgcagaaggatggctggactaaggcgcgatttcagtccgcagccgctaccgccaagggtcccaagggcgctctctccccaggagggtttgatgacagtaccctgccactggttgataagtctctagagggggagaagactggaagcagagacgtgatccccatggacgctctgggccctgacggctacagtacagtggatcgcagagaacgacgaccgagaggcgctagtagtgcgggtgaagctagcgagaaagagccactgaaattggaccccagtagaaaggctccgcctccaggcccatcacgaccggctgtgaggctggtggacgcagtcggtgacgcaaaacctcaaccagtggactcttgggtgtag

SEQ ID NO: 214855 - DNA, 2682 bp, Artificial Sequence
  Description of Artificial Sequence: Synthetic coding sequence
atgcccgcagaactgagacaggaacaatctcccggatcacaggcatctctcgctacgatgcccgaagccccagatgttctagaagaaaccgtgactgtggaagaggatcccggtacgccaacctcccacgtgagtatcgtcacctccgaagatggtacgacccgccgtactgagaccaaggtgactaagaccgtgaaaacagttactacaagaaccgtgagacaggtgccagtgggtccagatgggctgccactgcttgacgggggacccccattgggaccctttgcagacggcgcactggatcgccacttcttgctgaggggtggaggtcccgtggccacactttcaagagcctatttgtctagcgggggagggtttccagagggacctgagccacgagactccccaagttatggtagcttgagtcgtggcctggggatgcgacccccaagggcaggtccgctcgggccaggtcctggagacgggtgtttcaccctgccaggtcatcgggaggctttccccgttgggcctgaacctggtccccctgggggaagatcccttcccgagcggttccaggccgaaccctatggcctcgaggacgacactcgtagcctggctgctgacgacgaaggagggcctgaattagagccggactatggcaccgccactcggcgaagaccggagtgtggcaggggtctccatactcgcgcttatgaggacactgctgacgatggcggtgagcttgccgacgaacgccctgcattccccatggttaccgccccactcgctcagcccgaacgcggaagcatgggttcactcgataggctcgttaggcgctcaccctcagtggactccgccagaaaggaaccacggtggagagaccccgagctgcctgaggtcctggcaatgctgcgacatccggtggacccagtgaaggccaacgcggctgcgtacttacagcatttatgctttgaaaacgagggcgtgaaaaggagggtacgtcagcttcgaggtctgcctttgctggtagcactgctggaccaccctcgtgccgaagtccgcagaagggcgtgcggagcattgcgcaatttgtcttatgggagggatactgacaacaaggcagccatacgcgattgtggaggggtgcccgctcttgtaaggctcctgcgagcagctcgggataatgaagtccgtgagctcgtgaccggaaccctgtggaatctttcctcctacgagcccctaaagatggtgattatagatcacgggctccagactctgacccatgaggtgatagtgccacacagcgggtgggaacgtgagccaaatgaggactcaaagccgagggacgcagaatggacaacagtgttcaaaaacaccagtggctgcctgcgcaatgtcagtagtgacggcgcagaagcgagacgacgactgagggagtgcgagggcttggtcgacgctcttcttcacgctttacagtcagccgtgggcagaaaggacaccgacaataagagcgtggagaactgcgtatgcatcatgcgcaacttatcatatcacgtgcataaggaggtcccgggtgccgatcgatatcaggaagcggaacctgggcctctcggatcagctgtcgggagccagaggcggagacgtgacgacgcgtcgtgtttcggtgggaaaaaagcgaagggtaaaaaagatggagagatggataggaacttcgatacgctggatctacccaagcgcaccgaggccgcaaagggtttcgaactgctgtatcagcctgaagtcgtgagactctacctctctctgttaactgaatcacgaaattttaacaccctggaagccgcagccggtgccctacagaacctgtccgcaggtaactggatgtgggcaacctacatccgcgcaactgtgcggaaggagcggggtttgcccgtgttggtggaactgctgcagagtgagaccgataaagtggtgagagccgtggcaatcgctctcaggaacctcagtctggaccggaggaataaggacctcatcggctcttacgccatggcggaactcgtgcgcaacgttagaaatgcccaagcccctccaagaccgggtgcctgcttggaagaagacaccgtcgtggccgtacttaatactatccacgagattgttagtgattccctggacaacgctcgaagcctgctgcaagctcgaggagttcctgcactggtggccctggtagcgtctagccagtcagttcgagaggcaaaagctgcctcccatgtcctgcagacagtttggtcttataaggagcttcgaggcactttgcaaaaggacggatggacgaaggcacggttccagagtgccgctgcgacagccaagggacccaagggcgcacttagccccggaggattcgatgacagtacactccccctggtggacaagtccctggaaggggaaaaaactggctcccgagacgtcatccccatggatgccctgggaccagatggctattctactgttgatagaagagagcgtcgacctaggggagcatcaagtgctggtgaggctagcgagaaggaaccactaaaattggatccttctcgaaaagcccctccaccaggccctagtaggccagcagtgagactggtcgatgccgtgggcgacgcaaagcctcagccagtggactcttgggtgtag

SEQ ID NO: 214856 - DNA, 1131 bp, Artificial Sequence
  Description of Artificial Sequence: Synthetic coding sequence
atggaatcctacgacatcatcgccaatcaacctgtggtcatagacaatggatcaggggttataaaggccggatttgctggggaccagatcccaaaatattgttttcccaactatgtgggacggccaaagcatatgagggtgatggccggagctctggaaggagacctgtttataggtcccaaggccgaagaacaccgtggtctcctcaccattcgctacccgatggagcatggtgtggtgcgggactggaatgacatggagcggatatggcagtacgtgtacagtaaggaccagttgcagactttctccgaagagcaccccgtcctgcttaccgaggccccactcaatccatcaaaaaatagagaaaaggcagccgaggtgtttttcgagacttttaacgtgccagcactgttcatatccatgcaggctgtgttgagtctgtatgctactgggcgaactaccggtgtagtccttgactccggggatggcgtgacccacgctgtcccaatttacgagggcttcgccatgccccatagtatcatgcgggtggacatagctggacgggatgtgagtaggtatctgaggcttcttctccggaaggagggggtggatttccatacgtcagccgagtttgaggttgttcggaccattaaagaacgggcttgttatctgagcattaacccacaaaaggatgaagcacttgagacagagaaggtgcagtacacactgccagatggaagcaccctcgacgttggacccgctagattcagggcccctgagctcctatttcagcccgatctagtgggcgacgagagtgaaggcttacatgaagtggtcgccttcgccattcacaagagtgacatggatctgagacgcactctgttcgcgaatatcgtgctgagcgggggttccaccctgttcaaaggatttggagaccggctgttgtccgaggtcaagaaactcgcccctaaagacattaaaatcaagatttctgcaccgcaggaaaggctgtactcgacctggatcggcggaagcatcctggcttcacttgacacattcaagaaaatgtgggtatcgaagaaggaatacgaggaagatgggtctcgagccattcatcggaaaaccttttag

SEQ ID NO: 214857 - DNA, 1167 bp, Artificial Sequence
  Description of Artificial Sequence: Synthetic coding sequence
atgagtaaggtgtttaagaaaacttccagtaacgggaagctcagtatatatctgggaaagagagatttcgttgatcatgtagacacagtagaacctatcgatggtgtagtgctggttgaccctgaatatctgaaatgtcggaagctatttgtcatgctcacatgcgcttttcgctatggcagagacgacttggaggtgatcggcctgacgtttaggaaggatctctatgtgcagactctgcaggttgtgcctgctgagtcgagcagtccacaggggcctctgactgtgctccaggagagattactgcacaaactgggggacaatgcgtatcctttcacgctacaaatggttaccaacctgccatgtagtgttacactccagccgggaccagaggacgctggaaagccatgtggaatagattttgaggtcaagtccttctgcgctgagaaccccgaagagaccgtgagtaagcgcgactatgtgaggctggtagttcgaaaggtgcagtttgcacccccagaggccggacccggtccctcggctcagaccattcgcagattcttactttccgcacagcctctccaactacaggcatggatggatcgagaggtccactatcatggggagccaattagtgttaatgtgtcaatcaacaactgtacgaataaggtcatcaagaaaattaaaatttcagtggatcaaatcactgacgtggtgctgtatagcttagacaaatacactaagaccgtcttcattcaggaatttactgagaccgtggctgctaactcctctttctcccagagcttcgccgtcacccccattctggcagcatcctgccagaaaaggggtctggcactggacgggaaactgaaacatgaggatacaaaccttgcctcaagcaccatcatccgtcctggcatggacaaggagctcctcgggatcttggtctcatataaggtgcgagtgaacctgatggtgtcttgtgggggaattctcggcgaccttacggcgagcgatgtaggcgtggaattgcccctggtgctcatccaccctaagcctagccacgaagccgcatcatcagaggacatcgtgatcgaggagtttacacgaaagggcgaggaagagtcacaaaaggcagtagaggcagaaggagacgaaggcagttag

SEQ ID NO: 214858 - DNA, 1167 bp, Artificial Sequence
  Description of Artificial Sequence: Synthetic coding sequence
atgagtaaggtatttaagaagacctcatcaaacggtaagctgagtatctatcttggaaagcgtgacttcgtggatcacgttgacacggtggagccaatcgacggtgtggtgctggtcgaccctgaatacttaaaatgtcgcaagctgttcgtgatgctcacttgcgcatttcgctacggccgtgatgacctagaggttatcggactcacctttaggaaggacctatacgtccagacactgcaggtggttccagcagagagttcttcaccccagggaccgctgaccgtgttacaggaacgcctccttcataagctaggggataacgcttatccttttacccttcaaatggttaccaacctgccgtgttctgtgaccctgcagccgggacccgaagacgcaggcaagccttgtggaattgatttcgaagtaaagagcttctgtgccgagaaccctgaggagactgtatcaaaacgggattatgttagattggttgttagaaaggtgcagtttgcccctcctgaggctggcccaggccctagcgcccagactattagacgcttcctgctgagtgcccagcctctgcagctgcaggcctggatggacagagaagtgcattatcatggcgaacccatctccgtgaacgtctcaatcaacaactgcacaaataaagtcatcaaaaaaatcaagatctctgtggaccagattactgacgtcgttctctattctctcgataagtacacgaaaacagtcttcatccaggagtttacagagaccgtggcagccaattcttctttttcacaatcctttgccgtgactcccatcctggccgctagttgccagaagcgtggattggcattagatgggaaactgaagcatgaagataccaacctggcaagctctaccatcatccggccaggtatggacaaggagctgctgggaattctcgtgtcttacaaggtgagggtcaacctcatggtatcctgtggaggcatcttgggcgacctgactgcctccgacgttggagtggaactacctttagtgttgatccatccaaaaccatcacatgcctctgcttcttctgaagacatcgtgatagaggagttcacccgcaagggagaagaggagtcccagaaagcagtggaggccgaaggggacgaaggctcctag

SEQ ID NO: 214859 - DNA, 1080 bp, Artificial Sequence
  Description of Artificial Sequence: Synthetic coding sequence
atgtcaaaggtgttcaaaaagactagctccaacggcaagctttctatctaccttggcaagagggactttgtcgatcacgtggacactgtggagcctatcgatggagtggttctggtggaccccgaatacctgaagtgccgcaaactattcgtcatgctcacttgcgcattccggtatggtcgcgatgaccttgaagtcattggcctcacattccggaaggatttgtatgttcaaacccttcaagtggtccctgctgagagtagctcaccccaaggccctctcaccgtgctgcaggaaagactgcttcacaagctcggcgacaacgcctacccctttaccctgcaaatggtgactaatttgccttgttcggtcacattgcaacccggacccgaagatgctggaaaaccatgcggtattgactttgaagtgaaatccttttgcgctgagaaccctgaggagaccgtaagcaagcgtgactatgtcagattggtagtgagaaaggtccagtttgccccacccgaagccggaccaggaccttcagctcagaccatacgtcggttcctgctgagtgctcagcccctgcagctgcaggcctggatggacagggaggttcactatcacggtgagccaatttcagtcaatgtctccattaacaactgcaccaataaagtgatcaagaaaatcaagattagcgtggatcagatcacggacgttgttctatactccctggataagtatacaaaaacagtatttattcaggaattcacggagaccgtggccgctaatagcagcttctctcagtctttcgctgttactcccattcttgccgcttcctgtcaaaagagagggctggccctggatggcaaactaaagcatgaggatactaatctggctagcagtaccatcattagacctggtatggataaagaactcctcggcattcttgtgtcatacaaggtgcgggtgaatctgatggtatcctgtgggggaatccttggcgatctgacggctagtgatgtgggagtggagctgccactcgtgctgattcaccccaagcccagccacgaggccgcacggtag

SEQ ID NO: 214860 - DNA, 993 bp, Artificial Sequence
  Description of Artificial Sequence: Synthetic coding sequence
atgggcgagaaaccaggtacaagggtgttcaagaagagctccccaaactgtaaactaacagtctatctcggcaagcgcgacttcgtcgatcacctcgacaaagttgacccagtggatggcgttgtccttgttgaccccgattacctgaaagacagaaaggtgttcgtcactctcacctgtgccttccgctacgggagggaggatctcgatgttctgggcctgtctttcaggaaagacttgttcatagccacatatcaggctttcccccctgttccgaaccctcctcgaccccctacccggctgcaggaccgtttacttcggaaactgggccagcacgcacatccttttttctttaccatccctcagaaccttccatgctctgtgacactgcagcctgggcctgaggataccggtaaagcctgcggcgtggactttgagataagggccttttgtgccaagtctctggaagaaaagtcccacaaacggaacagtgttaggttggtgatcagaaaggtccaatttgctcctgagaaaccagggccacagcctagcgctgagacaactagacattttcttatgtccgatcgcagccttcacctcgaggccagcttggacaaggaactgtactatcacggcgagcccctgaatgttaatgtacatgtgactaataatagcacgaagaccgttaaaaaaattaaagtcagtgtgcggcaatacgcagacatttgtttgttctctaccgcacaatacaaatgccctgtggcccagcttgaacaggatgaccagagggagggcggatgccagcaaggcggagccggaaaccccggagtcctgcagggtcagggtgaggcgggtggcgtttccagacgcggatgcctatgcggtgcggcattttgctcctatgctccgcaggcccctcgacctcaccctcctccccagacgccagtaagtagaagcggtgatcggtgtccctgtgggcatcagccccactag

SEQ ID NO: 214861 - DNA, 1245 bp, Artificial Sequence
  Description of Artificial Sequence: Synthetic coding sequence
atggtgcttggcaaagttaagtccttaacaatatctttcgactgtttgaacgactcgaacgtgcctgtgtacagcagtggtgacacagtgagcgggagggtgaacctggaggtaaccggcgaaattagggttaaaagtctcaagatccacgcccgtggtcacgccaaggtcaggtggacagagtcccgaaacgccggaagcaatacagcctatacccaaaactacacagaagaggtggagtattttaaccacaaagatatcctgatagggcatgagagggatgatgataactcagaggaaggattccacactattcactcaggcagacacgagtacgctttctccttcgagctgccacagacacccctcgcaaccagtttcgaaggcaggcacggcagtgtgaggtactgggtgaaggcagagttgcatcgtccatggcttctgcctgttaagctaaaaaaggagtttactgtattcgagcatatagatattaacacacccagtttgctaagcccccaggccggaaccaaagagaaaaccttgtgttgctggttctgtacatccggccctatttcgctgagtgcaaaaatcgaaagaaaagggtatacgccaggcgaatccatccagatttttgctgagatagagaactgctcttcacgtatggtagtgcccaaagccgctatttaccagacgcaggccttctacgcaaagggaaagatgaaagaggtgaagcagttggtcgcaaatcttagaggtgaatccctctctagcggtaaaaccgaaacctggaacgggaagttgcttaagatacctccagtatcgccctctattctggattgtagcatcatccgcgttgaatactctctcatggtctacgtagatatcccgggtgccatggacctatttctgaatcttcctttggtgatcggaacaatacccctccacccgttcgggagcaggacgtcttctgtgtcatctcaatgtagcatgaacatgaattggttgagcctaagcctgccggagcggccagaggcccctccgagctatgcggaggttgtgactgaagaacagagacgtaataatctcgccccagtttctgcatgcgacgattttgagcgagccctgcagggaccactctttgcctatatacaggagtttagatttctcccaccccctctgtactctgaaatcgatccaaacccagaccagtcagctgatgaccgcccttcctgtccctcacgttag

SEQ ID NO: 214862 - DNA, 1233 bp, Artificial Sequence
  Description of Artificial Sequence: Synthetic coding sequence
atgggcgacaaggggacccgggtgtttaagaaagcctcccctaacggtaagctgaccgtctatctcggtaaaagggattttgtcgatcacatcgacttagtggatcccgtcgatggcgtagtcttggtggatccggaatacctcaaagaacgcagagtgtacgtgacattgacgtgcgctttccgatatggacgagaggatctggatgtgctgggtctaacgttcaggaaggatctctttgtggccaatgtccagagttttccacccgcacccgaagataagaagcctttaacgcggcttcaggaacgattaatcaagaaactaggtgagcatgcctacccttttacattcgaaatcccccctaacctaccctgttctgtgaccctgcaaccaggacccgaggacacgggaaaggcctgtggggtggattatgaagtgaaagccttctgtgctgagaacctggaggaaaagatccacaaaagaaacagcgttcgactggttatccggaaggtgcaatatgctccggagcggcctggaccacagcccacagcagagacgaccaggcagttcctgatgagtgacaagcccctacacctcgaagcaagcctggacaaagaaatctactaccacggcgaaccaatttcggtcaacgttcacgtgaccaacaatactaataaaacagtcaagaaaataaagatttcggtgcgtcagtacgccgacatctgcctgtttaataccgctcagtataagtgtccagtggcaatggaggaggcggatgacacagttgcgcctagcagcaccttctgtaaggtgtacaccctgacaccctttctcgccaacaatagggaaaagagggggttggccctcgacggaaagttaaaacatgaagatacaaacttagcaagttccaccctcctgcgcgagggcgcaaatcgcgaaatactgggaattattgtgtcatacaaagtgaaggtgaagctcgttgtgtcacggggtggggacgttgctgtcgaactgccattcacactgatgcaccccaaacccaaggaggagcctccccatcgcgaggtcccggaaaacgagactccagtggacacaaatctcatagaactagatactaacgacgatgacatcgtgttcgaggactttgctcgacagaggctgaagggcatgaaggatgataaggaggaggaagaggatggcactggttctccgcagcttaataatcgctag

SEQ ID NO: 214863 - DNA, 1257 bp, Artificial Sequence
  Description of Artificial Sequence: Synthetic coding sequence
atgggggataagggcaccagagtgtttaagaaagcaagcccaaacggtaaactgaccgtgtatctcggaaaacgagattttgtggaccacattgacctggtagatcccgttgacggagtggtgttggtagatcctgagtatttaaaggagagaagagtttatgtgacattgacgtgcgcatttagatatggccgagaagacctcgacgttttaggccttacttttcgaaaagacttgtttgtcgcaaacgtgcaaagttttcctccggctcctgaagataaaaaaccacttacacgtttgcaagagcggctcattaagaaactgggagagcacgcttatccttttacttttgaaataccccctaacctcccttgcagcgtaacactgcaacccggacctgaagacactggtaaagcttgcggcgtcgattatgaggttaaagcattttgtgcagaaaatctagaggagaaaattcataagaggaactcggtaaggctcgtgatacgaaaagtccagtatgctcccgaacgacctggacctcagcctaccgcggaaaccaccagacaattcctgatgagcgacaaacccctccacctcgaagcctcacttgacaaggaaatctactaccatggagagcccataagtgttaatgtgcacgtcacaaacaataccaataaaactgttaaaaaaatcaaaatcagtgtgaggcagtacgcagacatatgcctgtttaatactgctcaatacaaatgtcccgtggcaatggaggaagccgacgacacagtggccccaagtagcactttttgtaaggtttacaccctcacacccttcttggccaacaacagagagaagcgcggattggccctggacggtaaactcaaacatgaagacaccaacctcgcatcgtctactctgctgcgggagggagcgaaccgggagattcttggcattattgtctcttacaaggtgaaagtaaaactagttgtgtccaggggcggactcctgagaggactgtgcttttctgatgtagcggtcgagctcccctttacgttaatgcatccaaaacctaaggaagagcccccacacagagaggttccggagaacgagactccagtcgacactaatctgatcgagttggataccaatgacgatgacattgtgttcgaggattttgccagacaaagactgaaaggtatgaaggatgacaaagaggaggaggaggatggaactggctctccacagctcaacaataggtag

SEQ ID NO: 214864 - DNA, 1257 bp, Artificial Sequence
  Description of Artificial Sequence: Synthetic coding sequence
atgggagacaaaggcacccgcgtttttaagaaggcatcacccaacggcaagctgacagtttacctcggaaagcgcgattttgtcgatcacatagacctggtagacccggtggacggagtggtgttggtggaccccgaatatttgaaggaaaggcgcgtgtacgtgaccttgacatgcgccttcagatatggtcgggaggatcttgacgtgctgggactcaccttcagaaaggacttatttgtcgctaacgtccagtcctttccgccagccccagaggacaaaaaacctctgacaaggctacaggagaggctgattaagaaattaggcgaacacgcatacccctttactttcgagatccctccaaacctgccttgttccgttactctgcagcctggacctgaagatacagggaaagcctgtggagtggactatgaagtgaaggctttttgcgcggagaaccttgaggaaaagatccacaaaaggaactctgttagactggtaatacggaaggtgcagtatgcgcctgagcgccctgggccacagcccactgcagaaaccacacgccagttcctgatgtcagacaaacctctgcacctcgaagcctctctggataaagagatttattaccacggcgagcctattagcgtgaacgtgcacgtgactaacaataccaacaaaacagttaaaaaaatcaaaatctctgtccgccaatacgcagacatctgtttattcaacacagcccagtacaagtgtcctgtggccatggaggaagcagatgacacagtcgcacccagctcaactttctgcaaagtgtataccttgacaccatttctggccaacaatagggagaaaagaggcctcgcactggacggtaagctaaaacacgaggatacgaacctggccagtagtacccttctgcgggagggtgccaacagagaaatcctgggaatcatcgtttcttataaagtgaaggtgaaactcgttgtatcacgcggagggctgcttggcgatctggccagcagcgatgtggcagtagaactgccattcaccctcatgcacccgaagcccaaagaagagccaccccacagggaggtcccagaaaatgaaaccccggttgataccaatctgattgaacttgatacaaatgatgacgatatagtatttgaggattttgccaggcagaggctgaaaggaatgaaagatgataaggaagaggaggaggacggcacaggatccccccagctaaacaacaggtag

SEQ ID NO: 214865 - DNA, 1230 bp, Artificial Sequence
  Description of Artificial Sequence: Synthetic coding sequence
atgggtgagaaacccggaacccgggtttttaaaaagtcttctcctaattgcaagctcactgtgtatctgggaaaaagagactttgttgaccacttggataaggtcgacccggtggacggcgtagtgctcgttgatcccgactatctgaaggatcggaaggttttcgtaactttaacatgcgccttcagatacggacgcgaagatttagatgtcctcggtcttagctttcggaaagacctttttatcgccacttatcaggccttccctcctgtgccaaaccctccccgacctcccacacgcctgcaggaccggcttctacggaaactgggacagcacgcacatccgtttttctttaccattcctcagaacttgccctgcagtgttacactgcagccgggtccagaagatacaggcaaggcatgcggagtggatttcgagatacgcgctttctgcgctaagtcgctggaggagaagtctcacaaacgcaattcggtgaggctcgtgatcagaaaagttcagttcgcccctgagaagccaggaccacagccctctgctgaaacgactagacacttcctgatgtctgaccggtcgttacatctcgaagctagcctcgacaaggagctctattatcacggagaacctttaaatgttaacgtgcacgtgaccaataattctacgaaaacagttaagaagatcaaagtctctgtacgtcagtacgctgatatctgcctgttctccaccgcgcagtataaatgccccgtggcccagttagagcaggatgatcaggtcagtccaagctctaccttttgtaaagtatacaccattacgcctctattatcggataatcgcgaaaagagagggttggctctcgacggtaaattaaaacatgaggataccaacctggccagttctacaatcgtgaaggagggggctaataaggaagtcctcggtatactggtctcctaccgcgtgaaggtgaagctggtggtgagcagggggggagatgtgtccgtggaattgccctttgtgctgatgcaccccaaaccacacgaccatatccccctgcccaggccccagagcgcagcccctgaaacagacgtccccgtagacaccaaccttattgaatttgatactaattatgccacagacgacgacatcgtatttgaggatttcgcaagacttcggctgaaaggcatgaaggacgatgactacgatgaccagctttgttag

SEQ ID NO: 214866 - DNA, 1185 bp, Artificial Sequence
  Description of Artificial Sequence: Synthetic coding sequence
atgggcgagaaacccggaaccagggtttttaaaaagtcctctcccaactgtaaactaaccgtgtatctcggcaaaagagacttcgtcgatcatctggacaaagtggaccctgttgttttcgtgacactgacatgtgcttttaggtatggaagagaggacttagatgtactaggactctcttttaggaaagacctgttcattgcaacctatcaggctttccccccagtgccaaatcctccgcgacctcctactagactgcaggaccgtctgctgaggaaactggggcagcatgcccatccttttttcttcacaattccccagaacctcccctgttccgtcacgttgcagccaggacctgaagataccgggaaagcctgcggcgtcgacttcgaaattcgcgcattttgtgccaaaagtctagaggagaagtctcataagcgcaactccgttagactggtgattaggaaggtgcaattcgcgccagaaaaacctggtccacaaccaagcgccgaaacaacgaggcactttctgatgtctgatcgctctctgcatctggaggcttcccttgacaaggaactctattatcatggcgagcccctgaatgtgaacgtccatgtgaccaataacagcactaagactgtgaagaagattaaggtgtcggtacgtcagtatgccgacatctgcctgttctccacagcacagtacaagtgtccagtcgcgcaactggaacaagacgaccaagtgagtccctccagtactttctgcaaagtttataccattacaccactgctatccgataaccgtgagaaacggggtcttgccctagatggcaagctgaagcacgaggacacaaatcttgcatcatcaaccatagtgaaggaaggagccaataaggaagtgcttggcatactggtctcttatagggtaaaggtgaaactcgtggtgtcgagagggggtgatgtttctgttgagctgccgtttgtgctcatgcaccccaaaccccatgaccatatccccctacccagaccccagtcagcagcgcctgagacagatgtaccagtggatacaaacttgattgaatttgataccaattacgccactgatgatgatatcgtattcgaggactttgcccgacttagactaaagggaatgaaggatgatgattacgacgaccaactgtgttag

SEQ ID NO: 214867 - DNA, 1266 bp, Artificial Sequence
  Description of Artificial Sequence: Synthetic coding sequence
atgggcgaaaagcccggaactcgggtatttaagaagtcttcacctaattgtaaacttacagtgtacctgggtaaaagggacttcgttgaccaccttgacaaggtcgaccccgtggatggcgttgtcctggtggaccccgactacttgaaggatagaaaagtttttgttaccctaacttgcgctttccgctacgggcgtgaggacctcgacgtccttgggctttcctttagaaaagacttattcattgctacgtaccaggcctttccacccgtgccaaatcccccacgtccgcctacaagacttcaggataggctcttaaggaagctgggtcagcacgcccatccttttttttttaccatccctcagaacttgccgtgtagtgtgacgttgcagccaggacccgaagataccggtaaagcctgcggggtggactttgaaatccgagccttctgcgccaaaagtctggaggaaaaatcccataagcgcaattccgtgcgtctagtgatccgaaaagtgcaatttgcgccagagaagcccggaccacagccgagcgccgagactaccaggcactttctcatgtccgacaggagtctacatctcgaggcgagcctggataaggaactgtactaccacggcgagccactgaacgtcaatgttcatgtgaccaacaatagcacaaaaactgtcaaaaagattaaggtgtctgttaggcagtacgctgatatctgccttttcagcacagcacagtataaatgccctgtcgcccaactggagcaggatgatcaggtctctccctcctcaactttttgtaaagtctataccatcaccccactgttaagtgataaccgggagaaaagaggcttggctctagatgggaaactcaagcacgaggatactaatttggcttctagcaccatagtgaaagagggggctaacaaggaagttctggggattctggtgtcgtaccgcgtgaaggtaaagctagtggtcagtagaggcggagacgttagcgtagagctccccttcgtgctgatgcatccaaaaccccatgaccatatacctcttccacgcccacagagtgccccaacccctacgccacccctacctgttcctcccgcagccccagaaacagatgtgccggtcgacactaatctaatcgaattcgacactaactatgctactgacgatgatatcgtgtttgaagacttcgccaggctgcgcctcaaaggaatgaaggatgatgactacgatgaccagctttgttag

SEQ ID NO: 214868 - DNA, 1233 bp, Artificial Sequence
  Description of Artificial Sequence: Synthetic coding sequence
gcagccaatcgtgccggaggcggtcgcgcacatcatggcggtgagactagggatcagttgacagtgtatctcggcaaacgtgatttcgttgaccatttagacaaagtggacccagtggacggggtcgtactggtggaccctgattatctgaaggatcggaaggtgttcgtgacactcacttgcgcatttagatacggaagagaggatttggatgtgcttggcttatcattcagaaaggatttattcattgcaacctaccaggctttccctccagtgccaaatcctcctcgccctccaaccaggttacaggatcggctgctccggaaactcggccagcacgctcacccattctttttcaccataccacagaacttaccctgctcagtgactctccaacccggtcctgaagacactggtaaggcctgtggagtggactttgaaatccgcgctttttgcgcaaaatcgctcgaagagaaatcccataagcgaaattcagtccggctggtgatacgtaaagtccagtttgctccagagaaaccgggaccacagccttccgccgagaccactagacactttctcatgagcgacagatcattgcaccttgaggcttccttggataaggaactctattatcacggcgagccgctgaacgtaaatgtccacgtgaccaacaacagcactaagactgtcaaaaagatcaaggtttccgtgaggcaatacgccgacatttgcctgttctccacagcacaatataagtgtcctgtcgctcaactcgagcaggatgaccaggtttctcccagtagcactttctgtaaagtgtacactatcacacccctccttagcgacaatagagagaaaagaggattagcccttgacggcaagctaaaacatgaggataccaacctggcttcctcgaccattgtgaaagagggcgctaacaaggaggtgctcggaatcctggtctcctatagagtgaaagtgaagctggtagtctcccgcggtggagatgtgtctgttgagctgccatttgtcctgatgcatccaaaacctcatgaccatatccctttacctcgccctcagtccgccgctccggagactgacgtacctgtggacaccaacttgatcgaatttgatacaaactatgctacggacgatgacatcgtgttcgaggacttcgcgcgtctgaggctcaagggaatgaaagatgacgactatgacgaccaactttgttag

SEQ ID NO: 214869 - DNA, 1047 bp, Artificial Sequence
  Description of Artificial Sequence: Synthetic coding sequence
atggccgcaggggttgctggatggggtgtcgaagcagaggaattcgaggatgcaccagatgtagaacctctggagcctaccctaagtaatattatagagcaacggagtctgaagtggatcttcgtgggtggaaagggtggtgttggtaagaccacttgcagttgctctcttgcggtacagctgagcaagggccgagagagcgtgctgatcatcagtactgaccccgctcataacatcagcgatgccttcgatcagaagttctccaaggtgcccaccaaggtgaagggatacgataatttgttcgctatggagatagaccccagcttaggggtggcagaacttcctgacgaatttttcgaggaagataatatgctgtccatgggtaagaagatgatgcaggaagctatgtctgccttccccggaattgacgaagcgatgtcttacgctgaggttatgcggttggtaaaaggaatgaatttttctgtggtcgtatttgacacggcacctaccggacacaccctgaggctgctgaactttccgaccatcgttgaacgtgggttagggagactcatgcagattaagaaccagatttcgccgttcatctcacagatgtgcaacatgctgggactcggtgacatgaacgccgaccagttggcgtctaaactggaggagactctccccgtgatacggagcgtgtctgagcagtttaaggatcccgagcagaccacattcatctgcgtctgtattgcggagttcctgtcactgtacgaaacagaacgtctgatccaggagctggccaaatgtaagatcgacactcacaacatcatagtgaaccagctggtctttccagatcctgagaagccctgcaagatgtgtgaagcgaggcataaaatacaagccaagtatttggaccagatggaagatctgtacgaggattttcacatcgtcaaactgccactgctcccacatgaggtgcgcggtgcagataaggtaaataccttttccgctctgctgcttgaaccatacaaacccccttccgcccagtag

SEQ ID NO: 214870 - DNA, 1047 bp, Artificial Sequence
  Description of Artificial Sequence: Synthetic coding sequence
atggcagccggagtcgctgggtggggcgttgaagccgaggagtttgaggacgctcccgacgtggagcccctggagcctacactgtccaatatcattgagcagaggagcctaaaatggatatttgtgggaggcaaaggaggagtgggcaagactacctgcagctgctcattggctgttcagctctccaaaggcagagagtcagtactgatcatttccacggaccccgctcataacatctccgacgcattcgatcagaaattcagcaaagtaccaacgaaagtgaagggctatgataatttatttgccatggagattgacccttctctgggggtggccgaactcccggacgagttcttcgaggaggacaatatgctgtctatgggcaagaaaatgatgcaggaagctatgtcagcattccctgggatagacgaggctatgtcctacgcagaggtgatgcgcctagtgaagggaatgaatttttccgtcgtagttttcgatacggcccctacaggccacacactccggctgcttaactttcctaccattgttgaacggggactggggcgactcatgcaaatcaaaaaccagatctccccattcatatcccagatgtgcaacatgctgggactgggcgacatgaatgctgaccagctcgcctccaagctggaagaaacgctgcctgtaatacggtctgtgtcagagcagtttaaagatcctgaacagaccacttttatctgtgtgtgcatagctgagttcttatcattgtatgagaccgaaaggctgatccaggaactagccaaatgcaaaattgacacccataatatcatcgtgaatcagttagttttcccagatcctgagaaaccttgcaagatgtgcgaggctagacacaagatccaagctaaatacttagaccagatggaggatctgtacgaggactttcatatcgttaaattacctctgttgccacacgaagttagaggggcagataaggttaataccttcagcgcccttttgttagaaccatataaacctccgtctgctcagtag

SEQ ID NO: 214871 - DNA, 1128 bp, Artificial Sequence
  Description of Artificial Sequence: Synthetic coding sequence
atggcagccctcagggatgccgagattcagaaggatgtgcagacctactatggtcaggtgctcaaacggtctgccgacctgcagactaatggctgtgtgactactgcacggccagtccctaagcacattcgggaagcactgcagaacgtccatgaagaagtcgctctgagatactacggatgcggtctcgttattccagaacatctcgaaaactgctggatcctcgatctgggatctggatccggaagagactgttatgtcctttctcagctggtgggagagaagggccacgtgaccggcatagatatgactaaggggcaggtcgaggtggccgagaagtacctagattaccatatggagaaatacggctttcaggcgtccaatgtcaccttcatccacggctacattgaaaagcttggggaggcgggtatcaaaaatgaaagccatgatatcgtggtctctaattgcgttattaatttagtgcccgataagcagcaggtactccaagaagcataccgggtgctgaagcacgggggtgagctgtacttttctgacgtgtatacgtccctggaacttccggaggagatccggacacacaaagtcctgtggggcgaatgccttgggggagccctgtactggaaggagctggctgtgctggcccagaagatcggattttgtccaccacggcttgtgacagccaaccttattaccatccaaaacaaggaattagaaagggttatcggggactgccgattcgtttctgctacatttagactcttcaagcattcaaaaaccgggcctactaagagatgtcaggttatctacaatgggggtatcacggggcatgaaaaagagttgatgttcgacgcgaattttaccttcaaggaaggagagatcgttgaggtggatgaagaaaccgccgcaatcctcaagaatagtaggttcgcccaggatttcctcatccgacctataggtgagaagcttcctacatccggcggatgttctgctttggagctgaaggatattattactgaccctttcaagctggccgaggaatccgacagcatgaaaagcagatgtgtccctgacgctgcagggggatgctgtggaaccaaaaaatcatgctag

SEQ ID NO: 214872 - DNA, 816 bp, Artificial Sequence
  Description of Artificial Sequence: Synthetic coding sequence
atgggcaatggcggacggtcggggctccaacagggcaagggcaatgtggatggggtggctgctacgcctacagcggcatctgcgagttgccagtacaggtgcatagaatgtaaccaggaagcaaaagaactgtaccgcgactataatcatggggttttaaagataaccatctgcaagtcttgccagaaaccggtagataagtacatcgaatacgaccctgtcatcatcctgatcaatgctatattgtgtaaggctcaggcctaccgccatatcctcttcaacacccagatcaatatccatgggaaactgtgcattttttgcctattgtgcgaggcctatctgaggtggtggcaactccaggattctaatcaaaacaccgccccagatgacctgatccggtatgctaaggagtgggacttctacaggatgttcgccatcgccgctctggagcagacagcctacttcatcggcatctttaccttcctctgggtggaaagacctatgacggccaaaaagaaaccaaattttatcctgctcctaaaggctcttcttctgagctcctacggcaagttgctgcttattcctgcagtcatttgggagcatgattacacatctgtgtgcctcaagctgatcaaggtcttcgtgctgacaagtaactttcaagctatccgggtaaccttaaacattaatagaaagctctcttttcttgcagtgctgtcaggtcttctactcgaaagcatcatggtgtacttctttcaatcaatggagtgggatgtggggtcagactacgcgattttcaagtctcaggacttctag

SEQ ID NO: 214873 - DNA, 807 bp, Artificial Sequence
  Description of Artificial Sequence: Synthetic coding sequence
tagggtcgcagtggactgcagcaaggtaagggtaacgttgacggcgtagccgctactccaactgccgctagtgccagctgtcagtaccggtgcattgagtgcaaccaggaggctaaagagctgtatcgagattataaccacggcgtgttgaaaattaccatatgtaagtcctgccaaaagccggtggataagtacatagagtacgaccctgtcatcatcctcattaatgcaatactgtgtaaagctcaggcctaccgacacatcttgtttaacacccagatcaacattcatggcaagttgtgcatcttctgccttctttgcgaggcttacctgagatggtggcaacttcaggactcaaatcagaataccgcccctgacgacttgattcggtatgcaaaagagtgggatttttatcgtatgtttgctatagccgcacttgagcagacagcttattttattggaatttttaccttcctttgggtggagcgtcccatgaccgctaagaagaaacctaacttcatactgcttttaaaggccctgctcctctctagttacgggaagctgctcctgatccccgcagtgatatgggagcacgattatacgtccgtgtgcctaaaactcatcaaggtgtttgttctaactagcaatttccaggcgatccgggtaacacttaatattaatagaaaactctccttcctagccgttctctcaggcttgttgctggagagcattatggtgtacttttttcaaagcatggaatgggacgtggggtcagattacgctatcttcaagagccaggacttttag

SEQ ID NO: 214874 - DNA, 2547 bp, Artificial Sequence
  Description of Artificial Sequence: Synthetic coding sequence
atgaatagcagttctgcgaacatcacctatgctagtagaaaacgccgtaaacctgtgcagaaaaccgtgaagcccataccagccgagggcattaagtctaatccctcgaagcggcaccgtgatcggttgaacactgaactagacaggctggcgtcactcctccccttcccccaggacgtgatcaataagttagataaattatccgtgctgcgcctttcagtatcttacctgcgtgccaaatccttctttgacgtcgccctgaagagctctcccaccgagagaaacggagggcaggataattgtcgggcagccaactttagggaaggcctgaacctccaggagggggagtttctgcttcaggctttgaacggatttgtgttggtcgttaccacagatgctctggtattttatgcctccagtaccatccaggactacctcgggtttcaacagagtgatgtgattcatcaatccgtttatgaactcatacacactgaggaccgtgccgagttccagcgacagctgcactgggcgctgaatccatcacagtgtacagagagtgggcaaggaattgaagaggcgactggacttccccaaacagtcgtatgctataatcctgaccaaattccccctgaaaacagcccgctgatggagagatgtttcatttgccgactccggtgtctgctggataacagttcaggctttctcgcaatgaactttcaaggaaaattaaagtacctacacggacagaaaaagaaggggaaggatggctcaatactgcccccacagctcgctttattcgccatagcaactcccctgcagccaccctccattctagagattaggaccaaaaactttatctttagaacgaagcacaaactcgactttacccccatcgggtgcgacgctaagggacggattgtgcttggctacaccgaggctgagctgtgcaccagaggctccggatatcagtttatccacgcagctgacatgctgtattgtgccgaatcccacatccggatgatcaaaacaggcgagagcggaatgatagtttttagactgctgactaagaataacaggtggacctgggtgcagtctaacgcccgtctgctgtataaaaatggcaggcccgactacataattgtcacgcagcgcccattgaccgacgaggagggtacagaacatctgagaaaaagaaataccaaactccctttcatgttcactaccggggaggccgtcctttatgaggctacgaaccctttccctgcaattatggacccattgcctctgaggactaagaacggaactagcggcaaggattctgccacaacaagcactctgtctaaggacagcttgaaccctagcagcctcctggcagcgatgatgcaacaagatgaatctatttatctatacccagcttcatcaacctcctctaccgcgccatttgagaacaatttcttcaatgaatcaatgaatgaatgcagaaactggcaggataatactgcccctatgggaaatgacaccatcttgaaacacgagcagattgaccagccacaggacgtcaactcctttgccggtgggcatccgggactcttccaagattcaaagaactccgatctgtactcgatcatgaaaaatttgggcatcgactttgaggacatcaggcatatgcagaatgagaagttcttcaggaacgacttctcaggggaagttgacttccgggacattgacctgaccgacgagatactcacatacgttcaagactcactgagcaagagtccgtttataccttcagactaccaacagcagcagtctctggctctcaactcttcttgtatggttcaggaacatctgcacttggagcagcaacagcagcatcatcagaaacaggttgtcgtggaaccccaacaacagttgtgtcagaagatgaaacacatgcaggtgaacggcatgttcgagaattggaacagcaatcagtttgtgccattcaactgtccacagcaggatccacagcagtacaacgtttttacggaccttcacggaattagccaggagtttccctataaatccgagatggactctatgccctacacacagaacttcatcagttgtaatcaaccagtgctgccccagcactcaaaatgcaccgagctggattatcccatgggcagcttcgagcccagcccttatcctaccacatcaagcttggaagacttcgtgacatgcctgcagctgccagaaaaccagaagcacggcttgaacccacagtccgccatcatcaccccccagacctgctacgccggagcggtgtcaatgtaccagtgccaaccggagccccagcatacgcacgtggggcagatgcagtacaacccggtgctccccggtcaacaagctttcctcaataagtttcagaatggggtattgaacgagacctacccagccgagttgaacaatatcaataacactcagacaaccactcacctgcagcccttacatcaccctagtgaggctcgccctttccccgatttaacttctagcgggtttctctag

SEQ ID NO: 214875 - DNA, 2547 bp, Artificial Sequence
  Description of Artificial Sequence: Synthetic coding sequence
atgaatagttcctccgccaatattacatatgcctctcggaaacggaggaagccggttcagaaaaccgtcaaacccatccctgctgaaggcattaaaagcaacccatccaaacggcatagagatcggttgaacaccgagttagatagactggcctctctgctcccttttccccaggatgtgattaataaacttgacaagctgtcagtgcttaggctgtctgtctcttacctcagagccaagagtttcttcgatgtcgcgctaaagtcctcccctacagaacgcaacggagggcaggacaactgcagagccgctaactttcgtgagggattaaatctgcaggagggtgaattcttactgcaggctttgaacgggttcgtattggtagtgactacagacgctctggtgttctacgcttcttccaccattcaggattatcttggctttcaacagtcagatgtgatccatcagtccgtatatgagttgatccacactgaggatagggcggaattccaaaggcaattgcattgggcgcttaatccttcccagtgcacggaatccggccagggtattgaagaggcaaccgggttaccccaaacggtcgtgtgctataaccccgatcagattccacccgagaacagtcctctgatggaacgatgtttcatttgtcggctcagatgtcttctggacaactcaagcgggttcctggcaatgaacttccagggaaaactgaaatatctgcacggacagaagaaaaagggcaaagatggtagcatactgccaccacagctggcgctcttcgccatagctactccattgcaacctcccagcatcttagagattcgcacaaagaatttcatctttaggacgaaacataagctagacttcacacccattggctgtgatgcaaaaggaagaatcgttctggggtacaccgaggctgagctgtgtaccaggggcagcggatatcagtttatccacgctgccgacatgttgtattgcgccgaatctcatatccggatgatcaaaactggtgagagtggcatgattgtcttccgcctgctcacaaaaaataacagatggacctgggtacagtccaacgcacggctactttacaaaaacgggaggcccgattatattattgtgacccaaaggcctcttactgatgaggaaggtactgagcatctcaggaagaggaatacaaagctgcccttcatgttcaccaccggagaggcagttctgtatgaggccactaaccccttccccgcaatcatggatcctctgcctctgaggacaaagaacggcacatccggtaaggacagcgcgaccaccagcactctgagtaaagactccctcaacccgagttcactgctcgccgctatgatgcagcaggatgaatccatctatctgtaccctgcatcatctacaagttctaccgcaccgtttgagaacaacttttttaatgagagcatgaacgagtgtaggaactggcaagataataccgcacctatggggaacgataccattctgaagcacgagcaaatcgaccagccgcaggatgtgaattcattcgccggaggtcacccagggctgtttcaggatagcaagaactccgacctatacagtataatgaaaaacttgggaatcgacttcgaagacatacgtcacatgcagaacgagaagttcttcagaaacgacttttctggcgaagtggatttccgggacattgacctgaccgacgagatcctgacctacgtgcaagacagtctgagcaagtcacccttcattccttctgactatcagcagcaacagtctctggctctgaactcgagttgtatggtacaggaacacctccatttggaacagcagcagcagcaccaccaaaagcaggtggtcgtggagccccagcagcaactgtgtcagaagatgaaacacatgcaagtgaatggcatgttcgaaaactggaacagtaatcaattcgtgcccttcaactgtccacagcaggatccccagcaatataacgtctttaccgacttgcatggcatatcccaggaatttccttacaagagtgagatggacagtatgccatacactcagaattttataagttgcaatcagccagtgctaccccagcactccaaatgcacggaactggactaccctatgggctcattcgaacctagcccttaccccacaacatcttccctggaagatttcgtgacgtgcctgcagctccctgaaaatcagaagcatggcctgaacccccagtccgcaatcatcacccctcagacttgttacgctggggctgtgtctatgtatcagtgtcagcctgagccccagcacactcacgtggggcagatgcagtacaacccagttctacccggtcagcaagcgttcctgaacaagttccagaacggagtgttaaacgagacctatcctgcggaactgaataatataaataacactcagaccacaacacacctgcagcccctccatcaccccagtgaagctcgcccttttcctgacctgactagctcaggatttctctag

SEQ ID NO: 214876 - DNA, 993 bp, Artificial Sequence
  Description of Artificial Sequence: Synthetic coding sequence
atggctgatattatagccagactcagggaagacggaatccagaagcgggtcatccaggaaggacggggtgagctgcccgattttcaggacggtaccaaggcaacgtttcactatcgaacgctgcacagcgatgacgaaggtacggtgctggatgattccagagcgagaggaaagccgatggagttaatcattgggaaaaaattcaagctgccagtttgggaaaccatcgtgtgtaccatgagggagggagaaattgctcagttcctgtgcgacatcaagcatgtggtcctgtatccactggtggctaaaagcctgcgcaatatcgctgtgggcaaagaccccctcgagggccaacggcactgctgcggggtcgcccagatgagggaacactcttcgctcgggcacgccgacctcgacgctttacagcagaaccctcagcctctgattttccacatggagatgttgaaggtcgaatcacccggaacgtaccaacaggacccttgggccatgacagacgaagagaaagctaaggccgtccctctaatccaccaagaaggaaatcggttatatagggaaggccacgtgaaagaagcagccgctaagtattacgacgccattgcctgcctgaagaacctccagatgaaagaacagcccggatcccccgaatggattcagcttgaccagcagattacccccctgctgctaaactactgccaatgtaagttggtggtcgaagaatattacgaggttctcgaccactgtagctctattctcaacaaatatgatgacaacgtcaaggcctacttcaagcgcggtaaagcccatgcagctgtttggaacgcgcaggaagcccaagcagatttcgcaaaagttctggaacttgaccctgctctggctcccgttgtcagtcgtgaactccaggcactggaggcgagaatccgacagaaggacgaagaggataaggcccgttttaggggaattttttctcattag

SEQ ID NO: 214877 - DNA, 966 bp, Artificial Sequence
  Description of Artificial Sequence: Synthetic coding sequence
atggacgctgccctgctgctgaatgtagaaggggtgaaaaagacgatcctacacgggggaacaggcgagttacctaattttatcactggtagtcgcgtcatatttcattttcggactatgaaatgcgatgaggagaggacagtcattgatgactctagacaggtggggcagcccatgcatattattatcggcaacatgttcaaactggaggtctgggagatcctccttacatccatgcgcgtacacgaggtggccgagttctggtgcgacacgatcgtggacgccccttcagattatcaacgggagacttggaatctgagcaaccacgagaagatgaaggctgttcccgttctgcatggcgagggaaatcgcttgtttaaactcggaaggtatgaagaggcctccagtaaatatcaagaggctatcatctgtctcaggaatctgcaaaccaaagagaagccctgggaggtgcagtggctgaagctggaaaaaatgatcaatacgcttatcctgaactactgccaatgtctgctgaaaaaggaagagtactacgaagtgttagagcacacatctgacattctcaggcatcatcctggaatcgttaaagcctattacgtgagggcaagagcccacgccgaggtctggaacgaggctgaagctaaagctgatcttcagaaggtgctcgagcttgagccgagtatgcaaaaagctgttagaagagaattgagactgctagagaaccgtatggcagagaaacaggaggaagagcgtttgagatgtaggaatatgttgtcacaaggtgccacgcagcctccggctgaacctcccacagaaccgcctgcacaaagctccactgagccacccgctgagcctcccactgcaccgtcagcagagttatccgcaggccctccagcagaacccgcaactgagccccctccctcgcctgggcatagtctccagcactag

SEQ ID NO: 214878 - DNA, 975 bp, Artificial Sequence
  Description of Artificial Sequence: Synthetic coding sequence
atggacgcagccctcttgctcaacgtagaaggtgtcaagaagacaattttacatggtggcacaggagagctgcctaatttcataacaggaagtcgccacaccggagtgtatcccattctgtctaggtcactgcgacagatggctcagggcaaagacccaaccgagtggcacgtccacacctgtggtttggcaaacatgtttgcttaccacaccttgggctacgaggatctcgacgaattgcagaaggagcctcagccattggtgttcgtcatcgagcttctccaagttgacgcaccgagtgactaccagcgggagacatggaacctttccaatcacgagaagatgaaggccgtgccggtgctgcacggggagggcaatcgcttattcaagttgggtagatacgaggaggctagctctaaatatcaggaagccatcatctgcctgcggaatttgcagactaaagagaaaccgtgggaggtacaatggttgaaacttgagaaaatgatcaatacgttgattctgaactattgccaatgtctgctgaagaaagaagaatattatgaggtgcttgaacacacgtcagatatcctgcggcatcaccccggaatcgtcaaggcatactacgtgagggcccgagcccacgctgaagtgtggaatgaggctgaagccaaagccgaccttcagaaggtgctcgagttggagccctctatgcagaaagccgtgcgcagggagcttcgtctactcgaaaaccgcatggccgagaagcaagaagaggaacgccttcggtgtcgcaacatgttatctcagggcgcaactcaacctcccgctgaaccaccaacagaacctcctgcgcagtcctctactgagccccctgccgaaccccctacagccccatctgccgagctcagcgcaggccctcccgctgaacctgctacagagccacccccatcacctggccactcactgcagcactag

SEQ ID NO: 214879 - DNA, 1155 bp, Artificial Sequence
  Description of Artificial Sequence: Synthetic coding sequence
atggacgccgcactgcttctgaacgttgaaggagtcaagaagaccattctccacgggggtacaggagagttaccgaacttcatcactggcagccgggtgattttccatttcaggaccatgaaatgcgacgaagagcgcacggtaatcgacgactcccggcaagtgggccagcccatgcacatcattataggtaatatgttcaagctcgaggtttgggagatcctcctgacaagcatgagagttcatgaggttgcagagttttggtgtgataccatccacaccggcgtatatcctatactcagccgctctttaaggcagatggcgcaaggcaaggatccaactgaatggcatgtgcatacatgtggcctggctaacatgttcgcctaccatactctgggctatgaagacttggatgaactgcaaaaggagccccagccactcgtgttcgtgatcgagctgcttcaggtcgatgcaccttcagattaccagagggagacttggaacttgagcaaccacgaaaagatgaaggctgtgcctgtcttacacggcgagggaaacaggttattcaagttaggaagatatgaagaggcctctagcaagtaccaggaagccataatctgcctgcgcaacctgcagacgaaggaaaagccttgggaggtgcaatggctaaagttggagaaaatgatcaatacactgatactgaactattgtcaatgtttactaaagaaggaggaatactacgaagtgctcgagcacacatccgacatattacgtcaccatcccggaattgtgaaagcctactacgtgagggcgagggcccatgccgaggtatggaacgaagctgaggccaaagccgatctgcagaaagtcctggaactcgagccctctatgcagaaggcggtccggagggagttacgcctgttggagaacaggatggcagagaagcaagaagaggagaggctgcgctgccggaatatgctaagtcagggagccacccaaccacccgcagagccccctaccgagccccctgcccaatcatccacagagccgccagctgaacctcccacagcaccttctgctgagctatctgccggacctccagctgaacctgccacggagccaccccctagccctgggcactctttgcagcattag

SEQ ID NO: 214880 - DNA, 981 bp, Artificial Sequence
  Description of Artificial Sequence: Synthetic coding sequence
atggacgcagctttgctgttgaacgtggaaggggtcaagaaaaccatccttcacggaggtaccggcgaactgcccaattttattacaggcagccgtgttatatttcactttcgaaccatgaagtgcgatgaggagcgtactgtcattgacgattccagacaagtgggccaaccaatgcatatcataatagggaacatgtttaagttggaggtttgggaaatactccttacgtcaatgagagtccacgaggttgccgagttttggtgcgataccattcacaccggtgtataccccattctgtcccggagtctgcgccagatggcacagggtaaagacccaactgagtggcatgtgcacacctgtggtcttgccaacatgtttgcttaccacactctcggctacgaagatctcgatgagctgcaaaaggaaccccagcccctggtgttcgtgatcgaattactccaggtggacgctccatccgattatcagagagagacatggaatctgagcaaccatgagaagatgaaagcagtgcccgtcctgcacggagaggggaatcgcttgtttaagctggggcgatatgaggaagcttcaagcaaataccaggaggcaataatttgtctgcgcaacttacaaacaaaggaaaaaccctgggaggtgcagtggcttaagctggagaagatgattaacactttgatcctgaattattgccagtgtcttcttaagaaggaggagtattacgaggtgctggagcacaccagtgatatcctgcgccaccatccgggtattgtgaaagcctattatgtaagggcaagagcacacgctgaagtatggaatgaagccgaggctaaggctgatctccaaaaggtcttggagctggaaccttcgatgcagaaggccgtgaggcgggaacttcgtttactggagaatgcttggcgacgttctcgccgtcgctcaggctgcgcagccggtacatgttag

SEQ ID NO: 214881 - DNA, 975 bp, Artificial Sequence
  Description of Artificial Sequence: Synthetic coding sequence
atggatgctgccctcctgctgaatgtcgaaggagtgaagaaaaccattctacacgggggaaccggggaattgccaaatttcattaccggaagccggcacactggtgtgtatcctatactctctcgctccctgagacagatggctcaaggtaaggacccaactgagtggcacgtgcacacctgcggccttgccaacatgtttgcctatcacaccctgggatatgaggaccttgatgaactgcagaaagaaccacagcctctggtcttcgtcatcgaattactgcaagtggacgcaccctcagactaccagagggagacctggaatctgtcaaatcatgagaaaatgaaagccgtgccagtcctccacggggaaggtaaccgtttgtttaagctggggaggtatgaagaggcatcatcgaagtatcaggaagcaatcatctgcctcaggaatctccaaacaaaggagaaaccgtgggaagttcaatggcttaaactggagaaaatgatcaacactctaatccttaattactgccaatgtctgctgaaaaaagaggagtactacgaagtattggagcatacatcggatatcctcaggcatcatccaggcatagtgaaggcctattatgtgagagcgagggcgcatgccgaggtatggaatgaggcagaggctaaggctgatctgcagaaagtgctggaattggaacccagtatgcaaaaagccgtgcgacgggagcttcgactactggagaaccggatggcagagaaacaggaggaagaacgcctgcgatgcaggaacatgctatctcaaggtgcaacccagccaccagccgaacctcccaccgagcctccagcccaatcgtccactgagcccccagcggagccccctaccgcgcctagtgcagagctcagtgcgggaccaccagctgagcccgctactgagccacctcccagccccggacattcgctccaacattag

SEQ ID NO: 214882 - DNA, 1251 bp, Artificial Sequence
  Description of Artificial Sequence: Synthetic coding sequence
atggcagccaccacagcaaatcccgaaatgacgtctgacgtcccgtcacttggtcccgctatcgcaagtggtaacagcggacctggcatccaaggaggcggagccattgtgcagcgggcaattaaaaggcgccctggactggatttcgacgacgacggagaaggaaacagtaaattcctgaggtgtgatgatgaccaaatgtctaacgataaggaaagattcgctcgatccgacgacgaacagtccagcgccgacaaggagagactggccagggaaaaccactccgagattgagagacgaagacggaataaaatgacagcctatattactgaattaagcgacatggtgccgacctgctccgcacttgcgagaaaaccagataagctaaccatcctccgcatggccgtttcgcacatgaagagtctgagaggaacaggcaacactagtactgacggttcttataagcctagctttttaaccgatcaggagctgaaacatctgattctcgaggcagcagacgggttcctttttatcgtctcttgcgagactggcagggttgtgtacgtttctgatagcgttacccccgtcctaaaccagccccagtctgaatggttcggttctaccctttacgaccaggtccacccagacgatgtggacaaactgcgtgagcagctgagtactagcgaaaatgccctcacaggcagaatcctggaccttaagactgggacagtgaaaaaagaaggacaacagtcaagtatgagaatgtgtatgggctcccgacgcagcttcatttgtcgtatgcgttgtggtagtagtagtgtggaccctgtttcagtgaacagactgtcgttcgtgcggaaccgctgtcgaaatgggctgggatcagtgaaggacggtgagccccatttcgtggttgtacattgtactgggtatatcaaagcctggccaccagccggagtctctctcccagacgatgacccagaagcgggacaggggtccaagttttgcctggttgccatcggacgacttcaggtgacttcctcccctaattgcaccgatatgtcaaatgtctgccagcccactgagttcatctcccgacacaacatagaaggaatctttaccttcgtggaccacagatgcgttgcaactgtagggtatcagccccaagagttgctggggaaaaacatcgttgagttttgtcacccagaagatcagcagcttctgcgagattcctttcaacaagaactgtag

SEQ ID NO: 214883 - DNA, 2223 bp, Artificial Sequence
  Description of Artificial Sequence: Synthetic coding sequence
atgtatcaccactgggtacagccactcccactagagacactagatttggagttcaaagtcgaggaaccactgagccgcggactcttaagtggcgaccaggcgggactgaagtacctactgttggcattcctcaggctggatttcgacgacgacggtgaaggaaatagcaaattcctgcgctgcgacgatgaccagatgtcaaacgataaggaacgatttgcaagggagaatcactctgagatcgagagaagacgcaggaacaagatgaccgcttatatcacagagctcagtgacatggttccaacgtgcagcgcattagccagaaagcccgataagctgaccatcctgagaatggcagtgagtcacatgaagagcctgagaggaaccggtaatacatccaccgacggatcttacaagccgtcctttctgaccgaccaggagttgaaacaccttatcttggaagcggcagacggcttcctgttcatagtgtcatgcgagactggccgagtcgtgtacgtgtccgactcagtcaccccagtgcttaatcaaccacagtccgaatggtttggttccaccctgtatgaccaggtgcatccagatgacgtcgacaagcttcgagaacagctaagcacgagtgagaatgcattgactggcaggatactagatctgaagaccggcaccgtaaaaaaggaaggccagcagtcatcaatgcggatgtgcatgggctcaagacggagttttatttgccgaatgaggtgtgggtcttcttctgttgatcccgtttcagtgaaccggctttcttttgtccggaacagatgcagaaacggccttggatccgtgaaagacggggagccccatttcgtggttgtgcactgcaccgggtacattaaggcctggcccccagctggagtcagtctgccagacgacgaccccgaggctggccagggatctaaattctgtctggtcgctataggacgactccaggttacttcctctccgaattgcactgacatgtcaaacgtatgtcagccgacagagttcatcagcagacacaacattgaggggattttcacctttgtggatcacagatgcgtcgccacagtcggctatcagccacaggaactgctcggtaagaacatcgtggagttctgtcaccctgaagaccaacagctgctgcgagattcattccaacaagtggttaaattaaaagggcaggtcctcagcgttatgttccgtttccgtagcaaaaaccaggagtggttgtggatgcgcacatcatcatttacctttcagaatccctactccgacgagattgagtatatcatttgcactaatactaacgtgaagccgctgacctacaggcaacagcagcaacagacggagctggacatggtgccaggtcgcgatggactggctagctataatcatagtcaggtagtacagccggtcaccactaccggaccggagcattccaaacccctggagaagtccgatggtctatttgcacaggaccgagatccacggttctcagaaatctatcacaatataaacgcagatcaaagcaaagggataagctcgagcaccgtcccagccacgcagcagttgttctcccagggaaatacatttccacccacgcccagaccggctgaaaactttcgcaatagtggactcgcgccaccagtgactattgtgcagccgtccgcaagtgccggacaaatgctagcacagatttccaggcattctaatcccacccaaggggcaacgccaacctggacccccactacacgaagtggattctctgcgcaggtggcaacccaagccaccgctaagacccggaccagtcagttcggagtgggcagtttccagacacccagttcttttagctccatgtctctgccaggggctcctacagccagccccggtgccgctgcttacccctccctgaccaataggggatcgaatttcgctcctgagacagggcagactgcgggtcaattccagactaggaccgcagaaggagtcggtgtgtggcctcagtggcagggacagcagccccaccaccgctcgtcaagctctgagcagcacgtgcaacagccccctgcacagcagccgggtcagcctgaagtgtttcaggaaatgctttccatgttgggggatcagtccaatagttataataatgaggagtttccagacctgacaatgttcccgccattttccgagtag

SEQ ID NO: 214884 - DNA, 1251 bp, Artificial Sequence
  Description of Artificial Sequence: Synthetic coding sequence
atggccgctaccacggccaaccctgagatgaccagcgacgtgccctccctgggtcccgctatcgcgtcaggaaattccgggccaggaattcaagggggtggcgcaattgtccagcgggctatcaaacggcgacctggcctcgactttgatgacgacggagagggtaattcgaaatttcttcgctgtgatgatgaccagatgtccaatgataaagaaaggtttgccagatctgacgacgagcagagctctgcagacaaggaaagacttgctcgagagaatcacagcgagatcgaaaggcggcgtcgaaacaaaatgaccgcatacattaccgagttgagcgatatggtccctacttgctctgctctcgccagaaagccagacaagctaaccatccttcggatggcggttagccacatgaagagcctccgaggcacaggaaacactagtaccgatggatcatataagccttccttcctcacggatcaggagctcaaacatctcatcttagaagctgcagatgggttcctgttcattgtgtcctgtgagacaggaagggtggtatatgtgtccgactcagttactcccgtgttgaatcagccgcaatccgagtggttcggatccacgctctatgatcaggtccacccagacgacgtggataaactgcgcgaacagctgtccacttccgaaaacgctctgactggtagaatcctcgacctgaagacaggtacagtgaaaaaggaggggcagcagtcatccatgcgtatgtgtatgggcagtcgcaggtcttttatctgtcggatgagatgcggcagctcctctgtggatcccgtctccgttaaccgactgtcgtttgtgaggaatcggtgtagaaatggcctcgggtcagtgaaggacggggagccccacttcgtagtggtgcactgtacaggctacatcaaagcatggccgcctgccggagttagtctgcccgacgacgaccccgaagcaggccaggggtccaaattttgcctcgtcgcaattggacgcctgcaggtgacctcctccccaaattgtaccgatatgtctaatgtctgccaacctaccgagttcatcagcagacacaatatagagggcatctttacttttgtcgaccacagatgtgtagcaacagttgggtaccagccacaggagttgcttgggaaaaatatcgttgaattttgtcaccccgaagaccaacaactcctcagagactcgtttcagcaggaactgtag

SEQ ID NO: 214885 - DNA, 2325 bp, Artificial Sequence
  Description of Artificial Sequence: Synthetic coding sequence
atggctgcgaccacagccaacccagagatgacatctgacgtaccttcattgggaccggctatcgcttccggcaactcaggtcccggaattcagggagggggtgcaatcgtgcaacgtgctattaaacgccgtccagggctggattttgacgacgacggggagggaaactctaagttcctgcgatgtgatgatgatcagatgagtaacgacaaagagcggttcgccagggagaaccattcagagattgagaggcgtaggcgaaacaagatgaccgcctatatcactgagctgagtgacatggtgccgacctgtagcgccctggcccgtaaacctgacaaactcacgatcctccgaatggcagtcagtcatatgaaaagcctccggggaactggtaacacgtccacggacggatcatacaagcccagctttctcacagatcaggagttgaagcacctgatcttagaggccgctgatggattcctgtttattgtcagttgcgagacaggtcgtgtcgtgtatgtctcagacagcgtgacccccgtcttaaatcaaccacaaagtgaatggttcggttctacgctctatgatcaggtgcatcccgatgacgtggacaagctgcgagagcaactgtccacctccgagaatgcactgaccggacgcatactggatctgaagacaggcaccgtcaagaaggaaggtcaacagagttcgatgcgaatgtgcatgggatctaggaggagctttatttgtcgaatgcgatgcggcagtagctctgtcgatcctgtcagcgtcaaccgcctgtcattcgtcagaaatcgctgtaggaacggccttggttctgtcaaagatggggagccacacttcgttgtcgttcattgcacagggtatattaaggcatggccacccgcaggcgtctcacttcccgatgacgatcccgaagctggacaaggctctaaattctgcctggtggccatcggtcgcctgcaggtaaccagcagccctaattgtactgacatgagtaacgtatgccagcccactgaattcatcagtaggcacaatatagagggtatatttacctttgtcgatcacaggtgtgtcgctactgttgggtatcagccacaggagctcctgggaaaaaatattgtggagttctgccatccggaagaccaacagctactcagggactcatttcagcaggtggtaaaactgaaagggcaggttctgtccgtgatgtttagattccggtctaaaaatcaggagtggctttggatgcggacttctagctttacctttcagaatccttacagcgatgagatagaatatattatttgcactaacacaaacgtaaaaaactcctctcaggagccaagaccaactttgagcaataccatccagaggccgcagcttggcccaacggccaacctgcctctggaaatggggtctggccagctcgctccaagacagcagcagcagcagaccgaattggacatggtacctggacgggacggtctcgcctcatataaccattctcaagtggtacagcctgtcaccaccactggtcctgaacattctaaaccattagagaagagtgatggtctttttgcccaggaccgagatccccgattttcagagatttaccataatataaacgcggaccagtctaagggaatttcatcatcgaccgtgccagcgactcaacagcttttctcacaaggcaatacgttccctcccacaccacgtccggcagaaaattttaggaacagcggcctagctccccctgtcactatagtgcagccaagcgcatctgccggacagatgctcgcgcagatcagtaggcatagcaaccctacccagggtgctactcccacatggactcccacgacacgttctgggttcagcgctcaacaggtagccacacaggctacagccaaaacccgtacctctcagtttggggtcggctctttccaaaccccctcctctttttcttccatgagcctgccgggagcgccaactgccagccctggggctgcggcttacccttcattaaccaatcgaggtagcaatttcgccccagagacgggccagactgctggacagtttcaaactcgcactgcagagggagttggagtgtggccccagtggcagggccaacagccacatcacagaagtagcagcagcgagcagcatgttcagcagcctccagctcagcagcctggccagcctgaagtgttccaggaaatgctttcaatgttaggagatcaatccaactcatacaataacgaggagtttcccgacctcactatgttccctccgttctccgaatag

SEQ ID NO: 214886 - DNA, 2328 bp, Artificial Sequence
  Description of Artificial Sequence: Synthetic coding sequence
atgacttccgacgtcccctctctggggcctgctatcgcttccgggaactcaggcccaggcatacagggtggcggtgccatcgtgcagcgggctatcaagaggaggcctggtttggactttgatgatgatggcgaaggcaacagcaagttcctacgctgcgatgatgatcagatgagcaacgacaaagagcgttttgcaaggagtgatgatgaacaatcttctgccgacaaagagcggctggctagggaaaaccatagtgaaatcgagagacggagacgtaataagatgactgcatatatcactgagctttcagatatggtgcccacttgctcagctctcgcacggaagccagataaactgacaatcttgcgaatggccgtaagtcacatgaaatcccttcggggaacagggaatacatccacggacggctcttataagccctcatttctgaccgaccaagagctaaaacatttgatcctggaggccgcagacggatttttgtttatcgtctcgtgtgagaccggccgagttgtgtatgtgtctgattcagttactcctgtgttaaatcagccccagtccgagtggtttggctcgacgctgtacgaccaggtccatcccgatgacgtggataaactcagggagcaattatctactagtgaaaatgcactgactggacggatactggatctgaagaccggaaccgtgaaaaaggagggacaacagagttccatgaggatgtgcatgggaagtcgcagatcctttatctgtcgaatgagatgtggttcctcaagcgtggaccccgttagcgtgaataggttgagttttgttaggaacagatgtagaaatggtctgggatccgtaaaggacggcgagcctcattttgtcgtcgtccattgcactgggtacatcaaagcatggcctcctgccgacgatgatcccgaggccggacaggggagtaagttctgccttgtcgccatcggacgcctccaggtgacaagtagtccaaactgcacggatatgagtaatgtttgccagccgaccgagttcatatcccggcataatatcgagggcatcttcacttttgttgatcaccgctgcgttgcaacagtggggtatcaacctcaggaattactgggcaaaaatatcgtcgagttttgccatcctgaggaccaacagttactgagggattcattccagcaggtggttaagctcaagggacaggtgttgtccgtgatgttcaggtttcgcagtaaaaaccaggagtggctgtggatgaggacctctagtttcaccttccaaaatccttactcggatgaaatagagtatatcatctgcacgaacacaaacgtcaaaaactcttcgcaggagccgagaccgaccttgtctaataccatccagcggcctcagcttgggcctaccgctaatttgccactcgaaatgggctccggccagctggcccctcggcagcagcagcaacagacagaactcgatatggtccctggtagggacggccttgcttcatacaatcacagtcaggttgtgcagcccgtcaccacaacagggcctgagcatagcaagcctctggaaaagtctgacggtctgttcgctcaggaccgcgatcccagatttagcgaaatatatcacaatatcaatgctgaccagtctaaggggattagctccagcactgtgcccgcaacccagcaactcttctcacaaggtaacaccttccctccgaccccacggccagcggaaaattttaggaattctggccttgccccacctgtcacaatcgtgcagcccagcgcctccgcaggccagatgcttgctcagatatccagacattccaaccccacccagggggctacaccgacatggactccgactacaaggagtggtttctctgcccagcaggtagcaacacaggcaaccgcaaagacgagaacatctcagtttggggtgggtagctttcagacacctagcagcttttcatcaatgagtcttccgggagcacctacagcctccccaggcgcagccgcttacccatctttaactaatagaggttctaatttcgccccagagacagggcagactgcgggacagtttcagactagaacagctgagggagttggggtctggcctcagtggcaagggcagcagccccatcacagaagcagtagttccgagcagcatgtccagcagcccccagcacagcaaccgggacagccggaagtctttcaggagatgttatccatgttaggtgatcagagcaacagctacaataacgaggagttccccgacctcacaatgttccctcccttctctgagtag

SEQ ID NO: 214887 - DNA, 1428 bp, Artificial Sequence
  Description of Artificial Sequence: Synthetic coding sequence
atgagcgccaccgccgctgctcggaagagaggcaaaccagcatctggagcaggtgccggagccggtgctggaaagcggaggaggaaggccgatagtgctggagataggggcaagtccaaggggggtggtaagatgaatgaagagatctcatccgactcggagagcgagagcctggcgccacggaagcccgaggaagaagaggaagaagagttggaggagactgcccaggagaagaaattgagattggctaagttgtacttggaacagcttcgccagcaggaagaagagaaggccgaggcaagggccttcgaggaggaccaggtcgccggtcggctcaaggaggacgtgctcgaacagcgaggcagacttcagaaacttgttgcaaaagagatccaggcacccgcatctgcagacatcagagtcctgcgtgggcaccagctgtccattacctgcctagtcgtgacacctgacgactccgccatattttccgcagccaaggactgcagtatcatcaaatggtcggtggaaagtggtaggaaactccacgtgatccctcgggcaaaaaaaggagcggaagggaagcctcctggccatagctcacacgtcctgtgtatggctatcagttcagacggcaaatatctggcctctggcgacaggtcaaaactgattctcatttgggaggcacagtcatgtcagcacctttacacatttactggtcacagggatgctgtttctgggcttgcttttcgacgaggtacccatcaactttactccacctcacatgacagatccgtgaaagtgtggaacgtcgctgaaaactcctacgtagaaaccctgtttggacatcaagacgctgttgccgctctcgatgcattgtcaagggagtgctgtgtcaccgccggaggcagagatggcacggttagagtttggaaaataccagaagaatcccagctggtgttttacggccatcagggatctatcgactgtattcaccttatcaacgaggaacatatggtctctggagcggatgacggcagcgtggcactatgggggctctctaaaaagaggcctctcgcgctgcagcgcgaggcccacggcctgagaggagagccaggccttgaacagcctttctggatctctagtgtagccgcactgctcaacactgatctcgtggcaacaggctcccactccagttgtgtcaggctgtggcagtgtggcgaaggatttcgccagctggatctgctttgtgatataccgctggtgggattcattaacagcttaaagtttagtagctctggcgatttcttagtcgccggagtagggcaagagcatagattaggacgttggtggcggattaaggaggctagaaattctgtctgtattatccccctgcggcgagtcccagtgccaccagcagcgggttcatag

SEQ ID NO: 214888 - DNA, 2154 bp, Artificial Sequence
  Description of Artificial Sequence: Synthetic coding sequence
atggctacacctgccgcagtcaatccgccagaaatggcctcggatattcctggcagtgtgaccctgcccgtggccccaatggccgctactggccaggtcagaatggccggagctatgccggctagaggaggcaagcggaggtccggcatggattttgacgacgaggacggcgagggtccgtctaaattttccagggagaatcactccgaaattgaacggaggcgcagaaataagatgacccagtacatcacagagctgagtgacatggtgccaacctgctccgcattggccagaaagcccgataagctcacaatcctcagaatggccgtttctcacatgaaaagtatgcgcggaacagggaacaagagcaccgacggcgcttataaaccttctttcctgaccgagcaggagctgaaacatctgatattggaagcagccgatggatttctttttgtggtggctgcagagacaggaagggtgatttatgtgtccgactccgtgacacccgtactgaatcaacctcagtccgaatggttcgggtcaacactgtatgaacaagttcaccccgacgatgtagaaaaactgagagagcagctgtgcacaagcgaaaactccatgaccggccgtattctagatcttaaaactggcactgtcaagaaggagggccagcagtccagcatgagaatgtgtatgggttcaaggaggtcttttatctgtcgtatgcggtgtggtaacgcccctcttgatcacctcccactgaacagaattaccacaatgcgcaagcggttccgcaatgggctcgggccagttaaagaaggtgaagcccagtatgcggtggtgcactgcaccggatatatcaaagcctggcctccagctggcatgacaatccccgaggaggacgccgatgtgggccaggggtcgaaatactgcttggttgcaatcggacggctccaagttacttcctcgcctgtctgcatggatatgaatgggatgtccgtccccaccgagttcctctccaggcacaattctgatgggatcattacgtttgttgacccaagatgtatctcagttataggctaccagccgcaggatttgttagggaaagacattctggaattctgccaccccgaggaccaaagccacctgagagaatctttccagcaagtggtcaaactcaaaggacaggtgttaagtgtgatgtacagattccgcacaaaaaacagggaatggatgcttattcgcacctcttctttcacattccagaacccatatagtgacgagattgaatatattatttgcactaacacaaatgttaagcagctacagcaacaacaggccgagttggaagtgcatcaacgagatggcctgtcctcctacgacctgtcccaggtgcctgtgcccaacctgcctgctggggtgcatgaagctggcaagtccgtcgaaaaggccgacgcgatctttagccaggaaagggatccaaggttcgcagaaatgttcgccggaatctctgcctccgagaaaaaaatgatgagttctgcctcggcagcagggacccagcagatttacagccagggctctccttttccctccggtcactccgggaaagccttttccagcagtgtcgtacatgtgccaggggtgaacgacatacagtccagttcaagcaccggacaaaacatgtctcaaatttctcgccagctgaatcaatcccaggtggcgtggacgggcagtcgcccaccctttcccggtcagcagatcccaagccagagcagcaaaactcagagtagtccgtttggaatcgggactagccatacgtatcccgcagacccaagtagctattcccccctgagttctcccgctactagttccccctctggcaacgcttatagcagtctggccaataggacaccaggttttgccgaatcagggcagtcatccggtcagttccaggggaggccgtcggaggtgtggagccagtggcagtctcaacaccacggacagcagtctggggagcagcactctcaccaacagccaggacaaacagaagtctttcaggatatgttacctatgcccggagacccaacacaggggacaggcaattataacatcgaggactttgcagatctcggcatgtttccccctttcagcgagtag

SEQ ID NO: 214889 - DNA, 2118 bp, Artificial Sequence
  Description of Artificial Sequence: Synthetic coding sequence
atggcaagtgacattcccggttcggtaactctgcctgtggcgcctatggcagccaccggtcaagtgcggatggcaggtgcaatgcctgctagagggggaaagagacgcagcggaatggactttgatgacgaagacggagagggaccctcaaaattttcacgagagaatcatagcgagatcgagaggcgccgtcgtaataagatgacccagtatattacagagctgtcagacatggtcccaacatgttccgcgctcgccagaaagccagacaaactcactattttgagaatggcagtcagccacatgaagtcaatgcgcggaactgggaataagtcgaccgatggagcatataaacccagcttcttaacagaacaggaactcaagcatctcattctagaagccgcagatggtttcttgtttgtggttgccgctgagactggcagggtcatctatgtgtctgactctgtgacccccgtgctaaaccagcctcaatctgagtggttcggtagcaccctctacgaacaggtgcaccctgacgatgtagaaaagcttcgtgagcaactatgtacttctgagaatagcatgactggacgaatcctagacttgaaaactggtacagtcaaaaaggaaggacagcagtcatccatgcgcatgtgcatgggttctagacgctccttcatttgtaggatgagatgtggcaatgcaccgcttgaccacctacctctgaatcgaattacaaccatgagaaaacggttccgcaatggactgggcccagtgaaagagggagaggcacagtacgcagtggtgcattgcacaggatatatcaaggcatggcctccagccggaatgacaatacctgaggaggatgcagacgtgggccagggatccaagtattgtctggtggccataggaagactgcaagttaccagctctccagtttgtatggatatgaatggtatgagcgttcctacagagttcctgagccgccataattcggacggtatcataacatttgttgatccaaggtgtatttctgtcatcggttaccagcctcaggacctcctggggaaagatatccttgaattctgccaccctgaagaccagagtcacctacgcgagtcctttcagcaagtggtcaagctcaaagggcaagtgctctccgtaatgtatcgcttcagaacgaagaaccgcgagtggatgctcattcgcacctcaagtttcactttccaaaatccctactctgatgaaattgaatacatcatatgtacaaacacaaacgtcaagcaacttcaacagcaacaagccgagttggaagtgcatcagcgagacggtctttcttcatatgatctatcgcaagtgcctgttcctaacctgcctgctggggtgcacgaagcgggaaaatctgtcgaaaaggctgatgccatctttagccaggaacgggatccaagattcgcggagatgttcgcaggcatctctgcaagtgagaagaagatgatgagttcagcatctgccgcaggcacacagcaaatctattcccagggttctccgttcccatccggacattccggaaaggccttttcttcgagcgttgtgcacgtgcccggagtaaacgacatccagtcttccagctctaccgggcagaacatgtcacaaatcagtcgccagctgaaccagtcccaagtggcctggaccgggagtaggcccccatttccgggtcagcaaatacccagtcagtcatccaaaactcagtcatctccttttggtataggtacctcacatacttaccccgcagacccttcaagttattcccctctctcgtctccggctacaagttcaccatccggaaacgcctactcctctctggccaatcgtacacctggtttcgccgaatcgggacagagcagtgggcagttccaaggacgcccatcagaggtctggtctcagtggcagagccagcaccatgggcagcaatcaggagagcagcactctcaccaacaacccggacagactgaagtatttcaggatatgctcccgatgcccggtgatccacgaaacgagtggtggtcaccccattcacgacagcattttcgtcagcccatttcatacgccaggatgtag

SEQ ID NO: 214890 - DNA, 2121 bp, Artificial Sequence
  Description of Artificial Sequence: Synthetic coding sequence
atggctagcgatattccgggatccgtgacgctgcctgtggctcccatggctgcgaccgggcaagtgcgcatggccggagcaatgcccgctagagggggaaaacggcgaagcggcatggacttcgacgacgaagatggggaaggaccctccaagtttagtagagaaaaccacagcgagatcgaaaggcggaggagaaataaaatgactcagtatattactgagttgtcagacatggtcccaacttgttccgcattagcccgaaagccggacaaactgaccatcctgcgaatggctgtctcacacatgaaaagtatgcgagggacagggaacaagagtaccgacggggcatacaagccaagtttcttgactgagcaggaacttaaacatctgatcctcgaggctgccgatgggttcctctttgtggtggctgccgaaacagggagagtcatctatgtctccgattccgttacccccgtgctgaatcagccccagagcgagtggttcggctctaccctttacgaacaggtgcaccctgacgacgtggagaaactgagagagcagctgtgcacctcagagaacagcatgaccggtaggattttagacctcaagactggcaccgttaagaaggaaggccaacaatcttctatgagaatgtgcatggggagtagacgatcatttatttgccgaatgcggtgtgggaatgcgccactggatcatctgccactgaaccggatcaccacgatgagaaagcgatttcggaacgggctcggacctgtgaaggagggggaggcccagtacgctgtggtccattgcacaggctacattaaagcctggccccctgccggtatgacaatcccggaggaggacgcggacgtgggccagggctccaagtactgcctcgtggccatcgggaggctgcaagtgacaagctctcccgtctgcatggatatgaacggcatgagtgttccaactgagtttttatccagacacaattccgacggcattattacgttcgtcgatcccaggtgtataagcgtgatcggataccagccgcaggatctcttgggaaaagatattctcgagttctgtcaccccgaagatcagtctcatttacgggagagctttcaacaggtagtcaaactaaaaggtcaggtgttaagcgtcatgtatcggtttagaacaaaaaaccgagagtggatgcttatcaggaccagttccttcacctttcagaacccgtatagtgatgagattgagtatattatctgcacgaataccaatgtgaaacagctccagcaacagcaggctgaattagaggtgcaccagcgcgatgggctcagtagctatgacttgagccaagtccctgtcccgaaccttccagctggcgttcatgaggcgggaaaatcagtcgaaaaggcggacgcaatctttagtcaagagcgcgaccccagatttgccgaaatgttcgctggaattagcgcttcagagaaaaagatgatgtccagcgcgagcgctgccggaactcagcagatctacagccagggcagcccatttccttctggccatagcggcaaggccttttcatcatcagttgtgcacgtacctggcgtgaacgacatccagtcttcttcatctacaggtcagaatatgtcgcagatctcacgccagctgaatcagtctcaggtggcttggacgggttctcgtcccccatttccaggtcagcagataccttcacagagtagtaaaactcagagcagtcccttcggaattggaactagccatacgtaccctgccgatccgagctcttattctccactgtcttcccccgctacatcctcaccttctggtaatgcctacagtagtctggccaaccggacgcccggattcgcagaatccggccagtcttctgggcagttccagggaaggccaagcgaggtctggagtcaatggcagtcacagcatcacggacagcagtctggggaacagcattctcatcaacagcccggacagaccgaagtattccaggatatgctccccatgcccggagacccaacgcagggcaccgggaactacaacatcgaagatttcgcggacttgggaatgttccccccattttcagagtag

SEQ ID NO: 214891 - DNA, 2121 bp, Artificial Sequence
  Description of Artificial Sequence: Synthetic coding sequence
atggcgtctgacatccctggttcagtgacgttacccgtggctcctatggcggcaacaggacaggtgcggatggccggtgccatgcccgctcgaggaggcaaaaggcgaagcgggatggatttcgatgatgaagacggagagggacctagcaaatttagtagagagaatcacagcgagatcgagcgcagacgcagaaacaagatgacccagtacattaccgaactttccgacatggtacccacatgtagtgcacttgctcggaaacctgacaaactgactatcctgagaatggcggtgtcccatatgaagtccatgcgagggactggaaataaaagtacggatggcgcttataagccctcctttctgaccgagcaggagctaaagcatctgatcctggaggccgctgacggatttctttttgtggtcgcggctgagaccgggagggtgatctacgtctctgattctgtcaccccagtgcttaatcaaccgcagagtgagtggttcggctcgactctatatgagcaggtgcatccagatgatgtggagaagcttcgggaacaactctgtactagcgagaattcaatgaccggacgaatcctggacctgaagaccggcaccgtgaagaaggaaggtcagcagtctagtatgaggatgtgtatgggtagtagacggtcctttatttgcagaatgagatgtggtaacgcccctctggatcacctgccactcaataggatcacgaccatgcggaagcgcttccggaatggcttaggccctgtaaaagaaggagaggcccagtacgcagtcgttcactgtaccgggtacattaaggcatggccacccgctggaatgaccattcccgaggaggacgccgacgtggggcagggatccaaatactgtctggttgctatcggcagactccaggtgacttcatcaccagtgtgcatggatatgaacggaatgtcggtgcccactgaatttttatccaggcacaattcggatgggattattacttttgtggatcctaggtgtatctcagtgatcggatatcaaccccaggacctgctcggcaaggatattctggagttctgtcatccagaggatcagagtcacctgagggagtctttccaacaggtggtcaaactcaagggacaggtcctctccgtaatgtaccgctttcggacgaaaaacagagagtggatgctgattcgcacatcaagttttacgtttcagaatccatactccgacgagatcgaatacatcatatgcaccaataccaatgtcaaacaactgcagcagcagcaggccgaactggaggtccatcaacgggacggcctgtcatcatacgatcttagtcaggtgcccgtacccaatctgcccgcaggtgtacatgaggccggaaaatccgtcgagaaagctgacgccatcttcagccaggaacgtgacccaagattcgccgaaatgtttgcaggcatctcagctagtgagaaaaaaatgatgtcctctgcctctgctgccggaacccagcagatatattcccaggggagtccttttccaagtggacactccggcaaggcgttttctagcagcgttgtgcacgtccctggcgtcaatgacatacagagttcatctagcaccggacagaatatgtcccagatttctagacagctgaaccagagtcaagtggcctggactggctcgagacctcctttccccggtcagcagattccatctcagtcttccaagacccaaagctctcctttcggaatcgggacgtcccacacgtaccccgctgacccttcaagctatagccccttaagctcacctgcgaccagcagtccctccggtaacgcctactcgtctctggctaacagaacccccggattcgctgagagcggtcagtctagcgggcaattccaaggacgcccttcagaggtatggagccagtggcaaagtcagcaccatggtcaacagagtggcgagcaacacagccaccagcaaccaggacaaaccgaggtgttccaagacatgttgccaatgcccggagaccctactcaaggaactggtaactacaacatcgaagatttcgctgacctcggtatgttccctcccttttcggagtag

SEQ ID NO: 214892 - DNA, 1701 bp, Artificial Sequence
  Description of Artificial Sequence: Synthetic coding sequence
atggccaccccagccgctgtgaacccaccagagatggcgtctgacatccctggtagtgttaccctccccgtggcgccaatggctgcgactgggcaagttcgtatggcaggagctatgccggcaagaggtggaaagcgcaggtctggtatggatttcgacgacgaggacggggaaggtcctagcaaattttcgagagaaaatcattccgagattgagcgacgacggagaaataaaatgactcagtatatcaccgagctttctgatatggtgcctacttgtagtgcacttgctcgcaagcccgacaagctaactatcctgcgcatggccgtaagccatatgaaatctatgcgcggaactgggaacaaaagcacggatggagcctacaaaccttctttcctgactgagcaggaactgaaacacttgatcctggaagctgccgatgggtttctcttcgttgtggccgctgaaacgggcagagtcatctatgtatctgatagcgtgacacctgtgctgaaccaaccacaatcggagtggtttggatccacactctatgaacaggttcacccagacgacgtggaaaagctgagggagcagctctgtacctccgaaaacagtatgacagggaggattttagacctgaagaccgggaccgttaagaaggaaggccaacagtcctccatgaggatgtgcatggggtcccgccgaagcttcatttgtcgcatgcgttgtggcaatgctcctctggatcacttgccactgaatagaatcacaacaatgcgcaagaggtttagaaatggactcgggcctgtcaaggaaggcgaagcccagtacgcggtggtgcactgtaccgggtatatcaaagcctggccccctgctgggatgacaataccagaagaagacgccgacgtgggtcagggatctaaatactgtctcgtagccatcggcagactgcaggtgacttcctcccccgtttgcatggatatgaacggaatgtcagtacctaccgagtttttgtccaggcataattctgacggtataattacttttgttgatcccagatgtatcagcgtcattgggtaccagcctcaggacttgctgggtaaagatattttggagttttgccatcccgaggaccagagccatctgcgagaatccttccagcaggtcgttaaacttaagggacaggtgctgagcgtgatgtacagattccgcaccaagaacagagaatggatgctcatccgcacgagctcctttaccttccagaacccgtattctgacgaaatcgaatacattatttgtactaataccaatgttaagcaactgcagcagcagcaggcggaattggaagttcaccagagggatggactatcctcatacgacctctcacaggtgccagtgcccaatctacctgctggagtgcacgaggcaggtaaaagcgttgaaaaggctgatgccatctttagtcaagagcgggacccaagattcgcagaaatgtttgcaggcatttcagcaagcgagaaaaaaatgatgtcatctgcgtccgccgcaggcacccagcagatttattcacaaggtagccccttcccttccggtcactccggtaaagcattttccagcagcgtggtgcatgttcctggagtcaacgacatccagagttctagtagcaccggacagaacatgagtcagatatcaggttcctag

SEQ ID NO: 214893 - DNA, 2160 bp, Artificial Sequence
  Description of Artificial Sequence: Synthetic coding sequence
atgcctagaactatgattccacctggggaatgcacgtacgctggacgaaagcgcaggagaccgctccagaaacagcggccagcagtgggcgcagagaaatccaaccctagtaaacgacaccgggaccgcttgaatgcagagttagatcaccttgccagtctcctccctttccccccagatatcatctctaaactggacaaactgagcgtactgagactctcggttagctatctccgggtgaagtcttttttccaagtggttcaagagcagtctagcagacagccagcagctggggctccatcccccggtgattcctgtccactggctggaagcgctgtgttagaggggcgattgctgctcgaaagtttaaatggatttgccttggtagtgtctgccgaaggaaccatattttacgcctcagctacgatcgtagactatctcggcttccaccagactgacgttatgcatcagaatatttacgattacattcatgttgatgacaggcaagacttttgtcggcagctccattgggccatggaccctccccaagtcgtctttggccagcccccacctctggagaccggggatgacgctattttgggcaggctgcttagggcacaagagtgggggacagggactccaaccgaatactctgcttttctgacgcggtgcttcatttgccgagtaagatgtctgcttgactctacgtcaggattcctcgccagagggtcccaggcctggcaattaaggctgtgctgtcccgagcctctgatgacgatgcagtttcagggcaagttgaagttcctgttcggccagaaaaagaaggcaccaagtggtgccatgcttccaccgcgtttgagccttttctgcattgcagcgccagtcctgctgccgtctgcggctgagatgaaaatgcggagcgcactgctccgtgccaaaccacgagcagacacagccgcaactgcagacgcaaaggtgaaggcgactacatccctttgcgagtccgaattgcacggaaaacctaattactcagctggcaggtcctccagagagtcgggtgtcttagtcctgcgagagcaaaccgatgccggacgatgggcccaagtccctgcgagggctccctgcctttgtttaagaggcggacccgatctagtcctggatcctaagggaggttcaggagacagggaggaagagcaacatcgaatgctctcaagagccagtggggttacaggaagacgagaaacaccgggtcctacaaagcccctgccctggacagccggtaagcacagcgaagacggcgctcgtcctcgacttcagccgagtaagaatgatcctccaagcctccgcccaatgccacgaggctcctgtttgccttgcccctgtgtgcaggggacctttcgaaactctcctatctcacacccaccttctcccagtcccagcgcctactcctcaagaacctctcgccctatgcgcgacgttggcgaggaccaggtacatcctccactctgccactttccgcagagaagccttcaacatcagctgccccagcccggagcgcagcgttttgccacccgcggttatccaatggaagatatgaagctgcagggtgtccccatgccaccaggcgacctgtgtggccctaccctcctgctcgatgtgtcgataaagatggaaaaagatagtggatgtgagggggcagccgacggctgcgtgccctcccaggtgtggttgggtgcctccgacaggtcgcacccagcgacattccctactaggatgcacctgaaaacagagcccgatagccggcagcaggtgtatattagtcacctaggccatggagtaagaggagcccagccccatggacgggcaaccgcaggcagatctcgcgagctcacaccatttcaccctgctcattgcgcctgtctagaacccacagatgggctgccacagtcagagccccctcatcagctgtgcgccaggggaagaggggaacagtcttgtacctgtagagctgcggaagctgcacctgtggtcaaacgcgagcccctggacagccctcagtgggccactcactcacagggaatggtgcctgggatgctgccaaagtcagccctggcaaccctagtgccaccacaggcttctggctgtaccttcctgccttag

SEQ ID NO: 214894 - DNA, 2106 bp, Artificial Sequence
  Description of Artificial Sequence: Synthetic coding sequence
atgccacgaacaatgatcccccctggagagtgtacttacgctggcagaaaacgtagacgcccactccaaaagcaacgtcccgctgttggtgcagaaaaaagcaatccatcaaagagacacagagacaggctgaacgcagagctcgatcatctcgcatctttgctgccttttcccccagatattattagtaagctcgataaactatccgtgttgaggttgtccgtaagctacctgcgcgttaagagctttttccaggtcgtgcaggaacagtcgtcccgccagcctgctgctggggcaccatctcccggagatagttgtcctctggcaggaagcgcggtactggaaggtaggctgctgctggagagcttgaacggctttgcactggtggtttccgcggagggcacgatattttacgccagcgccactatcgtggactatctgggcttccaccaaacggatgtgatgcaccaaaatatttatgattacatccatgtggacgacagacaggacttttgccggcaactgcactgggccatggaccctccacaggtggtgtttggccagcctcccccactcgaaaccggcgacgatgccatcctgggacgacttcttagggcccaggagtggggtactgggactcctactgaatattcagccttcctgacacgatgtttcatctgtagagtgagatgcctgttggactccacaagcggcttcctgactatgcagttccagggcaaattgaaattcctcttcggccagaagaaaaaagctcctagcggagccatgttgccaccacggctgagtttgttttgcatcgccgcacccgttttgctgccctctgcagctgaaatgaaaatgcggtcagctttgctccgagcaaagccccgtgctgacacagccgcaactgctgatgccaaggttaaggcaaccacttctttgtgcgaatccgaactgcatggaaaacctaactacagcgctgggagatcttccagagagtcaggggtcctcgtgttgcgcgagcagaccgacgcgggaagatgggctcaggtccctgctcgtgcgccatgtttgtgcttgagggggggtccagatctcgtgctggacccgaagggagggtctggggacagagaagaggagcagcatcgtatgttgagcagagcatctggcgtaaccgggagacgcgagaccccgggtcccactaagcctctgccctggaccgccggaaaacactctgaggacggagcacgccctaggttgcaacctagcaagaacgatccaccatctctgcgccctatgccacgcggttcttgcctaccatgtccttgcgttcagggaacatttaggaacagtcctatttcccatcctccttcaccaagtccgtccgcctattcatctagaacctccagacccatgagggacgtgggagaagaccaagtgcatcccccactgtgtcatttcccgcaaaggtccctccagcaccagctgccccagccaggtgcgcagaggtttgctacaagaggctaccctatggaggatatgaagctgcagggtgtgcctatgccccctggcgatctgtgcggacctacactgttactggacgtctcaatcaagatggagaaggattctggatgtgagggcgcagcggacgggtgtgtcccctcccaagtatggttgggagcgagtgataggagccatccagctaccttccccacccggatgcatctgaagactgaacccgatagtagacaacaggtttacatctcccacttgggacacggtgtgcgcggagctcaaccccacggtcgagcgaccgccggacgtagtcgtgagctcacaccattccaccctgcgcactgtgcctgtttggagccaaccgacggactgcctcaatccgagccaccacatcagctgtgtgccagggggaggggtgaacagtcctgtacctgtagggcagccgaggcagcacccgtggtgaagcgagagcctctagactctcctcagtgggctactcactcccagggcatggtgcccggtatgctgccaaagagtgctctcgccacccttgttcccccacaggcgtcagggtgtaccttcttgccttag

SEQ ID NO: 214895 - DNA, 2205 bp, Artificial Sequence
  Description of Artificial Sequence: Synthetic coding sequence
atgtctggattcgacgatccagggattttttattctgactcctttggcggtgatgcccaagctgatgaaggccaagcaaggaagtcacagttgcagaggcgatttaaggagtttctccggcagtatagggtcgggaccgaccgaactgggttcaccttcaaatatcgagatgagttgaagcgccattacaacttaggggagtactggatagaagtggaaatggaagacctcgcctcctttgatgaggatctcgctgactacctctacaagcagccagccgagcacctgcagctgcttgaggaggcagcaaaggaagtggcagacgaagtgactaggccgagaccctcaggagaggaagtcctgcaagatatccaggtcatgctgaagtccgatgcatcgccctccagcattagatcactaaaatccgacatgatgtctcatctggtgaagatccccggaatcatcatagccgcatcagctgtcagggccaaggctactagaatttctattcagtgcaggtcttgtaggaataccctcactaatatcgctatgcgccctggtctggaagggtacgcgttacccaggaaatgtaacacggatcaggctgggagaccaaagtgcccccttgatccttacttcatcatgccagacaagtgcaaatgcgtggacttccagacccttaaattgcaagagctcccagatgctgtgccacatggcgaaatgccacggcacatgcagctgtactgtgacagatatctgtgcgacaaggtcgtgcccggaaacagagttactatcatgggcatttactctattaaaaagttcggtttgactacttctcgtggccgagatcgcgtcggggtcgggattcggtcgtcatacattcgcgttctggggatacaggtcgataccgacggctccggacgcagttttgccggagctgtgtccccacaggaggaggaggagttccgtcgattggcggcattaccaaatgtgtacgaagtgattagcaagtctatcgcgccttccatttttggcggaaccgatatgaaaaaagccattgcgtgtctgttgttcggcggatcaaggaagcggctacccgacggcctgaccaggcgaggagacatcaacctgctcatgttgggcgaccccggtactgctaagagtcaactactcaagttcgtggagaagtgcagtcctattggcgtgtatacatccgggaaaggatcttctgccgctggcctgaccgcatccgtaatgcgtgatccctcctccaggaattttattatggaaggcggagcgatggttttagctgatggaggagtcgtttgcatagatgagttcgataagatgagagaagacgacagagtggctatccatgaggccatggaacagcagacaatttctatcgcaaaagccggtatcacaaccactctaaattcccgatgctcagtgttggcggctgccaacagtgtgttcggccgttgggatgagaccaaaggtgaggacaacattgacttcatgcccacaattctctccaggtttgatatgattttcatcgtaaaagatgaacataacgaggagagggacgtgatgctagctaagcatgtaatcacattacatgtgagcgctcttactcaaacacaggccgtggaaggagagatcgatttggctaaacttaagaagtttatcgcatactgtagggtgaagtgtgggccacggctatctgccgaggcagctgaaaaattgaaaaatagatacatcatcatgcgatccggcgctagacagcatgaaagagacagcgacaggagaagctccattcccattactgtgagacagctggaagccattgtccggattgccgaagccttgtccaagatgaaactccaaccctttgcaacagaagctgacgtggaggaggcactccggctgttccaggtctctactctggatgctgcgctttcaggaaccctttcaggcgtggagggctttacatcccaggaggaccaggagatgctcagtaggatcgaaaagcagttgaaacgacgttttgcaattgggtcacaggtgtcggagcactctattatcaaggatttcactaagcagaaatacccagagcatgctattcacaaggtgctacaactgatgctccgcaggggcgagatccagcatcggatgcagagaaaggttctgtaccggctcaagtag

SEQ ID NO: 214896 - DNA, 1530 bp, Artificial Sequence
  Description of Artificial Sequence: Synthetic coding sequence
atgtcgatgggcgctccgagatcattactcttggcacttgcggcagggctggccgtggctagaccccctaacatcgttctcatcttcgccgatgatttaggatatggcgatctcggctgttacgggcatccatcttccacaactccaaacctcgatcagctggcagcaggaggacttagattcaccgatttttatgtccctgtgagcttgtgtaccccttcgcgtgcagctctgcttaccgggagactccctgtccgaatgggaatgtatcctggcgtgctggtgccaagctcacgcggagggcttcctctcgaagaggtgacggtagcagaggtgttggccgcacgaggatacctaacggggatggccggaaagtggcatctaggtgtggggcctgaaggggcttttctgccgcctcaccaggggttccatagatttctgggtataccttattcccacgatcagggaccctgtcaaaacttaacttgcttcccacctgcaacaccgtgcgatggtggctgcgatcaagggctggtgcctatcccactccttgctaatcttagcgtggaggctcagcctccatggttgccaggattggaggcacgatacatggcattcgcgcatgatttaatggcagatgcccagagacaggacagaccatttttcctctattatgccagtcaccacacacattaccctcagttttctggacaaagtttcgcagagaggtccgggagggggccattcggagactcgttgatggagctcgatgctgcagtcggtacccttatgacagcgatcggcgatctaggccttctggaggagacactggttatcttcactgccgataatggccctgagaccatgcgaatgtctagagggggttgttccgggctgttgagatgcgggaaaggcacaacatatgaaggaggggtcagggaacctgcccttgccttttggcctggccacatcgcccctggggtgacacacgaattagcttccagtctggacctgctccctactcttgctgctcttgctggtgcccctctgcccaacgtcactcttgacggatttgatctcagccccctcctcctaggcacgggaaaatcaccgagacagtccctcttcttttatccatcttatcctgacgaagtccggggtgtgttcgctgtccggaccggaaaatataaggcccatttcttcacgcagggcagcgctcattctgatacgaccgctgatccagcctgtcacgcctcttcgtcactgactgctcacgaacctccactgctttacgacctgtccaaggacccaggcgagaactataacctgctcggaggggtagctggcgctaccccagaggtgttgcaggcattgaagcagcttcagctgctgaaggcacagttggacgccgcagtcactttcggcccttcccaggtggccaggggggaagatcctgcgctacagatctgctgccatccgggatgcaccccacggcctgcttgctgtcactgccccgacccccacgcctag

SEQ ID NO: 214897 - DNA, 1530 bp, Artificial Sequence
  Description of Artificial Sequence: Synthetic coding sequence
atgagcatgggcgctcccagatctctgctgctggccctggcagccggtctggctgttgcccgaccacccaacattgtgttaatattcgccgatgacctggggtatggggacctgggctgctatgggcaccctagttccaccacccccaacctggaccaactcgccgcaggaggcttgcgctttaccgatttttatgtgccagtatctttgtgtacccccagcagagccgcattgttaacgggacgtctcccagttaggatgggaatgtacccgggagtgctcgttccttctagtagaggcggattacctctcgaagaggtcaccgtcgccgaagtcctcgcagccaggggatacctcaccggtatggcgggaaaatggcacctgggggtcggccctgagggagcgttccttcccccacatcaggggtttcataggttcctgggcataccctatagccacgaccaaggaccatgccagaacctgacatgcttccctcctgctaccccctgcgatggcggatgtgatcaagggcttgtccctattcccctgttagctaacttatccgtcgaggcacagcccccttggctccccggtctggaggctcgctatatggcgtttgcccacgatctgatggcagacgcacaacggcaggataggcctttcttcctgtactacgcatcacaccacacccattacccacagtttagcgggcagagtttcgcagaacgttcaggcagaggacctttcggcgatagtttgatggagctggacgctgccgtgggtacactaatgactgccattggcgacctgggattactggaagaaaccctagttatatttaccgctgacaatggaccagaaactatgaggatgtcacggggtggctgtagcggtttgttgagatgtggcaaaggaacaacatacgaaggtggcgtccgcgagcccgctcttgctttctggccgggtcacattgccccaggagttacccatgagctcgcttcttctctggacctcttgcccaccctcgccgcactcgccggagcgccactgcccaacgtcaccctggatgggtttgacctctccccccttctgctgggcactggaaagtcccctaggcagtccttgttcttttatccttcgtacccagatgaagtgcgaggagtgtttgcagtaaggaccggtaagtacaaggcccactttttcacccaggggtctgcccattccgacaccaccgcagaccctgcctgccacgcctcctcatccctgactgctcacgaaccgccactgctatacgatctgagtaaggaccctggcgaaaactataatctacttggcggagttgcaggagctacccccgaggtgctgcaagccctgaaacaactacagttactcaaggcacagctggacgccgctgttactttcggaccaagtcaagtagccaggggtgaggaccccgcactgcagatctgctgccatcccggatgcacccccaggccagcctgttgtcactgcccagatcctcacgcctag

SEQ ID NO: 214898 - DNA, 1530 bp, Artificial Sequence
  Description of Artificial Sequence: Synthetic coding sequence
atgtctatgggagcacctcgcagcctgcttctggccctggccgctgggctggcggtcgctcgccctcctaacattgttctgatttttgccgatgacctaggctacggagacctagggtgctacggccacccaagctcgactacacccaatctggatcaactcgctgccggtggactccggttcactgacttctatgtgccagtgtcactctgtacaccttccagagctgcccttctgacgggtcgattgcccgtgaggatgggaatgtatccaggggtccttgtgccttcctcccgtggcggattaccacttgaggaggtaacagtggcagaggttctggcagcaagagggtacctgaccggcatggcaggcaaatggcatcttggggtgggcccagaaggagcattcctccctccgcaccagggcttccatagattcctggggatcccctactcacacgatcaaggaccatgtcagaatctgacttgttttcccccagccaccccctgtgacggaggatgcgaccagggcctggtaccgatcccgctgctcgcaaatttgtccgtggaagcccaaccaccttggctgcctgggcttgaggcccgatatatggcgtttgcgcacgatctcatggcggatgcacagcggcaggatagacccttctttttgtattatgcatcccaccacacccactacccacaattctcaggtcagtcgtttgccgagaggagtggcagaggcccttttggtgactccttgatggaactcgacgccgcagttggaactctgatgaccgcaataggagacctgggtctcctggaggagactctggtgatctttacagccgataatggccctgagactatgagaatgtctagaggcggatgctcaggcctgttgcgctgtgggaagggcacaacttatgaggggggagtgcgggaaccagccctggccttctggcctggccacattgccccaggagtaactcatgaactcgcttctagcctggatctcctgcccaccctcgcggcactagctggcgcacccctgccaaacgtcactctggacggctttgacctgtccccactactgctaggcacaggaaagagcccgcgacagtccctgtttttttacccaagctatccagatgaggtgaggggagtgttcgcagtcagaacgggaaagtataaggcccacttcttcacccagggatctgcacatagtgatacgactgcagatccagcctgccatgcctccagttcacttaccgcgcacgagcccccattgctgtatgatctctcgaaagacccaggcgagaattataatctcctcggtggcgttgcaggggcaactcccgaagttttgcaggctctcaagcaactccaactcctgaaggctcagctggacgctgcggtgacgttcggtccatctcaggtcgcaaggggggaggaccccgctctccagatctgctgtcatcccggatgcacaccacgaccagcatgctgtcattgccccgacccccacgcctag

SEQ ID NO: 214899 - DNA, 1272 bp, Artificial Sequence
  Description of Artificial Sequence: Synthetic coding sequence
atgggcatgtacccgggagtcttagtaccctcaagcaggggaggacttccgctggaggaagtgaccgtagcggaggtgttggctgcccgtggatacttaacaggaatggctggcaagtggcacctgggagttggccctgagggagcttttctgcctccgcaccaaggttttcataggttcctggggatcccctatagccatgatcaaggaccctgtcagaatctgacctgctttccccctgcaactccctgtgatggcggatgcgaccaggggcttgttccgattcctctgctcgccaacctgtcagtggaagcacagcccccttggctaccgggattggaggcgaggtacatggccttcgcgcatgacctaatggcagacgcgcaacgtcaggatagacctttcttcctgtactacgcctcccaccacactcactaccctcagttcagtgggcagtcttttgccgaacggagtgggcgtggcccattcggcgatagcctcatggaattggatgctgccgttggtaccctcatgacagctatcggagatctgggacttttggaggaaacgttggttatctttaccgcagacaatggcccagagacaatgagaatgtcaaggggtgggtgctctggcctgctcagatgcgggaaagggactacttacgaaggtggagtacgtgaaccagcactggcgttttggcctggccacatcgcgcctggtgtgacacacgaactggcctctagtctcgatctactgcccactctggccgcactcgccggtgctcccctgcccaacgtcaccctagatggctttgatctcagccctttgctgctcggcaccggaaagagccccagacagtccctctttttctacccaagttacccagatgaagtgagaggagtgtttgccgtgcgaacaggcaagtacaaggcgcacttcttcacccaagggagcgcccacagtgacacaaccgctgaccccgcatgccacgcttcatcttctctgaccgctcatgagcccccattgctgtacgaccttagtaaagatcccggtgagaattataacttgctcggtggcgtagctggggctactcctgaggtgctgcaggcgttgaaacagctccagttgctgaaggcccagctagatgccgctgtcacgttcggtcccagccaagtcgctagaggggaggacccagctcttcagatttgttgtcatcccggatgtactccaaggcctgcttgttgtcattgcccagatccacacgcatag

SEQ ID NO: 214900 - DNA, 1524 bp, Artificial Sequence
  Description of Artificial Sequence: Synthetic coding sequence
atgggcgctcccaggtctcttctgctggctctcgctgcaggcttggccgtcgccaggcctccgaatattgtgctgattttcgcagacgacctcggatatggagatctgggctgttacgggcatccctcaagcactaccccaaatctcgatcaattggctgctggaggcctgaggttcaccgacttttacgttcctgtgtccttgtgtaccccctcccgggctgccctgctgactggtcgactcccagtacggatgggaatgtaccccggagtcctcgtcccatcaagcagaggaggtctgcccctcgaggaggtaactgtggcagaggtcctcgcagcgaggggctacttgactggcatggccggtaagtggcatcttggggtaggccctgagggcgctttcctaccgcctcatcagggcttccacagattccttgggattccttactctcacgatcaaggcccttgtcagaatctcacatgcttcccccctgctaccccctgcgacggaggttgcgaccagggactggtgccgatccctctgctcgcaaacctgagcgtcgaagcacagcccccttggctacctggtttggaagctcggtacatggctttcgcacacgatttgatggctgatgcccaacgccaggaccgtcccttcttcctctattacgcctcacaccacactcattatccccagttctcagggcagagtttcgccgagaggtccggtcgaggcccttttggcgattcgctcatggaattagacgcagccgtgggtacattaatgaccgccataggcgacctggggctactcgaggagacattggtcatctttactgctgacaacggacccgaaactatgcggatgagccgcggaggctgctctggactcctaagatgcggcaagggaacgacatacgaagggggtgtccgcgagccagccctcgccttctggccaggccacatcgcccctggggtcactcacgaactggcatcatctctggaccttctgcctactctggcagcgcttgcgggtgctcctctgcccaatgtcaccctggatgggtttgacttgtcccccctgctgttaggaaccgggaagtctcctcgccaaagtctctttttctatccatcctacccagacgaagttaggggcgtgttcgccgtgcggactgggaagtataaagcccacttcttcacccagggctccgcacactccgacacaacagctgacccggcatgtcacgcctcctcaagtttaacagctcatgaacctcccctgctgtacgacttgtccaaagatcctggtgaaaattacaatttgctgggaggcgtggcaggcgctacacctgaagttctgcaagctctgaaacagttgcagctgcttaaggcccagctggacgccgcagttacgtttggcccttcacaggtggctcggggtgaagaccccgcattgcaaatctgttgccatccaggttgtacccccagacccgcatgttgtcattgccccgatccccacgcatag

SEQ ID NO: 214901 - DNA, 1524 bp, Artificial Sequence
  Description of Artificial Sequence: Synthetic coding sequence
atgggtgcaccgcgatccttattgctagccctcgctgctggacttgcagtggcccgtcctcccaatattgttcttatatttgccgatgatctgggctatggcgatctgggctgttatgggcatccttccagtactacccctaaccttgaccagttggcagcaggaggcctgagattcactgatttctacgtgccagtctctctatgcaccccctctagggcagcattattaacaggtaggctccctgttcggatgggcatgtatcctggagttctggttccctcatccaggggaggactgccactcgaagaggtgactgtggctgaggtacttgccgctcgcggatacctaacgggcatggcaggaaaatggcaccttggcgttggtcctgaaggtgctttcttgcctccacaccagggctttcacagattccttgggattccatattcgcacgatcagggaccgtgtcaaaatctcacatgttttcctccagctactccttgcgacggagggtgcgaccaagggctggtgcccattccactcctcgctaatctctcagtggaggcccaaccaccctggctgccgggactggaggccaggtacatggcttttgctcacgacctgatggccgatgcacagcggcaggaccgaccatttttcctctactacgcttcccaccacactcattatcctcaattttctggccaatccttcgctgagcgaagtggaaggggaccctttggggattcgcttatggaactcgacgctgcagtgggcacactgatgactgctattggggatttgggtttactggaagagactctcgtgatcttcactgcagacaatggtcccgagaccatgcggatgtcacgcggtgggtgttctggcctccttcggtgtggcaaagggactacatacgagggcggagtgagggagcctgcattggctttctggccagggcatatcgcacccggagtcactcacgaacttgctagctctttggatctgttgcccacgctcgcagcccttgctggagccccactgccaaatgttaccctggacgggtttgatctgagcccacttctacttggcacaggcaagtcccccaggcaaagtctgtttttctacccgtcttaccccgacgaggtcaggggggtgttcgccgtgcgcaccggcaaatataaggcccacttctttacccaagggtcagcccactctgacactacagctgatccagcgtgccacgcaagcagttcgttaacagcacacgagccacccttattgtacgatttgtccaaagacccgggagagaactacaacctgctaggcggtgtggccggagctaccccagaggtgctccaggccctcaagcagttgcagctgctcaaggcccaactggacgccgctgtaaccttcggcccatcccaagtagccagaggcgaagatcccgctctccagatatgttgccatccgggttgtaccccccgacccgcttgttgccactgtccagatccccacgcctag

SEQ ID NO: 214902 - DNA, 1782 bp, Artificial Sequence
  Description of Artificial Sequence: Synthetic coding sequence
atgcgatccgcggcacggagaggccgtgctgcccctgccgctcgcgactctctccctgttctgttgtttctgtgcttgttgctaaagacctgtgagcccaagacagccaatgctttcaagcctaacattctgctgatcatggccgacgatttaggcaccggagatttagggtgctacggaaataatactctacgaacaccaaatatcgaccagcttgctgaggagggggtcagacttacacaacatttggccgctgcgccactgtgcacaccaagccgagccgcatttctgactggacggcatagctttcgatctggcatggacgctagtaatggctatcgcgctctgcagtggaatgcaggatccggcggactgcccgagaatgaaacaacgtttgcccgtatcctccagcagcacggttacgcgacggggctcattggtaaatggcaccagggcgtaaattgcgcgtcgaggggtgaccactgccatcatccactcaaccacgggtttgactacttttatggcatgcctttcacgcttacaaatgactgcgatcctggccgaccacccgaggttgacgctgcactgagagcccaactctggggctatacccagttcctcgccctggggatcctgaccttagcagccggacaaacatgtgggttcttctctgtctctgctcgcgctgtgactggcatggcgggtgtgggatgcctcttctttatctcttggtatagctcctttggatttgtgaggagatggaattgcatcctgatgcgcaatcatgacgtgacagagcagccaatggtgctcgaaaagacagcctccctgatgctgaaggaggcggtatcctatattgagaggcataagcatggtccttttctcctgtttctgagcctgcttcacgtacacataccccttgttactacttctgcattcctgggaaagtcccaacacggactgtatggcgataatgtggaggagatggattggctgatcggtaaagtgctgaatgcgatcgaggacaacggcctaaaaaatagtacgttcacatactttacctcggatcatgggggacacctggaggccagagatggccactcacaactgggaggctggaatggaatctataagggtgggaaaggaatgggcggttgggaaggcggtattcgtgtcccaggaatatttcactggcctggtgtgctgcccgcaggcagagtaattggcgagccaacatcattgatggacgttttcccaactgtggtccaactcgtcggtggtgaagtgccgcaagaccgggtaattgatggccactcccttgtgcctttactgcagggagcagaggcacggagtgcacacgaatttctgttccattactgcggacaacacctgcacgcagccagatggcaccagaaagactctggctcagtgtggaaagtccactacacaactcctcagttccacccagagggtgccggagcctgctacgggaggggcgtttgcccatgtagtggcgaaggtgttacccatcaccgaccccctcttctctttgatctatcgcgagatccttctgaggctcgtccgctgactcctgattccgaacccctctatcatgcggttattgcgagggtaggggcagcagtgtcagagcaccggcagactctgagccctgtgccccagcagtttagcatgtccaacatactctggaagccctggctacagccatgctgcggccacttccccttctgcagctgccatgaggatggcgacggcaccccttag

SEQ ID NO: 214903 - DNA, 1770 bp, Artificial Sequence
  Description of Artificial Sequence: Synthetic coding sequence
atgctccacttgcaccactcctgtctgtgctttaggtcctggctacccgctatgctagccgtcctgctgagcctcgccccaagtgcctcctctgatatctccgccagccgcccaaatatcctccttttgatggctgatgacttgggaatcggagatattgggtgctacgggaacaacaccatgagaactccaaatatcgaccggctcgccgaagatggggtaaagctgactcaacacatctccgcggcaagcctgtgtactccgtcaagggcagcattcctgacaggcaggtaccctgtacggtctggcatggtcagctccatcggttatagggtgctgcagtggacaggggcaagtggcggacttcccacgaacgagacgacattcgccaagattctaaaagagaaagggtacgcaaccggtctcattggtaaatggcatctcgggctcaattgcgaatccgcttcagatcattgccatcaccctctccaccacggtttcgaccacttttacggcatgccattttccttaatgggcgattgcgccagatgggaactctcagagaagagagtaaatctagaacagaaactgaacttccttttccaggtgctggcccttgtggcccttactctggttgcaggcaagcttacacacctgattcccgtgtcttggatgcctgtcatctggtccgccttgtctgccgtactgctgctggcatctagctacttcgtcggcgcattgattgtccatgccgactgcttcctgatgcgcaatcataccataaccgagcagcccatgtgttttcagaggactacgcccctgatactgcaggaggtagcgtcctttttaaagcgcaataagcatgggccatttctccttttcgtgagtttcttgcatgtgcatatacccctaatcactatggaaaatttccttggcaagtcattacacgggctgtacggggataatgtcgaggaaatggactggatggtgggtagaattttggacaccctggacgtcgaggggctttccaactccaccctcatatatttcactagcgaccacgggggatcactcgagaatcagttgggcaatactcaatacggcggttggaacggtatttacaagggcggtaaaggtatgggagggtgggagggtgggattagggttcccggaatcttccggtggcccggagtgctgccagccggaagggtgattggcgaaccaacctccctcatggatgtctttcctacggtggtacgcctggccggtggggaggtccctcaagacagagtgatcgacggacaagatttgctgcctctactgttaggcacagcccaacactctgaccacgaattccttatgcattattgcgaacggttcctgcacgctgcccgatggcaccaaagagacaggggcaccatgtggaaggtccatttcgtaacccctgtgtttcaaccagaaggagccggagcatgctatggccgtaaagtgtgcccatgtttcggagagaaggtcgtgcatcacgaccctccgctgctcttcgatctgtcacgcgatccctccgaaactcatattctcacaccggcatctgagcccgttttttatcaggtcatggaaagagtgcagcaggctgtgtgggagcatcagcggacattatcaccagtgcccctgcaactcgaccgtctgggaaatatctggagaccatggctacaaccatgctgtggcccttttcccctgtgttggtgcctacgcgaggacgatccacagtag

SEQ ID NO: 214904 - DNA, 537 bp, Artificial Sequence
  Description of Artificial Sequence: Synthetic coding sequence
atgctccacctacaccactcttgcctgtgtttccgtagctggctgcccgctatgttggccgtgcttttgtcacttgcacccagcgcctccagtgacatctccgcctcccggccaaacattctgcttctcatggccgacgatctgggaataggagatataggttgctacggtaacaacacaatgcggacgccaaatattgataggcttgccgaggatggggtcaaacttacccagcatatcagcgctgccagcctttgtacaccaagccgcgcagcgttcttgacgggaaggtaccccgttcggtccggcatggttagctcaatcggatatagggtcttgcagtggacgggcgctagcgggggactccctacaaacgaaactaccttcgccaagatcctaaaagagaagggttacgccaccggactgattgggaaatggcacttgggcctgaactgcgaatccgcctccgaccattgccaccaccctctgcatcatggattcgatcacttttatggcatgcccttctctctgatgtag

SEQ ID NO: 214905 - DNA, 1635 bp, Artificial Sequence
  Description of Artificial Sequence: Synthetic coding sequence
atgagcggatcaagagagcgagacaacatgctgcacttgcaccactcgtggaccccaaacatcgatcgactggccgaggatggtgtcaaacttacccagcacatttctgcagctagtctttgcaccccgagccgcgctgcattcctgaccggaaggtatccagtgaggtcaggaatggtcagtagcatcggttatagagtgctccagtggaccggcgcttcgggcggtctgccaactaatgagactaccttcgctaagatcttgaaagagaaaggatatgccaccggactgatcgggaaatggcaccttggacttaactgcgaatcagcatctgatcactgtcaccaccctctacaccacggcttcgaccatttttatggaatgccattctctctgatgggagattgcgccagatgggagctgtctgagaagcgcgtaaatcttgaacagaaattaaactttctgtttcaggtgttggctttggttgctctcaccctggtagccggtaaattaactcaccttatccccgtatcctggatgccagtcatatggtccgcactaagcgccgttctgctgctggcgtcctcttattttgtcggcgcattgattgtgcatgccgactgctttctgatgagaaaccacacaataaccgagcagcccatgtgctttcagcgaactaccccactgatcctccaagaagttgcttcatttctcaagcgcaacaagcatgggccttttctgttattcgtctcctttctacacgtgcatatccctcttattacaatggaaaactttcttggcaagtctctccatggtttatacggagacaacgttgaagaaatggattggatggtcggaagaattctggatactcttgatgtggaaggcttatccaatagtaccttaatatatttcacctcagatcacggcggtagcctggaaaaccagcttggaaatactcagtacggaggctggaacggtatttacaaaggcggaaaagggatgggcggatgggaaggtgggattcgagtcccgggtatattccgctggccgggagtgctacccgctggtagggtcattggtgaacctaccagcttaatggacgtgtttccaaccgtagtgagacttgccggaggggaggtcccacaggaccgtgttatcgacgggcaggacctattgcctctcctgctcgggacagctcagcattctgatcatgaattcttaatgcattactgcgaaagattcctccacgccgcaagatggcatcaaagagacaggggcaccatgtggaaggtgcacttcgtaacgccagtattccagcccgaaggcgcaggggcatgttacggcagaaaggtatgtccctgcttcggcgagaaagtggtgcaccacgatcctcctctcctgttcgatctctctagggatccgagtgaaactcatatacttactcctgcgagcgaaccagtgttttatcaggtcatggaaagggttcaacaggctgtttgggaacatcaaaggaccctgtctccagttccacttcaactggacaggcttggaaacatatggcgcccatggctccaaccttgttgtgggcctttcccactgtgctggtgcctgcgggaggatgatcctcagtag

SEQ ID NO: 214906 - DNA, 1845 bp, Artificial Sequence
  Description of Artificial Sequence: Synthetic coding sequence
atgcggcctgttataaatagatgtgcccctggtagcctagacctaatgcttccacaggcagctagcgagggtatcgtctttcacagtctgcagatttccctgtgctttcgctcatggctcccagctatgctggccgtgctcttgtccttggcccctagcgccagctccgatatcagtgcttcgaggcctaacattcttctgcttatggcagacgatttagggatcggtgacatcggttgctacggcaacaacacaatgcgtacacctaatattgacagactcgccgaagacggcgtaaaacttacacagcatatcagcgctgcctctctatgcacgccatccagggcagcctttctaactgggagataccccgtccgctctggaatggtctcctcaattggctatcgtgtacttcagtggactggcgctagtgggggactcccaacgaacgagacaactttcgctaagatcctcaaggagaagggatatgctaccggcctgataggcaagtggcacctcgggctcaactgtgagagtgcctccgatcactgtcaccaccctctccatcatgggtttgaccacttctatgggatgcccttctctctgatgggagactgtgcacgatgggagttatcggagaaacgcgtgaatctggaacagaagctgaacttcctttttcaggtgcttgcactggtggcactcactcttgttgcgggaaagctgactcacctgatccccgtgtcatggatgcccgtgatctggtcagcgttgagcgccgtcctgctgctcgcttcatcgtattttgtcggcgctctgatcgtccatgcggactgttttttaatgaggaaccatactatcactgagcagccaatgtgcttccagagaactaccccattgatcttgcaggaggtggcgtcttttctcaagaggaataagcatggacccttcctgttattcgtgagcttccttcatgtgcacataccactgattactatggagaattttttgggcaaaagtctgcacggtctgtatggcgataacgtggaagagatggattggatggtaggtcgaattttggacacactagatgttgagggcctgagcaattccaccctcatctacttcacaagcgatcatggcggaagcctggagaaccagttaggcaacactcagtacgggggttggaacggaatctataaaggaggaaagggcatgggcggatgggagggcggaattcgagttcccggaatctttcgctggcctggagtgctgccggctgggagggtcatcggggaacccacctcgctgatggatgtttttcctactgtggtccgactcgccggaggcgaagtcccacaggacagagtcatcgacggccaggacctactgccccttttactcggcacggcccaacattctgaccatgagttcctgatgcattattgtgaaaggttcctccacgctgccaggtggcaccagcgagataggggcaccatgtggaaggtgcattttgtgacgccagtgtttcaacctgagggagcgggagcgtgttacggcagaaaggtgtgcccctgctttggggagaaggtagtgcaccacgatcccccattgctcttcgacctgtcccgcgacccctcagagacccacatcctgactccagcttccgaaccagttttttaccaggttatggaacgcgttcagcaggcggtctgggagcaccagcgtacactcagccctgtgcctctgcaacttgatagactcggaaacatctggcggccttggctgcagccatgctgtgggcctttccctctttgctggtgcctgagagaggatgatccgcaatag

SEQ ID NO: 214907 - DNA, 1773 bp, Artificial Sequence
  Description of Artificial Sequence: Synthetic coding sequence
atgcggccacggaggcccctcgtgtttatgtctcttgtatgtgccttgcttaatacatgccaggcacatcgagtgcacgatgacaagcctaatatcgtcctgattatggttgacgatctcggtattggggacctaggctgttacgggaacgataccatgaggacaccccacatcgaccggctggccagagaaggagtgcgattgacacagcatatctccgctgcctcactatgctcaccatcgcgatcagcctttctgactgggagatacccaatcaggagcggaatggttagtagcggaaacaggagggttatccagaaccttgccgtgcccgctggactgcccctgaacgagactacccttgctgctcttctgaagaaacagggatactccactggcctgatcggtaagtggcatcaaggactcaattgtgattctcgttccgaccagtgccatcatccatacaattatggatttgattattattatgggatgcctttcacattggtggacagctgctggcccgaccctagcaggaacacagaactagcattcgagtctcaactctggctgtgtgtgcaattagtggccattgccattttaaccttgaccttcgggaagctctcaggctgggtgtccgttccttggctgctaatctttagcatgatactgttcatatttctcctgggatacgcatggttcagcagccacacatcccctctctattgggattgcctcctgatgaggggccatgagatcactgaacaacccatgaaggctgaacgcgcagggtcaatcatggtgaaggaggctatctcctttctggagcggcactctaaggaaacattcctcctgtttttttcttttctccatgtgcatacgcccctccccacaaccgacgacttcactgggacgtccaaacacgggctctatggcgacaatgtggaggagatggacagtatggtcggcaagatcttggatgccattgatgatttcggcctgcggaacaacactttagtttattttacctcggaccacggcggtcacctggaggcaagacgcggacacgcacagcttggtggttggaacggaatttacaaaggcggaaaaggaatgggtggctgggaaggcggtattcgggttcctggcattgtgcgatggcctggtaaggtgcctgccggtcgcctcataaaagaacccacatctctaatggacatccttcccaccgtggcatccgtatcgggaggttccctccctcaggaccgcgtaattgacggcagggatctgatgccgctgctccagggcaatgtccgccactcagagcatgagttcttgtttcattactgcggatcctacctgcacgccgtcaggtggataccaaaggacgactctggaagcgtgtggaaggcccattatgtcactcctgtgttccagcctcctgcctcaggcggttgctatgttacgtctctgtgtaggtgtttcggcgaacaggtcacttatcacaacccaccacttctattcgatctgtccagagacccgtcagaaagcactcccctgactcctgccacagaacccctgcatgactttgtgattaagaaggtagccaatgccctcaaagagcatcaggagacgattgtccccgtaacctaccagctctccgagctaaatcagggtcgaacatggctcaaaccctgctgtggcgtctttccattttgtctctgtgacaaagaagaagaagtgtcacaaccaagaggaccaaatgaaaaacggtag

SEQ ID NO: 214908 - DNA, 1773 bp, Artificial Sequence
  Description of Artificial Sequence: Synthetic coding sequence
atgagacctcggcgacctctggttttcatgtctctcgtctgcgctttgttgaacacttgccaggcccaccgcgttcacgatgataagcctaacatcgttctgatcatggttgacgatcttggaattggggatctggggtgctatggcaacgacaccatgaggacgccacatatcgacaggctggcccgagagggagttcggctgacccagcatatttcagccgcatcactgtgtagcccctcacggtcggcatttctcaccgggcgttatccgataaggtcaggcatggtgagctcgggcaatagacgggtgattcaaaaccttgctgtaccagctggactccctctgaacgagacaaccttagcagccctgcttaaaaagcaagggtacagcacagggctcattggcaaatggcaccaggggcttaattgcgacagcaggtcagaccaatgccatcacccttacaactatggatttgactattactacggtatgccattcacattggtggattcttgctggcctgacccaagccgaaataccgagctagcctttgaatcccagctgtggctgtgcgtccaactggtggctattgctattctcaccttgacctttggtaaactcagcgggtgggtcagcgtcccttggctgctgatattctcaatgatcttgttcatttttctgctgggatacgcctggttctcctctcacacaagccccctctactgggattgcttactgatgcggggacacgagatcaccgaacagcccatgaaagcggaaagagccggaagcatcatggtgaaggaagcaattagtttcttagaacgccacagtaaagagacatttttgctgttcttttcctttctgcacgtgcatacgcctctccctacaactgatgattttaccggtactagcaagcatggcctgtacggagataatgttgaagagatggattcaatggtaggaaaaatcctggacgctatcgacgacttcggcctgcgaaacaacaccctggtgtactttacttcggatcacggtggacatctggaggctagacgaggtcacgctcagcttggcggatggaatggcatttataagggtgggaagggtatgggcggttgggagggcggaatccgagtgcctggcatcgttagatggcccggtaaagtgccagctggccgactgattaaagaacctaccagcctcatggacattcttcctaccgtggcaagcgttagcggcggtagcctaccgcaggaccgcgtgattgacggccgagatttaatgccgcttttgcagggcaatgtgagacactcggagcacgagtttctgtttcattactgtggctcctatcttcatgccgtcaggtggattccaaaagatgacagtggctctgtatggaaggcccactacgtcacaccagtgtttcagccaccagcctctggagggtgttatgttactagcctgtgtcggtgctttggtgaacaggtgacttaccataatccaccccttcttttcgacctttcaagggacccctccgaaagtacgcctctgactccagccacggagcccctccatgactttgtgattaaaaaggtggccaacgccctgaaagagcatcaggagaccattgttcccgtcacataccagctctctgaacttaaccagggtagaacctggctgaagccctgttgtggcgtcttccctttctgtctgtgtgacaaggaggaggaggtaagtcagccaaggggccctaatgagaagagatag

SEQ ID NO: 214909 - DNA, 1773 bp, Artificial Sequence
  Description of Artificial Sequence: Synthetic coding sequence
atgcgccctaggcgtcctctggtttttatgagtcttgtatgcgccctcctcaacacttgtcaagcacatcgggtacatgatgacaaaccaaatatcgtactgatcatggtggatgacctggggataggcgacctcggctgttatggcaacgataccatgcgcaccccacatattgatcgcttagcccgtgagggagtgcgtctgactcagcatatcagcgctgcctcactgtgctccccttccaggtccgcattcctgaccggcaggtaccctatccggagtggcatggtcagttccggcaatcgcagagtcatccaaaatctggccgtgcccgcaggtcttccactgaacgagacaaccctggcagcgcttctgaaaaagcagggctatagcactgggttgatagggaaatggcaccagggtctcaattgcgattcccggagcgatcaatgtcaccacccgtacaactacggcttcgactattattacgggatgcctttcaccttagtggattcatgctggcccgacccttctaggaatactgagttggctttcgaatcacagctgtggctgtgtgtgcagctggtcgccattgccatcctcactttaacatttgggaagttaagcggctgggtttccgtcccctggctcctcatctttagcatgatcctgttcatcttcctattgggctatgcgtggttttcctctcataccagccctctgtattgggactgtctgctgatgaggggacacgaaataaccgagcagcctatgaaagcagaaagggccggaagtattatggtgaaagaggccatctcttttcttgaacggcatagcaaggaaacattccttttattcttctcctttctccacgtccatacgccactccctaccacggacgactttactgggaccagtaagcacggcctgtatggagacaatgttgaagagatggactccatggtcggcaaaatcctggacgctatcgatgacttcggcctcagaaacaataccctcgtgtattttacctccgaccatggagggcacctcgaggccaggcgaggccatgcccagctcggagggtggaacgggatctacaagggaggaaaaggtatggggggatgggaaggaggcattcgtgtgccaggaattgtgaggtggcctggaaaagtccctgctggtagacttatcaaagaacctaccagtcttatggatattctgcccacggtagcttccgtttctggcggaagcttgccacaagaccgcgtcattgatgggagagacctaatgccgctcttgcaggggaacgtgcggcactctgagcacgagtttctgtttcactactgtggtagctacctgcatgcagtgcggtggattcctaaggacgacagcgggtctgtgtggaaggcccattacgttacccctgtgttccagccacctgcctccggcggatgctatgtgacctcactgtgccgatgtttcggagaacaggtaacttaccataacccgccactcctttttgatctgagtcgggatccaagcgaatcgactcccttaacacccgctaccgagccactccacgacttcgtcattaaaaaggttgcgaacgccctgaaggagcaccaagagacaattgtccccgttacatatcagttgtctgaactgaatcagggacggacttggctgaaaccatgttgcggcgtatttcctttttgcttgtgcgataaggaagaggaggtatctcagccgagaggtccgaatgagaagcgctag

SEQ ID NO: 214910 - DNA, 1689 bp, Artificial Sequence
  Description of Artificial Sequence: Synthetic coding sequence
atgacaaggaacgcgagacctaacattgtcctgttaatggcggatgacttaggcgtgggcgatctgtgttgctatggcaacaattctgtctcgacaccaaatattgacagactggcttctgagggggtgcggctcacccagcacctggccgctgccagcatgtgtaccccttcacgcgcagcttttcttactggtaggtatcccatacggagcggcatggtttccgcatacaacttgaacagagcctttacctggctcgggggttccgggggtctgcccactaatgaaaccaccttcgcgaaacttctgcagcatagagggtaccggacgggattgattgggaagtggcacctgggcctgagctgcgctagtcgaaatgaccactgttatcatccactcaaccacggcttccattatttctacggtgtcccatttggcctcttgtcagactgtcaagccagtaagactcctgagttacaccgctggctgcgcataaaactctggatatccacggtggcacttgctcttgtgccttttctgctgctcatcccgaagtttgcaaggtggtttagcgtgccttggaaggtcattttcgtctttgctctcttggcgttcttgttcttcacgtcatggtacagttcctatggatttacacggagatggaactgtattctgatgagaaatcacgagatcatccaacagcctatgaaagaagaaaaggtggccagtctgatgctgaaagaggcgctagctttcatcgagagatataaaagggagccattcctgctgttttttagctttctgcacgtgcacactcctctgattagtaagaagaagtttgtcgggagatctaagtacggacggtatggcgataatgtcgaagaaatggactggatggtcggaaagatcttggatgcactggaccaggagagattggctaaccacacgctggtttacttcacgtctgataatggcggtcatcttgagcccttggatggtgccgtacagctaggcggatggaacgggatctacaaaggaggcaaaggcatgggcggttgggagggaggcatcagggtgcctggtattttcaggtggcccagcgtgttggaggcaggcagagtgatcaacgagcctacttcactgatggacatctaccccaccctcagttatataggtggtgggatcctgtcccaggatagagtgattgacgggcagaacctgatgcctcttttagaaggaagggcgtcccacagcgatcacgagtttctctttcattattgtggtgtttacctgcacaccgttcgctggcaccagaaggactgcgctactgtatggaaagctcattacgtgacccctaagttctaccctgagggcactggggcatgctatggctcaggaatctgctcatgcagtggtgacgtgacgtaccatgacccaccgctgttattcgatatcagccgggatccgagtgaggcactgccactaaaccccgataacgagcctttattcgacagcgttataaagaaaatggaggcggctatccgcgagcaccggagaaccttaacgcccgtcccacagcagttcagcgtatttaacacaatttggaagccctggctgcagccatgctgcgggacatttcctttctgcggatgcgacaaggaagatgacatcctaccaatggccccttag

SEQ ID NO: 214911 - DNA, 1710 bp, Artificial Sequence
  Description of Artificial Sequence: Synthetic coding sequence
atgcacacccttactggcttttcactggtatcactgctgtcgttcgggtacttaagttgggactgggcgaagccctcatttgtggcagacggaccgggtgaggctggggagcaacccagcgccgctccaccccaaccaccacatatcatcttcatcttaaccgacgaccaaggctaccacgatgttggctaccatgggagcgacattgagacccctactctggaccggctagccgctaagggcgttaagctggagaattattacattcagccaatttgtactcctagtagaagccagctgctgactggcaggtatcagattcacaccgggctccaacattctattataagaccacagcaaccaaactgtctgccgctcgatcaggtgactcttcctcagaaactgcaggaagctgggtactctacccatatggttggcaagtggcaccttggtttttatagaaaagagtgcctgcccaccaggaggggtttcgataccttcctcggctcactcacaggcaacgttgactactacacgtacgataactgtgacgggcctggggtgtgtggtttcgacctgcacgaaggggaaaacgtagcctggggcctgtcggggcagtacagtactatgctgtatgcccagcgtgcttcacatatcctcgcctcgcactcaccccagcgccctcttttcctgtatgttgcgttccaggcagttcacactcccctacaaagtccccgtgagtatctgtacaggtatagaacaatgggaaacgttgccaggagaaaatatgcagcaatggtgacctgtatggacgaggcagtgagaaacataacctgggccctgaagcgatacggtttttacaataattccgtgatcatttttagcagtgacaatggagggcagacattttcaggtggtagtaattggccccttagaggtagaaaaggaacctattgggaaggaggagtcaggggcttagggttcgtgcattctcccctgttaaagcggaaacagcgaacttcgcgcgctctgatgcacatcacggactggtaccctacattggtgggcctcgcgggtggcaccacttcagcagctgatgggcttgatggatatgatgtttggccggcaatttccgaaggcagggcttctcctcgaactgagatcctgcacaacatagaccccctttataaccacgcccagcacggctcgttagaggggggatttggcatctggaatactgccgtgcaggcagctatcagggtcggagaatggaagctgctgaccggggacccagggtacggagactggattcccccacagaccctggcaactttccctggtagttggtggaatctcgagcggatggccagcgtccggcaggctgtgtggctcttcaatattagtgcagacccctatgagcgcgaggatctagccggacagcggcctgacgtggtgcggaccttgctcgccagattggccgagtacaacaggaccgctatccccgtcaggtacccagcggagaatcctagggcgcatccagacttcaatggcggtgcttgggggccttgggccagcgacgaggaggaagaagaagaagaaggcagggcacgttcattctcaaggggacggcgtaaaaagaaatgcaagatatgtaagctccgatcattctttcgtaagttgaacacacgactgatgagccagcgcatctag

SEQ ID NO: 214912 - DNA, 261 bp, Artificial Sequence
  Description of Artificial Sequence: Synthetic coding sequence
atggttggcaagtggcatttgggattttatcggaaggagtgtttgcccaccagaaggggatttgatacattcttagggagccttactggcaatgttgactactacacatatgacaattgcgacgggccaggcgtctgcgggttcgatctgcacgaaggggagaacgtcgcctggggcttaagcggccaatacagcactatgctgtacgcacaaagagcctcccatatccttgccagtcattctccgcagagacctttgtag

SEQ ID NO: 214913 - DNA, 1281 bp, Artificial Sequence
  Description of Artificial Sequence: Synthetic coding sequence
atggttgggaagtggcatcttggcttctatcgcaaagaatgcctgccgacacgccgtggtttcgacacttttctgggaagtctgacgggcaacgttgactattacacatacgacaactgcgatgggcctggagtgtgtgggttcgaccttcacgagggcgagaacgtggcgtgggggctgagtgggcagtattccacaatgctctatgcccagagagctagtcacattttggcttcccacagtccccagaggcccttgtttctttacgtggcttttcaggccgtgcacacacctctacagagcccccgagagtatctgtatcggtaccggaccatgggtaatgtggcacgaaggaaatatgcagccatggtaacctgtatggatgaggctgtgcgcaacataacttgggccctgaagcgatacggattctacaataatagcgttattattttcagttctgataacggtggacagacgttctccgggggaagcaactggcctttgaggggtaggaaaggtacgtattgggaaggaggagtaagggggctgggattcgttcactcccccctgctaaagcgcaaacagaggacgtcacgagcactcatgcatattactgactggtacccaacactggtgggcctggcaggtggtaccaccagcgctgccgacggcctggacggttatgacgtttggcctgcaatttctgaagggagggcctccccacgcaccgagatcctccataacattgaccctctgtataatcacgcccagcatgggtccctggagggaggattcgggatctggaataccgccgtgcaagctgcaataagagtgggcgagtggaagcttttgaccggtgaccctggctacggggactggatccctccgcagacattagcaacctttcctgggtcttggtggaaccttgagcgaatggccagcgtccgccaagccgtgtggctttttaacatctcagccgacccctatgaacgcgaagatcttgcagggcaacgcccagatgtcgttagaaccctgctcgcaaggctcgcggagtacaatcgcaccgcaatccccgtaagatatcccgcagagaacccacgcgctcatcctgacttcaatggcggagcctgggggccttgggcatccgacgaagaagaagaggaggaagaaggacgagcacgcagcttttccaggggacggagaaagaagaaatgtaagatttgtaaacttagatcattctttaggaagcttaacacgcggcttatgagccagcggatctag

SEQ ID NO: 214914 - DNA, 1800 bp, Artificial Sequence
  Description of Artificial Sequence: Synthetic coding sequence
atggctccacgcggttgcgccggacaccctcccccaccatcccctcaggcgtgcgtctgtcccggtaagatgctggccatgggagcccttgcgggattctggattctgtgtctgcttacctacggatatctgtcatggggccaagctctggaggaagaagaggaaggagcactcctggctcaagccggtgagaagcttgaacctagtacaacttcaactagtcagccacatctgatcttcatcctcgcggatgatcagggtttccgcgacgtcggctatcatgggtcagagattaaaacgcccacactggataagttggctgccgagggtgtgaagctggaaaactactatgtgcagcccatctgtaccccttctaggagccagtttatcactgggaaatatcaaatccataccggtctccagcacagcatcatccgccctacacaaccgaactgcctccccctagataacgccacgctgccacagaaactcaaggaagtgggatactcgactcacatggttggaaagtggcacttgggcttttatcgcaaagaatgcatgcccactaggagagggtttgataccttcttcggaagcttactgggatccggtgattactacacccactacaagtgtgacagtcctggtatgtgtgggtatgatctctacgagaacgataatgccgcttgggactacgataatggcatatacagtacacagatgtacacacaacgggtacagcagatcctcgcttcacacaaccccaccaaacctatattcctgtatatagcttaccaggctgtgcatagcccgcttcaggctcccggaagatatttcgaacattataggagcattattaatattaatagaaggagatatgctgccatgctgtcatgcctcgacgaggccataaataatgtgactttggccctcaagacgtacgggttttataataatagtatcatcatatactcttctgataatggcggacaacccaccgccggtggttctaactggccactccgtggttccaaggggacctattgggaaggtggaattcgtgcagtagggtttgtgcactcccccctcttgaagaacaagggaaccgtgtgcaaagagctggtgcacattaccgattggtatcctaccctgatatcgctcgccgaaggacaaatcgacgaggacatacaactggacggctacgacatatgggaaaccatttctgagggcctacggtctcccagagtcgacatccttcataacatcgatcctatctacacaaaggcaaagaatgggagctgggcagcaggctatgggatctggaacaccgccatccagtcagctattcgggtgcagcattggaagctcctgacggggaacccaggctatagtgattgggtgcctccgcagagcttctccaacttaggccctaataggtggcacaacgagagaattaccctgtctaccggcaaaagcgtttggctattcaatatcactgcagacccctatgagcgtgtcgatctgagtaacaggtaccccggtatcgtcaagaagctattaagaaggctgtcccagttcaacaaaactgccgtgccagtgagatatcctcccaaggatcctaggtctaacccaaggctgaacggaggagtgtggggaccctggtataaggaagagactaaaaaaaaaaaaccctccaagaaccaggcagagaagaagcagaagaaaagcaagaaaaagaagaagaaacagcaaaaggccgtttcaggatccacttgccactcaggggtgacctgtggctag

SEQ ID NO: 214915 - DNA, 1791 bp, Artificial Sequence
  Description of Artificial Sequence: Synthetic coding sequence
atggcgcctagggggtgtgccggtcatccccctccccctagcccccaggcatgtgtttgcccgggtaagatgctggctatgggtgccttagcaggattttggatcctttgcttattgacttacgggtacctgagctgggggcaggcattagaggaggaggaagagggagcacttctggctcaggccggagaaaaactggagccaagcaccacgtccacctctcaacctcacctgatatttattttagcggatgaccaaggatttcgcgatgttggctaccatggaagcgaaattaagactccaacactggataagttggcagctgagggagtgaaactcgaaaactattacgtgcagccaatttgcacgccatctaggtcgcagtttattacgggtaagtatcagattcatactggtctgcagcactcgataatcagacctacccagcccaattgtcttcctctagacaacgccactttgccccagaagctcaaggaggtagggtactccacacatatggtgggcaagtggcatctcgggttctatcggaaggagtgtatgcctacccggaggggtttcgatactttctttggatccctgctgggctctggggattattacacccactataagtgcgatagcccaggcatgtgtggatacgacctgtatgagaatgataatgccgcttgggattacgacaacggcatctactccacgcagatgtatactcagagagtgcagcagatcctggccagtcataacccaacgaagccaattttcttgtacatcgcctaccaagccgtccatagccctctccaagccccaggccgttatttcgaacattaccgtagtatcattaacatcaaccgacggaggtatgcagcaatgctctcttgtttggatgaggccattaacaacgttaccctggcattgaagacctatggattttacaataactctattataatctactcttcagataacggcggacagccaacagccggtggtagcaactggcctctcaggggtagtaaaggaacttattgggaaggtgggattcgggctgttggttttgttcatagccccctcctaaaaaataaaggtaccgtgtgcaaagagcttgtccacattacagactggtaccctactctgatttctttagcagagggtcagattgacgaggacatccaactggatggttacgatatctgggaaactattagtgaaggcctcaggagcccacgcgtagatattctgcataatatcgaccctatttatactaaggcgaaaaatggctcttgggccgctggctatggtatctggaatacggccatccagtcggctattagggtgcagcattggaaattactcacagggaatcccggatactccgattgggttccaccacagagtttctctaacctcggccctaatcgatggcacaatgagagaattacactttccaccggtaagtccgtctggctgttcaacatcaccgctgacccttacgagcgggtagatctgtctaacagatatccaggcattgtaaagaaactactgagaaggctctcccagttcaataagacagcggtgccagttcgctatccgccaaaagaccctcgttcaaaccctagattaaatgggggtgtgtgggggccttggtataaggaggaaaccaaaaaaaagaagcccagtaagaatcaggcagaaaaaaaacaaaagaagagcaagaaaaagaagaaaaagcaacagaaggccgtgtcaggtaagcccgcaaacctcgccagatag

SEQ ID NO: 214916 - DNA, 507 bp, Artificial Sequence
  Description of Artificial Sequence: Synthetic coding sequence
atggcacccggacagcaagcaatgggtagtggtacactgcagtcctcccagccaagtgagtgttccactggtttactaacgggcaatcccggttattctgattgggtccctccacaaagttttagcaacctgggacctaataggtggcataacgaacggataacgctttccacagggaagtctgtttggctcttcaacatcacagccgatccttacgagcgggtcgatctcagcaatcgttacccgggtatcgtaaagaaactgctgagacgactgtctcagtttaacaagacagctgtgccggtcagatatccgcctaaagaccctcgcagtaacccgagactgaacggcggagtctggggcccttggtacaaggaggagactaaaaaaaaaaagccttctaagaaccaagccgaaaaaaaacagaagaaatcgaagaaaaagaaaaaaaaacaacagaaggccgtgtcagggtccacttgccattcgggagtaacctgcggctag

SEQ ID NO: 214917 - DNA, 1611 bp, Artificial Sequence
  Description of Artificial Sequence: Synthetic coding sequence
atgttgttattgtgggtttctgtcgttgcagcattggcactcgctgttttggccccaggcgctggcgagcagaggcggagggctgcaaaggcccctaacgttgtactggtggtttctgactcatttgatggccgtcttactttccaccccggttcccaggttgttaagcttccctttatcaacttcatgaagacccgcggaacgagctttctgaatgcgtatactaatagtcccatctgctgcccatctagagctgctatgtggtccggcctgttcacgcaccttacagagagctggaataactttaagggactcgacccaaattacaccacatggatggatgtgatggagcggcacggttacagaacacagaagttcggaaaacttgactataccagcggacatcactctatatctaaccgcgtagaggcctggactagggatgtggctttcttgctgcgacaggaggggcgtcctatggtgaatcttatccggaatcgaacaaaagttcgggttatggagcgcgactggcaaaacaccgataaagctgtgaattggcttcgcaaagaggccatcaactatactgaaccattcgttatctatctgggccttaatctgcctcacccgtatccctcccctagctctggtgaaaacttcggcagcagtacgttccacacctctttgtactggctcgagaaggtatcacacgacgcaataaaaatccccaagtggtcacccctgagcgagatgcaccccgtggactattacagcagttacactaaaaactgcaccggaaggtttacaaagaaggagatcaagaatataagagccttttactatgccatgtgcgctgaaaccgacgccatgttaggagagataatcttagcactccaccagttagatctcctacagaagaccattgtgatttactccagtgatcacggagaactcgctatggaacaccgacaattctataaaatgagcatgtacgaagcatcagcccacgtccctctcctcatgatgggcccaggcattaaggcaggcctacaggtcagtaacgttgtctctttagtggatatatatcccaccatgctggatattgccggtattcctctgcctcagaacctgtcaggatactcgctgctgcctctttcgtctgaaaccttcaagaacgagcacaaggtgaaaaacctccatcctccctggattctgtccgaattccacggatgcaatgtgaacgcaagtacctatatgctgaggacaaaccactggaaatatatcgcctactcagacggggctagtatcctgccacagctcttcgatctcagtagcgatcccgatgagctgacaaatgtggccgtaaaattccccgagatcacatactcactagatcaaaaattacactccatcatcaattatcctaaagtctcggcaagcgtgcaccagtacaataaagagcaattcatcaaatggaaacagtccatcggacagaactactctaacgttatcgcgaatctgcggtggcaccaagattggcagaaagaacccaggaaatacgagaacgcgattgatcagtggctgaagacccacatgaatcccagagctgtctag

SEQ ID NO: 214918 - DNA, 561 bp, Artificial Sequence
  Description of Artificial Sequence: Synthetic coding sequence
atgcttctcttatgggtgtcggttgtggctgctctggctctggccgtactggcccctggggcaggagagcagagacgacgagccgcaaaagcccctaacgtggtacttgtggttagcgacagttttgacggaaggttgacttttcaccctggctctcaggtcgtgaagctgccattcatcaattttatgaaaacccgcggaacctcatttcttaatgcttacacaaactcccctatctgttgcccttcccgagctgctatgtggagcggattgttcactcacctgactgaatcttggaacaacttcaaggggctggacccaaactacacaacttggatggatgtcatggaaagacacggctataggacacaaaagttcggcaaacttgattacacctcaggacatcattcaattagcaatagagtcgaggcctggacccgcgacgtcgcgttcctcctgcgacaggaaggcaggccaatggtgaatttaattagaaacagaacgaaggtgagagtaatggagcgcgactggcaaaataccgataaagctgttacaggatag

SEQ ID NO: 214919 - DNA, 1275 bp, Artificial Sequence
  Description of Artificial Sequence: Synthetic coding sequence
atgtggggctgctgcgtctgtggagccttgtttgagggccagaggctgcggcttttgcgcgcaccgggagatggcttgtctagccccttcaccgtggtgagtaggaagtggcacttgggccaccacggttcgtatcacccaaacttcaggggctttgactactattttggaataccatactcacacgatatgggatgcaccgatacccccggatacaaccatcccccatgccctgcctgtcctcagggtgatggaccatcccgcaatttacagagagactgttatactgatgtggctctcccactttacgagaacttaaacatcgtggagcaaccagtgaacttgtccagtctcgctcagaagtacgccgagaaagcgacgcagtttatacaaagagcttctacgagtggccgaccttttctgctctacgtggccctggctcatatgcatgttcccctgcctgtgacccagctccctgctgctccacgcggacgctctctctatggtgccggtctatgggaaatggattctctggtgggccagatcaaggacaaggtggatcatacggtgaaagagaacacattcctgtggttcaccggcgacaacgggccatgggcacagaaatgcgagctggccggtagtgtggggccattcaccggattttggcagactcgccaaggcggtagccctgcgaaacagactacttgggaagggggtcatagagtcccagctctcgcctactggcccggacgcgttccggtcaacgtaaccagcactgctctgctctccgtgctggacatattccccacggtagtggcccttgcacaggcctcactgccccaaggacgaagattcgatggagtggatgtttccgaagtgcttttcggtcgcagccagccaggccatagagttctcttccacccaaattctggcgctgcaggggaattcggggcactccagactgtgcggctcgagaggtacaaagctttttacatcacaggcggagcccgtgcgtgcgacgggagcaccggtcctgagctgcagcacaaatttcccctgatattcaacctggaagacgatactgccgaagctgtgcctctggagaggggaggggctgagtatcaggcggtcctgcctgaggtgcgcaaggtattggctgacgtgttacaggacattgccaacgataatattagcagtgctgattacacacaggacccgtcagttacgccttgctgtaatccataccagattgcctgccgctgccaggcggcttag

SEQ ID NO: 214920 - DNA, 1578 bp, Artificial Sequence
  Description of Artificial Sequence: Synthetic coding sequence
atgggatggcttttcctgaaagtgttgctggccggtgtctctttctccggtttcttgtaccctttggtggacttctgtatttcgggcaagacaaggggacagaagcctaactttgtcataattctagccgatgatatgggctggggggaccttggggctaattgggccgaaaccaaagataccgctaatctggataaaatggcttctgagggaatgcggttcgtcgacttccacgccgcagcctccacctgcagccctagccgggcttcgcttcttacgggtcgcttgggactgcgcaacggggtcaccagaaacttcgcagtgacatcagtgggcggacttcctctgaatgaaacaacgctggctgaggtgctccagcaggccggatatgttacgggcatcatcggaaagtggcatcttggccaccacggatcctatcatcctaacttccgtggcttcgactattactttgggattccctatagtcacgacatgggatgcaccgataccccgggatacaatcaccctccttgccctgcttgccctcaaggcgacggtccctcccgcaatctgcagcgagactgttataccgatgtggcccttccgctgtacgaaaatcttaacattgtggagcaacctgtgaacctctctagcttggctcagaagtacgctgaaaaggctacccagtttatacaacgggcatctacctccggcaggccctttctgctgtatgtagcactggcccacatgcacgttcccctgccagtgacccagctgccagctgctccacgcggacggagtctgtatggtgccggtctctgggaaatggactcattggtggggcagattaaggataaagtagaccacaccgtgaaggagaacacatttctctggttcactggcgacaatggcccttgggctcaaaagtgtgagctggcagggtcagtggggcctttcaccgggttttggcagacccgtcaaggtgggagccctgctaagcagaccacctgggaaggagggcacagagtgccggctctggcatactggccgggacgcgtgcccgtgaacgtgacatccaccgccctgctgtcagtgctggacatttttccaacagttgtagccctggcccaggcctcccttccccaaggtcgacgattcgacggcgtggatgtgagtgaggtgctctttggacgcagccaaccaggacaccgcgtgctttttcacccgaatagcggggctgctggtgagttcggcgctctccagactgtgcgtctggaacgctataaagctttttacatcacaggcggtgccagggcctgcgacggctccactggtccagaacttcagcacaaattcccacttatcttcaatctcgaggacgacaccgcggaggccgtcccgctggaacgaggcggagccgaataccaggccgtcctgcccgaagttcggaaagtgctggctgacgtgttgcaagatattgccaatgacaacatttcttcagccgactacacccaggacccatctgtgactccatgctgtaatccttaccagattgcctgccgatgccaggctgcatag

SEQ ID NO: 214921 - DNA, 747 bp, Artificial Sequence
  Description of Artificial Sequence: Synthetic coding sequence
atgaccaaaacctcgacctgtatctatcactttcttgtcctcagctggtacactttcttgaattattacatctctcaggagggtaaggatgaggttaagcctaaaatcttggccaatggagctagatggaagtatatgaccctcttaaatctgctgaagaacaggactgctggtttcgacatttaccaacccggatcatttcgacagttgctgcaaaccattttctacggtgttacctgtcttgacgacgttctcaaacggacaaagggcggaaaggacataaagttcctaacagctttccgcgacttgctgttcaccacattagcattcccagtgtcgacctttgtcttcctagcgttttggatcctgttcctgtataaccgggatttgatctaccccaaagtcttggacaccgtgattccagtgtggttgaaccacgccatgcacacatttatttttccaatcaccctggctgaagtggttcttcggccacactcatacccctctaaaaaaacaggcctgactctcctcgcggcagctagtatcgcctacatctctaggatactgtggctttatttcgagaccggaacatgggtttaccccgtgttcgccaaattgtcactgctgggcctagccgctttctttagcctctcttatgttttcatcgcaagcatatatctgcttggagaaaaactcaaccactggaagtggggagatatgagacagccacgaaagaagcgtaagtag

SEQ ID NO: 214922 - DNA, 609 bp, Artificial Sequence
  Description of Artificial Sequence: Synthetic coding sequence
atggctaaagtgtcggttctgaacgtggccgtgctggaaaatccgagccccttccacagccctttccggttcgagatctctttcgagtgttctgaggcactcgccgacgatctcgaatggaagataatctatgttggctcagccgagtcagaggaattcgaccaaatcctggatagcgtcctggttggacctgtaccagcaggcagacatatgttcgtatttcaggccgacgccccaaacccttcacttattcctgagaccgacgcagttggtgtaactgtagtcctgattacctgtacctaccatggtcaagagtttatccgggtcggatattatgtcaataacgagtatctgaaccctgagctacgcgaaaacccacccatgaagccggacttctctcagttgcagcggaatatcttagcatcgaaccccagggtgaccagatttcatatcaattgggataacaatatggataggctcgaggctattgagacccaagatccgtcattgggatgcggcctgcctctgaattgcactcccattaagggattaggattaccaggttgtattccaggtctcctgcctgagaactccatggactgtatctag

SEQ ID NO: 214923 - DNA, 1506 bp, Artificial Sequence
  Description of Artificial Sequence: Synthetic coding sequence
atggacacacaggcaggctcagtggatgaggagaatgggaggcagcttggggaagtcgaacttcagtgcggtatttgcaccaaatggtttactgctgatacgtttgggatcgacacctcgtcatgcctaccctttatgaccaattatagctttcactgcaatgtgtgccaccacagcggtaacacgtatttcctcagaaagcaggctaatctgaaggagatgtgcttgtcggccctggctaacctgacttggcagagtagaacccaagatgaacaccctaaaactatgttcagcaaggacaaagacatcattcccttcatcgataaatattgggagtgtatgacaacaaggcagaggcctggcaagatgacttggcccaataatattgtgaagaccatgtccaaggaacgcgatgtcttcctggtcaaagagcaccccgatccgggaagtaaagaccctgaagaggactatccaaaatttggcctgctcgatcaggatctgagtaatattggccctgcttatgacaaccagaagcaatcttctgcagtgtctacctcaggcaatctgaacggtggaatcgcagcagggtcttccggaaaaggaagaggcgctaaaaggaaacagcaggatgggggaacaacaggtaccacgaagaaggccagatccgaccctcttttttcagcccagcggctgcctccccacgggtatcctttggaacacccattcaacaaggacggctatagatacattctggccgagccagaccctcatgcccctgatccggaaaagctagagcttgactgttgggcgggaaagcctatacccggagacctgtaccgcgcatgtttgtacgagcgggtccttctggctctccatgatagggctccccagctgaaaatctctgacgaccgcttgaccgtggtcggcgagaagggctattccatggtgcgagcctctcatggtgtgcgcaaaggggcttggtacttcgaaataactgtcgacgagatgcccccagacacagccgctcggctaggatggtctcagccattaggaaacctgcaggcccctttagggtacgacaaattctcatactcgtggagaagcaagaaaggaacaaaattccaccagtccattggtaagcattatagcagtggctacgggcagggggatgtgctgggattctacattaacctgcccgaggataccgaaacagcaaagagtctgcccgatacgtacaaagataaggcgctcatcaagttcaaatcctatctgtactttgaagagaaagacttcgtagataaggctgaaaaatcgctcaagcagacgcctcatagcgaggtgtcaatcaactttgggccatgcttcaagtatcctcctaaggacctaacttaccgtccaatgagtgatatggggtggggtgcagtagtggagcacaccttggcagatgtgctttatcacgtcgaaacggaagtcgatggtagacgttcacccccatgggagccatag

SEQ ID NO: 214924 - DNA, 1887 bp, Artificial Sequence
  Description of Artificial Sequence: Synthetic coding sequence
atggcagctgcgggagctgggccaggacaagaagcaggagcgggacctggccctggggctgtggccaatgccacgggtgccgaagagggagaaatgaagccagttgctgccggagccgcagcaccccctggcgaggggatatctgcggcacccactgtggagccctctagcggagaggcagaaggaggcgaggccaatctagtcgatgtgagtggcggactagagacagaaagttccaatggcaaggacacactggagggcgcaggcgacacctccgaagtgatggacacacaggctgggtctgtcgatgaagaaaacggcaggcagctgggcgaagtcgagctccagtgcggaatctgtacgaaatggtttaccgctgatacatttgggattgacacctcatcatgtctgcccttcatgacaaactactcttttcactgtaacgtatgccatcactccgggaatacctactttctgaggaaacaggccaaccttaaggaaatgtgtctgagcgcccttgccaatctcacttggcagagtcgaactcaggatgagcatcctaaaacaatgttctccaaagataaggatatcattccatttatcgataagtattgggaatgtatgacaacaaggcagagacctggcaagatgacttggcccaacaatatagtcaaaaccatgtccaaggagagggatgtgtttctggtgaaggagcatccagaccctggttctaaagaccccgaagaggattacccaaagttcggactcctcgaccaggacctctccaatatcggccctgcctacgataaccagaagcaaagctcagcagtgtccacatctggaaatctgaatgggggaattgccgcaggttcctctggtaaagggagaggcgctaagaggaaacagcaggacggaggcacgacaggcacaaccaagaaggccaggagcgatccactgttttcagctcagagactgccccctcacggctatcctctggagcacccctttaataaagatggctaccggtacattttggctgaaccggatccccatgcgcctgacccagagaagttggaattagactgctgggcaggcaagcctatcccgggagatctgtacagggcctgcctttatgaacgcgtccttctcgctctgcacgaccgcgcaccccagctgaagatctccgatgaccgtttgacagtggtcggcgagaagggctactctatggttcgagcaagtcacggtgttcgaaaaggtgcctggtatttcgagattactgtggacgagatgcctccagacactgcggcacgtctaggctggagccaacccctgggtaatctccaagctcctctcggatatgacaaattctcatactcatggaggtcaaaaaaaggcaccaaattccaccaatcaatcgggaaacactactcctctggctatggacagggcgatgtccttggattttatataaacctccctgaggatacagaaacggcaaagtctcttccggacacctataaggacaaggctttgatcaagtttaagagctacctgtacttcgaggaaaaggattttgtggacaaggccgaaaagagccttaagcagaccccgcatagcgagattattttttacaagaacggcgtaaaccagggcgtagcctataaagatatattcgagggcgtttactttcctgcaatatccctctacaaatcttgtacagtctctattaacttcggtccatgctttaaatacccaccaaaggatttaacctacagacccatgagtgatatgggttggggtgccgttgtggagcatacactggctgacgtgctgtatcatgtcgagaccgaggtagacggccgaaggtcccctccatgggagccctag

SEQ ID NO: 214925 - DNA, 1605 bp, Artificial Sequence
  Description of Artificial Sequence: Synthetic coding sequence
atggacactcaggccggttcagtggatgaagaaaacggaagacaactgggcgaggtcgaactgcaatgtggtatttgtaccaagtggttcaccgccgatacgttcggcatcgacacatcttcatgcctgcctttcatgacaaactacagttttcactgtaacgtgtgtcaccattcaggcaacacctattttcttcggaagcaggccaatctgaaagaaatgtgtcttagtgccctcgctaatctgacatggcagtcaagaacccaagacgaacatccaaagacaatgttctctaaagacaaggatattattccctttatcgataaatattgggaatgcatgaccacccggcagcgccctggcaagatgacatggccaaataacatcgtcaaaactatgagtaaggaaagggatgtcttcttggtcaaggagcaccccgatcctggatcgaaagacccagaagaggactaccctaagttcggcctcctcgatcaggacctatcgaacatcgggcctgcatatgataaccagaaacagagcagcgccgtttcgacatcgggcaacctgaatggaggcattgcagccggatccagcggcaagggcagaggcgctaagcggaagcagcaagacggcggaacaacaggcactacgaagaaagcaagatcagatcccctgttctccgcccagcggttgcctccacacgggtaccccctagaacatcctttcaacaaagatggctacagatacattctggctgagcctgacccgcacgctcccgatccggaaaaactggaacttgattgttgggccggtaagcccatccccggtgatctgtaccgcgcttgcctctatgaacgggttttactggctctgcacgatagggcccctcaactcaagatctccgacgatcgattgaccgtggtgggtgagaaaggttactcgatggtccgagccagtcacggcgtacggaagggagcctggtatttcgagattacagtggatgagatgcccccagacacggccgctaggctcggttggtcgcaacccttgggcaacctgcaggcccctttgggatatgataaattcagttactcatggcggtctaagaaggggactaagttccaccagagtatcgggaagcactatagcagtgggtatggtcaaggagatgtgctgggcttctatataaacctcccagaagatacagaaacagcgaagtctctgcccgatacttacaaggataaggccttgatcaagtttaagagctatctgtattttgaagagaaggactttgtggacaaagccgagaagtcactgaagcagacaccccattcggagataatcttctataagaatggcgtgaaccagggagtagcctacaaggatatctttgagggagtctattttccggcaatcagcctgtataagtcctgcactgtgtcgattaatttcggcccatgtttcaaatacccgcctaaggacctaacatatcgacctatgtctgatatggggtggggagcagtcgttgagcacacactggcagatgtactgtaccatgtggaaacagaagttgatggcagaaggtcacctccttgggagccatag

SEQ ID NO: 214926 - DNA, 1506 bp, Artificial Sequence
  Description of Artificial Sequence: Synthetic coding sequence
atggatacccaggccggatctgtagatgaagaaaacggccgacaattgggagaggttgaactgcagtgtgggatctgcactaaatggtttaccgcggacacattcgggattgacacatccagttgcctgccctttatgaccaactactctttccattgtaatgtgtgtcaccactccggcaacacatactttctgaggaaacaagcaaacctgaaagagatgtgcctttcagcccttgcaaatcttacatggcaatctcgaacacaagacgagcacccaaaaactatgttctccaaagataaggatataattccgtttatcgataagtactgggagtgtatgaccacacggcaaagaccgggaaagatgacttggcctaataacatcgttaaaaccatgagtaaggaaagagacgtgttcctcgtaaaggaacatccagatcccggatccaaggacccggaggaggattaccccaaattcgggctattagaccaggacttatccaacatcggccctgcctatgacaatcaaaagcagtcatccgcagtctcgaccagtgggaacttgaatgggggaatagccgctggctccagcggtaaaggcagaggcgcaaagcgtaagcaacaagacggagggaccactggtacaaccaaaaaggccagatcagacccattgttttctgcacagaggctgcctccgcacggatatccgctggagcaccccttcaataaggatggatataggtacatcttggcagagccagacccacacgctcccgatccagaaaagctggaattggactgctgggcaggcaagcccatccccggagacctctatcgagcgtgcctctacgaacgggtcctactcgccctgcatgatcgcgcaccccagcttaaaatcagcgacgatcggctgacagtggtcggagagaaggggtattctatggtaagggccagccatggtgtgagaaaaggtgcatggtacttcgagatcactgtggacgagatgccaccggacaccgctgctagactggggtggtcccagcccctgggcaatcttcaagctcccctggggtacgacaaattctcctacagttggaggagtaaaaagggcacaaaatttcaccaatctatcggcaaacattatagcagcggctatggacagggcgatgttttagggttttacatcaatttgcccgaggatacggagaccgcgaagagtctccccgacacatataaagataaagcccttattaagtttaagtcctatctttacttcgaggaaaaggattttgtcgataaagccgaaaagagtctgaaacagaccccccactccgaagtgtcgatcaacttcggcccttgttttaaatacccgcctaaagatcttacctaccgcccaatgagcgacatgggttggggcgctgtggtcgagcacactcttgccgatgtattgtaccacgtcgagacagaagtagacggaagaaggtcccccccatgggaaccctag

SEQ ID NO: 214927 - DNA, 1470 bp, Artificial Sequence
  Description of Artificial Sequence: Synthetic coding sequence
atgacaaattacagctttcactgcaacgtctgccaccactctggtaatacatactttctccgcaagcaggctaacctgaaagagatgtgcctgtcagctctggccaatctgacatggcagagtaggacccaggatgagcacccaaagactatgttcagcaaggacaaggatatcatccctttcatagataaatactgggagtgtatgacgactcgtcaacgccctgggaagatgacttggcccaacaacatcgtcaaaacgatgtctaaagaaagggacgtctttctggtcaaggagcatcctgaccccggttccaaagaccctgaggaagactatcctaagttcggactgctagaccaggatctgtcaaacattgggccagcgtatgacaaccagaaacagagtagcgctgtgagcacttcagggaacttaaatgggggaatcgccgcaggcagctccgggaagggacgcggagcgaagcgaaagcaacaggatgggggaaccacgggcacaacgaagaaggctagatccgatccactgttctctgcacagagactccccccacacggttatcctttagagcacccttttaacaaggacggttaccgatatatacttgccgagcccgaccctcacgcacctgaccccgagaaactggaattggactgctgggctgggaaaccgattcccggtgacctgtaccgcgcttgcttgtacgaaagagtgctactcgcattacatgaccgagcaccacagctgaagattagcgatgataggttaactgtggtgggcgagaaaggatattccatggtgagagcgtcacatggggtaaggaagggcgcttggtactttgagatcaccgtggacgaaatgccacccgataccgccgctcgactgggttggagtcagccactgggcaacttacaggctcctttgggctacgataaattcagttacagttggagaagcaaaaaaggaactaagtttcaccagtcaatcgggaaacactactcatctgggtacggccagggcgatgtcctcggattctacatcaatctcccagaggacactgaaacagctaagtctttacccgatacttataaagacaaggcactcattaaatttaaaagctacctctactttgaggaaaaggacttcgttgataaggccgagaaaagcctcaagcagaccccacatagcgaaattatcttttacaagaacggcgtgaaccagggcgtggcatataaggatatcttcgagggcgtctacttccccgctattagcctgtacaagtcttgcacagtatctatcaatttcggcccatgcttcaagtatccacccaaggatctaacctataggccaatgtcggacatgggctggggcgcagttgtggagcataccctcgccgatgtgctgtatcacgtcgagacagaggtggatggaaggcggtctcccccatgggaaccatag

SEQ ID NO: 214928 - DNA, 876 bp, Artificial Sequence
  Description of Artificial Sequence: Synthetic coding sequence
atgaccaaggaataccaagacttgcaacacttagacaacgaagagagtgaccatcaccagctaaggaaagggcctcccccaccccagcccctgctccagcgcttgtgctccgggccaagactactgctgctgagcctgggactgtccttactgctgctggtggtggtgtgtgtgataggcagccagaacagccagttgcaggaggagctaagggggttaagagaaacgtttagcaactttaccgcctccactgaagcccaggttaaagggttaagcacgcagggcggtaatgtcgggaggaagatgaagagcctagagagtcagctggagaagcagcagaaggacctgtctgaggatcatagcagcctactgctgcatgtcaaacaattcgtttctgatcttcgatccctctcctgtcagatggcggcacttcagggaaacgggtctgagcgcacttgctgtcctgtgaattgggtcgaacatgagcggagctgctactggttctcacgcagtgggaaagcctgggctgacgccgataattactgtcggctggaggacgctcacttggtagtagtgacctcttgggaagagcaaaagttcgtgcagcaccatataggccctgtcaatacatggatgggccttcatgaccagaatggaccttggaaatgggtagacggaacagactacgagaccgggtttaagaattggaggccggagcagcccgacgattggtacggacatggcttagggggaggtgaggattgcgcccacttcacagacgatggccgatggaacgatgatgtgtgccagcggccataccggtgggtgtgcgagaccgaacttgacaaggcttctcaggagccaccccttttatag

SEQ ID NO: 214929 - DNA, 759 bp, Artificial Sequence
  Description of Artificial Sequence: Synthetic coding sequence
atgacaaaggaataccaggatttacagcacttagacaacgaagaatctgatcaccatcagctcaggaaggactcgcagctgcaggaagagcttaggggactgagggagacattctctaattttacagcctccacagaggctcaggtcaagggactgtctacacaaggcggtaatgtgggtcggaagatgaagtcattggaaagccagttagagaaacagcagaaagacttaagcgaggatcacagcagcctgttgctccacgtcaagcagtttgtgtccgatttgcgcagcctcagttgtcagatggccgctctgcagggaaacggctccgagcgcacgtgttgtcctgtgaattgggtggaacacgagcgcagctgctactggtttagtcgctcagggaaggcctgggcagacgcagataactattgtcgcctcgaagatgcccatctggtggtggtgacatcttgggaagagcagaaatttgtgcagcatcatatcggccctgttaatacatggatgggcctccacgaccagaatgggccttggaagtgggtggacggaaccgactacgagacgggattcaagaattggagacccgaacagccagacgactggtatggtcacggcctgggcggaggcgaggactgcgcccattttaccgatgacgggagatggaacgatgacgtctgccaacgtccctacagatgggtttgtgagacagaactcgacaaggccagccaggaacctccccttctctag

SEQ ID NO: 214930 - DNA, 759 bp, Artificial Sequence
  Description of Artificial Sequence: Synthetic coding sequence
atgacaaaggagtatcaggaccttcagcatttggacaacgaggaaagtgaccaccaccaactgcgcaaagactcccaactgcaggaagaattaaggggcctgcgagaaaccttttccaatttcactgctagcacggaagcacaggttaagggcctctcaacgcaaggtggcaacgttggccgaaaaatgaaatcactggaatcccaactcgagaagcagcagaaggatctttcagaagaccattcctctcttctcctccacgtcaaacagttcgtctctgacttgcgctccttgagttgtcaaatggctgcccttcagggtaatgggagtgagagaacatgttgcccggtgaactgggtggagcatgagcgtagttgctactggttctcccgctcagggaaggcatgggctgacgcagacaactactgccggctcgaggacgcccacttggtggtggtcacctcatgggaagaacagaagtttgtgcagcatcatattggaccggttaacacatggatggggctgcatgaccagaatggcccatggaagtgggtcgatggaaccgattatgagaccgggtttaaaaattggaggcccgaacaaccggacgactggtatggtcacggactgggcggaggcgaggactgtgcgcacttcacagatgatggacggtggaacgacgatgtctgtcagcgcccatataggtgggtttgtgaaaccgaacttgataaagcttcccaagagcctcctctgttgtag

SEQ ID NO: 214931 - DNA, 5679 bp, Artificial Sequence
  Description of Artificial Sequence: Synthetic coding sequence
atggccaatcgtagggtcggacgcggttgctgggaggtcagcccgaccgagcggaggcctcccgctggcctgcggggaccagccgcagaggaagaggcgtcatcccctcctgtccttagcctgtctcatttttgccggtcgcccttcctttgtttcggcgatgtgctgctgggtgcgagccgcacgctgagtctggcactggataaccccaacgaagaggtggcagaggtcaaaatctcccatttccctgccgcagatctcgggttctcagtttctcagaggtgcttcgtgctgcagccaaaggaaaagatcgtcattagcgtgaactggacacctttaaaggagggtcgcgtcagagagataatgacatttctggtaaatgacgtgctgaaacaccaggcaattctgttaggcaatgccgaggaacagaagaagaaaaagcgcagcctgtgggacactataaagaaaaagaagattagcgcaagtacaagccacaacagacgcgtgtcaaatattcagaatgttaataagactttctctgtgtcccagaaggtggatagagtcaggtcacccctgcaagcatgcgagaaccttgccatgaacgaggggggtcctcccacagagaacaatagtctcatccttgaggagaataaaatccccatttcccccatctctccagcgtttaacgaatgccacggagcaacctgcctgccccttagcgttagacggtccaccacatattcgtccctgcacgcaagtgaaaacagagaactgctaaacgtgcactccgctaatgtcagtaaagtctctttcaacgagaaggcggttacagagacgagtttcaactcggtcaatgttaatggccagagaggtgaaaactcgaagttgagcctgactcccaattgttcttctactctgaatatcactcagtctcagattcattttctgagtcccgatagtttcgtgaacaactcacatggagccaacaatgaactggaacttgtgacctgcctcagcagcgatatgttcatgaaagataattctcagccagttcacctcgaatcaacaattgcacacgaaatctaccaaaagatccttagtcctgattcattcattaaggacaactacggactgaatcaggatctggaatctgaatccgtgaatccaattctaagtcccaaccagtttctcaaggataatatggcatacatgtgcacctcacaacagacctgtaaagtgccactctctaatgaaaactcccaagtgcctcagtcccccgaggactggcggaagtctgaggtttcacccagaatccccgaatgtcagggatctaagagtcccaaggcaatatttgaggagctggtggagatgaagtcgaattactactcttttattaaacaaaacaatcctaagtttagcgcggtacaggatattagctcccactctcacaacaagcagcccaagaggaggcctatcctaagcgccaccgtgaccaaacgcaaggccacctgcacgcgggagaaccagacggaaataaataaaccaaaggccaaaaggtgcctgaattcagccgtgggggagcatgaaaaggttatcaacaaccagaaggaaaaggaggactttcacagttatctacctattatcgatccgatcctgagcaagagtaagtcttataagaacgaggtgaccccctcctctactacggccagcgtcgccagaaagcggaaaagcgatggatcaatggaggacgccaatgtcagagtcgccatcaccgagcataccgaggtccgtgaaatcaagaggattcacttttccccatcagaaccaaaaactagcgcagtcaagaaaacaaaaaacgtcacaaccccgatttcaaagagaattagcaaccgggagaagctgaacctaaaaaaaaaaaccgatctgagcatttttcggactcctattagtaagaccaataagcgcactaaacccatcattgcagtcgcccagtccagcctgactttcattaagcctctgaaaactgacattcctcgccacccaatgccatttgcggctaaaaacatgttctatgacgagagatggaaagagaaacaggagcaggggttcacatggtggctcaactttattctgacacccgatgatttcaccgtcaagactaatatatccgaggttaatgccgcaacactgcttcttggcatagaaaaccagcacaagatctcagttccccgtgccccaacaaaggaggaaatgtctctgcgggcatacaccgctcgctgccgcctcaatagactgaggcgggcagcctgtcgtctcttcacctcagaaaagatggttaaggctatcaaaaagttagagattgaaatagaagcaagacggttaatcgtccggaaagatcggcacctctggaaggacgtaggagagcggcagaaggtgctaaactggctgctcagttacaatcccctttggctgcggataggcctggagactacatacggcgaactgatatccttagaagataactcagacgtgacgggtctagcaatgtttatcctgaacagactgctttggaaccccgatattgcggcagaatataggcatcctacagtgccccacttgtaccgggacggtcatgaagaagcgctgagtaaattcacccttaaaaaacttctgctgctcgtgtgtttcctggattacgccaaaatatcaaggctaattgatcacgacccttgcctgttttgcaaagacgctgagttcaaggccagcaaggagatacttttggccttctctcgggacttcctgtccggtgagggcgatctgtcacgtcacctcgggctgctcggcctccccgtgaaccatgtgcaaactcccttcgacgagttcgatttcgccgtcacgaacttggccgtggacttgcagtgcggcgtgcgactggtcagaacaatggaacttctaacacagaactgggacctcagcaagaagctccgcatcccggctatttccaggttacagaagatgcacaacgtcgatatagtgctgcaggtgctgaaatctagaggaatcgaactctctgacgaacacggcaacacaatattatcaaaagacattgtggacagacatagggagaaaactttacggttgctgtggaaaatcgcattcgcctttcaggttgatatctcactgaacttagatcagctgaaagaagaaatagctttcttgaagcatacaaaaagtatcaagaagaccattagtctgctctcttgtcattctgacgatttaataaataagaaaaaaggaaagagagattccgggtccttcgagcagtattccgagaatatcaagttgctgatggactgggtcaacgccgtttgtgcattttacaacaaaaaggtggaaaacttcacagtgtcattttccgatggcagagtgctctgttacttgatacatcactaccatccctgctacgtgccctttgatgctatttgtcaaaggacaacccagacagttgaatgcacacagaccggatctgtggtgctcaatagcagctcagaatccgacgactctagcctcgatatgtcactaaaggcattcgatcatgaaaatactagcgaactgtataaggaactcttggagaacgagaagaaaaactttcacctagtgcgatcagctgttcgagacctgggcggaatcccagccatgattaatcattccgatatgtctaacacaatcccggacgagaaagtcgtcatcacctatctttcctttttatgcgccaggctgttggacctgagaaaagagatccgcgctgcgcgactaatccagactacgtggcgcaagtacaagctcaaaacggacctcaaacgacaccaggaaagagagaaggccgctcgcatcattcagctggctgtgataaacttcctggcgaaacagcgtctgcggaagagggtcaatgcagccttggtgatccagaagtactggcgcagagtgcttgcgcagcgaaaattgctgatgctgaagaaagaaaaactggagaaagttcaaaacaaagccgctagtcttattcaggccatgtggagaaggtacagggctaaaaagtatctctgtaaggtgaaagcagcctgcaagatacaggcctggtacaggtgctggcgagcacacaaggagtacctggcaattcttaaggccgtgaaaattatacagggctgtttttataccaagctggagaggactcggttcctcaatgtccgggcttcagcaatcataattcagagaaaatggagagctattctaccagcaaaaatagcccacgagcactttttgatgataaagagacatagggcggcatgtctaattcaagcccattatagaggctataaagggagacaggtcttcttacggcaaaaatctgccgcactgataattcagaagtatataagggccagggaagctggaaagcacgaaaggatcaaatacatcgaattcaagaagtctacagtcatcttacaagcactcgtccgcggttggctcgtgcggaagagatttctggagcagcgcgctaagatcaggttgctgcatttcacagcggcagcttattaccatctgaatgctgtgcgcatacagagggcttataaactctatctcgctgtgaaaaacgccaataaacaagttaattcagtgatttgtatccagcggtggtttcgggcacgtcttcaggaaaaacgctttattcagaagtatcattctattaaaaaaatcgagcacgaaggccaggagtgtctgagccagcgcaatcgtgcagcatcagttatacaaaaggctgtcaggcatttcctgcttcgcaagaaacaggagaagttcacctctgggatcattaagatccaggccctctggcgtggatattcatggcgtaaaaagaacgattgtaccaagattaaggccatcaggctgtcccttcaggtggtgaacagagagattcgcgaagaaaacaagttgtataagcgcacagctctggcactgcattacttgctcacatacaagcacctgagcgcgattctcgaagcgcttaaacacctggaggtcgtgacgaggcttagcccactgtgttgtgaaaacatggctcagagtggcgcaatttcaaagatctttgtcctgatccgaagctgcaacagatcaattccctgcatggaggtaataagatacgctgttcaggtactgttgaatgtttcaaaatatgagaagacaacctctgctgtctatgacgtggagaactgtattgatatactgctcgaactgctgcagatctatcgggagaagcctggcaataaagttgcagataagggagggtccatctttacaaagacttgttgcttactggcgatcttactgaaaaccacaaaccgcgcttctgatgtaagatcccggtcgaaagtcgtggaccggatttacagtctgtacaagctcacagctcataaacataaaatgaacactgaaaggatcctctataaacagaagaaaaatagttcaatttccatacccttcatccctgaaactcccgtccgcacaaggatcgtttcccggcttaagcccgactgggtgctccggcgagataatatggaggagataaccaatcctctgcaggctatacagatggtgatggacacattgggtataccctactac

SEQ ID NO: 214932 - DNA, 4170 bp, Artificial Sequence
  Description of Artificial Sequence: Synthetic coding sequence
atggctaaccggagagtgggaagaggctgttgggaggtttcaccgactgaacgcaggccccctgcaggtctgcgtgggccagcagccgaggaagaagcatctagtcctcctgttctgtccctttcacacttctgccggagtccttttctctgctttggcgatgtgcttctgggtgcttctaggactctgtccctggccttggataaccctaacgaggaagtggccgaggtaaagatcagtcattttccggctgctgacctgggcttttcagtgagccagcgttgttttgtgctgcagccaaaagagaagattgtgatctccgttaattggacaccactcaaggaaggacgtgtgcgtgaaattatgacatttctggttaatgatgtcctgaagcaccaggctatcctgctcggtaacgcagaggaacagaagaagaaaaaacgttctctctgggataccatcaaaaagaaaaaaatctctgcttccaccagtcataacagacgggttagtaacattcagaacgtgaataaaactttcagcgtctcccagaaagtggataggaggtacaggcaacaaacctatttcaataaacttaaaaagataaccaagaccgtccagcaacggtactgggcaatgaaggagcggaacatacagttccaaaggtacaataaacttagacactcagtcatttacattcaagcaatttttcgtggaaagaaggcccgtaggcatctgaagatgatgcacattgctgctacgctgatccaacgccgtttcaggacactgatgatgcgtaggagattcctgagtctgaaaaagaccgctatcttgattcagagaaagtatcgcgcacacctgtgtacaaagcaccatctgcagttcttgcaggtccagaatgccgtgatcaagatacaaagcagctatagacgttggatgattcgtaagcggatgcgggagatgcacagggcggcaaccttcattcagtcaacctttagaatgcatagattgcatatgagatatcaggcactcaaacaggcctctgttgtaatacaacagcaataccaggccaatagggcagccaagttacagagacaacattacctccgtcagcgtcacagcgctgtgatactacaggctgctttccgtggtatgaagacccggcgacacctgaaatcaatgcacagtagcgccacactgatacagtcgcgatttagaagtctgctggttcggcgtcggttcatcagcttgaaaaaggctactatattcgtacaacgaaagtacagagctacaatttgtgccaagcataaattgtaccagttcctccacctgagaaaagcagcaatcaccattcaaagcagctaccgacggcttatggtgaagaagaaactacaggagatgcaaagagccgcagtgctaatccaagccacctttcgtatgtaccggacttatatcacatttcagacttggaagcacgcatccattttaatacagcagcactaccgaacataccgtgctgccaaacttcagcgcgagaactatatacggcaatggcactctgcggtagtgattcaggcggcttataagggtatgaaggcgaggcaactgttgagggaaaaacacaaggcaagcattgtaattcaatccacctaccgtatgtacaggcaatactgtttctaccagaaacttcagtgggctacaaaaattatccaggagaagtatagagcaaataagaagaagcagaaggtgttccagcataatgaattgaaaaaagaaacgtgcgtacaggccggatttcaggacatgaacataaagaaacagatccaggagcagcaccaggccgcaattatcattcagaaacattgcaaggcttttaagattcgtaaacactacttgcatctgagagccaccgtggtttcgatccagcgccgatatcgcaagttaaccgctgtgcgcactcaggccgttatttgtatccaatcttattatcgtggattcaaggtccgtaaggacatccaaaacatgcaccgggcagctactttgattcagtctttctaccggatgcaccgcgcaaaggtggattatgaaaccaagaagactgcgatcgtggtgatccaaaactattatagactctatgttcgtgtgaagacagagaggaagaatttcctcgctgttcagaagagcgtgagaaccatacaggccgcttttagaggtatgaaagttaggcaaaaattgaagaacgtgtctgaggaaaagatggcagcgatagtcaaccagagcgcactgtgttgctaccgatccaagacccagtacgaggctgttcagtcagaaggagtaatgatacaggaatggtacaaggcttccgggctggcgtgctctcaggaggcagagtaccattctcagagcagagccgcagttactatccagaaagcattttgtcggatggtgacccggaaacttgagactcagaagtgcgccgctctgaggatccagttttttcttcagatggcagtctacagacgaagattcgtgcaacagaaaagggcggcaattacactccaacactactttaggacctggcagactagaaagcagttccttctgtatagaaaggcggcagtcgtactgcagaaccactatcgggctttcctcagcgctaagcaccagcgccaggtatacttacaaatacggagcagcgtgattattatccaggccaggtctaaaggttttattcagaagcgaaagtttcaggaaattaagaacagtaccatcaagatccaggcaatgtggcggaggtatagagcaaaaaaatatttgtgtaaggtgaaagcagcttgcaagatacaagcgtggtaccgatgttggagggcccataaagaatacttggcgatcttaaaagctgtaaagattatccagggatgcttttatacaaagctcgagcgtacccggtttcttaacgtgagggccagcgctataatcattcaacggaaatggagggccatcctacctgctaagattgcgcacgagcatttccttatgatcaaacgacatagggcggcatgcctgatccaggcccattacagaggttataagggcagacaggtgttccttaggcagaagagtgctgccctgatcattcaaaagtacattcgcgcaagggaggccggtaaacacgaaaggatcaagtacatcgaattcaaaaaatccactgtcatccttcaagccctggtgagaggctggctggttaggaaaagattcctggagcagcgtgcaaagattaggctgcttcacttcacagcagccgcttattaccacctcaatgctgtgaggattcaaagggcctataagctctacctggccgttaagaacgcaaacaagcaggtaaatagtgtcatatgcattcagaggtggttccgcgctaggcttcaggagaagaggttcatccagaagtaccactcaatcaaaaagatcgagcatgaaggccaggagtgtctctctcagagaaatagagccgcaagcgtcattcagaaggctgtgcgccactttctgctccggaagaagcaggaaaaattcacctctggcataatcaagattcaggctctgtggaggggatacagctggcgtaagaagaatgactgtactaagatcaaggcgatacggctgagcctgcaggtggtgaatagggagattagagaggaaaataagctgtacaagcggactgccctggccctgcactatctgctcacctataagcatctgtcagctatcttagaggctctcaagcatcttgaggtggttacccgactctcgcccttatgttgtgaaaatatggcgcagagcggggcaatcagcaaaatttttgtcttaataaggagctgtaaccgtagtattccgtgtatggaggtgattcgctacgctgtgcaggttctgctgaacgtgtcaaaatatgagaagactacatcagcggtgtacgacgtggaaaattgtattgatatcctgttggaattgcttcaaatctaccgcgagaagcctgggaacaaagtggctgataaaggcggaagcatcttcacaaaaacatgttgtctgctggccatccttcttaaaacaactaaccgggcatctgtatctatcagccaactcccattctttaaaattatctttttgtggtcttag

SEQ ID NO: 214933 - DNA, 3429 bp, Artificial Sequence
  Description of Artificial Sequence: Synthetic coding sequence
atgtccctgcgggcatacactgctaggtgcagactgaaccgtctgagacgggctgcttgcagactgtttacatccgaaaagatggtcaaagcaatcaagaaactggagatcgagattgaggcccgacgactcatagtgcgaaaagaccggcacctatggaaagatgttggggaacgtcagaaggtcctcaactggctcttaagctataacccgctttggctcagaatcggcctggagaccacctacggcgaactgattagcctcgaggacaactccgacgttactgggctggctatgttcatcctcaatcgcttgctgtggaacccagacattgctgcagagtaccgtcaccccactgtcccacacctgtacagggatggacacgaggaagctctgagcaaatttactctcaaaaaactattactgttggtctgttttctcgattacgccaagatctcaagacttattgatcacgacccttgtctcttttgtaaagacgccgagtttaaggcctctaaggaaattcttctggccttttcccgagacttcctcagcggagagggcgacttgagccgtcatttgggattgctcggtctacccgtgaaccacgttcaaactccatttgatgagttcgactttgccgttaccaacctcgccgtggacctacaatgtggcgtccgactggtccgtaccatggagctgttgacccaaaattgggatttgtcaaagaagctgaggattcccgctatatcgcgcctgcagaagatgcacaacgtggatattgttctccaggtgctgaagtcacgcggtatcgaactcagcgatgagcatggcaataccatcctgtcaaaagacattgtcgatcgacatagggaaaagacgctacggctcctctggaagattgcatttgcctttcaagtggatatttcactgaacttagatcaactgaaagaagaaatcgcttttcttaaacataccaaatcaataaaaaaaaccatttcactcctgtcttgtcactccgatgatctgataaacaagaagaaagggaagagagactctgggagcttcgaacagtatagtgaaaatatcaagcttctcatggactgggtaaatgctgtatgcgctttctataataagaaagtggagaatttcaccgtatccttctccgatgggagggtgctatgttaccttattcaccattatcatccttgttatgtacctttcgatgcaatctgccaacgcaccacccagaccgtggaatgtacgcaaactggatcggtcgtcctgaactccagcagcgaatccgacgactcctctctggacatgagcttgaaagcgtttgatcatgaaaatacttctgagctgtataaggagctactggaaaatgaaaaaaaaaattttcatctcgtgagaagcgcagtgcgcgacttgggcggaatccccgcaatgatcaaccactcagatatgtctaacactatacctgatgagaaggttgttataacctacctgagttttctctgtgctcgcctgcttgacctgaggaaagaaattcgcgcagccagattgatccagaccacatggagaaagtacaagctgaaaactgatctaaaaaggcaccaggaaagagaaaaagctgctaggattatacagcttgccgtaattaactttctggccaagcagagactgaggaaacgtgtcaacgctgctctagtgattcagaaatactggagacgggtgctagctcagcgaaaacttctgatgttgaaaaaggagaaacttgagaaggttcagaacaaggcggctagccttattcaggcgatgtggcggaggtaccgggctaagaaatacctgtgtaaggtgaaggccgcatgcaagatccaggcttggtaccgctgctggagggctcacaaagaatacctggctatactcaaagcggtcaagattatccaaggctgcttctacacaaaactggagagaactcgcttccttaatgttagagcctctgcaatcattatccagcgcaagtggcgcgcaatactgcccgctaagatcgctcacgaacactttcttatgatcaaacgacaccgcgctgcctgcttgattcaggcccactataggggatacaaggggagacaagtctttctgcgacagaagtcggccgctcttattatccagaaatacatccgggctagagaagccggaaagcatgagagaattaaatacatcgaattcaaaaaaagcaccgtcatcctacaggccctggtcaggggttggctggtacggaagaggtttttagagcagcgggcaaaaattcgcttgctgcactttaccgcagcggcatactaccatttaaacgctgtgcgcattcagcgcgcatataagctgtaccttgcggtgaaaaacgctaacaaacaggttaacagcgtaatctgcatacagcgatggtttagggctaggttgcaggagaagaggttcatccagaagtatcacagcataaagaaaattgaacacgagggacaggaatgcctttcccaaaggaaccgcgctgcgagcgtcatccagaaagcagtcagacactttctgctgcggaagaagcaagaaaaatttacttctgggattataaagatccaggccctttggagagggtactcctggcggaaaaagaatgattgcacaaagataaaagcaatccgcctgtctctacaggtagtcaacagggagattcgcgaagagaataaactctacaagcgaacagctcttgctctccattacctgctgacctataaacatttgtccgctatcctcgaggctctgaagcatctggaagtggtcacacgacttagccctctgtgttgcgagaacatggcgcaatcaggggctatcagtaagatcttcgtcttaatccggagttgcaataggtctatcccgtgcatggaagtcattaggtacgcagtgcaagttctgctgaatgtaagcaaatacgagaaaacaaccagtgcggtctatgatgtggagaattgcattgatattctgttggagcttttacaaatttacagagaaaaacccggaaataaagtagcggacaagggaggcagcatcttcacaaaaacgtgctgcctgctggcaattctgctcaagaccaccaacagggctagtgacgtgagatcaaggagtaaagtggtggatagaatctactctctgtacaagctgacggcccacaagcataagatgaacacagagcggatcttatacaagcaaaaaaaaaactcaagtatttctataccttttatcccagagacaccggtgcggacgcgcatcgttagccggctgaaaccggactgggtgcttcgcagagacaatatggaagagataaccaaccccttacaagccatccaaatggtcatggacactctgggtatcccctactag

SEQ ID NO: 214934 - DNA, 10434 bp, Artificial Sequence
  Description of Artificial Sequence: Synthetic coding sequence
atggcaaatagaagggtggggaggggttgttgggaggtttctcccactgagaggcgacccccagccggtttgaggggcccagctgccgaggaggaagcaagctcccccccagtgttgtctctgtcacatttttgccgcagcccattcctgtgcttcggagacgtgctgctcggggcatcccggacactgagcctggcactggataatcccaacgaagaggtggcagaagtgaaaatcagccattttcccgctgccgaccttgggttcagtgtcagtcagagatgcttcgtgcttcagccgaaggaaaaaattgtcattagtgtgaattggaccccccttaaggaaggacgcgtgagagagataatgacattcctcgttaatgatgtcctgaaacaccaggctattctgctggggaacgctgaggagcagaagaaaaaaaagagatccctctgggacaccatcaaaaagaagaagattagtgcatcgacctcccacaatagacgcgtgagtaacatccaaaatgttaataagaccttttccgtgagccagaaggtagatagagtaaggtccccgctgcaggcttgtgagaacctggcaatgaatgaaggcggtccacccaccgaaaacaactccctcatcctcgaagagaataagataccaatttcaccaatcagtcctgctttcaatgagtgtcatggcgctacatgcctgccattgtcagtgcggaggtcgactacctactcatctctccatgcatcagagaatcgtgagttactgaacgtgcattctgctaacgtttcaaaggtgtcatttaacgagaaagcagttacggagacatcatttaactctgtgaatgtaaacggacagcgaggtgaaaattcaaagctcagcttgacacccaactgcagttctactctgaacattactcaatctcagatccactttctttccccagacagcttcgtgaacaacagtcatggtgctaataacgaactcgagcttgtgacatgtttatctagcgatatgttcatgaaagataactcccagcctgtgcacctcgagagtactatcgctcatgagatttaccagaagatactctcaccagactcattcattaaagataactacggtcttaaccaggatttggaatccgagtctgtgaaccccatcctcagcccaaatcagtttctgaaggacaacatggcctatatgtgcactagccaacagacatgtaaagtgccacttagtaatgagaattcgcaggtgcctcaaagtccggaggactggagaaaatcagaagtctctccccgaatccctgaatgtcagggtagcaagtcacctaaagccatcttcgaggagctggtggagatgaagagtaattactattccttcatcaagcagaataatccgaagttcagtgctgtgcaggatatttccagtcatagtcacaataagcagccaaagcgacgccctatcttgtccgcgaccgtgactaagcgcaaggctacttgcacaagagagaatcagaccgagatcaataagcctaaggccaagcgctgcctgaattcagctgtaggagagcacgagaaggtgataaataaccaaaaagagaaagaagacttccactcctatctgccaataattgacccaatcctgtcaaaatcaaaatcatacaagaacgaggtcacacctagtagtactaccgcgtcagtggctaggaaaagaaaaagtgatggcagcatggaggacgccaacgtgcgcgtggctatcacagagcatactgaagtgagagagatcaagcggatccacttttctccttcggagccgaagacctcagcggtaaagaagaccaaaaatgtgaccacacctatctctaaaagaataagcaatagggagaagttgaacttgaaaaaaaagaccgatttgtccattttccgtacacctatctcaaaaactaacaagcgaaccaagccgattatcgccgtggctcagtccagtctcacgtttataaagcctctcaagactgatatacctcggcacccaatgcccttcgccgctaagaacatgttttatgatgagagatggaaggagaaacaagagcaggggtttacttggtggctgaattttatattgactcccgacgacttcacggtgaagaccaacatttcggaagtgaatgccgcaaccctgctcttaggtattgagaaccaacacaagattagcgtacctcgagcacctaccaaggaggagatgagcctgcgtgcctataccgctcgatgccggctgaacagactgcggagggccgcttgtcgtctctttactagcgaaaaaatggtgaaggcaatcaaaaaactcgaaatcgagattgaagcgcgtcggctcatcgtgcggaaggataggcatctctggaaagatgtgggagagcgacagaaggtgttgaattggctgctctcctacaaccccctctggctcaggattggccttgaaactacttacggggaattgatcagcctggaggacaacagcgacgtaaccgggttggcgatgtttatcctgaataggttgctctggaacccggatattgcggcagagtaccgtcaccccacagttcctcacctgtaccgagacgggcacgaagaagctctcagtaagttcactctaaaaaaattgctgctgctggtgtgctttcttgattacgcaaaaatctctcggctgatcgatcatgacccatgcctcttctgcaaggacgctgaatttaaagcctcgaaggaaatccttctggcttttagtagagacttcctttctggcgagggcgatctctcccgccatttaggtctactgggactgcctgtgaaccacgtgcagactccatttgatgagttcgacttcgccgtaacaaacttggctgtggacctccagtgcggcgtgcggctggttcgcaccatggaacttctcacccagaactgggacctgagtaaaaagctgagaattccagcaattagcagactccaaaaaatgcataatgtggatattgttctgcaagtcctgaaaagccgaggaatagaactgagtgacgaacatggcaatacgatcctgagtaaggatattgttgaccgccaccgggaaaagactcttcgcctcctgtggaaaatagcattcgccttccaggtggacatcagtttaaacttggaccagctgaaggaagagatcgcgtttctgaaacacacaaagtccattaaaaaaaccatctctctgctctcatgtcattccgacgatctgataaacaaaaagaagggcaaaagggattccggctcattcgagcagtatagtgagaatataaaactccttatggattgggtgaatgccgtgtgtgccttctacaacaagaaggtcgaaaacttcactgtctcattttcagacggacgagtcttgtgctacctcatccatcattatcacccatgctatgtgcctttcgacgcaatttgccagcgaaccacccagactgtggagtgtacacaaactgggagtgtggtgctcaatagctcgagtgaaagtgacgactcatccctggacatgagcctcaaagcattcgaccacgaaaatacgtctgagctctacaaggaactgcttgagaatgaaaagaagaattttcacctggtccgctcggccgtaagagatttgggagggataccagcaatgattaatcatagcgatatgtcaaacacaattcctgacgagaaggtggtgattacctatctgagttttctctgcgccagattgctcgacttgcggaaggaaatccgagcggcaagactgatccaaactacatggcgcaagtacaagctcaagaccgacctaaagaggcaccaggagcgggaaaaggccgcacggataatacaactagctgtgattaatttcctagccaagcaaagacttaggaagcgggttaatgcagctctcgtcattcagaagtactggagacgggttctggctcagcgcaagttgctgatgcttaaaaaagagaagctcgagaaggtgcagaataaggcagcctcgctcatacagggctactggagacgttacagcacccgacagcgctttctgaagctcaaatactacagcataatcttacagagccggataagaatgataattgctgtgacgtcctataagagatacctgtgggctaccgtgacaatccagcgccactggcgggcttatttgcgcagaaaacaggaccaacagcggtatgaaatgctgaagagctccactctgattatccagtccatgttcagaaaatggaagcagagaaaaatgcaaagccaggtgaaagcgacagttattctgcagcgggctttccgggagtggcatctgagaaagcaagccaaggaagaaaactcagccatcatcatccaatcatggtatcgaatgcacaaggagctcagaaagtatatctacattcgtagctgtgtcgtgatcattcaaaaaagattcagatgttttcaggcccaaaagttgtataaaagaagaaaggagtcgatacttaccatccagaagtattacaaggcatacctgaaaggcaaaattgagaggactaactacctgcaaaagcgcgctgctgctatacaacttcaggcagcctttcgcaggctgaaggcacacaacctttgtagacagatcagggcggcttgcgtaatccaaagctactggagaatgaggcaggatcgcgtgaggtttctgaacttaaagaagacaataataaagttccaagcacatgtgcggaaacatcagcagaggcaaaagtataagaaaatgaagaaggcagctgtgatcatccagacccacttcagggcttacattttcgctatgaaggttttggctagttatcagaaaactcgtagtgccgttatcgtgctgcagtctgcgtacaggggaatgcaggctagaaagatgtacattcacatcctcacctcggtgatcaagattcagagctattatcgcgcttacgtgtccaaaaaggaattccttagcctgaaaaacgcaactatcaagttacaatctacggtcaagatgaaacagacacgaaaacagtacttgcatctgcgtgcagcggcactcttcattcagcaatgttacagaagcaaaaagattgccgcacagaagcgtgaagagtacatgcagatgcgagaatcctgcatcaaactccaggcattcgtgagggggtacctggtgcggaagcaaatgagactgcagagaaaggcagtgatatctctccagtcatattttaggatgaggaaagctcgacaatactatttgaaaatgtataaggcaatcatcgtgattcagaattactaccacgcttacaaagctcaggtgaaccagcgcaaaaacttcctgcaggttaaaaaggcagctacctgccttcaggccgcataccgcggttacaaggtccgccagctgattaaacagcagtcaattgctgctttaaagatccagtccgcattccgaggctacaataaacgagtaaagtaccagagcgtattacagtccatcattaaaattcagcgctggtaccgtgcttataaaaccttgcatgacacaaggacacatttcctgaaaaccaaagctgccgttatatcactacagagcgcttatagaggttggaaggtaaggaagcagattcggagggaacaccaagctgcccttaaaatccagtcagcttttcgaatggcaaaagctcagaagcagtttcgcctcttcaagacagctgctctggtaattcagcagaacttccgcgcttggactgcaggcagaaagcaatgcatggaatacattgagctgcgccacgctgtgctagtgctacagtctatgtggaagggcaagacactcaggcggcagctgcagaggcagcataagtgtgctataattatccagtcctactaccgcatgcatgtacagcagaagaagtggaaaattatgaaaaaggctgccctccttatccagaagtattacagggcctatagtatcggacgggaacaaaaccacctgtacttgaaaactaaggcagcggtggtcactctgcagtcggcttacagaggcatgaaggtccgaaaaagaatcaaggactgcaacaaggcagcagtgacgatccaatcaaaatatagagcctacaagacaaaaaagaaatatgccacgtatcgggcatcggccattataattcagagatggtatcggggaatcaaaatcacaaaccaccagcacaaagagtatcttaaccttaagaagacggctattaagatccagtccgtataccgtggtatacgggtacgtaggcatattcagcacatgcatcgggctgcgacatttatcaaggcaatgttcaagatgcaccagagtagaattagctatcacaccatgagaaaagctgcaattgtgatacaggttaggtgccgagcatattatcagggtaagatgcagcgggaaaaatacctgaccatcctgaaagctgttaaagtattacaggctagcttccggggagttcgggttaggcggaccttgcggaaaatgcagaccgcagccaccttgatacaaagtaattatcggaggtaccgccaacagacctattttaacaaactgaagaaaataacaaagactgtgcaacagaggtactgggccatgaaggagaggaacatccagttccagcggtacaacaaactaaggcactctgttatatacatccaggcaatcttccgagggaaaaaggccaggcgacatttaaagatgatgcatatcgctgccactctaatccagagacgcttcaggacgctgatgatgaggcgccgttttttgtcactcaaaaaaaccgccatcctgattcagcggaagtatcgggctcacctgtgtaccaaacaccaccttcagtttctccaggtccagaatgcagtgatcaaaattcagtcctcctataggcggtggatgatccgcaagcgaatgcgagagatgcaccgggcagctacgttcatacagtcaactttccggatgcatcggttgcatatgaggtatcaggctttaaagcaagcaagcgtagtgattcaacagcagtaccaagccaacagagccgcaaagctccagaggcagcattacctgagacagaggcattcggcagttattctccaagccgctttccggggaatgaagacgagacgtcatctcaaaagcatgcattcatccgctactctaatccagtctcggttccgctccctattggtgaggcgtcgctttattagcctcaaaaaggccaccatcttcgtgcagagaaaataccgggcaacaatctgcgctaaacataagctatatcaatttttacatctgcgtaaggccgcaatcactatacagtctagctaccgaaggttgatggtgaagaagaagctgcaggagatgcagcgggctgctgtgctcattcaggctacgtttcgaatgtaccgcacctacatcacatttcagacatggaagcacgccagcatccttattcagcagcattataggacttacagggccgctaagctccaaagggagaattacattaggcagtggcacagcgccgttgtgatccaggccgcatacaaaggaatgaaagcccgacagctgttgagggaaaagcataaagcatccatcgtgatccagagtacctaccgcatgtaccgccaatattgtttttaccagaagctccagtgggccactaaaatcatccaggaaaaatatagagctaataagaagaagcagaaggtatttcagcataatgaactcaagaaggaaacttgtgtgcaggctgggttccaagacatgaacatcaagaagcaaatccaagagcagcaccaagccgcaatcatcattcagaagcactgcaaagctttcaaaatccgcaagcactacctccatttgcgagccaccgtggtctctattcagagacgataccggaaactcacggcagttcggacccaggcagtcatatgcatccaatcttattataggggattcaaggtccgaaaggatattcaaaacatgcatagagccgctaccttaatccagtctttctaccggatgcatagggcgaaagtggactatgagactaagaagactgcaatagtcgttatccagaattactatcgtctatacgtgcgcgtgaaaaccgagaggaaaaactttcttgccgtgcaaaagagtgtgaggactattcaagcggctttccgtggcatgaaggtacggcagaaacttaaaaatgtttctgaggaaaagatggccgctattgttaatcaatccgccctctgttgctaccgcagcaagacacagtacgaagccgtacagtccgagggagtcatgatccaggaatggtacaaagctagcggactggcttgtagtcaagaggctgagtaccatagtcagagccgcgcagcagtaaccattcaaaaagctttctgccggatggtcaccaggaagttggagacacagaagtgcgcagctctgcggatccagttttttctccagatggcagtatatagacgaagattcgtccaacaaaaacgagccgcaatcactctccagcattactttcgtacttggcagacccgtaagcaatttttgctgtatcggaaggcggctgtggtcctgcaaaaccactatcgggcattcctttcggccaagcaccagcggcaagtgtacctacagatacggtcctctgttataattatccaagcacgttccaaagggttcattcagaaaaggaagttccaggaaataaaaaatagcacaattaaaatacaggctatgtggcgaaggtatagagctaagaaatacttgtgtaaggtcaaggccgcatgtaagatccaggcttggtacagatgctggcgagcgcacaaggagtacctggcaatccttaaggcagtgaaaattatccaaggctgcttttacactaaactggagcggacccgattcctcaacgtccgggcttctgcaataattattcagcgcaaatggagggcgatcctgcccgctaaaattgcgcacgaacatttccttatgatcaagcgccaccgcgctgcgtgtcttattcaagctcactatcgcggatataagggccgacaggtattcttgcggcagaagtcagccgctctgattatacagaagtacatccgggcaagggaagcgggaaagcatgagcgcataaaatatattgagtttaagaagtctaccgtaattctccaggctctggtacggggttggctcgtcaggaagcgcttcctcgagcaacgcgctaagatacggctgctgcacttcacagctgcagcttactaccatctcaatgcggttcgcattcaaagagcctataaattatacttagccgtcaaaaatgccaataagcaggtgaattcggtgatttgcattcagcggtggtttcgggcacgcctgcaggaaaaacgctttatccagaagtaccatagcattaagaagatcgagcatgaggggcaggaatgtttgagccagaggaacagggcagccagtgtgatacaaaaagcagtgcgccactttctgcttaggaagaaacaggagaagttcacctcaggaatcatcaagatccaggcgctctggcggggatattcatggaggaagaaaaatgattgtaccaaaattaaagccattcggctgagcttgcaggtggtgaatagagagatccgcgaggaaaataagttgtataaaagaaccgcactcgccctccattaccttctgacatacaaacacctgagtgcgattctcgaggccctgaaacacctggaggtggtcacccgactcagccccttgtgctgcgagaacatggcacagagtggtgcaatatctaaaatattcgttctgattcggtcttgcaataggagcatcccttgcatggaggttattagatatgccgtccaggtcctcctgaacgtctccaagtatgaaaagacaacatctgccgtctatgacgtggagaactgcattgacatccttctcgagctgctacaaatttaccgggaaaaaccgggaaataaggtggcagataaagggggatctatatttaccaagacgtgctgcctcctagctattttactgaagaccaccaatagagcttccgatgtgaggtccaggagcaaggtggtggaccggatctatagcctgtacaagctgacagcgcacaagcacaaaatgaatacagaaaggatcctctacaaacagaagaaaaattcctccatctctatacccttcattccagagacaccggtgaggacacgaattgtgagcaggcttaagcctgactgggtattgcggcgtgataatatggaagaaataacgaacccacttcaggccattcagatggtgatggatacgcttgggatcccgtactac

SEQ ID NO: 214935 - DNA, 1686 bp, Artificial Sequence
  Description of Artificial Sequence: Synthetic coding sequence
atgtgtgggatttgggcccttttcggaagcgacgactgtttgtcggtacagtgcctttcggccatgaaaatcgcccacagaggcccagatgccttccggttcgagaatgtgaatggatacaccaattgttgtttcggtttccaccgactggctgttgtggatccattgtttggaatgcagccaatccgcgtgaagaagtacccttacctctggctgtgttataacggcgaaatttataatcataagaaaatgcagcaacacttcgaatttgagtatcagacaaaagttgacggtgaaattattcttcatctttatgacaaggggggaattgaacagaccatttgcatgttagacggagtgtttgcgttcgtgctgttagacactgccaataagaaagtgtttctgggcagggacacctacggggtgaggcctctatttaaggctatgacagaagatgggttcttagccgtctgttctgaagccaagggtctggtaaccctgaagcacagcgcaacaccttttctgaaggtcgagccctttctaccaggccattacgaagtgttggacctaaagccgaatggaaaggtcgccagcgtcgagatggtgaaatatcaccattgtcgcgacgtgccacttcatgccctctacgacaatgtggaaaaactgttccccggatttgagattgaaaccgttaagaataatctgcggatactgtttaataatgcggtcaaaaagaggctaatgacagatcggagaattgggtgcctgctgtcagggggattggactccagcctcgtggccgcaactctcctaaagcagctgaaagaggcccaggtccagtacccactacagactttcgccatcgggatggaggatagtcctgatttattagcagcccgtaaagtcgccgaccatattggatcagagcattacgaggtactctttaactcggaggaagggattcaggctttggatgaggtgatttttagccttgaaacctacgacataaccacagttcgcgcttcagtcggaatgtacctcatttcgaagtacatccgcaagaatactgactccgtggtgattttcagtggtgaaggctccgacgagctcacccagggatacatttactttcataaggcgccttcccctgagaaagccgaggaagagtcggaacggctcttgcgcgagctttacctgtttgacgtgctgagagccgaccggactaccgccgctcatgggttggagctgagagtgccttttctcgaccatcgcttcagctcatactacttgtctctgccacctgaaatgcgtatccccaaaaatggcatcgaaaagcatctgctcagagagactttcgaggacagcaatctcatccccaaggaaatactatggaggccaaaagaggcttttagcgatgggattacaagcgtgaaaaatagctggttcaaaatcctgcaggaatatgtggagcatcaagttgacgacgccatgatggccaacgcagcgcagaaatttccgttcaacacccccaagaccaaggaaggttactactacaggcaagtttttgaacgccattaccctggcagggcagactggctttctcactactggatgcctaagtggatcaacgcgaccgacccctccgccagaaccctaacacattacaagtccgcagtgaaggcttag

SEQ ID NO: 214936 - DNA, 1686 bp, Artificial Sequence
  Description of Artificial Sequence: Synthetic coding sequence
atgtgcggaatctgggccctgttcgggtctgacgattgtctgtcagtacagtgcttatccgctatgaagatcgcgcatcgcggtcctgacgcctttcgttttgagaatgtcaacggttacacaaactgttgcttcggatttcatcggctggctgttgttgacccattgttcggaatgcagcctattcgggtaaagaaatacccctacctatggctgtgctacaacggtgagatttacaatcataagaagatgcagcaacacttcgagttcgagtaccagaccaaagtggacggggaaattatccttcacctgtacgataagggtggtattgaacagaccatctgcatgctggacggtgtcttcgccttcgtgttattagataccgcgaacaaaaaagtgttcctaggcagggacacatatggagtgcgccctctttttaaagccatgaccgaagatggatttctggccgtgtgtagtgaagccaaaggcttagtcactctgaagcacagcgcgaccccattcctcaaagtcgagccgtttctgcccggacactatgaggtgctggatcttaaacccaatgggaaagtcgcttcggtggaaatggtgaaataccaccattgtagagatgttcctcttcatgccctttatgataatgtagaaaagctgttcccgggttttgaaatcgagaccgtgaagaacaatctacggatcttgttcaataacgccgtcaaaaaaaggcttatgaccgaccgacggatagggtgtctcctgagcggcggtctggatagctccctggttgccgctaccttactcaagcaattgaaagaggctcaagtgcagtaccccctgcagacgtttgccatcggcatggaagattcccccgatttgctggcagcacggaaggttgctgatcacatcggttcagagcactatgaagtgctgtttaattctgaggaaggcatccaggctctcgatgaggtgattttcagcctggagacctacgatatcacaaccgttcgggcttctgtcgggatgtatctgatttctaagtatattcgcaaaaacacggactctgttgtgatcttctcaggagagggctccgacgaactgacacagggatacatctactttcacaaggccccttctcccgaaaaggcagaggaggaatcagagcgtctgctgcgagaattgtatctgtttgacgttctacgagctgacagaactacggcggctcacgggctcgagttgagggtgcctttcctcgaccatcgcttttcatcctactatctgagcctgccccctgaaatgcggatccctaaaaacgggattgaaaaacacctgctgagagagactttcgaggacagtaatctgatccctaaagagattctgtggcggcctaaagaggcgttcagcgatggcatcacgtcagtgaagaactcttggttcaaaatcctccaagagtacgtggagcaccaggtggacgatgcaatgatggcaaacgcagcccagaagttcccttttaacactccaaaaaccaaggagggctattattatcggcaagtttttgagcggcactatccaggcagagccgattggctgagccactattggatgccgaagtggatcaacgccacagatccgtctgccagaacactgactcattacaaaagcgcagtgaaggcttag

SEQ ID NO: 214937 - DNA, 1686 bp, Artificial Sequence
  Description of Artificial Sequence: Synthetic coding sequence
atgtgcggtatttgggcgctttttggatcagatgattgtttgtcagtgcaatgcctgagcgccatgaaaatcgcccatagaggaccggacgccttcaggtttgaaaatgtgaacggctatactaattgttgttttggttttcaccggctggccgtggtcgaccctctgttcggtatgcagccaattagagttaagaagtacccctatctgtggctctgctacaatggcgagatatataaccacaagaaaatgcagcagcacttcgagtttgagtatcagactaaggttgacggggagattatactgcatctttacgacaaaggcggtatagaacaaacaatttgcatgctggatggcgtattcgccttcgttctgctcgacactgctaacaagaaagtgtttcttggtcgagatacttacggagtcaggcctctgtttaaggccatgaccgaggatggcttcctggccgtctgttctgaagctaaaggccttgtgacattgaagcattcagccaccccttttctgaaagtggagccgttcctacccggacattacgaagtcttagatcttaagcccaatggcaaagttgcctcagtggagatggtaaagtaccatcattgtcgcgacgtgcctctgcatgccctgtacgacaatgtcgagaaactgttccctggcttcgaaattgagaccgttaagaacaacctccggatcctctttaacaacgctgttaagaagcgactgatgaccgatcggcgtatcgggtgcctactaagtggcggacttgacagcagcctggtggcggctactctactgaaacagctgaaggaagctcaggtgcagtaccctctgcagactttcgctatcgggatggaagattccccagacttattagctgcacggaaggtggcggatcacattggatctgagcactatgaagttttattcaatagtgaggagggcattcaggccctcgacgaggtaatattttcactggaaacttatgatattactacggtcagggcttccgttggcatgtacctgatttccaagtacatcagaaagaatacagactcggtggttatttttagtggtgaaggtagtgatgagctgacccagggctatatctactttcacaaggcgccaagcccggagaaagctgaagaggaatccgagaggcttctaagagagctttacttgttcgacgtgctgcgcgcagatcggacaactgccgctcatgggctcgaactgagagtacccttccttgaccaccggttttcttcttactacttgtctctccctcccgagatgcgtatacctaaaaacggcatcgagaagcacctattgcgcgaaacttttgaggacagcaacctaatacccaaagagatcttgtggaggccaaaggaagcattttctgacggcataacatccgtgaagaactcttggttcaaaatactacaggaatacgtagaacatcaggtggacgacgccatgatggcaaacgccgcacaaaaatttcccttcaacactcccaaaacaaaggagggctattactacagacaggtgttcgagcggcactacccaggcagggccgattggctgtctcattactggatgccgaagtggattaatgccaccgaccctagcgctagaaccctcacacactacaaaagcgcggtaaaggcctag

SEQ ID NO: 214938 - DNA, 87 bp, Artificial Sequence
  Description of Artificial Sequence: Synthetic coding sequence
atgtgtggaatttgggctcttttcggtagcgatgattgtctgtccgtgcaatgcctttccgccatgaaaattgcacacagggggtag

SEQ ID NO: 214939 - DNA, 489 bp, Artificial Sequence
  Description of Artificial Sequence: Synthetic coding sequence
atgtgtggcatctgggcactgttcgggagtgatgactgccttagtgtgcagtgcttgtctgccatgaaaattgcccaccggggtccagacgcattccggttcgagaatgtcaacgggtacacgaattgttgcttcgggttccacaggcttgctgtggttgatccactgtttgggatgcagccgatcagggtgaaaaagtatccctatctgtggctgtgctacaatggggaaatatacaatcataagaaaatgcagcagcatttcgaatttgaatatcaaacgaaggtggacggagagatcattctccatttgtacgataagggcggaattgagcagaccatctgcatgctggacggggtgttcgcctttgtcctgctcgataccgcaaataagaaggtattcctgggacgggatacatatggcgtgagacccctatttaaggcaatgaccgaggacggtttcctggctgtatgctcagaagccaaatag

SEQ ID NO: 214940 - DNA, 648 bp, Artificial Sequence
  Description of Artificial Sequence: Synthetic coding sequence
atgtgtgggatctgggcactgttcggtagcgatgattgtctgtccgtgcagtgcctgtccgcaatgaaaatcgcccacagaggcccagacgctttccggttcgagaatgtgaatggctacaccaactgctgttttgggttccaccgactggccgtggtggaccctctgttcggaatgcagccaatacgggtcaaaaagtacccctatctgtggctgtgttacaacggtgagatctacaaccacaagaaaatgcaacaacatttcgagtttgagtaccagaccaaagtggacggtgagatcatcttgcacctatatgacaagggcggaattgaacaaacaatttgtatgctggacggcgtttttgcgttcgttctattggacacggctaataagaaggtgtttctgggacgtgacacgtatggtgtccgtccactattcaaggcaatgacagaggacggtttcctggccgtgtgctccgaggctaaaggtctggttaccctgaagcactcagcaacacctttccttaaagtggaaccgttccttccaggacactacgaggtgctggacttgaagccaaacggtaaggtggcgagcgtggagatggtcaaatatcaccactgccgcgacgtgccactccacgctctgtag

SEQ ID NO: 214941 - DNA, 360 bp, Artificial Sequence
  Description of Artificial Sequence: Synthetic coding sequence
atgtgcggaatatgggccctgttcggtagtgatgactgtttatcggtccaatgcctttcagctatgaagatcgcccatcggggtcctgacgccttccggttcgagaacgttaatgggtatacaaactgctgcttcgggttccaccgtctcgccgtagtcgacccgctcttcggaatgcagccgatccgagtgaaaaaatacccgtacctgtggttatgttacaatggagaaatttataaccacaagaaaatgcagcaacatttcgagttcgaataccaaaccaaagtggatggagaaatcatacttcacctctacgataaagggggaattgagcagactatctgtatgctggacggctag

SEQ ID NO: 214942 - DNA, 102 bp, Artificial Sequence
  Description of Artificial Sequence: Synthetic coding sequence
atgtgtggaatatgggccttgttcggttcagatgattgcctcagcgttcagtgtctgtccgctatgaagatcgctcatcggggaccagacgcattccgctag

SEQ ID NO: 214943 - DNA, 192 bp, Artificial Sequence
  Description of Artificial Sequence: Synthetic coding sequence
atgaagattgctcacagaggcccagatgcattccgattcgaaaacgtgaacggctatacgaattgctgttttgggtttcataggctggcagtcgtcgaccccctatttggtatgcagcctattcgggtgaaaaagtacccatacctctggctttgctacaacggggagatctataaccacaagaaagtctag

SEQ ID NO: 214944 - DNA, 1437 bp, Artificial Sequence
  Description of Artificial Sequence: Synthetic coding sequence
atgcagcagcatttcgagttcgagtaccaaacaaaagtggatggcgaaatcattctgcacctgtacgacaaaggcggaatcgagcagaccatttgcatgttggatggggtttttgcattcgtgctcttggacacagccaacaaaaaggtttttcttgggcgtgatacatacggggtaagaccgctgtttaaggcgatgacggaggatggtttcctcgcagtgtgctccgaagccaaaggactggttaccctcaagcattcggctacaccatttctgaaggttgagccttttctgccaggccattatgaagtccttgatctgaagcccaatggcaaagtggcgtccgtggagatggttaaataccaccactgtcgggatgtcccacttcacgccttatacgacaacgttgaaaagctcttcccagggtttgagatcgagaccgtcaagaacaatctgcgcatcctgtttaacaacgctgtgaagaaacggttgatgacagatagaagaatcggttgccttctgagcggaggcctcgattcttctctggtcgcagctacactgttaaaacagctcaaggaggctcaggtgcagtatcccttacaaacctttgccattggcatggaagatagtcccgacttgctcgccgcacgtaaggtggccgaccacatcggcagtgaacactatgaagttctgttcaattctgaggaagggattcaggccctcgacgaggttatattctcactggagacgtacgatatcaccaccgtgcgcgctagcgttggcatgtatctgatcagcaaatacatcagaaagaatacagacagcgttgtgattttttccggggagggaagcgacgagctgacgcaggggtacatctactttcacaaagccccttcaccagaaaaggccgaggaggaatcggaacggctcctccgcgaactgtacctgttcgatgtcctgcgagcagatcggaccaccgctgcccatgggctggagttgcgcgtcccctttctagatcacagattctccagctattacctgtcgctgccacctgagatgaggatccctaagaatgggatcgagaaacacctgttaagggagactttcgaggattcaaatctgatcccaaaagagattctatggaggcctaaagaagctttcagtgacggcattacaagtgtaaagaattcctggttcaagatcctgcaggaatacgtggagcaccaagttgacgatgccatgatggcgaatgccgcacagaagttccccttcaacacccccaaaacgaaagagggttattattatagacaggtgttcgagaggcattacccaggacgtgctgactggctctctcactattggatgccaaagtggatcaacgctacggatccctctgctcgaaccctaacgcattataagagtgcagtcaaagcatag

SEQ ID NO: 214945 - DNA, 1623 bp, Artificial Sequence
  Description of Artificial Sequence: Synthetic coding sequence
atgaagatcgcccatagaggcccagatgcttttcgctttgagaacgtgaacggctataccaactgttgcttcgggtttcacaggctggctgtggttgatccgctgttcggcatgcaacccattagggtgaaaaagtatccatatctgtggctgtgctataacggcgagatttataaccacaaaaagatgcagcagcatttcgaatttgaataccagacaaaggtcgatggagaaattatcctgcacctgtacgataagggtggaattgaacagaccatctgtatgctggacggggtgtttgccttcgtgctcctggacaccgctaataagaaagtctttctaggacgggacacatacggggttcggccattattcaaggctatgacagaagacggctttttggcggtgtgctccgaggctaaaggtctcgtgacccttaagcatagtgccaccccttttctgaaagttgagccttttctgcctggccattacgaggtgctcgacctgaagcccaacggaaaagtggcctctgtcgaaatggtgaaataccaccactgccgggatgtgccattgcacgctctgtatgacaatgttgaaaagcttttccctgggttcgagatcgagacagtgaagaataatctgagaattctgtttaacaatgctgtgaagaagaggttgatgacagaccggcgaatcgggtgtttgttatctggaggactggattcaagcctggtcgccgctaccttgttaaaacagctgaaggaggcccaagtacagtacccactgcagacgtttgccattgggatggaggactctcctgacttactcgctgcaaggaaagtagctgaccatatcggttccgaacactacgaagtgctcttcaacagtgaggagggaatccaggccctggacgaggtcattttcagcttggagacttatgacatcaccaccgtccgtgcgagtgtgggcatgtacctaatcagcaaatacatcaggaagaacacagactccgtcgtgatttttagcggcgagggttccgatgaattgactcaaggttacatttatttccataaggctccatcaccggaaaaggccgaggaagaatctgaacgcctactgagagagctgtacctgtttgatgtgctgagggctgacagaaccactgctgcccacggtctcgagttgcgcgttccattcctggatcatcggttcagtagttattacctgagcctgcctcctgagatgcgcatccctaaaaatggaattgaaaaacacctgttgagggagaccttcgaggatagtaacctgattcccaaggagatcttgtggaggccgaaggaggcctttagcgatggaatcacatcggttaagaattcctggtttaagattctgcaagagtatgtcgaacaccaggtagatgacgccatgatggccaacgccgctcagaagtttccctttaacacacccaagacaaaggagggctactactaccgccaggtattcgagagacattaccccggacgggcagattggctctctcactactggatgcccaagtggataaatgcaactgacccaagcgcccgaactcttacacactacaaatctgccgtgaaagcatag

SEQ ID NO: 214946 - DNA, 1437 bp, Artificial Sequence
  Description of Artificial Sequence: Synthetic coding sequence
atgcagcagcattttgaattcgagtatcagacgaaggtcgacggagagatcatcctgcatctttatgacaagggagggatcgagcagacaatctgcatgctggatggggtctttgcctttgtgctgctggacactgctaataaaaaggtctttctggggagggatacgtacggagtacgaccactgtttaaagcaatgacagaggatggctttctcgccgtctgtagtgaggccaaagggctggtcacgctgaaacacagcgccacgccatttctaaaggtagagccctttctgcctggacactatgaggtcctcgacttaaagcccaatggaaaagtggcttcggtggagatggtcaaatatcatcattgccgcgacgtgcccctgcacgccctttatgacaatgttgaaaaactgttccccggtttcgaaatcgagacagtaaagaacaatctgagaattttatttaacaatgctgtgaagaagaggttgatgactgataggagaatcggctgcttgctgtccggaggcttggattcatctttagtagcagccactttattgaaacagctaaaagaggcccaggttcaataccctctccagaccttcgcgattggaatggaggactcccctgacctgctcgccgctcgcaaggtcgccgaccatattggaagcgaacattacgaggttttgttcaatagtgaagagggcattcaggcccttgatgaagtaatcttttctctggaaacatatgacatcaccacagtccgggcatcagtcggaatgtacctgattagtaagtacatccgcaaaaataccgatagtgtagtcatattttcgggcgaaggcagtgacgaattaacccaggggtatatttacttccataaggcgccaagccccgagaaggcagaagaggagtctgaaagattactacgggaactgtacctcttcgacgtactgcgcgctgaccgcactactgcagcccatggattggaactcagagttcctttcctggaccatcgcttctcgtcttactatctaagtctgcctcctgagatgaggattcccaagaatggaatcgagaagcacctcttaagggagaccttcgaagattccaatctcattccgaaagagattctttggagaccaaaagaagctttctcggatggtatcacgagtgtgaagaactcatggttcaagatccttcaggagtatgtggaacaccaggtcgacgacgccatgatggcaaatgcagcccagaagtttccatttaacactcccaagactaaggaggggtactactatcgccaagtgttcgaacggcattaccccggacgggctgattggttaagccactactggatgcccaaatggattaatgctacagaccccagcgccagaactctgactcattataaatcggctgtgaaagcgtag

SEQ ID NO: 214947 - DNA, 1395 bp, Artificial Sequence
  Description of Artificial Sequence: Synthetic coding sequence
atggctgccagctgtctagtgcttctagctctgtgcctgctgttgcccttgctgctactcggaggatggaaaagatggaggaggggcagagccgctcgacatgtcgtagcggtagtgcttggggatgtcggacggagtcccaggatgcagtatcatgccctgagtctcgcgatgcacggcttttcggttaccctcctgggcttttgtaacagcaagccccatgatgaactcttacagaataatcgaatccagatcgtgggactaaccgaactgcagagcctagctgtggggcctcgcgtcttccagtacggcgtcaaggttgtgttacaggcaatgtacctcctgtggaaacttatgtggcgagagccgggagcctatatattcctgcagaatcctccaggacttccctcaatcgcagtttgctggttcgtcgggtgtctctgtggaagcaaacttgttattgactggcataattacggctattccatcatggggctggttcacggcccaaaccacccccttgtgctgctggccaaatggtatgagaagttctttgggcgtctctcacatcttaatctatgcgttactaacgccatgcgcgaagatctagcggacaactggcatatccgtgctgtaacagtgtatgacaagcctgcatcgttcttcaaggagacacccttagatctgcaacaccgcctttttatgaagctggggtccatgcattccccgtttcgagcaaggtctgagcccgaggacccggttacagaaagaagtgcatttacggaacgagacgcgggtagtgggctcgtcaccaggctacgggagaggcccgctctgctggtgtcctccaccagctggaccgaagacgaagacttttctattctgctggcagccctagaaaaatttgaacagctgacccttgacgggcacaacttgccctccctcgtttgtgttatcaccggcaaaggccctcttagagaatactattcccgactgatccaccagaagcacttccaacacatccaggtgtgtactccttggctggaggcagaagactatccgctgttgttaggctccgcggatttgggggtctgcctgcacactagttccagtggcctcgacctgcctatgaaggtggtggacatgttcggttgttgcctaccagtctgtgcagtaaacttcaagtgccttcacgagttagtgaagcacgaagagaatggcctggtcttcgaggacagcgaggaacttgcagcacagttgcagatgctgttctccaactttcctgatccagcgggaaagctgaaccagtttagaaaaaatctgagggaatcccaacagctcaggtgggacgagtcttgggtgcagacagtcctgccacttgtaatggacacttag

SEQ ID NO: 214948 - DNA, 1062 bp, Artificial Sequence
  Description of Artificial Sequence: Synthetic coding sequence
atgtacctactgtggaaactaatgtggcgcgaacctggcgcatatatatttcttcaaaatcctcctggtctgccctcaatagcagtttgctggttcgtggggtgcctatgcggttccaagctggtgatagattggcataactatggatactctattatgggcctggtgcacgggcctaaccatccgctggtactgcttgctaaatggtacgagaaattctttggcagactttcccatttgaatctatgcgtaacaaatgcgatgagagaagatttagctgataattggcacatccgcgctgtgaccgtttacgacaagcccgcttccttctttaaagagaccccactggatctgcagcatagactcttcatgaagctgggtagtatgcactctcctttccgggctcgctctgagccagaagatcctgttaccgaaaggagcgcatttactgagcgtgacgccggatccggactggtgacccgcttgcgcgagcgcccagctctgctcgtctcttctacatcttggacagaagacgaggacttcagtattctgcttgctgccctggagaaattcgagcagttaaccttagacggtcacaatctacctagcttagtctgtgttattactgggaagggcccactacgcgaatattactctagactgatccaccagaagcatttccaacatatccaggtgtgtaccccttggttagaggctgaagattatcccctgttgctcgggagcgccgacctgggggtgtgcctgcacacatccagttcgggacttgacctacccatgaaggtcgttgacatgtttggatgttgcctgcctgtttgtgccgtcaattttaaatgtcttcacgagcttgtcaagcatgaggagaacggcttggttttcgaagatagtgaagaactcgctgcccagcttcagatgctattcagtaattttccggatcctgctggcaaactcaaccagtttagaaagaatttgagagagagtcagcaactccgatgggacgagagctgggtgcagactgtgcttcccttggtgatggatacttag

SEQ ID NO: 214949 - DNA, 1422 bp, Artificial Sequence
  Description of Artificial Sequence: Synthetic coding sequence
atggctcagctcgaaggttattattttagtgcggctttatcttgcacattcctggtgtcgtgtctgttattttccgcctttagtcgtgcgttgcgcgagccatacatggacgagatctttcacctgccccaagctcagaggtactgtgaggggcactttagcctctctcaatgggaccctatgatcactaccttacccggtctctatttggtaagcatcggtgtaattaagcctgccatctggattttcggatggagtgaacacgtggtctgtagcattggcatgctacgctttgtgaacctccttttttccgtaggcaatttctatctgctctatctacttttctgcaaggtgcagccacggaacaaagctgctagctccatccagagagtgctgtccaccctgacactcgcagtcttccccactttgtatttttttaactttctgtactacaccgaggcgggttccatgttcttcacgttatttgcttatctcatgtgcctctatggcaaccataaaacctcagcgttcttgggtttctgcggctttatgttccgacagactaatattatctgggctgtcttttgtgcgggaaatgtgatcgcccagaagctgaccgaggcctggaaaacagaactacaaaaaaaggaggacagactaccccctatcaagggtccatttgccgaattccgcaaaattctgcagttcctcctcgcctatagtatgagctttaagaacctgtctatgcttctgctgttgacttggccgtacatccttctcggattccttttctgtgcctttgtggtcgtgaacggcggaatcgtcatcggcgatagatcttcacacgaggcgtgcctgcactttccacagcttttttattttttctcattcactctattcttcagcttcccacacttgttgtcacctagcaagattaagacttttctctctcttgtatggaagagacgcatcctgttcttcgttgtcaccctggtgagcgtatttctggtgtggaagttcacatacgctcacaaatacctgctcgcagacaatcgtcattacaccttttatgtgtggaagagggtgttccagaggtatgagaccgtgaagtacctgctggtgcctgcctatatttttgcgggatggagtatcgctgactcgctgaagagtaaatcgatcttttggaatttgatgttcttcatctgtctgttcaccgtgatcgtaccccagaaattgctagagttccggtatttcatactcccatacgtgatatatcggctgaatattcccttgcctcctacctcgagactaatatgcgaactgtcatgttacgctgtagtgaatttcatcactttttttatttttctgaacaagacatttcagtggcccaattctcaggacattcaaagatttatgtggtag

SEQ ID NO: 214950 - DNA, 1479 bp, Artificial Sequence
  Description of Artificial Sequence: Synthetic coding sequence
atggccgctggtgagaggtcatggtgcctgtgtaaactgctccgctttttctactcgctcttttttcctgggctgatcgtgtgcggcacattatgcgtttgtcttgtaattgtactgtgggggatccgcttactgctccagcgcaaaaaaaagttggtgtcaacttctaagaatggtaagaatcaaatggtgatcgctttcttccacccctactgcaacgccggtggtggaggcgagcgcgttctgtggtgtgccctgcgcgctttgcagaaaaagtaccctgaagctgtttacgttgtgtacaccggtgacgttaatgtgaatggccagcagattctggagggtgccttccgcaggtttaatattagactgatccatcctgtgcagtttgtattcctgagaaaacggtacctcgtcgaggactcactgtaccctcatttcactttgctcgggcagtctctgggttccatctttctcgggtgggaagccctgatgcaatgcgttcctgatgtatacatcgatagtatgggttatgccttcactctgcctctgtttaaatatattggaggctgtcaagtggggagttatgtccactatccgaccatatctacggatatgctgtccgtcgtgaagaaccagaacattggattcaacaacgccgcattcataacccggaacccattcctttccaaagtgaagcttatttattactacctgtttgcatttatatatggactcgtgggctcttgtagtgacgtcgtaatggtaaattcctcttggacacttaatcacatcttatccctatggaaggtcggaaattgtactaacatagtctatcctccctgtgatgtgcaaaccttcctggacatcccactgcatgaaaaaaaaatgacaccaggccaccttctagtatcggtaggccagttcagacccgaaaagaatcatcctcttcagattagggcgttcgccaagttgctgaacaagaagatggtggagagtcccccttccctgaagctcgttcttatcggagggtgccggaacaaagatgacgagctaagggttaatcaactgcggagactttctgaagatctgggggttcaagagtatgttgagttcaaaattaacatccctttcgacgagttgaagaattacctatcagaagccaccattgggttgcacacaatgtggaacgaacactttggtataggcgtggttgaatgcatggccgcagggacaatcatcctagctcataacagcggaggccctaaactcgatatcgtagttccccacgagggggatatcacgggcttcttggccgagagcgaggaggactatgctgagaccatcgcacacattctctccatgagcgcagaaaagcggctgcagattcgaaaaagcgcgagggccagcgtgtctaggttcagcgatcaggagtttgaggttacatttctgagttcggtggaaaagctgttcaagtag

SEQ ID NO: 214951 - DNA, 111 bp, Artificial Sequence
  Description of Artificial Sequence: Synthetic coding sequence
atggctgctggagaaaggtcttggtgtctatgcaaattactgcgcagctgcggagtttatgggagctggcacaattacccttgtactcagttcggaggccctaaagcttag

SEQ ID NO: 214952 - DNA, 1467 bp, Artificial Sequence
  Description of Artificial Sequence: Synthetic coding sequence
atggccggtaagggcagcagcggaaggcggccactcttgctgggccttttggtcgctgtcgcaaccgtgcacttagttatctgtccgtacactaaggtggaagaatcctttaacctccaggctacgcacgaccttttgtaccattggcaggaccttgagcagtatgaccatctggagtttcctggcgtcgtacccaggacattcctggggccagtggtgattgcagtgttctcaagtcccgcagtctacgtgctgagcctcctcgagatgagcaaattttatagtcaactaattgttcgaggagtgctgggacttggcgtcatctttggcctgtggaccctgcagaaggaggtgcgcagacatttcggcgcaatggtcgctaccatgttctgctgggtgacggcaatgcaattccacctgatgttttactgcaccaggacgctgcctaacgtgcttgcgctgccggtggtcctcttagccctggccgcttggctgaggcatgagtgggcaaggttcatctggctgtcggcgtttgctataatcgtgtttcgtgtggaactatgtttgttccttggtcttctcttattgcttgcattagggaatcggaaagtcagtgtggttagagctttacggcacgccgtgcccgcaggtatcctgtgtctagggctcactgtcgctgtggattcgtacttttggcggcaactgacatggcctgaaggcaaagttctatggtataatactgtgcttaacaaatcttctaattgggggacaagtcctttgctctggtacttctatagcgcgctgcccagagggctgggatgctccctcttatttatacctcttggcctggttgaccgacggacacacgctcctacggtgctcgccctgggcttcatggccttgtatagtctgttacctcataaagagttgcgcttcattatttatgcgtttcccatgttgaatattacagctgcaagagggtgctcatatctgctgaataactataagaagtcctggctctacaaggccggatctttgctcgtgatcggacatcttgtggtgaatgccgcatacagtgctactgctctctacgtatcccattttaactaccccggtggtgtagcgatgcagaggctccaccagctcgttccgcctcagaccgatgtcctcctgcatatagacgttgccgctgcacagactggagtctctcgatttctccaagttaactccgcctggaggtacgacaaaagagaggatgtgcagccagggacagggatgctcgcctacacacacatcctgatggaggctgctcccggactcctggcgctgtaccgcgacacccaccgggtgctcgcttcagtcgtcggcactaccggggtgagcctaaacttgactcagctccccccattcaatgtgcatttgcagactaagcttgtgctgctggagcgcctgccccgtccttcctag

SEQ ID NO: 214953 - DNA, 987 bp, Artificial Sequence
  Description of Artificial Sequence: Synthetic coding sequence
atgccgcctacacagccacgcccttgcatgtgcccgataagtactacgcaggtggcctcccaatgcaggggctgcacgtcttggtgcccacccaggcagacctctttctgtaccctgacatggcagccccctcgccaggtatgtctgggctttagcaagagtacagcaccagggggaaccactagagggcgaatgtgctctaggggccaggcttgttggcatacccatacgagctcctggagacgcccatgggccccaggtcccctgcagggacacacgccaggcccaggacagagacgaggggaccaccggtgtgaatcagaacccgaccccacagccccactacagaggcctcccgctgataaagctggagcttctggagaagccccacccgctgtgctgagaggcactcggcaaccctctgctgccactggactccccggtgccgtaattacaacaagcttttggcataattcctcaacaatcatgacaatccagcgatcaaaatcaaaagactgggcccctgcctcagaccgtcaccagactcgctctagggcttcctctacagcttcagccggagcactgagtactaaggaacgtggagcacaggtgctgctggctcccagggaaccactccccagggtgatggtggcgagctcaggtctacctgccggagattgccggcctgatcaggtgccgtttatgactaatcaggagcaaagggcacacccgggtacgtgtctgccagggggacacgtctgcccagcacacccaggtggcgctgtgttctggcagcaccccactctggctgctagggggcctctgggggcaccaaagactgcgcctcctctgagaggagaccatggcggtccaggcaggactcctcccccttggtgtcatcactgtaacttctgcattcataggcacccaatctctattacagacaagatccttggcgacaaacacatccagaagggaatgcgctag

SEQ ID NO: 214954 - DNA, 2865 bp, Artificial Sequence
  Description of Artificial Sequence: Synthetic coding sequence
atgaacaatcaccagttagagctggccaaacagctgcacaaagaggggcatcttttttactgcacctgtagagtgctgacatgccccggacaggctaagagcatcgctagtgccccagggaaatgtcaggactctgccgctcttacctctacggctttctcaggcctggacttcggcctgctatccggatacctgcataagcaagctctggtcacagctacgcacccaacatgtaccctcctttttcctagttgtcatgcttttttccccctgcccctgacacctacactgtataagatgcacaaaggttggaaaaactactgcagccaaaaatccctgaatgaagccagcatggatgagtacctgggaagtcttggtctttttcgtaagctgactgctaaagacgcctcttgtctctttcgtgctatttcagagcagttgttttgctctcaggttcaccatctggagatccggaaggcgtgtgtgtcttatatgcgcgaaaaccagcagaccttcgaatcttacgtggaggggagcttcgaaaaatacctggaaagacttggagacccaaaggaatccgcagggcagctggaaattagggctttgtcactgatttataatcgggatttcatcctgtatcggttccccggaaaaccccctacttacgttaccgataacggatacgaagataagattcttttgtgctacagtagctcaggccactacgacagcgtgtactccaaacaattccagagctccgccgctgtttgccaagcggtattatacgagatcctttacaaagatgtcttcgtggtggatgaggaagaactcaagacagccatcaagttattcagaagcggctctaaaaagaataggaacaacgcagtaactgggtccgaagacgcgcacacggactacaaaagcagcaaccaaaaccgcatggaggagtggggggcttgctataacgccgaaaacattcctgaagggtacaacaaaggaacggaagaaaccaagtcacctgagaatccaagcaagatgccgtttccatacaaggtactgaaagccctggacccagagatctaccgcaacgtggaattcgatgtgtggctggattcaagaaaagaactgcagaaaagtgactacatggagtacgcaggacggcaatactacctcggtgacaaatgtcaggtctgcctggagagtgagggacgctactacaacgcacacatccaggaagtgggaaacgaaaacaacagcgtaactgtatttatcgaggaactcgccgagaagcatgtagtgccgcttgcgaacctgaaacccgtgactcaggtcatgagtgtgcccgcatggaatgcaatgccgtccagaaagggcagaggctatcagaaaatgccagggggatacgtccccgagattgtgatcagcgaaatggatatcaagcaacagaagaagatgttcaaaaaaattcggggaaaggaggtgtatatgactatggcatacggaaaaggggatcccctgcttccacccaggctccagcattcaatgcattacggacatgatccccctatgcactacagccagacagcaggaaacgtcatgagcaatgaacattttcacccacagcacccaagccccagacagggacgtgggtatggcatgccacggaattcctctcgcttcatcaatcgccacaacatgccagggccaaaagtggatttttaccctggcccaggaaagagatgttgtcagtcgtatgataacttttcttatcggtctcgttctttccgccgatcacatcgccaaatgtcgtgtgtcaacaaagaaagtcagtacggctttacgccagggaacgggcagatgcctcggggtctcgaagagacaatcaccttttacgaggttgaggagggggatgagacagcttaccccacacttccaaatcatggtggtccgtcaaccatggtacctgccacttccggctattgtgtcgggagacgagggcatagcagtggcaagcagacgctcaatctggaggaagggaacgggcagtctgaaaatggccgatatcacgaagagtatctgtatcgggcagaacccgactatgagacttcaggagtgtacagcactacagcaagtaccgccaacctgagccttcaggacagaaaatcctgcagcatgagtccgcaggacactgtcacaagctacaattatccgcagaagatgatggggaatattgctgccgtcgctgcgtcctgtgccaataacgtccccgcaccagtactctctaatggcgctgcagctaaccaggctatatctaccacctctgtgtcatcccagaatgctatccagcctttgttcgtgtccccaccgacccatggaagacccgatacaaaggttcttcaatattatttcaatctcgggctccagtgctattaccacagttactggcactcaatggtgtatgtgccacagatgcagcagcagctccacgtggagaattacccagtctataccgagccacccctggtagatcaaaccgtgcctcagtgttacagtgaggttcggcgtgaggatggaatccaagcagaagcctccgccaacgacacattcccaaatgctgactcaagcagcgtaccccatggcgctgtgtactatcccgtgatgagcgacccctacggccagccccctcttcctggcttcgacagctgcctccctgtcgtgccagactactcctgcgtccctccatggcaccccgttggcacagcatacggcggttcaagccagatccacggcgcaataaatccgggacccattggatgtatcgcaccatcccccccagcatcacactatgtgccccagggcatgtag

SEQ ID NO: 214955 - DNA, 498 bp, Artificial Sequence
  Description of Artificial Sequence: Synthetic coding sequence
atgaaatgtgttttcgtgaccgttgggaccacctccttcgacgatttgattgcttgcgtgtctgctcccgactcccttcagaagatagagtcgttaggctacaacaggctcatactccaaatcggtcggggaactgtggtccccgagcccttttctacggagagcttcacacttgatgtgtacaggtacaaggattccctgaaagaggacatccagaaggccgaccttgtcatttcccatgcaggggcaggtagttgcctggaaaccctggaaaaaggaaagccccttgtagttgtgatcaacgaaaaactgatgaataaccatcagctggagctggccaaacagctccataaagaggggcatcttttctactgcacatgttctaccctgcccggactgcttcaatccatggacttgtctacactgaagtgctacccgccaggccagcctgagaagttcagtgccttcctggataaggtcgttggcctgcagaaatag

SEQ ID NO: 214956 - DNA, 3414 bp, Artificial Sequence
  Description of Artificial Sequence: Synthetic coding sequence
atgaaatgcgtcttcgttacagtgggaactacctcgtttgacgatctcatagcttgtgtatcagccccagactctctgcagaagatcgagagcctggggtacaaccgtttgattctgcaaattggcagaggcactgtggtccccgaacccttttccactgagtcctttaccttggatgtttacaggtataaggacagtttaaaagaagacattcagaaagccgacttagtgatcagtcatgctggcgcaggatcgtgtctcgagacgttggagaagggaaaaccactggtcgtggtcatcaacgagaaacttatgaacaatcatcagttggagctcgccaagcagctgcacaaggaaggccacctcttctattgtacttgtcgtgtgttaacttgccctggccaggccaaaagtatcgccagcgctccgggtaagtgccaggactctgccgcattgacctccacagctttcagtggcttggatttcggactcttaagcggatatctacacaagcaggccttagtcacggccactcatccaacctgcacactgttgtttcctagctgccatgccttctttcccttgcctttgactcccactctgtacaaaatgcacaagggctggaaaaactactgttctcagaagagtctgaatgaggcaagcatggatgaatatctcgggtccctgggattattccgtaaactgacggccaaagatgcctcgtgtctgtttagagcgatttctgagcagctgttttgctctcaggtacatcatttggagatcaggaaggcatgtgtttcctacatgcgcgaaaaccagcagacattcgaaagctatgttgaaggctctttcgaaaagtacctggaacggctaggcgatcctaaagagtccgccggtcagctagaaatccgcgctctcagtttaatttataatagggatttcatcttatatcgattcccaggcaagcccccaacttatgtcaccgacaacggatacgaggacaagatactactgtgctacagttcctctggccactatgactcagtatatagcaagcagttccagagcagtgcagctgtgtgccaagccgtgctctacgagattctatacaaagatgtattcgtcgtagatgaagaggaacttaaaaccgcaatcaagttgttcagaagcggcagtaagaaaaatcggaacaacgctgtcacaggtagcgaggacgcgcacaccgattataaaagctctaaccaaaatagaatggaagagtggggagcctgctataatgctgaaaatattcctgagggttataataagggcacagaggagacaaagtcccctgagaaccctagcaagatgccatttccgtacaaggtgttaaaggcactcgatccagagatctatcggaatgtggagttcgatgtatggctcgacagtcgtaaagagctccagaagtcagattacatggagtatgccggaaggcagtattaccttggcgataaatgccaggtgtgcctggagtccgaaggccgttattacaacgcccacattcaggaggtgggaaatgaaaataattcagtgaccgttttcatcgaggaactggccgagaagcatgtagtgcccttagccaatctaaagccggtcacccaggtgatgagtgtgcctgcctggaacgctatgcctagtcgcaagggtcggggttaccagaagatgcctggcggatacgtgcctgagatcgtcatcagcgaaatggatataaaacagcagaagaaaatgtttaagaagattagaggcaaagaggtttatatgaccatggcatacggaaaaggtgatcctctgctaccacccaggttgcaacacagtatgcactatggccatgacccacctatgcactacagccagacagccggaaacgtcatgtcgaacgaacatttccaccctcagcatccctctcctaggcaaggcagaggctatggcatgcctcgcaattcaagcagattcatcaatagacacaatatgccgggacctaaggtcgatttttatccaggtcccggaaagaggtgctgccaatcctacgacaacttcagttacaggagccgcagcttcagaaggtctcacagacagatgtcttgtgttaacaaagagtcacagtatggcttcacccctggcaatggccagatgcctagaggtctggaggaaactatcactttctatgaagtggaagaaggtgatgagactgcctacccaactctaccaaatcacggaggaccatccacaatggttccagccacatcaggctattgcgttggaagaagaggccatagttccggcaagcagacattaaacctggaggagggcaacgggcaatccgagaacggtcggtaccatgaggagtatctctaccgcgcagaacctgactacgagacctccggcgtttatagtaccacagccagcacagccaacctaagtcttcaggatcggaaatcctgctctatgtcaccgcaagacacagtaacgagttacaactatccccagaagatgatgggcaacatcgcagccgtggctgcttcttgtgccaacaacgttcccgcaccagtactgtcaaatggcgcagcagccaaccaggcgataagtaccactagcgtaagcagtcaaaatgcgatacaaccactgtttgtgagtcccccaactcacggcagacctgttatagctagcccttcctacccttgtcactccgcaataccgcatgctggcgcttcactgccacctccacccccaccaccccctcccccaccaccccctcccccaccaccacctccgccacccccacctccccctcccccagcactcgacgtgggggagactagcaacttacaacctcccccaccactgccaccacctccctactcctgtgacccctcaggatccgacctgcctcaagacacaaaggtccttcagtattactttaatctcggactgcagtgctactatcattcctactggcactccatggtatacgttccccagatgcagcagcaacttcatgtcgaaaactacccagtatatactgagccaccattagtcgaccaaactgtgccccagtgttattccgaggtgcgaagagaggatgggatacaggcagaggcaagcgccaacgacacatttcccaatgcggattcctcttccgtgccacatggcgctgtatactacccggtgatgtccgacccctacggacagcctcccctgcctggcttcgactcatgcctgcctgtcgttccagactattcatgtgtcccaccgtggcaccccgttggcactgcctacggcggatcctcgcagattcatggggctatcaacccgggacccattggctgcatcgccccatctccacctgcctctcattacgtcccacaaggaatgtag

SEQ ID NO: 214957 - DNA, 651 bp, Artificial Sequence
  Description of Artificial Sequence: Synthetic coding sequence
atggtgtgtgtactagtcctcgctgccgctgccggagctgtcgcagtgtttctgatcctgaggatttgggtagtgttgaggtcaatggacgtaactccaagggagtctctgtccatcctggtcgtcgctggaagcggcggacacactactgagatcctccgtcttcttgggtcgctatccaacgcttacagccccaggcactatgtgattgctgatactgatgagatgagtgcaaacaaaatcaactcattcgaactagaccgcgcagaccgcgatccgagcaacatgtacacaaagtattatattcataggattcccagatcacgtgaagttcaacagtcatggccttcaaccgtctttactactctgcacagcatgtggctgtcattccccctgattcaccgggtgaagcctgatctggtgctctgcaatggaccgggaacttgcgtcccaatctgcgtgtccgccctgcttcttgggatcttaggaatcaagaaggtcataattgtgtacgtagagagtatttgcagagtagagactttgagtatgagcgggaagattctgtttcacctcagcgactattttatcgtccagtggcccgctctgaaggaaaagtacccaaagtcagtctacctgggcagaattgtctag

SEQ ID NO: 214958 - DNA, 972 bp, Artificial Sequence
  Description of Artificial Sequence: Synthetic coding sequence
atgccgctcttaaagcttgtgcatggctcccctcttgttttcggggagaaatttaagcttttcacattggtgtctgcctgtatccctgtgttcaggctggcacgccgacggaaaaaaattctcttctactgccactttcctgacctgttgctgaccaagagagattctttccttaaaagactgtacagagcacccattgattggattgaggagtacacaacggggatggctgactgcatcctggtcaactctcagtttacagccgcagtcttcaaagagacctttaaaagcctgagccatatcgatcctgacgtactctacccttctctcaacgtgacctcattcgatagcgtggttcccgaaaaattggacgatcttgtacccaagggaaagaaattcctactgctcagcattaacaggtacgagaggaagaagaacctgaccctggccctggaagctctcgttcaactgcggggacgccttacctcgcaggactgggaacgggtacaccttatagtggctgggggatatgatgaaagagtgctggaaaatgtggagcactatcaggaattgaaaaagatggtgcagcaaagcgacctcggtcagtatgtcacgttcctgagaagttttagcgacaaacagaagatcagtctcttgcactcctgcacatgtgtcctgtacaccccctctaatgaacactttggaattgtgcccctcgaggcaatgtacatgcagtgcccagtgatcgcagtgaattcgggtggcccattggagtcaatcgaccactccgtaaccggtttcctgtgcgagcctgacccggtgcatttttccgaagccatagagaagttcatcagagagcccagcttaaaagcaacgatgggcttggccggtagggctagagtaaaggaaaagtttagtcccgaggccttcacagagcagctgtacagatatgtcacaaagctgttggtgtag

SEQ ID NO: 214959 - DNA, 1251 bp, Artificial Sequence
  Description of Artificial Sequence: Synthetic coding sequence
atggctgaggagcaaggtcgggaacgagatagtgtgcctaagccaagtgttcttttcctccacccagatctgggagtcggtggcgcagaacgactggttttagacgctgccttggccctgcaggccagaggctgctcggtcaagatatggacagcccactacgaccctggacactgcttcgcagagtctagagagctgccagttcgttgcgccggagattggctgcccagaggcttggggtggggcggtaggggcgctgccgtgtgtgcctatgtgcggatggtttttctggccctgtacgtgctttttttggccgatgaagagtttgacgtggtggtgtgtgaccaggtcagtgcctgcatccccgtgtttagactggccaggagacgcaagaagatcctgttttattgtcactttcccgatctcttgctgacaaagagggatagcttcctgaaacggctctatcgagccccaattgattggatcgaggagtatactactggcatggcagattgtatactggtgaattctcagttcactgcagcagtgttcaaggagacattcaaatccctgagccatatcgatccagatgttctttacccatctttgaacgtcactagctttgactctgtggtgcctgagaaattagacgacctcgtgcccaaaggcaaaaaattcctacttctcagtatcaacaggtacgagcgaaaaaaaaacctcactctcgccctggaagccctggtgcagttgcgtggcaggctcaccagccaggattgggaaagggtgcacctgatagttgccggtggttacgatgagcgcgtcctcgagaacgtggagcattaccaggagctgaaaaaaatggttcagcaaagtgatctgggccagtatgtgacattcctcaggtctttttccgataaacagaaaattagcctgcttcactcctgtacttgcgttttatacaccccttccaacgaacatttcggcattgtgcccctggaggccatgtacatgcagtgtccagtcatcgcagtgaattcggggggacctttagagtctatagatcatagcgtcaccggtttcctgtgcgaaccggatcctgtgcacttcagtgaggccatcgagaaattcatcagagaaccatccttgaaagccaccatgggccttgcaggtcgtgccagagtcaaagagaagttctctccagaggcttttaccgagcaactgtatcggtatgtgaccaaactcctggtgtag

SEQ ID NO: 214960 - DNA, 1317 bp, Artificial Sequence
  Description of Artificial Sequence: Synthetic coding sequence
atggcagctggactgcgcaagcgcggtcgatccgggtccgcagctcaggccgaaggactgtgtaagcagtggctacagagagcgtggcaggaacgacgccttctgcttcgggaaccgcgatatacactcctcgttgccgcttgcctgtgtttagccgaggtgggcattaccttttgggttatacatcgagtggcttacaccgaaatcgattggaaagcttatatggctgaggtggagggcgtcattaacggaacatacgattacactcaattacagggagacaccggacccctggtttatccagctggcttcgtctacatcttcatgggcttgtactatgccacttctcggggaaccgatattagaatggctcagaatattttcgcagtcctgtatctcgctactctcttattggtatttctgatctaccatcagacctgtaaagtcccaccctttgttttcttcttcatgtgctgcgcctcataccgggttcacagcatctttgtgctaagactgtttaacgaccccgttgcgatggtgctgctgttcctctctataaatctgctcctggcgcagcgatgggggtgggggtgttgcttcttcagtttggctgtatcagtgaagatgaacgtactcctcttcgcgccaggccttctcttcttgctgcttacacagtttgggttcaggggagctttgccaaagctgggtatctgcgctgggttacaggtggttctggggctccctttcctgttagaaaatccgtctggatacctgagcagatcttttgacctgggtcgtcagttcctctttcattggacagtaaactggcgttttctgcccgaagcactctttctgcatcgagcttttcacctcgcccttctgactgcacacctgaccctgttgttactgttcgcactgtgccggtggcaccggaccggcgaatccatactgtctctcctcagggaccctagcaagagaaaggtaccaccacagcctcttacccctaaccaaatcgtctccaccctgtttacttctaattttatcggaatatgttttagtcgtagccttcattatcagttctatgtgtggtatttccataccctcccatacctcctctgggccatgccagccagatggcttacacatcttctgcgcttactggtgctggggctgattgagctctcatggaatacatacccctccacctcatgttcttcagctgccctccacatttgtcatgcggttatactgctccagttatggcttggaccacagccgttccccaagagcactcagcattccaagaaagcccactag

SEQ ID NO: 214961 - DNA, 1149 bp, Artificial Sequence
  Description of Artificial Sequence: Synthetic coding sequence
atggcggctgctcggctggcccgagcagctcccgctgcagccggagccgcactccacgctgctggaggccgtctgccactaccagggggaggcggacaccacttgttgggccactcacagggaggtatgtaccccgctggcttcgtctacattttcatggggctctactatgctacgagccggggtaccgacatcagaatggctcagaatattttcgcggtgttatatcttgcaactctgctgcttgtcttcctgatctatcatcagacatgcaaggtgccaccatttgtgttttttttcatgtgttgcgcatcatatcgcgttcattccatttttgtgctccgcttatttaacgatcccgttgccatggttcttctcttcctttctatcaatctgctcctggcgcagaggtggggctgggggtgttgctttttttcactagccgtatctgttaagatgaacgttctgctctttgcacccggtttattatttttactgctgacccagtttggctttcgcggagcgcttcccaagctgggcatatgtgctggcctgcaagtagtcctgggtcttcctttcctcctggagaacccctctgggtatctgtcccggtctttcgatttaggaaggcagttcttgtttcactggacagtaaactggaggttcctgcctgaggctctctttctgcaccgcgcttttcacttagctctcctcacggcccacctgactctacttctgctcttcgccctctgcagatggcataggacaggcgaaagcatcctctctctattaagagacccgtccaagcgtaaggtgcctccacaaccattgaccccaaatcagatcgtctcaacactgttcacgtcgaactttatcgggatctgtttctctagatctctgcactaccagttctacgtatggtatttccacaccctcccctatcttctctgggcaatgcccgctcgctggttgacccacctacttcggctgttggtgctcggcctgatagagctgagttggaacacttatccttctactagttgctcctccgctgccttgcatatttgccacgctgtgattttgctgcagctgtggttgggtcctcagccttttcccaaaagtactcaacattcaaaaaaggctcattag

SEQ ID NO: 214962 - DNA, 1530 bp, Artificial Sequence
  Description of Artificial Sequence: Synthetic coding sequence
atggagaagtggtatctaatgaccgtcgtcgtgctgattggactgactgtgaggtggacggtaagccttaatagctacagcggcgcagggaagccccctatgttcggggattatgaggcgcagcgacattggcaggagattacctttaacctccccgttaagcagtggtatttcaattcctcggacaataatctgcaatattggggcctcgattatccccctcttactgcgtaccatagcctgctttgcgcttatgtggccaaattcatcaaccccgactggatcgccctgcacaccagccggggttatgaatctcaggcccataaactcttcatgcggaccaccgtcctgatcgcagatctgctgatctacattcccgcagtggttctgtattgctgttgtctgaaagagatttccactaagaagaagatcgcgaacgcactttgcatactcctctatcctggattgattctgattgattacgggcactttcaaaacatatataattctgtgtcgctgggcttcgctttatggggtgtcctggggatctcatgcgactgcgatcttctgggttcattggccttctgcctggcaattaactataaacaaatggaactctaccacgcactcccttttttttgctttcttctggggaagtgtttcaagaaaggacttaaaggcaaaggtttcgtgctgctggtgaaattggcttgcattgtcgtcgcgtctttcgtcttatgttggctgcctttcttcacagagcgtgagcagacactgcaggtattgaggcgattgttcccggtcgatagaggcctgttcgaagataaggtggcgaacatctggtgcagctttaatgttttcctgaagataaaggacatcctgcccagacatatacagttgataatgagcttttgcagtacctttctaagtctcctgccagcgtgcattaagttgattctgcagccctcttccaagggctttaagtttactctcgtatcctgcgctctatctttttttctgttcagctttcaggtccatgaaaaatctatcctgcttgtctctttgcctgtctgcctggtgctgtctgagattccattcatgtctacatggttcctgctcgtctccaccttctcaatgctgccactgctcttgaaggacgaactcctcatgccttctgtggtcactactatggcctttttcatcgcatgcgtaacctcgttcagcattttcgaaaagacgagtgaggaagaactccagttgaaaagcttctccatttctgtaaggaaatatctgccctgcttcacatttctctcccggatcatccagtatctattcttgatctcagttattactatggtcctgcttacactgatgactgtaaccctcgacccgcctcaaaaactgcccgacctcttttcggtgctggtttgtttcgtttcatgcctcaattttctgttctttctggtctatttcaacattatcatcatgtgggacagtaagagtggcagaaaccagaagaagatttcttag

SEQ ID NO: 214963 - DNA, 1524 bp, Artificial Sequence
  Description of Artificial Sequence: Synthetic coding sequence
atggagaaatggtacctgatgactgtcgtcgtgctcatcggtttgaccgtcaggtggaccgtctctttgaacagctacagtggagctggcaagccacctatgttcggcgactacgaagcccaacgtcattggcaagagataacctttaacctaccggtcaaacagtggtattttaacagttcagataacaatttacagtattggggcctcgactatccccctctcaccgcctaccactctctgctctgcgcctacgtggccaagtttataaaccccgattggattgctctacacacaagcagaggctatgaatctcaggcacataagctgttcatgcgaacaacagtgctgatagcggatctcctgatctacatccctgctgtcgtcctctactgctgttgccttaaggaaatcagcacaaagaagaaaatcgctaacgcactctgcatcctgctataccctggccttatactaatagactatgggcattttcaatataattctgtgtccctgggctttgctttgtggggcgtgttggggatctcctgcgactgtgacctgttggggagtcttgcgttctgcctggccattaactataagcagatggaattgtaccacgcccttccctttttttgttttttactgggtaagtgttttaaaaagggcctgaaaggtaagggatttgtcctgctggtcaaacttgcttgtattgtcgtggcctccttcgtactttgttggctcccatttttcacggaacgggagcagacactacaggtcctgagacgactgttcccggtggaccgcggattatttgaagacaaggttgccaacatatggtgctcatttaacgtctttttgaagatcaaggatatcctgcccagacatatacagctcataatgtctttttgctccactttcttaagcctactccctgcttgcattaaacttatattgcagccgtcatctaagggtttcaaattcactctcgtttcctgcgccttgagcttcttcctgtttagtttccaggtgcacgagaagtcgattcttctcgtctcgttgcctgtatgtcttgttctgtccgagatccccttcatgtctacctggtttctgctcgtttccacatttagtatgcttcccctgctgttgaaggacgaactgctcatgccttctgtggttacaaccatggccttctttatagcttgcgtgacaagcttctctattttcgaaaagaccagcgaagaagagcttcaactcaagtcattctctatctcagtgcgaaaatatctgccgtgtttcacttttctctctcgtatcatccaatacctattcctgatatctgtcattactatggtgttattgaccctcatgacagttacactggacccacctcagaaactccccgacttgttttctgtgctcgtgtgttttgttagctgcctcaactttctgtttttcctggtctatttcaacataatcatcatgtgggattctaaatctggcaggaaccagaagaaaatctcttag

SEQ ID NO: 214964 - DNA, 765 bp, Artificial Sequence
  Description of Artificial Sequence: Synthetic coding sequence
atggaactttatcatgccctacccttcttttgctttctccttggaaaatgtttcaaaaaagggctgaaaggcaaaggcttcgtgctcctggtcaagctggcttgcatcgtagtcgcgtccttcgtgctgtgttggcttccattcttcaccgagagagagcagaccctgcaggtccttagaaggctcttcccagttgaccgtggtctgtttgaggataaagtcgctaatatatggtgttcttttaacgtctttctcaaaataaaagacatacttccaaggcacatccagctcatcatgcgacccgtgtgccttgttctctccgagatccccttcatgagcacctggttcctcttggtgagtactttctccatgctgccactcctgcttaaggacgagctgctgatgccgtctgtggttactactatggctttttttatcgcttgcgttacctccttttctatcttcgagaaaacttctgaggaagagttgcagttgaagtcattctctatatccgttagaaagtatttgccgtgtttcaccttcttatcccggatcatccaatatctgtttctgatcagcgtcatcacaatggtgttgctgacactcatgaccgtcacgctggatccaccacagaagctgccagacctgtttagcgtgttggtctgcttcgtgtcctgccttaattttttgtttttcttggtatacttcaatattataatcatgtgggactctaaatccgggcgaaatcaaaagaaaatcagttag

SEQ ID NO: 214965 - DNA, 1581 bp, Artificial Sequence
  Description of Artificial Sequence: Synthetic coding sequence
atggccgctctcacgatcgccaccggtacaggtaactggttctccgcgctcgccctaggtgtcacactgctgaagtgccttctgatccctacctatcacagtaccgacttcgaggtacaccgaaactggctggccatcacacactcattacccataagccaatggtattatgaagcaacatctgaatggaccctggattatcctccctttttcgcctggtttgaatatattttatcccacgtagctaagtatttcgatcaggagatgcttaacgtacacaatctgaattactcgagttccaggacgcttctctttcagcggttctctgtgatctttatggacgtgttgtttgtttacgctgtaagggagtgttgcaagtgcattgatggcaagaaggtggggaaggaacttactgaaaaaccaaagttcatcttaagtgtgctgcttttgtggaatttcggccttctgattgtggatcatatccacttccagtataatggctttctcttcggcttgatgttgctctctatcgcacggctgtttcagaagagacatatggagggggcttttctgtttgctgtcctactgcatttcaagcacatttatctgtacgttgctcctgcgtatggtgtttatctgcttcgcagctactgtttcactgccaacaagccggacggttccattaggtggaaaagctttagttttgtccgagtaataagcctcgggttggtcgtgttcttagtctccgcccttagtctcggcccattcctcgcactcaatcagctccctcaggtattctctcggctctttccttttaaaagaggtctgtgtcatgcttactgggcccctaatttttgggctctctataatgcactggataaggtcctgagtgtcattgggcttaaattgaagtttttagaccctaataacattccgaaggcgagtatgacttccgggctcgtgcagcagttccagcacaccgtgttaccatcggtaacgccgcttgccactttgatttgtacacttatcgcaatacttccgtccatcttctgcctctggttcaaaccccagggaccaagggggttcctgcggtgtctaacactctgcgcactttcatccttcatgttcgggtggcacgttcacgaaaaagccattctgctggccattttacctatgtctttgttgagcgttgggaaggccggagacgcatcgatttttctcattctgaccacaacagggcactactctctctttcctcttctatttaccgcacccgagctccctatcaagattctcctcatgttactgttcacgatctattccatttcctccttgaagacgctgtttagaaaggaaaaaccactttttaattggatggaaaccttctacctgctgggcctcgggccactcgaggtctgctgcgagttcgtctttcctttcacctcctggaaagtgaaataccccttcataccattgctgttaactagcgtctattgtgccgtgggcatcacatatgcatggttcaagctgtatgttagcgtcctaattgatagtgccattggcaagaccaagaaacagtag

SEQ ID NO: 214966 - DNA, 1404 bp, Artificial Sequence
  Description of Artificial Sequence: Synthetic coding sequence
atggcagccctcacaatagcgaccgggaccgggaactggttcagtgccctggcactgggtgtgacgttacttaagtgcctgctcatccctacataccatagtacagactttgaggtgcatcgaaactggcttgctataacacactcgctccccatttcccagtggtattatgaggctactagcgaatggacgctggattaccccccattcttcgcgtggttcgagtatatcctgtcccatgtggctaagtacttcgatcaggagatgcttaatgttcataatctgaactactcatcttccaggaccctgctcttccaaaggttttccgtgatttttatggacgtgctttttgtttacgcagtgcgtgaatgctgtaaatgcatagatggtaaaaaagtgggcaaggaactgactgagaagcctaagtttatactctcagtgctccttctttggaactttggtctgctcattgttgatcacatccatttccagtacaatggatttttgtttgggctgatgttactgagcattgctcgtctgtttcagaaaaggcatatggaaggcgcttttctcttcgccgtgctcttgcacttcaagcacatctatctgtatgtggcgccagcctatggggtgtatttgcttaggagctactgctttaccgctaacaaacccgacgggagtatccgctggaaaagtttttctttcgtcagagtgatctccctgggactcgttgtgtttctcgtctcagccctcagtttggggcctttcctagctctgaatcagctgcctcaggtcttttcgcggcttttcccgtttaaacgcggattgtgccacgcttactgggcaccaaatttctgggctctgtacaacgcactggacaaggtgctgagtgttatagggctaaagttaaaatttctagacccgaataatatcccaaaggcctctatgacaagcggcctcgtccagcagttccaacacactgtgttgccgagcgtgacacccctggcaactttgatctgtaccctgatcgccatactccccagcattttctgcctgtggttcaagccacaaggccctcggggatttctcaggtgcttgacactctgtgccctctccagcttcatgttcggctggcatgtgcacgagaaggcaatcctgctcgccatactgccgatgagtctgctgagtgtcggcaaggccggagacgcctccatattcctgattttgactacgactggccattactcattgttccctttactcttcaccgcgccagaattaccgattaaaattctgctaatgttgctgtttactatctactccatctcttctctcaaaacactgttccggaggagctttacactggtggctcaggcaggcgttcagtggcatgacctgtcctag

SEQ ID NO: 214967 - DNA, 1323 bp, Artificial Sequence
  Description of Artificial Sequence: Synthetic coding sequence
atgatgttagcctttcttgtgctctctaccggcatgttttgctcttcttctgctttccttcccagcagtttctgcatgtatacaacccttatcgctatgaccggctggtatatggacaaaacgtctatagccgtgctcggcgttgctgcgggagccattctgggctggccattctccgctgccctcggacttcccatcgcttttgatctcctagtgatgaagcaccgatggaagtccttttttcactggtctcttatggccttaatattgtttctggtgcccgtggttgttattgacagttattactacggcaagctggtaatcgcacccctgaacattgtgctatataacgtgttcaccccccacggccctgacctgtacgggacagaaccatggtatttctacctcatcaacgggtttctgaatttcaatgtagcttttgctctggcactgctggtgttacctcttaccagtctcatggagtatctcttgcagcgattccatgtgcaaaatcttggccacccctactggttgaccctggccccaatgtacatttggttcattatcttctttattcagccccataaggaggaacgattcctgtttcccgtgtatccgctgatatgtctttgcggagccgtcgctctcagcgcactgcagaagtgctaccatttcgtcttccagagatatcgcctcgaacattatacggtgacatcgaattggctggcactgggcaccgttttcctgtttgggcttctgtccttttccagaagtgttgcgcttttcaggggctatcatggccctctggatctgtatccggagttttaccgcatcgccactgatcccaccatccacactgtgcctgaggggcgtcccgtcaacgtgtgcgtggggaaggagtggtacagatttccttcatcttttctgcttcccgacaactggcagcttcaatttattccctccgagttccgtggacagctcccaaagccctttgcagagggtcctttagctactagaatcgtgccaacagatatgaacgatcagaatctggaggagccatcacgctatatagacatcagcaaatgtcactacctagtggatcttgatactatgagggagacaccacgggagccaaagtactcctccaacaaggaggagtggatctccctcgcatataggccctttcttgatgcgtcccggtctagcaagctgttgcgggcattctatgtgccctttctgtctgatcaatacaccgtgtacgtaaattacaccatccttaaacctagaaaggccaagcagatcagaaaaaagtcaggcggatag

SEQ ID NO: 214968 - DNA, 2535 bp, Artificial Sequence
  Description of Artificial Sequence: Synthetic coding sequence
atggcaccaagacgcctcttactggtcggtgaggggaacttttcctttgcagccgctctctccgagaccttagatcaaagtactcagttgaccgccacatgcctgcagcgcccagcagagctggccagggatcccctggcgtgggaaaatcttcaatgcctgcgtgagaggggcatcgatgtgaggttcggggtagactgcactcagctcgctgacgtgtttgagctgcatgaacgggaatttgaccaaatctatttcatattcccccactgcggaagaaaagcaggagtggccaagaacagagaactcctggccaagttctttcagagctgtgccgatgttttagccgaagaaggcgaggtgcacgtcgcattgtgccgcggacagggcggaacacccgcagacaaaccacagagagagtggcacaactcttggcaagtcgtcgcaatggctgcactgggaggactgatactgagtgacgtataccctttctcatgtaaagctgtagcaggctataaatgcactgggtatcggtcgcaagacaagagcttccatgttgagggcgctctgaaccatatttttactcggtcactgccatttgaggggtctcagccgcgtatttttcggatcaagctcgggaaccaatggttttccttccccgagccggaggcattagtgggcaagctcaaccgattagcgatggcttcccgcggagccagacagcgccttaagggctccggtgctagctccggtgacaccgctcccgcagcagataaattgagagagctcctgggcagccgcgaagctggaggcgctgaacatcgaacagagctgagtggtaataaagcgggacaagtttgggcacccgagggaagcactgccttcaaatgcctccttagcgccaggctgtgtgcagcgctgttgtctaacatctccgactgcgacgaaacatttaactattgggagccaacgcactatctcatctatggagaggggtttcagacctgggaatactcacccgcatatgctatcagaagctacgcctaccttctgttacacgcctggccagcagcgtttcatgcgagaattttgcagacaaacaagattttggtgttctactttctgagatgtcttctggccttcgttagctgtatctgcgagctttatttctacaaggccgtttgtaagaaatttgggctgcacgtctcccgcatgatgctcgcctttttggttctttcgactgggatgttttgtagttcatctgcattcctcccaagcagcttttgtatgtataccacccttattgccatgactggctggtatatggataagactagcattgccgtcctgggtgtggcagccggagctatcctggggtggcccttctctgcagcattaggcctgccaatcgcatttgatctcctggtgatgaagcataggtggaagtcatttttccactggtcgctgatggcactcatactgtttctcgtgcctgtggtcgtaatagatagctattattatggcaagctcgtcatagcccctttgaacattgttctctacaatgtctttaccccacacggacctgatctgtacggaacggagccgtggtacttctacttgataaacggctttctgaacttcaacgtggcttttgcattagcactcctggtgctccctctaacttctctcatggagtacctgctgcagcgattccacgtgcaaaatctgggccacccatattggctcactcttgctcccatgtacatttggttcataattttttttatccagccccataaggaagagagattcctcttccccgtgtacccgctgatctgcctatgtggagccgtggccctgtcggccttgcagaaatgctaccactttgtttttcagcgataccggctagaacactatacggtcaccagcaattggctcgctcttggaacggtgttcttgttcggcctgctgtctttcagccgcagcgtcgccctttttcggggataccacggtcccctcgacctctatccagaattttaccgaattgccaccgaccctaccatccacacagtgccggaaggaagaccagtcaatgtctgtgtgggcaaggagtggtaccggttcccctcaagctttctgcttcctgacaactggcagctgcaatttattccttctgagttccgaggtcagcttcctaaaccgttcgcagaaggtcccctcgctacaagaattgtgccgaccgacatgaatgaccagaacctggaggaaccctcacgatacattgatatttccaagtgccactatctcgttgacctggatacaatgcgggaaacccctcgggagccgaagtactcttccaataaggaggagtggatttcattggcgtatagaccctttctcgacgccagcaggagcagtaagctgctgcgcgcattctacgtccctttcctgtctgaccagtatactgtgtacgtgaattacactattctcaaacctcgaaaggccaagcaaatacgtaaaaagagcggtggctag

SEQ ID NO: 214969 - DNA, 1344 bp, Artificial Sequence
  Description of Artificial Sequence: Synthetic coding sequence
atgatgctggccttcctggtcctgtccacggggatgttctgctcatccagtgcttttctgccttcatctttctgcatgtatactaccctgattgctatgaccgggtggtacatggacaagacaagtattgctgttttgggcgtagcagctggcgctatcctggggtggccattctccgccgctttgggtctgcctattgcgtttgatctcctggtcatgaagcaccgctggaagtcattttttcactggagcttaatggccctgatcctgttcttagtgccggttgtcgtgatcgattcttactattacggcaagctcgtgattgctcctctgaatatcgtgttgtacaacgtgttcacaccccacggacccgacctgtacggaactgagccttggtatttttacctgattaacggttttcttaacttcaacgtggcatttgctctggctttattggtgctgcccctgacatccctgatggagtatctgcttcagagattccacgtacagaatctgggccatccctactggctcacgcttgcccctatgtacatttggtttattatctttttcatccagccacacaaggaggagcgattcctgttccccgtgtatccattgatctgtctgtgcggcgctgtagccctgtccgcattgcaacactcctttctttacttccagaagtgctatcacttcgtgttccagcgctacaggcttgagcactataccgtgacctctaattggttggcactgggtaccgtgttcttgttcgggctgctgtcattcagcaggtctgttgcactgtttcgagggtatcacgggcctctggacctctatcccgaattctatcgcattgccactgaccctactatacatacagtcccggagggacgcccagtgaacgtttgtgtgggtaaggagtggtaccgctttccgtcatcttttcttctgccagataattggcagctccagtttattccaagcgaattccggggtcagctgcctaaaccattcgctgaggggcctctggccactagaattgttcccaccgacatgaacgaccagaacctggaggaaccttcccgttatatagatattagcaaatgtcattaccttgttgaccttgatactatgagggagacgcctcgggaacctaaatatagtagtaacaaggaggagtggatttcactggcataccggccatttctcgatgcatccagaagctctaagttgctgcgggctttttatgtcccttttttaagcgaccagtatacggtgtacgttaactatacaatcctgaaacctcgaaaggctaagcaaatacgtaaaaagagcggcggatag

SEQ ID NO: 214970 - DNA, 1647 bp, Artificial Sequence
  Description of Artificial Sequence: Synthetic coding sequence
atggttctcgcagagttatatgtatctgaccgagagggatctgacgccactggcgatggcaccaaagaaaaacccttcaagacgggcctgaaggctctcatgaccgtcggcaaggaacccttccccaccatatacgtcgactctcagaaggagaacgagcgatggaatgtcattagtaaatcccaattgaagaatattaagaaaatgtggcaccgggagcagatgaaatcagaatctcgggaaaagaaagaagccgaggattccctcaggcgggagaaaaatctggaggaggcaaaaaaaatcaccatcaaaaatgatccttccctacctgaaccaaagtgcgtgaaaattggggctcttgaagggtacagaggacagcgagtcaaagtgtttggttgggtgcatcggctgcggaggcagggcaagaacttgatgttcctcgttttgagagatggtaccggatacctgcagtgtgtattagcagacgagctgtgccagtgttataatggggtgctgcttagcacagagtcgtctgtcgcagtatatgggatgctcaatcttactccgaagggaaaacaagctccagggggacacgagctcagttgcgacttttgggaactgatcggactggccccagccggaggggctgataaccttatcaacgaagagtctgatgtggatgtgcagctgaacaaccggcacatgatgatcaggggagagaatatgtcaaaaatcctgaaggcaagatctatggtgacaagatgttttcgggatcacttctttgacagaggctattacgaggtaacccctcctaccctggtgcaaacacaagtcgaaggtggtgcaaccctatttaagttagactactttggagaggaagctttcctgacgcagtcttctcagctgtatctggagacatgtctgcccgctctcggcgacgtgttttgtattgcgcagtcatatcgcgcagagcagagcagaaccagaagacatttggccgagtatacccacgtggaggcagaatgcccatttcttacattcgatgacctgttgaataggctggaagaccttgtgtgcgatgtggtagaccgcattctcaagagcccagcaggctccatcgtgcatgaactcaatcccaacttccagccccctaagcggccttttaagagaatgaactattcagacgctattgtgtggctgaaggaacacgacgtcaagaaggaggacggtacattttacgagttcggagaggacattcccgaagccccagagaggttaatgaccgatactataaatgagccgatcttgctgtgtcgctttccggtagaaattaagtctttctatatgcagcggtgcccagaggattctcgcttgacagagagcgtggacgtgctaatgcccaatgtgggcgaaattgtcgggggaagcatgcggatcttcgattctgaggaaatcctcgccggttataagagggagggaatcgacccaactccctactattggtacacagaccaacgcaagtatgggacttgtcctcatggcggatacggactgggcttggaacgctttttgacatggatcctcaacagatatcacatcagagacgtgtgtctttatccccgattcgtgcaaagatgcacgccatag

SEQ ID NO: 214971 - DNA, 765 bp, Artificial Sequence
  Description of Artificial Sequence: Synthetic coding sequence
atgacggtgggcaaagaaccgttccccacaatatacgtggacagtcaaaaggaaaatgaacgttggaatgtgatcagtaagtctcaacttaaaaacatcaagaagatgtggcatcgcgagcagatgaaaagcgagagcagagaaaagaaggaggcagaggactccctccggagggaaaagaatttagaggaggcaaaaaagatcacaatcaagaacgatccaagcctccccgagcccaagtgtgttaagattggagctttggaggggtacagaggccaaagagtcaaggtattcggctgggtccaccggctcaggcgacagggcaaaaatctgatgtttctggttctgcgcgatggaactggatacctgcagtgtgtgttggccgacgagctctgccaatgctataacggtgtgttattgtccacagaatcaagtgtcgcggtctacgggatgctgaatctgacacctaaagggaagcaggctcccggtggacacgaactttcatgcgatttttgggaattgatcggtctggctcccgctggaggggctgacaacttgatcaacgaggaatcagacgtcgacgtgcagctgaacaataggcatatgatgattcgaggcgagaacatgagcaagattcttaaggctcggagcatggtgactcgctgttttcgcgatcacttttttgatcggggatactatgaggtgtcaatgcacagttctgcattcgcaaagaacatgttcttcgctgtgctgaagctggaatag

SEQ ID NO: 214972 - DNA, 900 bp, Artificial Sequence
  Description of Artificial Sequence: Synthetic coding sequence
atgtgtgaagattggtgttttcgagatcacttctttgaccggggatattatgaggtcaccccacccaccctcgtccagacccaggtcgagggtggcgcaaccttatttaagcttgattactttggagaagaggctttcctgacccagagctcgcaactgtacctggagacttgcctgcctgccctcggtgatgtgttctgtattgctcagagttaccgggctgagcagtctagaactaggcgccatttagctgaatatactcatgtcgaagccgagtgtccgtttctgaccttcgatgacctactaaaccggttagaggacctggtttgtgatgtcgtcgaccggatcttgaaatcccctgccggttctattgtgcacgagctgaatcctaattttcagccacctaaacggccattcaaaagaatgaattactcggatgccatcgtgtggctcaaggaacatgacgtcaagaaggaggacgggactttctatgagttcggcgaggatataccagaagccccagagagactgatgacagataccatcaacgagcccatcttactatgtcgcttccccgtggaaatcaaaagcttctatatgcagcgttgcccagaagatagcaggctcactgaatctgttgacgtgctcatgcctaatgtcggtgagattgttggcggatctatgcgcatctttgacagcgaagagatactggccggatacaaaagggaggggattgatccaactccctattactggtacactgatcaacggaaatatggaacttgtcctcacggcggatatgggctgggtctagaacggttcctgacctggattctcaacaggtaccacattagagacgtgtgtttgtaccctcggtttgttcaacgctgcactccctag

SEQ ID NO: 214973 - DNA, 525 bp, Artificial Sequence
  Description of Artificial Sequence: Synthetic coding sequence
atggtgttggccgaactgtatgtgtcggacagggaaggctctgacgccaccggcgacggcacgaaggagaagccatttaaaaccggcctcaaggcccttatgaccgtgggcaaagagccgttccccacaatctatgtggatagtcagaaggaaaacgaaagatggaatgtgatctccaaatcacaattaaagaacataaagaaaatgtggcacagagagcaaatgaagagtgagtccagagagaagaaggaggctgaggattcactgaggcgtgagaaaaatctggaggaggcaaagaaaatcaccataaagaacgatccgtctctaccagaacccaagtgcgtgaaaattggcgctctggaaggttatcgtgggcagagggtaaaagtcttcggttgggtacatagactcagacggcaagtaagtgtgctgcagtggagctcgctagtgcatggcgagcagtgctgctcggtctggaatgccaagtcctatcccaagggccaagccggaagccgatggccttag

SEQ ID NO: 214974 - DNA, 1434 bp, Artificial Sequence
  Description of Artificial Sequence: Synthetic coding sequence
atgctgggtgtgaggtgtctcttgaggagcgttagattctgctcttctgcccctttcccaaagcataaacctagcgcaaaactgtccgttagagacgccctgggggctcagaatgcatcgggagagcgaataaagattcagggatggattcgatcagtccgtagtcagaaagaggtcctatttctgcacgtgaacgacgggtcttctctggaaagcctacaggtggtggccgactctggactggactcccgcgagctgaacttcgggagctcagtggaagtgcaagggcagctgataaaatctccgagcaagcgccaaaacgtcgagttgaaagccgagaagatcaaggttattggaaattgcgatgcaaaagactttcctattaagtataaggagaggcaccccctggaatacctgaggcagtatccacacttcaggtgtcgcactaatgtgctggggagcatcctgcgcatccgatccgaggccactgcagcgattcatagcttcttcaaggactcaggattcgtgcacatacatacgcctattattacttcaaacgatagcgaaggggctggcgagctcttccagttagagccctcagggaagctcaaggtgcctgaagaaaactttttcaatgtgccagcttttttgactgtcagcggccaactccatctggaagttatgtctggcgcatttactcaagttttcactttcgggcctactttccgtgcagaaaacagccagagcaggagacatctggctgagttctacatgatcgaggctgagatcagctttgtagatagtctgcaggacctgatgcaggttattgaggaactcttcaaagctactacaatgatggtgctgagtaagtgtccggaggacgtcgagctgtgccataagttcatcgcaccgggtcagaaagatcgcctggaacatatgctcaaaaacaatttcttgataatctcgtacacagaagccgtggagatcctgaagcaggcctcccagaacttcacctttacacctgagtggggagctgatctgcggacggagcatgagaagtacctcgtaaagcattgcgggaacatcccggtgttcgtcatcaactatcctttgactcttaagccgttctacatgcgcgacaacgaggatggcccacaacataccgtggccgctgtggacctcctcgttcctggggtgggggagttgtttggaggcggattgcgagaggagagataccacttcctggaagagaggctcgcacggtctggactaactgaagtgtatcagtggtatctcgacctcagacgctttggctcggtcccacacggtgggttcggaatggggttcgagcggtacctccagtgcatactcggagtcgataatataaaagatgtgatccccttcccacgttttcctcactcttgcctgctctag

SEQ ID NO: 214975 - DNA, 942 bp, Artificial Sequence
  Description of Artificial Sequence: Synthetic coding sequence
atggcccagagaaaaaatgccaagtcctctggtaattcatcttctagcggctccggatcggggtcaacttctgctggctccagcagtcctggagctcgccgagagaccaagcacggcggacataaaaatggccgaaaaggtggcttatcgggcacaagcttcttcacgtggttcatggtcatcgcactactgggcgtttggacctctgtggctgtcgtgtggttcgaccttgtggattatgaagaggtgttggggaaactgggcatctacgacgcagatggagacggcgatttcgatgtggatgatgcaaaagtcttgctggggttgaaggagcggtcaacctcggaaccggcagtcccacctgaggaggctgagcctcacaccgagccagaggaacaggtgcctgtcgaggctgagccacagaacatagaggacgaagctaaagagcagatccaaagtcttctacatgagatggtgcatgctgagcatgtggaaggagaggatctccagcaggaagacgggccaacaggcgaaccccaacaggaagatgatgaattcctcatggctactgacgttgatgatagattcgaaacacttgaacctgaagttagccatgaggagaccgagcacagctatcatgttgaggagaccgtatcacaggactgcaatcaggacatggaagagatgatgtccgaacaggagaatcccgatagttcggaacccgtcgtcgaagatgagcgactgcaccatgacactgacgacgttacatatcaggtatatgaggaacaggctgtgtatgaacccctggaaaacgaaggaatcgaaataacggaggtaactgcccctcccgaagacaaccctgtcgaggactctcaggtgatcgtggaagaagtctctattttcccggtcgaggagcagcaggaggtgccacctgacacgtag

SEQ ID NO: 214976 - DNA, 612 bp, Artificial Sequence
  Description of Artificial Sequence: Synthetic coding sequence
atggcccagcgaaagaacgcgaagagttctgggaacagttcctcttccgggagcggttcagggtcaactagcgcaggaagttctagcccgggagcgaggcgggaaaccaaacacggcggacacaagaatggccgaaaaggaggactcagcgggactagcttcttcacatggtttatggtgatcgctctattaggcgtctggacttcagttgcagtggtctggttcgacttggtggactatgaagaggtcctggcaaaggccaaagactttcgatataatctgtctgaagtgctgcagggcaagctggggatctacgacgccgacggcgacggtgattttgacgtggatgacgctaaggtcttactgggtctgaccaaggatggatccaacgagaacatcgattctctggaggaagttttgaacattttagctgaggagagtagtgattggttttatggctttttatccttcttgtacgacataatgacccctttcgaaatgttggaggaggaagaggaagagagcgagacagccgacggcgtggatgggacgagtcagaacgaaggagtgcaggggaagacatgcgtgattctggacctccacaatcagtag

SEQ ID NO: 214977 - DNA, 2277 bp, Artificial Sequence
  Description of Artificial Sequence: Synthetic coding sequence
atggcgcagcggaagaatgctaaatcttcagggaatagttcaagctctgggtccggcagtgggagtacatccgccggaagctcgtccccgggtgcccgtagggaaaccaaacacggagggcataaaaatgggagaaagggaggcctcagcgggacttcattctttacatggtttatggtaatagcgttgctgggtgtctggacatccgtcgccgtagtgtggtttgatctagtggattatgaggaggtgctggggaaattggggatctatgatgccgacggagatggtgactttgatgtcgacgacgccaaagttctgctaggtctgaaggaacggtccacgagtgagcccgcagtgccccctgaggaggccgaacctcacaccgagcccgaggagcaagtacctgtggaagcggaaccacagaatatcgaggacgaagccaaagagcaaatccaaagcctgctgcacgagatggtgcatgcagagcacgtcgagggtgaggacctgcagcaggaagacgggcctacaggcgaacctcagcaagaggacgatgagtttctgatggctacagatgtggatgaccgattcgaaacgctcgagcctgaagtgtcccacgaagagacggaacattcgtatcatgtcgaagagacggtctcacaagattgtaatcaggatatggaggagatgatgagtgagcaagagaatcctgactcctcggaacctgtcgtggaggatgagaggctacatcatgacacagatgacgtgacataccaggtgtacgaggaacaggcagtgtatgagcccttggaaaacgagggcattgagatcacggaggttactgcccctccagaggacaatcctgttgaggacagccaggtaatcgtggaggaagtgtctatttttcctgtcgaggagcagcaggaggtcccacccgaaacaaatcgcaagacagacgaccccgagcagaaggctaaggtcaagaagaagaagccaaagctcctcaacaaattcgataagacaataaaagccgagctggacgccgctgagaaacttcgaaagcggggtaaaatagaggaagccgtgaatgcgtttaaggagttggtcagaaaatacccacagtctcccagggctcgatatggtaaagcccagtgtgaggacgatctggcagagaaacggcgaagcaatgaggtgctacgcggagcaatagagacataccaagaggtcgccagcctgccggacgtccccgctgacctgttgaagctttccttaaaacgtcggtccgatcgccaacagttcctagggcatatgcgcggttctctcctgacattgcagagattagtacaactgtttccgaatgacacgagtctgaagaatgatttgggcgtgggttatctacttataggagataatgataacgctaagaaagtttatgaagaagtcttgtccgtcacacctaacgacggtttcgccaaggtgcactatggctttattctgaaggctcagaacaagattgccgagtccattccttacctaaaggagggcattgagagcggggaccccggtacagatgatggcagattttacttccaccttggcgacgcaatgcagagggttggcaacaaagaagcctataaatggtacgagcttggccacaaacgcggtcacttcgctagcgtgtggcagcgcagcctgtacaacgtgaacgggctcaaggcccaaccatggtggacccctaaagaaaccggatacacagaacttgtcaagtctctggagcggaactggaaactcattagagacgaaggtctggccgtgatggacaaggctaaaggtttgtttctacccgaagacgaaaacctgagagagaaaggggactggagccaatttaccctctggcaacagggtagaagaaatgagaatgcttgcaaaggggctcctaagacctgcacgctgttagagaagtttcccgagacgacagggtgtagaaggggtcaaattaagtactccatcatgcaccccggtacacatgtgtggccacacaccggacctactaattgtcggttgaggatgcacttaggccttgtgattcctaaggagggttgcaagattcgttgcgccaacgaaactaaaacctgggaagaaggaaaggttctgattttcgacgatagctttgaacatgaggtctggcaggatgcatctagtttcaggttgatttttatcgtcgacgtctggcatcctgagctaacaccgcagcagcggcgttccctccctgcgatctag

SEQ ID NO: 214978 - DNA, 678 bp, Artificial Sequence
  Description of Artificial Sequence: Synthetic coding sequence
atggctgaagacaaggagactaaacatggcggtcataagaatgggaggaaagggggtttatctggaacctccttctttacatggttcatggtcatcgccctcttgggagtatggacttcagtggctgtggtgtggtttgacctcgtggattacgaagaagtactagcgaaggccaaagattttcgctataatttgagtgaggtcctccaggggaaactcggtatctatgacgccgacggagatggtgactttgatgtggatgacgctaaagtcctgttggagggaccaagtggagtcgcaaaaaggaagacgaaggccaaagttaaagaactgactaaagaagagctgaagaaagagaaggaaaagcccgagtcccgaaaagaaagcaagaatgaggagcgtaagaaggggaagaaggaggatgtgcgcaaggacaaaaaaattgcagatgctgaccttagcagaaaggagtcccccaaaggaaagaaggaccgtgagaaagagaaagtggaccttgagaaaagtgccaaaacaaaagagaatcggaagaagtctacaaatatgaaagacgtgtccagtaagatggcctctagagacaaagatgataggaaagaaagcagaagcagtacgagatacgcacatctcacaaagggaaacacccagaaaaggaacggttag

SEQ ID NO: 214979 - DNA, 1290 bp, Artificial Sequence
  Description of Artificial Sequence: Synthetic coding sequence
atggctcagagaaagaatgcaaaaagctcaggaaacagttccagctccggttctgggagtggttcgacctctgctggttcatcttcccctggcgctaggcgagagaccaaacacggcggacacaagaatggcaggaaaggcggattgagtgggactagcttctttacctggttcatggtgattgccctccttggagtgtggacatcagtcgcagtggtgtggtttgacctcgttgactacgaagaggtgctaggaaagctgggcatctatgacgccgatggggacggagacttcgacgtagacgacgccaaggtgctgctggggcttaaagagcgcagtacaagcgagccagccgtgccgcctgaggaggccgagccacacaccgaaccagaagagcaggtcccagtggaggctgagcctcagaacattgaagacgaggccaaagagcaaatacagagtctcctccacgaaatggtccacgccgaacacgtggagggcgaggacttacagcaggaggatggtcccacaggggaaccccagcaggaagacgatgaatttctgatggccacagacgtggacgatcgatttgagaccctggaacccgaggtatctcatgaggagacagagcattcctaccacgttgaagagacggatagcagcgagccggtagtcgaagacgaacgcctccatcatgataccgacgatgtcacttaccaagtatacgaagagcaggcagtatatgaacccctggagaatgagggcattgagattaccgaggtgactgccccacccgaagataaccccgtcgaggatagtcaggtcatcgtcgaagaagttagcatttttcctgtcgaggagcaacaggaggtccctcccgaaacaaatcgcaagacagacgaccctgagcagaaggcaaaagtaaaaaaaaagaaaccaaagctgttgaataagttcgataaaaccattaaggcagagctcgacgctgctgaaaaactgcgaaagcggggtaaaattgaggaggcagtgaatgcatttaaagagctggtgaggaagtatccacagtctcctcgagccaggtatggaaaagcccagtgcgaagacgacctcgcggagaaacgcagatcgaatgaggtcctgcgcggagcgattgaaacataccaagaggtggcctcactcccagatgtccccgctgacttgctcaagctgtcgctgaagcgcagaagcgataggcaacagtttctgggacacatgagggggagcctgctgactctgcagagactagtgcagtag

SEQ ID NO: 214980 - DNA, 900 bp, Artificial Sequence
  Description of Artificial Sequence: Synthetic coding sequence
atggcagaggataaggaaacaaaacacggaggtcacaagaacggccgaaagggaggactgagtggcacctctttctttacttggttcatggtaatagcactccttggtgtttggacatctgtcgctgtggtctggttcgacctggtggactacgaagaggtactggccaaagccaaggatttcaggtacaacctgtccgaagttctgcagggcaagcttggaatttacgatgccgacggagatggagacttcgatgtcgatgatgccaaagttcttctgggtctgaaagagcgatcaacatctgagccagcggtgcccccagaagaggccgaaccccatacggagcccgaggagcaggtcccagtggaggccgaaccgcaaaacatagaagatgaggccaaagaacagattcagtccttgctccacgagatggtgcatgccgaacacgtagagggggaagacctacagcaggaagacgggccaactggggagccgcaacaggaagacgacgaatttctgatggctaccgacgttgacgaccggttcgagaccttagaacccgaggtgtcacatgaggaaaccgaacactcatatcacgttgaggaaactgtttcacaggactgtaatcaagacatggaagagatgatgtctgaacaggagaatccggacagcagcgaacccgtagtagaggacgaacgcctgcaccacgacacagatgacgtgacctaccaggtctacgaagagcaggccgtgtatgaacccttagagaatgaagggatagagataaccgaggtgacagccccacccgaggataatcccgtcgaggatagtcaggtcattgttgaagaggtgtccatctttcccgtagaggagcaacaggaagtgccccctgatacttag

SEQ ID NO: 214981 - DNA, 900 bp, Artificial Sequence
  Description of Artificial Sequence: Synthetic coding sequence
atggctgaggacaaggagactaaacatgggggtcataagaacggcagaaagggagggttgtcagggactagcttctttacctggttcatggtcatcgcgcttctgggggtgtggacatcagtggccgttgtgtggtttgacctggtcgattacgaggaggtgttagccaaggccaaggattttcgatacaacttatcagaggtgctgcagggaaagctggggatctacgacgccgatggagacggagattttgacgtggatgacgctaaagttcttctcggattgaaggagcgaagtaccagtgagcccgcagtcccccctgaagaagctgagccacacaccgagcccgaagagcaggtgccagtagaggctgagccccagaacattgaagatgaagccaaggaacagatccagagtctgctccatgagatggtgcatgccgaacacgtggagggcgaggatcttcagcaggaggacgggcctacaggcgagccacagcaggaggatgatgagttcctgatggcaaccgacgtggacgacagattcgagaccctggagcccgaagtgtcacatgaggagacagaacattcttatcatgtggaggagactgttagccaagattgcaatcaggacatggaagaaatgatgtctgaacaagagaacccagatagcagtgagccagtggttgaggatgaaagacttcaccatgacaccgacgacgttacctaccaggtgtacgaagaacaggctgtatacgagcccttggaaaatgaggggatcgaaatcactgaggtgacagcccctccagaagacaatcctgtcgaggactcacaggtgatcgtcgaagaggtgtcgatcttccctgtggaggagcagcaggaggttcctcctgatacttag

SEQ ID NO: 214982 - DNA, 897 bp, Artificial Sequence
  Description of Artificial Sequence: Synthetic coding sequence
atggcagaggataaggagaccaagcacggcggtcacaagaacggccgaaagggcggactgtctggcacttccttctttacttggttcatggtgatcgctctgcttggagtgtggactagtgtcgccgtagtctggttcgacctggtggactatgaagaggtgctcgctaaagcgaaggattttaggtacaatctgtcagaagttttacaggggaaactaggaatttacgacgccgacggagatggcgactttgacgttgatgatgctaaagtgcttctggggctgaaggaaagatccacctctgagcctgcggtgccgccagaagaggccgaaccacatacggaacctgaggagcaagtcccagtcgaggctgaacctcaaaatattgaggatgaagccaaggagcaaatccagagcctgcttcacgaaatggtccatgcagagcacgtggaaggggaagatctgcagcaagaagacggcccaacgggtgagccccagcaggaggacgacgagttcctgatggctactgacgtggacgaccgcttcgagacactggagccagaggtgtcccatgaagagacagagcacagctatcacgtagaagagaccgtgagccaggattgcaatcaagacatggaagaaatgatgagcgaacaagaaaacccagacagctccgaaccagttgtggaggacgaacggctgcaccacgatacggatgacgttacttaccaggtttacgaagagcaggtctacgagcctttagagaacgagggcattgaaatcaccgaggtgaccgcgccacccgaggataatcctgtggaggactcgcaggtgatagtagaggaagtatcaatttttccagtagaagaacaacaagaggtgccacccgatacatag

SEQ ID NO: 214983 - DNA, 813 bp, Artificial Sequence
  Description of Artificial Sequence: Synthetic coding sequence
atggcgcagcgcaaaaatgcaaaaagctccggaaactcctcctcctcgggaagtgggtctggcagcacgtccgcaggcagctcatcacccggagccaggcgtgaaacaaagcatggcggacataagaacggtcgcaaggggggactgtccggcacctcattctttacttggttcatggtgattgccttgctcggtgtgtggactagtgtggcagttgtatggttcgatcttgtggactacgaggaagtgctgggcaagctggggatctacgatgcagacggcgacggagattttgatgttgatgatgcaaaggtcctcttaggtcttaaggagcgatcaacatcagaacctgccgtgcctccagaggaggctgaaccacataccgaaccagaagagcaggttccggtggaagcagaaccccagaacattgaggacgaggcaaaggagcagatacaatcactgcttcatgagatggtgcatgccgagcatgaaacggaacattcataccacgtggaggagacagtatcccaggattgcaaccaggacatggaggaaatgatgtcggaacaggagaatccggatagctccgagccagtcgtggaagatgaacggctccaccacgataccgatgacgtgacctaccaggtgtatgaggaacaggctgtttacgagccattggaaaacgaaggaatcgagatcaccgaggtaactgctccgccagaggacaaccctgtcgaggattctcaggtcattgtggaagaagtgtcaatattcccagtggaggagcagcaagaagtacccccagatacttag

SEQ ID NO: 214984 - DNA, 633 bp, Artificial Sequence
  Description of Artificial Sequence: Synthetic coding sequence
atggccgaggacaaggagacaaaacacggcggacacaaaaacggacggaaggggggactatccggaaccagtttcttcacctggtttatggttattgcactgttgggcgtctggacctctgtggctgtggtctggtttgacctcgtagattatgaggaggtgctgggcaaactaggtatctacgacgccgacggggatggcgacttcgatgtcgatgatgctaaggtcttactggaggggcctagtggggtcgctaagcgaaaaacaaaggcaaaggtcaaggagctgaccaaggaggaactgaaaaaggaaaaagaaaaacctgaatctcgtaaagaaagcaagaatgaagaaaggaaaaaaggaaaaaaagaggacgtgagaaaagataagaagattgctgacgccgatctgtccagaaaggaaagccctaagggaaagaaggacagagaaaaggagaaagtcgacctcgagaaatccgctaaaactaaagagaatcgtaagaagtcaaccaacatgaaagacgtgagctccaagatggcctctcgtgataaggacgaccgcaaagaaagccgaagttccacccgatatgcccatctgacgaagggaaacacgcagaagcggaacggatag

SEQ ID NO: 214985 - DNA, 771 bp, Artificial Sequence
  Description of Artificial Sequence: Synthetic coding sequence
atggccgaagataaggagaccaagcatggaggacacaagaacgggagaaaggggggtctgtccggcactagcttttttacctggtttatggtgattgcgctgctgggtgtctggacctcagtggctgtggtgtggtttgatctggtggattacgaagaagtcctcgccaaggcaaaggactttaggtacaatttgtccgaggtgctccagggaaagctgggcatctacgacgctgacggcgacggagacttcgacgttgacgacgccaaagttttgctcggcctcaaagaacgatctacctcagaacctgccgtgccaccagaggaagccgaacctcataccgagcccgaggagcaagtacccgtagaggcagagccccagaatatagaagatgaagccaaagaacagattcagtccctcctgcatgagatggttcacgccgagcacgaaaccgagcacagctatcacgtggaggagacagtcagccaggactgtaaccaggacatggaggaaatgatgagcgagcaagaaaacccagacagttctgaaccagttgttgaagacgagagattgcatcatgacactgacgatgtgacgtaccaggtatacgaagaacaggctgtttatgaaccacttgaaaacgaggggattgagattactgaggtaacagcccctcctgaggataaccccgtggaagattcccaagtcattgtagaggaggtgtctatattccctgtcgaggaacaacaggaggtgccccctgacacttag

SEQ ID NO: 214986 - DNA, 2190 bp, Artificial Sequence
  Description of Artificial Sequence: Synthetic coding sequence
atggcagaagacaaagagacaaagcacggtggccataaaaatggcaggaagggcggactgtcaggtacctcattctttacttggtttatggtgatagccctgctaggcgtgtggaccagtgtagcagtagtgtggttcgatttggtagactacgaagaggttctgggtaaactggggatttacgatgcagatggagatggcgatttcgacgtggacgacgctaaagtcttactgggcctaaaagaacggagcactagtgaacctgccgtcccaccagaagaggccgagccccatacagagccagaggaacaggtgccagttgaggcagaacctcagaacatcgaagatgaggccaaagaacagattcagagcctcttacatgagatggtgcatgcagagcatgtggagggagaagatcttcagcaggaggacggcccaaccggggagccccagcaagaggatgacgagtttttgatggcgaccgacgtggacgaccgtttcgagacactggaacctgaggtgagtcacgaggagactgaacacagttaccacgtggaggagacagtgtcccaggactgcaatcaagacatggaggaaatgatgagcgaacaggagaaccccgacagctctgagcctgtggtggaggatgagaggctacatcacgacaccgacgatgtcacctaccaagtgtatgaggagcaggccgtgtatgaacccctggagaatgaaggaattgagattactgaagttacggcgcctcctgaagataacccggttgaagattcacaagttatcgtagaggaagtgtccatctttcccgtggaggagcagcaggaagtgcctcccgaaaccaatagaaagacggacgaccctgagcagaaagccaaagtgaagaaaaagaaaccaaagctgctcaacaagtttgataagacaattaaggcggagctggatgctgccgaaaagctacgaaagcgaggtaaaattgaggaggctgtgaacgccttcaaggaactcgtgcgcaaatacccccagtccccgagggcacgctatggcaaagcccagtgtgaggatgatctggccgagaagagaagatcaaatgaagtccttcggggagctattgaaacataccaggaggtggcttctctgccagatgtaccagctgatttgctgaaactgtccctgaagcgtcgttcggacagacagcagtttttgggacacatgaggggaagcctgcttacactgcagagattagtgcagctgttccccaatgacaccagccttaagaatgatctcggggttggctacctgctgataggagataatgacaacgccaaaaaggtttacgaagaggtcctttcggtgaccccgaacgatggttttgccaaagtgcactacggcttcatactcaaagcccagaataagatcgccgaaagcattccctatcttaaggagggcattgaaagcggggacccagggaccgacgatggcaggttttattttcacctgggcgacgcgatgcagcgggtcgggaacaaggaggcgtataagtggtacgagctgggccataagcgtggacactttgcttcagtctggcaacggtctctgtacaatgtgaacgggctgaaagctcagccctggtggacacctaaagagaccgggtacaccgaattggtgaagagcctggaaagaaactggaagctcatcagagacgagggcctggcagttatggataaagccaaggggcttttcctgcccgaggatgaaaacctaagagagaagggagattggagccagttcacactgtggcaacagggtcgaagaaatgaaaacgcttgtaagggtgccccaaagacatgcactttgcttgagaagtttcccgagactacaggatgccgacgtgggcagatcaaatatagcatcatgcatccagggactcacgtctggccccataccggtcctaccaattgccggcttcggatgcacctgggcctcgtcattcccaaagaggggtgcaaaataagatgcgctaatgaaaccaagacgtgggaggagggaaaagtgctgatattcgacgatagctttgaacacgaggtttggcaggatgcttcgagttttagactgatttttatagtcgacgtgtggcatccggaactgacaccccagcagcggagatcgctgcccgcaatctag

SEQ ID NO: 214987 - DNA, 1032 bp, Artificial Sequence
  Description of Artificial Sequence: Synthetic coding sequence
atgggctcccctggtgcttcccttggtattaagaaggcactacagagtgagcaggcgaccgcactgccagcgtctgcccctgctgtcagccagcctacagctcctgctccatcctgcctacccaaagctggccaagtgatcccaaccctattgcgtgaggccccattctcctctgttatagctccaacgctcctttgtgggtttctcttcctggcgtgggtagctgctgaagtgcctgaggagagctcgcgcatggctggctcaggcgctcgatctgaagaaggcaggcgacagcacgctttcgtcccagagcctttcgacggagcaaatgttgtacccaacctgtggttacattcctttgaagtgatcaacgaccttaaccattgggaccacatcacgaaattacggtttcttaaagagtcactcagaggtgaggccctcggcgtttataatcggctttcaccacaggaccagggcgattacgggacagtgaaggaggcattgctcaaggcttttggcgttcctggcgctgcgccatcgcacctgccgaaggagatcgtctttgctaactcaatgggtaagggctactacctgaagggaaagatcggcaaagtaccggtgaggttcctggtcgatagtggcgctcaagtatccgtggtgcaccctaatttatgggaggaagtcactgacggagatcttgacacactgcagcccttcgagaatgttgtgaaagttgcaaacggggctgagatgaagatattaggcgtgtgggacacggctgttagcctgggtaagttgaagcttaaggcccagtttctggtcgccaacgctagtgctgaggaagctattattggcacagatgtgctccaggaccacaacgcaattctggactttgaacataggacctgcaccctgaaagggaagaaattccgcctactccccgtgggcggttcactggaggacgaattcgacctagaattaattgaggaggatcctagcagtgaagaaggtagacaagagttaagccactag

SEQ ID NO: 214988 - DNA, 960 bp, Artificial Sequence
  Description of Artificial Sequence: Synthetic coding sequence
atgtgcagcttgcctgtgcccagagaaccactccggagagtggctgtgactgggggaactcatggcaatgagatgagtggggtctacctggcacgccattggcttcacgcccctgccgagttacaaagagcttctttctcggccgtacctgtgcttgccaatcccgctgctaccagtggctgtcgaaggtacgtcgatcatgatctcaatcgtacgttcacgagcagttttttgaatagccggcctactcccgacgacccctacgaagtgacaagagccagggagttaaaccaactgcttggccctaaggcctctggtcaggcttttgactttgttctggatcttcataacacgacggcgaatatgggcacgtgcctcatagctaagtcctcccatgaggttttcgccatgcatctgtgtagacaccttcagttgcagtacccagagctcagttgccaggtcttcctgtaccaaagaagtggtgaagaaagttacaatctcgacagcgttgcgaaaaacggcctaggactggaactaggaccccagccccagggcgttctccgcgcagatattttttcacgtatgcgcacacttgtcgcaacggtactggacttcatcgagctcttcaaccagggcaccgccttccctgcttttgagatggaggcatataggcctgtcggcgtggttgatttccctagaacagaagcgggacacctggcaggtaccgtccacccccagctgcaggatcgagacttccagcctctgcagcccggtgctccaatttttcagatgttctccggcgaggacttgttgtacgagggagagtcaacagtgtaccctgtcttcatcaatgaagccgcatattacgaaaagggggttgcctttgttcaaactgagaagtttacatttaccgtgcctgcgatgcccgcactcacgccagccccaagcccagcctcatag

SEQ ID NO: 214989 - DNA, 1041 bp, Artificial Sequence
  Description of Artificial Sequence: Synthetic coding sequence
atggcaaggaaatccaacctgcctgtactgctggtcccatttttgctgtgccaagctcttgtcagatgcagctcaccactgccacttgtcgttaacacctggcctttcaaaaatgcaactgaggccgcatggcgtgcgctcgctagcggcggttcagcattggacgcagtggaaagtggctgcgccatgtgcgaacgggaacagtgcgatggcagtgtgggatttggtggttccccagatgagctgggcgagacaaccctggatgctatgataatggacggcactactatggatgtgggggcagtcggagatttacggcgaataaaaaatgcaatcggggtagcaagaaaggttcttgagcacaccacacatacactcctggtgggcgagagcgccactacatttgcccaaagtatggggtttatcaacgaagatttatcaactacggcttcccaggctctgcactccgattggttggccaggaactgccagcctaactactggaggaatgtcattcccgacccttcaaagtattgcgggccatataaacctccaggcatcctcaaacaggacatcccgattcacaaggagaccgaggacgatcggggacatgatacaattggaatggtagttatccacaagaccgggcacatcgccgctggcacatccactaacggtataaaattcaagatacatggacgggtgggcgatagccccatcccaggagctggtgcatacgccgacgataccgcaggcgcagccgctgccaccggaaatggggacattttgatgagattcctgccctcctatcaggcggtggaatatatgaggcgcggagaagacccaacaatagcctgccagaaggttatcagtagaatacagaaacatttcccagagttctttggtgctgtcatctgtgcaaatgtgacgggtagctatggagccgcttgcaataagcttagcacttttacccagttctcattcatggtgtataacagcgagaagaatcagccgacagaggagaaagtagattgtatctag

SEQ ID NO: 214990 - DNA, 573 bp, Artificial Sequence
  Description of Artificial Sequence: Synthetic coding sequence
atggagtcgcagcggttagagttaattcgactgatggagacgcaggaagaagacgtggttctcttaactgcaggagaacacaataaagcttgctcactgctggggaaacttcggttggaatgcgcagacttactcgaaacacgcggagtggtgctcagagaccctactctgttctctttcctgtgggtggtggattttcctctctttctgcccaaagaggagaacccccgtgagttggagtcagcccaccatccatttactgctccccacccaagcgatattcacttgctgtatactgagcccaaaaaggaagatgtcaaaatgctgtcacatctcctacaggcgctggactatggtgcaccgccacacggcggaattgctctcggacttgaccgactgatctgccttgttaccgggagcccaagcatccgagatgtgattgctttcccaaaatctttccgaggacacgatctgatgagcaatacccccgatagtgttcctccggaggagctgaagccataccacatacgggtatccaaacctacagactccaaggcagaaagggctcattag

SEQ ID NO: 214991 - DNA, 1938 bp, Artificial Sequence
  Description of Artificial Sequence: Synthetic coding sequence
atgtactttccgagttggctgagtcagctctaccggggactctctcgtcctatacgtaggacaactcaaccaatttgggggagtctgtacagaagtctcctgcagtcttcgcagagacggatccctgagttttctagctttgtggttcggaccaacacatgtggggagctgagaagctcccatttaggccaagaagtgaccttatgcggctggattcagtaccggagacaaaatacttttcttgttctgagggactttgatggactagtccaagttattatcccccaggacgaaagtgcagccagcgtgaaaaagatattatgtgaagcccctgttgaaagcgtcgttcaggtcagcgggaccgtgattagtaggcctgccggacaggagaaccctaagatgcctacgggtgaaatcgaaatcaaggtgaaaaccgcagagctacttaatgcttgtaagaagctgccatttgaaatcaaaaacttcgtaaaaaagacagaggccctgcgacttcagtaccggtacctggacctcagaagtttccagatgcagtacaatctgcggcttaggtcacagatggttatgaaaatgagagagtatttatgtaatctgcatggattcgtggacatcgaaacacctacattattcaaaaggaccccgggaggagcaaaagagttccttgtgccctccagggagcctgggaaattttactctttgccgcaatcaccccagcagttcaaacagctcctcatggtggggggactggacaggtactttcaggtggcgaggtgttaccgcgacgaaggttcacgacccgaccgtcagccagagtttacgcaaatagatatcgagatgagttttgttgaccagactggtatccagagcttgatcgagggattattgcagtactcatggcctaatgacaaagaccccgtggtcgtgccttttcccaccatgacatttgcagaagtgctggccacgtatggcaccgacaagcctgatacgcggttcggcatgaagatcatagacattagcgatgtcttcagaaatacagagatcggattcctccaggacgccctgagcaagccccatgggacagtgaaggccatctgcattccggagggtgctaaatacctcaagcgcaaagatattgagtcaatccggaacttcgcggcagatcatttcaatcaggaaattctgccggtattcctgaacgccaaccgcaattggaattccccagttgcaaattttataatggaatcacagaggctcgaattaatccgtctgatggaaacacaagaggaagacgtcgtccttttgacggcaggagaacataacaaagcctgttccctgctcggtaaactgcgcctcgaatgtgcggatttgctggaaacacgaggcgtcgttctccgtgaccctaccctgtttagctttttgtgggttgtggacttcccgctgttcctcccaaaagaggaaaatcccagggagttggagtcagcccatcacccgttcacggccccacatccgagcgatatccatcttctgtatacagagcccaaaaaggccagatcccaacactatgatctggtgctgaacggcaatgagattgggggtggcagtatcagaatacataacgccgagctgcagcgttacatcctggccacattgcttaaggaggatgtaaagatgctgagccacttgctccaagctctcgactatggtgccccaccccacgggggtattgccttggggcttgaccgcctgatttgtctcgtcactgggagcccctccattagagacgtgatcgcattccctaaatcttttcgtgggcacgacctgatgagcaatacacctgactccgtgccgccagaggagctcaaaccatatcatattcgcgtgagcaaaccaaccgacagcaaggccgaaagggcccattag

SEQ ID NO: 214992 - DNA, 1143 bp, Artificial Sequence
  Description of Artificial Sequence: Synthetic coding sequence
atgaaggagtacgttctgttgctgtttctcgcactgtgcagcgccaagccgttcttcagtccctctcacatcgcccttaaaaacatgatgctgaaggatatggaagatacagatgatgatgacgatgacgatgacgatgacgacgatgacgacgaagacaattctttgtttccaacgcgagagccaagatcgcactttttccccttcgatctgttccctatgtgtccgtttggatgccaatgttatagcagggtggttcattgttccgatttaggattgacttctgtacctacgaatattccatttgacactcgaatgctggacctgcagaacaataaaatcaaggaaatcaaggagaacgacttcaaagggctaacttcactgtacggcttgatcctaaataacaataagttgactaaaatacaccctaaagctttcctcaccacaaagaagcttcgcagactttacctgtctcacaaccagctgagcgagatcccactgaacctgcccaagagtttggccgaacttcgcatccacgagaataaggtgaaaaaaatacagaaagataccttcaaaggaatgaacgccctccatgtgctggagatgtccgcgaatcccctagacaacaatggtattgaaccaggggcatttgagggggtgacggtttttcacattcgcatagctgaagccaagcttacttctgtccccaaaggcctgcccccaacccttctggagctccacctcgattataataaaatttccacagttgaactcgaggattttaaaaggtacaaagaactgcagcgcctggggctgggtaataacaaaattactgatatagaaaacggatcgctggccaacattcccagggtgcgagaaatccatttggaaaataacaagctgaaaaaaattccctctgggctacccgaactgaaatacctgcaaattatctttctccactccaactctattgcccgagtaggcgttaacgacttttgccccaccgtgcctaagatgaagaaaagcttatactcagccatcagtcttttcaataaccccgtgaagtactgggagatgcagcctgccaccttccgctgtgtcctaagccgaatgtccgtccagcttggcaactttggcatgtag

SEQ ID NO: 214993 - DNA, 732 bp, Artificial Sequence
  Description of Artificial Sequence: Synthetic coding sequence
atgaaggaatatgtgctcctgctgttcctggcgctgtgctctgccaaacctttctttagcccaagccacatcgctctaaaaaacatgatgctgaaggatatggaagacaccgacgatgatgacgacgatgacgacgatgatgatgacgatgacgaggacaactctctgttcccaacacgggagccacgtagtcatttttttccatttgatctgtttcctatgtgtccttttggttgtcagtgttatagtcgtgtggtccactgctcagacctaggacttacatcggtgcccacaaatatcccgttcgatacccgtatgctcgatctgcagaataataaaattaaggagattaaggaaaacgatttcaagggcctgactagcttgtacggactcattctgaataataataaactgacaaagatacatccgaaagccttcctgaccacaaagaagctacgtcggttgtacctgagccacaaccagctgagcgagatacctctgaaccttcccaagtccttagccgaactcaggatccacgagaacaaagtgaaaaagatccagaaagacactttcaaaggcatgaacgcgctccatgtgcttgagatgagtgccaaccctctggataataacgggattgagcctggggcatttgagggtgtgacggtgttccacataagaatcgccgaggcaaaactgaccagcgtcccaaaagttaacctccctcagttctag

SEQ ID NO: 214994 - DNA, 243 bp, Artificial Sequence
  Description of Artificial Sequence: Synthetic coding sequence
atgatgctgaaggatatggaagacaccgatgatgacgacgacgatgatgatgatgacgacgacgacgacgaagataactcgctgtttcctacacgcgagccgaggtcacacttctttccttttgacctgttcccaatgtgtccatttggatgtcagtgttatagccgcgttgtgcattgctccgatctcggcctaacttcagtccctacaaatatcccattaatcctggagtgcttgatctag

SEQ ID NO: 214995 - DNA, 732 bp, Artificial Sequence
  Description of Artificial Sequence: Synthetic coding sequence
atgaaagaatacgtgttgctgcttttcttagctttgtgttctgccaagcctttcttctcgccctcccatatcgcactgaagaatatgatgttaaaggacatggaagacacagacgacgacgacgacgatgatgacgatgacgatgacgatgatgaagataattcattgttccccactagggaaccaaggtcacacttcttcccttttgacttgttccccatgtgtccgtttggatgtcagtgctactcacgcgtggtgcattgttctgacctggggttgacatctgtgccaaccaatattccttttgatactcggatgcttgatctgcagaataataaaataaaggagattaaagagaatgactttaagggcctgacttccttgtatgggctgattcttaataataataagctcacgaagattcaccctaaggctttccttacgaccaaaaagctcagaagattgtacctgtcccataaccagctctccgagatcccactaaaccttcccaagagtctggccgagctgcgcatacatgagaacaaagtaaagaaaatccagaaagacacattcaaaggcatgaacgcgctgcacgttcttgagatgtccgccaatcctctggataacaacggaattgagccaggcgcttttgaaggtgtcacggtcttccacatacgcatcgcagaagccaagcttacatccgtgcccaaggacaatctgcctagcttttag

SEQ ID NO: 214996 - DNA, 3885 bp, Artificial Sequence
  Description of Artificial Sequence: Synthetic coding sequence
atggcgcttgccggactgtgtgccttactcgcatgttgttggggcccagccgctgtgctagcaacagcagccggagacgtggatccaagcaaggaacttgagtgcaaattaaaatctatcactgtgtctgctctgccctttctgcgcgaaaatgatctctctatcatgcatagcccaagcgcttccgaaccaaaactgctgtttagtgtgagaaatgatttccctggtgagatggtggtggtagacgaccttgaaaacaccgagcttccttactttgttctcgagatttcaggaaatactgaggacatccctcttgtgaggtggagacaacagtggctggaaaacggcaccctgctgttccatatccaccatcaagatggagctccatccttgcctggccaagaccctacagaagagcctcaacatgagagcgctgaggaggagttgcgtattctccacattagcgtgatgggcggaatgatcgccctgctgctaagtatcctgtgccttgtgatgatcctctacacgcgacgacggtggtgtaagcgacgaagagtcccccaaccacagaaatcagccagtgcagaagccgctaacgagattcattacatcccttccgtgctaatcggcggtcacggcagggagtccctgcgcaatgccagggtgcagggtcacaattcctcgggaaccttatctattcgcgaaacgcccatcctggacggatacgagtacgatatcactgatttacggcatcatctgcagagggaatgcatgaacggcggagaggatttcgcttctcaagtgactagaactctggactcactacaaggctgcaacgagaagtccggcatggatttaacaccgggtagcgacaatgctaaactttccctcatgaacaagtataaggataatatcattgccacatcacctgttgattctaatcaccagcaggccacattgttatcacatacttcctcctcacagcggaaacgcattaacaacaaggctcgagcaggaagcgccttcttaaatcccgagggggactcgggcaccgaggcagagaacgatcctcagctcacattttataccgatcctagcaggtcacggagaaggtctagggtgggatcacctaggtctcccgtgaacaaaaccacactgacgctcatctccattacatcttgtgtgattggtctggtctgcagttcccacgtgaactgcccactcgttgtgaaaataacgctacacgtgcccgagcaccttatcgccgacggatctcggttcatcctactcgaaggcagccagctagacgcctctgactggttgaaccctgcacaggtggtgctgttctcccaacagaacagcagcggaccatgggcgatggacctgtgcgctcgccgtctgctggacccctgcgagcatcagtgcgaccctgagacgggcgaatgtctctgttatgagggatacatgaaagacccagtccacaagcacctctgtattcggaatgagtggggaacaaatcaaggcccttggccttacactatctttcagagagggttcgatcttgtattgggcgaacagccctctgacaagatctttcgattcacatacacactgggcgagggcatgtggctgcctctgtctaagtcctttgtaatccccccagctgagctggcgataaacccttccgctaaatgcaaaacggatatgactgtaatggaagacgcagttgaagtgcgagaggagctcatgacctcctcctccttcgattcgctcgaggttttactcgatagcttcggtcctgttcgagactgttcaaaggacaacgggggatgctctaaaaacttccgttgcatcagcgaccgcaagctggattcaactggctgcgtgtgtccgtccggcctgagccctatgaaggattcctccggctgctatgacagacatatcggggtggattgctctgacggctttaatggtggatgtgagcagctgtgcttgcagcagatggccccattcccggacgatcctacattatacaacatcctcatgttctgtggctgcatcgaagactacaaactgggcgtagacggtaggtcatgtcagctgataacagaaacatgccctgaggggtctgattgtggggagagtcgcgaactgcccatgaatcaaacactgttcggggagatgttctttggatacaacaaccacagtaaagaggtcgcagcaggtcaggtgctgaagggaaccttccggcagaataattttgctcgcggactggaccaacagctgcccgacggacttgttgtggccaccgtgccgctggaaaatcagtgtctcgaggagatttcggagcctacaccagatcctgatttcctgacgggcatggttaacttcagcgaggtgagcggctaccccgtcttacagcactggaaggtgcgatccgtcatgtaccatattaagctgaatcaggttgcgatcagccaagccttgagcaatgcccttcactctctcgatggtgctacttcccgggcagattttgtagcgcttctggatcagttcggcaaccattacatccaggaagcgatctacgggttcgaggaatcgtgctccatttggtatccaaataagcaggtgcaacgcagactgtggctggaatatgaggatatttctaaaggaaactctccaagcgatgagagcgaagagagagagagagatcccaaagttttgacattccctgaatacatcacgtctctctccgattccggcacgaagcacatggccgcaggcgtgagaatggaatgtcactctaagggtagatgtccgtcatcttgcccactgtgtcacgtcacctcctcacccgacactccagctgaaccagttctgctcgaggtgacaaaggcagctcctatttacgagttggtcaccaacaaccagacccagagactgctccaggaggccaccatgagtagcttgtggtgctccggaactggggatgttatcgaagattggtgtagatgcgatagtacagctttcggagctgatggcctgccaacctgtgctcctcttccgcaacccgtgctccgcctctcgaccgtccacgagccctcatccacacttgtagtgctggaatgggagcattcggagccaccaatcggagtccaaattgtagattacctcctgagacaggagaaggtcactgacaggatggaccacagcaaagtggagaccgagacagtgctctcatttgtcgacgatatcatttccggcgctaagtccccctgtgctatgccctctcaggtgccggataagcagttgactactatctctctgattatcaggtgccttgaacctgatactatatacatgttcactctctggggcgtcgacaatacaggtcgacggagtaggccatcagacgtaatcgtcaaaactccgtgccctgtcgtggacgacgttaaagctcaggagattgcagacaaaatatataatttgttcaatgggtatacgagcggcaaagagcaacagacggcatacaatacactgttggacctgggtagccctacattacacagagtcctgtaccactacaatcagcattacgagtcgttcggcgagtttacctggcgatgtgaggacgaacttggccctaggaaggccggtctcatcctgagccaactaggagacttgtcatcctggtgcaacgggcttctgcaggaaccaaaaatttcgctgcgcaggtctagtctgaaatacctcggctgtcggtactcagagatcaaaccctacgggctcgattgggccgaactgtctagagacctaagaaaaacttgcgaggagcagactctctcaatcccctataatgattacggggattccaaggagatatag

SEQ ID NO: 214997 - DNA, 3909 bp, Artificial Sequence
  Description of Artificial Sequence: Synthetic coding sequence
atggcgttggctggcctatgcgctctcctggcttgctgttggggccctgctgcggtcctggcaacggctgccggagatgttgatccatctaaggagctagagtgtaaacttaagtctattaccgtatccgccttgccatttctacgtgaaaacgatttatctataatgcacagccctagcgcatctgagccaaaactcctatttagcgtgcggaacgattttcccggtgagatggttgtcgtggacgacctggagaataccgagctgccttacttcgtccttgagatctccggtaatactgaggacatccccctcgtgaggtggagacagcagtggctggagaatgggaccttgctgtttcatattcaccatcaagacggcgctccctcacttcccggacaggatcctactgaagagcctcagcacgagtccgcggaagaagaactgcgcattctgcacatctctgtgatggggggaatgatcgcactgttgttgagcatcctgtgcttggtcatgatcttgtacactaggcgacgatggtgtaagcgcagacgcgtcccacagccccaaaaaagcgcaagtgcagaagccgctaacgaaatccattacattccttccgtgcttataggcggacatggaagggagtccctcaggaacgccagggttcagggccataattctagcggaactctcagtataagggagactccaatcctcgacggctacgaatatgatattactgacctgcgccaccaccttcagagggagtgcatgaacggaggcgaggatttcgcgtctcaggtaacccgcacactggacagtctgcaggggtgcaacgagaaatctgggatggatctgacgcctgggtccgacaacgctaagctgtccctaatgaataagtataaggacaatattatcgctacatcccccgtcgactctaatcatcagcaggctacacttttatctcacacgtcatcaagccagaggaaaagaatcaacaacaaggcacgggctggaagcgctttcctgaaccctgagggagactccggtaccgaggccgagaacgatcctcaactcactttttataccgatccttcccgctcccggcgacgatcacgggtcggctcaccaaggtcacccgtgaataagactacccttaccttgatctccataacctcatgtgtgatcggtctagtgtgcagctcccacgtaaactgcccattggtggttaagataacactgcatgtgcccgagcatttaattgctgatggcagccgattcatcttactagagggcagtcagctggatgcgtctgactggcttaaccctgcccaggtggtgctcttttctcagcagaactcttccggcccttgggcgatggacctctgcgctaggaggttgttagatccctgcgaacaccagtgcgacccagaaaccgggaggcgcgagcatcgagcggcaggcgagtgtctatgctacgaagggtacatgaaggatcccgtgcacaagcacctctgcattagaaacgagtggggtactaaccaagggccttggccctacaccattttccaacgcggatttgatctggttctgggagaacagcccagtgataagatctttcggttcacatataccctaggagaaggcatgtggctgccactgagcaagagctttgttatcccaccagctgaactggccatcaacccctcagccaagtgcaagacagatatgaccgtgatggaagacgctgttgaagtgcgcgaggagctcatgactagcagctcgttcgactcccttgaggtactcctggattcttttggcccagtacgggactgtagcaaagacaacggagggtgcagcaaaaacttccggtgcattagcgatagaaaactcgatagtacaggctgtgtctgcccaagtggcctttctccgatgaaggactcctcaggatgctatgaccgccatataggcgtggactgttcggacggcttcaacggaggctgcgagcagctgtgcctgcagcagatggcaccgtttcccgacgacccaaccctgtacaacattctgatgttttgcggatgtattgaagattacaaacttggggtcgacgggaggagttgccagctaattacggagacttgcccagaggggagcgattgtggagagagccgcgaactccctatgaatcagacgttattcggcgagatgttcttcggttataacaaccactccaaggaggtggcagctggtcaggtgctcaaaggcactttccgtcagaacaactttgcacggggtctggaccagcagctgccggatggactcgtagtcgctaccgttccattggagaatcagtgtttagaggagatttccgagccaacaccggaccccgacttcttgactggcatggtgaatttttctgaggttagtggttaccccgtcctgcagcactggaaagttcgcagcgtgatgtaccatattaagctgaaccaggtggcaatttctcaggcactgtcaaatgccctgcactcattggatggagctacatcaagagccgactttgttgccctcctcgaccagttcggcaaccattatatacaggaagccatatacggttttgaggagtcttgtagcatatggtaccctaataaacaggtgcagcggagattgtggctcgaatacgaggatatatcgaagggcaactctccctctgacgagagcgaggaacgtgagagagacccaaaggtgctgaccttcccagaatacatcacttccctatctgatagcggcacaaagcacatggccgcaggcgtacgaatggaatgccactccaagggtcgttgtcccagcagctgtcctttgtgccatgtgacatcttcaccagacaccccagccgaaccagtgctcctggaagtgacaaaggctgctcctatttacgagttagtgacaaacaaccagacacagagactgttgcaagaggccaccatgagctcactctggtgtagcggtacaggcgacgtaattgaggactggtgtcgctgtgatagtactgcctttggggctgacggccttcctacttgcgctccgctgccacagcctgtgctgagattgtccactgtacatgagccatcctcaacgctggttgtgctggaatgggaacattctgaacctccgatcggggttcagatcgtcgactacctacttaggcaggagaaagtcaccgaccgaatggatcatagcaaagttgagaccgagaccgtcctctcctttgtggatgatattatctccggggctaagtctccttgcgcaatgcctagccaggttccggataagcaattgactactatttcgttgattattcgctgcctggagcctgacacgatatatatgttcacgctgtggggcgtcgacaatacaggtcgcaggtcacgtccctccgatgttatcgttaagaccccctgtcccgtcgttgacgacgtcaaagcccaggagattgcagataagatctacaacctgttcaatggatatacttccggaaaggaacaacagacagcttataacacgctgctggatttgggcagtccaacactgcaccgcgtgctgtatcattacaatcagcattacgagtctttcggcgagttcacatggaggtgtgaggatgagttgggaccccgaaaagcaggactgatcctcagtcagcttggggacctctcaagctggtgcaatggactgctccaggaacccaagatcagcctgcgcaggtcctcattgaaatacctcggatgtcgctatagcgaaatcaagccttacgggctcgactgggcagagctaagtcgcgacctgcgcaagacttgcgaggaacaaacactctcaataccctataatgactacggagacagcaaagaaatttag

SEQ ID NO: 214998 - DNA, 3651 bp, Artificial Sequence
  Description of Artificial Sequence: Synthetic coding sequence
atggcactcgccggattatgcgctctactagcctgttgctggggtcccgctgctgttcttgctacagccgcaggtgacgtggatcccagcaaggaactggagtgcaagctgaagtccatcacggtcagtgccctcccattcctgagggaaaatgacctctccatcatgcatagcccatcggcctctgagccaaagttactgttttctgtgaggaatgattttcccggtgagatggtcgtggttgatgacctcgaaaataccgagctgccctatttcgtgctcgaaatatctggtaatacagaggacatcccactggttcgatggcgacagcagtggcttgaaaacggaacgctgctctttcacatccatcaccaggacggcgctccgagcctgcctggccaggatcccaccgaagagccccagcacgagtcagcggaggaggaactgcgaatcctgcatatctccgtaatgggcggaatgatcgcactgctgctgtctatactgtgcctggtgatgattctctatacaaggagaaggtggtgcaagcgcagacgggtcccccagccacaaaagagtgcctctgccgaagctgcgaatgaaatacactacatccctagcgtccttatcggaggccacggacgggaatctctgaggaatgcgagagtgcaggggcataactcttccggcactctgtccatccgcgagacaccgatcctggatgggtacgagtacgacatcactgacttgaggcatcatctgcagcgggagtgtatgaacgggggtgaggactttgcatctcaagtgacgcgtaccctcgatagtctgcagggatgtaatgagaaaagtgggatggacctgacaccagggtctgacaacgcaaagctctctctgatgaacaagtacaaagacaacatcatagcgacatcaccggtagattccaaccaccagcaggccacattgttgtcccatacctccagctcacagcggaagaggatcaataataaggcccgagccggttccgcttttctaaaccctgaaggagattccgggaccgaagccgaaaatgatccccaactgacattttacaccgacccatctcgatctcgcagacgatcccgcgttggctccccacgcagcccagtcaacaaaacaaccctgactctgatctcaattacatcatgcgtcataggtcttgtgtgcagttctcatgtgaattgcccgcttgtcgtgaagataacactgcatgtccctgaacacctcattgcagacggaagtaggtttatcctcctcgagggttcccagctagacgcctcagactggctaaacccggcacaggttgttctgttctctcaacaaaatagcagtgggccatgggccatggatctttgtgccaggagattgctggacccttgcgagcatcagtgcgacccagaaaccggggaatgcctgtgttacgagggctacatgaaggacccggtccacaagcatctgtgcatacggaacgagtgggggacaaatcagggaccatggccttacacaattttccagaggggattcgatcttgtgttgggcgagcagcccagcgacaagatttttaggtttacatacactctcggagaggggatgtggttgccattatctaagagctttgtgatacctccggctgagctggccattaacccttccgccaagtgtaaaacggacatgacagtgatggaggatgccgtcgaggtgagagaggaactgatgacatcttcaagctttgacagtctggaggtgctgctggactcctttggcccagtacgcgattgttccaaagacaacggcggttgcagtaagaatttccggtgtatttccgatcgcaagctggattccacgggttgtgtatgtccctctggcctgtctcccatgaaagactcgagtgggtgctatgaccgtcacatcggagtggactgttcggatggctttaatgggggttgtgaacagctgtgcctgcaacagatggcccctttcccagacgaccccactttatataatatactgatgttctgtggatgtatcgaggattataagctcggggtcgacgggcgttcatgtcagttaattacagagacctgcccagagggctcagactgcggagagtccagggaattgcccatgaaccagacgttgtttggcgagatgttcttcggttacaacaaccatagcaaagaagtggccgctggtcaggttctgaaggggactttcaggcagaacaactttgccagagggctggatcagcagctccctgacggcctagtagttgctactgtcccccttgaaaaccaatgcttggaagagatcagtgaacccaccccagaccccgactttctcactgggatggtcaactttagcgaggtgtccggctatcctgtgctgcaacattggaaggtgcgtagcgtgatgtaccacattaaattaaatcaagtggcaatttctcaagccctcagtaacgctctgcacagcttggatggcgcaacttctcgggctgacttcgtggctctgctggatcagtttggcaatcactacatccaggaagccatctacggctttgaagaatcatgcagcatttggtatcccaacaagcaggttcagaggcgtctgtggcttgagtacgaggacatttcaaaaggaaacagtccaagtgacgagtctgaggaacgtgagcgcgaccccaaagtgctcacatttcccgagtacatcacctctctgtcggactctggcaccaagcatatggcagccggagtgcgtatggagtgccacagcaaaggccgatgtccttccagctgtcccctctgccacgtgacgagtagccctgacacacccgcagagccagtcctgctggaggtgacaaaggcagccccaatatacgagctggtcacaaataaccaaactcaacggttactccaagaggccacgatgtcatcattgtggtgctctgggactggcgatgtgattgaggattggtgtcgctgcgattccaccgcattcggagcagacgggctgcccacttgtgcaccactgcctcagccggttctcaggttatccaccgtccacgagccctcctccactttagttgttcttgagtgggaacactcagagccacccatcggggtccaaatcgtggattacctgctgcggcaagaaaaggtgacagaccgcatggatcattctaaagtggagacagagacagtcctcagctttgttgacgacatcatcagtggtgccaagagtccgtgcgccatgccaagccaggtgccagataagcaattgacaaccatctctttgattattagatgtctagaacctgatacaatctacatgtttacactatggggtgtagataacactggacgtaggtccagaccttccgacgtgatcgtgaaaacgccttgccccgtcgtggacgatgtcaaggcccaagagattgctgataagatttataatctcttcaacggctacacttccggaaaggaacagcaaacagcttataacaccctgctcgatcttgggagtcccacgctacatagggtgctttatcactataatcagcactatgaaagttttggggaatttacctggcggtgtgaggacgagctggggcctagatag

SEQ ID NO: 214999 - DNA, 3657 bp, Artificial Sequence
  Description of Artificial Sequence: Synthetic coding sequence
atggccctggccggactctgcgccctgctagcgtgttgttggggcccagctgccgtgttggccaccgccgctggagacgtcgaccccagtaaggaactggaatgcaagctgaagtctatcaccgtcagcgctcttccattcctcagagagaatgatctgagcatcatgcacagcccttctgcctcggagcctaaactactgtttagtgtgcgcaacgattttcctggcgagatggttgtggtcgatgaccttgagaacacggaactgccttatttcgtgctggaaatcagtgggaatactgaagatattcccttggtcagatggcgccagcagtggctggagaatggtactctgttgttccatattcatcaccaggatggcgctccatccttgccaggtcaggaccccaccgaagagccgcagcacgagtctgcagaagaggagctgcggatcttgcatatctccgtgatggggggaatgattgccctcctgctgagcatcttgtgccttgtgatgattctgtacacgagacggagatggtgtaagcggagacgggtccctcagccccagaagtccgcatcggctgaagcggctaatgaaatccactacattccgagcgtgctgattgggggtcacggcagggaatccttgcggaatgctagggtgcagggtcataactctagcgggactttgagcattcgtgaaactcctatcctcgacggatatgaatatgacatcaccgatttgcggcaccatttgcagcgagaatgcatgaatgggggagaagacttcgcaagccaggtcacaaggacgctggattctctgcaaggctgcaatgagaagtccggtatggacctgaccccaggcagcgacaatgctaaactgtccctgatgaacaagtataaggataatatcattgccacctccccggtggattccaatcatcagcaggcgactctgctgagccatacatcttcctcacagagaaagcggatcaacaacaaagctcgcgctggtagcgccttccttaacccagaaggagactcaggcacagaagccgaaaacgatcctcagctgacattctacactgatccttcacgctctcggagaaggagcagagtggggtcacctcggagtcccgtcaacaagacaacgctgactctcatatctatcacttcctgtgtgatcggcctggtctgcagttctcatgtcaattgtccactcgtggtgaagattaccttacatgttccagagcacctcatagctgatgggtcccgatttatcttactggaaggtagccaacttgacgcctcagactggctcaaccctgcccaagtggtgttgtttagccagcagaatagttcaggcccatgggcgatggacttgtgtgcgagacgattgcttgacccttgcgaacatcagtgcgatcctgagaccggagaatgtctgtgctacgaaggctatatgaaagaccctgttcacaagcatctctgcattcgcaacgagtggggaaccaatcagggaccctggccttacaccatttttcaaagagggtttgatctggttctgggagagcagccatccgataaaatattcaggtttacttatacccttggcgaagggatgtggttacccctgtccaaaagcttcgttatacccccagccgaactagctataaacccatccgccaagtgtaagacagatatgaccgtgatggaagacgcggtcgaagtgagggaggaactgatgacctcatcttcattcgactccttggaagtgctgttggactccttcggccctgtgcgcgactgctcaaaagataatggcggatgctccaagaattttcgttgcatcagcgatcgcaagcttgattctactggctgtgtctgtccttccggtctctcacccatgaaagattcatccggctgttatgaccgccacatcggggtggactgttcagacgggttcaatggtggctgcgaacagctgtgcctccagcagatggcccctttccccgacgaccctaccctatataatatactcatgttctgcgggtgcatcgaggattacaagttgggggtcgatgggagaagctgccagctcatcaccgagacatgtcccgagggcagtgattgcggggagtcccgagagctgcccatgaaccagacactgtttggcgaaatgttttttgggtataataatcatagcaaagaagtggccgctgggcaggtgctgaaaggtaccttcagacagaataatttcgcaaggggattagatcagcagctgccagatgggcttgtggtcgccaccgtgcctttagagaatcagtgtctggaggaaatctccgaacctactccagacccagacttcttgactggaatggtgaatttctcagaggtgtccggctaccccgtcctccaacactggaaagtgaggtccgtgatgtaccatatcaaactgaatcaggtggccatttctcaggcactgtccaatgcattgcattccctcgatggagctacctcccgggcagattttgtggccctcctggaccaatttggaaatcactatatacaggaagctatttacggatttgaagaaagctgtagcatctggtaccccaataagcaggttcagcggcgattgtggctcgagtatgaggatattagtaagggcaacagtcccagcgacgaaagcgaggaaagagaacgcgacccaaaagtactcacctttcccgaatacatcacttctctgagtgactccgggaccaagcatatggcagcgggagtgcgtatggaatgtcatagtaagggacgttgcccctcctcctgccccctgtgccatgtcacatcctcgccggacacaccggcagagcccgtgctgctggaggtgactaaagccgctccaatatacgaactggtcacaaataaccagactcagaggctcttacaggaagccactatgtcgagcctatggtgctctggaaccggtgatgttatagaagattggtgtaggtgcgatagtactgcttttggagcggacggcctccctacgtgcgccccactgccccagcccgtccttcgtctgtctactgtccacgaaccttcttctacacttgtggtactggagtgggaacattcagaaccgcctatcggcgtccaaattgttgactacctactgcgacaagagaaagtgaccgaccgtatggaccattccaaggtcgaaacagagaccgtcctaagctttgtggatgacatcataagcggggctaaaagtccatgcgccatgccaagccaggtaccagacaagcagctgaccactatttcactcattatcaggtgcctcgagccagacaccatttacatgttcacactttggggagtggataacaccgggaggagatctcgaccaagtgacgttatcgttaaaaccccttgccccgtggtggacgacgtgaaggcccaggagattgctgacaaaatttataatctcttcaacggctatacctccggaaaagagcaacagacagcatataatacccttctggacttaggatcaccaactctgcacagagtgttatatcattataatcagcactatgagtccttcggagaatttacttggaggtgtgaggatgagctgggacctagaaatcagtag

SEQ ID NO: 215000 - DNA, 1323 bp, Artificial Sequence
  Description of Artificial Sequence: Synthetic coding sequence
atgaataccctgctctgtaagggtatgttctgtctcctcagttgggaggcggactctcgcggaaggctcggcgagtataccctccaaccacttagtttgcagactgaggaaaccactgagctcgggagcaagaaagagctgaaatctatgccatttatcacctatctgtccgggctcctgacagctcagatgctcagtgacgaccaactcatctccggagtcgaaatcagatgcgaggagaaggggaggtgtccctctacctgccacctgtgtcggagaccagggaaggagcaactttccccgactccagttctgttggagatcaacagagttgtgcctctgtacactctaatacaggataatgggaccaaggaagccttcaagtcggctcttatgagtagttactggtgtagtgggaaaggagatgttattgatgattggtgtcggtgtgatctaagcgcctttgacgccaacggtctccccaactgttcccccttactgcagcccgtcttgcgtctgagccccaccgtggagccgtcttctaccgtcgtatcactggagtgggtggatgtgcagcctgcgattggaacaaaggtcagtgattacatcctgcagcacaagaaggtagacgaatataccgacactgacctgtatacaggggagtttctgagtttcgcagacgatctactgagcggtctggggaccagctgtgtcgccgctggtaggtcacatggcgaggtgccagaagtttccatctattcagtgattttcaaatgtcttgaacctgacggcctctataagttcactttgtacgcagtggacacacgcggtcgtcacagcgagcttagcacggtgacactgcgaaccgcctgtcccttagtggacgataacaaggccgaggaaattgcggacaaaatctacaatctatataacggttatacttccgggaaggaacagcagatggcctacaatacgctgatggaagtgtccgcttctatgctgtttcgagtacagcatcattacaattcacactacgagaagtttggagacttcgtttggcggtctgaggatgaactgggccctcggaaggcccatctgatcctgagacgcctggaaagggtctcctcccattgcagttctctgttgaggtcggcctacatccaatctcgtgtagagacagtgccctatctgttctgtagatcggaggaggtcaggcccgcaggtatggtctggtattcgatcctcaaggacactaaaatcacttgtgaagaaaaaatggtgagtatggcacgcaatacctacggagaatccaaggggagatag

SEQ ID NO: 215001 - DNA, 4020 bp, Artificial Sequence
  Description of Artificial Sequence: Synthetic coding sequence
atggcagcggctggggcacgcctgagccctggcccaggtagcggtctgcgaggacgtcctagactgtgcttccaccctggacccccacctctgctacccctcctgctgctgttcctgttgttactgccacccccacctctgctggctggcgcaacagcagcagcatcaagagagccagacagtccttgtcggctgaagacggtgaccgtgagcactcttcccgcactcagggagagtgatatcggttggtccggagcacgggctggcgctggcgctggcacgggagctggagcagctgccgcagctgcgagtccagggtctcctggaagcgccggtacagcagcggaatcccggctactcctctttgtgcggaacgagctgccgggaaggattgctgttcaggatgacctggacaataccgaacttcctttctttactttggagatgtcggggacggcggcagatataagcctggtgcactggagacagcagtggctagaaaatgggactctgtactttcacgttagcatgtcaagcagtgggcagctggcacaggcaaccgcccctactcttcaggaaccctcagaaatcgtcgaggagcagatgcacattctgcacatctcagttatgggcggtttgatagcactattactgttactgctggtgtttactgtggccttatacgctcaacgcaggtggcagaaaagacggagaatcccccaaaagtctgcttccacggaggccacccacgagatacattatataccttccgtgctcttgggacctcaggcgagggaatctttcaggagcagccgtctgcaaacccacaacagtgtcattggtgtgcctatccgggagactccaattctggacgattacgactgtgaggaagatgaggaaccacctagaagagcaaatcatgtgagtagggaggacgagtttgggagccaggtcacgcacacactcgacagcctaggccaccctggcgaggaaaaggtggatttcgaaaagaaggcagcggctgaagcaacccaggagaccgtggagagcctgatgcagaagttcaaagaatccttcagagcaaacacccccatcgagattggccaattgcagcccccacttcggagtacctctgctggaaaaagaaagagaaggtcaaagtccaggggtggcataagctttgggagggcgaagggcacatctggaagtgaggctgatgacgaaacacagctcacattctatactgagcaataccgatcccggaggagaagtaagggactgctgaagtcccccgtgaacaagacagctctgactctcattgccgtttccagttgtatcctggccatggtttgtgggagtcaaatgtcctgtccacttactgttaaggtgactctgcacgtgccagagcacttcattgcagacgggtcctcatttgttgtgtcagaggggagttacttagacatttccgattggcttaaccccgcaaaattgtctttatattatcagatcaatgctacatccccctgggtccgcgatttgtgtggccagcggactaccgatgcctgtgaacagctgtgcgaccctgagaccggcgagtgttcttgccacgaaggttacgcccctgaccccgtgcataggcatctatgcgtacgaagcgattggggacagagcgaaggaccctggccctatacgaccttggagagaggatacgatctagtgaccggtgaacaggcgccagagaaaattctgagatccacattctctctgggtcagggactgtggttgccagtctctaagtctttcgtagtacccccagtggaacttagtatcaaccctctcgctagctgcaaaacagatgtcctggtgactgaggaccccgctgatgtgagagaagaagcaatgctgtcaacctacttcgagacgatcaatgatttactcagttcattcggtcccgtgagagactgcagcagaaacaatggtgggtgcaccaggaattttaagtgcgtgtctgaccgccaggttgactcttccgggtgcgtgtgtcccgaggagctcaagccaatgaaggacggttctggatgttatgatcatagcaaaggaatcgactgttctgatggcttcaatggcggatgcgaacaactctgtttgcaacagacactacccctcccgtatgatgctacatcctctactattttcatgttctgcgggtgtgtcgaggagtacaaactggcacccgatggaaagtcttgtttaatgctaagcgatgtttgcgagggacctaagtgcttgaaacctgacagcaaattcaatgacacactttttggggaaatgcttcacggatacaataaccggacacagcatgtgaatcaaggccaagtgtttcaaatgacctttagggagaataacttcattaaagacttccctcagctcgcagatggactcctggtcattcctttacccgtggaagagcagtgtagaggagtgcttagtgaaccactcccggatctccagctcctgaccggtgacattcggtacgacgaagctatggggtatcccatggtgcagcaatggagggtgcgctccaacctttacagagtcaagttgtccacaattacactcgccgctgggtttactaatgtgttgaagatcctcactaaggagtctagccgcgaggagctgttgagttttattcagcactacggctcgcactacattgccgaggctttgtacggctctgaactgacctgtatcatccacttcccatctaagaaagtccagcagcaactatggctgcaataccaaaaagaaactactgagttaggctctaagaaagagctgaaaagcatgccctttatcacatacctgtctggactcctgactgctcagatgctgtccgatgaccagttgatttctggcgtcgaaataagatgtgaggagaagggtaggtgcccatctacctgtcacctctgtcgacggccaggcaaggagcagcttagtcccaccccggtacttctcgagattaatcgggtggttccactgtatactctgattcaggacaacggcaccaaggaggctttcaagtccgctttgatgtcttcctactggtgttctgggaaaggcgacgttattgatgattggtgccgatgtgatttgagcgccttcgatgctaatggtctgcctaactgttctcctctcctacaaccggtgctacggctttctccaacagttgaaccatcaagtacagttgtcagtcttgagtgggtggatgtgcagcctgccatcggtacaaaggtctctgattatatccttcagcacaagaaagttgatgagtataccgatactgacctttatactggcgaatttctgagcttcgctgacgatctgctgtcaggactggggacatcttgcgtggcagccggtaggtcgcatggagaggtgcctgaagtgtcaatatactccgtcatatttaagtgccttgaaccggacggcttgtacaaattcacactttacgcagtggatacccgtggtcgccactcagaactcagcactgtgactctgcgcactgcatgtcccctggtggacgacaataaagctgaggaaatcgcagataagatttacaacctgtataatggatatacctcagggaaggagcagcaaatggcctataacactcttatggaggtcagcgctagcatgctattcagagtgcagcaccactacaacagtcactacgagaagttcggcgatttcgtgtggcgctctgaggatgagctggggcctcgcaaggcccacctcattcttaggcgtctcgagagggtgagttcacattgctcttccttactgagaagcgcctatatacagtcaagagtggaaaccgtaccctacctcttttgcagaagtgaggaagtgcgccctgcaggaatggtgtggtatagtatcctgaaggatacaaaaatcacctgcgaagagaagatggtgtccatggccaggaacacgtacggggaaagtaagggccgttag

SEQ ID NO: 215002 - DNA, 1188 bp, Artificial Sequence
  Description of Artificial Sequence: Synthetic coding sequence
atgcccttcattacctatctgtcaggactgctgacagcacagatgctctccgatgaccagctgattagcggtgtcgaaatcaggtgcgaagaaaaaggtcggtgcccatctacttgccacctgtgtcggagacctggcaaggaacagctttccccgactccggtgctgctcgaaattaaccgcgttgtccccctctacaccctcattcaagataatggtacaaaagaggcgttcaaatccgccctgatgtctagctactggtgcagtgggaaaggagacgtcattgacgactggtgcaggtgtgatctctctgctttcgatgcgaacgggttacccaattgctcacccctgctgcagcccgtcttacggctatcaccgacagtggaaccttcaagtaccgtggtgagcctggaatgggtagacgttcagccggcaattggaactaaagttagtgattacattctacaacacaaaaaagtggatgaatacacagacacagacctgtacacaggtgagtttctgtcttttgctgatgatcttttgagcggattggggacttcgtgtgtcgcagctggcaggtctcatggcgaggtgccagaggtgtctatctatagtgtgatctttaaatgcctcgagcctgacgggttatataaattcacactgtacgcagtggacacaagaggacggcactccgagttgtccacagtgactctcagaaccgcttgccctttggtggatgacaacaaggcagaagaaatcgcagacaagatttataacctgtataacggatatacttcaggcaaggaacagcagatggcatataatacgctgatggaagtctctgccagcatgctgttccgggtgcagcatcactacaattctcactatgagaaattcggagacttcgtctggcggtcagaagacgaactgggcccacggaaggctcatctgatcttgcgtcggcttgaacgggtatcctctcactgcagcagcctattacgcagcgcttatattcagtctcgcgtggagactgttccctatctgttctgccggtcagaggaagtgaggcccgctgggatggtgtggtacagcatcctgaaggacacaaaaattacttgcgaggagaaaatggtgagtatggctaggaacacctattacctgaccttgtctaaggtgagtcctttttag

SEQ ID NO: 215003 - DNA, 585 bp, Artificial Sequence
  Description of Artificial Sequence: Synthetic coding sequence
atgccattcatcacttacctatcgggcctcctcaccgcccagatgctctctgacgaccagttaatctccggcgttgagattaggtgtgaagaaaaagggagatgcccaagtacatgccacttatgtcgccgacccggtaaggagcaactctctccaaccccagtgctactagagattaaccgggttgtgcccttgtatacactcattcaggataacggcacaaaggaggcgttcaagtcagctcttatgtccagctattggtgctcagggaaaggggatgtaattgatgattggtgtaggtgtgacttaagcgcctttgacgccaatgggctgccgaactgcagcccacttttacagccagtgctccgactcagccccactgtcgagccttcctccacagttgtgagtctagagtgggtggacgtgcagcccgcaatcggcacaaaggtttcagattacatccttcaacacaagaaagtggacgagtacaccgacacggacttgtacacagtgtactgctggatcaccttcatcgacctccgaatcctgaatcaaccgtgtattccaggaatgaaacccacctag

SEQ ID NO: 215004 - DNA, 3867 bp, Artificial Sequence
  Description of Artificial Sequence: Synthetic coding sequence
atggctgccgctggagcacggctgtcccccggaccgggttcgggattgagaggcaggcctaggctctgttttcatccaggtcctccgcctctactccctctacttttgttattcctactattgctcccacccccacctctgcttgccggagcgaccgcagccgcttccagggaaccagactcaccctgcaggttgaaaaccgtcacggtgtccaccctgcctgctttaagggaatccgatataggctggtcaggggcacgagctggggctggggctgggacaggcgcaggggctgccgctgctgccgcatcacctgggagccctggttcagccggtaccgctgcggaaagccggctgctactgtttgtgcggaatgagctaccaggacgaattgctgttcaggacgacttagataacacggagctgccatttttcacactggagatgagcggcacagcagccgacatctccctcgttcattggcgacagcagtggcttgagaacggtaccctctatttccacgtgtcaatgtcttcgtcaggtcaactagcgcaagctactgcccctacattacaggagccctcagagatagtcgaagagcagatgcacatactccatatcagcgtcatgggcggactcattgcactgttgcttctgctgttggttttcacggtcgccctgtacgcgcagagacgctggcaaaaaagacggcgaattccacagaagtctgccagtacagaggccacccatgagatccactacatccccagcgtattgctggggcctcaggccagggagagtttccgatcatctaggctgcagactcacaacagcgtgattggggttccaattcgagagacgccaatcttagatgattatgattgtgaggaggacgaagaacctcctagacgtgcaaatcacgtgtcgcgggaagacgaatttgggtcccaggtcactcacaccctcgacagcttgggacaccccggagaggagaaggtagattttgagaagaaaggcggaatttcatttggccgtgctaaaggtacatcgggaagcgaggctgacgacgagacccagctgaccttttacacagaacaatatagaagccgccgacgctccaaaggcctgttaaaatctccagtcaataagaccgctcttaccctgatcgctgtatcgtcctgcatccttgcaatggtatgcggctcacaaatgagttgtcccctgactgtgaaggtgactctccacgttcctgaacactttatcgccgatggctcctccttcgtcgtaagcgagggctcatatctggacatatcagattggttgaacccagccaagctgagcttgtactaccaaataaacgccacctccccctgggtgagagatttgtgcgggcagaggacaacagacgcctgcgagcagctctgcgaccctgaaacgggagaatgctcttgtcacgaaggatatgcacctgaccccgtgcaccggcacctgtgtgtgcgttctgactggggccagtccgagggtccctggccatatacaaccctggagcgtggatacgaccttgtgaccggagaacaagctccagagaaaatcctgcgcagcacgttctccctgggacaagggctgtggttgccggtatccaaaagttttgtggtaccacctgttgaactatcgataaatccactggcatcttgcaaaacggatgtgttagtgactgaagatcctgccgatgtaagagaggaagcaatgctaagtacctactttgaaacaataaatgacttattgtctagctttggaccagtccgagattgtagccggaataatgggggttgtactcggaacttcaagtgtgtttctgaccgccaagtagactcaagcggttgcgtctgccccgaggaattgaaacccatgaaggacgggtccggctgttatgatcattccaaagggattgattgctccgatggtttcaatgggggatgcgagcagctgtgtttgcagcagacactgccgcttccatacgacgctacttcatcgactattttcatgttctgtgggtgtgtggaggagtataagttggcccctgacgggaagagctgcctaatgctgagcgatgtgtgcgaagggcctaaatgcctaaaacccgacagtaagttcaacgataccctgttcggcgaaatgctccacggctataacaaccggacccaacatgtcaaccagggccaggtgtttcagatgacatttagagagaataactttattaaggacttccctcaactagctgatgggctgctcgtgattcccctccctgtggaagagcagtgtagaggcgtgttgtccgagccgctacctgacctccagctgttgactggggacatccgttacgatgaagcaatggggtatccaatggtgcagcaatggcgtgtgcgttccaatttataccgggtaaagctgagtaccattaccttggccgctgggttcaccaacgtcctgaaaatcctgacgaaagagtcaagtagagaggagctattatcatttatacaacattatggctctcactacattgccgaggctctttacggctctgaacttacctgtattattcactttccttcaaagaaggtccaacaacaactgtggctccaataccagaaggaaaccacagaattgggcagtaagaaagaattaaaatcaatgccttttataacctacctctctggactcctcactgctcaaatgctctctgacgaccagctgatcagcggcgtggagattcgctgtgaagaaaaagggagatgcccctcaacctgccacctctgtcgcagaccgggtaaagagcagctttcccccactcccgtcctcttggagatcaatcgcgtagtgccactttataccctcatccaagataacggaacaaaggaggccttcaaatccgccctcatgtcttcatattggtgctctgggaaaggtgacgtcatcgatgattggtgcaggtgcgacctctctgcgtttgatgccaacggtctgccaaactgcagtccacttttgcaaccagtgctgcgcctgtccccaactgtcgagccaagcagcaccgtggtgtcccttgaatgggttgacgtgcaacccgcaatcggtaccaaggtgtctgattatattctacagcataagaaggtcgatgagtacactgacacagacctctacaccggagagttcctttctttcgcagatgaccttctcagtggactaggcaccagttgcgtggccgctggaagaagtcacggggaagtccccgaggtctctatctattccgtgattttcaaatgcttagagccggacggcctgtataaatttactctgtatgccgtggataccagaggtcgccacagcgagctaagcactgtaacactgaggaccgcctgtccactcgtggacgacaacaaggccgaagagattgcagacaaaatttataatctctacaatggctataccagtggcaaggaacagcagatggcctataatacactcatggaagtctctgcgtccatgctcttcagagtccagcaccattataattctcattacgaaaaatttggagattttgtgtggaggtctgaggacgaactgggtccacgaaaggcacacttaatcctcagacgcctcgaaagagtctcatcccactgctcttccctcctcagatcagcttacatacagtctcgggtggaaacagttccatacctcttttgccggagcgaagaggttaggccagccggaatggtctggtactccattctgaaggacactaaaatcacatgtgaagaaaaaatggttagtatggcaagaaatacatatggtgagtcaaagggacggtag

SEQ ID NO: 215005 - DNA, 1188 bp, Artificial Sequence
  Description of Artificial Sequence: Synthetic coding sequence
atgcccttcatcacctacctctccggtctcttaacggcacagatgctttccgacgatcagctcattagcggtgttgagattaggtgcgaagaaaagggccgatgtccctccacctgccacctctgtagaagacccggaaaggagcagttatcccctacacctgtcctcctggagataaaccgggtagtgcccttgtacacactaattcaagataatggcaccaaggaggctttcaaatctgcccttatgtccagttattggtgcagtggcaaaggggacgtcatcgatgactggtgccgttgtgatctttccgctttcgacgcgaatggcctgccaaattgttcccctctgctccagcccgtcttgaggttgtccccaacagtagagcccagtagcaccgtcgtgtccctggaatgggtcgacgtgcaaccagcgatcggcaccaaggtgtccgattatatcctgcagcacaagaaagtcgatgaatataccgacacggatctctacactggggaatttctcagctttgcggacgacctcttgagcggcctgggcacatcttgcgtcgctgcagggagatcgcacggcgaggtgcccgaggtctcaatctattcagtgatcttcaaatgtttagagccggatggattgtacaagttcactctgtatgctgtcgataccagaggccgtcacagcgaacttagtaccgtcacactcagaaccgcttgtccactggtagatgataataaggcagaggagattgcggacaaaatctacaacttgtacaatgggtacacatccggtaaggaacaacagatggcttataataccctgatggaagtgtcggcctcaatgttgttccgtgtgcagcaccactataattcccattacgagaagtttggagactttgtgtggagatccgaggatgagctgggacctcgcaaagcacacctcatcttacgcaggctggagcgcgtgtctagccattgttcttccttgctgaggagcgcctacattcaatcacgagtggagactgtcccctacctattttgccgatcggaggaggtgaggcctgcaggcatggtgtggtattcgattttaaaagataccaagattacctgcgaggagaaaatggtatctatggcccgaaacacctactatcttacactgtccaaggtcagccccttctag

SEQ ID NO: 215006 - DNA, 4008 bp, Artificial Sequence
  Description of Artificial Sequence: Synthetic coding sequence
atggccgcagccggtgccagactgtcaccaggaccaggatctggtttacgaggaaggcctcgcctctgtttccaccccggacccccaccgctactgcctcttttgctactcttcctgcttcttttaccccctcctcccttgctggccggtgccactgcagctgcctcacgtgagccagacagcccctgccggctgaagactgtgaccgtgagcaccctccctgcattacgtgaaagtgacattggctggtccggcgctcgggctggtgccggagctgggacaggggcaggagcagcagcagcagctgcttctcccggatcacctggcagcgccggaacagcggctgagtcccgcctgctgctgttcgttcgtaacgagctgcctggcagaattgcagtccaggatgaccttgataatacagagctccccttttttacacttgagatgagtggcacggccgcagatattagtctcgtgcattggcgacaacagtggctggagaacggcaccctgtacttccacgttagtatgtcgtccagtgggcaacttgcccaggccactgcgccaaccctccaggaaccaagcgagatcgttgaggagcagatgcatattctgcacatctctgtcatgggaggtttgattgcattgctgctcctcctgcttgtgtttaccgtcgccctgtatgcccagcgacggtggcagaaaaggcggagaatcccccagaaaagtgcatccactgaagcgacccacgaaatacactacatccccagcgttttgttgggaccccaagcaagagaaagttttaggtcgagcaggctacagacccacaatagtgtgatcggagtgcccattagggaaactcctattctcgatgattacgactgcgaggaagacgaggagccgccacgcagagccaaccacgtgtctcgggaagatgagttcgggagccaagtgacccacaccttggattcactgggacaccctggcgaagaaaaagtcgatttcgaaaaaaaggcagcagctgaagcaacacaagagacggtggaatctctgatgcaaaagttcaaggaatcattccgggctaatacaccaatcgagattggacagctccagccgcctcttaggagcacatctgctgggaaacggaagcgccgtagtaaaagtcgcggtgggatctcattcgggagagctaaagggacctccgggtctgaggctgacgacgaaacccaactcacgttttacacagaacaataccgttccagaagaaggtccaagggactgctcaagagccccgtaaataagactgctctcacacttattgctgtaagctcttgtatcttggctatggtgtgtggcagccaaatgtcatgccccctgaccgtcaaagtcactctgcatgtccctgagcacttcatcgccgatggaagcagctttgtcgtgtcggagggaagctatctggatatcagtgactggctcaatccggcaaagttatcactctactatcagataaacgccacgagcccttgggtccgcgatctgtgtggtcagcgaaccactgacgcttgtgaacagctttgcgacccagagacaggtgagtgcagctgtcacgaaggttatgcacctgacccagtccatcgccatctctgcgtgcggtccgactgggggcagagcgaaggtccatggccatataccaccctcgagaggggttacgatttggtgacaggtgagcaagcccctgagaagatcctgtcattaggccagggcctctggttgcctgtgtcaaagagcttcgttgtgccccctgtagagctgtctatcaaccctttagcatcatgtaagactgacgtcctggtaactgaagacccagccgatgttagggaagaggcgatgttgtccacttatttcgagaccatcaatgacctcctctcaagctttggacccgtgcgcgactgcagtcgaaacaacgggggatgcactcgaaacttcaagtgcgtttccgatagacaagtggatagctcgggctgtgtatgcccagaggagctcaagcccatgaaagacgggtctggctgctatgaccattctaaagggatagactgcagtgatgggtttaacggaggctgtgagcaactgtgcctccagcagactctccctctgccctatgatgcaacgagtagcacaattttcatgttttgcggctgcgtggaagagtacaaactagctcctgatggaaaatcctgtctgatgctgagtgatgtctgcgagggacccaagtgcctgaagccagacagtaaatttaatgacacgcttttcggcgaaatgctccacggctataataatcgtactcagcacgtcaatcagggccaagtgttccagatgacctttcgggaaaacaacttcatcaaggactttcctcaacttgcggatggtctgctggtcattcccctaccggtagaagagcagtgtcgtggtgtactgagtgagccccttcccgacttacaactattaactggcgacatccgttatgatgaagcaatgggttatccaatggttcagcaatggagggtcagatctaatctatatagggtgaaattgagcaccatcactctggctgctggcttcacaaatgtcctgaagatcttgacaaaggagtctagccgtgaagaattgttgtcttttattcaacactatggaagccactatatcgcagaagccctctatgggtctgaactcacttgcattatccacttccccagtaaaaaagtgcagcagcagctatggctccagtaccagaaggaaaccactgagctggggagcaagaaagagttaaagtcaatgccttttatcacatacttaagcggtctgctcacggctcagatgctttccgatgaccaactgatctcaggagtggaaatcagatgtgaggagaaaggaagatgtcccagcacgtgccatctgtgtagacgacccggtaaggaacaactttcccctacccctgtcctactggaaatcaaccgcgtggtacccctctacacacttatccaagataatggaacaaaggaggctttcaaatctgctctaatgtcctcctattggtgtagcggcaaaggagatgttattgatgattggtgccgatgcgacctgagtgcattcgacgctaacggcctacccaattgtagtccgctcctacagcctgttttgcgtctcagccctacggtagaaccgtcttcaactgtcgtttccttggagtgggtggacgtccagccggctattggcaccaaagtgtcagattatattctgcagcacaaaaaggttgatgaatacactgacaccgacctgtacactggcgaatttctgtcattcgctgacgatctgctgtccggccttggtactagttgcgtggctgccggaaggtcacatggtgaggtccccgaggtcagcatttactctgtgatttttaaatgcctggagcccgacggcctctataagttcactctgtacgccgtcgatacccgaggacggcactccgaactgtctaccgtaacactgcgcaccgcctgtccccttgtggatgacaataaggccgaggaaatagccgacaagatctacaacttgtacaatgggtatacatcagggaaagagcagcaaatggcatataatacgctgatggaggttagtgcctccatgctgttcagggtgcagcaccattacaactctcattatgaaaaatttggcgattttgtgtggaggtccgaggacgagcttggccctaggaaagctcatctcatccttcgaaggttggagcgggtttcctcccattgttcgtcactgttgcgcagcgcctatatccagtcccgggtcgaaacagttccctatcttttttgccgcagtgaggaggtgagacccgctgggatggtttggtactccatcctgaaagacacaaaaatcacatgtgaggagaagatggtgagtatggctcggaacacctacggcgaatctaagggtaggtag

SEQ ID NO: 215007 - DNA, 297 bp, Artificial Sequence
  Description of Artificial Sequence: Synthetic coding sequence
tagatggcatacaatacgctcatggaggtgagtgcatccatgctcttcagagtccagcatcattataattctcactatgaaaagttcggagatttcgtgtggcgcagcgaagatgagcttggaccttcacttctagaaagctttatgtcactccaggatatcaatttgctagaacggagacctggtagaccccagaggcccggaaacccattatcaaacgtttcctggcgtatctcggagattgctccgacttcacacaccgacatgtctgcagggataaaggagactgcaagctag

SEQ ID NO: 215008 - DNA, 6827 bp, Artificial Sequence
  Description of Artificial Sequence: Synthetic coding sequence
atggccgcagagagaaggtgtggatccatgagggacctgcgtgcccaggtgacgtctggactactacccttccctgaggtgaccctacaggccctgggagaagacgagatcactctcgagtccgtgttgagggggaaattcgcagctggaaaaaatggcctagcatgcctcgcctgcggccctcaactcgaggtggttaactccattacaggggagcgcctgtctgcctatcggttttcaggcgtgaatgaacagccccctgtcgtgctggctgtgaaggagtttagttggcaaaagcggaccggactgctcatcggtttggaggagactgaagggtcagttctttgtctgtatgacctcggcatctccaaggtcgtaaaggccgtcgttctcccgggacgcgttacagctatcgaacctatcatcaatcatggcggagcctcagcaagtacacagcacctgcacccctctctgaggtggctctttggcgtggccgcagtggtgacagacgtgggccaaatcctccttgtggacctgtgtctggacgacctgtcgtgcaaccagaacgaggtcgaggcaagcgatctggaagtgttaaccggaatcccggcagaggtgccacacatccgggagagtgtaatgagacagggacgccacttatgcttccagctcgtgtcccctactggcaccgccgtgagcacactgtcatacatctcgcggaccaaccagcttgccgtaggcttctcagatggctatctagccctgtggaatatgaagtctatgaagcgagagtactacattcagctggagtctggtcaggttcctgtatacgctgtgaccttccaagaacctgagaacgacccacgcaactgctgctacttatgggcagtccagtccacgcaagatagtgaaggagacgtcctgtccctgcatttactgcagcttgccttcggaaacagaaagtgtctagcctccggccagattttatatgagggcctcgagtactgtgaagagcggtacacgttggatctgaccggcggaatgttccccctaagaggacagaccagcaacaccaaactcttgggctgtcagagcatcgagaaattcagaagccacggggaccgtgaggaaggagtaaatgaggctcttagtcctgacacatctgtgtccgtgttcacttggcaggtgaatatctatgggcagggtaagcccagcgtgtatctgggtttgttcgacatcaatagatggtaccacgcgcagatgcccgacagcctgagatcaggcgagtatctgcacaattgcagttattttgctctatggagtctggagtcggtagtctccagaacttctcctcacggtatactggatatacttgttcacgaacggtcactcaacaggggcgtaccaccatcctatcccccacccgagcagttctttaaccctagcacatataactttgacgcaacttgcctgcttaactctggggtggttcacctgacatgcactggtttccagaaagagaccctgactttccttaaaaagagcggccctagcttgaacgagctcatccctgacggttataacaggtgcctggtcgctgggctactatctccacgttttgtggacgtccagccctcaagtctgtcacaagaggagcagctcgaggccattctgagtgcagccattcagaccagctcgctgggcctgttgacagggtatattcgcagatggataactgaagagcagcctaatagcgccacgaaccttagatttgtgctggagtggacctggaacaaagtcgtgctgaccaaagaggagttcgaccggctctgtgtccccctctttgacggctcgtgccacttcatggatccacagaccatacaatctatccagcagtgttacctgttgctcagcaatctgaacatagtgctctcttgttttgcgtcggaagcgagggaaattacagagcgaggcctgatcgacctcagcaacaaatttgtggtcagccacttaatctgtcagtatgcacaggtggtgttgtggttctcacactctggcctccttcctgaaggtattgacgatagcgtgcagttgtctagactttgctataattatcctgttattcagaactactatacttcgagaaggcagaaattcgaacgtttatctcggggaaagtggaatccagactgtcttatgatcgacggcctggtgagccagctaggcgaacgcatcgagaaactgtggaagagggacgaaggcggaacgggtaagtatccacccgcatcgctacatgccgtactggacatgtacctgctggacggtgttaccgaggccgctaaacactccatcacaatatatttactgttagacataatgtatagctttcccaataaaaccgatacccctatcgaaagtttccccaccgtattcgcaatcagctggggacaggtgaagcttatacaggggttctggttgatagaccataatgactatgagtcgggactcgatcttttgttccatccagccactgctaaacccctcagctggcagcactctaagatcatacaagctttcatgagtcagggcgagcatcgccaggccctgaggtatatacagaccatgaaaccaacggtgagctcaggaaacgatgttattttgcacttgacagtcctgcttttcaaccgctgtatggtggaagcttggaacttcttaaggcagcactgtaatcgcttgaacatcgaggagctgctgaagcacatgtatgaagtgtgtcaagagatgggcctgatggaggatttgcttaagttgcccttcaccgatactgagcaggagtgcctggtcaaatttttgcagtccagcgccagtgtgcaaaatcacgagttccttctggtgcaccatctgcagagggccaattacgtccccgcacttaagctcaaccagacactcaaaatcaatgttatgaatgaccgagaccccaggctgagagaaaggtctttagcacggaattccatcctggaccagtacgggaaaatcctccccagagtgcatcggaagttggccatcgaaagagctaaaccctaccatctctccacctcttccgtgttcagacttgtctccaggcctaagcccctctccgctgtgcccaaacaagtggtaacagggaccgtcctgacccgcagtgtgtttatcaacaatgttctgagcaagattggagaagtatgggccagcaaggagcctattaactcaactacgcctttcaactccagcaaaatcgaggaacctagccccatagtatatagcctgcccgcaccagaactgcctgaagctttttttggcacaccgatttcaaaagcatctcaaaaaatcagcaggctgctggacctggttgtgcagcctgtgccgagacccagccagtgctctgagttcattcagcagtcctccatgaaatcccccctctatttggtgtcccgaagcttgccctcttctagtcaactgaagggatctccgcaggcaatcagccgtgccagtgagctccacttgctggaaacccctctagtggtgaagaaggcgaagtcactcgctatgagtgttacgacaagtgggttctcggaattcactccacaatcgatactgcgctcaactctgagatctacacccttggccagcccatccccgagtccagggaggtctccacagaggctaaaggagacaagaatcagctttgttgaagaagatgtgcatcctaagtggatcccaggggctgccgatgatagcaaactggaagtcttcactactcccaaaaaatgtgcagtgcctgtcgagacggaatggttgaagagtaaagatcgcacaactagcttcttcctgaatagcccagagaaagaacatcaggaaatggacgagggtagccaaagcctggagaagttagatgtgtctaaaggaaattcctccgtttccattactagcgatgaaaccacactggagtaccaggatgccccatctccagaagatcttgaagagaccgtgttcacagcctcaaagcccaagagctcttccacagctttgaccacgaatgtcaccgaacagaccgagaaagatggtgataaggacgtgtttgcttcagaagtcacgccttccgatctccagaaacagatggggaatctggaggatgccgagaccaaggatctgctggtggccgctgaggcgttcagtgagctcaaccacctgtcacccgtgcaaggaacagaggctagtctgtgcgcaccatccgtgtatgaggggaagatctttacccagaaaagtaaggtcccggtgttggatgaaggactcacgagtgtggaaacctatactccagcaattcgcgcaaacgacaataagtccatggcagacgtactcggcgatggcggtaatagcagtcttaccatttcggagggcccaatagttagcgagaggcgactgaatcaagaagtggcattgaacctaaaagaagaccatgaggtggaggttggcgttcttaaggagtcagtcgatctgcctgaggaaaaactgcccatttccgacagtccacccgacactcaagaaatccacgtgatcgaacaggagaaacttgaagcccaggactcaggtgaagaggccaggaacctctcttttaatgagttgtacccttctgggactcttaagctgcagtacaattttgacacaatcgaccagcagttctgtgacctcgccgataataaggatactgctgagtgcgacatcgcagaggtggatggggaactgtttgtggcgcagtctaatttcactctcattcttgagggggaggagggagaagtggagcccggtgactttgcctctagtgacgtgctcccgaaagccgcaaatacagcaacagaggaaaagttagtgtgcagtggagagaacgacaaccatggacagattgctaatctgcccagtgctgtcacatctgaccagaaaagccaaaaggtcgacacccttccatatgtcccagaacctattaaggtggctatcgcagaaaacctgctggatgttattaaagatacgagatccaaagagatcaccagcgacaccatggagcagagcattcatgagactatacctctcgtgtctcaaaatatcatgtgtcccaccaaactggttaagagtgctttcaagacagcccaagaaacttccaccatgaccatgaacgtctcacaggtggatgatgtggtatctagtaagaccaggacccgtggccagcggattcagaacgtaaacgtcaaatctgcgcagcaagaagccagcgccgatgtggctacacccaaaatgcctggacagagcgtgagaaaaaaaacaagaaaggccaaagagatcagtgaggcaagcgagaacatttactcggacgttcggggactgtctcagaatcagcagattccccaaaactctgtgaccccaaggcgaggcaggcgtaaaaaggaggtaaaccaggatatactcgaaaacacgtctagtgtggaacaagagctacagatcacaaccggtagggaatcaaagagacttaagtcatcccagctcctggagcctgctgtggaagagacaaccaaaaaagaggttaaagtaagtagcgtcactaaacggacccctcgcagaattaagagaagcgttgaaaaccaggaaagcgtggagatcattaatgacctgaaagtgtccactgtgacatctccgtcaagaatgatcagaaagcttaggtcaactaacctcgatgctagcgaaaacactgggaataagcaagacgataaaagcagtgacaagcaactccggattaaacacgttcgaagagtgaggggccgagaggtctcaccatctgacgtgcgggaggattctaatctcgaatcatcacagcttacagtccaagcggagttcgacatgagtgcgatcccacgaaagcgcggtcgccctaggaaaatcaatccctccgaggacgtgggatcaaaggccgtcaaagaggaacgcagcccaaagaaaaaggaagccccttcaatccggagacggtctacgcgcaacactcccgctaaatctgagaatgtcgatgtgggcaagcccgcacttggtaagagcatcctcgtgcccaatgaggagctgtccatggtaatgagtagcaaaaagaaactcacaaagaaaactgaaagtcagtcccagaagcggagcctgcatagtgtcagcgaggagcggactgacgaaatgacgcacaaagagactaacgagcaggaagaaagactgctagctaccgcctcattcactaaatcatccagatcaagcaggacccggagctctaaagcaatcctcctgccggatctgtccgagcctaacaatgaacctctgttctcccccgcatctgaggtgccacggaaggcaaaagctaaaaaaatcgaagttccagctcagctcaaggaactagtttctgacctgagttcacagtttgtgatcagtcccccagcgctccggtctaggcagaaaaatacctccaacaagaacaagctggaggacgagctgaaggacgacgcacaatcagttgagacactgggcaagccaaaggctaagcggataaggacctccaaaaccaagcaggcctctaagaatacagaaaaagagagcgcttggtctccaccccctatcgagatcagattgatttccccactggcttctcctgcagatggggtaaagtctaagcccagaaagactactgaggtgacgggtacggggctggggcgtaataggaagaagctttcctcttaccctaagcagattctgaggaggaagatgctgta

SEQ ID NO: 215009 - DNA, 6905 bp, Artificial Sequence
  Description of Artificial Sequence: Synthetic coding sequence
atggatagcttggcaggtttaagtccgcgtgaagccgcaggcgtactgagcctgtcgtgcgttggagtttgtagcacttgcgcatgggcctggccacacggttctatgcgagatctgcgggctcaagtcactagcggcttgctgccttttccggaggtcactcttcaggccttgggcgaggacgagattacactggagagcgtcctgcgtggcaaattcgctgccggaaagaatggattggcctgcctggcatgcggaccacagctcgaggtcgtgaatagcatcactggcgagagattgagtgcctaccgattttccggggttaacgaacagcctcccgtcgtactggccgttaaggagttttcatggcagaaaaggactgggctcctgatcggtctggaggagacggaggggtccgtgttgtgcttatacgaccttgggatttccaaagtcgtgaaggcggttgtgctgccgggacgcgtcaccgcgattgagcccataattaatcacggcggtgcctcggcctcgacgcagcatctacacccatccctgagatggctgtttggggtggctgctgtagtgactgacgtggggcaaatcctgctggtggacctctgtctggacgatctgtcctgtaatcagaacgaggttgaagcttctgatctggaggtgttgaccggtattcctgcagaagttcctcatattcgggagagcgtgatgaggcagggtcggcatctgtgttttcagctggtaagtcccaccggtactgctgtcagtacgctatcctatatctccaggacaaatcagctggccgtggggttcagcgatggttaccttgccttgtggaatatgaagagtatgaagagggagtactacatccagttagagtcaggacaagtacctgtgtacgcagtcacctttcaggagccggaaaatgatccccgaaactgctgctacctctgggctgtccagtctacccaggactccgaaggggatgttctcagtcttcacctcctccagctggcattcggtaatcgcaaatgcctggcatcgggacagatattgtacgaaggactcgagtattgtgaagagcggtacacactggacttaacaggaggtatgtttccgctgcgcggtcagactagcaacacgaaacttttgggctgccagtctatcgagaaatttagatctcatggagacagggaggagggcgtcaatgaagcgctttctcccgatactagcgtgagtgtgtttacctggcaagtgaacatttacggacagggtaaaccatctgtctatttggggttattcgacatcaaccggtggtaccatgctcagatgcctgattccctgcggtcaggcgagtacctacacaattgttcttatttcgccctgtggtcacttgagtcagttgtgagcaggacgtctccccacggtatcctcgacatcctggtgcatgagaggagtctcaatcgtggcgtaccgcctagttatcccccacctgaacagtttttcaatccatccacctacaatttcgatgccacatgtctgctgaatagcggagtggttcaccttacatgcactgggtttcagaaggaaacactgacgtttttaaagaagagtggcccttccttgaacgagcttattcccgacgggtacaaccggtgcctcgtggcaggtctcctgtccccccgattcgttgacgtgcagccaagtagcctgtcacaggaggagcagttagaggctatactgtccgccgcaattcagacatcaagtctcggcttactgactgggtatattcggagatggattacagaggagcaaccaaacagcgcgaccaatctgagattcgtcctggaatggacttggaataaggttgtgttgacgaaggaggagtttgatagactgtgcgtccctctgttcgatgggtcatgtcattttatggatccacagaccattcaatcaatccagcagtgctatctgttgctctcgaatttgaatatagtgctgtcttgtttcgcctccgaagcacgggagattacagagcgcggactgatcgacttatctaacaagtttgtagtctcccatctcatctgccagtacgctcaggtggttctgtggtttagccactcgggcctgctacctgaaggtatcgatgattctgtgcagctctcgcgtctctgctacaactacccggtgatccagaattattacactagccgtagacagaagttcgaacgactctctcgcggaaaatggaatccggactgcttgatgatcgatgggttagttagccaacttggagagcgtattgagaaattatggaagcgcgatgaaggcggtacggggaaatacccacctgcgtcactgcacgctgtcctggatatgtacctgctcgatggagttactgaagctgccaaacactcaataaccatttacctgttgcttgatatcatgtatagctttcctaacaaaacagacacacccatagagtctttcccaacagtgtttgcaatctcatgggggcaggtgaaactgattcaggggttctggctcatagaccacaacgactacgaaagcggcttggacctcctctttcatcctgccactgctaagcccctctcttggcagcatagcaaaatcatccaagccttcatgtcgcagggagagcatcggcaggcacttaggtacatccagacaatgaaacccacagtgtcaagtggcaatgacgtgatcttacacctgacggtgctgctgtttaatcggtgcatggtggaggcatggaattttttgcgtcaacattgcaacaggctcaacattgaggagctccttaagcatatgtatgaagtgtgccaggaaatgggcctgatggaggatctcctcaaactgccctttacagacacagagcaggagtgcctggttaagtttctgcaatccagcgcctcggtacaaaatcacgaatttctgctggtgcaccatcttcagcgagcaaattatgttcctgcgctaaagctcaatcagaccttaaaaattaatgttatgaacgatagagatcccaggttacgcgagcgaagcttagcacggaactccatcttggatcagtacggcaagattctcccccgagtccaccggaaactcgccatcgaacgagcaaagccctaccatttgtccaccagcagtgtgttcaggttagtatctaggccgaagccccttagtgccgttccgaaacaggtagtgacaggtacggtgctgaccagatccgtgttcattaacaacgtcctgagtaagatcggggaggtgtgggcatctaaggagccaatcaatagcaccactcccttcaattcttctaagatcgaagagccttcaccaattgtgtattctcttccagctcctgagctgccggaagcattcttcggaacgccaataagtaaggcatcacagaagatcagcagactcctagacctcgttgtgcagccagtccccaggccatcccagtgttccgagttcatccagcagtcttctatgaaatctccactgtatctggtctcacgaagcctgcccagcagctctcaacttaaagggtccccccaggccatttcccgggcttccgagctgcacctgttggagacaccgttggtcgtgaagaaggccaagagcctggcaatgagcgtaacaacctcagggttcagcgagtttactccccaatctatactgcggagcacgctaagaagcactcctctcgctagcccctccccaagtcctggcagatcgccgcagagattaaaagaaacgcgaatctcttttgtagaggaagacgtgcaccctaaatggataccgggtgccgctgatgattccaagctggaggttttcacgacacctaaaaaatgcgcagtgcccgttgagaccgagtggctgaagtcaaaggaccgcacaacctcttttttcctgaatagcccagaaaaagaacatcaggaaatggatgaagggtctcagagcctggagaagttagacgtatcgaagggtaactcgagcgtgtctatcacctccgacgaaaccacactggagtaccaggacgccccatcacctgaagacttagaggaaactgttttcaccgcaagcaagcccaaatcttcatccacagctctgacaaccaacgtgaccgaacagacagagaaagacggagataaggacgtttttgcttcggaggtgacaccgagtgatctgcagaaacaaatgggtaacctggaggatgcggagactaaggatcttcttgtagcagcggaggctttctccgaattaaatcacctaagccctgtgcaggggactgaagcatctctgtgcgcaccatcagtgtacgaggggaagatcttcactcagaaaagcaaagtgccggtgctagatgagggtctgactagtgtagagacatatacgcccgctatccgggctaacgataataaatccatggcggacgtactgggggatgggggaaacagcagcctgaccatttcagaagggccaatagtttccgaacgtagacttaaccaggaagtggctctcaatctgaaagaagatcatgaggtggaagtaggcgttctgaaagaatctgtcgacctgcctgaagaaaaactgcccatttctgacagcccacccgacacacaggagatccacgtgattgagcaagagaagctggaggctcaggattctggagaggaggcccgtaatctgtccttcaatgagctgtacccatccgggacactaaagctacagtacaactttgacacgattgaccagcaattctgcgacctggccgataataaagataccgctgaatgcgatatcgccgaggtcgacggggaacttttcgtggcccagtcaaactttacactcatacttgagggcgaggagggcgaggtggaacccggagatttcgcctcatcggacgtcttgcctaaggcggctaataccgcgaccgaggaaaaactcgtgtgtagcggtgagaatgacaaccacggccagattgcaaatctgccttctgcggtaacttcggatcagaaatcacagaaggtcgacaccctcccctatgtgccagaacccattaaggtggctattgcggaaaatctgcttgatgtgatcaaagacacaagatctaaagaaattacctcagataccatggagcagagcattcacgaaaccatcccactcgtatctcaaaatattatgtgccccacgaagctggtgaaatctgcctttaagaccgctcaagagacatccaccatgactatgaacgtgtctcaagtggacgatgtcgtgtccagcaagactagaacccggggacagcgcatccagaatgtgaacgtgaaatcagcacaacaggaagcctctgccgacgtagccacccccaagatgcccggacagtcagtgcgcaaaaaaacacggaaggctaaagaaatatccgaggctagtgagaatatttacagtgacgttaggggcctctcacagaaccagcagatcccgcaaaacagtgtgaccccaaggaggggcaggcgaaagaaggaggtgaatcaggacattctggagaatactagctcggtcgagcaggaattacaaattacaacaggcagggagagtaaacggttaaaaagctcccagctgctggaaccggctgttgaggaaactaccaaaaaagaggtgaaggtgagttcagtcacgaagcgtactccaaggcggatcaaaaggtctgtggagaaccaggaatctgtggagatcattaacgacctgaaagtctctacagtgaccagccccagccgcatgatccggaaactccgctcaaccaatttagacgcatccgagaataccggtaataaacaggatgacaaatcttccgacaagcagctacgcatcaagcacgtccgtcgagtcagaggcagggaagtgagcccatctgatgttagagaggactctaatctagagtcaagtcagcttactgtgcaggcagaattcgatatgtcagcaatccctcgcaaaaggggcagaccacgtaagatcaacccctccgaagacgttggtagcaaggccgtaaaagaggaacggtccccgaagaagaaggaagccccaagcattaggcgacggtctactcgcaacaccccggctaaatcggagaatgtcgacgtgggaaaacccgctctcgggaaatccatactagttcccaatgaagaactgagtatggttatgtctagtaaaaagaagctgaccaagaaaactgagtcacaaagtcagaaaaggtccctgcacagtgtgtcagaggaaagaactgatgagatgacccacaaggaaacaaacgagcaagaagagaggctgctcgccactgcctcttttacaaaatcttcaagatcttcccgtactcggtcttccaaggcaatcttacttcccgatttgagtgagccaaacaacgagcctctgttctcccccgcttccgaagttccccgaaaggccaaagcgaaaaaaattgaggtccctgcccagctgaaggagctggtgtctgatctcagctctcagtttgtaatctctccaccggctttgcgatcaaggcagaagaacacctccaataaaaacaagctggaagatgaactgaaagatgatgcgcagagcgtcgaaacgctgggaaagcccaaagcaaaacgcatcaggacttcaaagacaaaacaggctagcaagaacacagaaaaagaaagtgcgtggagccctcctccaatagagataagactaatctcaccactcgcctcccccgctgatggtgtgaagtctaaaccaaggaaaaccaccgaagtgaccgggaccggactagggaggaacagaaaaaaactttcaagctaccctaagcagatccttcgcagaaagatgctcta

SEQ ID NO: 215010 - DNA, 6800 bp, Artificial Sequence
  Description of Artificial Sequence: Synthetic coding sequence
atgagggacctgagggctcaagtaacctcaggcttgctgccatttcccgaagttacacttcaagctttaggggaggatgagattaccctggaatccgtgctaaggggaaagttcgctgcagggaagaacggactggcctgcctcgcatgcggccctcaactagaggttgtgaactccatcactggtgaaaggctgagtgcctacaggttttccggagtgaacgagcagccaccggtcgttcttgctgttaaggagttttcatggcagaaacggacaggtctgctgattggcctggaagagactgagggctccgtgctgtgtctttacgaccttgggattagcaaagtggttaaagccgtggtactgccagggcgtgtgaccgccattgagcctattattaatcacggcggagcatctgcgtccacccaacacttgcatccttcactgagatggctgttcggtgttgccgcagtggtcacggacgttggccagatcttactggtggacttgtgcttagatgaccttagctgtaatcaaaatgaagttgaggctagcgacctcgaagtcctcaccggcatccccgctgaagtacctcatattcgagagagcgtaatgagacaggggcgacatctctgcttccagcttgtgtcacctacgggcaccgcggtttctactctctcctacatctcaaggacgaaccaattagccgtgggctttagcgacggatatctcgctctgtggaacatgaaatcaatgaaaagagaatattacattcagctggagagcggccaggtacctgtatacgccgtgacgtttcaggagcccgagaacgatccacgcaactgttgttatctatgggccgttcagagcacccaggacagcgaaggcgatgtgctgtctttgcacctgcttcagcttgctttcggcaaccgtaagtgcctcgcctctggccagatcctgtatgaaggcctcgaatactgtgaggaacggtatactttggatttgactggcggaatgttcccactccggggacagacttccaacaccaaacttctgggctgccagtccatcgagaaattcaggtcccatggagatagagaggaaggagtgaacgaagcattgtcccccgacacaagcgtgtcggtattcacttggcaggtgaacatctatgggcagggaaaacctagcgtttacctgggtctcttcgatatcaacaggtggtatcatgcccagatgcctgacagtttgcggtcaggagagtacctccacaattgctcctactttgcgctctggtccctcgaaagcgtcgtatcacggaccagcccccatggaatattagatatactcgtccatgaacgctcattgaatcgaggggtaccccctagttaccccccacccgagcaattcttcaatccatctacatataattttgacgctacctgtttgttgaattctggggtagtgcatctgacatgcaccggatttcagaaggagactttaacttttttgaaaaagtcaggaccttcgctcaacgagctcatccccgatggttacaacagatgcttagtggccggtttgctgagccctcgatttgtcgacgtacagccaagctcccttagtcaggaagagcagctggaagctattctcagcgctgctatccagacaagcagcctcggacttttaacgggctacatcaggagatggattaccgaggagcagcctaactcagctacaaacctaaggtttgttctggagtggacttggaacaaggtggttcttaccaaggaagaattcgataggctctgtgtcccgctctttgatggatcttgtcacttcatggaccctcagactatccagtcgatccaacagtgttatctattactgtccaatttaaacatagtattgagttgttttgccagcgaagctcgcgagatcaccgagcgcggactcatcgatctttctaataaattcgtggtgagtcatctgatttgtcagtacgcccaagtcgtgctatggttctctcactccggcttgctgccagaaggcatcgatgactctgtgcaactgtcaaggctctgctacaattaccccgtgattcagaattactatacatctagacgacagaagttcgagagattgtctcggggtaaatggaatccagattgcctcatgatcgacggactggtcagtcagcttggggagcgaattgagaaactctggaagagggatgaggggggaacaggcaaatacccacctgcttccttgcacgctgtactggatatgtacctgctggacggcgttacagaagccgcaaaacactctattaccatttatctcttactcgacatcatgtacagtttcccaaataagaccgatacgcccatcgaatcttttcctactgtatttgccatctcctgggggcaggtaaagctcatccagggattctggttaatcgaccacaacgattacgaaagtggcctcgatctcctcttccaccctgctaccgccaaacccctatcctggcaacattcaaagatcatccaggcatttatgagccagggcgagcaccgccaggcactgcgctacatccagacgatgaagcctaccgttagttcaggaaatgacgtcatcctgcatctcaccgtactgctctttaatagatgcatggttgaggcgtggaactttttgagacagcactgcaatagactgaacatcgaggagctgcttaagcacatgtatgaggtgtgtcaagagatgggtctgatggaggacctgctcaagctccccttcactgatacggagcaggagtgtctcgttaagtttctgcagtctagcgcctctgtgcaaaatcatgaattcttacttgttcaccacctgcaacgcgctaactacgtgcctgctttaaagctgaaccagactttgaagataaatgtgatgaacgaccgggaccccaggttacgagagcgcagcctcgcacgtaactctatcttagatcagtacggtaaaatcctgcctagggtgcacaggaaactggccatcgagcgtgctaaaccttaccacctctctacctcttccgtgttccggctcgtgagccgccctaagcccctttctgctgtgccaaaacaggtggtcacggggactgtcttgacccggtcagtctttatcaacaatgtcttatccaagataggagaagtctgggcttccaaggagcccattaattccaccaccccttttaacagctccaagattgaagagccatccccaattgtgtactccctgccagctcctgagcttccagaggccttctttggaacccctataagcaaagccagccagaagattagcagattacttgacctggtggtacaacctgtcccaagaccttcccagtgctctgaatttatccagcagtcgagcatgaaaagccctctgtacctcgtgagccggagcttaccttcatcctcccagctcaaaggctcccctcaggctatcagcagggccagcgagctgcatctcctggagacccccctggtcgtgaaaaaagcaaaatcactcgccatgagtgtaacaacttctggctttagcgagtttacaccccagtctatcctgaggtctacactgcgaagcacccccctggcttctcctagccctagcccaggaagatccccccagcggctgaaagagactcgaatttccttcgtggaggaagacgttcatccaaagtggattccaggcgcagctgacgattcgaaactggaggtgttcactaccccaaaaaaatgcgccgtccccgtcgagacagagtggctgaagagcaaagatcgcacgacttcatttttcctaaacagcccggaaaaggaacaccaggagatggacgaggggtcgcagtctttagagaagcttgacgtgagcaagggcaatagctcggtcagtattacgtctgatgagaccactctggagtatcaggacgcaccttcaccggaggatctggaggaaaccgtattcactgctagtaaaccgaagtcttcatccacagcacttactacaaacgttaccgagcagaccgagaaagatggggataaggacgtgttcgcctccgaggttactccctccgacctgcaaaagcaaatggggaacctagaagacgctgagactaaggatctgttagtagcagcagaggctttttccgagctgaatcatttgtcaccagtccaagggactgaggcatccctatgtgcaccttccgtttatgaaggaaagatcttcactcaaaaatcaaaggttcctgtactcgatgaaggactaacaagcgtcgaaacctatacgcctgctattcgtgccaatgataacaaatccatggccgacgtcttgggcgacggtgggaatagtagtttaaccattagtgagggtcctattgtttccgaacgaagactgaaccaggaagtagcactcaatcttaaggaggatcatgaggtcgaagtgggggtgctgaaagaatccgtggacctgcctgaggagaagctcccaatctccgatagtccacccgatacccaggagatacatgtcattgagcaggaaaaactggaggctcaggattctggggaagaggcgaggaatctctcctttaacgagctgtacccctcgggtacactcaaattacagtacaacttcgacacaattgatcaacaattctgcgacctggccgacaataaagacactgccgagtgtgatatcgctgaagtggacggagaactgtttgtggcccaatctaactttaccctgatcctggagggcgaagagggagaggttgagccgggagatttcgcttcctctgacgtgctgccgaaagccgcaaatacggccacagaggagaagttggtgtgcagcggcgagaacgataatcacgggcaaattgcgaatctccccagcgcagtgacgtccgaccaaaagtcacagaaggttgataccttgccatacgttcctgagcccatcaaagtagccatcgctgaaaacctcctggatgtgattaaagatactagatcaaaggaaattacaagcgatacaatggagcagtcgatccacgagacgatccccctggtctcgcagaacatcatgtgtccgaccaaacttgtaaaaagcgcttttaaaaccgcccaagagacatctacaatgacgatgaatgttagccaggttgacgatgtggtgagctcgaagacacggaccaggggacagagaatccagaacgtgaacgtcaagagcgctcagcaggaagccagtgccgatgtggctaccccgaaaatgccagggcagagcgtgcgaaagaagacacgcaaagcgaaggaaatctcggaagcgagcgagaacatatatagcgacgtgcgcggtctgtcccagaatcaacagataccgcagaactctgtcacgcctagaagaggcaggaggaagaaggaggtgaatcaggatatattggaaaacacgagttcggtcgagcaggagctgcagatcacgacaggacgcgagtccaaacggctcaagagttcacagttgctggaacccgctgtggaggagaccaccaaaaaagaagttaaagtgagttccgtgacgaaaagaactcccagaaggatcaaacgtagcgttgaaaatcaggaaagcgtagagataatcaacgatctgaaggtgtctaccgtgacatcaccatcacgaatgattagaaaactacgcagtaccaatctggacgcgtccgagaacactgggaataagcaggacgataagtcctcggataaacagcttaggatcaagcacgtaaggcgggtgaggggacgcgaagtgagtccctctgatgtcagggaggatagcaacctagagagtagccagctgactgtccaggccgagtttgacatgtctgctataccacggaagagagggcgacctaggaaaattaatccttcagaggacgtggggtcaaaagcggtcaaggaggaacgatcaccaaagaagaaggaggcgccatcaattcgcagacgtagcacgcgcaatacacccgctaaatccgaaaatgtcgatgtgggaaagcctgcccttggaaagtctatcctggtacccaatgaagagctgagcatggtgatgagtagcaagaagaaattgacgaaaaaaaccgaatcgcagtctcagaaaagaagtctgcattcagtgagtgaggaacggactgatgaaatgacccacaaggagacaaacgaacaggaggagcgattgctggccacagcctcatttaccaagagttcgcggtcctcacgcacacgctccagtaaggctattctcctgcccgatttgagtgaaccaaataacgagcctttgttcagccctgcctcagaggtccccaggaaagcaaaggccaagaaaattgaagtgcctgcccagctgaaggagcttgtcagcgacctgagtagccaattcgtgatctcaccacccgcacttaggtcgcggcagaagaacacttccaataaaaataagctggaggacgagctcaaggatgacgctcagtccgtggaaacgctcggaaagccaaaggctaagcggatccgaacctccaagactaaacaagcttcaaagaatactgagaaggaaagcgcctggtccccgcctcccatcgagatcaggctgatttcgccccttgcatcacccgctgatggagtgaagtccaagcctcgcaagaccaccgaagtaaccgggactggactgggacgcaaccggaaaaagttgtcaagctatccaaagcaaatactaagaagaaagatgctgta

SEQ ID NO: 215011 - DNA, 3567 bp, Artificial Sequence
  Description of Artificial Sequence: Synthetic coding sequence
atgaaagcagccgatgaaccagcgtacctgaccgtgggcactgatgttagcgctaaataccgtggggcattttgcgaggctaaaattaagacagttaagagattagtgaaagtgaaggtactcctgaaacaggacaataccacccagctggtccaagatgatcaggtgaagggtccgttgagagtgggggctattgtggaaacgcgtacctcagatggaagtttccaggaggcaattattagtaagttgaccgatgcttcctggtacacagtcgtctttgatgatggtgacgagcgtacgctgcgccgtacctcgctctgccttaaaggtgaaaggcattttgcggaaagtgaaactcttgaccagctccctctaaccaatcctgagcatttcgggacgccagtgatcgctaagaaaacgaatcgaggtcggcgatcttcattgcctgtcacagaggacgaaaaggaggaggaaagtagcgaggaagaggacgaggacaaacgacggctaaacgacgaactgcttggcaaggtggtgagcgtggtgagcgcaacggagaggaccgagtggtatccagcgctggtaatctctccgtcctgtaatgatgatattaccgtgaaaaaggatcagtgtctcgttagatcgtttattgactccaaattttactcaatcgctagaaaggacattaaggaggttgacatcttgaatctgccagagtccgagctgagcacaaagcccggactccagaaggcctcgattttcctgaaaactagggttgtgccggacaattggaagatggatatctctgagatactggagtcttcatccagtgacgacgaggacgggcctgcagaagagaacgatgaggagaaggaaaaagaagctaagaagactgaggaggaagtgccagaggaggaactcgatccggaggaaagggataattttctgcagcagttatacaagtttatggaggacaggggcactccaatcaataaaccgcctgtactggggtacaaagatttgaacctgttcaagctctttagactcgtttaccaccaaggtgggtgcgacaatatcgacagcggcgctgtatggaaacaaatctacatggatcttggaattcccattctgaacagcgcggcatcgtacaacgtgaagaccgcatataggaagtacctctacggctttgaagagtactgccgttccgcaaacatccagttccgtacagttcatcaccacgagcccaaagtgaaagaggagaagaaagaccttgaggagtccatggaggaagctctcaaactcgaccaggagatgcccttgactgaagtcaagagcgagccagaggagaatatcgactcgaactctgagtcggagcgtgaagaaatcgagctgaagtcccccagggggcgtagacgaatcgccagagatgtgaactctattaagaaagagattgaggaagaaaagactgaggataagttaaaggataatgatacagagaacaaggatgtagatgatgactatgagacagccgagaagaaggagaatgagctgctcctgggacgaaagaacacccctaaacagaaggagaagaagataaagaagcaagaggacagcgataaggacagtgacgaggaggaggagaaatctcaggaacgagaagagaccgagtcaaagtgcgattccgagggggaggaggatgaagaggatatggaaccttgcttaacgggtacgaaggtgaaggtgaaatacggtaggggaaagactcaaaagatttatgaggcttcaattaaatccactgagatcgacgatggagaggtattgtatttagtgcactattacggttggaacgtgaggtatgatgaatgggtcaaagctgaccggattatctggcccctggataaaggcggacccaagaagaagcaaaagaagaaagccaagaacaaggaggattccgagaaggacgagaagcgggacgaggagcgtcagaaaagcaagcgtggtcggcctcctcttaagagtactctgtccagcaacatgccctatggtttgtcaaagacagcaaatagtgagggaaaatcagactcatgctcaagtgatagcgagactgaggacgcgttggaaaagaacctcattaacgaggaactctccctgaaagacgaattagaaaagaatgagaaccttaatgacgataagctcgacgaggaaaaccccaaaattagtgcccacattttaaaagaaaatgacaggacccagatgcagcctttggaaactttgaaactggaagttggtgagaatgaacagatcgtgcagattttcggtaataagatggagaaaacggaggaagtgaaaaaggaagcagagaaatcccccaaaggcaaaggcagaagaagcaaaaccaaagacctctcccttgaaataattaaaatcagttccttcggccagaatgaggccggttctgagcctcatatcgaggcgcactccctcgagctaagtagtctggacaacaagaactttagtagcgcaacagaagatgagatagaccaatgcgtaaaggagaagaagctcaagcggaagatccttgggcagtcatctcccgagaagaagatccggatcgagaacggtatggaaatgacaaacacagtgagtcaggagcgaacctctgattgcatcggctcagagggaatgaagaatctgaatttcgagcagcacttcgaacgtgaaaacgagggcatgcctagtctcatcgcagagtccaaccagtgtatacagcaattaacatccgaaagattcgattcaccggcagaagagaccgtgaacatacccctcaaggaagacgaagacgctatgcccctaatcggaccggagaccttggtgtgccatgaggtggacctggacgatttggatgagaaggataagacttctattgaagacgttgcagtggagtcatccgagtccaactcactcgtttccatcccacctgccctccccccagttgtccaacacaacttctctgtggcttcacctctcacactgtcccaagacgagagccggagcgtgaagagtgaaagtgacattacaatcgaagtcgattctattgccgaggagagccaggagggcttgtgtgagcgggagtccgctaatggttttgagaccaacgtcgcctcaggaacgtgtagcatcattgttcaggagagggagtcccgcgaaaagggacagaaacgtcctagtgacggcaattccggccttatggctaaaaagcaaaagaggactccaaaacgtacatctgccgctgccaaaaacgaaaagaatgggactgacgaattggataacatgaatagcacggagcggatttcatttctgcaagaaaagctgcaggagatcaggaaatattacatgtccctcaagagtgaagtggcgactatcgatcggcgtagaaaacgactgaagaagaaagaccgggaagtgtcccacgcaggagcttctatgagtagcgcttccagcgatacggggatgtctccaagtagctcaagtccacctcagaatgtactggccgtcgaatgtcggtag

SEQ ID NO: 215012 - DNA, 3774 bp, Artificial Sequence
  Description of Artificial Sequence: Synthetic coding sequence
atgaaagccgctgacgagccagcatacctgaccgtgggcaccgatgtttccgctaagtaccggggagccttctgtgaagcaaagattaaaaccgtgaaacgcttagttaaagtgaaagtgctactcaaacaagacaatacgactcagttggttcaggatgatcaggtgaagggaccattgagggttggggcaatcgtggaaacaagaacctcggatggatccttccaggaagctattatcagcaagctgaccgatgcatcctggtacactgtagtgttcgacgacggggatgagaggaccttacgcaggaccagtctttgcctgaagggggaacgacatttcgccgaatccgagaccctggaccagcttccacttactaacccggagcactttggcacccctgtgatcgcaaagaaaaccaacaggggacggaggagctcactcccggttaccgaagatgaaaaggaagaagagagcagtgaggaggaggacgaggacaaaaggagattgaatgacgagcttctcggaaaggtggtcagcgtcgtaagtgccaccgagcgcaccgagtggtaccctgctctagtgatttcccctagctgcaacgacgatataaccgtaaaaaaagaccagtgtttggttaggtcctttatagactctaagttttactcaatcgcccgtaaggacatcaaggaggttgatatcctgaaccttcccgagtccgaattgtcaaccaaacctggcctacagaaggcctccatattcctaaagactagggtggtccctgataactggaaaatggacatttccgaaatcctagaatcctcaagctcagacgatgaggatggcccagctgaagagaatgacgaagagaaggaaaaggaagccaagaaaacagaggaagaggttcccgaagaggaactggacccggaagagcgggacaattttctgcagcaactgtacaagtttatggaggacagaggaacacctatcaacaaaccacctgtgctgggctacaaagacctgaacctgttcaaacttttcaggttagtctaccaccagggaggctgcgacaacattgacagcggtgctgtgtggaaacagatttacatggaccttgggattcctatcctaaactcagccgcttcttacaatgtcaagactgcgtaccgaaagtatctgtatggcttcgaagaatactgcagatccgcaaatatccaatttagaactgtccatcatcacgaacctaaagtcaaagaggaaaaaaaggaccttgaggaatcaatggaggaggccttaaaacttgatcaggaaatgccactgacagaagtgaagtcagaaccagaggaaaacatcgatagcaatagcgagagcgaacgcgaggaaatcgagctcaagtcccctcgaggccgtcgccgtattgccagagacgtgaactcaattaaaaaagagatagaagaggagaagaccgaagacaagctgaaagataatgacacagagaataaggatgtcgatgacgattatgaaactgccgagaagaaggaaaatgaactgcttctggggagaaaaaatactccaaaacagaaggagaagaagataaagaagcaggaggatagcgacaaagacagcgacgaggaggaagaaaaaagccaggagcgggaagaaaccgaatcaaaatgtgactcagagggggaagaggacgaggaggacatggaaccatgcctaactggcaccaaagtaaaggtgaagtacgggagaggtaaaacccagaaaatctatgaggcttctatcaaatcaacagagatcgacgatggagaggtgctatatctggtgcactactacggctggaacgtgagatacgatgagtgggtaaaggccgatcggataatttggcctcttgataaaggcggacctaagaagaagcagaagaaaaaggcaaaaaacaaagaagactccgagaaggacgaaaagcgcgacgaagagcgccagaaaagtaaaaggggtagacctccacttaagagcacactgtccagtaatatgccttacggattgtccaagacagccaattctgagggcaaatctgattcctgctctagcgattcagagaccgaggatgctttggaaaagaatttaattaatgaggaattgagcctgaaagacgaactcgagaaaaatgagaatctgaacgacgacaaactggatgaggagaatcccaaaatctcagctcacatcctgaaggaaaacgatagaactcagatgcaacccctcgagacactcaaactggaggtgggcgagaacgaacagatcgtgcagattttcggcaataagatggagaaaaccgaggaggtgaaaaaggaggccgaaaaaagcccgaaggggaaggggcgtaggtccaagactaaagaccttagcctcgaaatcatcaaaatcagcagtttcggccagaacgaagccggatcagagcctcatattgaagctcactcactagagctgagtagcctcgataataagaatttttcttccgcaacggaggatgaaatcgaccagtgtgtgaaggagaagaagctcaagaggaaaattctgggtcagagttctccagaaaaaaagattaggattgagaatggcatggagatgaccaatacagtatcccaggagcggacatctgattgtatcgggtcggaaggcatgaagaacctcaactttgagcagcactttgaaagagagaatgagggaatgcccagtctgatcgccgagtctaaccagtgtattcaacagctcacatctgagcggtttgatagcccagcagaggagaccgtcaatattccactgaaagaagacgaggacgcgatgcctctgattggccctgagacgctcgtttgccatgaggtagacctcgacgacctagacgagaaagataagacatccattgaggatgttgccgttgagtctagcgaatctaactctctcgtctcaatacccccagctctgccgccagtggtacagcacaatttttctgtggcgagccctcttactctgagtcaggacgagtccaggtctgtaaagagtgagagcgatatcactattgaggttgactccattgccgaagaaagccaggagggcctttgcgaacgcgaatccgcgaacggattcgaaacgaacgtcgcatcagggacttgttctatcatcgtgcaggagcgtgaatcgcgcgagaagggtcagaagagaccatccgatggcaattcaggcctgatggctaagaaacagaagcgaaccccgaagaggacgagcgctgcagccaaaaacgagaaaaacgggaccggtcaatcatcagacagcgaggaccttccagtgctggataattcttctaaatgcacacctgtcaaacatctcaatgtgagcaagccgcagaaactcgctcgctcacccgcaaggatatcgccacacatcaaagatggagaaaaagacaaacacagagagaaacaccccaactcctcacctagaacttataagtggtcttttcagctgaacgagcttgacaatatgaacagcacggaacgtatcagctttctgcaggagaaactgcaggagatacgaaaatattatatgtccctgaagtcggaagtggctaccattgacagaaggcggaagaggttgaagaagaaggatagagaggtgagccacgcaggggcaagcatgtcatcagcttcatcggataccggaatgagtccctccagttcctctccccctcagaacgtcctggcagttgagtgtcgatag

SEQ ID NO: 215013 - DNA, 3612 bp, Artificial Sequence
  Description of Artificial Sequence: Synthetic coding sequence
atgaaggccgctgatgaacctgcttacctaactgtcggcacagatgtgtccgctaaatacagaggcgcattctgtgaagccaagatcaaaaccgtgaaaaggctggtgaaagtgaaagtcctgctgaaacaggataatacaacgcagctggtgcaagacgaccaggtgaagggccctctccgagtgggcgctatcgttgaaacccgcacatctgatggctcctttcaggaggctatcattagtaagctgacagacgcatcctggtacactgtggttttcgatgatggggatgaacggacattgcggcgtacatccctgtgcctaaagggcgaacggcacttcgccgagtcggagaccctggatcagcttcctctgaccaaccccgagcacttcggaacccccgtgatcgctaagaagactaatcgcggacggagaagctcgctccccgttaccgaagacgagaaagaggaagagagcagcgaagaagaagatgaggacaagcgtagactcaatgacgaattactcggcaaggtggtctccgtggtgagcgctactgagcggaccgagtggtaccccgcactcgtgatatctccctcctgtaacgacgatataactgtcaaaaaagatcaatgcctggtccggtcctttatcgatagcaagttctatagtatagccaggaaggatatcaaagaagtagatattttaaacctgccagagtcggagttatccaccaagcccggactacagaaagcatcgatttttcttaaaacccgtgtagttccagacaactggaagatggacatttctgaaatactggagagtagctccagcgacgacgaggacggacccgctgaggagaacgatgaagagaaggaaaaagaggctaaaaagaccgaagaggaggtgccggaggaggagttggacccagaggagagggacaatttcctgcaacaactctataaattcatggaggaccgtggcacaccaattaacaagccgccagtgctcggctataaggacctcaacctcttcaaactattccgcctggtttatcaccagggaggctgcgataatatcgatagtggagctgtctggaagcagatttacatggatttgggcatccctattctcaattcggccgcatcatacaacgtgaagaccgcgtaccggaaatacctgtacggttttgaagagtactgcagaagcgccaatatccagtttaggactgttcaccaccacgagccaaaggtcaaggaggaaaaaaaagaccttgaagaatcaatggaagaagcactcaaattagaccaggagatgccattaaccgaggtgaagtctgagcctgaagagaatattgactcaaactccgaaagcgagcgggaggagattgagttgaagtcaccaaggggaaggagacggatcgcaagggacgtgaatagcattaagaaagagattgaggaagagaagacagaagataaactgaaggataacgataccgagaataaagacgtggatgacgattatgagaccgcagagaaaaaggagaatgaactgctgttagggagaaaaaatacacctaaacagaaggagaagaaaattaaaaagcaggaggacagcgacaaagattccgatgaggaggaagaaaagtctcaggagcgggaggaaaccgagagcaagtgtgatagtgaaggggaggaagatgaagaggacatggagccttgcctgacaggcacgaaggtcaaagtgaagtacggaagagggaagactcagaagatttacgaagcctccatcaaatccaccgaaatcgatgatggggaggtgctttacttggtgcactattacggatggaatgtacgttacgatgaatgggtaaaagcagatcgcatcatctggcctctggataaggggggtcctaagaagaagcaaaagaagaaagcaaaaaataaagaagattctgagaaggatgaaaagagagacgaggaacgccaaaagagtaaaagaggtcgccctcctctcaagtccacgttatcttcgaacatgccgtatggcctcagtaagaccgcaaactctgagggtaagagcgattcatgtagttccgattccgaaacggaggacgccctggagaagaaccttataaatgaggagctctccctcaaagatgaattggagaaaaacgagaacctcaacgacgacaaactcgacgaggaaaaccccaaaatctccgcccatattcttaaggaaaatgaccgcacccagatgcagccccttgagaccctgaaattagaagtgggcgagaatgaacagatcgtgcaaatcttcgggaataagatggaaaagactgaggaagtcaaaaaggaggcagaaaaatctccgaagggcaagggaagacggagcaagactaaggatctgtccctcgaaattatcaaaatttcatcttttgggcaaaacgaggcgggatccgagccccatatcgaggcacattctctggaattgagcagtctcgacaacaaaaatttcagcagtgcgactgaggacgagattgaccagtgtgttaaggaaaaaaaactcaagcgaaaaatcttgggacaatcctcccccgagaaaaaaatccgcatcgagaatgggatggagatgacaaacacggtgtcacaggagagaacaagcgactgcatcggtagtgagggcatgaaaaatctgaatttcgagcagcacttcgagagagaaaatgaaggaatgccctcattgattgccgaatcgaaccagtgcattcagcagctgacctccgaacgttttgacagccccgcagaggagacagtcaatatcccgctaaaggaagatgaggacgcaatgccattaattggccctgagactctcgtgtgccacgaggtggacctcgatgacctggatgaaaaagataagacatccattgaggatgtggccgtggagagttctgaatccaactccctcgtgagcattcctcccgctttgcccccagttgttcagcacaatttttccgtagcctcaccattgacactttcacaggatgaatctcgctccgtcaagtcggaatcagatattacaattgaggtggatagtattgccgaggaaagccaggaaggcctctgtgagagggaaagtgccaatggctttgagacgaacgtggcctctggcacttgttccattattgttcaggagcgagagtcaagggagaagggccagaaacgcccatctgacggaaactctggactgatggccaagaaacaaaagaggacccccaaacgcacctcagccgctgcgaaaaacgaaaaaaatggcaccggccagagttcagactcagaggacctgccagtgttggacaattctaacgaacttgataatatgaattccaccgagcgcatttccttcctacaggaaaaactccaggagattcgcaaatactatatgagtctgaaaagtgaggtcgcaacaattgaccgccgtcggaagcgcttaaaaaaaaaagatcgcgaagtgtcccatgcgggagcgagtatgagctcagctagctccgatactggaatgtccccctctagttctagccccccacagaacgtgctcgccgtggagtgtcggtag

SEQ ID NO: 215014 - DNA, 165 bp, Artificial Sequence
  Description of Artificial Sequence: Synthetic coding sequence
atgaaagctgcagacgagcccgcataccttacggtggggacagacgtctccgctaagtacaggggtgctttttgcgaggccaaaattaaaaccgtgaagcgactggtaaaagtgaaggttctcctgaagcaagataacaccacccagttggtgcaggatgattag

SEQ ID NO: 215015 - DNA, 3567 bp, Artificial Sequence
  Description of Artificial Sequence: Synthetic coding sequence
atgaaagccgcagacgagccggcttatctaactgtcggaactgatgtgtcggccaagtacaggggtgccttttgcgaggccaaaatcaagactgtcaaaagacttgtcaaggtcaaggtcttgctgaaacaggataacactacacagcttgtgcaggatgaccaggtgaagggccctctccgcgtcggggctatcgttgagaccagaacatcagacggcagttttcaggaagcaattatctccaagcttaccgatgctagctggtatacagtcgtgttcgatgatggcgacgagcgtacactgcggcgtaccagcctgtgcctcaaaggcgagaggcacttcgctgagagcgagacccttgatcagcttcccctgaccaaccccgagcatttcggtacccctgtgattgctaaaaaaactaacaggggacgccgaagcagtctgccagtgaccgaggatgaaaaggaggaagaaagctccgaggaagaggatgaagacaaaagaagacttaacgacgaactgctggggaaggtggttagcgtcgtttcagctaccgaacggacagaatggtaccctgctctggtgatttctccgtcttgcaacgacgatataacggtgaagaaggatcagtgccttgtgcgttctttcatcgattccaagttttactcaattgctcgcaaggatatcaaagaggtggacattctcaacctccccgagtctgaactgtcaaccaagcctggacttcagaaagccagcatcttcctgaaaacgcgggtggtgcctgataactggaaaatggacatttccgagatcttggagtcctcatcctcagatgatgaagacggcccagcagaagaaaacgacgaagaaaaggaaaaagaagcgaagaaaaccgaggaagaggtgccggaggaggagctcgatcccgaggaaagggataactttctgcagcagctgtacaaatttatggaagatagaggaactccgatcaataaacccccagttttaggatataaggatcttaatctgttcaaattatttaggttggtgtatcaccaggggggatgtgacaacattgattccggggcagtgtggaagcagatttatatggatctcggtattcccattttgaatagcgcggcaagctacaacgttaagaccgcctaccgaaaatacctgtacggcttcgaggagtactgccggagtgcaaatatccagttcaggacggttcatcaccacgaacccaaagtcaaggaggaaaaaaaggacctggaagagtctatggaagaagctctgaaattagaccaggagatgccccttaccgaggtaaagagcgagccagaggagaatattgacagtaactccgaaagcgaacgcgaggaaattgaacttaagtccccccgaggtcggcgtcgcatcgccagagacgtcaacagtatcaaaaaagagatcgaagaggagaagaccgaagataagcttaaggataacgacactgaaaataaggatgtggacgacgattacgaaactgccgaaaaaaaggaaaatgaactgctcctgggtagaaaaaatacgcctaagcaaaaggaaaaaaagattaagaagcaggaggattctgataaggacagtgatgaggaagaggagaaatcccaggaacgcgaagagaccgaaagtaagtgtgactccgaaggagaggaagatgaagaagacatggaaccatgcttaactgggactaaggtaaaggttaagtatggacggggaaaaactcagaagatttacgaagcaagcataaaaagtacagaaatcgacgatggggaggtcctgtacctcgtccactattatgggtggaacgtgaggtacgatgagtgggtgaaggcggatagaattatttggccattggacaaagggggaccgaaaaagaagcagaaaaagaaggctaagaataaggaggattcggagaaggacgagaaaagggacgaagaacggcagaaatctaagcgcggtaggccaccactaaaatccaccttgtcttcgaatatgccatatggcctgtcaaaaaccgccaacagcgaggggaaatccgattcctgttctagcgacagtgaaactgaggacgccctggaaaagaatctgattaacgaggaactgtccctcaaggacgaactggaaaagaacgagaacctgaacgacgataagctagacgaggagaatccgaaaatctctgctcacattctgaaagagaacgatcggacacagatgcagccacttgagaccctgaagttggaggtgggtgagaatgagcaaattgttcaaatcttcggtaacaagatggagaaaaccgaggaggtgaagaaagaggccgagaaaagccctaagggcaagggaaggagatcaaagacaaaggatttgagtctcgaaatcattaagatatcctcatttgggcagaacgaagcgggaagtgagccccacatcgaggcccattccctggagctcagttcgctcgacaataagaactttagcagtgcaactgaggacgaaattgaccagtgtgtgaaggagaagaaacttaaacgaaaaatcctggggcaaagttcccccgaaaagaaaatccgcattgagaacggtatggaaatgaccaatacagtgtcacaagagaggacatccgattgtattggtagcgaaggtatgaaaaatcttaattttgagcaacattttgagagggaaaatgagggaatgccctcccttatcgccgagtcaaaccagtgtattcagcagttgacatccgaacggttcgacagtcctgcggaggagaccgtgaatatacccctgaaagaggacgaagatgccatgcccttgattggacccgagactctcgtgtgtcacgaggttgatctcgatgacttagatgagaaggacaaaacgtctattgaggacgttgccgtggaatcctcagaaagtaattcactggtctccatccctcccgctctgcctcccgttgtgcagcacaacttcagcgtggcctcccctctcaccctgagtcaagatgagtctaggagtgttaagagcgaatccgacatcactatcgaagtagattctatagccgaggagtcacaagaaggcctgtgcgagagagagtctgcaaacggctttgaaaccaatgtagcgagtggcacatgcagcataattgtccaggagcgagagtctcgcgagaagggccaaaagcggccaagcgatggcaacagcggcctaatggccaagaaacaaaagcgcacccctaaaaggacttcagcagcagctaaaaacgaaaaaaatggaaccgatgagctggataatatgaactccaccgaaagaatctcctttcttcaggagaagcttcaagaaattcgaaagtattacatgtctctgaaatctgaagtcgccactatcgacaggagaagaaagagactcaaaaagaaagacagggaggtgtctcacgccggagcttcaatgagttcggcgagctctgacacaggaatgtccccatcatcaagctcgccccctcagaacgtcctagccgtggagtgcagatag

SEQ ID NO: 215016 - DNA, 3939 bp, Artificial Sequence
  Description of Artificial Sequence: Synthetic coding sequence
atgaaagccctggatgagcccccttacctcactgtaggcacagacgtgagtgccaaataccgcggtgccttctgcgaggcgaagattaagaccgccaagcgtttggtgaaggtgaaggtgacctttagacacgacagttcgactgtggaggttcaagatgatcacattaagggtccgctgaaggtcggagctatcgtggaggttaaaaacctcgacggcgcataccaagaagctgtgattaataagcttactgatgccagttggtatacagtagtgttcgatgatggagacgaaaagactttgaggagaagctccctgtgcctcaaaggagaaagacatttcgccgaatctgaaaccctggaccaactgcctctgactaacccagaacacttcggtacaccagtcatcggtaagaagacgaataggggtcgtcgttccaaccacatcccggaagaagagtcatctagctcttccagcgacgaggacgaagacgatagaaagcagatcgatgagttactgggcaaggttgtctgcgttgactatatttctctagacaagaagaaggcgttatggttccctgctctcgtcgtgtgtccggactgttccgacgagatcgccgttaagaaagacaacatccttgtaagatcttttaaggacggcaagttcacctctgtgccacgcaaggatgtacatgagatcacaagcgacactgctccgaagccggacgctgtgctcaagcaggccttcgaacaggcactggaatttcacaagtcaaggacaatccccgctaactggaagacggagctgaaggaagactcctcctcgagcgaggccgaagaggaagaagaagaagaagacgatgaaaaagaaaaagaagataacagcagcgaagaggaggaagagatcgaaccgttccccgaggagcgggagaattttctacagcagttatacaagtttatggaggatagaggaactccaattaacaagaggccggtcttaggctatcgcaacctcaacctgtttaaattgttccggctcgtgcataagctcggcggtttcgacaacattgagtccggtgctgtgtggaagcaagtctatcaagatttaggtattccagtgctgaattctgcagccggatacaatgtgaaatgcgcctataaaaagtatctatacggttttgaagaatactgcagaagcgcaaacattgaatttcagatggctctgcccgaaaaagtggttaataagcagtgcaaagagtgtgagaatgtcaaggagatcaaggtcaaagaagagaatgagaccgaaatcaaagagattaaaatggaggaggagcgcaacataattcctcgagaggagaagcccattgaagatgaaattgagaggaaggaaaatattaagccaagcctgggttcaaaaaaaaacctgctggaaagcatccctacgcactccgatcaggaaaaggaagtgaacattaaaaaaccagaggacaacgagaacttggatgacaaggatgacgatactacccgagtggacgagtctctaaacatcaaagtggaggctgaagaagagaaagcaaagagcggagatgagacgaataaggaagaagacgaggatgatgaagaagccgaagaagaggaggaggaggaagaggaggaggaggatgaggatgacgatgataacaacgaggaggaggagtttgaatgctatcctcctggaatgaaagtccaagtgcgctatggtcgagggaaaaaccaaaaaatgtacgaagcctctatcaaagatagcgacgtagagggcggtgaagtcctctacctggtgcattactgcggatggaatgtccggtacgacgagtggataaaggccgataagattgtgagaccagcagataagaatgtaccaaagatcaagcacaggaaaaaaataaagaacaaactggataaggaaaaagacaaagacgagaagtactcccctaagaattgtaagttacgacggttgtcaaagcctccatttcaaacgaatccatccccagaaatggtaagcaaattggatctgacagatgccaagaatagtgacacagcgcatatcaagagcatagaaataacttccatcctgaacggcttgcaggcgtccgagtcaagtgcggaagattcggagcaggaggatgagcggggagctcaagacatggataataacggaaaagaggagtctaaaattgaccacctcaccaacaacaggaacgatctgatctctaaggaggaacaaaattctagttccctcctcgaggaaaacaaagtgcacgcagatcttgtgatttctaaacctgtgagcaagtctcccgaacgcttgcgcaaggacatcgaagtcctgtcagaggatacagattacgaagaggacgaggtgactaagaagaggaaggatgtcaaaaaagatacaacggataagtcctcaaagccacagataaaacggggaaaacgccgatattgcaacacagaagagtgtctcaagacaggatcaccagggaagaaagaagaaaaggcaaagaataaagagtccctgtgtatggaaaattcttcaaatagctcatctgatgaagacgaggaagagactaaagccaagatgaccccaacaaaaaagtataacggccttgaagagaagcgcaaaagccttagaacaacgggtttttatagcggattcagtgaggtggccgaaaaaagaattaagttactgaacaactctgatgagcggctgcagaacagccgagccaaagaccgaaaagatgtgtggagctccattcaaggacaatggccaaaaaagactctgaaagaattattctctgactctgataccgaagctgctgccagtccaccccatcccgctcccgaagaaggtgttgccgaagaatccctgcagaccgttgccgaggaggaatcttgcagcccaagcgttgaactggaaaaacccccacctgtcaacgtagatagtaagcctattgaagagaaaacagtggaagtgaacgaccggaaagccgagtttccttcgtctggttctaattccgtgctaaatactcccccaactacgcccgaaagtccatcctctgtgaccgtcactgaggggtcccgacagcagagtagtgtgaccgtctctgaaccactcgctcccaaccaggaggaggtgagatctatcaagagtgaaactgactctacgatcgaggtcgactcggtggccggtgagctgcaggacctgcagtctgaggggaatagctcaccagcaggcttcgacgcgtctgtgtccagcagtagttccaaccagccagaacctgaacatccagaaaaggcatgtactggccagaagcgcgtgaaggatgcccagggtggaggctcgagtagcaaaaagcaaaaacggagccataaggctacagtggttaacaataagaagaagggtaaaggtactaattcttccgattccgaggaactgagcgccggagagtctatcacgaaatcccagcctgtcaaatccgtgtctaccgggatgaagtcccattctacaaagagcccagcacgcactcagagtcccggaaagtgcggaaaaaacggggacaaagatcccgatctgaaggaaccaagcaacaggctgcccaaggtgtataagtggtcctttcagatgtctgaccttgagaacatgacatccgcagaaagaatcacaattctgcaggaaaaattacaggagattcggaagcactatctgtcactgaaatccgaggtcgccagcatcgaccgcagacggaagaggcttaagaaaaaagaacgtgagagcgccgctactagctcctcatcaagcagtccctcttcatcttccataacggctgccgtcatgcttacattggcagagccgtccatgagtagtgcctcacagaacgggatgagtgtggagtgtcgctag

SEQ ID NO: 215017 - DNA, 3681 bp, Artificial Sequence
  Description of Artificial Sequence: Synthetic coding sequence
atgaaggccctagatgaacccccatatctcacagtggggactgatgtgtccgccaagtacagaggggcattttgtgaggctaagattaaaacggctaaaagactcgtaaaggtaaaggtcacttttagacacgatagttctaccgtggaagtacaggacgaccacattaaggggccattgaaagtgggcgcaatcgtggaagtcaaaaatctggatggggcttaccaggaagccgtgatcaataagctgactgacgcctcatggtacacagtagtatttgacgatggcgatgaaaaaaccctgagacggtcctcactgtgcctgaagggagagagacactttgctgagtctgagacgctcgatcaacttccattaactaatccagagcattttggtacccctgtcattggcaaaaagacaaatcgcggacggagatccaatcacatacccgaggaggaatcctccagtagctcgagcgacgaagacgaggacgatagaaaacagattgatgagctgctggggaaagtggtgtgtgtggattatatctcactggacaaaaaaaaggccctgtggtttcctgcgctcgtcgtgtgtcccgattgcagcgatgaaattgccgttaagaaagacaacatcttggtgcgctccttcaaagacggcaagtttacatccgttcctcgaaaggacgtgcatgaaatcaccagcgacaccgctccgaagccggacgccgtcttaaaacaagccttcgaacaggcattggaatttcataaatcccgcaccatccctgccaattggaagactgaactaaaggaggatagcagtagctctgaagcagaggaggaagaggaggaggaggacgatgaaaaggagaaagaagacaattcctctgaagaggaggaggagattgagccatttccggaagaacgcgagaactttttacagcagctatataagtttatggaagatagagggaccccaattaataaaagaccagttctcggataccgcaacctgaacctgttcaagcttttccgcctggtccataagcttgggggtttcgacaatatcgaatccggggctgtctggaagcaggtctaccaggacctggggattcctgtgctgaacagtgcagctggatacaacgtaaagtgcgcgtataagaaatacctctatggctttgaggaatattgcagaagcgctaatatagaatttcagatggcccttccagagaaggtcgttaacaaacagtgcaaggaatgtgagaatgtgaaggaaatcaaggtgaaggaggaaaacgagaccgagataaaggagataaagatggaagaggaaagaaatattataccaagagaagagaagccaattgaagatgaaatcgagcggaaagagaatatcaagcctagtcttggctcaaaaaagaacttattggagagtatcccaacgcattctgaccaggagaaggaggtcaacataaagaaacctgaggacaatgagaatctcgatgacaaggatgacgacacgacacgcgtcgacgaaagtctgaacataaaagtggaggctgaggaggaaaaggccaaatcgggatacgatgagtggatcaaagcggataagattgtacggccagccgataagaacgtacctaaaatcaaacaccggaagaaaattaaaaacaagctggacaaagaaaaagataaagacgagaagtactccccaaagaattgcaagctccgcaggctatctaagccaccatttcagaccaacccatctccagagatggtgagcaagctggacttgacagatgcgaagaactccgatactgcgcacatcaaaagtatcgaaataacgagtatcctcaacggtcttcaggctagtgagtcaagcgccgaagacagcgagcaggaagacgagaggggtgcccaagacatggacaacaacggcaaggaggagtcaaagatcgaccaccttacaaataaccgcaatgatctgataagtaaagaagaacagaactccagcagcctgcttgaggaaaacaaagtgcatgccgatctggtgattagcaaaccagtgagcaagtcccctgagaggctccggaaagatattgaagtgctctcagaagacaccgactacgaagaggatgaggtcaccaagaagagaaaggacgttaaaaaagatactaccgacaagagttccaaaccccagataaagcgtggtaaacgtcgctactgtaatacggaggagtgtcttaaaacaggtagcccaggcaagaaagaagaaaaagctaagaataaagagtctctgtgtatggagaactccagtaacagttctagtgacgaagatgaggaggagaccaaggcaaaaatgacacccaccaaaaaatacaacggactagaggaaaagaggaagtctttaagaaccactggtttttatagcggtttttcggaagttgctgaaaaacgtattaaacttctgaacaattccgacgaacgcctgcaaaattctagagccaaggaccggaaggatgtctggtcatccatacagggccaatggccgaagaaaacgctcaaagaattgttctctgatagcgatactgaggccgctgcttcacctccccaccccgcacccgaggagggagtagctgaggagagtttgcagacagtcgccgaggaagaatcttgtagtccgtcggtggagcttgaaaagcccccacctgtgaacgtcgactctaagccgatagaagagaagaccgtcgaagtcaacgacaggaaagccgagtttccctcatcaggttcgaatagcgtcctgaacactcctccgactacacctgagagcccctcgtctgtgactgttactgaaggatcacgacagcagtcgagcgtcactgtatcagaacctctggcccctaaccaagaggaggtgagatcgattaaaagtgaaacagattcaaccatcgaggtcgatagcgtcgccggagagctgcaggacctacagagcgaaggaaacagtagccccgcaggtttcgacgccagcgttagctcttcaagcagtaaccagcctgagcccgagcaccccgaaaaggcctgcactggccaaaagcgcgttaaagatgcccaggggggaggaagtagtagtaaaaagcagaaaaggagccacaaggcgaccgtggtaaataataagaagaaggggaaaggcaccaatagctccgacagcgaggagctgtctgctggagagagtataaccaaatctcagccagtgaagtctgtgtcaaccggcatgaagtctcatagcaccaagagtcccgctcgtactcaatccccaggaaagtgtggcaagaatggggacaaagatcccgatctgaaggagccgtctaatcgcctacccaaggtgtataaatggtcttttcagatgtcagatctggagaacatgacctcagccgaaaggataaccatcctgcaagagaaattacaggagattcgcaagcactacttgtcactgaagtcagaagttgcatccattgatcgtagacgcaagcggctgaagaaaaaggaaagagagtccgcagctacctcctcatcatcttcctctccttcaagttctagcatcacagccgcagtgatgctgaccttggctgagccttctatgtcttccgcaagccagaacggcatgtctgtcgaatgccgttag

SEQ ID NO: 215018 - DNA, 3939 bp, Artificial Sequence
  Description of Artificial Sequence: Synthetic coding sequence
atgaaggcactggatgagccgccatacctgactgtgggtaccgacgtgagcgctaagtaccggggagctttctgcgaggcaaaaatcaaaactgctaagcggctcgttaaggtgaaggtgactttccgccatgattccagcaccgtcgaggtgcaggacgatcatattaaaggcccactgaaggtgggtgcaattgtcgaggtaaagaacctcgatggcgcatatcaggaagccgttattaataagctgaccgatgcctcctggtacacggtggtgttcgatgacggcgatgagaaaacgctcaggaggtccagcctgtgtctaaaaggagagaggcattttgcagagagtgagacgctggatcagctgccactgacaaaccccgagcattttggcacaccggtaattgggaagaagacaaaccgcggtaggagatctaatcacatccctgaagaagagtcatcatcctcctctagtgatgaagacgaagatgaccggaagcagatcgatgagctgctgggtaaggtggtttgcgtcgattacatttctcttgacaaaaaaaaagcactgtggttccccgctcttgtggtttgccctgattgcagtgatgagatcgcagtgaagaaagacaacattctggtgcgcagttttaaggacggtaagtttacctccgtgcccagaaaggatgtccatgagatcaccagtgacactgcgcctaagcccgacgcagttctgaaacaggctttcgagcaagctctggagttccataagtctaggaccatccctgctaactggaagaccgaactgaaagaagacagtagttcctctgaggccgaagaggaggaggaggaagaggatgacgaaaaggagaaagaagacaacagctcagaggaggaggaagaaatagaacccttccctgaggaacgggaaaatttcttgcagcagctatataagttcatggaggaccggggaactccaatcaataagagacccgtccttgggtatagaaatctgaatctgtttaaactgttcagactcgtccataaactcggaggctttgataacattgaatcgggcgctgtttggaaacaggtctatcaggacctcgggatccctgtcctgaattccgccgctggctacaacgtcaaatgtgcatacaagaagtacctctacggttttgaggagtattgtcgctccgcaaatattgaatttcagatggctctccctgagaaagtcgttaataagcagtgcaaagagtgcgagaacgttaaggaaattaaggtcaaggaggagaacgagacggagataaaggaaattaagatggaggaggagaggaatattattcccagggaggagaagccaattgaagatgaaattgaacggaaagaaaacatcaaaccaagcctcgggtccaagaaaaacttgctcgagagcatcccaacccactccgaccaggaaaaagaagtgaatatcaaaaaaccggaggacaacgaaaacctagatgataaggatgacgatacaacacgcgtggacgaatccctaaatatcaaagttgaggcagaagaagaaaaagctaaatctggagacgaaacaaataaggaggaagacgaagatgacgaggaagccgaggaagaggaagaggaggaagaagaagaagaggacgaggacgacgatgacaacaacgaggaggaagaatttgagtgctacccccctggcatgaaagtccaggtccgctatggacgcggaaaaaatcagaaaatgtatgaggccagcattaaggattcagacgtggaagggggagaagtcctgtacctggtgcattactgtggctggaatgtgcgctatgacgagtggattaaagccgataaaatcgtgcggccagctgataaaaacgtgcccaaaataaagcaccgcaagaagattaagaacaaattagataaggaaaaagacaaagacgagaaatactcacctaagaactgcaagcttaggagactgtccaagccaccatttcagacaaacccatccccagaaatggtcagcaaactggacctgactgacgccaaaaatagcgataccgctcacatcaaaagcatcgagatcacatccattcttaatggactgcaggcttccgaaagctccgcagaagatagcgagcaagaagacgaacggggagctcaagatatggataataacggaaaagaagagtctaagatcgaccacctcaccaacaataggaacgacctgatttctaaggaagaacagaatagttccagtctgctcgaggagaacaaagtgcacgctgatctggtcatttcaaagcctgtgtctaaaagccccgaaagactgcggaaggacattgaggtcctatccgaagacaccgactacgaagaggatgaagtcacaaagaagagaaaggacgtgaaaaaagacaccactgacaaatcaagcaagccacagataaaacgcggaaagagaaggtattgcaacaccgaagagtgcctaaaaaccggatcgcctggaaaaaaggaggagaaagccaaaaacaaagagtccctatgtatggagaatagtagtaattcaagcagtgatgaggatgaagaggaaaccaaggctaaaatgactccaactaagaagtacaatggattggaggaaaaacggaaaagtctacggacgactgggttctactcagggttctcggaggtggccgaaaaaagaattaagctcctgaacaattctgacgagcggctccaaaattcccgagccaaagacagaaaggatgtttggtcgtcaatccagggacagtggcctaaaaaaactctgaaagagctgttctcagatagcgatacagaagccgctgcatcccctccccatccagccccagaggaaggtgtggcagaggagagcctacaaaccgtcgcagaggaagagagctgtagtcccagtgtcgagctagaaaaaccacctccagtgaacgtggactcaaagcccatcgaagagaagaccgtggaagtcaacgaccgcaaggccgaattcccctcttctggctccaacagcgtccttaacacacctccaaccactccagaatccccttccagcgtaactgtcaccgagggctcacgccagcagtcaagcgtgacagtgtctgaaccgcttgcgccaaatcaagaggaggtgcggtcgattaagtccgaaaccgacagcacaattgaagtcgacagtgtggcaggggagctccaggatttgcagagtgagggcaactcttcccccgcaggcttcgatgcctcagtgtcatcttcttcatcgaaccagccggagccggaacatcctgaaaaagcatgtaccggccaaaagcgcgtgaaagatgctcagggcggtggatcaagttcgaagaaacagaaacgctcccacaaggccacagtggttaacaataaaaagaagggaaagggcaccaattcttctgattctgaagaactatctgcgggagagagcattactaagagccagccggtcaagtccgtctctacaggcatgaagtctcattctactaagagtcccgctcgtactcaaagccctggcaagtgtgggaagaatggtgataaggaccctgacctcaaggagcctagtaatcgcttaccaaaggtgtacaagtggtcgttccagatgtctgatctggagaatatgacatctgctgaaaggattaccatcctgcaggaaaagctgcaggagatccgcaagcactacctatctctgaagagtgaggtggcctctatcgaccgacgtcgaaaacgtctgaaaaagaaggaacgggagagcgctgccacttcatcgtcaagctcatctccttcaagctcaagcattactgctgccgtgatgttgacattggccgagcctagcatgtccagtgccagtcagaacggcatgtctgtggaatgtcgctag

SEQ ID NO: 215019 - DNA, 3462 bp, Artificial Sequence
  Description of Artificial Sequence: Synthetic coding sequence
atgaaggccctggacgaacctccttaccttactgttggcactgatgtctcagccaaataccggggtgcattttgcgaggctaagattaaaactgccaaacgactcgtgaaggtgaaagtgacctttcggcacgattctagtaccgttgaagtacaggatgaccacattaagggtcccctcaaagtgggtgccattgtggaagttaaaaatctggacggcgcttaccaggaggctgtcataaataagctaacagacgcgagctggtataccgtggtgttcgatgacggagacgagaagactttgaggcgctcttccctgtgtcttaagggcgagcggcactttgccgaatccgaaaccctggaccagttgcccctgacaaatcccgagcacttcggaacacctgtgatcggtaaaaagactaatagagggaggcggtccaatcatatccctgaggaggaatcaagctcttcaagttccgacgaggacgaggacgataggaagcagatcgacgagctactgggaaaagtggtgtgcgtagattatatatctcttgataaaaagaaagctctttggtttccagcgctcgtcgtgtgtcctgactgcagtgatgaaatcgcagtgaaaaaggacaatatcctggtgaggagcttcaaggacggcaagtttacatccgtgccgcgaaaggatgtacatgaaattaccagcgacacagcacctaagccagacgcagtcttgaagcaggcttttgagcaggctttagaattccataagtcacgtacaattccagccaattggaaaaccgagttaaaggaagattccagctcaagtgaggcggaagaggaggaggaggaggaagacgacgagaaggagaaggaagacaacagtagcgaagaggaggaggagatcgaacctttcccagaggagagggagaacttcctgcagcagctgtacaaatttatggaggacaggggcacacccatcaataaacgccctgtgctaggatacaggaatctaaacttgttcaagctttttaggcttgtgcataagctcggcggattcgataatatcgagtctggcgctgtctggaaacaggtgtaccaagacttgggaatccctgtcctgaattcggccgctgggtacaacgtgaagtgtgcttacaaaaagtatctgtatggttttgaggaatactgtcgctctgcaaacattgagttccagatggcacttcccgagaaggtcgttaataagcagtgcaaggaatgtgagaatgttaaggagatcaaggttaaagaggagaacgaaactgagattaaggagatcaagatggaagaagaaagaaacatcatccctcgggaggagaagcctatagaagacgagattgagagaaaggagaacatcaagccctctctgggctctaaaaagaacctgctggaaagtattcccacacattccgaccaagagaaagaggtgaacattaaaaagcccgaggacaacgaaaatctggacgacaaggatgatgacactacacgggtcgacgagtctttgaatattaaagtcgaggcggaggaggaaaaggcaaagtccggggacgagacgaacaaagaagaggatgaagatgatgaggaagccgaagaggaagaagaggaagaggaggaagaagaggatgaggacgacgacgataacaacgaagaggaagagttcgaatgttacccaccgggaatgaaggtgcaggtgagatatggcagaggtaaaaatcagaagatgtatgaggccagtataaaagacagcgacgttgagggcggagaagtactttatctcgttcattactgtgggtggaacgtgcggtatgatgagtggatcaaggcagataagattgttagaccagcggacaaaaacgtgcccaaaatcaagcaccgtaagaagatcaaaaataaactcgataaggaaaaagacaaggatgagaaatattctccaaaaaactgcaaactgcggaggctcagtaagccccctttccagaccaatccttcgcctgaaatggtctcaaagctagatctcactgatgcaaagaactcggacactgctcacattaagtccatcgagatcacaagcattctaaacggactgcaagccagcgagagttccgcagaagactccgaacaggaggatgagaggggggctcaggacatggacaacaatggcaaggaggagtccaagattgatcatttgacaaataataggaacgacctcatctcaaaggaagagcagaatagtagttctttactcgaggaaaataaagttcacgctgatctggtgatatctaaacctgtgtctaaaagccccgaacgtctgcggaaggatatcgaagtactcagcgaagacacggactatgaggaggacgaggtgaccaaaaagcgtaaagatgtcaagaaagacacgaccgacaaaagctctaagccccaaataaagcgcggaaaacgacgctattgcaacaccgaggaatgtttgaagactggcagtccgggaaagaaggaagagaaggccaagaataaagagtctctttgtatggaaaactcatccaattccagctctgacgaggacgaagaagaaactaaggccaagatgacccccacgaagaagtacaatggactggaagagaagaggaaatccctgaggaccaccggcttctatagcgggttcagcgaggtggccgaaaagagaatcaagctgttgaataatagtgatgaacgcctgcagaatagccgcgcaaaggacagaaaggacgtctggtcatcgattcagggtcagtggccaaaaaaaacccttaaggagctgttctccgactccgatacagaagccgcagccagtcccccacatcctgccccagaagagggcgtcgctgaggaatcgcttcaaactgtcgctgaagaggagtcctgttccccctctgttgagcttgagaagccgcctcccgtcaacgtagactccaaaccgattgaagagaaaactgtggaggtaaatgaccgcaaagcggagtttccctcatccgggagcaatagcgtgcttaatacaccacctacaactcccgagagcccttcctctgtgacggtgactgaaggttctagacagcaaagttcagttactgtgtcagagcctctagcccctaaccaggaagaggtccgtagcattaagtccgagactgacagcaccattgaggtggatagtgtcgctggtgaactgcaagacctgcagagcgaaggtaatagcagtccggcaggattcgatgcgtctgtctcctcctctagcagcaaccagcccgagccagaacacccggagaaggcttgtaccggccagaagagggtgaaggacgcccaggggggaggctcctcgagtaagaaacagaagaggagtcataaagcgaccgtcgtcaataacaagaagaagggaaaggggattttaccacattag

SEQ ID NO: 215020 - DNA, 1452 bp, Artificial Sequence
  Description of Artificial Sequence: Synthetic coding sequence
atgaaggccctggatgagcccccatatctaacggtgggcacagatgtgtctgcaaaatataggggggcattttgtgaggctaaaatcaagactgcaaagagactcgtcaaggtaaaagtcacgttccgccatgattcctcaaccgtagaggtgcaggacgatcacatcaagggtcctttaaaggttggggctatcgtggaggtgaaaaatctggacggcgcttatcaggaggccgtgatcaacaagttaactgacgcatcatggtatacagtcgtgttcgatgacggagatgagaaaaccctgaggcggagtagcctttgcctgaagggtgaacggcacttcgcagagagcgagaccctggaccaactgccccttactaaccccgagcatttcggcaccccagtaattgggaagaagaccaacaggggccgaagatctaatcatattccagaggaagagagctcttccagcagttctgacgaagacgaagatgataggaaacagattgacgagctcctcggaaaggtcgtgtgtgtggactatatttccctggataagaaaaaggcgctttggtttcccgctctggtcgtgtgccccgactgttccgatgaaatcgctgttaagaaggacaacatcctcgtccggagtttcaaggacggcaaatttacttctgtgccacggaaagacgtacacgaaattaccagtgacactgctcccaagcctgacgccgtgctcaagcaagcctttgaacaggctctcgaatttcataaatctcgtactatcccagcaaactggaagaccgagctgaaagaagactcttcttcttccgaggcagaggaggaagaggaggaggaggacgacgagaaagagaaagaagacaactcttctgaagaggaagaggaaatcgaaccatttccggaggaacgggaaaactttttgcagcagctgtacaaatttatggaagacagaggaacacctatcaacaagaggcccgtgctgggctatcgtaacctcaacctgtttaagctgtttcggctggtacacaaattgggaggcttcgataatattgagtccggcgcagtctggaagcaggtgtatcaggatctgggaattcctgtgctgaattccgccgcaggttataacgtcaaatgcgcatacaaaaagtatctgtatggttttgaagagtattgtaggtctgccaatattgagttccagatggccttacctgaaaaggtggtaaacaaacagtgcaaggagtgtgagaatgtgaaggagatcaaggtgaaagaggagaatgagactgagattaaagagatcaagatggaagaggagagaaacataatccccagggaagaaaaacctattgaggatgagatcgagcgtaaggagaatatcaagcccagtctgggatccaagaaaaacctgctggaatctatcccaacccattcctag

SEQ ID NO: 215021 - DNA, 1968 bp, Artificial Sequence
  Description of Artificial Sequence: Synthetic coding sequence
atgaaagcactggatgaaccaccttacttgacagtgggaactgacgtgtccgctaaatacagaggagctttctgcgaggctaagattaaaacagctaagcgcctggtcaaggtcaaggtgactttcaggcacgacagttctactgtggaagtgcaagatgaccacattaagggccctctcaaagtgggggcaattgtggaggttaaaaatttggacggggcttatcaggaagccgttatcaacaaattgaccgacgcttcctggtacaccgtggtgtttgatgacggcgacgagaagacgctgagacggtcttccctgtgtctgaagggggaaagacattttgcggaatccgaaacacttgatcagctgccattaacaaacccagagcattttggcaccccagtgattggtaagaagactaatcggggacgcaggtctaaccacatcccagaggaggaatcaagctccagctcatccgacgaagatgaagacgatagaaaacagattgacgagctgttaggaaaagtggtttgcgtggactacattagcctcgataagaagaaggcgctctggtttccggcattggttgtctgtcctgactgcagcgatgagatcgcggtaaaaaaggataatatactggtacgttcttttaaagatgggaaattcacttctgtgcctagaaaggacgtgcacgagataactagtgatactgccccaaaaccagatgcagtgctgaagcaggcctttgagcaggctctcgaattccataagtctcgtactatcccagctaactggaagaccgagttgaaagaagattctagtagctctgaggccgaggaggaggaagaagaagaggacgacgaaaaggagaaggaagacaacagcagcgaagaggaagaagagattgaaccatttcccgaggaaagagaaaactttctacaacagctgtataaatttatggaggatcgtggcaccccgatcaacaaacgccctgtcttgggataccggaacctgaacctatttaagctctttcgactagttcacaagctgggaggcttcgataacattgaatccggggctgtgtggaagcaggtctatcaggaccttggcatacccgtgcttaactctgccgcagggtacaacgtcaaatgcgcatataaaaaatacctatatggcttcgaggagtactgtcgatccgcaaatatagagttccagatggctctacctgagaaggtcgttaataaacagtgcaaggaatgcgagaatgtcaaagaaattaaggtcaaggaggagaacgaaacggaaattaaggagataaaaatggaagaggagcgtaacataatacccagagaggagaaaccgatcgaggacgagattgagcgcaaagaaaatatcaaaccatccctcggtagcaagaaaaaccttttagagtccatacccacccacagcgatcaagagaaagaagtgaatatcaagaaaccagaggataatgaaaatcttgacgataaggacgatgacacaactagggtcgacgaatccctcaacatcaaggtggaagcagaagaggaaaaggccaaatctggagatgaaactaataaggaagaggatgaggacgacgaagaagctgaggaggaagaggaggaggaagaagaggaggaggatgaggatgatgatgataataacgaggaagaagaattcgaatgttatcctccaggcatgaaggtccaggtccggtatggccgtggcaaaaaccaaaaaatgtacgaggcttcaattaaggactcagacgtcgagggaggagaagttctgtacctggtgcattactgtgggtggaacgtacgctacgatgagtggatcaaagcggataaaatcgtgcggccagcagataaaaatgttcctaaaatcaagcacaggaaaaaaattaagaattctgtctacaaaaagaaaaaaaagaaaaaaaataagtag

SEQ ID NO: 215022 - DNA, 1785 bp, Artificial Sequence
  Description of Artificial Sequence: Synthetic coding sequence
atggccgctccagtcaaaggtaaccgcaagcagagtaccgaaggagatgctctcgacccacccgctagtcccaagcccgcaggcaagcagaacgggattcaaaaccctataagccttgaagacagcccggaggcaggaggcgagcgggaggaggagcaggaaagagaggaggagcaggcatttctggtgtctctgtataaatttatgaaggaaagacatacccccatagaacgagtgccacatctaggatttaaacaaatcaacttgtggaaaatatacaaagctgttgagaagttaggagcctacgagctggtgactggcagacgcctgtggaaaaacgtgtatgatgagcttggaggttcacccggaagcacctctgctgctacatgcacacgccgacattatgaacggctggtgttaccttatgtgaggcacctcaagggcgaggatgacaaacctctgccaaccagcaagcccagaaaacagtacaagatggccaaggaaaatagaggggatgatggagctactgagcggcctaaaaaagctaaggaagaaaggaggatggatcagatgatgcccggaaaaacaaaggccgacgctgctgacccggctcccttgccaagccaggaaccccctaggaactccactgagcaacagggtctggctagcgggtcatcagtgagtttcgtgggtgctagcgggtgtcccgaggcctataaaagactgctcagcagtttctattgtaaaggaacacacggtataatgtcacctttggccaagaagaagctactggctcaagtctcgaaagtggaggccctgcagtgtcaagaggaaggttgtagacacggcgcagagccccaggccagtcccgcagtacacctccctgagtccccgcagagcccaaagggattgaccgagaacagtcgccaccgcttgaccccgcaggagggacttcaagctcctggaggatctctgagagaggaagcgcaagcaggaccatgccctgcagccccaatctttaagggatgcttttacactcaccccaccgaggttttgaagcccgtctcacagcatcccagagactttttttcccgtctgaaggacggcgtcctactgggcccacctggtaaagaaggcttatcggtgaaggaaccccagcttgtatggggcggagatgccaatagaccgtcagcatttcacaaggggggatcaaggaaaggtatactctatcccaagcccaaggcatgctgggtgagtccaatggcgaaggtaccagctgagtcccctactctgccaccaactttcccaagcagccccggactcggatccaagcgcagcctggaagaggaaggtgccgctcattctgggaaacgactgagagcagtgtctccattcttgaaggaagcggatgccaaaaaatgtggcgctaaaccagccggtagcggcctggtgtcctgccttttgggccctgcattgggcccagtgccaccagaggcttaccgcggaaccatgctgcattgcccattgaatttcacgggcactcctggtcccctcaaggggcaggctgctcttcctttttcccctctagtcataccagccttccccgcacacttcctcgctaccgcgggaccatcacccatggccgctggcctgatgcattttccccctaccagtttcgactctgctctgaggcacaggctttgtccagcaagcagcgcttggcatgcccctccagttaccacctatgccgcaccgcacttttttcatctgaataccaagctgtag

SEQ ID NO: 215023 - DNA, 1917 bp, Artificial Sequence
  Description of Artificial Sequence: Synthetic coding sequence
atggctgcccctgtgaaaggaaaccgcaaacaaagtaccgaaggtgacgcgctggacccgcctgcctctcccaaaccagctggtaagcagaacggaatacagaaccccatttctctggaggacagccccgaggccggaggggagagggaagaggaacaagagcgcgaagaggagcaagctttcctcgtgtctttgtataaattcatgaaagagcgccacacacccattgagcgtgtccctcacctgggtttcaagcagatcaacctttggaaaatttacaaggcagtagagaagcttggggcttacgagttagtaacgggccgacgtctgtggaagaacgtgtacgacgagttgggaggatcccctggctccacatcagccgcaacctgtacgagacggcactacgaacgcctggtcctaccctacgtccgtcacttaaagggcgaggatgataaaccgctcccaactagcaaaccaaggaaacaatacaaaatggccaaagagaatagaggcgacgatggagccacggaacggcctaaaaaggctaaggaagaacgtaggatggatcagatgatgcccggaaagaccaaggctgacgcagccgatccagctcctctgccgtcccaggaacccccaaggaattccacagagcagcagggcctggcttcagggtcaagcgtgtccttcgtgggagcatccggttgcccggaggcatacaagcgtttgctgtcctcgttttattgcaagggaacacatggcatcatgagtccgctggccaaaaagaagctgctagctcaagtttctaaggtggaggcactacagtgccaggaagagggctgcagacacggcgcagagcctcaggcctccccagccgtgcacctgcctgaaagccctcagagccccaaggggctgaccgagaacagccggcataggctaactccacaagaaggccttcaggctcctggcggatccctgagggaagaggcccaggctgggccttgtccggcagcaccaatcttcaagggctgtttctacacacatcccaccgaggtattgaagcctgtgagccagcacccgcgtgatttcttttctaggttaaaagacggcgtgctgctaggcccacccggaaaggagggcctcagtgtcaaggaaccgcagctcgtgtggggtggggacgccaaccgaccttcagcatttcacaaggggggatcgaggaagggcattctgtatccaaagcccaaagcctgctgggtgagcccaatggccaaagttcccgcagagtcacctactcttcctcctacatttcccagctcccccggtctcgggtccaaaagaagtcttgaagaggagggcgctgctcacagcggtaagcgcttacgcgctgtgagtccgttcctgaaggaggctgacgctaagaaatgtggagccaagccagcgggatccggactggtctcttgcctgctcgggcctgctctggggccagtgccccctgaagcgtataggggaacaatgttgcactgtcccctgaattttactggaactcaccaccagagccagcccatgcaacgccctacctcaagtaccagcactccaagctgtaggcccgcacacggggtcgtgtatacagttgagtctactggcgcatacaaccgccaagtgttactgcccggtggctcggaactggttccagcaacacaggacactcgcgctatgcctcttgctggtcagcctgggacttcagaagaagagggtagcggaaagactggcttcatctccagacagcagccggaacctagaagccggggaccttcttgttataaggctctgggcgaggacggccaacttccactgcctcagtcgggcgctagaagtacacaagttgcgcatgggaagtctaataagaaaacgcctgtctag

SEQ ID NO: 215024 - DNA, 1581 bp, Artificial Sequence
  Description of Artificial Sequence: Synthetic coding sequence
atgaaggagaggcacacacctattgagcgtgtccctcatctgggattcaagcagataaatctgtggaagatctacaaggcagtcgagaaacttggcgcatatgagctggtcacagggcgaagactgtggaagaatgtgtacgatgaattagggggatcaccagggagcaccagcgccgcaacctgtactaggaggcattatgagcgcctggttctaccttatgtaagacacctgaagggggaagatgacaagcccctcccaaccagcaagcctcgtaaacagtataagatggcaaaagagaaccgcggtgatgatggagccaccgagcggccaaaaaaggcaaaggaagagcgacgcatggaccagatgatgcctgggaagaccaaagcggacgccgctgatccagcccctttgccctcccaggagccgccacggaattccactgagcagcaagggctggcaagcggctcctctgtaagttttgtgggggcatccggatgccccgaggcctacaaacggctgctctcctctttttattgtaaagggacacacggaatcatgagcccccttgcaaaaaagaagctgttggcacaggtatccaaggtggaagcactccagtgtcaggaagaagggtgcagacacggcgcagagccccaggcgtcccccgctgtgcatctgcctgagtcaccccagtcaccgaagggcttaactgaaaattctagacaccgcctgactccacaagaggggctgcaggcaccaggaggtagcctgcgggaggaagctcaagctggcccatgcccagctgcccctattttcaaagggtgcttctacacccaccccactgaggttttaaagccggtgtcccaacatccaagggacttcttctcacgcttgaaggacggcgtgttattaggaccgcctggcaaggagggcctcagcgtcaaggagccacagttggtgtggggtggggacgccaatcgcccttcagcctttcataaaggcggatctcggaaggggatcctgtaccccaagccaaaggcctgctgggtcagcccgatggctaaggtccccgcagaaagcccaacattgccaccaacatttcccagctcccccggactcggctccaaaagaagtctcgaggaagagggtgccgcacacagcgggaaacgcctgcgcgctgtcagcccattcctaaaggaagccgacgccaagaagtgtggcgcaaaaccagccggatctggcctggttagctgtttgctgggtcctgcgcttggccctgttcctcccgaagcctacagagggacgatgctccattgtcccctcaatttcactggtactccaggtcccctgaaaggacaggcggcactgcctttcagccctctggtcataccagccttcccagcccactttctagccactgcagggccatccccgatggcagccggactcatgcattttccccctacatctttcgatagtgctcttcggcatcggctgtgtcctgcttcgtctgcttggcatgccccaccagttactacttacgccgcaccacacttttttcatttgaatactaagctgtag

SEQ ID NO: 215025 - DNA, 3567 bp, Artificial Sequence
  Description of Artificial Sequence: Synthetic coding sequence
atggaacctaactctctgcagtgggttggctccccatgcgggctgcacggcccatatatcttctataaggcatttcagttccacttggaaggtaaaccaaggattctgtccttaggtgacttcttctttgtccgctgtactcctaaggatccaatctgtattgctgaactccagctgctgtgggaagagcgcacatcacgacagctccttagttcaagtaaactctacttcctcccagaagacaccccacagggccgaaattcagaccacggagaggacgaagtgatcgctgttagtgaaaaggtcattgtgaaactcgaggatctggtgaagtgggtgcattcagacttcagcaagtggcggtgtggctttcacgccggaccagttaagaccgaggcattgggcaggaacggccaaaaggaggccttgctgaagtaccggcaaagcactctaaacagcggactgaatttcaaagatgtcctgaaggaaaaagcagatctgggagaagatgaagaagagaccaatgttattgtgctgtcttacccccaatactgtcgctatcgctctatgctcaagcgcattcaggacaagccaagttcaatcctgacggaccagtttgcgctcgccctgggaggcatcgctgtggtgtcgcgcaacccacaaatactctattgtagggatacattcgaccacccaaccctaatcgagaatgagagcatatgcgacgagttcgcccctaacctgaagggaagacccagaaaaaagaaaccctgcccccaaagacgggactctttttcaggcgttaaagattccaacaacaactccgacggaaaggctgtcgccaaggtgaagtgcgaagcccgaagcgcccttactaagcccaaaaacaatcataattgtaagaaggtgagtaacgaggagaaaccgaaggttgcgatcggcgaggaatgtagggctgacgagcaggctttcctggtggccctatacaaatacatgaaggaaaggaagacacccatcgaacgcataccctacctgggctttaaacaaatcaacctctggacaatgtttcaggcggctcagaagctcgggggatatgaaacaatcaccgcccgaaggcagtggaaacacatttacgacgagctgggcggaaaccctggatccacatccgctgctacttgcactcgaaggcattatgagaggcttattctgccctacgaaaggtttatcaaaggagaggaggataagcccctccctcccataaaaccacggaagcaggaaaacagcagtcaggagaatgagaataagaccaaagttagcggaaccaagaggattaagcatgaaattcccaagtctaagaaggagaaagagaatgcgccaaagccacaagacgccgcagaggtgagctctgagcaggagaaagaacaggagacccttatctcacagaagtcgattcccgagcccctgccagccgctgacatgaagaagaaaatcgagggctaccaagagttttcagccaaaccactggctagccgagtggaccctgaaaaagataatgagacggatcaaggttccaatagcgagaaggtggccgaggaagcgggtgaaaagggacctaccccgcctcttcccagcgctcccctcgcccctgagaaagacagtgccttggtgccaggtgcctccaagcagccccttacctccccatccgcactggtagacagcaagcaagaatccaagctttgttgcttcacagaaagtcctgagtccgagcctcaggaggcatccttcccaagctttcccaccacacaacccccactggcaaaccaaaacgagacggaggacgacaaactgccagctatggcggattacattgctaactgcactgtcaaggtcgaccaactgggatcagacgacatccacaacgcgttgaagcagacacctaaggtcctcgtggtgcagtccttcgatatgttcaaagacaaggatttgaccggaccgatgaatgagaaccatggcctgaattacactcctcttctgtattccaggggaaaccctggcattatgtcccccctggctaagaagaaattgctgtctcaggttagcggcgctagcctcagcagctcctacccttacggcagcccccctcccttgatttcaaaaaaaaagctgatcgcacgggatgatttatgctcatccctgtcccaaactcaccacggacaatcaacggatcatatggccgtttctcgcccttctgtgattcagcatgtgcagtctttccggtccaagccgagtgaggagagaaaaactatcaatgatatattcaagcatgaaaagctatcaagatcggatccccaccgctgctcatttagcaaacatcaccttaacccattggcagacagctacgtacttaaacaggaaatccaggaggggaaggacaaactgctggagaagcgggcactacctcacagtcatatgcccagcttcctggccgacttctacagtagtccgcatctacacagcctgtaccgtcacactgaacatcacctacacaatgaacagactagcaaatatccctctagggacatgtatcgggaatcagaaaactcctcttttccatcccatcggcatcaggagaagctacacgtcaactatctgacctccctacatctgcaggacaaaaagagtgccgcagccgaggccccaactgatgaccagcctacggatttgagcctccctaagaaccctcataagcctactggaaaagtcctgggactggcccacagcactaccgggccacaggagtctaaggggatttctcagttccaggtgttgggatcccagtccagggactgccatccgaaggcatgcagggtctccccgatgacgatgtctggccctaaaaaatacccagagagcctttctagaagtggcaagccccatcatgtccgattggagaattttcggaaaatggagggaatggtgcacccaattttacacagaaaaatgtctccccagaatatcggggctgcacgcccaattaagagatctctggaagacctggatcttgtgattgctggtaaaaaggcccgagccgtgagccccttagatcccagcaaggaagttagtggtaaggagaaagcaagcgagcaggagagcgaaggaagcaaggctgctcatgggggacacagtggcggaggatccgagggccataagctgccattgtcaagcccgatctttccaggtctgtactccggctccctgtgcaacagcggacttaatagccggctccccgctggttatagccactccctgcagtatctcaaaaaccagacggtactttccccactgatgcagcctttggcttttcactctttagtgatgcagagaggcatttttacgagccccacgaacagccagcaactgtataggcacctggccgctgccacgcccgtgggcagtagctatggggatctccttcataacagcatctaccctttggcggctatcaaccctcaagctgccttcccatcgtcccaactgtctagcgtgcatcctagcacgaagctgtag

SEQ ID NO: 215026 - DNA, 2838 bp, Artificial Sequence
  Description of Artificial Sequence: Synthetic coding sequence
atggcccctaacctcaaaggccgtcctagaaaaaagaagccttgtccccagagacgggattctttctcgggggttaaggacagcaacaataactctgatggcaaggcggtggccaaggtcaagtgcgaggcacgttccgccctgacaaagccaaagaacaaccacaattgcaagaaggttagcaacgaagagaagcctaaagtagcgataggtgaggagtgcagggccgacgagcaggcgttcctggtcgccctgtataaatacatgaaggagagaaagacccccattgaacgcattccttacttaggcttcaagcagattaatctatggacaatgttccaggccgcacagaagctgggaggatatgagaccatcacagcacggagacaatggaaacatatctatgacgaactgggcggtaaccccggatctacatccgccgctacttgtactcggcgtcactacgagcggctgatcctgccatacgagagattcattaagggcgaggaagataagccgttgcctcccattaaaccaaggaagcaggaaaattcgagtcaggaaaatgaaaataagacaaaggtatccggaacaaagcgaataaagcatgagatccccaaatctaagaaggagaaggaaaatgcgccaaagccccaggatgctgccgaggtgtcgagcgagcaggagaaagagcaggaaacacttatttcccagaagtccatcccagaacctctgcccgcagctgacatgaagaaaaaaattgaaggctatcaggagttttcagccaagcccctggcgtctagagtggaccctgagaaagacaatgaaaccgatcaaggcagtaactctgagaaagtcgcagaagaggctggagaaaagggcccaaccccacccctaccgtctgctcccctggcccctgaaaaggactcagctctcgtgcctggagctagcaagcagccactgacctctccttctgcacttgtggacagcaagcaagaaagcaaattgtgttgcttcaccgaatcaccagagtcagagcctcaggaagcctcattcccttcttttccaacaactcagccccctctcgcaaaccagaacgagaccgaggacgacaagctcccggcaatggccgactacattgccaactgcacggtgaaggtggatcaactgggatcagacgacatccacaatgcacttaagcagactcccaaggtgcttgtggtgcaaagtttcgatatgtttaaggacaaggatctgaccggcccaatgaatgagaaccacggcctgaattacaccccactcttgtacagtcgtggaaacccaggcattatgagccctctcgcaaagaaaaagcttttgagccaggtgtccggagccagcctgtcaagcagttatccgtatggatccccccctccattgatttccaagaagaaattaattgcacgtgatgatctgtgctcaagcttgtcacagacacaccacggtcagagcaccgatcacatggccgtgtcccgcccttccgttatccaacatgtgcagtctttccggagcaaaccaagtgaggaacgcaaaactataaatgacatatttaagcatgagaaactgagccgcagtgacccacatagatgctccttctccaaacatcacttgaatcctcttgctgatagttacgtgctgaaacaagaaatccaggaggggaaggacaaactcctcgaaaaacgggcacttccacactcccacatgccaagctttctagcagatttctacagctcaccgcacctacacagtctatataggcacacagagcatcacctgcataatgagcaaacatctaaatatcctagtcgggatatgtacagggaatccgagaactcgtcctttcccagtcaccgccaccaagaaaagctgcatgtgaactaccttaccagcctgcacctgcaggacaaaaagagtgctgccgctgaggcaccaacagacgaccagccgacagatttgagcctgcctaaaaacccccataaaccaactggtaaagtgttggggctcgcacactctaccacgggaccacaggaatcaaagggtatttctcagttccaggttctgggaagtcagtctcgtgattgccacccaaaagcctgccgtgtgtcccccatgaccatgtcaggccctaaaaagtatcctgagagcctgtcgaggtcaggcaaacctcaccatgtgagattggagaacttccggaaaatggaggggatggtgcacccgatcttgcatcggaagatgtctcctcagaacattggggcagcccgtcccatcaaacggtctctggaagacctggacctggtaattgccggaaagaaagcaagggctgtgtcccccctggacccttctaaagaagtatctggaaaagagaaggcctcagaacaggaaagcgaaggctcgaaggccgctcacggcggacactcggggggaggaagtgagggccacaagttgcctctcagctcacctatttttcccggactttacagtggcagcctgtgtaactccggactgaatagccgactgcccgcagggtactcacacagcctgcagtatctaaagaaccagactgtgctctccccactaatgcaacctctcgctttccattccttggtcatgcaacgcggtatatttactagtccaacaaacagtcagcagctgtaccggcatcttgccgctgctactcctgtaggctcaagctatggcgatctcttgcacaactctatctatcccctggccgcaataaaccctcaggcagcatttccttcatcccagttgtcatctgtccacccaagcactaaactgtag

SEQ ID NO: 215027 - DNA, 1134 bp, Artificial Sequence
  Description of Artificial Sequence: Synthetic coding sequence
atgggcaccactgaggcgacgttaagaatggaaaatgtggacgtcaaagaggagtggcaggatgaagacctccctagaccactcccggaagagaccggcgtcgagttgctcggctctcctgtggaagacacgtcgagcccccctaacacgctgaacttcaatggggctcatcgaaagaggaagactctcgtggcacctgaaatcaatatctcactcgatcagagcgagggcagcttgctgagtgacgactttcttgacacaccggatgacttggacataaatgtggacgacatcgagacacctgatgagactgactctctggaatttctcgggaacggcaatgagttagaatgggaggatgacacgcccgttgccaccgccaaaaacatgcccggagacagcgccgatctctttggcgacggcactaccgaggacgggtcagcggcaaatggcaggctttggcgaaccgtgatcataggcgagcaggaacatcgtattgatcttcacatgattcggccttacatgaaagtcgtgacacacggagggtactacggggagggcttaaacgcgattatagtatttgccgcttgtttcctgcctgattctagcctcccggactaccattacatcatggagaacctctttctctacgttatttctagtctggaactgctggtagctgaggactatatgattgtctatttgaacggcgcaaccccacgtcgacggatgcccggaataggatggcttaagaagtgctaccagatgatcgatcgcaggctaaggaaaaatctgaaatcgctcattatcgtacacccaagttggtttattcgcacggtgcttgctatatctagaccattcatttcggtcaaattcattaacaagatacagtacgtgcatagtctggaagatctggaacagctgatccccatggagcacgtccagattccagattgtgtgctccaatacgaagaagagaggctcaaagccagacgagaaagtgccaggccacagccagagttcgtgctgccacggagcgaagagaaacctgaagtggcgccagtcgaaaaccgcagcgccctcgtatctgaagatcaagaaacctctctgcagcccctgcacagaagcagctag

SEQ ID NO: 215028 - DNA, 1116 bp, Artificial Sequence
  Description of Artificial Sequence: Synthetic coding sequence
atgggtaccactgaggcaacactccgaatggagaatgtggacgtcaaagaggagtggcaggatgaggacctacctagacccttaccagaagagacgggggtagagcttctgggtagccccgtagaagataccagctcccctcctaataccttaaatttcaacggggcacacaggaaacggaagactttagtagcccctgagattaatatcagcctggaccagtctgaaggcagtcttcttagcgatgactttctggacacacctgatgatctggacatcaacgtggacgacatagagactcctgatgaaaccgattcactggaattcttgggcaatggcaatgagctggagtgggaggacgatactccagtggcaacagccaaaaatatgccaggtgattccgccgatctctttggcgatggtacgaccgaggacgggagtgcggctaacggtcgactctggcggacagtaataattggagagcaggaacatcgaatcgatctacatatgatccgcccatacatgaaagttgtgacccacggagggtattatggggagggcctcaacgccatcatagtattcgccgcatgcttccttccggacagctccttgcccgactaccattacatcatggagaacttatttctgtacgtgataagctccctggagctgctggttgcagaggattacatgattgtgtatctcaacggtgcaacgcctagaagacggatgcccggaatagggtggctgaaaaaatgctatcaaatgatagatcggcgtttgcgtaagaacttaaagtccctcatcatcgtacacccctcctggttcattaggactgttcttgctattagcaggccgtttatatcggtgaaattcatcaataaaatccaatacgtccactctctggaggacctggaacagttgattcccatggaacacgttcaaattcccgactgcgtcctacaatacgaggaggagcggctcaaggcacggagagagtccgccagacctcagccagagttcgttctaccacgcagcgaggaaaagcccgaggttgctcctgtggaaaaccggtcggcacttgtcagcgaggatcaagagactcgcatgtcttag

SEQ ID NO: 215029 - DNA, 1134 bp, Artificial Sequence
  Description of Artificial Sequence: Synthetic coding sequence
atggctgggcgacgctcaagtcaacccggaattgccctgcacaatccaggaaaccatcaggtgcaaaacccccaaggcagactcgaaactgtcagaccactccccgaggagacaggggtggaattactgggaagtccagtcgaggacactagctctcccccaaacactttgaacttcaatggtgcccatcggaagcggaaaacactagtggcccctgaaattaatatctcgctggatcaatcagaaggcagtctgttaagcgacgactttctggacacccctgatgacttagatatcaatgttgacgatatcgagactcctgatgagacagatagtttggagtttcttggtaacggcaatgaattagagtgggaggatgatacacccgtggccacggcgaaaaatatgcctggcgatagtgctgacttatttggtgatgggaccacggaagacggttctgcagcgaacggcaggctctggcggacggtcattatcggcgagcaggagcacagaatagacctgcacatgatcaggccctacatgaaagtggtgacgcacggaggctattatggggagggacttaacgccattatagtgtttgccgcttgcttccttccagactcctccctccccgattaccactacatcatggagaatctctttctctatgtgatctcttccctagaactcctcgtggctgaagactatatgattgtttatttgaacggggcaactcctagaagacgcatgccgggaattggatggctgaaaaagtgctatcagatgatagatcggaggctgcgaaagaatttgaaaagcctcatcattgtgcatccatcttggttcatccggacagtcctcgctatctcacgcccatttatttctgtaaagttcatcaacaagatacaatacgtccactcattagaagacttggagcaacttattcccatggaacacgtgcagatacccgactgtgtcctacagtatgaggaagaaaggctgaaagcaagacgggagagcgccagacctcagccagagtttgtgctaccgcgaagtgaagagaagcccgaagttgctcctgttgagaaccgtagtgctttggtttctgaagatcaagagacctctatgagctag

SEQ ID NO: 215030 - DNA, 1116 bp, Artificial Sequence
  Description of Artificial Sequence: Synthetic coding sequence
atgggcacaacagaagccacactgcggatggagaatgttgatgtgaaggaggagtggcaagatgaggacttgccacgacccctgccagaagagaccggggtggagttgctcggcagtcctgtcgaggacactagcagtcccccaaacacattaaactttaacggagcgcatcgcaagaggaagaccctcgttgcccctgagataaatatcagcctggatcagagtgaaggcagcctactgtccgatgatttcctagatactcctgacgacctggatatcaacgtggatgacatcgagaccccggatgagacagactccctcgaattcctcggaaacggaaatgagcttgaatgggaggacgatacccccgtagcaacggcaaagaacatgccaggggactcagcggacttattcggcgatgggactaccgaggacggctccgcggctaacggtaggctgtggcggacggttatcatcggagagcaggagcacagaattgatctgcatatgatacgtccatacatgaaagtggtgacgcacggtggttactatggcgagggcctgaacgcaatcatagtctttgccgcatgttttctgcctgatagcagtctgccggactaccattacatcatggagaacctgtttctgtacgtcatctcatctcttgagctactggtggcagaagactatatgattgtgtacctgaatggcgctacacctcgccgaaggatgccgggaatcggctggttgaagaagtgttatcagatgatcgacagaaggctgcgcaaaaacctcaagtccttgatcatagtccacccatcatggttcattaggacagtgctcgcaatcagcaggcccttcatttccgtcaagttcatcaacaagatccaatatgtgcactcgctggaagacctcgagcagttaatccccatggaacatgtccaaattcccgactgtgtgctgcaatacgaagaggagcggctcaaggcccgtagggagtcagccaggccccagcccgagttcgttcttcccaggtctgaagagaagcctgaggttgcgccagtcgaaaacagatctgctctggtctctgaagatcaggaaacaagcatgtcctag

SEQ ID NO: 215031 - DNA, 1050 bp, Artificial Sequence
  Description of Artificial Sequence: Synthetic coding sequence
atgggcactactgaggctaccctcagaatggaaaatgtggatgtgaaagaagaatggcaagatgaggatccgcctccaaataccctcaattttaatggagcccaccgcaaacgaaagaccttggttgctcccgagatcaatatctcgctggatcagtcagaaggctcattgctttcagatgactttttggacacacccgatgatctggatatcaatgttgacgatatcgaaacaccagacgagaccgatagtttggaattcctgggcaatggaaatgagcttgagtgggaggacgacacgcccgtggcaactgctaaaaatatgcctggagattctgcagacctgttcggggatggcaccacagaggacggctctgctgccaacggcaggctgtggagaacggtgataatcggtgagcaggaacataggatcgatttgcacatgataaggccttatatgaaggtggtcacacatgggggttattacggagaggggctgaacgccattattgtcttcgctgcatgttttcttcctgactcttccttgccagattatcactacatcatggagaatctgttcctatacgtgatctcttctctcgagctcctcgtcgctgaggattacatgattgtgtatcttaatggggctactccccgacggagaatgccaggtatcgggtggttaaagaaatgctaccagatgatcgacaggagactgcgtaaaaaccttaaaagcctgataatagtgcacccttcctggtttatacgcaccgtcctggcaatctctcggcctttcatctcagtcaaattcattaataagatacagtacgtgcactctctggaggatctcgagcaactgatcccgatggaacatgtgcaaatacccgattgcgtattacagtatgaagaggagcgtttgaaagctaggcgcgagagcgcacggccacaacccgagtttgtgctgccccgtagcgaagaaaaacctgaggtcgcaccggtcgaaaacagaagcgccctggtaagtgaggaccaggaaaccaggatgagctag

SEQ ID NO: 215032 - DNA, 2448 bp, Artificial Sequence
  Description of Artificial Sequence: Synthetic coding sequence
atgaagtcgaaccaggagcgttctaacgagtgcctgcccccaaagaagcgcgaaatccctgccaccagccgttcatcagaagaaaaagccccaacgctgccaagcgataaccatcgcgtagaaggcactgcctggctaccgggaaatcctggcggtagggggcacggcggagggagacatggtcccgcagggacctccgtggagctgggactccagcagggcatagggttgcataaagccctctctacaggactggattattcgccacctagcgcgccacgtagtgtacccgtggccactaccctgcctgctgcatacgccaccccgcagcccggaacaccggtgagccctgtgcagtacgcacaccttccacacacctttcaatttattggctcatcgcaatattcgggaacttacgcctcattcatcccttcccagttgatacccccaaccgcgaatcctgtgactagcgcagtggctagtgcagccggagccacaactccctctcagagatctcagcttgaggcctactctaccctccttgccaacatgggatcgctgtcacagacccccggacataaagccgagcagcagcagcaacagcaacagcaacaacagcagcagcatcagcatcagcagcaacaacagcagcagcagcaacagcagcagcagcagcatctgtcccgggcaccgggactgattacgcccggaagccctcctcccgcacaacagaatcagtatgtgcacataagctctagccctcaaaacacaggcaggacagccagcccgccagctattccagtgcacctgcatccccaccaaacgatgattcctcatacactcacccttggtccccctagccaggtcgttatgcaatatgccgatagcggttctcactttgttccgagagaggcaaccaaaaaagctgagagttctagattgcagcaggcaattcaggctaaggaagttctcaatggggaaatggaaaaaagcaggcgatatggagccccttcgtcagccgacctcggactggggaaagctggcggtaaatccgtacctcatccatatgagtccagacacgtcgtggtccacccatcaccaagcgactacagcagtagagaccctagcggagtgagggctagtgtgatggtgctccccaattcgaacacccccgcagcggatcttgaggtacaacaggccacccacagagaagcaagcccctcgaccctgaatgacaaaagtggactccatctgggtaaacccggacatcgaagctacgccttgagccctcacactgtgatccagaccacccactccgcaagcgagcctctgccagttgggttgcccgctaccgctttctatgccggaacacagccaccagtgatcggctatctcagtggacagcagcaggccatcacctacgccggttctcttccgcaacacctcgtgattcctggaacccagcctctgctcatccctgttggaagcacagacatggaagcctctggagcagctccagcaatcgtcaccagttctccacagtttgctgcagtgccacacacctttgtcactactgccctgccaaaatccgagaacttcaacccagaggctttggttacgcaagccgcttatcctgctatggtccaggcgcagattcacctgcctgtcgttcagagtgtggcctctcccgcagcggctcctcctaccctgccaccctactttatgaagggatccattatccagctggccaatggagagctcaaaaaagttgaagacctgaagaccgaggattttatccagtctgcagagattagcaacgacctaaagattgattcgagcactgtcgagaggatcgaggattctcacagcccaggggtggcggtgatccaattcgccgtaggcgaacatcgggctcaggtcagcgtcgaagttctcgtggaatatccgttcttcgtattcggacaagggtggtccagttgctgccccgagcgaacttcccagctgtttgatctgccttgctccaaactgagcgtgggtgacgtgtgcattagtttaaccttaaaaaatttgaagaatggctctgtgaaaaagggtcagcccgtagacccagcttcagtcttgctgaagcactcaaaagctgacggcctggccggttcccgtcatcggtatgctgaacaggagaacgggatcaatcagggcagcgctcagatgctgtctgaaaatggggaacttaaatttcctgaaaagatgggactgcccgcagctcccttcctgacgaagatcgaaccaagcaagcccgctgcgacgcgcaaaagaagatggtcggccccagagtctcggaaattagagaagtctgaggatgaaccacctctcacactcccgaagccctcacttatccctcaggaggttaagatttgcattgaaggcagatccaatgtaggaaaatag

SEQ ID NO: 215033 - DNA, 2448 bp, Artificial Sequence
  Description of Artificial Sequence: Synthetic coding sequence
atgaagtcaaatcaagagcgaagtaatgagtgcctgcctccaaaaaagcgagagatcccagccacctctcgaagttccgaggagaaggccccaacacttccatctgataaccatagggtggaaggcaccgcctggctcccgggaaaccctggtggacggggtcatggcggtggtcgccacggaccagccggaacgtccgtggagctggggctgcagcagggcattggcttgcacaaagcacttagtactggattggactattccccacccagcgctcccagaagcgtgccggttgccactacactgcctgctgcgtacgctacaccgcagcccggaacaccggtctcacccgtgcagtatgcgcatctcccccacacatttcagtttatcggaagcagccaatatagtggaacgtatgcttcattcattccatctcagctaatccccccaaccgccaaccccgttacatccgctgtggcgtccgctgcgggagccaccaccccatctcagcgcagccaactcgaggcctactccactctcttggctaacatgggaagcctgagtcagaccccgggtcacaaagcagagcagcagcagcagcagcagcagcagcaacaacagcagcaccagcatcaacagcaacaacagcaacagcagcagcagcagcagcagcaacacctctcccgtgccccaggtttaatcacacccggatccccccctcctgcgcagcagaaccagtacgtgcatatctccagttctccacagaacacaggaagaacagcatcaccacccgctattcctgtgcatctgcacccacaccaaaccatgattccacacacactcacactcggacccccatcacaggtcgtcatgcagtatgccgattcaggatcacacttcgtgcccagggaagcaactaaaaaagcagaatcttcccggctgcaacaagctatccaggcaaaagaggtgctgaacggagaaatggagaaatcccgcagatatggcgcacccagctctgcggacctgggcctgggcaaggcgggtggaaagagtgttccccacccttacgagagcaggcacgtggtcgtgcacccttctccgagtgattattctagcagagacccgagcggcgtcagagcgagcgtgatggtgctgcccaactcaaacacccccgctgccgatctggaagtacagcaagccacacacagagaagccagcccatccacacttaacgataaatccgggctgcacttaggaaagcctggccatagatcgtatgccctgagtcctcacactgtcattcagacaacgcattcagcctccgaaccgcttccagtgggattaccggcaaccgctttctatgcaggaactcagccccctgtgatcgggtatctgagtgggcagcaacaagcaattacctacgccggtagcctcccacagcatttagttatcccaggaactcagccactgctgattcccgtgggctccaccgacatggaggcctccggggctgctcccgctattgtgacatcaagtcctcagttcgccgcagtcccccacacttttgtcactactgctctgccaaaatcagagaactttaaccccgaggctcttgtgactcaggcggcttatccagctatggtgcaggctcagattcatcttcctgtggtgcagtctgtcgcttctccggctgcagccccaccaactctgcctccttattttatgaagggatccattatccaattagccaacggagaattaaaaaaagtcgaagacctgaagacagaggattttattcagtccgccgagatatcaaatgacctgaaaattgatagctcaacagtcgaacggattgaggattctcacagccccggtgtggcagtaattcaatttgctgtgggcgagcatcgggcacaggtcagcgtagaagtgttagttgagtatccattcttcgtattcggacaagggtggtcttcatgttgccccgagcggacgtctcagctattcgacttgccctgttccaagctcagtgtgggggacgtgtgcatttcacttacactaaaaaacctgaaaaacggctcagtcaagaagggccagcctgtggaccccgcttctgtattgctcaagcactcgaaggccgatggactcgccggaagtcgccacaggtacgcagaacaggaaaacggtataaatcaagggagcgctcagatgctgagcgagaacggagaattgaagtttccagaaaaaatgggcttacccgcagctccctttctgaccaagattgaacctagcaaacctgccgctactcgaaagcgccgatggtctgccccagaaagcagaaagctggagaaatcagaagatgagccccctctgactctgcccaaaccttctctaatacctcaggaagtgaagatatgtatcgagggacgcagcaacgtcggcaagtag

SEQ ID NO: 215034 - DNA, 2448 bp, Artificial Sequence
  Description of Artificial Sequence: Synthetic coding sequence
atgaaatctaaccaggagagatctaatgagtgcttgcctcctaagaagcgagagatccctgccacttccaggtcaagtgaagaaaaggcccctacgctccctagtgacaaccatcgggtcgaaggcacagcttggttaccaggcaacccaggaggcaggggccatggcggaggacgacatggcccagccggtacctccgtcgaactgggtctccaacaaggcataggacttcacaaggccctgagcacagggcttgactattctcctccttcagcgcctcgcagcgtgcccgtagctactacactccccgcagcctatgccacacctcaacctggaacaccagtcagtcccgtgcagtacgcccacctgccccacacttttcagtttatcggctcttcgcaatacagcgggacatatgcctcttttataccctcacagctgatccctccaaccgccaacccagtaacatccgccgtggcctcagctgccggagcaactacaccaagccagaggagccagctggaagcatattccacccttctcgcaaacatgggttctctctcccagacccccggacataaagccgagcagcagcagcaacagcagcagcagcagcagcagcaacatcaacaccaacagcagcagcaacagcagcagcaacagcagcaacagcaacacctgagtagagctcctggattgatcacgcctgggagcccccctccggcacaacaaaatcaatacgttcatatctcatcttcacctcagaacacgggacgaacagctagtcccccagccatcccagtgcatctccacccgcaccaaacaatgattccacataccctgaccctgggcccaccgagccaggtggttatgcagtacgctgattcagggtcgcattttgtgcctcgggaggcgacaaagaaagccgaaagctctcggctgcagcaagcaattcaggcaaaagaggtattgaacggagagatggagaagtctagaagatatggggctcctagctctgctgacttagggctgggcaaagcaggaggaaagtccgtacctcatccctacgaaagtagacatgtcgtcgttcatccctccccatcggactattcatccagggacccctctggagtaagagcaagcgtcatggtattgcccaacagcaacacaccagccgctgacctggaggtgcagcaagctacacacagagaggcctctccatctacactcaacgataagtcgggtcttcatcttggcaagcccggacaccggagttatgccctgtcaccccatacggtaattcagacgacccattcagcgagtgagccactgcctgtcggcctcccggcaacagccttctatgctgggacccaacctccagtgatcggatacctgagcggtcaacagcaggcaattacttacgccggttccttgccacaacatcttgtgattcctggtactcagcctttgttgatcccggtcggcagtactgacatggaggcgagcggggctgctccggctattgtgacatcctcccctcagttcgccgctgtcccacatacattcgtgactactgccctccccaaaagcgaaaactttaaccccgaggccctggtcacccaagccgcataccctgctatggttcaagctcagatacatctaccggtagtccagtccgtggcttcccctgccgctgctccacctacattgccaccgtacttcatgaagggcagcatcatccaactggcgaatggcgagttgaaaaaggtggaggacctgaaaacggaggacttcatacaaagtgcagagatctcaaacgatcttaaaatcgattcgtcaacggtcgaacggattgaagactcacactctcctggagtggccgttatccagttcgccgttggcgaacacagagcgcaagtgtctgtggaggttctcgtggagtaccctttttttgtatttggccaggggtggagctcttgctgcccagagcgaacctctcagctctttgatcttccctgtagtaaattgagcgtaggtgacgtctgtatctccctgacactcaagaaccttaagaacgggagtgtcaagaagggacaacctgtggaccccgcttcagtgctcctcaagcactcgaaggccgatgggttggctgggagcaggcacagatacgcagagcaggaaaacgggatcaatcaaggctccgcacaaatgctgtctgaaaacggtgagttgaaattccctgagaaaatgggactgcccgcagccccatttctgacaaagatcgagcccagcaaaccagcagccactcgcaagcgacgctggtccgccccagaatcaaggaaactcgagaagagcgaagatgagcctcctttgactctgcccaaaccctcacttatcccacaggaggtgaaaatctgcattgagggcagaagcaacgtgggcaaatag

SEQ ID NO: 215035 - DNA, 1428 bp, Artificial Sequence
  Description of Artificial Sequence: Synthetic coding sequence
atggccgcaccgagacctcctcctgctaggctctccggagttatggtgcctgcaccaattcaggacctcgaggccttacgtgcccttacagctttgtttaaagaacaaagaaatcgggagaccgcccctagaaccatctttcagcgagttctggacatcctgaaaaagtccagccacgccgtcgagctggcttgtcgcgatccgtcccaggtggaaaacttggcatctagtctccagctgataacagagtgcttccgatgcctgagaaacgcttgcattgaatgcagtgttaatcaaaactccattcgcaacttagacaccattggcgtggctgtggatctgatactcctatttcgggagcttagagtggaacaggagagtcttctgacagcctttagatgtgggctgcaattcctcggcaacatcgcatcgagaaatgaagacagccagtctatcgtgtgggtccacgcatttcccgaactgttcttatcctgcctgaaccacccagataaaaaaatcgttgcctatagctctatgattctgtttacaagcctcaaccatgaacgcatgaaagagctggaggaaaatctcaacattgcaatcgacgtaatcgacgcctaccaaaaacaccccgaatcagagtggccgtttctgatcatcactgatttatttctgaagtcacctgagctcgtgcaagctatgttccctaaactgaataatcaggagcgggttacactgttggacctaatgatcgccaagatcacctcagacgaacctcttactaaagatgacatcccggtattcctccgacatgcggaactcattgcgtcaacgttcgtggaccagtgtaagaccgtattgaaattggcatccgaagaacctcccgatgacgaggaggctctcgctacgatacggttgctagacgttctgtgtgaaatgacagtgaatactgagctgttgggctacctccaggtgttccctggcctcctggagcgcgtcattgacctccttcgcgtgatacacgtggccggtaaagaaacaacaaacattttttcaaactgtggctgcgtgcgtgccgagggggatatttctaacgtggctaacggcttcaagtcccacctcataaggctgataggcaatctgtgctacaaaaacaaagacaatcaggacaaggtgaatgaactggatgggattccattaatactggacaattgcaatataagcgactctaacccttttctcacccagtgggtgatctatgcaatccgaaacctcaccgaggacaattcgcaaaatcaagatcttattgccaaaatggaggagcagggcctagctgatgcctcgctgctaaaaaaggtcgggtttgaagtggaaaagaagggcgaaaagctgattctgaagtccacacgggacacaccaaaaccttag

SEQ ID NO: 215036 - DNA, 1236 bp, Artificial Sequence
  Description of Artificial Sequence: Synthetic coding sequence
atggccgctccccgacctcccccagccaggctttctggggttatggtgcccgcacctatccaggatctggaggccctccgggcacttacagccctcttcaaggagcagcgcaacagaaatctggatacaatcggggtggcggtagacctcattctgctttttcgggagctgcgagtggagcaggagagccttttgaccgcattcaggtgtggcctgcaatttctcggaaacatcgcctctcgaaacgaagactcccagagtattgtttgggtgcacgcttttcccgagctcttcctgtcatgtttaaatcaccctgataaaaaaatagtggcctatagtagcatgatcctgtttacttctcttaaccatgagaggatgaaagagttggaggagaatttaaatattgccatcgacgtaatcgacgcataccagaaacatccagaaagtgagtggccgttccttattatcactgacctgttcctcaagtcacctgagctggtccaggccatgttccctaagcttaacaatcaagaaagagtgacattacttgatttaatgattgcaaagatcacatccgacgagccgctgaccaaggatgacataccggtgttcttgcgtcacgcagagctgattgcatcaacttttgtcgatcagtgtaaaacagttctgaagcttgcatctgaggaaccacccgacgacgaagaggccttggccaccatccgactcctagatgtgctgtgcgagatgacagtcaataccgaattattaggctatctacaggtatttcccggattgctggaaagggtgattgacttgttgagggtgattcacgtggcaggcaaagagaccacaaatatcttcagtaattgcggttgtgtgcgggctgagggcgatatttctaacgtcgccaacgggttcaagtcacatctgataaggttgataggcaacctgtgctacaaaaacaaagacaatcaagataaagtgaatgagcttgatgggatcccattaatcctggataattgcaacatatccgactctaatccctttcttacgcagtgggtaatttacgctatccgcaatttgactgaagataattcccagaaccaggatcttattgctaagatggaagaacagggcctcgccgacgcctctctactgaagaaagtgggtttcgaggtggagaagaagggggaaaaactgatcctgaagagtacacgggacactcccaagccatag

SEQ ID NO: 215037 - DNA, 1362 bp, Artificial Sequence
  Description of Artificial Sequence: Synthetic coding sequence
atggcggctccgaggccccctcccgctcgtctgagtggggtgatggtgccagcaccaatccaagatttagaagccctacgggctctgaccgcactgtttaaggagcagcgcaatcgcgagacagcccctaggaccatcttccagcgggtattagacatccttaagaagagttcgcatgctgttgagcttgcctgtagagatccatcgcaggtggagaaccttgcgtcatcgctgcagctcatcactgagtgctttcgttgtttgagaaatgcttgcatcgagtgcagcgtaaatcaaaattctattagaaacctggacaccatcggggtggccgtggatctgatcctcctcttccgggagttgagagtagagcaggaaagtctgctcactgcttttagatgtggcttgcaatttctgggcaacattgcgagtaggaatgaggattcccaatcaatagtgtgggtgcatgcatttcccgagctgttcctaagttgccttaaccatcccgataagaagatcgtggcatacagctctatgatcctgttcacctcactgaatcacgaacgtatgaaagaactggaagaaaacctgaatatcgccattgacgtgattgacgcttaccagaaacatccagagagcgaatggccattccttattataacagacctcttccttaagtcaccagagttggttcaggcgatgtttccaaagttgaataatcaggagcgggtgaccctgttggacctcatgatcgccaagattacgtcagatgagcctttaacaaaggacgacataccagtcttcttgcggcacgcagaattaatcgcttccacgttcgtagatcaatgtaagactgtacttaagctcgcatccgaggagcctccggtgatgtatccctatatgcgaatcgtgggaaaattccgactgcttgatgtcctttgcgagatgaccgtgaacactgagctcttgggctatctacaggttttcccgggtctcctggagcgggtgatcgatctcttgagggtcatacatgtcgctggcaaggaaacgaccaatattttcagtaattgcggatgtgtgcgggctgaaggagatatttccaacgtggcaaatgggttcaagtcccacctgattagactcattgggaacttatgctacaagaataaggataatcaggacaaggttaacgagctcgatggaataccacttattctggataactgtaacattagtgattccaatccgtgtagcgatccagtgggcgatatctgtcaccctaaaccttatagacggcaacaaccaaaacctcggttcgactgtaaggatgggggaactggggcaggacgatgcattcccacctag

SEQ ID NO: 215038 - DNA, 2070 bp, Artificial Sequence
  Description of Artificial Sequence: Synthetic coding sequence
atgaaaccggtacacgagcggagccaggaatgccttccgcctaagaagagggatttgcctgtaacctccgaggacatgggacgcacaactagctgtagcaccaaccatacaccgagctctgatgcgtctgagtggtctagaggggtggtggtcgcaggacaaagccaggctggagccagagttagtctcggaggagatggcgcagaagccataactggtctgaccgtcgaccagtatgggatgctatataaggtcgccgtacccccagcaacatttagtcctaccggcctgccatccgtggtaaatatgagcccccttccgccaacattcaatgtggcatcatcattgatccaacaccctggaatccactaccctcccttacactacgcccaactcccctcgaccagcttgcagttcataggctcgccctacagccttccctacgcagttcctccaaactttctgcccagccccctgctcagcccctccgccaatctggctacttctcacctgccccactttgtgccgtatgccagtctgttagcagaaggagccacaccacccccacaggcccctagtcccgctcactctttcaacaaagccccaagtgctaccagccctagtggacagctgccccaccatagcagtactcaacccctcgatctggctcccggtcgtatgcccatatactatcagatgtctcgactcccagccggatacacattgcacgagacaccccctgccggagccagtccggtgctgacaccacaggagtcccagtccgcgctggaggctgccgcagccaatgggggacagcggcctagggaacgcaatctggtgcggcgagagagcgaggctctcgattcacccaactccaagggagaggggcaggggctggtgcctgtggtcgagtgcgtggtggacggtcaactatttagtggaagccagacccccagggtggaggtggctgctcccgctcatcggggaacgccagacactgatctcgaggtccagagagttgtgggagccttagcatcacaagactaccgggtggtagcagcccagcggaaagaagagcctagcccccttaatctttctcatcatacacccgatcatcaaggcgagggacggggatctgcaagaaaccccgctgagctggcagaaaagtctcaggcccgaggattctaccctcagtcccatcaggaacccgtaaaacacagacccctgccaaaagccatggtagtggcgaacggtaacttagtgcccaccggtacagacagcgggctccttcctgtgggctccgaaatcttggtagcctcatcgttagatgtccaggcacgggcaacattcccagacaaggaaccgacacctccacccattactagttcacacctcccttctcacttcatgaagggcgcaattatccagctcgccacaggcgaactgaaacgagtagaagatctccagacccaggacttcgtgcgttccgctgaggtctcaggcggactcaagattgacagttccaccgtggtcgacattcaagagtcgcaatggcctggatttgtcatgctgcacttcgtggtaggggagcaacagagcaaagtctctattgaggtgccccctgagcacccgtttttcgtgtatggccagggttggagctcctgtagtcccggtcgcacaactcaactattcagcctcccctgccatagactccaggtcggcgacgtctgcatctcaatctccttgcagtccctgaactccaactctgttagtcaggcgtcttgcgcacctccaagccagctgggcccaccccgtgaacggccagagagaactgtcctgggatccagggaactatgcgactctgaaggcaaaagccaacccgcaggagaaggatcccgcgtcgtcgagccatcacagcccgagtccggtgctcaggcctgttggccagcccctagttttcagaggtactctatgcagggcgaggaggccagagccgctctgctgcggccatctttcatccctcaggaagtcaagctgtccattgaagggaggtctaacgccggtaagtag

SEQ ID NO: 215039 - DNA, 3942 bp, Artificial Sequence
  Description of Artificial Sequence: Synthetic coding sequence
atgcggtcggccgctgccgcaccacggtcccctgcagttgccaccgaatcaagacgatttgccgcagcccgttggcccggatggcggagtctccaaagaccggctcgccgatctgggaggggagggggtggcgctgcccctggcccatacccctcagccgctcctccgcctcccggtccgggtcctcctccgtctcggcaatcgagtccaccctctgccagcgactgttttggctctaatggaaacggagggggtgccttcaggccaggaagtagaagactcctgggcctcggtggtccacctagaccattcgtggtactcttattaccactggctagcccaggcgcaccgcctgccgctcccacccgggcatctccgttgggtgcccgagcttctcctcccaggagcggggtgtccctcgcgcgtcccgctccaggctgcccacggcctgcctgcgaacctgtttatgggccactcaccatgagcctaaaaccacagcagcagcagcaacagcaacaacagcaacagcaacagcagcagcagcagcagcagcagcagcagcagcccccaccagctgccgcaaacgtacgcaaacccggaggctctggcctactggcttcccctgcagctgcaccttctccaagctcctcctctgttagctcatcgtccgcaaccgcaccttcctctgtggtagctgctacctccggcggaggtagaccgggacttggaagaggcagaaattctaacaaagggctacctcagagcaccatcagcttcgatggcatctacgctaatatgcgcatggtccatatcttaacctctgtggtgggaagtaaatgcgaggtccaggtgaaaaacggcggaatctacgaaggagtgttcaaaacttattctccaaagtgcgatctggtcttggacgctgcccatgaaaaatcaaccgagtcaagtagtggccctaaaagggaggaaataatggaatcaattctattcaaatgctccgacttcgtcgtggtccagtttaaggatatggattcttcttatgccaagagggatgcttttaccgactccgccatctcggctaaggttaacggtgaacataaggaaaaagacctggagccatgggacgcgggagagctcacagctaatgaagaacttgaggctctggagaacgacgtgtccaatggttgggatcccaacgacatgtttcgatacaacgaggagaactacggggttgtatcaacatatgacagtagcctttccagctacaccgtcccgttggaacgcgacaactcagaggagtttctcaagcgagaggctcgggctaatcagcttgcagaggaaatcgagagcagtgcgcagtacaaggccagagtggcattggagaacgatgacaggagcgaggaggagaaatatacagccgtccagagaaactcaagcgagcgggaaggtcatagcatcaacacaagagagaacaaatacatcccccctggacagcgcaacagggaagttataagttggggctccggaagacagaacagccctaggatgggccagcccggtagcggatctatgccatctcggtctacttctcacacctctgattttaaccccaattccggcagcgaccagcgagtcgtgaacggcggagtcccatggccgagcccttgcccatcccccagtagccggccaccttcaaggtaccagagtggtcccaatagtttgccgccacgcgctgccacccccacgaggccacctagcaggcccccaagccgtccaagcagacccccatctcatccgtctgcccatggaagccccgctccagtatcgaccatgccaaaaagaatgagcagcgaggggcctcccagaatgagtcccaaagcgcagagacaccctcggaaccatcgggtgtccgcagggagaggttcgatttcatcgggcctagagttcgtctctcacaaccctccaagcgaggcagccactccccctgtggctcgtacgtctccctccgggggaacctggtcatccgtggtttcgggggtgccgaggctgagcccgaagacccacagacccagaagcccgaggcaaaattccataggaaatacacctagcggacccgtgcttgctagcccccaggcaggcataatccctaccgaggccgtggccatgccaataccagctgcctctcccacccccgcaagcccagcctctaacagggcggttactccctccagtgaagccaaagatagtaggctacaggaccagcgacaaaacagtcctgccggaaataaagagaacatcaaacccaatgagaccagtccgtctttctcaaaggccgaaaacaaaggaatatcaccggttgtctccgaacacaggaaacagatcgacgaccttaaaaagttcaagaacgattttagattgcagccatccagcacctctgaaagcatggatcagctgctgaataaaaatcgtgaaggagaaaaaagccgggatcttataaaagataaaatagagcctagtgctaaggactccttcatagaaaactcttcttctaactgcacttcgggcagtagcaagcctaatagtccaagcatttccccatcgattctgagtaacactgagcacaagcgtggaccagaggtgacctctcaaggtgtccagacttcatcacccgcatgcaagcaagagaaagatgataaggaagagaagaaagacgctgcggaacaggtccgcaagagtaccctgaacccaaatgcgaaggagtttaaccctaggtctttctcccagcccaagccatccaccaccccaactagccccaggcctcaggctcaaccttcccccagcatggtcggccatcagcagcctacccctgtgtacacacagcctgtctgttttgctcctaatatgatgtaccctgtaccggtgagtcccggagtgcagcccctgtacccaattccgatgactccaatgcccgtgaaccaggctaagacatatcgcgcagtgcccaatatgccccagcagagacaggaccaacaccatcaatcggccatgatgcatcccgcaagcgccgctggaccccctattgcagcaacacccccagcatattctacacagtatgtggcctacagcccgcaacagttccctaatcaacccctcgttcaacacgtgccgcattatcaatcgcagcaccctcatgtttatagcccagttattcagggcaatgcacgcatgatggcaccaccaacacatgcccagccaggcttggttagcagcagcgcgacacagtatggcgctcatgaacagactcacgccatgtacgcatgtccaaagcttccctataacaaggagaccagcccttcattctacttcgcaatttctacaggcagcttggcccaacaatacgcccaccccaacgctacccttcatcctcacactccgcacccccagccgtctgcgaccccaacaggtcaacaacagtctcagcacggtggaagccatccagcgcctagtcctgtccaacaccatcagcatcaggccgctcaggctctccacctggcttccccccagcaacagtcagctatctaccacgcgggtctagccccaacgccacccagcatgactcctgcaagtaacacacaaagtccccagaactcatttcccgctgcgcaacaaacagtgtttactatccacccatctcacgtgcagcctgcctatacaaacccccctcacatggcgcatgtgccacaggcccacgtacagagcgggatggtgccttcacacccaacggcacacgctccaatgatgttgatgactacccagccacccggagggccacaagccgcactggctcagtccgcattgcagcccatccccgtgtctacgaccgcacattttccttacatgacgcacccctctgtccaagcacaccatcaacagcagctgtag

SEQ ID NO: 215040 - DNA, 2988 bp, Artificial Sequence
  Description of Artificial Sequence: Synthetic coding sequence
atgcgcagcgccgcagccgctcccagatcccctgcagtcgcaacagagagtcggcgattcgcggctgcacgctggcccggatggagaagcttacagcgcccagcacgacggagcggcaggggcggtgggggtgctgcgccaggcccttatccctctgcagcgccacccccacctgggcctggaccccctccatctcggcagagcagccctccctcagcgagtgactgcttcggttccaatggcaacgggggtggcgcttttcgccctggcagcagaaggttgctgggcctgggtgggccaccaaggccattcgttgttctcctgttgccactggcttcccccggtgcaccgcctgccgctccaaccagagcctcccccctgggcgctcgagccagtccgcctcggtccggagtgagtctagctcggcctgcacctggttgtcctcgcccagcatgtgaaccggtctatggcccacttaccatgagccttaagcctcagcagcagcaacagcagcagcagcagcagcagcagcagcaacagcagcagcaacagcagcagcagcagccacctccagccgctgccaacgtgagaaagcctggtggatctggcctgctcgcaagccccgcagcagccccttccccctcaagctccagtgtgtcctctagcagcgcgactgccccttcgtcggtcgtcgccgctacgtctgggggaggacgcccaggtctgggacgtggaagaaatagcaacaaaggcctcccgcagagtacaatatccttcgatggcatttacgctaacatgcgaatggttcacattctcacctcagttgttggatccaagtgtgaggtgcaagtgaaaaatggtggcatctacgaaggagtgttcaaaacctactcgccaaagtgtgatttggttctggatgccgctcacgaaaaatctactgaaagctcctccggcccaaaacgggaggagataatggagtccattctgttcaagtgtagcgatttcgtcgtggtacagtttaaggacatggatagctcgtacgccaagagggatgccttcaccgattccgccattagcgcaaaagtgaatggcgaacataaggagaaggatcttgagccatgggatgcaggcgaactgactgccaatgaggagcttgaagcgcttgagaatgacgtgtctaacggttgggaccctaatgacatgtttcggtataacgaagagaattacggagtcgtgtcaacttacgacagctccttatcatcatacaccgtacctctcgagcgcgacaactcagaggaattcctgaagagagaagccagagctaatcagttggctgaagaaattgagagtagcgcccagtataaagccagagtggccctcgagaacgatgatcggtcagaggaagaaaagtacaccgcagtgcagcgaaattcaagcgagcgcgaggggcactcaatcaacacacgggagaataagtacattcctcctggtcagaggaaccgggaggtcatctcctgggggtccggtaggcagaacagtccaaggatgggacagcccggaagcgggagcatgccctcacggtctactagccatacctccgactttaatcccaatagtggaagtgatcagcgggttgtaaatggaggcgtaccttggccctcgccctgtccaagtcctagtagtaggcctccaagcagataccagtccggtcctaattccctgcctccacgcgctgccaccccaacccgaccccctagtaggcctccaagccgtccttctcgcccacctagtcacccttctgcccatggcagccctgcacctgtgagcactatgcctaagagaatgtccagcgaggggcctccacggatgagcccaaaagcccaaagacaccctcgcaaccatagagtgtccgcaggcagagggagcatttccagcggcttggaattcgtaagccacaacccaccctctgaggctgctacacctccggttgctcgcacatcccctagtggcggaacgtggagttccgtggtgagtggagtaccaaggctgtcccctaaaactcatcggcctagatcccctcgccagaacagtattggaaacacccccagtggccctgtgctagcctcaccccaggccggaatcattccaacagaggccgtggctatgcctatccctgccgcatcccctacgccagcaagccctgccagtaatcgcgctgtgacaccatccagcgaggccaaggattcgagactgcaggaccagcgccaaaattctcctgccggaaacaaggagaatattaagccaaatgagacctcccccagcttttcaaaggccgagaataagggtatttctcctgtggttagtgagcaccgaaaacaaatcgatgacctaaagaagtttaaaaacgatttccggctgcagccaagcagcaccagcgagagcatggatcagctactcaataaaaacagggaaggcgaaaagtcacgggatctgatcaaagacaagatcgaaccctcagcaaaggactcctttatagagaactccagctccaattgcacatccggatctagcaaaccgaattcccccagtataagccccagcatcctgtcgaatactgagcacaagcgtggcccagaggtaacgagccagggcgtgcagacgtcgagtccagcttgcaaacaagaaaaggacgataaagaggaaaaaaaagatgctgcagaacaggtaaggaagagtacattgaaccccaatgctaaggagttcaatccgcgatccttttctcagcccaagcctagtaccacacccacaagccctcgaccacaagctcagccttctccctcaatggtagggcatcagcagcctactcctgtttacacccagccggtgtgttttgcacctaacatgatgtacccagtgcctgtatccccgggagtgcagtatcagatctgtcctaactcaggtaagaccagcatcatcagagtgccttag

SEQ ID NO: 215041 - DNA, 3189 bp, Artificial Sequence
  Description of Artificial Sequence: Synthetic coding sequence
atgctgaaaccccagcctctccagcagccaagtcaacctcagcaaccaccacccacacagcaggccgtggccaggcgaccacccggtggcacctcaccgccaaacggcggtctgccgggaccgctggccacatcggctgcgcctccagggcctcccgcagcagccagtccctgcttgggcccagtcgcggctgctggatccggattgcgaagaggggctgaaggcatcttggctccccaacctccccctcctcagcagcatcaggaaagacccggagccgctgctattggttccgcacggggtcagagcacaggcaaggggcctcctcagtcccccgtttttgagggtgtgtacaacaactctaggatgctccactttttaactgccgtggttggttctacatgtgacgttaaggtgaaaaacggaaccacttatgaagggatctttaagaccctgtcttccaaattcgaactggccgtggacgctgtccatcggaaggctagcgaaccagcaggcggaccccgaagggaggacattgtagacaccatggtgttcaagccgagcgatgtcatgctggtgcactttaggaatgtggatttcaattacgccactaaggacaagttcacagactccgcaattgcaatgaacagcaaagtaaatggagaacacaaggagaaggtgcttcaaaggtgggaaggtggcgactccaattcagatgactacgatctcgagagcgatatgtctaacggctgggatcccaacgagatgtttaaattcaatgaagagaactatggagtcaagactacatacgatagcagtcttagctcctataccgtgccgctcgaaaaagacaatagcgaggaattccggcagcgggaactgagagcagcacaacttgcaagggaaatcgagtcttctccgcaatacaggctccgcattgccatggagaacgatgatgggagaaccgaggaggaaaaacactcggctgttcagcggcaggggagcggcagagaaagccccagcctggcttccagagaaggcaaatatatccctctgccccagcgcgtgcgggaaggccctagagggggagtgaggtgtagttcttcccgaggcggaaggccgggactaagtagtcttcctcccagaggccctcaccacctggataatagttcccctggccctgggtccgaggccagaggaataaacggcggaccctcacgcatgtcacctaaagcacagaggcctctacggggtgctaagaccctctcctccccatcaaataggccttctggggagacctctgtgccacctccccctgctgtaggccgtatgtatccaccacgaagccccaaaagcgccgctcctgcccctatatcagcctcatgtccagaaccacccatcgggtccgcggtgcccacgagttcggcgtccattccagtgacgtcctccgtctctgatcccggtgtcgggagcatctcccctgcatctccgaagatctcattggcccctactgatgtaaaggagctgtcgacaaaagaacctggcagaacactagagccgcaagagttggccagaatagcaggcaaggtgccaggtctgcaaaacgaacagaagaggtttcagcttgaagagctcaggaagttcggagcccagtttaaactgcagccttcctctagccctgaaaatagcctggatcccttcccaccccgtatcctcaaagaagaaccaaagggtaaggaaaaggaagtcgacggtttgctgacaagcgagccaatggggtctcctgtgtccagtaagacggagtctgtgagcgataaagaggacaagccccctcttgcccctagcggaggcaccgagggtccagaacagccaccgcctccatgcccaagccagactggctctcctccagtgggactgattaagggcgaagataaggatgaaggacccgttgccgaacaagtgaaaaagtcaactctgaaccctaacgctaaagaattcaaccctaccaagcccctgctgagtgtgaacaagtcgacctccacgcccacctctcctggaccaagaacgcattccaccccttccattccagttttgacagctggtcaatcaggcttatattccccacagtacatcagctacattcctcagatccacatgggtcccgctgttcaggcgcctcagatgtacccctaccccgtgtcaaattctgtgcccggacagcagggaaaatatcggggagccaagggcagtctgccaccgcagagatctgatcagcaccaacctgccagcgccccaccgatgatgcaggccgcagccgctgcaggaccacctctcgtagctgccactccatactcctcctatattccttacaacccccagcagtttcccggacagcctgccatgatgcaacccatggcacactaccccagccagcctgtctttgctcctatgttacagtccaatcccagaatgctcacctccggaagccacccgcaggctatagttagctcgtctacaccacagtacccctctgccgagcaacctactccccaggccctttatgcaaccgtgcatcaaagctacccccaccatgctactcagttacatgcacaccaaccacagccagccactactccgaccggaagccagccgcagagtcaacatgccgcaccctcccctgttcagcaccaggccggacaggcaccccacctcggctccggccaaccccagcagaacttgtaccacccgggtgctctcaccggcaccccgccatccttaccccctggaccgagcgcacagtcaccacaaagctccttcccacagcccgctgctgtttacgcgattcatcatcagcagcttccacacggcttcactaacatggcccatgtgacgcaggctcatgtgcagaccggtataacagccgctccaccccctcaccccggagccccacaccccccacaggtgatgttgctgcatccaccccagtctcatggtgggccaccgcagggcgcagttccacaatcaggggttccggcactatcagcatccactccatccccatatccttatattgggcatcctcagggggagcagcctggccaggcacccggattccctggcggtgcagatgatagaattcctcctctacctcccccaggagagctcaaaatcgttctggcagctacctag

SEQ ID NO: 215042 - DNA, 3228 bp, Artificial Sequence
  Description of Artificial Sequence: Synthetic coding sequence
atgctcaagccacagcccctccaacagcctagccagccgcagcaacctccccctacccaacaggccgtggcaaggcggcctcctggaggcactagtccacctaatggaggattgcccggaccactggctacctcagccgctcctcctgggcctcctgccgctgcatcgccctgcctcggaccagttgcagccgctgggagtggcctgcggaggggagccgaaggcattttagcccctcagcctccccctcctcaacagcatcaggagcgccctggcgctgcagcgattggtagcgccagaggtcagagcaccggcaagggcccaccacagagtcccgtgttcgagggtgtttacaacaattcacgcatgttacatttcctgacagccgtggtgggatcaacctgcgatgtgaaggtcaagaacggaacaacctacgagggcatcttcaagaccctctctagtaaatttgaattggccgtggatgcagtgcaccgtaaagccagcgaaccggcaggtggacctcggcgagaggatattgtggacactatggtgttcaagccctccgacgtaatgctagtgcattttaggaatgttgattttaactacgctaccaaggataagttcaccgactctgccatagctatgaatagtaaggttaatggcgagcacaaggaaaaagtccttcaacgctgggagggtggcgacagtaacagcgacgattacgatctggagtctgatatgagcaatggctgggacccgaacgagatgtttaagtttaacgaagaaaactacggtgtgaaaaccacctacgatagcagcctgtcgagctacacggtaccgctcgaaaaggacaattctgaggagttcagacagagagaactccgagcagcacagttggccagggagatcgaaagttccccacaataccgcctccgaattgctatggagaatgatgacggacggaccgaggaggagaagcactccgcagttcagcggcagggctcgggcagagaatccccctcactggcctcgagggaagggaagtatattccccttccccagagagtccgggaagggccacgtgggggagtccggtgctccagcagccgcggtgggaggcccggtctgtcttcgttacccccacgtggtcctcatcatctcgacaactccagcccaggacccggttccgaggctcgtggaatcaatggcggaccctcccgcatgagtcctaaggcacagaggccgcttagaggggctaagactctgtcaagcccatccaataggccttctggagagacctcggtgcctcctccgcctgctgtaggacgcatgtacccccctcgctcccctaagagcgccgctcctgccccaatttctgcaagctgcccggagcctccaatcggatccgctgtccccactagttctgcctccattccagttacgagcagcgtgtcggatccgggtgtaggatccatttcaccggcttcaccaaagatttctctcgcccctaccgacgtcaaagaactgtctaccaaggaaccaggacgaacgcttgaaccccaggagcttgcccgtattgcaggcaaggtgcctggtctgcagaatgagcagaaaagatttcaactggaggagctacgcaagttcggcgctcaatttaagcttcaaccatcttcaagtcccgagaacagtctcgaccccttccctccacggatattgaaggaggaaccaaagggtaaagaaaaggaagtggacggactgctgacctcagaaccaatgggctctccagtcagttcaaaaaccgagagcgtgagcgacaaggaagacaaaccaccactggcacctagcggaggcactgaggggccagaacagcctcctccaccgtgccccagtcagactggctccccaccggttgggctgattaagggggaggataaggatgagggccctgtagccgagcaggtcaaaaaatctactttgaatccaaacgcaaaagaattcaacccgaccaaacctctgctgagcgtgaataagtcaacatcaacccccacatcacccggtcctcgaacccacagcacaccgagcatcccagtgcttaccgcagggcagtccgggctctactctccacagtacatcagctacatcccacagattcacatgggccctgccgtgcaggctcctcagatgtatccttacccggtgtccaatagcgtccccggtcagcagggtaagtaccgtggcgctaaggggagcctcccaccacagcggagtgaccagcaccaacctgctagcgccccaccaatgatgcaggcagcggctgcagctggcccacctttggtggcagccaccccatactcgtcctacatcccatataacccccagcagttccccggacagcccgctatgatgcagcccatggcccactacccaagccaacccgtgttcgcccctatgttacaaagcaaccctcgcatgctgacctctggaagtcaccctcaggccatcgtgtcgagtagcaccccccagtaccccagcgccgagcaaccgacgccccaagctctgtatgcgacggtgcaccagagttatccacaccatgctactcagctgcatgctcaccagcctcagccggctacgactccaactggcagccagccccagtcccagcatgccgcacctagccctgtccagcaccaggcagggcaggcaccgcacctgggatcagggcaaccacaacaaaatctgtaccatcctggcgctcttactggcactccgccatccttgccgcctgggccttccgctcagtcacctcagagcagtttccctcagccagcagcagtttacgcaattcatcaccagcagttgccccacgggtttacaaatatggctcacgtcacccaggcccatgtccagaccgggattaccgcagccccaccgccacatccaggggcaccacacccgcctcaggtgatgctactccacccccctcagagccacggaggccctccccagggtgccgtgcctcaatctggagtgcctgcactgtctgcgtccacaccatccccatacccatatataggccatccgcagggtgaacagccaggtcaggcgccaggttttcccggaggcgctgacgatcgcatccgggagtttagccttgcagggggaatctggcacggtcgggcagagggattacaggttggccaggacgccagggtcctagggggtgaatag

SEQ ID NO: 215043 - DNA, 3135 bp, Artificial Sequence
  Description of Artificial Sequence: Synthetic coding sequence
atgttgaaaccccagccgctgcagcagccatcccaaccgcagcagccccctcccacacagcaggcagttgctcgcaggcctcctggaggcacatccccgcctaacgggggtcttccagggcctctggctacatctgccgcacctcccggtccccctgctgcagcctcaccgtgtctgggcccagtggccgctgccggaagcgggttgcggcgtggtgcagagggcatcctggcaccccaacctcccccaccacaacagcatcaggaacggcctggggcagcagccataggatcggcgaggggccagagcaccggaaagggtccgcctcagtcgccggtcttcgaaggcgtgtacaataattcccgcatgttacactttctgacggcggtggtgggcagcacatgtgatgtgaaagttaagaatggcaccacttatgaaggaattttcaaaaccctgtctagcaagtttgaacttgcagttgacgctgtccatcggaaggcaagtgagcccgcaggcggtcccagaagagaggacattgtcgacactatggttttcaaacctagtgatgtgatgctcgtacactttcggaacgtcgacttcaactatgctactaaagataagttcacagatagcgcaattgccatgaattcgaaagttaatggagagcataaggagaaggtgcttcagcggtgggaaggcggtgactcgaactctgacgactacgatctggaatccgatatgagcaacggatgggaccccaatgagatgttcaaatttaacgaagagaactacggggtgaaaactacatacgatagtagtctgtcgagttacactgtgccactcgaaaaagataacagcgaagaatttcgtcagagggagttgcgggctgcccagctggcgcgagaaatcgaatccagccctcaatatcgactgcgcattgctatggagaatgacgacggacgtacggaagaggagaagcatagcgcagtacagcgccaggggagcggtcgcgaatccccttcgttggcttcaagggaggggaagtacatacccttgccccaacgcgtcagagaaggaccccgtgggggagtgaggtgtagtagctccagaggtggccgtccagggctctcttcactcccacctcgcggtcctcatcatctcgacaactcgtctcctggcccaggaagtgaagcacggggtatcaacggaggtccttcacgaatgtctcccaaagcccaaaggccactgcggggtgccaagacccttagcagtccgagcaatcggccaagtggtgaaaccagtgtgccgccacctccagccgtggggagaatgtacccacccagatccccaaaatcagccgcacccgcacccatatccgccagctgtcccgagccaccaatcgggagcgcggtgccgacttcaagcgcctcaattcctgtgaccagttcagtatctgacccaggcgtggggtccattagtcccgcttccccgaagatcagtctggccccaacagacgtgaaggagttaagcaccaaggaacctggaaggacgctcgagccacaggaactcgctaggatagcaggcaaggtgcccggacttcaaaatgaacagaagagatttcagctggaagaacttagaaaattcggtgctcaatttaaattgcaaccctcctcaagtccagaaaattcccttgatccatttcctccacgaattctgaaagaagagccaaaaggcaaggaaaaagaggtggatggcctccttacctctgagcctatgggcagtcccgtctctagcaaaacagaatctgtgagtgacaaggaagataagccgccattagctccgtctggagggaccgagggaccagagcagccacctcctccctgtcctagtcagacaggatctccacctgttggactaattaagggggaagacaaagacgaaggtcctgtggccgaacaggtcaagaagtccacacttaacccaaacgcaaaagaattcaacccaaccaaaccgttgctttcggtcaacaagtcaacctcaacaccaaccagccctggacctcgtacccactccactcccagcatcccagttctcacagccggtcaatctggcctatactcaccacaatacatcagctatatcccacagatccacatgggcccagcagtgcaggcccctcaaatgtacccgtacccagtctccaattccgtaccagggcagcagggcaaataccggggtgcaaagggaagcctgccgccacagcgatctgaccagcatcagcccgctagtgcccctccaatgatgcaggccgctgcagccgctggtcctcccctggtggccgctaccccatattccagctacattccctacaacccacagcaatttccaggccagccagctatgatgcagccaatggcccactaccccagtcagccagtgttcgcgcctatgctgcagtcaaaccccaggatgctcacatccggctcccacccccaggccattgtctcctcttcaacaccccaatacccgtctgcggagcagcccaccccccaggccctgtatgccaccgtacatcagtcttacccccatcatgctacacagctacatgcgcaccagccacagcccgctacaactcccaccggtagccaaccccagagtcagcatgccgcaccctcccctgtccagcaccaagccggacaagccccacatttgggaagcggccagccccaacagaatctttaccatcctggggctcttacgggtactcctccttcactcccaccagggccttctgcccagtcacctcaaagttccttcccgcaacccgctgctgtctacgccatccatcaccagcagcttccccacggtttcaccaacatggcccacgtgactcaggcccatgtccagacaggcatcactgccgcaccccctccacaccccggagcccctcatcctccacaagttatgttgctccaccccccacaaagccacggcggacctccccaaggagccgtgccacagtcaggcgtacccgctttgtcagcctcaactcctagtccatacccatacatcgggcaccctcaggtgcagagccatccttctcagcagctccctttccacccaccaggaaattag

SEQ ID NO: 215044 - DNA, 1203 bp, Artificial Sequence
  Description of Artificial Sequence: Synthetic coding sequence
atgctgaaaccacaacctcttcagcagccatcccagccccagcaaccacctccaacacagcaggccgtggcaaggagaccacccggaggaactagccctccaaatgggggtctgcccggtcccctggccacgagcgcagccccacctggcccacccgctgcagcttctccatgcctcggccctgtggctgcagctggcagcggtctgcggaggggggcagagggcattctggcgcctcagcctcccccaccacagcagcatcaagagcggcctggggcagccgcaatcggttcagctagagggcaatcgactggcaagggtcccccacagagtcctgtctttgagggtgtttacaataattcccggatgctccacttcctcacagctgttgtgggtagcacatgcgacgttaaggtgaaaaatggtaccacctacgaagggatcttcaagaccctgagttccaaattcgaactggccgtggacgcagttcaccgtaaggcgtcggagcccgctggcggtcccaggcgtgaagacatcgtggacacaatggtatttaagccatccgacgtcatgttagtgcattttcgtaatgtagacttcaattatgccaccaaggataagtttactgattccgccattgccatgaactcaaaagtgaatggggaacacaaggagaaagtgttgcagcgttgggagggaggcgactctaattcagatgattatgatctggagtctgatatgtctaacggttgggatcctaatgagatgttcaagttcaatgaggaaaactacggagtcaaaactacatacgattcttcactgagtagttacacagttcctcttgaaaaggataactctgaggaattccgccaacgggagctacgcgcagcccagctcgcccgtgaaatcgagagctccccgcaataccggttgagaattgcaatggagaacgatgatggccgaaccgaggaggagaagcattcagccgtgcagagacaaggcagcggcagagagagtcccagtctggcctcgagagaaggcaaatacataccgctccccccacaccggggtcaggggcaggggccagcaggcgtggggggatcctgcagtgctccagcacggcctcatcctgtgctgccttctcatccactgatctacagtcctgcgggtgacggacggtctttcatattctactatctctag

SEQ ID NO: 215045 - DNA, 3135 bp, Artificial Sequence
  Description of Artificial Sequence: Synthetic coding sequence
atgctcaagccacagccgttgcagcagccctcacagccacagcaaccaccgcctacccaacaggccgttgccagacgtcctcccggaggaacatcaccgcctaatggtgggttgccgggaccactagcgacttctgccgcaccgccaggaccccctgcggcagcctcgccttgtctagggccagttgcagccgctggctccggactgcggcgaggagctgagggcatcctggctccccagccgcctcctccacagcaacatcaggagaggccaggagcagcagcaatcggaagcgcgagggggcagtccaccggaaagggacccccacaatcccctgtgttcgaaggggtctacaataatagtagaatgctgcactttttgactgccgtcgtcggctcgacatgtgacgtaaaagtgaagaacggaacaacttatgagggaatcttcaagactctgagctctaagttcgaactggctgtcgacgctgttcaccgaaaggccagcgagcccgctggcggtcccagaagggaggatatcgtcgatacgatggtgttcaaacccagcgatgtgatgcttgtccattttcgaaatgtggacttcaactatgctaccaaggataagttcaccgacagcgctatagccatgaacagcaaggtgaacggggaacataaagagaaggttctccagcgctgggaaggtggtgatagtaactctgatgattatgacctggaatccgatatgtctaacggatgggatccaaatgaaatgtttaagtttaacgaggaaaactatggcgtgaagactacttacgactcctcacttagcagctatacggtgcccttggagaaagacaacagtgaggagttccgccagcgggaactgagggccgctcaattggctagagaaatcgagtcctccccacagtatcgactccgtattgccatggaaaatgacgacggcaggactgaggaggaaaagcacagcgccgtgcagcgccaagggagtggacgagaatcacctagtttggctagccgagaaggcaagtatatccctctgccccaaagggtcagggaaggtcccagaggtggggtaagatgtagtagctcacggggtggcaggccaggactgagtagtttgcctccacgtgggccacaccacctggacaacagcagccccggacccggaagcgaggcgagggggatcaacggagggccttccagaatgagcccgaaagcacagcgacctctgcgcggagctaagacactctctagcccatctaatcggccatctggagaaacttctgtgcctccccctccagcggtgggaagaatgtaccccccaagatctccaaagtccgccgcaccagcgcctatctccgccagttgccctgagcccccaatcggttcagcggtgccgacaagttctgcttctatccccgtgacatcctcggtgagcgaccccggtgtggggtcgattagccctgcaagcccgaaaatcagcctcgcccctactgacgttaaagaactgtcgacaaaagaaccgggtcggactcttgagcctcaggaattggcacgaatcgcaggtaaagtccctggtttgcagaacgagcagaagaggttccagctcgaggagctacggaaattcggcgctcagttcaaactgcagccttcctctagccccgagaactcacttgacccattccccccacgcatcctgaaggaggaacctaaagggaaggagaaggaagttgacggcctactcacctctgagcctatgggatctccagtctccagcaaaacagagtctgtctctgataaggaagataagcctccccttgccccatccggcggaaccgagggtcccgagcagcccccaccaccttgcccctctcagactggcagtccacctgtgggcctgattaagggtgaagataaagatgaaggaccagtggcagagcaggtcaagaagagcaccttgaatccgaatgctaaggaatttaatcctacaaagccactgctttccgtgaacaaatcaaccagtacgcccacttcgccagggcctagaacgcattccactccttccatccctgtgctgaccgctggtcagtcaggcctgtacagcccgcagtacatctcctatatcccccaaatccacatgggccctgctgtccaggcgcctcaaatgtatccctaccccgtgtcgaactccgttccaggacagcaaggcaaataccgcggtgccaagggatcgctgccaccacagcggtctgaccaacaccagccagcatccgcccctcccatgatgcaggccgctgcggctgccggtccaccactggtggcagccacaccatactcatcatatatcccctataatcctcagcaattccccggacagccagcaatgatgcaacccatggcccattacccctcacaacctgtgttcgcccctatgcttcagtccaatcccaggatgctcacttctgggagtcatcctcaagccattgtgagtagcagtaccccgcaatatccttcggcagagcaaccaactcctcaggcattgtacgctaccgtccaccagtcatacccccaccacgcaacacagctgcatgctcaccagccacagcccgcaacaacaccaaccggatcccagccccagagtcagcacgccgcaccgtctcccgtccagcaccaggccggacaggctccccacctgggctcaggacagccacagcagaatctctaccaccccggagcgctcactggaactccaccgtctctaccacctgggccatcagctcagtccccccagagcagtttcccccagccagcagccgtgtacgccatccatcatcaacaacttcctcacggttttaccaacatggcacacgtcacacaggcccatgttcagacagggattacggctgcgccaccccctcatcccggagcccctcacccacctcaggtgatgttactccatcccccacagtcgcacggtgggcctccacagggggcagtgccccagagtggcgttcctgctctctctgcatcgacaccgagtccatacccatatatcggccaccctcaggctcctctccctcctcccggagagttaaaaattgttcttgcggctacttag

SEQ ID NO: 215046 - DNA, 3294 bp, Artificial Sequence
  Description of Artificial Sequence: Synthetic coding sequence
atgttgaagccgcagcctctgcaacagcctagccagccccaacagccgccaccgactcagcaagcggtggccagaaggccacccggaggaactagccctcccaacgggggtctccctggccctcttgctacgtccgctgcacctccaggtcctccagctgcggcatcgccgtgtctcggaccagttgcagccgctggatcaggtcttcgccgtggtgcagaggggatccttgccccacagcctccgccaccacagcaacaccaagagcgtccgggtgcagcagccatcggctctgctcgaggacagagcactggcaagggtccacctcagtcgcccgttttcgaaggcgtgtataacaacagcagaatgctccacttcttgactgctgtggttgggtcgacgtgcgatgttaaggtcaagaacggtaccacctatgaagggatcttcaagaccttgtcctcaaagtttgagctggccgtcgacgcagtgcacaggaaggccagtgagcctgcgggaggtccccgtcgagaggatatagttgataccatggtgttcaaaccttcagatgtgatgctggtacatttccgtaacgtggatttcaactacgctacaaaggacaaatttacagactccgccatcgcaatgaactcgaaggtgaacggagagcacaaagagaaggtcctgcagcgatgggaggggggtgattcaaacagcgatgactacgatcttgagtcggatatgtctaacgggtgggaccccaacgaaatgttcaagtttaacgaggagaattatggagtgaagacaacctacgattcttcactgagtagctacaccgttcccctggagaaggacaacagcgaggaatttcggcagcgggagttacgagcagcacagcttgctagggagatcgagtcctctccccagtacagactacgtattgcaatggagaatgacgatggtaggaccgaggaggagaaacactccgccgtgcaaagacaagggtcggggcgtgaaagcccgtctctcgccagcagggagggcaagtatattcccctgccgcaaagagtgcgggagggccctcgtggcggagtgcgatgtagctctagtcgcggaggaaggcctggattgtcaagcctcccccctcgtgggcctcaccacctggacaattccagtcccggaccagggtcggaagctagaggtatcaatggaggacccagtaggatgagcccaaaggcccagagacccttgaggggagcgaaaactctctccagcccaagcaaccgaccaagcggcgaaacttcagtgccgcctccccctgctgtgggcagaatgtaccccccacggagtccgaagtctgccgcacccgcacccataagcgcctcttgccccgagccgccaattgggtcagccgtgccaaccagcagcgcgtcaattcctgtgacgagtagcgtgagtgatcccggtgtggggagcatctctcctgcctccccaaagatctcgctcgcgccaacggatgtcaaggaactgtcaactaaagaaccgggacgcaccttggaaccccaagagcttgcgcgaatcgcgggaaaagtgccagggctgcagaatgagcaaaaaaggtttcagttagaggagctgagaaagtttggggcacagtttaaactccagccttcaagctcacctgaaaatagccttgacccctttcctccacgtatcctgaaggaggagccaaaaggaaaggaaaaggaagtggatgggttgctgacatcagaaccgatgggctcaccggttagcagtaagaccgaatctgtgtccgataaggaggacaagcctcccctggcacccagcggtgggaccgaagggcctgagcagccccctcctccctgcccctcccagaccgggagcccccctgttggcctcatcaagggtgaggataaagatgagggccctgtcgccgaacaggttaagaagagtacactgaatccaaacgccaaggaattcaaccccacgaagcccttgctcagtgtgaacaagagcacatcaacacccacgagccccggaccccgtacgcattcaactccttcaatccccgtcctgaccgcgggacaatcaggcttatacagtccacagtatattagctatatcccccagatacacatgggccctgctgtccaagcgcctcagatgtacccatatcctgtcagtaattccgtgcccggtcagcagggcaaatacaggggagctaaggggtcattgcctcctcaaagatctgatcaacatcagccagcgagtgcccctcctatgatgcaagcagccgctgccgctggtcccccacttgtggccgctacgccctacagctcgtacattccgtacaatcctcagcaattccccggacagccagcgatgatgcaacctatggcacattatcccagtcagccggtcttcgcccctatgctgcagagcaacccacgtatgctgacaagtggatcacatccacaggccatcgtctcttcctcaacccctcagtaccccagcgccgagcaacctacacctcaggccctgtacgcaactgtgcaccagtcctatccgcaccacgctactcagctgcacgcgcatcagccgcagcctgccacgacgcccaccggatcccaaccgcaatctcagcatgccgctccaagtcctgtgcagcaccaggccggtcaagcaccgcacttgggctccgggcaacctcagcagaatctgtatcaccctggcgcactcaccggaacgcctcccagtcttcctccaggcccatctgcgcaaagcccccaatccagctttccacagcccgcagctgtatacgctatacaccatcagcagttgcctcatgggttcaccaatatggcacacgtgactcaggctcacgttcaaactggcattaccgccgctccgccacctcaccctggcgctccgcacccccctcaggtcatgctgctacatcccccacagtcccacggcggacctcctcagggggctgtgccccaatcaggcgtgcctgctctgagcgccagcacaccttccccctacccctatattggacatccccaaggagagcagcccggacaggccccaggctttcccggaggggcagacgataggatcctgtgccgcgtcggcagaagccactcccgcaggcgacaaggactagcgccagggtccgtattatgctttcccccatcttcactctcctgcgacccagcagccccactgcctacagcctccccagccctgtcggacccggactgtctgctgacatag

SEQ ID NO: 215047 - DNA, 2679 bp, Artificial Sequence
  Description of Artificial Sequence: Synthetic coding sequence
atgagcgagagggccgctgacgacgtgcggggtgagcccagacgagctgcagccgctgccggaggagctgctgctgccgcagcccgtcagcaacaacagcagcagcagcagcagcagccaccccctcctcagccgcagcgccagcagcatccgccacctccccctagaaggactcgcccagaggatggcggacccggagcggcatcaacatccgcggcagccatggccaccgtgggtgagcgaagaccacttccgtcacccgaagtgatgctcggccagtcctggaacctttgggtagaagcatcgaagttgcccggtaaggatggcactgaactagatgagagcttcaaggagtttggcaagaaccgcgaggtgatgggcctgtgtagagaagacatgcccattttcggcttttgccctgctcatgatgacttttacctggtggtatgcaacgattgcaaccaagtggttaagccgcaggcttttcagtctcactacgagcggaggcacagcagcagctcaaagcctcctctggctgtgccacctacctctgtgttttcattcttccctagtctctccaaaagtaagggaggcagtgcgagcggtagtaataggagcagcagcggcggagtactgtccgccagttcgagtagctcgaagctgcttaagagccctaaggagaagctccagttaaggggtaacacaagacccatgcatcccatccagcaatcgagagtcccccatggaaggatcatgacaccaagcgtgaaagtggagaaaattcacccaaaaatggatgggactttactgaagtcagcagtggggccaacctgtcctgccactgtcagtagcctggtgaaaccaggtttgaactgcccttcaataccgaaacccactctgccaagcccaggtcaaatcctcaacggaaaggggctgccggcaccacccaccctggagaaaaagcctgaagacaactctaataacagaaagtttttgaataaaaggctgagcgaaagagaattcgacccagatatccattgtggagtgatagatctggatacaaaaaaaccctgcacccgctccctgacttgcaagactcatagcctgacacaaaggagagccgtgcagggcaggcgaaagagattcgacgtcctgctggccgagcacaaaaacaaaactcgcgaaaaagagttaattcgacatccagacagccagcagcctccgcagcccctgagggacccacaccctgccccacccaggacctctcaggagccacaccaaaacccgcacggggtgataccctccgagtcaaaaccttttgtggcctccaagccgaaaccccataccccatccttgcctagaccgcctggctgtcccgctcagcaagggggaagcgcccctatagaccccccaccagttcacgagagccctcatcctcctttacccgcaaccgaacctgcatcaaggctgagctccgaagagggagagggagacgacaaagaggaatcggtggagaagctggattgccactatagcggtcatcaccctcaacccgcttcattttgcacttttggcagccgtcaaataggcaggggctactatgttttcgattcaagatggaatcgcctgaggtgtgcactgaatctgatggtggaaaagcatctgaacgctcagctgtggaagaaaatcccgcctgtcccatctaccacctcaccgatttctactaggatacctcacaggaccaacagtgtaccaacctcccagtgtggggtgtcttacctggccgctgccacggtgagtaccagccctgtgctgctgagttccacatgcattagccccaacagcaaatctgttcctgcgcacggaacaactttgaatgcccagcctgcggcttccggggctatggaccctgtctgtagcatgcagtcccggcaggtcagctcatcttcctccagtccttcgacaccgtctggtctgagcagcgttccctcttccccaatgtcacgtaaaccacagaaactaaaaagtagcaagagcttgcggccaaaggagtcttctggcaatagtaccaactgccagaatgcctcgtcctccaccagcggcggaagtggtaaaaagcgaaaaaattcatcccccctgttggtgcactcgtcaagctctagttcttcctcctcctcctcatctcactcaatggagtcctttcgtaagaactgcgtggcccactctggtcccccttacccctccaccgtcacttcctcccattcgattggattgaactgtgtcacaaacaaggccaatgctgttaacgttcggcacgatcagagtggcagaggacctcctacaggatccccagccgagtctatcaaaaggatgtcagtgatggtgaactcttccgattcaacactctcccttggccctttcatccaccagtcgaatgagctaccagttaacagccatgggagcttcagtcacagccatactccgctggacaaactgatcgggaaaaaacggaagtgctcaccctcgtccagctcaatcaataactcctcgagcaaacctaccaaggttgcgaaggtgcctgccgtgaacaacgtgcacatgaaacacaccggtacaattcctggggcacagggcttgatgaactcttctctgcttcaccagcctaaggctcgtccctag

SEQ ID NO: 215048 - DNA, 2838 bp, Artificial Sequence
  Description of Artificial Sequence: Synthetic coding sequence
atgtctgagagagcagccgacgacgtccggggtgaacctcgaagggccgctgccgcagcgggtggcgctgctgccgcagcggcacgccagcagcaacagcagcagcaacaacagcaacccccacccccacagccacagagacaacagcatccacccccacctcctcggaggactagacccgaggacgggggtccaggagctgcatccactagcgctgccgcaatggccacagtaggcgagagacggcctcttccctcaccggaagttatgcttggtcagtcttggaacctctgggtagaagcgtctaagctgccgggtaaggacggaactgagttagacgagtctttcaaagaatttgggaaaaatcgagaggtcatggggttgtgccgcgaagatatgcctatctttggattttgccccgcacatgacgacttttatcttgttgtgtgtaacgactgtaatcaggtggtcaaaccacaggcattccaaagccactatgagagacgccactcctcttccagtaagcctccacttgctgttcctcctacctccgtgttcagtttttttccctccttgtccaagtccaaaggtggctcggcctccggtagcaacagaagtagtagcggcggtgtgctgtccgcaagctcttcctccagtaagctgcttaagagcccaaaggagaaacttcagctaagggggaacactcggccaatgcaccccattcagcagtccagagtaccacacggccgaataatgacgccatctgtcaaggtagagaagatacaccccaagatggacggcacactgttaaaatcagcagtgggcccaacgtgcccagctaccgtcagctcacttgtcaagcccggactaaactgccccagtatacccaagcctacgctgccttctcctggccagatcttaaatgggaagggactacctgctcccccaacacttgaaaagaaaccagaagacaacagtaacaatagaaagttcctgaacaaacgattgagtgaaagggagtttgatcctgacattcactgtggagttatcgacctcgacaccaagaagccctgtactcggtccctgacctgtaaaacccattccctaacccaaaggcgggcagtccagggtagacgaaagcggttcgacgtgctccttgccgagcacaagaacaagactcgggagaaagagctgatacgacacccagactcccaacaacctccccagcccttgcgtgacccacaccccgctccacctcggaccagtcaggagcctcatcagaaccctcatggagtgataccgagtgaatctaaacccttcgtggcctcaaaacctaaaccgcacacacccagcttgccacgcccaccaggctgtccagctcagcaaggagggtccgcccctattgatccccctccagtgcacgagtccccccatcctccccttccagccactgaacctgcttctcgactgtcttctgaggagggggagggagatgataaagaggagtccgtggaaaagttggactgtcattactccggccatcaccctcagcccgcatcattttgtaccttcggctccagacagattgggagaggatactatgttttcgatagccgatggaatcgcctgaggtgcgctcttaatctgatggttgaaaaacacctgaacgcccagctttggaaaaagattccaccagtgcctagcactacctctcctattagcacaagaatcccccacagaacaaactccgtgcctaccagccagtgcggagttagctaccttgccgctgccaccgtcagtacgtcccctgtgctgctcagctcaacttgcatcagccccaattctaagagtgtgcctgcccatggcactaccctgaacgcgcagcctgcagctagcggggcaatggatccagtgtgttctatgcagtctcgccaagttagctccagttccagttccccctcaacacctagcggtctgtcaagtgtaccgagctcgccaatgagtagaaagccacagaaattgaaatcatctaaatcactgcgacctaaggaaagttccggtaattcaacaaactgccagaacgcgtcttcgtccaccagcgggggtagtgggaagaaacggaagaactctagtccactcttggtccatagcagctcaagctccagttcatctagttcctccagccactctatggagtctttccggaaaaactgtgtggctcattcaggacctccatacccatctacggtgacaagcagtcacagcattggtctgaattgcgttaccaataaagcgaacgcggtaaacgtgcggcacgaccagtcaggaaggggaccacccaccggcagccctgccgagagcatcaagcgaatgtcagtcatggtgaattccagcgatagcactttatccctcggcccattcattcatcaaagcaacgagcttcccgtgaacagccatgggtcattctctcattcacacaccccattggataagctgatcgggaagaagcggaagtgtagcccatcgagctcgtccattaacaatagttcttccaagcccacaaaggtcgctaaagtccccgctgtgaacaatgtgcacatgaagcatactggcactatcccgggagcacagggcttgatgaactcgagtctcctgcaccaggatatctcgtcaccctgcctgcgcactggaatatcagctaccagcccacagtctcctgatcttaaatctaaaggaacgtctctcactgccgagaatagtaccggacgaaataatgccgatacttttgaagacaaactgcatctgcattcagccctgtggaccccaaggtgtctttag

SEQ ID NO: 215049 - DNA, 81 bp, Artificial Sequence
  Description of Artificial Sequence: Synthetic coding sequence
atgtcagagagggccgctgatgacgtgcgcggagagcccaggagagctgcagccgctgctgggggtgcagctgctgcatag

SEQ ID NO: 215050 - DNA, 2679 bp, Artificial Sequence
  Description of Artificial Sequence: Synthetic coding sequence
atgtcagagagagctgctgatgatgtgaggggcgagccccgacgcgctgctgccgctgccggaggagctgctgctgcagccgcacgccagcaacagcaacagcagcaacagcaacaacccccacctccgcagccccagagacagcaacatccgccacctccaccaagacgaaccagacctgaggacgggggtcccggagcggcttctacatccgcagctgcaatggcaaccgtgggggaaaggcgaccgctcccgagtcccgaagtgatgctggggcagagttggaatttgtgggtcgaggccagcaagctccctgggaaagacggcaccgaattggacgaaagctttaaggagttcggaaagaaccgtgaggtcatgggcctctgcagagaagacatgcctatcttcggattctgtcccgctcatgacgatttctacctggttgtttgcaatgactgtaatcaagtggtgaagcctcaggcgttccagagccactatgaaagacgacactcttcttcttccaaacccccacttgcggtacctccaaccagtgtgttttctttctttccatcactaagcaagtccaagggcggaagcgctagtggctcaaaccggagctcctcaggcggtgtgttaagtgcctcatccagtagcagcaagctgctcaagtcccctaaggaaaagctacaattgcgagggaataccaggcccatgcatcccattcaacagtcccgcgtcccacacggccgtataatgactcctagcgtcaaggtggaaaagatccatcctaagatggacggcacccttctcaaaagtgccgttgggccaacctgccctgctactgttagcagtttagtgaagccaggactaaattgtcccagtatacctaaaccaactctaccaagtccagggcagatcttgaacggcaagggccttccggcaccccctacactggaaaaaaagccagaggacaacagcaataataggaaatttctcaacaagaggctgtctgaaagagagtttgacccagatattcactgtggtgtaattgacctcgatacgaagaagccttgtacccgatctttgacctgcaaaacgcactccctgacccagcggagggctgtccagggccgacgaaagaggttcgacgtactgctcgccgagcataagaataaaacccgcgagaaggagttaatcagacaccctgattctcagcaacctccgcagccacttagagatccacacccagctccgcctaggacatcccaagaaccccaccagaaccctcacggtgttattcctagtgagtccaagccctttgtggctagcaagcctaaaccacatacgccctcgctgcccagacccccagggtgtccagcacagcagggaggctcggcgccaatcgatccccctccagtgcatgaaagccctcacccccctctcccagctaccgaacctgcgtcgagattgtcttccgaggagggcgaaggcgacgacaaggaagaatctgtggagaaacttgattgccactatagtggtcaccaccctcagcccgcttcgttctgtaccttcggttctagacagatcggcagaggatattacgtatttgatagcaggtggaatagactccgttgcgcactaaatctgatggtggaaaaacaccttaatgctcagctgtggaagaaaatccctccagtccctagtacaaccagtcccatcagtactaggatacctcatcgcacaaactcagtccccacatctcaatgcggagtcagttacctggccgcagccaccgtgtcgacaagccctgtgctcctctcaagcacatgtattagtccaaattctaagtctgtgccagcgcacggtacaactctaaacgcccagccagctgcatctggggcaatggatcctgtgtgcagtatgcagtcgcggcaggtgtccagctccagcagctctccctcgacaccctccgggttgagcagcgtaccctcatctccgatgtctcgtaagccccagaaactcaaaagctcaaagtcactgagacctaaggaatcttcagggaattcaactaactgtcagaatgcttcttctagcaccagtggaggctccggcaaaaaaaggaagaatagcagcccactactggttcactcttcgagctcaagctcttcatcgtctagttcgagccatagcatggaaagcttccggaaaaactgtgtagcacacagcgggcctccttacccgagcacagtaacatctagccatagcattggtttgaactgcgtgacgaacaaggctaatgcggtcaatgtgaggcatgaccagtcaggtagaggaccgcctaccgggagccccgctgagagcatcaaacggatgagtgtcatggtgaattcctctgatagcacactctccctgggcccttttatccaccaatcgaacgaacttcctgtgaatagccacggatcttttagccactcccatacacctttggacaaattaattggcaagaaaaggaaatgttccccatcttcatccagcatcaataatagctccagcaaacctaccaaggtagccaaggtaccggcagtcaacaacgtgcacatgaaacatactggcaccattccaggcgctcagggactgatgaattcttcccttcttcatcaaccaaaggcgaggccatag

SEQ ID NO: 215051 - DNA, 2838 bp, Artificial Sequence
  Description of Artificial Sequence: Synthetic coding sequence
atgtcagagagagcagctgatgacgtacgcggtgagcccaggcgcgcagcagctgcggcaggaggggcagctgcagcagcggctagacaacagcaacagcagcaacagcagcagcagccgcctcccccacagccccagcgtcagcaacaccccccacccccaccgagacgtaccaggccagaggatgggggaccaggcgcagcgtctacatccgctgcagctatggcaactgtaggagaacggagacctttgccttctccagaggtgatgctggggcagtcttggaatttgtgggtcgaagcatccaaactccctggcaaggatggcaccgagttagacgaatctttcaaagagttcgggaagaatcgcgaggtaatggggctctgccgggaagacatgcccatcttcggcttttgtcctgctcacgacgacttctatctcgtggtttgcaacgactgtaatcaggtcgttaagccccaggctttccagagccactatgagcgcaggcacagcagctcgtctaaacctccactcgccgtgccgcctacgagcgtattctccttcttcccaagtctttccaagtctaagggcggtagcgccagcggctctaaccgctccagctccggcggtgtgctaagtgcgtcttcgtcctcgtccaaactgttaaaaagccccaaggaaaaactccagttacgtgggaacacaagacccatgcatccaattcagcagtcccgcgtgccacatggtcggattatgaccccaagcgtgaaagtcgaaaaaatccacccgaaaatggatgggacactactgaagtcagccgtcggtcctacatgtccggctacagtgtcctcactggtgaaacctggtctgaattgcccctccatcccaaaaccaactcttccatccccagggcaaatcctgaatggaaaaggcctgcctgcaccccctactctagagaagaaaccagaagataattcgaacaatcggaaattcctgaataaacgactcagcgagcgggaatttgatcctgatatccattgtggcgttatagatctggacactaagaagccctgcacaagaagcctcacatgtaaaacccattcccttactcaacgaagagccgtccagggacggagaaagagatttgatgtgctcctcgcagagcacaagaacaaaacaagggagaaagagctgatccggcatcccgattcccagcagcctccccagccgttgagggacccccaccctgcgcctccacgcacttctcaagaaccacatcagaatccacacggagtcatcccttccgaatcgaaaccttttgttgcttcgaagcccaagccccacactccatcactgcctcggcctccaggatgccccgcacagcagggtgggagtgctccaattgaccctccccctgttcacgaatcaccccatcctcccctaccggctaccgagcccgcttctagattatcctctgaggaaggggagggggatgacaaagaggaatccgtagaaaaactcgattgtcattattccggccaccacccacagcccgcatccttttgcacctttgggtctcgacagatcggaaggggatactacgtcttcgattcaagatggaaccgtctgagatgtgctctgaatctgatggtggagaaacacctcaatgctcaactgtggaaaaaaattccacctgtcccatcgacaacttctcctatcagtacaagaatcccacaccgtacaaacagcgtgccgacttcccaatgtggcgtgtcatatttggccgcagcaactgtgtctacttcccctgtcctgctcagttcaacctgtatctcacccaattctaagtccgtaccagcccatggaactacattgaatgcgcagccagccgctagcggtgccatggaccctgtgtgctctatgcaaagtagacaggtgtccagctcctctagttcaccgtcaactccgagcggcttgtcaagcgtgcccagctcaccgatgagccgtaagcctcaaaagttaaagtcctcaaagagcctcaggccgaaggaatcgtctggaaacagtactaactgccagaatgcgtcatcaagtaccagcggcggatccgggaagaaacggaagaactccagtcctttgctggtgcatagctcctcaagctcgagcagtagctcatctagcagccacagcatggagtccttcaggaagaattgtgtggctcatagtggacccccataccccagtactgtaacgagctcacactctatcggcttgaattgtgtgacaaataaagccaatgctgtcaatgtgcggcatgaccaatccgggagaggacctcccacagggagtcctgccgagagcattaaacgcatgtcagttatggtcaactcctcagatagtacccttagcctgggaccattcatacaccagtccaatgagctacctgtgaattctcatggaagtttcagtcattcccataccccactggataaactgatcggcaaaaagcgtaagtgtagcccttcatcttccagcatcaacaattcaagcagcaagcccaccaaggtggcgaaggtgcccgctgtgaataacgttcacatgaaacatacaggcacaattcccggtgctcagggcttaatgaacagctcacttttgcatcaggacatttcatccccatgtcttagaacgggtatcagcgccactagtccccagtcaccagacctcaagtccaaaggcactagcctgaccgccgaaaactcaaccgggaggaataacgccgacacatttgaggacaagctgcacctccatagcgcactgtggacgccacgatgtctttag

SEQ ID NO: 215052 - DNA, 393 bp, Artificial Sequence
  Description of Artificial Sequence: Synthetic coding sequence
atgtcagaacgcgcagctgatgacgtgcgaggagaaccaagacgtgcagcagccgcagcaggcggagccgcagccgcagctgcacggcagcaacagcagcagcaacaacaacagcaaccacccccaccccagccacaacgccagcagcaccccccacctccacccagacgcaccagaccggaggacggaggtcctggggctgcctcgactagcgccgcagctatggccacagttggggagcgtcgaccactcccgagtccggaggtcatgctgggacaaagctggaacctatgggtagaggcttccaaactgccagggaaagatggagaccggatcggcagaaaattccaaggcgtctggaaccgagaggtcatgggactgtgccgggagtag

SEQ ID NO: 215053 - DNA, 2244 bp, Artificial Sequence
  Description of Artificial Sequence: Synthetic coding sequence
atggagggctctaagacacccctgcagagtagtccctccgcgcaggaactcaaggcccctctggagagaagacattcctccagcagcaagcctccgctggccgttcctccaacatctgtcttttccttcttcccctccctttccaagtcaaaaggcggatcagcgagtggatcgaacagaagcagttctggcggagtcctttcagcaagcagctcctcctctaagctcttgaagagccctaaggagaaactgcagctgcgtggtaatactagaccaatgcacccgatccagcagtcccgcgtcccccatggaaggataatgactccgtcggtcaaagtggaaaaaattcaccctaagatggacggcacactgttaaagagtgcggttggcccaacgtgcccagccaccgtttcatcccttgtgaaaccgggtctaaattgtccttcaatcccaaaacccactctgccatcaccaggccagattctcaatggcaaaggactccctgctcctcccacgttggagaagaaacccgaggacaactcgaataaccgcaaatttctgaacaaaagactctctgagcgtgaatttgatcctgacatccattgcggagtcatcgacctcgataccaagaagccctgtacgaggtctctcacttgtaagacccattcactcactcagagaagagctgtacaggggagaaggaaacgcttcgatgttctgctagcggagcacaagaacaaaactagggaaaaggaactaatccggcaccccgatagccaacaaccccctcagcccctgagggatccccatcctgctcctcccagaacgtctcaagagccccatcaaaaccctcacggtgtcatccccagcgagtctaaaccttttgtagctagcaaacccaaacctcatactccgtccctcccaagaccccctggatgtccagcgcagcagggaggatctgctcctatagaccctccaccagttcatgaaagccctcatcctccacttcccgctactgagcctgcaagccgcctttcaagcgaggagggagagggagacgacaaggaggaatccgtcgagaaactggactgtcattacagcggccaccacccccaaccagcttcattttgcacctttgggtccagacaaattggcagaggttactatgtttttgacagcaggtggaacagactacggtgcgcattaaatctgatggtggagaagcacctgaacgctcagctgtggaagaagatccctccagtccccagcacgacgagtccaataagcacccggattccacatcgtaccaattctgtgccaacctcccagtgtggagtcagttacttggcagcagccactgtgagtacgtcaccggtgctgttgtcttcaacttgtatctcaccgaatagcaagagcgtacccgctcacggcacaacgctgaacgcacagcccgctgcctcaggagctatggaccccgtgtgttctatgcaaagccgtcaggtttcgtcatcaagttcttccccctcaaccccaagtggtctgtcatctgtccccagctcacccatgagccgaaagcctcagaagcttaaatcttctaagtccctgaggccaaaggagtcttccggaaacagcacaaactgtcagaatgccagctcctccacgtccggaggctcagggaaaaaaagaaagaatagcagcccacttttagtgcactcctctagctcctccagctcgtcttcttcctcaagccactccatggaatcttttcgaaagaattgtgtcgcacacagcggcccaccctacccatctactgttacctcttctcacagtattgggttgaactgcgtgaccaacaaggccaacgccgtcaacgttagacacgaccagtccgggaggggccctccgacgggtagtccagctgagagtataaagagaatgtctgttatggtcaattcctccgacagcaccctcagcttgggcccttttattcatcagtccaacgagttgccagtcaactcccacggcagcttctcccattcccacaccccgctagacaagctgatcggcaagaagcgaaagtgctccccgtccagttcaagtattaacaatagctcaagtaaacctactaaggtggcgaaggtgccagccgttaacaatgtacatatgaaacacacaggtacaatacccggagcccagggcttgatgaacagctccctccttcatcagcctaaggcaagaccatag

SEQ ID NO: 215054 - DNA, 663 bp, Artificial Sequence
  Description of Artificial Sequence: Synthetic coding sequence
atggaggaggatgagttcattggggaaaaaacctttcagcggtactgcgcagaatttattaaacattcacaacagatcggcgattcgtgggaatggcgtccatcaaaggattgctctgatggttatatgtgcaaaatccatttccagattaaaaacgggagcgttatgtcccatttgggggctagcactcatggacagacttgtctgcccatggaagaggctttcgagttgccactggatgattgtgaagtgatcgaaactgcagccgcatccgaagtaataaagtatgaatatcatgtgctttactcctgtagctaccaggtcccggtgctgtacttccgcgcatcttttctggatggacggccactgacgctcaaagatatttgggagggcgtgcacgaatgttacaaaatgaggctgcttcagggcccttgggacactatcacccaacaggagcaccctattttaggacagcccttcttcgtactacatccctgcaaaacaaatgaattcatgacgccagtgctcaagaacagccaaaaaatcaataagaacgtgaactacattacctcttggcttagcatagtggggccagtcgttggtctcaatctcccattgtcttacgctaaagcgacctcacaggatgagagaaatgtcccctag

SEQ ID NO: 215055 - DNA, 378 bp, Artificial Sequence
  Description of Artificial Sequence: Synthetic coding sequence
atggaggaggacgagttcatcggcgagaagacctttcagcgctattgtgcggagtttatcaagcattcccaacagataggagatagctgggaatggcgtcccagcaaggattgcagcgacggttatatgtgcaagatacactttcaaatcaagaacggaagcgtcatgtcacacctgggagcctccacacatggccagacctgcttacccatggaggtgaaatcctgctctgtgacacaagcaggagtgcaactccgagatttatcttccctgcagcctccgccttccggctttaagcagttttcttgcctgtctctaccgagtaactgggattatcgcggttccccgctccatctcgcaaatttcctctacttctag

SEQ ID NO: 215056 - DNA, 663 bp, Artificial Sequence
  Description of Artificial Sequence: Synthetic coding sequence
atggaggaagatgaatttattggagagaaaactttccaaagatactgtgcagagttcataaaacattctcaacagattggagacagttgggagtggcgcccatctaaagattgctcggatggttacatgtgcaaaattcatttccagattaaaaacggctctgtgatgtcacatctaggcgcttccactcatggtcagacctgtttacctatggaggaggcctttgagctgccactagacgattgcgaggtgatcgaaacagccgctgcctccgaggtgatcaaatacgagtatcatgtgttatactcttgctcttaccaagtgccagtgctgtattttcgcgctagcttcttggatggcagacccttgacccttaaagatatctgggaaggcgtacacgaatgttataagatgcggcttctgcaggggccatgggacaccatcacacaacaagaacacccaatcctgggacagccctttttcgttctgcacccctgcaaaacaaatgagtttatgaccccagtgcttaaaaatagccagaagattaataagaacgtgaactacattactagttggttgtcaattgtggggccagtggtagggcttaacctgccactgagttacgctaaggctacatctcaagatgagagaaacgtaccctag

SEQ ID NO: 215057 - DNA, 882 bp, Artificial Sequence
  Description of Artificial Sequence: Synthetic coding sequence
atggacaggcgagtgaaactctgggaagtgtttggcgagaagtgcgagttcaaggggtctctaagtggatcaaacgccggaattacctctatcgagtttgacagcgctggcagctaccttctggcggcaagtaatgatttcgcatctcgaatttggaccgtagacgactatagactgcggcacaccctaactgggcacagcggtaaggtcctgagcgccaagtttctccttgataacgcgagaatcgtatccggctctcacgatcggactctcaaactgtgggacctgcgcagtaaggtctgcataaaaaccgtgttcgcgggttccagctgtaatgacatcgtgtgcacagagcagtgcgttatgtccggccactttgacaagaagattagattctgggatattcgaagtgaaagcattgtgcgagaaatggagttacttgggaaaattaccgccttggatttgaatccagaaaggaccgagctcctttcgtgttccagagacgacttactgaaagtcattgacctgagaacaaacgctatcaagcaaacattcagtgcgcctggattcaagtgcggctctgactggactcgcgtggtgtttagccctgacgggtcttatgtagctgcgggttctgctgagggctcactgtatatttggagtgtgctgaccggtaaggtggagaaagtgttgtccagctcaaccgcacaccccagtatgcgctggcgagggcgtccactggcccgaacactaagcgtgtggaccaaggacgcaaagctgtgttgtgggcatagcacagacggggctttacgagccggaaggacgccggtgccttcctcagaagaggcccatggcctcttgcagccgtgtccagggagatag

SEQ ID NO: 215058 - DNA, 1335 bp, Artificial Sequence
  Description of Artificial Sequence: Synthetic coding sequence
atgtcaagtggcctgcgggcagctgatttccccaggtggaagcggcacatatcggagcagctgagacggagagatcgcctccagagacaggcctttgaagagattatactgcagtacaacaagcttctagaaaagtcagacctacacagcgtgttagctcaaaagttgcaggccgaaaaacacgacgtaccaaataggcacgaaatcagacggcgtcaagcgcgtctgcaaaaggagctggcagaggccgcaaaagaaccattaccagtagaacaggacgacgacatcgaggtgatagtggatgagaccagtgatcatactgaagaaacttcacctgtcagggccattagcagagccgcaacacgtcggagcgtcagctcatttccagtacctcaagataatgttgatacacaccccggttccggcaaagaggtgagggtcccagcgactgcactgtgcgtatttgatgctcacgatggggaagtgaacgctgtacaatttagccccggtagtaggctcctagcgacaggaggaatggacagacgggtcaaattgtgggaagtctttggcgagaagtgcgaattcaaggggagtctctcaggctctaacgccggaatcacctccatagagtttgactctgccggatcatacctgttagcagcctccaatgacttcgcctcacgcatatggaccgtggacgattaccgtctaaggcacaccttaactgggcactcgggtaaagtgctgagtgctaagttcctgctggacaacgccaggatagtcagcggttcccatgatcgtacactgaagctgtgggacttgcggtctaaagtgtgcattaagactgtgtttgccggaagttcatgtaacgatatcgtctgcacagaacagtgcgttatgtcaggccacttcgataaaaagattcgcttctgggatatcagatcggagagcattgtaagggagatggaactcctggggaaaatcacagcgctagatcttaacccggaacgcaccgagctcctatcctgttcgcgtgatgacctactcaaggtaatcgatctaaggacgaatgccatcaaacaaactttttctgctccaggattcaagtgcggctctgactggacaagggttgttttctcgcctgatggtagctacgtagctgcaggttccgcagaaggttcactgtacatttggtccgtgctgacagggaaggtcgaaaaagtcctctccaagcaacattcatcaagcattaatgccgtagcctggtccccatccggtagtcacgtcgtgtcagtggacaaagggtgtaaggccgtgctgtgggcacagtattag

SEQ ID NO: 215059 - DNA, 1287 bp, Artificial Sequence
  Description of Artificial Sequence: Synthetic coding sequence
atgtcctcgggactgcgagcggcagacttccctcgatggaaacggcacatttctgagcaactccgcagacgggatagactccagcggcaagcattcgaggaaatcattctacagtacaacaaactgctcgagaaatcagacctgcattccgtgttggcgcaaaagcttcaggcagaaaagcatgacgttcccaatcggcacgagatcagaagacgtcaggcccgactgcagaaagagctggcagaagctgctaaggaacccctgccagtggaacaggacgacgacattgaagtgatagtggacgagaccagtgatcacactgaagaaacgagcccagtgagagcgatctcacgcgctgccactaaacggctgagccagcccgcaggcggtctgctcgacagtattacaaatatcttcggaagacggtccgtctcttccttcccagtgccccaagataatgtggatacccaccctggatctggcaaggaggttcgggtccctgcaacagccctgtgcgtattcgacgctcacgatggtgaggtcaatgccgtgcagttctctcctgggataacttccatcgagttcgatagcgccggatcctacctattggccgcatcaaatgacttcgctagtcgcatctggacagtcgacgactaccggctgcgccacactctaaccgggcactccggaaaagttctgagcgccaagtttctcctggacaacgccaggatcgtcagtggcagccatgataggactctgaagctttgggacctgcgtagcaaagtgtgcattaagacagtattcgctggaagcagttgcaatgacatcgtatgcactgagcagtgcgtcatgagcggccacttcgacaaaaagatccgcttttgggatatccggagtgaatctattgtcagagagatggagctgctcgggaagattactgcactcgacctgaatcccgaaaggactgagctgctgtcctgcagccgggacgatctgctcaaagtgatcgacctaagaacaaatgctatcaaacagacattcagcgctccaggattcaagtgtggtagcgattggacccgcgtagtgtttagcccagatggatcctacgtagccgctggaagcgcagagggcagtttgtacatctggtcagtcctgaccggcaaggttgagaaggtccttagtaaacagcacagctcaagcatcaatgcagtggcttggagtcctagcgggtcccatgttgtctccgtagataaaggatgcaaagctgtcttgtgggcccagtactag

SEQ ID NO: 215060 - DNA, 1824 bp, Artificial Sequence
  Description of Artificial Sequence: Synthetic coding sequence
atgagcagcggcctgagggccgcagactttccccgatggaagcggcacatcagcgaacagctgcggaggcgtgacagactgcaaaggcaggcatttgaggaaattattctgcagtataataagctcctggagaagagcgacctgcacagtgttcttgctcagaagcttcaggcagagaaacacgacgtgcctaacagacacgaaatctcgcccggacacgacggaacctggaacgacaaccagcttcaggagatggctcagctgcgtataaagcatcaggaggagctgaccgagctccacaagaagaggggagaactagctcagctggtcattgatttaaacaaccagatgcagagaaaagacagagagatgcaaatgaacgaagccaaaatcgcagagtgcctccagacaatcagcgatctggagactgaatgcttggatctccgaactaagctgtgcgatttggagcgggcaaaccagactcttaaagacgagtacgacgccctgcagattactttcacggctctcgagggcaaactgcgaaaaacaactgaggaaaatcaggagcttgtgacgagatggatggccgagaaggctcaggaggcaaatagactgaacgctgagaacgagaaggacagtcgacggcgacaggcacgactgcagaaggagctcgctgaggctgccaaagaaccactgccagtggagcaagatgatgacatcgaggtcatcgtggatgagacatctgaccacactgaggagacctcacccgtcagagccattagccgtgccgcaaccaaacgcctctcacagcctgccggaggcttgctggattctatcacaaatatctttgggagacgcagcgtgagtagtttccctgtacctcaagataacgtcgacactcatccaggttccggtaaggaggtcagagtgcccgctaccgccttgtgtgtgttcgacgcacacgatggcgaagtgaatgccgtacagttttccccaggttcaagactgctcgctacagggggaatggatcggcgagttaagctctgggaggtgtttggcgagaagtgcgagtttaagggatctctgagcggttcaaatgccggtattacgagcatagaatttgactcagccggatcataccttctggcagcctcaaatgatttcgcctctagaatctggactgtggatgactaccgtctgcggcacaccttgacagggcactctggtaaggtcctgtctgcaaagttcttgctggacaacgcacgcatcgtctccggaagccacgaccggactctaaaattatgggatctccgcagcaaggtctgtataaaaacagtgtttgccggatcatcctgtaacgacatcgtgtgcacagagcagtgcgtaatgtccggacacttcgataagaagatccggttctgggacataagaagcgagtcaattgttagggaaatggaactgcttggaaagataactgcattggatctgaaccccgaacgcaccgaactgctgtcctgttcccgagacgaccttctcaaggtgattgacctgagaaccaacgcgattaagcagacttttagcgcaccgggttttaaatgtggctccgactggactagggtcgtgttctctcctgacggttcatatgttgctgccggttctgccgaaggtagtctgtatatctggagtgtcctgactgggaaggtggagaaggtcttaagcaagcagcattcttcatcaatcaatgcagtagcgtggagcccgtcaggttcacacgtggtgtccgtcgacaaaggatgtaaagcagtcttatgggctcaatactag

SEQ ID NO: 215061 - DNA, 1875 bp, Artificial Sequence
  Description of Artificial Sequence: Synthetic coding sequence
atgagttcaggattacgggctgcggacttccctcggtggaaacgacacatatcagagcagttgaggcggcgagacaggctgcagcggcaggcctttgaggagattattctgcaatataacaaattactggaaaagtccgacctacatagtgtgctcgcccagaaactccaggccgagaagcacgacgtgcccaatagacacgagatttcgcctgggcatgacggtacgtggaatgacaaccagctccaggagatggctcagttgaggataaagcaccaagaggagttgactgagttacataaaaagcgcggtgagctggcccaactggtgatcgatctgaacaatcaaatgcagagaaaggacagagaaatgcagatgaacgaagccaagattgcagagtgcctgcagaccatatcagacctggagactgaatgtctggatctgagaaccaagctctgcgacctggaacgagcgaaccagactctgaaagatgaatacgatgccctgcagattactttcactgcgctggaaggcaaactccgtaagacaacagaagagaatcaagagttggttactagatggatggccgagaaagcccaggaagccaataggctgaacgctgaaaacgaaaaagactctaggagacgccaagctaggctccagaaagaactggctgaagccgcaaaagagcctctgccagtggagcaggacgatgatatagaggtgattgtggatgagacctctgaccacactgaggaaactagcccagtgcgagccattagccgtgcggctaccaaacggctctctcagcctgcaggcggactgttagacagtatcactaatatttttggtctctcagagtcccccctgctgggacaccatagctcaagtgacgcagcccgaagacggagtgtctcctcttttccagtgcctcaggacaacgtcgatactcatcccggatctggcaaagaggtgcgagtgcccgcaacggccctctgcgtttttgatgcacacgacggggaagtcaatgcagttcagttctccccagggtcccggttactggccaccggcggtatggaccggagagttaagttatgggaggtgttcggagagaagtgtgaattcaagggaagcctgagtggtagtaatgccggtattacttctatcgagttcgactccgccggatcttacctgctggccgcttcaaacgatttcgcctcaagaatatggaccgttgacgactatagactcaggcatactctgaccgggcactcaggcaaggtacttagtgcgaagttcctgctcgataatgcccgaattgttagtggctctcatgataggacactgaagctttgggatctcaggagtaaggtttgtatcaagaccgtgttcgccggaagctcgtgcaatgacattgtttgcaccgaacagtgcgtgatgagcggacacttcgacaagaaaattcgattctgggacattaggtctgagtccatcgtgagggaaatggagctccttgggaaaattactgctctggacctaaaccctgagcgtaccgagttattgtcgtgcagccgggacgatctgctcaaagtaatcgatctccgcacgaacgccatcaagcagacatttagcgcccctgggttcaaatgtggatcagactggacgcgggtggtgttttcacccgatggctcttacgtcgcggcaggatcggccgagggctctctgtacatctggtccgtgcttaccggcaaggttgagaaagtgctgagcaagcaacactcttcctccattaacgctgtggcctggtccccttctgggagccacgtagtttctgtagacaaaggatgtaaggcagtcctttgggcccaatactag

SEQ ID NO: 215062 - DNA, 1767 bp, Artificial Sequence
  Description of Artificial Sequence: Synthetic coding sequence
atgtcctctggcctgagagcagcagactttcccaggtggaagaggcacattagcgaacaattgcgccgacgcgacagactgcagcgccaggccttcgaggagatcatcttgcagtataataagctgctagagaaatctgacctccattcggttttggcgcagaaactgcaagcggagaagcacgatgtgccaaatcggcacgagatcagtcctgggcacgatggcacctggaacgacaatcagctacaggaaatggcacagctgaggataaaacaccaggaggaactcactgaactgcacaaaaaacggggtgaactggcccaactcgtcattgatctgaacaaccagatgcaacgcaaggaccgagaaatgcagatgaatgaggccaagatcgcagagtgcctgcagaccatctctgacctggagacagagtgtcttgacctgagaacgaagctttgtgaccttgagcgcgctaatcaaaccctcaaggatgaatacgacgctctgcagatcacattcactgccctggaaggcaaattacggaaaaccaccgaggagaaccaggaactggtcacacgctggatggcagaaaaagcccaagaagccaatcgcctgaacgccgagaacgaaaaagattcccgtcgacggcaagcaaggctccagaaggaactggcagaagccgcaaaggagccgctccccgtggaacaggacgacgacattgaagttatcgtcgacgagactagtgatcataccgaggagactagtcccgttagggctatcagtcgcgcagcaacccggaggtctgtgtcttcctttccagtcccacaagacaacgtagacactcaccccggatctggcaaagaggtacgcgtaccagcgactgcactttgcgtttttgatgcccatgacggtgaagtgaacgcagtgcaattcagcccaggttcacgactgctggccaccggcggaatggaccgacgggtgaagctttgggaggttttcggtgagaagtgtgagtttaaaggaagcctgtccggttctaacgccggtatcacctccattgaattcgactcagccggaagttacctgttggccgcatctaacgacttcgcttccagaatttggaccgtggatgattataggttgcgccacacactcacaggtcactccggcaaggtgctttctgccaagtttcttctagacaacgctcgcatcgttagtgggtcccacgaccgcacgttaaagctctgggaccttagatctaaagtatgcatcaaaacagtgttcgctggcagctcttgcaatgacatcgtatgtaccgaacagtgtgtgatgagcggccactttgataagaagatcaggttttgggacatccgttcagagagcatagtccgagagatggagctactggggaaaataactgcactggatctcaaccccgagagaactgagctgctgagctgttctcgcgatgacttgctgaaagtcatcgacctgaggactaacgcaatcaagcagaccttcagtgcgcctgggtttaaatgcgggagcgattggacccgggtggtgtttagccctgatggatcctatgtggctgccggaagcgctgagggttccctctacatatggtccgtgttaacagggaaagtcgaaaaagtactttcaaagcagcactcttcctctattaacgctgtggcctggtccccttctggtagtcatgttgtgagtgtagataaagggtgtaaggccgtgctctgggcccagtactag

SEQ ID NO: 215063 - DNA, 2520 bp, Artificial Sequence
  Description of Artificial Sequence: Synthetic coding sequence
atggcccaattcgataccgagtatcaacgcctggaagcttcatactctgacagcccaccaggagaggaggatttgctggtgcatgttgccgagggttccaagtctccgtggcatcacatagagaatttggatctgttcttttccagagtgtataacctgcatcaaaagaatggatttacatgcatgctgatcggagagattttcgagctgatgcagtttctgtttgtggttgcctttacaacttttctggtgagctgcgtagactatgatattctgtttgccaacaagatggtgaaccattctctacatcctactgaacccgtgaaggtgaccttgccagacgcattcctgcccgctcaggtgtgctcagcacgcattcaggagaatggctccctcattaccattctcgtgatcgctggtgtcttttggatccaccgcttgattaaatttatatacaacatttgctgctattgggagatacactctttctatctgcatgccttaagaattcctatgagcgcattgccttactgcacatggcaggaagttcaggccaggattgttcagacacagaaagagcaccagatctgcatccataaacgtgaactgacggagctggatatttaccaccggatactaaggttccagaattatatggtggctctggttaacaagtcactgctcccactccggttcaggttgcccggactgggtgaagccgtttttttcacccgcggactcaagtataactttgaactcatccttttttgggggcctggaagcctgttcctgaatgagtggtccctcaaagctgaatacaagcgcggtggtcagcgcctggagctagcccagcgcctcagtaaccgtattctttggatcggaatcgcaaatttcctgctgtgccccttgatcctgatttggcagatcctgtatgccttctttagttacgccgaagtccttaaacgcgagccgggtgccctgggcgcacggtgctggagcctgtatgggagatgttacctgcggcatttcaatgaactggagcacgagcttcagtcgcgtctgaataggggttataagcccgcatccaagtatatgaattgctttcttagcccactgctgacactgttggctaagaacggcgcttttttcgcgggaagtatcctcgctgtcctcatagcactgaccatttacgacgaggacgtgctcgctgttgaacacgtgctcactacggtgactctgctaggggtgactgtcactgtgtgccgcagtttcattcctgaccagcacatggtcttctgccccgaacagctgctgcgcgtcatcctggcccatatacactacatgccggatcactggcaaggcaatgcccatcgctctcaaacgagggatgagttcgcacagttgtttcagtacaaagctgttttcatactggaggaactactcagtcccatagtaactcctctcatactgattttctgcctccgcccacgggctttggaaataattgactttttccgaaatttcaccgtagaagtggtgggggtaggagacacctgttcttttgcacagatggacgttcgtcaacatgggcatcctcagtggctgtctgccggtcagactgaggcctccgtctaccaacaggcagaagacggtaaaaccgaattatcactgatgcatttcgcaataactaaccccggttggcagcctccacgcgagagtacagcgttcctgggatttcttaaggagcaagttcagcgcgatggagctgccgcatcactggcccagggagggctactacctgagaacgctctatttacatccatccaatccttgcagagcgagtctgaacccctgagtctaattgctaacgtcgtagctggcagttcctgccgaggcccaccactgcccagagacctccaaggctcccgtcatcgagccgaggtggcctcagcgttgcgttccttctctcccctgcaacccggtcaagccccaactggtcgcgcacactcaaccatgacaggttccggcgtggacgcccgaacagcgtcctcgggcagcagtgtatgggagggacaactgcagtccctggtgctctctgaatatgcttcaaccgaaatgagcctacatgccctgtatatgcatcaacttcataaacagcaagctcaggcagaaccagagcgtcacgtttggcaccggcgagaaagcgatgagtccggtgagagtgccccagatgaggggggagagggggctagagcgcctcaaagcatcccacgcagcgccagttacccgtgtgccgcaccccgtccaggagcccctgaaaccactgcactgcacgggggattccagaggaggtatgggggtataactgaccccggtacagtccccagagtgcccagtcacttctctcgcctgcccctcggtggctgggctgaggatggtcagtcagcgagtcgccatcccgagcccgtacccgaagagggctctgaggacgaacttccaccacaggtgcacaaggtgtag

SEQ ID NO: 215064 - DNA, 2520 bp, Artificial Sequence
  Description of Artificial Sequence: Synthetic coding sequence
atggcgcagtttgacacagaatatcaacgcctggaggcctcctacagtgatagtcctccaggggaagaagatctgctcgtgcacgtcgccgaaggcagcaagtctccttggcaccacatcgaaaacctcgacctcttcttctctagagtctacaacttacatcaaaagaacggctttacctgcatgcttattggagagatcttcgagcttatgcagttcctatttgtggtcgccttcacgacctttcttgtatcgtgtgtagattacgatatccttttcgcaaacaaaatggtaaatcattctttgcaccccacggaacctgtaaaggtgactctgcccgacgcgtttctgccagcccaggtgtgtagcgccagaatccaggagaacgggtccctgattacgattctggtcatcgcaggcgtcttttggatccacaggcttatcaagtttatctataacatatgctgctactgggaaattcactccttttatctgcatgccctgcgcattcccatgtcagccctgccatattgcacgtggcaggaggtgcaagcaagaatcgtccagactcagaaggagcaccagatttgtattcataaaagagagctgaccgaacttgacatctaccatagaatcctgcgatttcagaattatatggtcgctctggtgaacaaatcactgcttcccctgagatttaggctccccggactgggcgaggccgtcttctttactcggggtttgaaatataattttgaactgattcttttttggggtcccggtagcctctttctgaacgaatggagcctgaaggctgaatacaaacggggtgggcagcggcttgaactggcccaacggttaagtaaccggattctttggataggcattgcaaatttcctcctctgtccacttatcctcatctggcagatcttgtacgcattcttctcgtacgcagaagtgcttaagcgtgagcccggtgcgttaggagcgagatgttggtcactgtacggcagatgttatttgcgacacttcaatgaattagagcatgagttgcagagccgccttaacaggggctacaaacccgcaagcaagtacatgaactgtttcctgagtcccctgctgaccctgctggctaaaaacggggcattctttgccggatccatattggcagttcttatcgcgctgaccatctatgacgaggacgtgctggccgtcgagcatgtactgaccaccgtgacactcctgggggtcactgtaactgtgtgtcggagttttattcctgatcagcatatggtcttttgtcctgagcaactgctgcgggtcatactggcccacatccactatatgccagaccattggcagggcaacgcccatcggtcacagaccagggacgagtttgcacaactctttcagtacaaggccgtattcatcctcgaggagctgctctctcccatagtgacgcccctcattctaatcttctgcttgaggccgagagcattggagattatcgacttttttcggaattttaccgtcgaggtggtcggagtcggcgacacctgttcgttcgcccaaatggacgtgagacagcacggccacccacagtggctgtctgccggtcagactgaggcgagcgtgtaccaacaggcggaagacgggaagacagagctgtccctgatgcattttgctatcacaaacccaggctggcagcctcctagagaaagcacagccttcctggggttcttgaaggaacaggtgcaacgagacggtgccgctgcctcactggcccaggggggactgctgcctgagaacgcgctgtttacctcaatacagtctctccaatctgagtccgagcccctttctttgattgccaacgtcgtggctggcagttcatgccgagggcctccgttgcccagagatttacagggcagccgtcatagagctgaggtggcgtccgccctgcgatcattctcgcccctgcaaccaggtcaggcccctacaggtagggcccattccaccatgactggctccggagtggatgccaggaccgcctcctccgggtcttccgtttgggaaggacagctccaatccttggtgctcagcgaatatgcttccaccgaaatgtcccttcatgcattatatatgcatcagctccacaagcagcaagctcaggctgaacccgaaagacatgtatggcatcggcgagagagcgacgagagtggtgaatccgccccagacgagggtggagagggcgcaagagccccacagagtataccccgatcagcatcctacccttgcgcagcaccgcgaccaggcgctccagagacaacagccctccacggcggattccagcgacgatatgggggaataacggatcccggaacggtgccacgggtgcccagtcacttctcacgcctgcctctcgggggatgggcagaggacggacagtctgcatcgaggcatccggagccggttccagaggaagggtcagaggatgagttacccccacaggtgcataaggtgtag

SEQ ID NO: 215065 - DNA, 2337 bp, Artificial Sequence
  Description of Artificial Sequence: Synthetic coding sequence
atgctcattggagaaatctttgagctgatgcagtttctgtttgtggttgcttttactacctttctggtcagttgtgtggattacgatatacttttcgcaaataagatggtgaaccactctctgcaccccaccgagcccgtgaaggtcactttgccagatgcttttctcccagcacaagtatgttcagctcgcatccaggaaaacggaagcctgatcacaatactggttatcgctggcgtcttctggatccatcgcttaattaaatttatttacaacatatgctgttattgggaaatccactctttctatctccatgccctcagaataccaatgagcgcgttgccttattgcacctggcaagaggtgcaggctcggattgttcagactcagaaagaacaccagatatgcattcataagagagagttgacggaactagacatataccaccggattctgagatttcagaattatatggtggccctggtcaataagagtctgctgcctctacgtttcaggctcccagggctgggtgaagccgtgttcttcactaggggactgaagtataactttgaactcatactgttctggggccctgggtccttatttttaaatgagtggagcctgaaagcagagtacaaaagaggaggccagagactcgaattggcacagcgactgtctaaccggatactatggatcggcatcgctaacttcttgctgtgcccactgatcttgatttggcagatcctgtatgctttcttctcttatgctgaggtcctcaagcgggagccaggcgctctgggcgctcgatgctggagcctgtacggcaggtgctaccttcgccactttaacgagctggaacatgagcttcagagtaggctgaatcgtgggtacaagccagcttccaaatacatgaattgctttctgtcgcctctgcttaccctgttggccaagaatggagccttctttgcagggagcatactggcggtgctcatagctttaactatttacgatgaagatgtgctagcggttgaacacgtgctcaccactgttaccctcctcggggttacggtcactgtttgccgatcgttcattcctgatcagcatatggtgttttgccccgaacagttgctgagagtgatactcgctcacatacattatatgccagatcactggcaaggaaacgcgcaccggagccagactcgcgacgagtttgcccagctgttccagtacaaggctgtgtttatccttgaagagctcctcagcccaattgtgacacccctaattctgatcttttgtctgaggcctcgagccctggagataatcgacttcttccgaaacttcaccgttgaagtcgttggggtaggggatacgtgctccttcgctcagatggacgttcgacaacacggccacccccagtggctctctgcgggacagactgaagcaagtgtgtatcagcaggctgaggacggtaaaacggagctgagcctgatgcattttgcgattacaaaccccggatggcaaccccctagggagtccaccgcattcctggggtttctaaaggagcaggtccagagggacggcgcagcagcttcgctcgcacaggggggtcttctgccggaaaatgctctatttaccagcattcagtcattacagtctgagagtgaacccctatctctcattgccaatgtcgttgccggaagctcttgcaggggccctcccctgccaagagacttgcaggggtctaggcatcgagctgaggtggcctctgctctgcggtctttttcgccactccagcccggacaggcacctacaggcagggcgcatagcaccatgactggcagcggcgtggatgctcgaacagcttcctccggcagcagtgtgtgggagggtcagctccagagtcttgtactctccgagtacgctagcaccgagatgagtctccatgctctttatatgcatcagctccacaagcagcaggcacaagctgagcccgaaagacacgtgtggcatagacgagaatcggacgagagtggcgaaagcgcccctgacgaaggaggcgagggagctcgcgcacctcagagtattccacggagcgcctcttatccctgtgcagcaccgagacctggcgcaccggagactacagccctccacggtggctttcaacgtaggtacgggggtatcacagatccgggaaccgtgcctagagtccctagccacttcagtcgcctgccactgggtggctgggcggaagacggacagtccgcatcccggcatcccgaacccgtacccgaagagggaagtgaagatgaactgcccccacaggtgcacaaagtgtag

SEQ ID NO: 215066 - DNA, 2520 bp, Artificial Sequence
  Description of Artificial Sequence: Synthetic coding sequence
atggcgcagtttgatactgagtaccaacgcttggaagcctcctattctgatagtccaccaggggaggaagatctgctggtccatgtcgcagaaggttccaagagtccttggcaccatatagagaatcttgatctgtttttctcacgtgtatacaatctccatcagaagaacggatttacatgcatgctgattggcgagatattcgaactcatgcagtttctatttgttgtggccttcaccaccttccttgtgagctgcgtcgattacgatattttgtttgccaacaagatggttaatcactctctccacccgacggagccagtgaaggttacccttcccgatgctttcctgccagcccaggtgtgcagcgctcgtatacaggaaaatggtagcttgataacaatcctcgtgattgctggcgttttctggattcaccgactcataaagtttatctataacatatgttgttattgggaaattcactctttctatctgcacgctctgaggatccctatgtccgctctcccctactgtacctggcaggaggtgcaggcccgtatcgtacagacgcagaaggagcatcagatttgtattcacaaaagggagctgactgagctcgacatataccacagaatcctgcgattccaaaattatatggtggccctagtgaacaagtccttgttgcctcttaggttccgtctgcccggattgggtgaggccgtgttcttcacccggggactgaagtataatttcgagcttattctgttttgggggcctggctctcttttcttgaatgagtggagcctgaaggcggagtacaagcgaggcggtcagagactagagctggcgcagcgtctgtccaaccggatcctctggatcgggattgctaatttcttactctgtcctctcattctgatttggcagatcctttatgctttcttctcatacgcagaggtgctgaagcgcgagccaggtgcattaggcgctaggtgctggtccttgtatggacggtgctacctgcggcacttcaacgagctggagcacgaacttcagagtaggctgaaccgtgggtataagcccgcatccaagtacatgaactgcttcctgtcccccctcctcaccctgctggccaaaaacggggcattttttgccggtagcattttagctgtattaatcgccctcactatttatgatgaggacgtgctcgccgtggaacacgtgttaactacagtcacattacttggcgtgacagtgaccgtctgcagaagctttattccggaccagcacatggttttttgtccagaacagcttttgagagtgattctggcacatatccattacatgcctgaccattggcaggggaacgcccataggagtcagacaagagacgagttcgcccagttgtttcagtataaagccgtttttatccttgaggagttactgagccccattgtgacccctttgatcctgatcttttgtctgagaccaagagcgctggaaatcatagacttctttcgcaatttcacggtagaggtggtgggcgtaggggatacgtgcagctttgctcagatggatgtgcgacaacatgggcacccccaatggctaagtgcaggccagaccgaggcgagcgtttaccagcaggccgaagacggtaagactgaactctctctgatgcactttgcaattacaaaccccggttggcagcctcctcgggagtcaaccgcttttctggggttcctgaaagagcaagtgcagagggatggagcagcagcaagcctcgctcaaggaggacttttacccgagaacgcactcttcacaagtatccaaagcctgcagagcgagtccgagcctctctcgcttatcgccaacgtggtcgcaggttcttcctgtcggggacctccactgcccagagatttgcaaggcagtcgacatagagccgaagttgcttcggccctgagaagcttttctccattgcagccaggtcaggcacctacaggacgagcacacagcacaatgacagggtctggggtcgacgccaggactgccagttctggcagttctgtgtgggagggtcagctccagtcgctggttctgtccgaatacgcctctaccgaaatgagtcttcatgcactttatatgcaccagctccacaagcaacaggctcaggcagagcctgagaggcatgtatggcaccgacgggagtccgacgagagtggagagtcagcccctgatgaaggaggcgagggagctcgggcaccccagtctatccccagatccgccagctacccatgcgccgcacccagacctggcgcaccagaaactaccgccttgcacgggggatttcagaggcgttatggaggcattactgatcccggaacagtcccgagagtgccctcccatttttcaagactgccattgggtgggtgggccgaggacggtcagagtgccagccgacaccctgaaccggtgcccgaagagggaagcgaggacgagctccctccccaggtgcacaaggtgtag

SEQ ID NO: 215067 - DNA, 510 bp, Artificial Sequence
  Description of Artificial Sequence: Synthetic coding sequence
atggcccagttcgataccgaatatcagcggctcgaggcaagctactctgattcgccaccaggagaggaggatttgctcgtgcatgtcgcagaaggctcaaagtccccctggcaccacatcgagaatctggacctcttttttagtcgggtgtacaatctgcaccaaaagaacggattcacgtgcatgctgattggggaaatttttgaactgatgcagtttcttttcgtggttgctttcaccacattcttagtatcctgcgtggattacgatatactgttcgcgaataagatggtcaaccattcattgcatcctacagaaccggttaaggtgacccttccagacgcctttctgcctgctcaggtgtgcagcgctaggatacaagaaaacggcagtcttatcacgatcctggtgattgcaggcgtcttctggattcatcgccttatcaaatttatttataacatttgttgctactgggaaattcacagcttctacctccacgccctgcgatag

SEQ ID NO: 215068 - DNA, 435 bp, Artificial Sequence
  Description of Artificial Sequence: Synthetic coding sequence
atggcccaattcgacaccgagtatcagcgattggaggcttcatatagtgactctccacccggtgaggaagacttactggttcacgtggccgaggggtcaaaaagtccctggcaccacattgagaatctggatctcttcttcagccgcgtgtacaatcttcatcaaaagaacggattcacctgtatgctgattggggagatatttgagctgatgcaatttctcttcgtagtagcctttaccacattcctagtgtcatgtgtggactatgacatcctctttgccaacaagatggtgaaccacagcctccaccctaccgagcctgtgaaagttacactccctgacgcgttcttaccagcacaggtctgttccgctcggatccaagaaaacggcagcctaattacaatcttggtcatcgctggagtcttttggatctag

SEQ ID NO: 215069 - DNA, 282 bp, Artificial Sequence
  Description of Artificial Sequence: Synthetic coding sequence
atggcccaatttgacacagaatatcagaggctagaagcatcctattctgactcaccgcctggcgaggaggacctgctcgtgcatgtcgcagaaggctccaagtccccatggcaccatatcgaaaacctggatctgtttttcagccgggtctataatcttcaccagaagaatggcttcacctgcatgctcattggtgaaattttcgagctaatgcagtttctctttgttgtggcatttacaacttttctggtgagctgcgtggactacgacatcctcttctag

SEQ ID NO: 215070 - DNA, 567 bp, Artificial Sequence
  Description of Artificial Sequence: Synthetic coding sequence
atggctcagttcgataccgaatatcaacggctggaggcatcttacagcgacagccctcctggtgaagaagacctccttgtgcacgtagctgaaggatcgaaatcaccttggcatcacatcgaaaatttggatctgtttttctccagagtttataatctccaccagaaaaacggcttcacatgcatgctaatcggcgaaatatttgagctgatgcagtttttgtttgtcgtcgcttttacaactttcctggtcagttgtgtggattatgatatcctgtttgctaataaaatggttaaccactcccttcacccgactgagcccgtaaaagtgactttgcccgatgcattcctgcctgctcaagtgtgctccgcacgaatccaggaaaacggaagcctgattaccatactcgtgatagcaggtgtgttttggatccatcgactcataaagttcatttacaatatttgttgttattgggaaattcattccttctatctacacgctcttaggatccctatgtccgcattgccctactgcacgtggcaggaagtgcaggcacggattgtctag

SEQ ID NO: 215071 - DNA, 396 bp, Artificial Sequence
  Description of Artificial Sequence: Synthetic coding sequence
atggcccagttcgacaccgagtaccagcggctggaagcgtcttattccgattcccctcctggcgaagaggatctactcgtgcacgtggcagagggttcgaaatccccctggcatcatatcgagaatctggatctgttttttagtagagtttacaatctgcaccagaagaatggattcacttgcatgctgatcggcgaaatttttgaactgatgcaattcctcttcgtggtggcttttactacctttctggtaagttgtgtcgactacgacattctgtttgccaacaagatggtcaatcactcgctccatcctactgaacccgttaaggttactctacccgacgccttcctgccagctcaggtgtgcagtgccaggattcaggaaaatggtagctag

SEQ ID NO: 215072 - DNA, 294 bp, Artificial Sequence
  Description of Artificial Sequence: Synthetic coding sequence
atggcccagtttgacaccgaatatcagcggctggaggcgagttacagtgatagtccacctggtgaggaagacctgctcgtgcacgtcgctgaaggcagcaagagcccatggcatcacatagaaaacttagacctgttcttcagtcgggtatacaacctgcatcagaaaaacggctttacttgtatgctgatcggagagatttttgagctaatgcagtttctctttgttgttgcttttaccacttttttagtaagctgcgtcgactacgacatcttgttcgccaataaaatgtag

SEQ ID NO: 215073 - DNA, 519 bp, Artificial Sequence
  Description of Artificial Sequence: Synthetic coding sequence
atggcccaatttgacacagaataccagcgactcgaggcctcatactctgatagccctcctggagaggaggatctcttggtgcatgtggcagaaggctcaaaaagtccttggcaccatatcgaaaatctcgacctattcttctcccgcgtctataatctgcaccaaaagaatgggttcacctgcatgctgatcggggaaatcttcgagttgatgcagttcctcttcgtggtcgccttcacaacttttctcgtttcctgcgtggattacgatatcctctttgccaataagatggtgaaccattcactgcaccctacggagccggttaaggtcactctgccagatgcatttttgcccgcacaggtgtgtagcgcacgcatccaagaaaatgggtcactaattaccattctggtcattgcgggagtattctggatccaccgtttgatcaaatttatctacaacatttgctgctactgggaaatccattctttctatctccatgcactgcggatccccatgtag

SEQ ID NO: 215074 - DNA, 1662 bp, Artificial Sequence
  Description of Artificial Sequence: Synthetic coding sequence
atggcaaaaaacagacgcgaccggaactcctgggggggttttagcgaaaagacctatgagtggagctctgaagaggaggagcctgtgaagaaggccggacctgtgcaggtactgatcgtcaaggacgatcattctttcgaactggatgagaccgcattaaataggattctgctgtcggaggctgtccgcgacaaggaggtcgttgctgtctccgttgccggtgcatttcgaaaaggaaagtcattcctgatggactttatgctgcggtatatgtacaaccaggagtcagtggattgggtgggtgattacaacgagcctctaaccggctttagttggcgcggaggatctgagagagaaaccaccggcatccagatttggtccgagattttccttatcaacaagccggacggaaagaaagttgccgtgttgctcatggatacacaaggtacattcgactcccagagtactctaagggatagcgcaactgtgttcgcactgtcaacaatgatttcaagtattcaagtgtataatctctcacagaatgtccaggaggatgatctgcagcacctacaactgtttaccgagtatgggagactggccatggaggaaaccttccttaaacctttccaatctctgatattcttagtgcgcgattggagctttccatacgagttctcctatggagccgatggtggggcaaagtttctcgagaaacgacttaaggttagcggcaatcaacacgaagagctgcagaacgtccggaaacatatacactcctgctttactaacattagttgctttttactaccccacccagggcttaaggtggccaccaacccgaactttgatggcaagctgaaagaaatcgacgacgaatttataaagaacctgaagatcttgattccctggctcctttccccagaatctcttgacattaaggagattaatggaaacaagataacctgtagggggctcgtcgagtattttaaggcatatattaagatctaccaaggagaagagcttccccatccaaagagcatgctgcaagccaccgccgaggcaaacaaccttgcagctgtcgctaccgcaaaagacacttacaacaagaaaatggaggaaatttgcggtggggacaagccctttctggcccctaacgacctccagacgaagcacctgcagctcaaagaagagagcgtgaagctgtttcggggtgtgaagaagatgggaggtgaggaattttcgcgacgctatctccaacagctcgaaagtgagatagacgagctatatatacagtacattaagcataacgattctaagaatatttttcatgcagcaaggacacctgcaacactgtttgtggttatttttataacatacgtgatcgccggagtaacgggctttatcggacttgacatcatcgcctcactgtgtaacatgattatgggcctgacccttataaccctatgtacatgggcatacattaggtattctggggaatatagggaattgggggcagttatcgaccaggtcgctgcggctctttgggaccaagcactgtataaactgtacagtgcagccgcaactcatcgacacctttaccaccaggcattcccaacccctaaatcagagtcaacagagcaatccgagaagaagaaaatgtag

SEQ ID NO: 215075 - DNA, 1677 bp, Artificial Sequence
  Description of Artificial Sequence: Synthetic coding sequence
atggcgaagaatcggagggatagaaatagctgggggggtttttctgaaaagacctacgagtggtctagcgaagaagaggaacccgtcaagaaagccggtcctgtgcaggtgttaattgttaaagacgaccatagctttgaattggacgagacggccctcaacagaatcctgctgagtgaggccgttcgcgataaagaggttgtcgccgtgagcgtggcaggggctttcagaaaaggcaaaagtttccttatggactttatgcttagatatatgtacaaccaggaatcagtggactgggtgggcgattataacgaacctctcaccggcttcagttggcgaggtggctcagagagggaaacgactggaattcagatctggagcgagatcttcctgatcaacaaaccagacggaaagaaggtggccgtcctcctcatggatacacaggggacgtttgactcgcaatcaaccctgagagattccgcaaccgtgtttgctctgtccaccatgattagcagcatccaagtctacaatttatcgcagaatgtgcaggaagacgacctgcagcatctgcaactgttcacagagtatggtagactcgctatggaagaaactttcctcaagccgttccagtcgcttatctttctagttagggactggtcattcccctatgagttcagctatggagccgacggaggagccaagttcttagagaagcggttgaaggtttcaggtaatcagcacgaagaattgcagaatgtgcggaaacacatccatagctgtttcacaaacatctcatgcttcttgctgccccatcctgggctgaaagtggctactaatccaaactttgacggaaagcttaaggaaatagatgacgaattcatcaaaaacctgaagattcttataccatggctgttgtcccctgagagcttggatattaaggaaatcaatggcaacaagatcacatgcagaggcctggttgaatactttaaagcatatattaaaatttaccagggagaggaacttccccacccaaagtccatgctccaggccacagcggaggctaacaatctggcagctgttgccaccgccaaagacacgtataacaaaaagatggaagaaatatgtgggggagacaagccgtttctcgcgcctaatgacttacagactaagcatctgcaactgaaagaggagtccgtcaaactgtttagaggtgttaagaagatgggaggtgaggagtttagtcgcagatacctacagcagctggaatcagagattgatgagctctatattcagtacattaagcacaacgacagtaagaacattttccacgcagctaggacacccgctacactcttcgttgtgatattcatcacttatgttattgccggagttactggattcataggcctcgacattatcgcaagcctgtgcaacatgataatgggcctcacactaataactctttgcacatgggcatatatcaggtattccggcgaatacagggaattgggggctgtgatagaccaagttgccgctgcactgtgggaccagggcccttctcatcaggcattgtacaaattatactccgcggctgccacacaccgccacctgtatcatcaagcctttcccactccaaaatctgagtctaccgaacagagcgagaaaaagaagatgtag

SEQ ID NO: 215076 - DNA, 1677 bp, Artificial Sequence
  Description of Artificial Sequence: Synthetic coding sequence
atggcgaaaaaccgtagagaccgcaactcctgggggggattttcagagaaaacatatgagtggtccagtgaagaggaggaacctgtaaaaaaggcaggccctgttcaggtccttatcgtcaaggatgatcactctttcgagctcgatgaaacggcactcaaccgcatcctgttgtctgaggccgtgcgagacaaggaagtggtcgcagtcagcgtggcaggcgctttcagaaagggaaaatccttcttgatggactttatgctccggtacatgtataaccaggagtctgtggactgggtcggcgattacaacgagcccctgaccggattctcttggcgcggaggatcagagcgagaaacaacagggattcagatctggtctgaaatctttctgataaataagcccgatggcaaaaaagtggccgtgctgctgatggatactcaggggaccttcgactctcagtcaaccttgcgggactctgccacagtgttcgcgctatccaccatgatctcgagtattcaggtttataacctgagccaaaacgtgcaggaagatgatttgcagcacttgcagctgttcactgaatatgggagactggccatggaggaaacttttctcaaacctttccaaagtcttatctttctggtgcgcgattggtcatttccctacgagttttcctacggcgctgatgggggtgcgaaatttctcgaaaagagacttaaggtgtctggaaaccagcacgaagagcttcagaatgtccgcaagcacatacattcttgcttcacgaatatttcctgcttccttctcccacatcccggtttgaaggttgcgaccaaccccaatttcgacggaaagctgaaggagatcgatgatgagttcatcaaaaacttaaagattctaatcccatggctactctcccccgagtctctggatattaaggagatcaacggtaacaaaattacttgtcggggtctggtagagtacttcaaggcatatataaagatttaccagggcgaagagctgccacatcccaaaagtatgctgcaagcgacagcggaagctaacaatctagccgcagtcgccacagccaaggacacatataacaagaagatggaggaaatctgcggtggggacaagccttttttggcccctaatgacttgcagaccaagcacctgcagctcaaggaggaaagcgtcaagttgttcaggggtgtcaagaaaatgggcggagaggaattctctcgcagatacctgcagcagcttgagtctgaaatcgacgaactatacatacaatatattaaacataatgactccaaaaatatctttcatgccgctagaacaccggcaactctcttcgtggtgattttcataacttacgttatcgcaggcgttacaggtttcatcggtctggatattatagcatcactatgtaatatgattatggggttgacactcataacattatgcacatgggcttacataagatactctggggaatacagggagctgggagccgttattgaccaggtggccgctgccctctgggatcagggaagtaccaatgaagcactgtacaaattatactccgcagcagccacacacagacacctgtaccaccaggccttccctacgcccaagtctgaaagcaccgagcagtcggaaaaaaaaaaaatgtag

SEQ ID NO: 215077 - DNA, 1662 bp, Artificial Sequence
  Description of Artificial Sequence: Synthetic coding sequence
atggcaaagaataggcgtgaccgaaattcctggggcggtttttccgagaaaacgtatgagtggagctctgaagaagaagagccagtgaagaaagctggcccagtccaggtgctaatcgttaaggatgatcactcatttgagcttgatgagaccgccttgaaccggatcctgctttcggaagctgttcgtgataaggaagtggtggccgtgtccgtcgccggtgccttccgtaaagggaagagctttctaatggacttcatgttgcgatatatgtacaaccaggagagtgtcgattgggtcggggactacaatgagcctcttacagggttctcttggagggggggaagcgagcgggagacaaccgggatccagatttggtccgaaatatttttaatcaacaagcccgatgggaagaaagttgctgtgctgctaatggacacacaagggacgttcgattctcagagcacccttagggacagcgcaaccgtgttcgctctctccaccatgataagctccatccaggtctataacctgtcacaaaacgtgcaggaagatgacctgcagcacctgcagctattcacagaatatggccgattggccatggaggagactttcctgaagccatttcagtctttgatattcctggtgagagactggtcctttccatatgaattctcctacggagcggatggtggagcaaaatttctggagaagcgactaaaggtgagcggaaatcagcacgaggagctgcagaatgtgcgaaaacacatccactcatgcttcacgaacatcagttgctttctgctgccacacccgggtctgaaagtcgctacaaatcctaacttcgatgggaaactgaaagagattgacgacgaattcatcaaaaatctgaaaatactgatcccatggttactcagccctgagtctctcgacatcaaggagatcaatggcaacaaaatcacctgtcgtggcctcgtggagtattttaaggcctatattaagatctatcaaggagaggaactgcctcaccctaagtctatgctccaggccacggccgaggccaataaccttgctgccgtggccaccgctaaggacacttataacaaaaagatggaggagatttgtggtggcgacaaaccgtttcttgcacctaacgatttacaaactaaacatctgcaactgaaggaagaatctgtgaaactgttcagaggagtgaaaaaaatgggcggagaggagttctcaagaaggtatcttcagcagctagagagcgagatcgatgagctgtatatccagtatatcaaacataatgatagcaagaacatatttcatgctgccaggactcctgccacactgttcgtggttatcttcattacctacgttatcgcaggggtcactgggtttatcgggctcgatattattgcgtctctctgtaacatgattatgggactgactctcatcacgttgtgtacctgggcctacataagatatagcggtgaatatcgcgagctgggagcggtgatcgaccaggtagctgccgctctatgggatcaggccttgtataaactctattctgccgcagccacccaccggcatctttatcatcaggccttccctacccctaagagtgagtccacagagcagagtgaaaaaaagaaaatgtag

SEQ ID NO: 215078 - DNA, 90 bp, Artificial Sequence
  Description of Artificial Sequence: Synthetic coding sequence
atggcaaaaaataggagggataggaattcctgggggggattttcggaaaaaacatacgagtggtcttccgaagaagaggagcctgtgtag

SEQ ID NO: 215079 - DNA, 303 bp, Artificial Sequence
  Description of Artificial Sequence: Synthetic coding sequence
atggctaagaaccgcagggataggaattcttggggcggattttccgaaaaaacctatgaatggtctagtgaagaagaagagcccgtgaaaaaggcaggccctgtgcaagtactgatcgtcaaagatgaccactcgtttgaactggacgaaaccgcactgaaccgaatcctgttaagcgaggccgtgagggataaagaggtggtggccgtcagtgtggccggagctttcaggaagggtaagagcttccttatggatttcatgttacgctatatgtacaaccaggagtccgtggactgggtgtag

SEQ ID NO: 215080 - DNA, 1701 bp, Artificial Sequence
  Description of Artificial Sequence: Synthetic coding sequence
atggtgctcaagaaaggaataaaatttttccagcggcttatcaactctaaaagtctccgattcggcgaaaactatgaggatgacgatcttgtaaactccgacgaggttatgaaaaagccctgtcctgtccagattgttcttgcccacgaggatgatcataactttgagttggacgaagaagcattggagcaaatcctgctgcaggagcatattagagatctgaatattgtggtcgtaagtgtggccggagccttccggaagggaaagtcttttcttctagattttatgctgcgatatatgtacaataaagactctcaaagctggattggaggtaataacgagcccctcactggctttacctggcggggtggctgtgaacgggaaacaaccggtatccaggtatggaacgaggtctttgtgattgaccggcctaacgggactaaagtggcggtgctcttaatggatacacagggtgcatttgattcacaatccactattaaggattgtgccacggtttttgcacttagcaccatgacatcatccgtgcaggtgtacaacctcagccagaacatccaggaagacgatctgcaacacctgcagctctttaccgaatacggcagattagcaatggaggagatctatcagaagccttttcagacgttgatgttcctgatcagagactggtcctatccatatgaacacagctatggcctggagggtgggaaacagtttctcgaaaagcggctccaggtgaaacagaatcagcacgaagagctgcaaaacgtgcggaaacatattcacaattgtttctctaatcttggctgcttcctactgccccaccccggactaaaggttgccactaatccgagcttcgatgggcgtttgaaagacattgacgaagatttcaaacgggagctgagaaacctggtcccattgctactagcgccagaaaacctggttgagaaggaaatctctggttccaaagtgacctgtagagacctggtggaatactttaaagcatatattaagatttatcagggagaagaactgccacacccaaagagcatgcttcaagccaccgcggaggcaaataatctcgccgctgttgctggagctagagatacttattgtaaatccatggaacaggtatgtggaggcgataagccctatattgcgccatcagacctggaacggaagcacttggaccttaaggaggttgccataaagcagttcaggagtgtgaagaaaatgggaggggatgagttttgtcggagatatcaagaccaactagaagccgaaattgaagagacctatgcaaacttcatcaaacacaacgatggtaagaacatattctacgcggctcgcaccccagccacattgtttgcggttatgtttgccatgtacattatctctggcctgacaggcttcattggtctcaactctatagctgtattatgtaatctggtgatgggtcttgccttgatctttctgtgtacatgggcatatgtgaaatactccggcgagtttagggagatcgggaccgtaatcgaccagatcgctgaaacattgtgggagcagcgcagtcctcgtaaggtgttttcaaaactcttcgaggtcactagacgcaggatggtgcaccgggctctgtcatccgcccagcgacagagactatcttctaacaataataagaagaagaattag

SEQ ID NO: 215081 - DNA, 1752 bp, Artificial Sequence
  Description of Artificial Sequence: Synthetic coding sequence
atggctgagggcgacgaagccgcacgaggtcagcaacctcaccagggactatggaggagaagaaggacgtcagacccatctgctgcagtgaatcacgtatcgtcaacaaccagcttgggtgaaaactacgaagacgacgacctggtgaatagtgatgaggtaatgaagaagccctgtccagtgcagattgtgctcgcgcatgaggatgaccataacttcgagctcgatgaagaggcgcttgaacaaattctcctacaggagcatattcgcgatttgaatatcgtggttgtgtccgttgcgggagccttcaggaaaggaaaatcttttctattagactttatgctgcgctatatgtataacaaagacagccagagctggataggtggaaacaacgagcctctgactgggtttacatggcgaggcggatgcgagcgtgaaacgactggcattcaggtttggaacgaggtctttgtcatagaccggcctaacggaacaaaagtcgccgttttgctcatggatacacagggagcatttgactcacagagcaccatcaaagactgtgccactgtgttcgcgttgtcaaccatgacttccagtgtccaggtttacaatttatcacagaatattcaagaagacgaccttcagcacttgcagctatttacggaatatggccgactggcgatggaggagatttaccagaaaccgtttcagacattaatgtttctgattcgcgactggtcttacccatacgaacattcctacggccttgaaggcggaaaacagttcctagagaaacggctgcaggtaaagcagaatcagcacgaagaactccagaacgtaagaaagcacatccacaactgctttagtaatctgggatgttttcttctgccacatccaggcttgaaggtcgccacaaacccctccttcgacgggcgactgaaggacatcgacgaggattttaaaagagaactgcggaatcttgtccccctcctgctggcgccagaaaatcttgtggagaaggaaatcagtggttcaaaggtgacatgcagagatctagtcgagtactttaaagcctatatcaaaatctatcagggcgaagagctccctcacccgaagtccatgttgcaagccactgcagaagcaaataacctggcggcagttgccggtgcccgtgacacgtattgtaaaagcatggaacaggtgtgcggcggagataaaccatacattgcgcctagtgatctggaacgtaaacatttagatctcaaagaggtggccatcaagcagtttcggagtgtcaaaaaaatggggggagacgaattttgtcgacgataccaggaccagctcgaagcggagatcgaggaaacctatgcaaattttatcaaacacaacgatggaaaaaatattttttacgccgctaggactccagctactctctttgcagtgatgttcgctatgtatattattagcggactgacaggattcattgggctgaactccatcgccgtattatgcaatctcgtcatgggcctggctttgatctttctctgtacctgggcatatgtcaagtattcgggggaatttagggagataggcacagtgatcgaccagattgcagagaccctgtgggagcaggttctgaaaccgctcggcgacaatctaatggaggagaatatccgacagtcagtcactaactctataaaagctggccttactgatcaagtgtctcaccacgcacgattaaagaccgactag

SEQ ID NO: 215082 - DNA, 1239 bp, Artificial Sequence
  Description of Artificial Sequence: Synthetic coding sequence
atggacacgcagggagcatttgattcccagtctactatcaaggactgcgccaccgtattcgcactgagcactatgacaagctcagtgcaggtgtacaacttatctcaaaatattcaggaagatgaccttcagcatctccagctgtttactgagtatggcagactcgccatggaggagatatatcagaagccattccagaccctcatgttcctcatccgagattggtcatacccttatgaacattcgtatgggttggaagggggtaagcaattcctggagaaacggctgcaggtgaagcaaaaccaacacgaagaactacagaacgtccgcaagcatattcacaactgtttctccaaccttggttgctttctcctgccacatcccggactcaaggtggctaccaatccatccttcgatggcaggctgaaggatatagatgaagactttaagagggaactgcggaatcttgtgcccctgctcttagcgcctgagaatctagtagagaaggaaataagtggctccaaagtaacatgtcgggatctcgtggaatattttaaagcctatataaaaatctaccagggcgaggagcttccccacccgaagtcaatgttacaggcaactgctgaggccaataacttggcagccgttgccggagcacgtgatacatactgcaaaagcatggaacaagtgtgcggaggagataaaccgtacattgccccaagtgaccttgagcggaagcacctagacctgaaagaggtagcaataaaacaatttcgttctgttaagaagatgggcggagatgaattttgtcggagatatcaggaccagttggaggccgaaatcgaagagacctatgcgaattttatcaagcacaacgacgggaagaacattttctacgcagcccgaacgcccgcaacattattcgccgtgatgttcgctatgtacataatttcggggcttactggattcataggcctgaattccattgctgttctttgcaatctggttatggggctggctctgatctttctctgtacttgggcctacgttaaatactctggggagttccgcgagataggtacagttatcgaccagattgctgagacattgtgggaacaggtcctgaagcccctgggcgataacctgatggaggagaacatccgtcagagcgttactaattcaatcaaagcgggactgaccgaccaggtgtcacatcacgccaggctgaaaacagactag

SEQ ID NO: 215083 - DNA, 1740 bp, Artificial Sequence
  Description of Artificial Sequence: Synthetic coding sequence
atggctgagggagatgaagctgcacgtggtcaacagccccaccagggcttgtggaggcggaggagaacctcagatccctcagcagccgtgaaccacgtgtctagtactacctctttgggggaaaactacgaagatgacgatcttgtcaattccgacgaagtcatgaagaagccctgtcctgtccagattgtgctggctcatgaagacgaccacaacttcgagctggatgaagaggcgttggagcagatcctgttgcaggaacatataagagacctgaatatagtggtggtgagtgtcgcgggagctttcagaaagggaaaaagcttcctgttggatttcatgctcaggtatatgtacaataaagattctcagagttggatcgggggtaataacgagccactgacaggtttcacgtggaggggcggatgcgagcgggagacgaccggcattcaggtgtggaacgaggtcttcgtgatcgataggcccaatggaacaaaagtcgctgtgcttttgatggatacccagggggcattcgactctcaatctaccataaaggactgtgctacggtgtttgcactatcaacgatgacctcttctgtgcaggtgtacaacttgagccagaatatccaggaagatgacctgcagcaccttcagctgttcaccgaatatgggcgactggctatggaagaaatatatcagaagccgttccaaacattgatgtttcttatccgagactggtcttacccttatgaacatagctatggccttgagggtggcaagcaatttctggagaaacgcctccaggtcaagcagaatcagcatgaggaactgcagaacgttcgaaagcatatacataactgttttagcaatctcggttgtttcctgctcccgcatcccggactgaaagtggctaccaacccaagtttcgacggcagactaaaggacatcgatgaggacttcaagcgggagttgagaaacctggttccactgctgctggctcctgagaacctggttgagaaggaaatctcaggatctaaggttacttgcagggatctggttgaatactttaaggcttatatcaagatttaccagggggaagagctcccccatcctaagtccatgctacaagccacagctgaggcaaacaatctggccgcagtggcaggcgcaagggacacctactgtaaatctatggagcaggtctgcggcggagacaagccttacattgcccctagcgacctggagaggaagcaccttgacttgaaggaagtcgcgataaaacagtttcgcagcgtcaaaaaaatgggcggtgacgaattctgtagaagatatcaggatcaactggaagctgagatcgaggagacatatgccaattttataaagcataatgatgggaaaaatattttttacgccgctagaacccccgctaccctgtttgcggttatgtttgctatgtatataattagtggtttaacaggttttattggccttaatagtatcgccgttttgtgcaacctggtgatggggctggcgctgatattcctatgtacctgggcctacgtcaaatactctggggagttcagggaaattgggaccgtcatcgaccagattgctgaaacactttgggagcaggtgttcagcaagttgttcgaggtgactaggaggcgaatggtacacagagccttatcgtctgcccagcgacagaggctctcttctaacaacaataaaaaaaagaattag

SEQ ID NO: 215084 - DNA, 1239 bp, Artificial Sequence
  Description of Artificial Sequence: Synthetic coding sequence
atggatacgcagggcgctttcgattcgcagagcaccatcaaagactgcgcaactgtgtttgcgctcagtactatgacaagctccgtccaggtgtataatctgtcccagaacatccaagaagacgatttgcagcatttacagctctttacggagtacggcagactcgccatggaagagatttatcagaagccgtttcagacgctgatgtttctgattcgtgattggtcttacccatatgagcactcttacggactcgaggggggaaaacaattcctagaaaagcgactgcaggtgaagcagaaccagcacgaggaactgcagaacgtgcgcaaacatatacacaactgtttctccaacctgggctgcttcttactcccgcatcctggactaaaagttgccacaaaccccagcttcgatgggcgtctgaaagacatcgacgaggactttaaaagagagctgcgcaatctggtgcccctgctgctcgcgcctgaaaacctggtggagaaagagatcagcgggagtaaggtaacatgtagagatttggtcgagtacttcaaggcatacatcaagatttaccagggtgaggagctcccccatcccaagtccatgctgcaagctaccgccgaggccaataatctggccgctgttgcaggtgccagagatacatactgtaaaagcatggagcaggtttgcggcggagacaaaccatacatcgcgccaagtgacctagagcgtaaacatctcgatctgaaggaagttgccattaagcagttccgatcggttaaaaagatggggggagatgaattttgcagaaggtaccaggatcaactggaggccgagatagaggagacctacgcgaacttcattaagcataatgacggcaagaatatattctacgctgcccgaactccagcaacgctgtttgctgtgatgttcgctatgtatattatctccggcctcacgggattcataggccttaactccatcgcagttttatgcaatctggtcatgggactcgccctcatattcttatgtacctgggcttatgtgaaatactctggtgaattcagagagattgggacagtcattgatcagatcgctgagacactgtgggaacaggtgctgaagcctctgggagataatcttatggaggaaaatattcgtcagtcggttaccaacagcataaaagcaggtctgaccgaccaagtctcgcaccacgccaggcttaaaaccgactag

SEQ ID NO: 215085 - DNA, 1242 bp, Artificial Sequence
  Description of Artificial Sequence: Synthetic coding sequence
atggatactcagggtgcctttgactcccaatccacaatcaaggactgcgcaaccgtgtttgccctgagcaccatgacctccagcgttcaggtgtataacctgagccaaaacatccaggaggacgatctacagcacctgcaattgttcactgaatatggcaggcttgccatggaagagatttaccagaaacccttccagaccttaatgttcctgatcagggattggagctacccttatgagcactcatatggtcttgaggggggtaaacaatttcttgagaaaagactccaggtgaagcaaaaccaacatgaagaactccagaatgttaggaaacacatccacaactgcttctctaacctggggtgcttcttgctcccacaccctggtctcaaggtggcaacaaatcccagtttcgacggcaggctcaaagacatagacgaggactttaaacgagagcttcgaaaccttgtccctctgctgcttgctccagagaatttggtggaaaaggaaatttctgggtcaaaagtgacctgtcgggatctcgtggagtattttaaggcgtacataaaaatctaccaaggcgaggagttacctcatcccaaaagtatgctgcaggctaccgcagaagccaacaacctcgctgccgttgcaggagcgcgagacacctattgcaagagcatggaacaggtctgcggaggtgacaagccatacattgccccatcggacctggagaggaaacatctggacttgaaagaggtggctattaagcagtttcgctctgtgaagaagatggggggagatgagttttgccggaggtaccaggaccagctggaggcagaaatcgaggagacgtacgctaattttatcaagcacaacgatggaaagaatatcttctacgccgctcggaccccagcgacattattcgctgtcatgttcgcaatgtatatcattagcggtctaacagggttcattgggctgaacagcatcgcggtactttgcaacctggttatggggctggccctgatcttcctctgtacgtgggcctacgtgaagtattcgggagaattccgggagatcggtaccgttatcgaccagattgctgaaaccctttgggagcagaggtctccgcgaaaggtgttttcaaagctattcgaagtaaccagacgccgtatggtgcacagagccctgagctccgcgcagagacaaaggctcagcagcaacaataacaaaaagaagaactag

SEQ ID NO: 215086 - DNA, 1707 bp, Artificial Sequence
  Description of Artificial Sequence: Synthetic coding sequence
atgagaaccgccggtcgagaccctgtgagcgccggtctgcagttccccaaggatggcagcacgcagcggcctgccaaccgcgctcgcttcgtgcctgctcggactagaccttctccgctacacccctgctgcttctgttttgaagggggtggatccatgctatctcctcaaagagtggcagccgcagcgagcaggggagccgacgatgccatggagtccagcaatatcttgcttcaggatcacatcagggatttggatgtggtcgtcgtttcagttgctggggctttccgaaagggtaagtcatttatactggacttcatgctaaggtacctctactcccagaaagagagtggtcacagtaattggcttggagatccagaggaaccactcactggtttctcttggcgcggaggtagcgatcctgaaacgacgggcatccagatctggagtgaggttttcaccgtcgaaaaacccggtggcaaaaaggtagcagtggtgctgatggatactcagggggctttcgactcacaaagcacagttaaggactgcgcaacgatctttgccctctcaacgatgactagcagcgtgcaaatatacaacctctcacagaacatccaagaagacgatttacagcaattgcaactgtttaccgagtacggaagattagcaatggatgagatatttcagaagccgttccaaactctgatgtttttagtgagagactggagcttcccttacgagtatagctacggacttcaagggggtatggcatttttggacaagcgcctgcaagtcaaagagcatcagcacgaggaaattcagaatgtgagaaaccacatacattcttgctttagcgatgtgacctgcttccttttgccccaccctgggctgcaggtagcgacatcgccggatttcgacggaaaacttaaagatattgcaggcgaattcaaagagcagctgcaagctctgattccctatgtattgaatccgagtaaattgatggagaaggagatcaatggttccaaagtgacctgtcggggtctgttggaatattttaaggcttatattaagatttaccagggtgaagacctgccacaccctaaaagtatgcttcaggcgaccgctgaggccaataatctagccgcagcagcaagtgccaaagatatctactacaataatatggaagaagtgtgtgggggtgaaaaaccttatcttagccccgatattctggaagagaagcattgcgaatttaagcaactcgcgctcgaccactttaaaaagacaaagaaaatgggaggcaaagatttctctttccgataccagcaggagctggaggaggaaatcaaagagctgtatgaaaatttttgcaaacacaatggaagtaaaaacgtgtttagcacattccgaactccggcagtgctgttcacaggtattgtggcgctctatatcgcttcaggactgaccgggtttatcggtctcgaagtggtggctcagctgtttaactgtatggttgggctgttattaatagcactgcttacttggggttacataaggtactctgggcagtacagagaactggggggtgctattgacttcggcgctgcttacgtcctcgaacaggcatccagtcatataggcaactcaacccaggcaactgtacgcgatgccgttgttggcaggccaagcatggacaagaaggcacagtag

SEQ ID NO: 215087 - DNA, 1626 bp, Artificial Sequence
  Description of Artificial Sequence: Synthetic coding sequence
atgctgagccctcagagagttgcagccgcagctagccggggagccgacgacgctatggaaagcagtaaacccggtccggtacaagtggtgctcgtgcagaaggaccagcatagttttgagcttgatgagaaggcactcgctagcatccttctacaagatcacatcagggatctcgacgtagttgttgtgtccgtcgccggagcttttcgaaaagggaaatcttttattttggattttatgctacggtacttatattcccagaaggagtccgggcacagcaattggttaggggatcccgaagagcctctgaccgggttttcatggcggggaggttccgacccggagaccaccggaatacaaatttggagcgaggtcttcactgttgaaaagcccggaggtaagaaggtcgccgtggttctaatggacacccagggggcttttgattctcagtctacagtcaaagattgcgctacaatctttgctctaagtactatgaccagctctgtccaaatttacaacctctcccagaatatacaagaagacgacctacagcaactgcagctttttaccgaatatggcaggctcgcaatggatgagatcttccagaagccttttcaaacacttatgtttttagtgcgggactggtcttttccatatgagtattcctacggccttcagggcggaatggcattccttgataagcgcctgcaagtgaaagagcaccagcatgaggaaattcagaatgtccgcaaccatatacactcatgtttctccgacgtgacgtgctttctccttcctcatcccggactgcaagttgctacaagtcccgacttcgacgggaaacttaaggacattgcgggagagtttaaagagcagttgcaggcactgataccctacgtcctcaatccgtctaagttgatggagaaggagattaatggatccaaggttacctgtcgcggactgttagagtattttaaagcctatataaaaatctaccagggagaagacctccctcaccctaaatccatgctgcaagccacagcggaagcaaacaacttagctgctgccgctagtgccaaggacatctattacaacaacatggaggaagtctgtggcggagagaagccctatctgtcacccgatattctggaggagaagcactgcgagttcaagcaactggcattagaccattttaagaagacaaagaaaatgggcggaaaagacttcagtttcagatatcaacaggaacttgaagaggagatcaaggagctgtacgaaaacttttgtaagcacaacggcagcaaaaatgttttttccacgttccggactcccgctgtgctcttcaccggcatcgtggctctgtacatagcctctggtctgactggcttcatcgggctcgaggtggtggcgcaactgttcaactgcatggttggccttttacttatcgcgctcctaacgtggggatatattaggtattccggccagtacagggagctgggcggtgctatcgacttcggtgcagcgtacgtgttggagcaggcctccagccatatcggcaactcaactcaggccaccgtgcgggatgcagttgtgggacgaccgtccatggacaagaaagctcaatag

SEQ ID NO: 215088 - DNA, 1065 bp, Artificial Sequence
  Description of Artificial Sequence: Synthetic coding sequence
atgtcccggctactgcatgctgaagaatgggctgaggtgaaggagcttggggatcaccataggcagccacaaccccatcaccttcctcagccgccaccgccaccacagcccccagctactctccaggccagagagcaccccgtgtatcctccagagctgtctttactggacagcactgatcccagggcttggctggcaccaactctacagggcatctgtacagctcgcgcagcccaatacctcctgcactctcctgaactgggagccagcgaagcagcagcacctagggatgaggtcgatggcagaggcgaactggttcggaggagctctggtggagcgtcctctagcaagtccccaggccctgtcaaggtaagggaacagctctgcaaactgaagggcggagtcgtagttgatgagcttgggtgttcacgtcagcgggcaccctcctccaaacaagtgaacggcgtgcagaagcagcgcagactggcagccaatgccagggaacgccgtcggatgcacggcctgaaccatgcgttcgaccagttacgcaacgtgattccctcatttaacaacgataaaaaactttctaaatacgaaaccttacaaatggcgcagatttatataaacgccttgtcagagttattgcagaccccttctggcggagaacagcctcctccccctcctgctagctgcaagagtgaccatcaccatctgaggaccgcggctagttatgaagggggagcaggcaacgcgaccgccgcaggggctcagcaggccagcgggggatcacaacggcctactccgccaggctcctgtaggacccgtttcagtgccccagctagcgccggtggatactcagtacagctggacgccctgcacttctccacctttgaggactccgccctgacggccatgatggctcagaagaatctctccccgagcttgcctggctctatcctgcagcccgtgcaggaggaaaactcaaaaactagcccacgttcacaccggtcagacggggagttcagtccacactctcattacagcgattccgatgaggcctcatag

SEQ ID NO: 215089 - DNA, 459 bp, Artificial Sequence
  Description of Artificial Sequence: Synthetic coding sequence
atgaagagttgtaaaccctccggaccacccgctggtgcccgtgtggccccaccttgcgccggaggaaccgagtgtgcagggacatgtgccggtgccggtcggttggaatccgcagctcgcaggaggctggccgctaacgccagggaacggcgacgaatgcaggggctgaacacagctttcgacagattaaggcgcgtagtaccccagtggggccaggataaaaagttaagcaagtacgaaactctacaaatggccttaagttacatcatggctctcacaagaatcctggccgaggccgaacggttcgggtccgagagagactgggtcgggctgcattgcgagcactttggacgcgatcactacttgccttttcctggggctaaacttccaggggaatcagaactctatagtcaaagattgtttgggttccagccggagccattccaaatggctacctag

SEQ ID NO: 215090 - DNA, 627 bp, Artificial Sequence
  Description of Artificial Sequence: Synthetic coding sequence
atgtggagatcctgcctacgcctgcgcgacgggggacggaggctcctgaataggccagctggaggccctagcgctagcatgtcccccggtcctacaatcccaagtcctgctcgcgcatacgctccgccaaccgagcggaaacggttttaccagaacgtctctataacccagggagagggcggattcgaaataaatctggaccaccgcaagctgaagacaccgcaggccaagttgtttacggtgccaagtgaagcattggctatcgcagtagctactgaatgggattcacagcaggacacgattaagtactatactatgcacttgaccacactgtgcaatacatctctggacaatccgacccagcggaataaagatcaactcatcagggccgcagtcaaattcttagacactgataccatctgttatcgagtggaagaacccgaaactttagtcgagctgcagcggaatgagtgggacccaatcatcgagtgggcagagaaaaggtacggggtcgaaatcagcagctcaacttctattatggggccatcaatcccagcaaaaactcgggaggtcctggtttcccacctggctagctataacacatgggcactccagggaatggattag

SEQ ID NO: 215091 - DNA, 618 bp, Artificial Sequence
  Description of Artificial Sequence: Synthetic coding sequence
atgtggcgatcttgcctgagactgcgggacgggggtagaaggctgctaaataggcccgctgggggaccaagtgctagcatgtcccctggccctacaattcctagtcccgctcgtgcttatgcccctcctaccgaaaggaagcgtttttaccagaatgtcagcatcacgcaaggtgagggcggatttgaaatcaatctggatcaccgcaaacttaaaactccccaagcaaagctctttaccgtgccttcagaagccttggccatagccgtcgcgaccgagtgggactcccaacaggacacaatcaaatactataccatgcacctgacaacactgtgcaacactagtctggacaacccgacccaaaggaacaaggatcagttaattagggcggcagtgaagttcctggacacagataccatttgctatagggtagaagaaccagagacacttgtggagcttcagagaaacgaatgggacccaataattgagtgggctgaaaagcggtatggagtggagatctcctcctccacctccatcatggggccatctatacccgcaaagacaagagaggtgctggtgtctcacctagcatcatataacacatgggccttgcaatag

SEQ ID NO: 215092 - DNA, 870 bp, Artificial Sequence
  Description of Artificial Sequence: Synthetic coding sequence
atgtggagatcatgcctgcgcttgagggacgggggacgcagacttttaaaccgtccagcaggcggtccctccgcaagcatgagtcccggacccactattccgtctcccgcacgggcatatgccccacccaccgaaagaaagaggttctaccagaatgtatctatcacgcagggggaagggggattcgagataaacttggatcacagaaaactgaaaactccgcaggctaagctattcaccgttccctccgaggcccttgcaattgccgtcgctaccgagtgggacagccaacaggatactataaaatattatacaatgcacctcaccaccctgtgcaacaccagtctggacaacccaacacagcggaacaaggaccagcttattagggcggctgtgaaattcttggacacagacacgatatgttaccgcgtggaagagcccgagacattggtggagctgcagcggaacgaatgggatccaatcattgagtgggcggagaagaggtatggagtggagatcagttcatcaactagtatcatggggccatcaatcccggctaagacacgggaggtgctggtgtctcatttggctagctataacacatgggccttacagggaattgaattcgtggcagctcagcttaagtctatggtccttacactcgggctcatcgacctacgactgacggtggagcaggctgtgttattgtcgcgtctggaggaagagtatcaaatccagaaatggggcaatatcgaatgggcgcacgattatgagctgcaggagctgcgggctcgcaccgcggctggaacactgtttatccacctgtgttctgagagcacaactgtgaagcacaagttgctaaaggagtag

SEQ ID NO: 215093 - DNA, 1590 bp, Artificial Sequence
  Description of Artificial Sequence: Synthetic coding sequence
atgctggggttcgtgggcagggtggcggcagcaccggcaagtggggcattgagaaggttgactccatctgcgagcctgcctccggcacaactgctgttgcgtgccgctccaaccgcagtgcatcctgtgcgggactatgccgctcagacctccccctccccaaaagcaggagcagctacagggcgaattgtggcggttatcggcgcagtggtcgatgtacagtttgacgaaggtcttccacccatccttaacgccctcgaggtccagggcagggaaacccggttggtactcgaagtggcgcagcacttgggtgagtcaactgtgaggactatcgctatggacgggacagagggactagtgcgtgggcagaaagtgttagatagcggcgctcccattaagatccccgttggacctgagacacttggtagaataatgaacgtgataggtgagcccattgacgaacgtggccctattaagactaagcagtttgcgcctatccacgcagaagcaccagaattcatggagatgagtgtcgagcaggagattctggtgaccggtattaaggtcgtggatctgctggcgccttatgccaagggtggtaagattggcctctttggcggagccggtgttggtaaaaccgttctgatcatggaactcatcaataatgttgcaaaggctcacggcggatactcagtgttcgcaggcgtgggtgagagaacccgggagggtaacgacctgtaccacgaaatgatcgaaagtggtgtgattaatctcaaagatgcaaccagcaaagtagccctagtctatgggcagatgaatgagcctccgggagctcgtgcccgtgtggcccttactggcctgacagtggctgaatatttccgggatcaggaggggcaagatgtactcctgtttattgacaacatattccgctttacccaggcaggatctgaagtaagcgcactcctcgggagaatcccctccgctgtgggctatcagcccacactggctacagacatgggcaccatgcaggagcgcatcacaacaaccaaaaaaggcagcataacttcagtacaggccatctatgtgccggcagatgacttgaccgaccctgcaccagcaaccacttttgcccacctagacgccaccactgtgctcagccgggcaatcgctgagcttggcatttaccctgcagtggacccactagacagtacctcgcgtattatggatcccaacatcgtgggcagtgagcactacgacgtggctcgcggagtccagaagattttacaggactacaagtccctgcaggacattattgcaattttgggtatggatgagttgtcagaagaagacaaactcactgtgtcccgggcaagaaagatccagaggttcttatcccaaccatttcaagtcgctgaggttttcacaggacatatgggcaaactcgttccactaaaggagacaataaaaggctttcagcagattcttgctggggagtatgaccacttgccagagcaggccttctacatggtgggacccattgaagaagccgtggctaaggctgacaaactggctgaggagcacagctcttag

SEQ ID NO: 215094 - DNA, 156 bp, Artificial Sequence
  Description of Artificial Sequence: Synthetic coding sequence
atggttgcatactggcggcaggcaggcctttcatacattcggtatagtcagatctgtgctaaagcagtgcgcgatgccctgaagactgagttcaaggctaatgccgagaaaacttcaggatctaacgtcaaaattgtgaaagtgaagaaagaatag

SEQ ID NO: 215095 - DNA, 156 bp, Artificial Sequence
  Description of Artificial Sequence: Synthetic coding sequence
atggtggcatactggcggcaggcaggtctgagttacatcagatatagtcagatctgcgccaaggctgtgcgggacgctctgaaaaccgagttcaaggccaatgctgagaaaacctccggcagtaacgtgaagatcgtgaaagtcaagaaggaatag

SEQ ID NO: 215096 - DNA, 156 bp, Artificial Sequence
  Description of Artificial Sequence: Synthetic coding sequence
atggttgcctattggcgacaggcagggttgtcatacatcaggtacagccagatttgtgctaaggccgtccgggatgctctgaaaaccgaatttaaggccaacgcagaaaaaacgtccgggtcgaatgtgaagatcgttaaagttaagaaagaatag

SEQ ID NO: 215097 - DNA, 894 bp, Artificial Sequence
  Description of Artificial Sequence: Synthetic coding sequence
atgttttcgcgtgcaggagtggccggtctgtccgcatggaccctgcagccccagtggatccaagtcaggaatatggcaacccttaaggatattacccgtaggctgaagagcattaagaacattcagaagatcactaaatccatgaaaatggtagctgctgccaagtatgcgagagccgaacgtgagcttaagcccgctcgcatctacgggcttggatccctggctttatacgaaaaggccgatatcaagggccctgaagacaaaaagaaacacctcctgattggcgtctcatccgataggggattatgcggcgcaattcattcgagcattgctaaacaaatgaagagcgaagtggccactctgacagccgcaggcaaggaggtcatgctggtcggtatcggcgataagatacgagggatcttataccggactcacagtgaccagtttctagtcgccttcaaggaagtcggtcgcaagccgcctacatttggggatgcctccgtcattgcattagagctgctgaatagcggctacgagttcgatgaggggagtataatcttcaacaagttcaggtcggtaatcagttacaagacagaggagaagcctatctttagcctgaacactgtggcaagtgctgactctatgagtatatacgacgatatcgatgccgatgttctgcagaattaccaggaatataacctagccaacattatatactactcacttaaagagtccaccacctcggaacagtctgctaggatgacggccatggacaacgctagcaaaaacgcctccgaaatgattgataagctgactctgacatttaaccgaactcgtcaagccgtgattacgaaggagttgatcgagatcattagcggcgctgccgctctttag

SEQ ID NO: 215098 - DNA, 897 bp, Artificial Sequence
  Description of Artificial Sequence: Synthetic coding sequence
atgttcagccgcgctggggtggcgggactgagtgcttggacgttgcagccacagtggatccaggtgcgcaatatggccacattaaaggacatcacgagacgcctaaagagcatcaaaaatattcagaagattaccaagagcatgaaaatggtggcagccgcaaaatacgccagagctgagcgggagctcaagcctgctagaatctacggtctgggttcactagcattgtacgagaaagctgatatcaaaggccctgaagacaagaagaaacaccttctaattggggtgagttccgaccgcggactgtgtggagctatccactcaagcatcgccaagcagatgaaatccgaagtagcaacattaactgcagctggcaaggaggtgatgctggtcgggattggcgataaaataaggggcattctgtacaggacccatagtgatcagttcctggtggccttcaaagaagtagggaggaaaccccctacattcggagacgctagcgtgatcgcactggaattgctcaactctggatacgaattcgacgagggttccattatatttaataaatttagatcggtcatctcctataagacagaggagaagccaatctttagtctgaatacggtggcttcagctgatagcatgagcatttacgatgatatcgatgcggatgtgctccagaattatcaggagtataatctggctaatattatctactatagcttgaaggagtctaccacctctgagcagtcggccaggatgacagcaatggataatgcatctaagaacgctagtgaaatgattgacaaattaactctgacgttcaaccggacccgacaggccgttatcaccaaagaacttattgaaatcatctccggagccgctgcgcttgactag

SEQ ID NO: 215099 - DNA, 753 bp, Artificial Sequence
  Description of Artificial Sequence: Synthetic coding sequence
atgaaaatggtagctgcggcaaagtatgctcgtgcggaaagggagttaaaaccagccaggatttatggcctaggtagcctcgccctgtacgagaaggctgatattaagggccctgaagataaaaagaagcacttacttattggcgtgtcctctgacagaggactttgtggtgcaatacatagcagcatagcaaaacagatgaaatctgaagttgccacattaaccgcagcaggcaaagaggttatgctcgtgggaataggcgataagattagggggatcttatacaggacgcactctgaccagtttctagtggcctttaaagaggttggaagaaaaccccctacatttggcgatgcctctgttatcgccctcgaattgctgaattcagggtacgaattcgacgaaggctctattatattcaataagtttcggagcgtgattagctacaagaccgaagaaaagccgattttttccctgaacacagtagcttccgccgactccatgtctatatacgatgacattgacgctgacgtgctccagaactatcaggaatataacctagctaacataatttactactcactgaaggagtccaccacttccgagcagagtgctaggatgacggcaatggataacgctagtaagaacgcgtctgagatgatcgataaacttaccctgacattcaaccgcacccggcaggccgtgatcacaaaggagttgatcgaaatcatctctggggcagccgcactctag

SEQ ID NO: 215100 - DNA, 642 bp, Artificial Sequence
  Description of Artificial Sequence: Synthetic coding sequence
atggcggcaccggcagtctccggcctctcaaggcaagtgcgctgtttttctacctcggtggtgcgcccttttgcaaaactcgtccgaccacccgtgcaggtatatggaatcgaaggtcgctatgcgactgcactgtactccgcagcttctaaacagaataagctggagcaggttgaaaaggaactgctgcgtgtcgcccagatcctgaaggagcctaaggtcgcagccagtgtgttaaatccttacgtgaaacgtagcataaaagtgaagtcactcaacgacattacagccaaggaacgattttctcccctcacgacaaatcttataaatctgctggcagagaacgggagactgagcaacactcagggagtggtgtccgctttctcaaccatgatgtcagtacataggggtgaagtcccctgcaccgtcacctccgcttcgccccttgaggaagcgacgctctccgagctgaagactgtgttaaaaagcttcctcagccagggacaggtgcttaagctggaagcgaaaacagacccctccattttgggcggaatgatcgtccgcattggggaaaagtatgttgacatgtctgtgaagacaaagatccagaagctggggcgtgctatgcgcgaaatcgtgtag

SEQ ID NO: 215101 - DNA, 411 bp, Artificial Sequence
  Description of Artificial Sequence: Synthetic coding sequence
atgcaaacagcaggcgctctgttcataagtcctgcattgattagatgctgcactcggggattgatccgaccggtctccgcctcttttttgaactcacctgtgaactctagcaagcagccatcctactctaattttccactgcaggtggcccgtagggagtttcagactagtgtggtgtctagagatatcgataccgccgcaaagtttatcggcgctggggctgcaactgtaggggtggccggttccggagccggaatcggtactgtctttggctctctgattattggttatgccaggaatccatcactgaagcagcagctgttctcttatgccattctggggttcgccctgtccgaggccatgggattattctgcctcatggtcgcattcttgattctgtttgccatgtag

SEQ ID NO: 215102 - DNA, 411 bp, Artificial Sequence
  Description of Artificial Sequence: Synthetic coding sequence
atgcaaaccgccggagctctgttcattagccccgcattaattcgttgctgtacacgtggtctcattagaccggtttcagcttcgttcctgaactctccggtgaattctagcaaacagcctagttactctaattttccgctgcaagtcgccaggcgggaattccagacctcagtggtgtcccgtgatatcgatactgctgcaaaattcatcggcgcaggagccgctactgttggtgtggccggatccggagctgggattggcacagtgtttggctcgcttatcatcgggtacgccagaaatccctccctgaagcagcaactgttcagttacgcaatccttggatttgctctctcagaggccatgggactgttttgcctcatggtcgctttccttattctgtttgcgatgtag

SEQ ID NO: 215103 - DNA, 474 bp, Artificial Sequence
  Description of Artificial Sequence: Synthetic coding sequence
atgcctgaactgattctgtctcctgctactgccccacaccccctgaagatgttcgcttgttctaagtttgtttccacaccttcattagtcaaatctacttcccagcttctttccaggcctctgagtgctgtcgtcctgaagcgaccggagatcctgaccgacgaatcactgagctcactcgctgtctcctgcccactgactagcctggtcagcagccgcagcttccagaccagtgcgatctcccgggacattgacactgccgctaagtttattggggctggggctgccactgttggagtggccggttcaggagcaggaattggaaccgtgtttggatccttgatcattgggtacgccaggaacccttcactcaaacagcagctcttcagttatgcaatcttaggttttgcactgtccgaagctatgggcctcttctgcttgatggtcgcctttctgatactgtttgccatgtag

SEQ ID NO: 215104 - DNA, 597 bp, Artificial Sequence
  Description of Artificial Sequence: Synthetic coding sequence
atgcccgaattgatcctgtacgtggcaatcacactatccgtagcagaacgactcgtggggccagggcacgcctgcgcagaaccaagctttcggagttccaggtgttccgcacccctttgccttctgtgtagtggtagttcctctcccgctactgcccctcaccccctcaagatgttcgcatgttctaagttcgtatcaactccctctcttgttaaatcaactagccaacttttgagccgtcccctgtcagcagtggtcctcaaaagacctgagatcctcacagatgagtctctgagctcattagccgtctcatgtcccctgacctctctagtaagtagtcggagctttcagacctcggccatttcccgagatatcgacacagctgctaaatttatcggggcaggagccgctaccgtcggcgtggccggatctggagccggaattggtaccgtgtttggctccctgattatcggatatgctcgcaatccatcactgaagcagcagctgttctcctacgccatcctggggtttgctctctccgaggctatggggctgttttgcctcatggtggcatttctgatcctgttcgctatgtag

SEQ ID NO: 215105 - DNA, 426 bp, Artificial Sequence
  Description of Artificial Sequence: Synthetic coding sequence
atgttcgcctgcagcaagtttgtgagcacgccgtctctcgttaagagcactagtcagctccttagtaggccactgagcgccgtcgtgctgaagagacccgagattctcacggacgaatcactgtcttctctggccgtctcctgtcccctgacgtctctggtcagttcgcgaagttttcagacttccgccatcagccgggacatcgacacagctgctaagtttattggggctggcgcagcgaccgttggggttgccggttctggcgcagggatcggtaccgtatttggaagcttgataattggctatgcacgcaatcccagtctgaaacagcagctcttttcttatgcaattcttgggttcgcccttagcgaggccatgggactgttttgcttgatggtggcctttctgatactgttcgctatgtag

SEQ ID NO: 215106 - DNA, 429 bp, Artificial Sequence
  Description of Artificial Sequence: Synthetic coding sequence
atgtttgcgtgtgccaagctcgcttgcacccccagcctcatacgcgctgggagtcgcgtagcctaccgcccaatttcagccagtgtcttatctcgtcctgaggcctcgaggaccggagagggctcaaccgtctttaatggagcacagaatggagtatcccagctgatccaacgggaatttcagacatctgccatcagccgagacattgatactgcggctaagttcatcggggctggcgcagcaaccgtcggtgtggccggatctggtgcgggaatcgggaccgtcttcggaagcctgatcataggctatgccagaaatccgtccctgaagcagcagctgttcagttacgcaatcctgggctttgcgctgtcagaggcaatgggcctgttttgccttatggtggctttcctcatactttttgccatgtag

SEQ ID NO: 215107 - DNA, 429 bp, Artificial Sequence
  Description of Artificial Sequence: Synthetic coding sequence
atgtttgcatgtgccaagcttgcgtgtacaccttccctgatccgtgccggaagtcgtgtcgcataccgacccatcagtgcttccgtcctctcgcgcccagaagcttcccgtaccggggagggatccactgtgtttaacggagcccagaacggggtgtcgcaactcatccaaagagagttccagaccagcgccatctcccgcgacatagatactgcagctaagtttatcggcgctggagccgcaaccgtgggggtggcaggttccggggctggaatcgggacagtgtttggaagcctcataatcggctacgcccgaaacccatcactaaagcagcaactcttctcttacgcaatcctcggctttgccttatcagaggcaatgggtctattttgccttatggtcgcctttttgatcctctttgctatgtag

SEQ ID NO: 215108 - DNA, 429 bp, Artificial Sequence
  Description of Artificial Sequence: Synthetic coding sequence
atgttcgcctgcgctaaactcgcctgcaccccctctttgatcagggccggatccagagtggcctaccggccaatttcggcctccgtgctgagccgacctgaagcctcccgcaccggagaaggctctactgttttcaacggcgcacagaatggggtcagtcagcttatccagagggagttccagacctctgccatttcacgagatattgataccgctgccaaattcatcggagccggtgctgctacggttggggttgccggaagcggagccggtatcggcacagtgtttggttcattgatcatcgggtatgctcgaaacccgagcctgaagcagcagctcttcagttatgctatcctaggctttgccctcagcgaggccatgggtctgttttgcctgatggtggcattcctgatcttgttcgccatgtag

SEQ ID NO: 215109 - DNA, 210 bp, Artificial Sequence
  Description of Artificial Sequence: Synthetic coding sequence
atggttccacctgtgcaggtgagcccactaatcaagctgggccgttattccgccttattcctcggtgtggcatacggtgccacaaggtacaattacttaaagcctcgggctgaagaggagcggaggatagcagccgaggagaagaagaagcaggacgaactgaaaaggatcgcgagagagctagctgaagacgacagcatcctgaagtag

SEQ ID NO: 215110 - DNA, 327 bp, Artificial Sequence
  Description of Artificial Sequence: Synthetic coding sequence
atgattctgcagcgactgttccgattttcttctgtgatacggtccgctgtcagtgtgcacttacggcgaaacataggcgtcactgccgttgcttttaataaagagctggaccctatccaaaaactcttcgttgataagatcagagaatacaagtccaagcggcagacgtctggcggaccggttgacgcttcaagtgagtatcagcaggaactcgaaagggaactgtttaagctaaaacaaatgtttggtaacgccgacatgaacacattcccaacttttaaattcgaggatccaaagttcgaagtgattgagaaaccacaagcatag

SEQ ID NO: 215111 - DNA, 327 bp, Artificial Sequence
  Description of Artificial Sequence: Synthetic coding sequence
atgatcttacagagactctttagattttctagtgtgattcggtcagcagtgtccgtccatcttcggcgaaacatcggggttaccgcggtcgcattcaataaggaattagatcctatacagaagttgtttgttgataaaattagggagtataaaagtaaacggcagactagtgggggtcccgttgatgcgtccagtgagtatcagcaggagttggaaagggagctcttcaagctaaagcagatgtttggcaatgcagacatgaataccttcccaacgttcaagttcgaggacccaaagtttgaagtaatagagaagcctcaagcttag

SEQ ID NO: 215112 - DNA, 327 bp, Artificial Sequence
  Description of Artificial Sequence: Synthetic coding sequence
atgatactgcaacgcctattcagattctccagcgttatccgcagtgccgttagcgtccacctgaggcgaaacattggagttaccgccgtggcttttaacaaggaacttgatcctattcagaagctctttgtcgacaaaatccgggaatataagtccaaaagacagacaagcggaggaccagtcgatgccagctctgagtatcaacaggaactggagcgagaactgttcaaactcaagcagatgttcggcaatgcggacatgaatacatttcctacattcaaattcgaagatcctaagtttgaagtaatcgagaagccgcaggcttag

SEQ ID NO: 215113 - DNA, 327 bp, Artificial Sequence
  Description of Artificial Sequence: Synthetic coding sequence
atgatcttgcaaagattgtttcgattttcttctgtaatccgttctgcggtgagcgtgcacctgagaaggaatatcggggttactgctgtggcttttaacaaggaactcgaccctatccagaagctcttcgtggacaagattcgggagtacaaatctaaacggcagacttccggagggcctgttgacgccagctcggagtaccaacaggagctggagcgggaactgtttaaactaaaacagatgtttggcaacgccgatatgaataccttccctacttttaaattcgaggatcccaaattcgaggtcatcgagaaaccccaggcatag

SEQ ID NO: 215114 - DNA, 327 bp, Artificial Sequence
  Description of Artificial Sequence: Synthetic coding sequence
atgatactacagcgcttgtttcgcttttcaagtgtaatccgatcagcagtttccgttcatttgcgtcgtaacattggggtcaccgctgtagccttcaataaagagctggatccgatccaaaagctgtttgtcgataaaatccgtgaatacaagagcaaacgccagacgtccggaggtcccgtcgacgcatcaagtgagtatcagcaagaactggagcgtgaattatttaagctgaaacagatgttcggaaatgccgacatgaatacttttcccaccttcaaattcgaggaccccaagttcgaagtgatcgagaagccccaggcctag

SEQ ID NO: 215115 - DNA, 351 bp, Artificial Sequence
  Description of Artificial Sequence: Synthetic coding sequence
atgcattgcgacggtgggataagcatgattctgcaacgcttgttccgttttagcagcgtgattagatccgccgtgtccgtgcacctacggcgaaatatcggggttaccgccgtggcattcaacaaagagctggacccaatacagaaactttttgttgacaagattcgagaatacaaaagcaaacgccaaacaagcggcggtcccgtggacgcttcctccgagtatcagcaggagctagaaagagaacttttcaagctgaaacagatgttcggaaacgctgatatgaacacgttccccacttttaagtttgaggatcccaagttcgaggtaattgaaaagccccaggcctag

SEQ ID NO: 215116 - DNA, 567 bp, Artificial Sequence
  Description of Artificial Sequence: Synthetic coding sequence
atgacagcaaaaggttcaacagggatggagatcctcctatctaccctggaaaacactaaggacctgcagacaaccctaaacatactgagcatactggtcgaactggtatccgctggcggtgggaggcgggttagcttcctagttacaaagggtggatcacagatcctcttgcagctcctcatgaatgccagcaaggaaagtcctccacacgaggacctgatggttcagatccatagcatcttagcaaaaataggaccaaaagacaagaagtttggagtcaaggctcgtataaacggtgcactcaatattacgctgaaccttgtcaagcagaatctgcaaaaccacaggttagtactcccctgtctgcagctgcttcgcgtgtattccgccaattccgtaaactcggtatcgctcggaaagaacggagtagtcgaattgatgttcaaaattattggtcctttctccaagaagaattcgagtctaatcaagaacaaatgtcaagagtcttgccgtcagcgtatctgcccctctgctttcaataacctgtgcaggttagccccaccctag

SEQ ID NO: 215117 - DNA, 3681 bp, Artificial Sequence
  Description of Artificial Sequence: Synthetic coding sequence
atgtctaagctgaaggttattccggaaaaatctctgacaaataactctaggatcgtaggcttgcttgctcagctcgaaaagatcaatgccgaaccatcggagtctgatacagctcggtacgtcacctcaaagatactacacttggctcagtcgcaggagaaaacacggagagagatgaccgctaagggcagtacgggaatggagatattgctctccactctagagaacaccaaggatctccagactaccttgaacattctaagcatcctggtggaactcgtaagcgcgggaggaggtagaagagtctctttcttggttactaagggaggtagccagatcttactgcagttgcttatgaatgccagtaaggaatctccgccacacgaggatctaatggtacagatccacagcattctcgccaagattggacctaaagacaaaaagtttggggttaaagcccgtattaacggcgctctgaatatcaccctcaatctagtgaagcagaacctgcagaatcacaggctggtcctaccatgtctgcagctcctccgtgtgtactctgcaaactcagtaaattccgtgagtctaggcaagaacggcgttgttgagctgatgttcaagattatcggtccgtttagtaaaaagaacagtagtctgattaaagtggcactggacacacttgccgctttgctgaaaagtaagacaaacgcacggcgagccgttgatcgcggttatgtgcaggtcctcctgacaatttacgtagactggcataggcatgataaccggcacaggaatatgcttattcgtaaaggcattctccagagcttgaaaagcgtgacaaacatcaagctggggcgtaaagcctttattgacgctaacgggatgaaaatcctgtataacacatcccaggagtgtcttgcagtccgtaccttagacccactcgttaacacaagctccttgattatgaggaagtgtttccccaagaaccggctgcccctgcccaccatcaagtcaagcttccatttccagctccctgtaatccccgttaccggtccagtggctcagctttactcattaccacctgaggtagacgatgttgtggatgagagtgacgacaatgatgacattgatgtggaagccgagaacgagacagaaaatgaggacgaccttgaccaaaacttcaagaacgacgacatcgaaacagatattaataaactgaagccacagcaggaacctggtcgcaccattgaagacctgaaaatgtacgaacacctctttccagaactggtagacgattttcaggattatgatctcatcagtaaagaaccaaagccattcgtttttgaggggaaggttagaggtcccatcgtcgtgcctactgccggtgaagaaacatctggtaattctggtaacttgcgcaaggtcgtgatgaaggagaacattagctcaaaaggggatgagggggagaaaaaatcaacctttatggatctggctaaggaagatatcaaggataatgatcgtacactgcagcaacagcctggtgatcagaatcgtaccatatcttccgtgcacggcctgaacaatgacatcgtgaaggccctcgacaggatcacactgcagaacatacccagccagacggcgcctggattcacggcagagatgaaaaaggattgcagcctgccccttaccgtcctcacctgtgcgaaagcttgtccccacatggctacgtgtgggaatgttctgtttgagggcagaaccgttcagcttggcaagctgtgctgcacaggggtggagacagaagacgatgaagacactgaaagcaatagcagcgttgagcaggcttcagttgaagtgcctgatggaccaaccttgcacgatcccgacttgtatatcgaaattgtgaagaacacaaagtcagtgcccgaatattctgaagtggcctatcctgactatttcggacacatccctccccctttcaaggaacctattctagagaggccatacggagtacagcggaccaaaattgctcaagatattgagcgcctgattcaccagtccgacatcatagacagggtggtttacgatctggataatcctaattacacgatccctgaggagggagatatcctcaagtttaacagcaaattcgagtcaggtaacctgaggaaggttatccagatcaggaagaatgagtacgatctcatactcaatagtgacattaacagtaaccattatcaccagtggttttatttcgaggtgtctggcatgagaccaggggtggcctaccggtttaatatcatcaattgtgaaaagtccaatagccagttcaattacggaatgcagcctctcatgtatagtgtgcaggaggcccttaacgctagaccctggtggatccgaatgggcactgatatttgctactacaaaaatcatttctcacgatcttccgttgctgcgggtgggcaaaaaggcaaatcatattacacaatcacgttcacagtaaactttccccacaaggacgacgtgtgttactttgcctatcattatccctatacctactcgaccctgcagatgcacctgcagaaacttgaatccgcacacaacccacagcaaatatattttcgcaaggacgttttatgtgaaaccctgagtgggaactcgtgcccattggttacaattactgcgatgccagagagtaactattacgaacacatctgtcatttccgtaaccgaccttatgtttttttgagtgctcgtgtacatccaggagagaccaatgcctcttgggtgatgaaagggactctggagtatctgatgtccaacaatccaaccgcccagagcttacgggaaagctacatatttaagatcgtcccgatgcttaatcccgacggtgtaatcaatggcaatcatcgttgctccttaagcggggaggacctaaataggcagtggcagtctccatctccggacctgcaccctactatttaccacgctaaagggctgctgcagtacctggccgctgtgaaaaggttgccgctagtgtactgcgattaccacggacactctcgcaaaaagaatgttttcatgtacggctgtagcattaaagagactgtctggcacaccaacgacaatgcaacctcttgtgacgtggtggaggacactggatatcggacattgcccaaaatcttgagccacatcgccccagcattttgtatgtccagctgctctttcgtggtcgaaaagtctaaggaatctacagccagagtcgtggtgtggcgcgagatcggcgttcagcggtcctataccatggaaagtaccttatgtggatgtgatcaaggtaaatataagggcctgcagattggtacaagagagttggaggagatgggcgctaaattctgcgtgggactcctacggctgaagagactcacatctcccctggaatacaatttaccgagcagcttgctcgacttcgaaaatgatctgatagaaagcagctgtaaggttacttctccgactacctacgtattggatgaggatgagcctcgtttcctcgaggaagtggattattccgccgagtctaacgacgaactggatatcgagttagctgagaatgtcggcgactacgagccctctgctcaggaagaggtactcagcgactctgaactcagcaggacctatcttccttag

SEQ ID NO: 215118 - DNA, 567 bp, Artificial Sequence
  Description of Artificial Sequence: Synthetic coding sequence
atgacagctaagggaagtactggcatggagatcctcttgagtacactcgaaaatacgaaggaccttcagactactttaaacattctgtctattcttgttgagctggtctccgccggaggaggcaggcgggtgtcatttttggtgaccaaagggggtagtcagatcttactacagcttctcatgaatgccagcaaggagtcaccaccacatgaagacctgatggtccaaatacactccatcctagctaagatcggaccaaaggacaagaagtttggggtcaaggccagaattaatggggctctgaatatcaccctcaatctggtcaagcaaaatttacagaatcaccgtctggtgctaccatgtctgcagctcttgcgagtatatagcgccaattccgtgaattccgtttctttgggaaagaacggagttgtggaattaatgttcaaaataataggcccattttctaaaaagaatagctctcttattaaaaacaaatgtcaggagtcatgtcgacagcgcatctgtccttcggcctttaataacctctgcagacttgccccaccctag

SEQ ID NO: 215119 - DNA, 714 bp, Artificial Sequence
  Description of Artificial Sequence: Synthetic coding sequence
atgagcaagctcaaagtcattcctgaaaagtctctgaccaataacagccggattgtgggtctgctggcgcagctggagaagatcaatgccgagccgtccgagtccgatacggcaaggtacgtcacttctaagatcctccatttagcccagagccaggaaaaaacccgccgagagatgacagcaaagggcagcactgggatggagattctcctgagcacactggaaaatacaaaggatctccaaaccactctcaatatcctgtcaattctggtggaactcgtgtctgctgggggtgggcgtagggtgtccttcttagtgacgaaaggcggatctcagattctgttacaactgctcatgaatgcgtcaaaagagtccccacctcacgaggacctcatggtgcagattcactcaatactagcaaagatcggacccaaggacaaaaaatttggcgtcaaagcacggatcaacggcgcattaaatattactttgaatctggtaaagcagaatctgcagaatcatagactggtcctcccttgtctgcagcttctgcgagtctattcagcgaattccgtgaattccgtgtctctgggaaagaacggcgtcgtggagctaatgtttaagatcattgggcctttcagcaagaagaatagtagtctaataaagaatgtctggcagagcggactctggatccttttaagtatccccccagtatag

SEQ ID NO: 215120 - DNA, 3561 bp, Artificial Sequence
  Description of Artificial Sequence: Synthetic coding sequence
atgtccaagctgaaagtaatacccgagaagtctctgaccaacaattccaggattgtcggtctccttgcccagttggaaaagatcaacgccgagccgagtgagagtgacactgcacgatatgtgacaagcaagattctgcacctggcacagagccaagaaaagacacgcagagagatgaccgctaagggctcaacggggatggagatcctgctatctaccctcgagaatactaaggacttacagacaacactcaacatcctgtcaatcctggtggaactcgtatcggccggagggggacggcgtgtatcttttctcgtgaccaaaggcggatctcagatcctgttacagctcctgatgaacgcttccaaggaatccccaccacacgaggatttaatggttcagattcattcaatcctcgcaaagatcggacctaaggataaaaaattcggggtgaaagctaggattaacggcgctctgaatatcacacttaacctggtgaaacagaacctgcagaatcacaggctggttcttccttgcctccagctgttgagagtgtacagcgcaaattctgttaactccgtcagtctgggaaagaacggagtcgtggagctgatgtttaaaatcattggcccattttccaagaaaaactcaagtttgattaaagtggctctggatactctggctgccctgctcaaatctaaaactaatgctcggagggcagtcgacagaggctatgtgcaagtattattgacgatctacgtcgattggcaccgacacgataatcggcatcgaaacatgttgattaggaagggcatcttgcagtcactgaaaagtgtgaccaatattaaactgggtcgcaaagcctttatcgatgcaaatggcatgaaaattctgtataatacaagtcagctcccagtaatcccagtgactggccctgtggcacagttgtatagcctcccccctgaagtggatgatgtggtggatgagtcagacgacaatgacgacattgacgttgaggccgaaaatgagaccgagaatgaagacgacctggaccagaactttaagaatgatgatattgagaccgatatcaataagctgaaaccccagcaagaacccggtcgcactattgaggacctcaagatgtatgagcacctattccctgagctcgtggacgactttcaagattatgatctgataagcaaggagcccaagccctttgtgtttgaggggaaggttcgaggacctattgttgttcccaccgccggtgaggaaacctctgggaatagcgggaacttgcgaaaagtggtgatgaaggagaacatatcttcaaagggagacgaaggcgagaagaagagtaccttcatggaccttgccaaggaggatataaaagataatgatcggaccctgcagcaacaacccggtgatcaaaatcgaaccatttcttctgtccacgggctgaataatgatattgtaaaggccctggatagaatcacgctgcaaaacatcccctcacagacggcacccggttttacggccgagatgaagaaggattgtagcctccctctcactgtgctgacatgcgcaaaggcatgtccacacatggccacctgcggcaatgttctattcgaaggaaggactgtccaacttgggaagctctgctgtactggcgtggagaccgaggatgacgaggacaccgaatctaatagctctgtagaacaggcctcagttgaagttcccgatggcccaactctgcacgatcccgatctttacattgagattgtgaagaacactaagtccgtgccagagtacagtgaggttgcttatcctgactactttgggcatatccctccaccctttaaagaacccattctagagagaccgtacggagtccagagaacaaaaatcgcccaggacatcgagcggctaattcaccagagcgatattatagaccgcgtggtctacgacctcgataacccaaactatacgatcccagaagaaggggacattttgaagtttaacagcaagtttgagtccggaaatctgcgcaaagtgattcagattaggaaaaacgagtacgatctcatcctgaacagcgatatcaactcaaaccactaccaccagtggttttactttgaggtcagtgggatgcggccaggggtggcctatcggtttaatatcatcaactgcgaaaaaagtaacagtcagtttaactacgggatgcagccattgatgtactccgtgcaggaagccctcaatgcgaggccttggtggattcgaatggggacagacatatgttattacaaaaaccactttagtagaagctcagtggcagcgggtggccagaaagggaaaagctattacacaattacttttacagtgaacttcccacataaggatgatgtctgttactttgcataccattatccttatacctacagtactctccagatgcacctacaaaaattggagagcgctcacaacccccagcagatatactttcgtaaagacgtgctctgtgagaccctgagcggcaatagctgccctctcgttaccatcacagctatgccagaatctaactactacgagcacatctgccacttccgcaaccgtccttacgtttttctctcagccagggttcacccaggagagaccaacgccagctgggtgatgaaaggcaccctcgagtatttgatgtctaacaaccccacagcccagagtctgcgggagagttacattttcaagatcgtcccaatgctcaatcccgacggagtgataaacgggaatcatagatgctcactgagtggcgaggacctgaatcgccagtggcagtcaccctcacctgatcttcaccccacaatctatcacgccaagggactgctgcagtatttggcagcggtgaaacgactcccacttgtctattgtgattaccacggacactctcgtaagaaaaacgtgttcatgtatggctgcagtatcaaggagaccgtatggcacaccaatgacaacgctacctcctgcgacgtggtggaggacactggctatagaacactgcctaaaattctaagccacatcgccccagctttttgtatgtcctcttgcagtttcgtggttgagaagtccaaggagagtaccgcccgtgtcgtcgtctggagagaaatcggcgtccagagaagttacacaatggagagcactctgtgtggctgtgaccagggtaagtataaaggacttcaaattggcacaagagagctcgaagagatgggtgccaaattctgtgtgggtcttctaagactgaaacgtcttacaagtccacttgagtacaatttgccatcctctttgctggacttcgagaacgacctcatagaatccagctgtaaggtgacctctccaaccacctatgtcctagatgaggacgagccacgttttctggaggaggtggattactccgccgagagtaatgatgaactggacatcgagttggcggaaaacgtgggggactatgagcctagcgcccaggaagaagtcttgagcgactctgagttgtcccggacttacctcccctag

SEQ ID NO: 215121 - DNA, 3717 bp, Artificial Sequence
  Description of Artificial Sequence: Synthetic coding sequence
atgcggactgggtcagccgcttcatccgccgctgcagcggcagctgccgcagctgcaagtgcctcgcccgctacaggagtctgcatgaagacaccaggagggggacggaggggaatcaggcgggaccccggagctgagccgggtgccgctgctctgaggggtccaaggcaacggcctatactgtcccgtctgaccaataacagtcggatagttggactgctggcacagctcgagaaaatcaacgccgagccgtccgagagtgatacagccagatacgtgacatccaaaatattgcatcttgcccagagccaggagaaaacgcgcagggaaatgaccgcaaaaggcagcactggcatggaaatccttctctcaacactcgagaacacaaaggacctgcagaccaccctgaacatcctgtccatcctggtggaactggtctccgctggtggagggagacgtgtatctttcttggtgaccaaagggggatcccagatcttactacaattgttgatgaatgcttcaaaggaaagcccaccgcacgaggatcttatggtccagatacactccattctggccaagataggtccaaaagataagaaatttggcgtcaaggccaggatcaacggggctctaaacatcaccctgaatctagttaagcagaatctgcagaatcatcgccttgtactgccctgtctgcagctgctacgggtgtattctgctaattccgtgaactccgtttctctcgggaagaatggagtggtggaactgatgttcaagatcattggtcccttcagcaagaagaactcttccttgattaaggtagcactggacaccctcgccgcacttttaaaatccaaaaccaacgcgaggcgcgctgtcgatagaggatatgtgcaggtgctgttaactatttacgttgactggcaccgccacgacaacaggcatagaaacatgctgatccgtaaaggtatcctgcaatctctgaaaagtgtgacgaacatcaagctgggccgaaaagccttcatcgatgccaatgggatgaaaatattatataatacatctcagctccccgtcatccctgtcacaggcccagtcgcccagttatattccctcccgccagaggtggatgatgtcgtagacgaatctgatgataacgacgacattgacgttgaggcagagaatgaaacagaaaacgaggatgaccttgaccagaatttcaagaatgatgatatagaaaccgacatcaataaacttaaaccacaacaggagcccggacgcaccatcgaagacctgaagatgtatgaacatctgttccccgaattggtggacgatttccaggattacgacctgataagcaaagagcctaagcctttcgtattcgagggaaaggtgcgcggacccatcgtagtccccacagctggtgaggaaacctctggcaacagcgggaacttacgtaaggtcgttatgaaggaaaacatcagctccaagggcgacgagggggagaagaagtctacgtttatggacttagcaaaagaggatatcaaagacaatgaccggactcttcagcagcagccaggcgatcagaatcgcactatttcaagtgtacacggacttaataatgatattgtaaaggccctggatcggataaccttgcagaatatccctagccagacagccccagggttcaccgctgagatgaagaaggactgcagcctccccttaacagtactgacgtgcgccaaagcatgcccccatatggctacctgtggcaatgtgctttttgaaggccgtaccgtacagctgggtaagctttgttgcaccggcgttgagacagaagacgatgaagacacggagtctaactcaagcgttgagcaggccagcgtcgaagtccctgatggtcctacactgcatgaccctgacctatatatcgaaatcgtgaaaaacactaaaagcgtacctgaatatagcgaggtagcatatcctgattatttcgggcatatcccccctccattcaaagaaccaatcttggagcggccttacggtgtgcagcggactaagattgcccaagacatcgagaggctgattcatcagtctgatatcatcgaccgagtcgtgtacgatttggacaacccaaactacactattcccgaggaaggagacatattgaaattcaattctaagttcgagagtggcaacctgcgcaaggtaattcagatacgcaagaatgaatatgacctgattttgaactccgatataaattctaaccactatcaccaatggttctatttcgaggtgagtggcatgcgccctggggtggcttatagatttaacatcatcaactgcgaaaagagtaacagccagtttaactacgggatgcagcctctgatgtattccgtacaggaggccctgaacgccagaccatggtggattcgtatgggcacagacatctgctattacaagaatcactttagtcggagtagcgttgctgccggtggtcagaagggaaagtcatattacaccattaccttcaccgtcaattttcctcataaagacgatgtctgctatttcgcttatcattatccctacacttactctaccctgcaaatgcacctgcagaaactggagtccgcgcacaacccgcagcagatttatttccggaaggatgtcctatgcgaaactctctccggcaacagttgccctctcgtgaccataacagccatgcccgagagcaattactacgagcatatttgtcactttaggaatcgaccgtatgtgtttctctcggcccgtgtgcaccctggagaaaccaatgccagctgggtgatgaaggggacactggaatatctgatgtcaaataatccgaccgcgcaaagcttgagggagtcctatatctttaaaattgtacccatgctgaatcccgacggggtcattaatgggaaccacagatgttctctgagcggcgaggatctgaaccgtcagtggcagtccccctctcctgatctccacccgacaatctatcacgcgaaaggactcttgcagtacctggctgccgtgaagagattgcccctggtgtattgtgattaccacggacactcaagaaagaaaaacgtgtttatgtacgggtgttccattaaagaaacagtgtggcacacaaacgataacgccacatcgtgtgacgtcgtcgaggacacaggataccggaccctgcccaagatcctctctcacatcgctccagccttctgcatgagttcttgttcgtttgtcgtcgaaaaatctaaggaatcaaccgcacgcgtggttgtgtggcgcgagatcggagttcaaagaagctacacaatggagtcaacgctgtgcggttgtgaccagggcaaatataagggattacagataggaactagagaacttgaagaaatgggagctaaattctgcgttggcttattacggcttaagaggctcactagccctttggaatacaacctgccatcaagcctgctcgactttgaaaacgacttgatcgagagtagctgcaaagttacatcacccacaacatatgtgctggatgaagatgagccacgcttcctggaggaagtggactactcagccgagtcaaacgatgagctggacattgagctggccgagaatgtgggcgactacgaacccagtgcacaggaggaagtgctgagcgactcagagctctctaggacttatctcccctag

SEQ ID NO: 215122 - DNA, 1932 bp, Artificial Sequence
  Description of Artificial Sequence: Synthetic coding sequence
atgaatgctagcaaagaaagcccccctcacgaggaccttatggtgcagatccattcaatcctggcaaagatcggtccgaaggccgttaatagtgtatcactggggaaaaatggtgtagtggaactcatgttcaaaattattggaccattctcgaagaaaaactcctctttaatcaaggttgccctcgatacacttgcagccctgttgaaatccaagacaaatgccaggagagccgttgaccgcggatacgtgcaggtcctgctcacgatctacgtcgattggcatcggcacgataacagacaccggaacatgctgatccgcaagggcattctgcagagccttaagagcgtgactaatataaagctgggccgaaaagccttcatcgatgcaaatggaatgaagattctctataacacctctcaggagtgcctggccgtcagaacacttgacccccttgtcaacacctcttcactgatcatgagaaaatgtttccccaagaatcgccttcctctccccacaatcaagtcctctttccatttccaactgccggtcatccctgtgacagggccagtggcccagctttattcactgccgccagaagttgacgatgtagtggatgagtccgatgataacgacgacattgatgtggaggccgagaatgaaactgagaatgaggatgatctggaccaaaattttaagaatgatgacatcgaaaccgacataaataagctgaaacctcaacaagagccgggtagaaccattgaagacttgaaaatgtacgagcacctctttccagaactagtcgatgacttccaagactacgatctaatatctaaggagccaaaacccttcgtattcgaaggaaaagtccgtgggcctatagtcgtgccaactgccggagaagagacctcgggcaatagtgggaatctccgcaaagtggtgatgaaggaaaacatctcctccaaaggagatgaaggagaaaagaagtcaacctttatggatctggccaaggaagacatcaaggacaatgaccgaacattacagcagcagcccggagaccagaaccgaacaatctcctctgtacatggtctaaacaacgatatcgtgaaagccctggaccggattaccctccaaaacatcccctcccagaccgcacctggcttcacagctgaaatgaagaaggattgttcactccccctcactgtgctcacatgcgctaaggcctgccctcatatggctacatgtggcaatgtgctttttgagggaaggaccgtccagctgggtaagctctgttgcacaggagtcgagaccgaggatgatgaggacactgaatcgaactcttctgtggagcaggcctccgtggaggtgcctgacggtcccacactccacgatcctgatctttatattgagatcgttaagaataccaagtccgtgccagaatattcagaggtcgcttatccagattatttcggtcatattcctccaccctttaaggaacctatccttgaaagaccatatggagtgcagcgaacgaaaatcgcacaggatatcgagaggctgatccatcaatcggacattatcgaccgagtggtatacgacctggacaacccaaactacaccattcccgaggagggcgacattctgaagttcaactctaagttcgagagtggcaacttgaggaaggtgatccagattcgaaagaatgaatacgacctcattctcaatagtgacattaatagtaatcattaccaccagtggttttacttcgaggtctccggcatgaggcctggtgtggcataccggttcaatattatcaattgtgaaaaaagcaactctcagttcaactacgctctgccgctcatgagttggatgaaaatgaatctggatagtctcaagaaattgatcacggtccagaaggttatgatgagctag

SEQ ID NO: 215123 - DNA, 1086 bp, Artificial Sequence
  Description of Artificial Sequence: Synthetic coding sequence
atggtccatgccgaggcctttagtaggcccctgtcccgaaacgaagtagtaggcttgatcttcagactcacaatcttcggggcagtcacatatttcaccatcaagtggatggtggacgcgatcgatccaacccgaaaacagaaggtggaggcccaaaaacaggccgagaaactgatgaaacagatcggagtgaagaatgttaaactcagcgagtatgaaatgtcaattgcggcacacctcgtggatccacttaacatgcacgtcacttggagtgacattgcagggctggacgatgttatcacagatctcaaggacacagtcatcctcccaataaagaagaagcacctttttgaaaacagtcgcctgctccagcctcccaagggcgtgcttctgtacggccctccgggatgcggcaagaccttgatagctaaggcaactgcaaaggaagccggatgccgctttattaatctgcagcccagcaccctcaccgacaagtggtatggagaatctcaaaagctggcggcagccgtgttctccctggctatcaagctccagccatccatcatattcatcgacgaaatcgattctttcctgcgtaatcgctccagctccgatcatgaagccaccgcgatgatgaaagcccagtttatgagtctttgggacggcctggacactgatcattcatgccaagtcattgtgatgggagcgaccaatagaccccaggatctcgactccgctatcatgcgaagaatgccaacccgtttccacattaaccagcccgctctcaagcagagggaagccatattgaagttgattctcaagaatgaaaatgtggataggcacgtggacctgctagaagtcgctcaggagacagacgggttctcagggagcgatctgaaagagatgtgccgggacgctgcccttttatgtgtgagagagtacgtgaactcaaccagcgaggagtctcatgatgaggatgaaatcaggccagtgcagcagcaggacctgcatcgcgcaatcgagaaaatgaagaaatcaaaggatgccgcttttcagaatgtacttacccatgtatgcttagactag

SEQ ID NO: 215124 - DNA, 1086 bp, Artificial Sequence
  Description of Artificial Sequence: Synthetic coding sequence
atggtacacgctgaggccttctcccggcctctctccagaaatgaggtggttgggttgatctttcgattgacgatcttcggcgcagtgacatacttcacaattaaatggatggtagacgccattgatccgaccagaaagcagaaggtcgaagctcaaaagcaggccgagaagcttatgaagcagatcggagtgaaaaatgttaagcttagtgagtatgaaatgagcatagctgcccacctggttgaccccctaaacatgcacgtgacgtggagtgacattgccggtctcgacgacgtcattaccgacctgaaggatacagtgatccttcctatcaagaagaagcatctgtttgaaaactctcgacttttacagcctccaaagggcgtgctgctttacggccctccgggatgcggaaagaccctaatcgccaaagccactgcgaaggaggcaggttgccggtttatcaacctgcagccatccacactgacggataagtggtacggggagagccagaaactggccgctgctgtgttttccctcgcgatcaaactgcagccatctattattttcatcgatgaaatcgattcgtttctgcggaataggtcatctagcgatcacgaggcgaccgcgatgatgaaagcgcagttcatgtcactgtgggatggcctagatactgaccattcttgccaggtgattgtgatgggtgcaacaaatcgccctcaagacctggacagcgccattatgcggagaatgcccacgagatttcacatcaatcagcctgcgctgaagcaacgcgaggccatacttaagttaattttgaagaacgaaaacgtggaccgccacgtggatttgttggaagtcgctcaagagacagatggattttcagggtctgacctgaaggagatgtgtagagatgctgccctgctgtgcgttcgtgagtacgtgaattctactagtgaggagtctcatgatgaggacgagatccggccagtccagcagcaggatctccacagagcgattgagaaaatgaagaaatccaaggacgctgctttccagaacgtgctcactcacgtgtgcctggattag

SEQ ID NO: 215125 - DNA, 822 bp, Artificial Sequence
  Description of Artificial Sequence: Synthetic coding sequence
atgaaacaaatcggtgtgaagaatgtgaagttatcggagtatgagatgtccattgccgcacatctcgtggatccattgaatatgcacgtaacctggtctgatatcgccggtctcgatgacgtcattaccgacctgaaagatacggtgatactccctatcaaaaagaaacatctgttcgaaaattcgcggctcctccagccgccaaagggcgtcctgttatatggaccgccaggatgcgggaaaactctcatcgcgaaagcaactgccaaggaagcgggatgccggttcatcaacctacagccgagcacgctgaccgacaagtggtatggcgagagtcagaagctagccgcagccgttttctcactcgctatcaaactacaaccctcaatcatttttattgatgagatagactcctttcttaggaaccggagtagctccgaccatgaagcaactgcgatgatgaaagctcagttcatgtccttgtgggacgggctggatactgaccacagctgccaggctcttaaacagagggaggcaattctgaagctgatcctcaaaaacgagaacgtggacagacatgtcgacctcctagaagtcgctcaggagacagacggtttctcaggatccgacctgaaggaaatgtgtcgcgatgccgcactgctgtgcgtaagagagtacgtcaattccacaagtgaggagagccacgacgaggacgaaattcgccctgtacagcagcaggatctgcatagggctattgaaaaaatgaagaaatccaaggacgctgccttccagaatgtgctcacccacgtgtgcctggactag

SEQ ID NO: 215126 - DNA, 864 bp, Artificial Sequence
  Description of Artificial Sequence: Synthetic coding sequence
atggtgcatgcggaagcattctcacgcccactatcccgcaacgaggtcgtaggtcttatctttagacttacaatttttggagctgtcacctacttcactataaagtggatggtcgatgccattgaccccactcggaagcaaaaagttgaggcccagaaacaggcggaaaagctgatgaagcaaatcggggtgaagaacgtgaagctcagcgagtacgaaatgtccattgcagctcatctcgtcgatccccttaacatgcatgtgacatggtccgatatagcaggtctggatgacgtgataacagacctgaaggacaccgttatccttccaataaagaaaaagcatctgttcgagaattccagactgttacagccaccaaaaggcgtcctgttgtacggccctcccggatgcggcaaaactctgatcgctaaggctaccgccaaagaggccggatgcagattcataaacttacagccgtcaacactgactgacaagtggtacggtgagtcacaaaaactcgctgcagccgtgttttctctggccatcaaactgcagccatctatcatcttcattgatgagatagatagttttcttagaaatcggagcagctctgaccacgaggctaccgctatgatgaaagcccagtttatgagtctatgggatggtctggatacggaccacagttgccaagtgatcgtgatgggagccaccaacagacctcaggacctcgactctgcaatcatgcgacgaatgcccacgcggttccacataaatcagcctgcactgaagcaacgcgaagcgatcctgaagcttatcctgaaaaacgagaacttgagaaaattaaagcccagagaagtcctctag

SEQ ID NO: 215127 - DNA, 4173 bp, Artificial Sequence
  Description of Artificial Sequence: Synthetic coding sequence
atggtggttctgcgctcttccctcgagctccacaaccatagcgcagctagcgctactgggtctctcgatttgtcgtctgactttctctctcttgagcatattggtaggagacgcttacggagtgcaggggctgctcagaagaaaccagccgctaccacagccaaagcaggcgatggaagttcagttaaggaagttgaaacttaccacagaaccagagccctgcggagcttgagaaaggatgcacagaatagcagcgactcctccttcgaaaaaaatgtcgagattaccgagcaattggcgaatgggaggcacttcacgaggcagctggcaagacagcaagctgataagaagaaagaggagcacagggaggacaaggtgatccccgtcacaaggtcattgcgagcaaggaacattgtccaaagcacggagcatctgcacgaggacaacggagatgtagaagttagacgttcttgtcgaataagatcccgctactccggcgtcaatcagtccatgctctttgataagttgatcactaatacagctgaagcagtgcttcagaagatggacgacatgaagaagatgaggaggcagaggatgcgggaactcgaggacttgggcgtctttaacgaaaccgaggagtctaacctgaacatgtatacgaggggtaaacagaaggacattcagcgcaccgacgaggaaaccaccgacaatcaggaaggtagcgtggaatcatctgaggagggggaagatcaagagcatgaagacgatggagaagacgaggatgacgaagatgacgatgacgacgacgatgatgacgatgatgacgatgacgaggatgatgaggatgaggaagatggagaggaggagaaccagaagagatactacttaagacagagaaaggcaactgtctactatcaggcgcctctcgagaaaccccgacaccagaggaaacccaatatcttctattcggggcctgccagtcctgctcgaccgcgatatagattatcctctgcgggtcccaggtcaccttattgcaaaaggatgaacagacgcagacatgcaatccacagttctgattctacatcttcatcctccagcgaggacgagcagcatttcgaaaggcgcaggaagcggagccgaaaccgagccatcaatcggtgccttcccctgaactttcgcaaggacgaactgaagggaatctacaaggatcgcatgaaaattggcgcaagcctcgccgacgttgaccctatgcagcttgatagcagcgttagattcgattctgttggaggcttaagcaaccatatcgccgcacttaaggaaatggtggtgttcccattgctctatccggaggtttttgagaaatttaagatccagcccccacgaggttgcctgttctacggccctcccggtactggaaagacgctggtggctcgggctcttgccaacgagtgcagccagggggataagagggtggcattctttatgaggaagggggcagattgtctttctaaatgggtaggcgagagcgaacggcagctcaggttgcttttcgaccaggcctaccagatgcgaccgtctatcatcttttttgacgagattgatggactcgccccagtcagatccagtagacaagaccagatccactcatcaatcgtctctacgctgctggcattgatggatgggctggatagtcgaggggagattgtggtgatcggcgcaacaaatcggttggatagcattgaccctgccctaagacggcctggacgctttgacagggagttcctgttctctctgcccgacaaggaggccaggaaggagatcttgaaaatccacacaagggactggaaccctaaaccccttgacacattcctggaggagctggccgaaaattgcgttggatactgcggggcagacatcaaaagcatctgtgctgaggctgcactctgtgctttacggaggcgctatcctcagatctacaccacttccgagaagctgcaactcgatctaagttctataaacatctcagccaaagacttcgaggtcgcaatgcaaaagatgattcccgcttctcagcgcgcagttacatcccccggtcaggcactgtccaccgtggttaaacccctcctccagaatacagtggataaaatcctggaggccctccagagagtgttcccgcacgcagagttccgaacaaataaaacactcgactctgatatatcctgcccgctcctagagagcgatctggcttactctgacgatgatgtgccctctgtctatgaaaatggtctcagccagaaatcctctcacaaagccaaagacaatttcaacttcctgcatctgaacagaaacgcatgttatcagcctatgagtttcaggccaagaatactgattgtgggtgagccagggttcggacaggggagtcacttggcacccgctgttatacatgccctcgagaagttcacggtgtacacccttgacattccagttcttttcggagtcagcaccaccagccccgaggaaacgtgtgcgcaggtgatccgcgaggccaaacggaccgcaccctccattgtgtatgtgccgcatatccatgtgtggtgggaaatcgtgggacctactctgaaagcgacctttacaaccttactacagaacattcccagctttgcgcctgttctgctgcttgccaccagcgacaaacctcacagcgcactgcccgaggaagtgcaagagctgttcataagggactacggggaaatctttaatgttcagctccccgataaagaagaacggacaaaattcttcgaggacttaattctcaagcaagcagcaaagccccctattagcaaaaaaaaggctgtgctgcaggctttggaggtgctgccggttgctcctcctcctgagccacggagcctgaccgcagaggaggtgaagagacttgaggaacaggaggaggacaccttccgagaattacgcatctttctgcgtaacgtgacccatcgcttagcaatcgacaagcgcttcagagtgtttaccaaaccagtggaccccgatgaggtacccgactatgtgaccgttataaaacaacctatggacctcagttcagtgatatcgaaaattgatctacacaaatacctgacagtaaaggattatctcagggacattgacctaatctgctcaaacgccctggaatacaaccccgatcgagaccctggggatcgcctgatacgccatagagcctgcgctctaagagacacagcgtacgcaattatcaaagaggaactcgacgaagacttcgagcagctgtgcgaggaaattcaggagtctcggaaaaagaggggttgttcttccagcaagtatgcccctagctactaccacgtgatgcccaaacaaaatagtactctggtgggcgacaagagatccgacccggagcaaaacgagaaactcaagacaccaagcaccccagtggcctgctcaacgccagcccagctgaaaagaaagatccgtaagaaatccaactggtatctgggaacaataaaaaaaaggagaaagatttcgcaagccaaagacgactcgcagaatgctattgaccataaaattgaatcggacaccgaggagactcaagacactagtgtagaccacaatgagactggcaataccggtgagtcatctgtcgaagagaacgagaagcagcagaacgcatccgagtctaaactggagctgagaaacaatagtaacacatgcaacattgagaatgagctggaagatagcaggaagacaaccgcttgcaccgagttgagagacaagattgcatgcaatggggacgcttcttcctcgcagattattcatattagcgacgagaatgaaggcaaagagatgtgcgtgctgaggatgacaagggcccgaaggtcacaggtcgagcagcaacagttgatcaccgtggagaaggctcttgcaatattgagccagccaactccgtcacttgtggtggatcatgagcgcttaaagaacctgctgaagaccgttgtaaagaagtcacagaattacaacatcttccagctggagaatttatatgctgtaattagccagtgtatctaccgacatcgcaaggatcacgacaaaactagcctgatacagaaaatggagcaagaggtggagaatttttcatgctccaggtag

SEQ ID NO: 215128 - DNA, 1719 bp, Artificial Sequence
  Description of Artificial Sequence: Synthetic coding sequence
tgaggagccctcgccttagccgctcctcgtcgatgtcgccaaccactgcctggtcgcgactgcgcacctggggcaccacccgcaggcgctgtgtcgcgagctggtagaatcggtttattcccatcgccagtttgcaccagcgccgcagtaaggtctgggagtggctatgccaaggatgcactcaacctcgcgcagatgcaagagcagactcttcagctcgaacagcagagtaaactgaaggagtatgaggccgctgtggagcagctgaaaagcgaacaaatccgtgcccaggctgaggagaggcgcaaaacactatcggaggagacccggcagcaccaggccagagcccagtatcaagacaagctcgctcggcagcggtacgaagaccagctgaagcagcagcaactactgaatgaggagaacctaagaaaacaggaggaatccgtccagaagcaagaagccatgcgaagagctacagtggagagggagatggagttgcgccacaaaaatgagatgctccgcgtagaagcagaggcccgagcccgagccaaagccgaaagggagaatgccgacattatcagagagcagattcgtcttaaggccgcagagcatagacagaccgtactagaatctattcggaccgccggtacgctgtttggtgagggatttcgcgcttttgtgacagattgggataaggttactgccaccgtggccggattgacactgttggccgtaggtgtgtatagcgcaaaaaacgctactctcgtggccggtaggttcatcgaagcgaggttaggcaagccatccctggttcgggaaacgtcccgcattactgttttagaggcactccgccaccctatccaggtctcccgacgcctgctgtctcggcctcaagacgccttggagggggtcgttctcagtccttctttagaggcaagggtacgggatatcgctatcgcaacacggaataccaagaagaatcggagtctgtatagaaacatcttgatgtatgggcctcctggcacggggaagacattgttcgccaagaaactagcccttcattctgggatggattacgccattatgaccggcggtgacgtagcccctatgggtagggagggggtcactgccatgcacaaactgtttgattgggctaacacgtcgagaagagggctgctcctgtttgttgacgaagccgatgctttcctgcggaaaagagccacagagaaaatttccgaggacctgagggcgacactcaatgcctttctgtacagaaccgggcaacactccaataaatttatgttggtgctggctagcaatcagcctgagcagttcgattgggccatcaatgaccgaataaacgagatggtccatttcgatttgccaggccaagaggagcgcgagagattggtccggatgtatttcgacaaatacgtgctgaaacctgccacggagggcaaacagcgactgaagctggctcagttcgattatggcaggaaatgtagtgaggttgccaggcttacagaaggtatgagcggtcgcgaaatagcacaattggcggtctcttggcaggccacggcctatgcaagcgaggatggcgtcctgaccgaagccatgatggatacccgtgtccaggacgctgttcagcagcatcagcagaagatgtgctggctaaaagccgaagggccaggaaggggggacgagccttccccatcttag

SEQ ID NO: 215129 - DNA, 1905 bp, Artificial Sequence
  Description of Artificial Sequence: Synthetic coding sequence
atgtcctggctgttcggtattaacaagggaccgaagggcgaaggcgcaggtccacccccaccactgccgcctgcgcagcctggcgcagaaggagggggagatcggggactgggagatcgaccagccccaaaagacaagtggtcgaattttgaccccaccgggctcgagcgcgcagctaaggccgctcgggagttagaacattcccggtatgctaaggatgccctcaatctggcacagatgcaggagcaaacactgcagcttgagcagcagtctaagctcaaaatgaggcttgaggccctgagcctgttgcacacgctggtgtgggcgtggtccctatgtcgcgctggtgcagtacaaacccaagagagattgagcggctccgccagtcctgaacaggttccagccggagagtgctgtgctctgcaggagtacgaggcggcagtggaacagctaaagagtgaacagattagggcacaggcagaggaaaggagaaaaacactgagtgaagagaccaggcagcatcaggctagggcgcagtaccaggacaaacttgcgagacagcggtatgaagaccagctaaaacaacagcaactcctaaatgaagagaacctcagaaaacaggaggaatctgtgcaaaagcaggaggccatgcgcagggcgaccgtggaaagggagatggagcttagacacaaaaacgaaatgcttcgggtggaggccgaagccagggctcgagctaaggcagaacgggaaaacgccgatattattcgtgagcaaatacgtctgaaagctgcggaacaccgacagaccgtgctggagtcaattcggactgctggcactctctttggagaaggcttcagagcattcgtgacggattgggacaaggttactgcaacggtggccggtctgacgttgttggccgtgggcgtttattctgctaagaacgcaacgctagtcgcaggcagatttatcgaagctagactaggaaagccgagcctggtgcgggagacgtcccgcatcacggtgcttgaagcactccgccatccaatccaggtttctcggcgtctgctgagccggcctcaggacgcactcgaaggtgtggtgctgagtccctcattagaggcccgagttcgggatattgccatcgccacccgaaacaccaaaaaaaatcgctcactgtatcgtaacatcctaatgtatgggcctccaggtaccggtaaaacactcttcgctaagaaactggcactccactccggcatggattatgccatcatgactgggggagacgtggctcctatgggccgagagggagttaccgccatgcataagttgtttgactgggccaacacgagccggagggggctcctgctctttgtggatgaggctgacgccttcctgaggaagcgagcaacagagaaaatttcagaagacctccgggctactctcaatgcatttctctaccgcacggggcagcacagtaacaaattcatgctcgtgttagcttcaaaccaacctgagcaatttgactgggccatcaacgaccgcataaacgagatggtgcattttgaccttccgggacaggaggagcgggagcggctcgtacgcatgtactttgataagtatgttttgaaacccgctacagagggaaagcaaagactcaagctggcccaattcgactatgggagaaaatgctctgaagttgccagactaacggaaggtatgagcggtcgagagatcgctcagctcgctgtctcctggcaagccaccgcatatgcatccgaagacggggtgttgactgaagccatgatggacactcgcgtgcaggacgctgtgcagcaacatcagcaaaagatgtgctggctcaaagccgaaggcccaggacgcggagacgagcctagcccttcctag

SEQ ID NO: 215130 - DNA, 1761 bp, Artificial Sequence
  Description of Artificial Sequence: Synthetic coding sequence
atgagctggctattcgggatcaataaggggccaaagggggagggtgccggtcctcctccccctctgcctcccgcacagccgggtgccgaagggggtggagaccgcggtctgggagatcgaccggcaccgaaggataaatggagcaatttcgaccccaccggactggagagagccgctaaagccgctcgggaactggagcacagcagatatgcgaaggacgccctgaatttagctcagatgcaggagcagactctccagcttgaacagcagtctaaactaaaggaatatgaggcagctgtggaacagctgaaaagtgaacagatccgtgcgcaggcagaggaacggcgaaaaacattgagcgaagagacaaggcagcaccaagcgagggcccagtaccaggataagctcgcacggcaaagatacgaggatcagctgaaacagcagcagctccttaatgaagaaaatctgcgcaagcaagaggaaagcgtgcaaaagcaggaggctatgcgacgggctacagttgagagggagatggaactaagacacaaaaatgagatgttgcgcgtggaagctgaggccagggcaagagccaaagccgaaagagagaacgctgacattatccgggagcagatcaggctgaaagccgctgagcaccggcagaccgtcctcgaaagtatacggacagccggaacgctgtttggagaggggtttagggcatttgtgacggactgggataaggtcactgcgacagttgctggcctcaccctccttgctgtcggtgtgtattcagctaagaacgcaacactggtcgcaggccgatttattgaggctagattgggaaaaccaagcctggtccgcgaaacctctcgaataaccgtactggaggctctgagacacccaattcaggtgtcaagaagactgctcagcagaccgcaggacgccctggaaggtgttgtactgtctcctagcctcgaagctcgtgtgcgggatatcgcaattgcgacccgaaacacaaaaaaaaataggagtttgtaccgaaacatcctgatgtacgggcctcccggaacagggaagacactttttgccaaaaagctcgccctccactcgggaatggactacgcgatcatgacgggaggagacgtcgctcctatggggagagaaggtgttaccgcaatgcacaaacttttcgattgggccaatacttctaggagggggttgctgctgttcgtagacgaggcagatgctttcctgaggaagcgggctactgaaaagatctccgaagaccttagagccacgctgaatgccttcctgtaccgcactggacagcactctaacaaattcatgctggttttagcctctaaccagccagagcagttcgactgggccattaacgatcggattaacgaaatggtgcactttgacctgcccggacaagaggaacgggaaaggctggtgcgcatgtatttcgacaagtacgtgctcaaaccggctacggagggcaaacaacgcctaaaattagcacagttcgattacggtcggaaatgtagtgaggtggccagacttaccgaagggatgagcgggagggaaatagctcagctcgcagtcagttggcaggccacggcttatgcgtctgaagatggagtgctaacagaggctatgatggatactagagtgcaggatgccgtgcagcagcaccaacagaagatgtgttggctgaaagccgaaggccctggcagaggggacgaaccaagtccatcttag

SEQ ID NO: 215131 - DNA, 792 bp, Artificial Sequence
  Description of Artificial Sequence: Synthetic coding sequence
atgtacggcccaccaggcactggaaaaaccctttttgcaaaaaaactggcactgcactcaggaatggactatgctatcatgactggtggcgacgtggcacccatgggcagagaaggcgtgactgccatgcataaactgtttgactgggccaacacatcacggagaggattgctactgttcgtggacgaagcagatgcgttcctccggaagcgtgcaacagaaaagatctccgaggatctgagggcaaccctaaatgcctttctctacaggacagggcagcatagcaacaatccctctcacgtgtcccatggaggatcatctccagctggacgcccttggctcacaccgcaggctaggtgggctccaagatttatgcttgtgctcgcctctaaccagcccgagcagttcgactgggccatcaatgatcggataaatgaaatggtccactttgacctccccggtcaggaggagcgcgagaggttagtgaggatgtatttcgataaatatgtactcaagcctgctacggaaggcaaacagcgccttaagcttgcacagttcgactacggcaggaaatgttcagaagtagctaggctcacggagggaatgagtggtcgggaaatagctcagctcgccgttagttggcaggcaactgcatacgcttcggaggacggagtcttgaccgaggcgatgatggatactagagtccaggacgctgtccagcagcatcagcagaagatgtgttggctcaaagcagaaggacccggacggggtgatgagcctagtcccagttag

SEQ ID NO: 215132 - DNA, 606 bp, Artificial Sequence
  Description of Artificial Sequence: Synthetic coding sequence
aaactggccttgcactccggtatggattatgcgattatgactggaggtgacgtggccccaatgggcagagaaggtgtgactgctatgcacaaattgttcgactgggcgaacacttctcgccgaggcctcctcttatttgttgacgaggccgacgcattccttcggaaacgggctaccgagaagattagcgaagatctgagggctaccctgaacgcttttctgtacagaacaggacagcactccaataacccttcacatgtctcacatggcggaagctcgcctgctggaagaccctggctgacccctcaggcaaggtgggcccctagatttatgttggtcttagccagcaatcaacccgaacagtttgactgggcaatcaatgatcgtattaacgagatggttcactttgacctcccaggccaggaggagcgggaaaggctcgtgcgcatgtatttcgacaagtatgtgctgaaacccgctacagaagggaaacaacgtctgaagctcgcccagtttgactatggacgcaaatgttccgaggtggcacgactaactgaaggcatgtctggaagagagatcgcccaactggcagtgtcatggcagtag

SEQ ID NO: 215133 - DNA, 435 bp, Artificial Sequence
  Description of Artificial Sequence: Synthetic coding sequence
atgtgtctttgtcgtccactactcccccagagagcacagtaccaagataaactggctagacagcgttacgaagatcaactgaaacagcaacaactgctgaatgaagagaacctcaggaagcaggaagagagtgttcagaagcaggaggcaatgaggcgggcaactgtagaacgagagatggagttgagacacaagaacgagatgctgcgggtggaggcggaggcaagagctagagcgaaggcagagcgcgaaaatgccgatatcataagggagcagattcgcctgaaggccgcagaacacaggcagacagtactggaaagcattaggaccgccggtacactctttggggagggctttcgggcttttgtaactgattgggacaaggtcactgctaccgttgcaggtcttactctcctggccgttggggtctactag

SEQ ID NO: 215134 - DNA, 309 bp, Artificial Sequence
  Description of Artificial Sequence: Synthetic coding sequence
atgcggctcgaggccctgtcacttctgcacacgctcgtctgggcctggagtttatgtagggccggtgccgtccagacccaggaacggctttctggtagcgcctcccccgagcaggtccccgctggggagtgttgcgcactgcaagagtacgaagcggcagttgagcagttgaagagcgagcagatcagagcccaagccgaagagaggaggaagacactctccgaggaaacaagacagcaccaggcccgtgcacagtaccaagataaactcgcccgacagcggtacgaggaccagctgaagcagcaatag

SEQ ID NO: 215135 - DNA, 1524 bp, Artificial Sequence
  Description of Artificial Sequence: Synthetic coding sequence
atgcaggagcaaaccctgcagctcgagcaacagtcaaagcttaaagaatacgaagccgcagtggagcagctgaaatcagagcagatccgagcccaggccgaagaaaggagaaaaaccctcagcgaagagacaaggcagcaccaagctcgagcccagtaccaggacaaattggccagacagaggtacgaagatcagctgaagcaacagcagctcttgaacgaagaaaatctcaggaagcaggaggagtccgtccaaaagcaggaggccatgaggcgtgccacagtggagcgggaaatggaactgcgccataaaaacgagatgctgcgggtggaggcagaggcacgcgcacgagcaaaggctgaaagggaaaacgctgatattattcgcgaacaaattcgcctcaaggcagccgagcacaggcagaccgtcttagagagcatccgaacagctggcacgctatttggcgagggcttcagggcctttgtgacggattgggataaggttaccgctaccgtcgctggtctgactcttctagcggtgggagtgtatagcgccaagaacgcaacacttgtcgctggtcgatttattgaggcaaggctcggtaaaccatctctggtgcgtgagaccagccgcatcaccgttctcgaagccctgagacaccctatccaagttagccgccgactgttatccaggccacaagacgccctcgagggtgtggtgttgtccccttctttagaagccagggtccgcgatatcgcaatcgcgacccgaaataccaaaaaaaacaggagcctgtacaggaatatcctgatgtacggaccccctggcacagggaagaccttgttcgccaaaaaacttgccttacacagcggtatggactatgcaattatgacaggcggtgatgtggctcctatgggacgagaaggcgtgaccgctatgcacaagctatttgattgggcaaacacctctagacgcggactgctgctctttgtcgatgaggctgacgccttcttacggaagagagcaaccgaaaagatatcagaggatctgcgcgcaaccctcaatgcctttctgtatcgtacaggccaacacagcaacaagttcatgctcgtgcttgccagtaaccagcccgaacagtttgattgggctataaacgaccgcataaatgagatggtgcacttcgacctgcctggccaggaagagagagagagactcgtgcgcatgtactttgataaatatgttctgaagccagctactgagggaaagcaacgtctaaaacttgctcagtttgactacgggcgtaaatgcagtgaggtggcccgtctcaccgaggggatgagcgggagggaaattgcacaactcgccgtcagctggcaggcaacagcgtatgcttctgaagatggagtgctcacagaagcaatgatggacacacgagtgcaggatgccgttcaacagcaccaacagaagatgtgttggctcaaagccgagggtcccggaagaggagatgagccctccccttcatag

SEQ ID NO: 215136 - DNA, 1947 bp, Artificial Sequence
  Description of Artificial Sequence: Synthetic coding sequence
atgagttggttatttggagtcaataaggggccaaagggcgagggggctggtccaccccctcctcttcctcccgctcagccaggtgccgagggaggtggtgatcgaggtttgggtgataggcctgcgcctaaggataagtggtccaactttgaccccaccggacttgagagagctgccaaggcagcacgagagctggaacactctaggtatgcaaaggaagcacttaaccttgcacaaatgcaggagcagacgctgcagctggagcagcaaagtaaacttaaggagtatgaggcagctgtggagcaactcaagtcggaacagatccgagcccaggcagaggagcgcagaaagactctttccgaagaaaccagacagcaccaggcccgtgcacagtaccaggacaagctggcacgtcagcgctatgaggatcaattaaaacaacagcagctgctgaatgaagagaacctccgcaaacaggaagagagcgtgcagaagcaggaagccatgcgcagagctacagtggagagagaaatggaactgcgccataagaacgagatgctgagagtggagaccgaggccagggccagagctaaagcagagagagagaatgccgacatcatccgcgaacagatccgactaaaggcttcggagcatcgccaaactgtgttggaatccattcgcacggccggaacacttttcggtgagggcttccgtgcttttgtgactgaccgcgacaaggttactgccactgtcgcaggcctgactttattagcggttggcgtctactccgccaaaaatgctacagctgtgacgggacgattcatagaggcccgactggggaagccctccctggtgcgcgagacttctcgtataactgtgctggaggcactgcgtcatccaatccaggtgtcccgtagacttctaagcaggccgcaggatgttcttgagggagtagtgctgtcgccttctctggaagctagggtccgggatatcgcgattgccaccaggaacaccaagaagaatagggggctttacaggcacattcttctgtatggcccacccggaactggtaagaccctctttgctaaaaagctggccctgcactcaggaatggactacgccatcatgactggcggtgatgtggccccaatgggacgcgagggagttacagcaatgcacaagctgttcgactgggcaaacacctctaggagaggcctgctgttgtttatggacgaagcagatgcattcctaaggaaaagggcgactgaagaaatttctaaggacctcagggctacactcaatgccttcctgtaccacatggggcaacattccaataaattcatgctcgtacttgcttctaatctgcccgaacaattcgattgcgccataaactctaggatagatgtcatggtgcactttgatctgccacagcaggaggaacgcgaaaggctggtccgcctgcatttcgataactgtgtgctgaaacctgcgaccgagggaaaacgcagactgaagctggctcagttcgactacggcaggaagtgttccgaagtagctcggttaacagaaggaatgtcagggagagaaattgcgcagcttgcagtctcctggcaggctaccgcatatgcctcaaaggatggcgtgttgaccgaggctatgatggacgcctgcgtccaggacgctgtgcagcagtaccgccagaaaatgaggtggctgaaggctgaaggcccaggacgcggtgtcgaacaccccctcagtggggttcagggggaaacgcttacaagttggagtctcgccacagacccttcctatccttgtctggcgggaccctgtacattccgcatatgttcatggatgggaactggattatgcccaggccctttatctccgagaatgagctgtggagggggacgccctttctgtcctcccggacatcctttactctag

SEQ ID NO: 215137 - DNA, 900 bp, Artificial Sequence
  Description of Artificial Sequence: Synthetic coding sequence
atgtcctggctcttcggggtgaataaggggccaaagggcgagggagcaggacctcccccacccctgcccccagctcagccaggtgcggaaggtggcggagataggggactgggggatagaccagcaccaaaggataagtggagtaatttcgaccctaccggtctcgaacgggctgcaaaggccgctagagagttggagcattcgcgctacgccaaggaagcactgaacctcgcacagatgcaggagcagacactgcagctggagcagcaatcaaagctgaagcagctgttgaacgaagaaaacctgcgtaagcaggaagagagtgtgcagaaacacaggcagaccgttctggagtccattaggacagccggtacgttattcggagagggtttcagggcattcgttacagaccgggacaaggttaccgcgacagttgcagggctaacattgttagctgttggcgtgtattctgcaaaaaacgcgaccgctgtgactggaagattcattgaggcgagactgggaaaacctagtctggtgagagaaacgtctcgcatcacggtgctggaggcactacgacatccgatccagcaggtttcccggagactattatcacggccacaggacgtgctcgaaggagtcgtattgtccccctcactggaagcacgggtccgcgacattgcgatcgctacacggaacaccaagaaaaatcggggtctatataggcacatcctgctgtatggaccaccaggcaccggcaaaaccttgtttgccaaaaaactggccctccatagcggaatggactatgcaatcatgacaggaggcgacgtggcacccatggggcgtgaaggagtgacggctatgcacaaactctttgattgggcgaacacatctagaaggtag

SEQ ID NO: 215138 - DNA, 351 bp, Artificial Sequence
  Description of Artificial Sequence: Synthetic coding sequence
atgagaagagcaaccgttgagagagagatggaacttcgccataaaaacgagatgcttcgggtcgaaaccgaggctagagcccgtgctaaggcagagagagaaaatgccgatatcatcagggagcagatcagacttaaagcctcagaacacaggcaaacagtgctggaaagtattcggaccgccggaactctgtttggggaaggattccgtgcattcgttaccgaccgggacaaagtcacagctactgttaatattttcatcaagcagggttggcaggtggcagaacggcagcattttcggcgacgtagatgggccgaccatgaagtccgtaggtctcgtagttcatggtag

SEQ ID NO: 215139 - DNA, 1449 bp, Artificial Sequence
  Description of Artificial Sequence: Synthetic coding sequence
atgttgagggtcgaaacggaggcaagagctcgagccaaagccgaacgagaaaacgcggacatcataagggaacagatccggctgaaggcaagtgaacacaggcagacagttcttgagagcattcgaacagctgggacactgtttggcgagggtttcagggctttcgtcaccgatagggacaaggtaactgctacagttgccggtttgacactgttagctgtcggggtttacagtgctaaaaacgctacagccgttaccggcagatttattgaggcccgactcggaaaaccctctctggttagggagacctctcgaattactgtcctggaggcccttagacatcctattcaggtgagcagaagacttttatcccgcccacaagatgtactggaaggagtcgtcctgtcagttagcccgagcctagaggcacgagtgagggatatcgcgatcgccaccagaaatacgaaaaagaatagagggttgtacaggcacatcctcctttatggcccacccggaaccgggaagacactctttgccaagaagctcgcactccacagtggcatggactacgcaatcatgactggcggtgatgtggcccctatgggcagagagggagtgactgcaatgcacaaactgtttgactgggctaatacgtcacggaggggactgcaagaggaaattagcaaggatttgagggccacgctgaatgcctttttgtaccacatgggacagcactcaaacaatcgtttcatgctggtgcttgctagcaacctcccagagcagtttgattgtgctattaactccaggattgatgttatggtccactttgaccttccgcaacaagaggaacgggaacggctggtgaggctgcacttcgataattgcgtgctgaaaccagctactgagggcaaacgcatgggtgtgggtcagctccccgtgtttcggcctcccccacacggtgtgggcagtgcagccctggctgcttctctcggaaattccttccctaggagactgaaactggcccaatttgattatgggaggaaatgcagcgaagtcgcaagattaaccgagggcatgtcaggtcgagagatcgcgcagctggccgtttcttggcaggctacagcttacgcctctaaggacggggttttaacagaggccatgatggacgcatgcgtgcaagacgccgtgcagcagtataggcagaagatgcgttggctcaaggctgagggaccaggcagaggtgttgaacaccctcttagcggcgtgcaaggcgagacactcacctcgtggtccctggccactgacccctcctatccttgcctcgccggaccctgcacttttcgcatatgctcctggatgggcaccggcctttgcccgggacccttaagcccccgtatgagctgtggaggcggtaggccattctgcccgcctggccaccccctcctatag

SEQ ID NO: 215140 - DNA, 354 bp, Artificial Sequence
  Description of Artificial Sequence: Synthetic coding sequence
atgaggagggcgaccgtcgagagagagatggaattaaggcacaaaaatgagatgctgagagtcgagactgaagccagggctcgggcaaaagccgaacgggagaacgccgacatcatccgggaacaaatccgccttaaggcaagcgaacatcgacagactgtgctcgaaagtataagaacagccggaactctgtttggcgaaggcttcagagcatttgtgacagatagggataaagtgactgccaccgtcaatatcttcatcaagcaggggtggcaggtggctgagcgacagcatcactttcgccgtagaagatgggccgaccatgaggtgcgtcgaagcaggtcctcttggtag

SEQ ID NO: 215141 - DNA, 5534 bp, Artificial Sequence
  Description of Artificial Sequence: Synthetic coding sequence
atggttggagtcctggcgatggcagccgctgctgcaccccctccagtgaaagattgcgaaattgaaccatgtaagaagaggaaaaaggatgatgacacctccacttgtaaaacgataacaaaatatctgtctcccctcggcaaaactagggaccgcgtgttcgctcctcctaagccatccaatattctagactatttcaggaaaacttcacctaccaacgagaaaactcaattaggcaaagagtgcaagataaagtcgcctgagtcggtacccgtggacagtaataaggattgtaccactccgctggagatgttctccaatgtcgaatttaaaaagaaacgtaaacgcgttaatctgagtcatcagctgaacaatataaagacagagaatgaggcaccaatcgaaattagcagtgacgattctaaagaagattattcgctgaacaacgatttcgtggagagttccacatcagttttacggtataaaaagcaggtggaagtcctcgctgagaatattcaggataccaaaagtcagcctaatactatgactagcctccaaaattcaaagaaggtgaaccctaaacagggaacaacaaaaaacgacttcaagaaactcagaaagaggaagtgtcgtgacgtggtcgatctttcagagtctcttcccttggccgaagagcttaaccttctaaagaaagacgggaaagatacaaagcaaatggagaatactacaagccacgccaatagtcgcgacaacgtaactgaagccgctcagctaaatgactctattatcaccgtaagctacgaggagtttcttaagtctcacaaagagaacaaagtcgaggagatccctgattcgacaatgtccatctgtgtcccaagcgaaaccgtggacgagatcgtgaaatcaggatatattagcgagagcgaaaactcggaaatatcccagcaggttcgcttcaaaactgtcaccgtgctggctcaggtgcatcctattcctccaaagaaaactggcaagatccctcggatctttctcaaacagaagcagtttgagatggaaaacagccttagcgaccctgagaatgagcaaaccgtgcaaaaacgaaagtccaatgttgtgattcaagaggaggagctggagttggcggtcctagaggctggctcttccgaggccgtgaagcctaaatgcacactggaggagaggcaacagttcatgaaggctttcaggcagccagcttctgacgccctcaaaaacggcgttaagaaatcgtctgataagcagaaggaccttaatgaaaagtgtttatacgaggtgggccgagacgacaacagcaaaaaaatcatggagaacagcgggattcagatggtgtcaaaaaacgggaaccttcagctgcacaccgataaaggaagtttcctgaaggagaagaataagaaactgaagaaaaagaataaaaaaacccttgataccggggcaatcccaggtaagaacagagaagggaatacacagaagaaagaaacaacgttcttcctgaaggaaaagcagtaccagaatagaatgagcctgcgccagcggaagacagaattcttcaaatcttcaactctgtttaataatgagtcgttggtctatgaagatattgctaacgatgacttattaaaagtttcatcattgtgcaacaacaacaagttaagccgcaaaacttccataccagtcaaggatatcaaactgactcaatcaaaagccgaatccgaggcctcactgttgaacgtctccacccccaaatccactcggaggtctggcaggatatctagcactccgaccacagagacaataagaggcatcgactccgacgatgtccaagacaattcacagctgaaggcctcaactcagaaggccgcaaacctgagcgaaaagcactccttatatacagcagagctgattaccgtccctttcgattccgagagccccatcaggatgaagtttacaaggatctccacacccaaaaaaagtaagaaaaaaagcaacaagcgctcagaaaaaagtgaggcaaccgatggaggctttacctctcagattcggaaggcttccaatacatcaaagaatatatccaaggccaagcaactcattgaaaaagccaaagcactgcatatctcacgctccaaggtcactgaggagattgccatcccattgcgcagaagcagtagacaccaaacgctccccgagcggaagaagctttccgaaacggaggatagcgttatcattatcgactcttctccgacagcgctgaagcaccctgaaaaaaatcagaaaaaacttcagtgtcttaatgatgttttgggaaagaagctgaatacctcaacgaagaacgttccaggcaagatgaaagtggcccctctgtttctcgtcaggaaggcccagaaggctgcagaccccgtcccgtctttcgatgaaagttcccaggatactagcgaaaaaagccaagactgcgacgttcaatgcaaggccaaacgggactttcttatgtcagggttgccggaccttcttaaaagacagatcgctaaaaaggcagctgcactagatgtgtacaatgccgtgagtacttccttccagcgagttgtgcacgtgcaacagaaggatgatggatgttgcctgtggcacttgaaacctccaagctgtcccctgctgacaaagtttaaggaactcaacacaaaggtcattgacctttctaaatgcggcattgcgctgggggaattctcgacactgaactctaagctgaagtctggcaacagcgctgctgtgtttatgcgaactcgtaaagagttcaccgaggaggtacgtaacctattgcttgaagaaataagatggagtaaccctgaattctcactcaaaaagtacttcccactcctactaaaaaagcaaatagagcaccaggtgttgtcttccgaatgccacagcaaacaagagctcgaagctgatgtcagccacaaagaaaccaagcggaaactcgtcgaggctgagaactctaaaagtaagcggaagaagccaaacgagtattcaaaaaatcttgagaaaacaaataggaaatccgaagaactttcaaagagaaataacagctcaggtatcaaactagatagtagtaaggattccggaacagaggacatgctctggacagagaagtaccagcctcagaccgctagcgaactgattgggaatgaattagcaataaagaagctccatagctggctcaaggattggaaaagacgagccgaactagaagaacgacagaatctcaaagggaagagagacgaaaagcatgaagatttctctgggggaatcgattttaaggggagctcggatgacgaagaggagagtcgcctgtgtaatacagtgcttattaccgggcctaccggagtaggcaagactgccgcagtgtacgcatgtgcgcaggagctggggtttaagatcttcgaggtgaatgctagctctcaaagatccggcaggcagatactgagtcagttaaaggaggctacccagagccatcaggtagataaacaaggggtgaatagccagaagccctgcttttttaatagctactacatcggaaaatcacctaagaagatatcgagccccaagaaggtggtaaccagtcccagaaaagtgccgccaccaagcccaaaatctagtggccctaaaagagccctgcctcccaagacgttggccaactatttcaaggtgtcaccaaagccgaagaataacgaggaaatcgggatgctgctggagaacaataagggtattaagaattcttttgaacaaaagcaaattacgcaaacgaagagcacaaacgccacgaatagtaacgtaaaagatgtgggcgctgaagaaccctctcgaaaaaatgcgacttcattgatcctcttcgaggaggtcgatgtgatattcgacgaagatgccggtttcctcaacgccattaaaacatttatggcgacgaccaagaggccagtcattctcactacttcagacccaactttctcattgatgtttgatgggtgctttgaggaaataaagttttctaccccctcgctccttaatgtggcgagttatctgcaaatgatttgtctcacagagaactttaggacggacgtcaaagatttcgttaccttattgaccgccaatacttgtgatatccgaaaaagtatcctttacctgcaattttggattcggtctggaggcggagtcctggaagaacgacccctgactctctaccgcggaaattcaagaaacgttcagctggtgtgctcagaacacggcctcgacaataagatctatcctaaaaacactaagaaaaagagagttgacctcccaaagtgcgacagcggatgtgccgagacactgttcggactcaagaacatcttctccccttcagaggatttgttctcatttcttaaacacaagatcaccatgaaggaggagtggcacaagtttattcagctgctcactgagtttcagatgcgtaacgtggacttcctttactccaatctggagttcatccttcctttacctgtggacactattccagagacgaagaacttctgcggcccatccgtgaccgtggatgcctctgcagctacaaagtcaatgaactgtctcgctcggaaacattctgaacgcgaacaacccttgaagaagtcacagaagaaaaaacaaaaaaagactctcgttatactggacgatagcgaccttttcgacacagacttagatttccctgaccagagcatttcactgagcagcgtatcatccagtagcaatgccgaggagtccaagaccggagatgaggaatcaaaagccagagacaaagggaacaacccagagaccaagaagtctataccatgcccccctaagaccacggccggtaaaaagtgctctgcactcgtctcacattgtctgaattcactcagcgaattcatggacaacatgtctttcctggacgctctcctaaccgacgtgagggagcagaacaaatatgggagaaatgacttctcttggacgaacggcaaagtcacgagcgggctatgcgatgaatttagtctggagagcaacgacggttggacaagtcaatcctctggtgaactgaaagccgcagccgaagctctgtccttcactaagtgctcaagcgccatctcaaaggcactggagaccctgaactcgtgtaagaagcttggccgagaccccacgaatgacctgactttttatgtgagccagaagagaaataacgtgtatttttcacagtcggctgcgaacctcgacaatgcatggaagagaataagcgtcattaagtctgtcttctcttcaaggagtctgttgtacgtgggaaaccgacaggctagcattatcgaatacctgccaaccctgagaaacatttgtaagactgaaaagctaaaggaacaaggcaagagcaaacgaaggttcctgcactattttgagggcatccacttagacataccaaaggaaacagtgaacaccctggccgctgattttcctta

SEQ ID NO: 215142 - DNA, 3543 bp, Artificial Sequence
  Description of Artificial Sequence: Synthetic coding sequence
atgtctgccgactctagtcccctggtgggctctactccaactgggtacggaacactcactattggaaccagcattgatcctctgagttccagtgtttcttccgtgcgcctctctggctactgcgggagcccttggagggtaatcggatatcacgtcgttgtttggatgatggcagggattcctctgttgcttttccgctggaagcccctctggggtgttcgactgagactgcgcccatgcaatcttgctcacgctgaaactctcgtgattgagatacgagataaggaagattcttcttggcagctgtttacggtgcaggttcagacagaggccataggagagggttctctggaaccttccccacagtctcaggccgaagacggaagatcccaagccgctgtgggcgctgtaccggaaggtgcatggaaggacacagcccaactgcacaagtccgaagaagccgtgtctgtgggccaaaagcgggtgctcaggtattatctgttccagggccaacgctatatttggatcgagacgcagcaggccttttaccaagtctctcttttggatcatggtcggagctgtgatgacgtccacaggtcgcgccatggactctctctacaggatcagatggtacgaaaggccatctacggtcctaacgtaatttccataccagtgaaatcttaccctcagttactggtcgatgaagctctgaacccttactatgggttccaggccttcagcatcgcactctggttagccgatcattactattggtatgccctgtgcatcttcctgatctcttctatcagcatttgcctaagcctttacaaaactcgaaagcaaagtcagacgctgcgagacatggtaaagctctctatgagggtgtgcgtgtgtcgtcccggaggtgaagaggaatgggtcgactcatctgaattggtccccggagattgcctggtgctgcctcaggaaggagggctcatgccatgcgatgcggcactggtcgcaggtgagtgtatggtgaacgaatctagtctaactggtgagagtattcccgtgctcaagacagctctacctgaaggtctgggaccatactgtgcggagacccaccggaggcacacgcttttttgtggcaccctcatcctacaggctagagcctacgttggaccacatgtattggcggtagttacccgaaccggattttgtacggccaaaggcggtctcgtcagtagcatcctacaccctagacctataaacttcaagttctataaacactccatgaagttcgtggctgcattgtctgtgcttgcgcttctagggacgatctacagcatcttcatattgtatcggaatcgggtgccactaaatgaaattgtaattagagccctcgatctggtgacagtcgttgtgccccctgccctgcccgcagccatgacagtctgcactctttacgcccaaagcaggctgcgaaggcagggcatcttctgtatccacccactacgcataaacctgggaggaaaacttcaactcgtctgctttgataagacagggacactcactgaagatgggttggatgtgatgggtgtcgtgcccctgaagggtcaggctttcctacctcttgtgcccgaacctagaagactgcccgtgggtcccttgctgagagcgctagcgacatgccacgcacttagtcgattacaggacacacctgtgggtgaccctatggacctgaagatggtcgaaagcactggctgggtgcttgaagaggagccagctgccgacagtgcctttggaacccaggttctggccgttatgaggcccccactgtgggagccacaactgcaagcgatggaggaacccccagtgccggtgagtgtgctgcaccggtttccattctcctcagccctacagagaatgtccgtcgttgttgcctggccaggcgctactcaacctgaggcttacgtgaaaggttctccagagctagtggccggactgtgcaaccccgagaccgtgcccacagactttgcccaaatgttgcagagttacactgctgctggttacagggtggtggccctggcttctaagccactacctaccgtccccagccttgaagccgcacagcagctcactagggatactgtggagggagacctgtctctgctcgggttgttggtcatgcggaacctactcaaaccccaaaccacacccgtcatccaggccttacgccgaacaagaatccgggcagtgatggttaccggagacaaccttcagaccgcagtgacagttgcccgaggatgtggaatggtggcccctcaggaacatttaattattgttcacgcaactcacccagagcgcggacagcccgcttcgctagagttcctgccaatggaatcaccaaccgccgtgaatggagtcaaagacccagaccaggctgcatcgtacactgtcgaacccgaccctaggtctaggcatctggcactgtcgggtccaaccttcggaatcatcgtgaaacactttcccaaattgctgccaaaggtgctggtgcagggaacggtgtttgccaggatggccccagaacagaagaccgaacttgtgtgcgagctgcaaaaactgcagtactgtgtggggatgtgcggggatggcgcaaatgactgcggagccctcaaagcagccgacgtaggaattagcctgtctcaagccgaggcatcagttgtgagcccgtttacgagttctatggctagcattgagtgtgtgcccatggtgatacgcgaaggcagatgcagcctggacaccagcttcagtgtattcaagtacatggcattgtattccttgactcagttcatttctgtgctgattctttacaccattaacactaatctcggcgatttgcaatttttggctattgatctggtgataaccacaaccgtcgcggttctgatgagtaggactggacccgctctggttctcggaagggtccgacccccaggggctctcttgtccgtccctgtcctctctagtttattactccagatggttctcgttactggcgtacaacttgggggttacttcctaacactggcccagccttggtttgtgcctctgaatcgaacagtagccgctccggataatttacccaattacgagaatactgttgtgttctcactgtccagctttcagtatctcatcctagccgctgccgtgtccaagggagcccctttcaggcggcctctctacacaaatgttccctttttggtggctcttgccttgcttagttcggttctggtgggtctggtcctggtgcccggattgttacagggaccattagcgctgaggaatatcactgacaccggattcaagctgcttctgctgggactggtcacattaaatttcgtgggcgctttcatgttagaaagcgtgttggaccaatgcctgcctgcttgcttacggcgtcttagacctaagcgcgcatcaaagaagaggttcaagcagcttgagagggagcttgcggagcagccctggccccctctgcccgcagggccactacgatag

SEQ ID NO: 215143 - DNA, 3477 bp, Artificial Sequence
  Description of Artificial Sequence: Synthetic coding sequence
atgtccgctgacagctcccctcttgttggcagcacccccacgggctatggcaccctgaccattgggaccagcatcgaccccctgagtagctctgtatcttctgtccgactgtccggctactgcggttccccatggcgcgtaatcgggtatcacgtcgtggtatggatgatggctggcatcccactgttgctgttccgttggaaacctctgtggggcgttaggctccgcctgaggccctgcaacctggcccatgccgagaccctggtgatagagattcgggataaggaagatagcagctggcaactgttcaccgtgcaggtacagaccgaggccataggagagggtagtctggagccttcaccacagtctcaggcagaggacgggcgaagccaagccgctgtgggcgctgtgccagaaggagcatggaaggacaccgctcagctgcacaagtccgaggaagccaaaagggtccttcgatactatctgttccagggacagcgctatatctggatagagacacagcaggcgttctatcaagtcagcctgctcgatcacggcagatcctgcgacgacgtacatcgctctagacatggcctcagcctgcaagaccagatggtgcggaaagcgatttacggaccaaatgtgatctctattccagtgaaatcttatccacaacttctcgtagatgaagcattgaatccatattatggcttccaggcattctctatagctctttggttggcggaccattactattggtatgccctctgcatctttctgatttccagcatttctatttgccttagcctttacaagactcggaagcagtcacagaccctgagggatatggtgaagctcagtatgagggtctgcgtctgccgcccagggggagaggaggagtgggtggattcttctgagctggttcccggtgattgtctcgtcttgcctcaagagggcggactcatgccttgcgacgctgcactggtggctggcgaatgcatggtgaatgaatccagcctgaccggggaaagcattcctgtgctgaagaccgctttgcctgagggtctagggccttactgcgccgagacccatcggcgacacaccttgttttgtggtacactcatccttcaagcgagagcgtacgtcggtccccatgttctcgcagtggtgacccgcacagggttctgtacggcaaaaggcggacttgtctcatccattttgcaccccagaccaattaatttcaagttttacaagcatagtatgaagttcgtcgccgctctcagcgtgctagccctgctaggaaccatttactctatttttatcctctaccgaaacagggtgccgttgaatgaaattgtaattagagctctggatttggtaactgtcgtggtgcccccagcgcttcccgcagctatgaccgtatgtacactttacgcccagagccgcttacgccgacaaggtattttttgcattcatcctctaagaattaaccttggcggaaaattacaactggtgtgctttgacaaaactggcacgctgactgaagacggtctggacgtaatgggcgtggtacccctgaagggccaggccttcttaccccttgtacccgaaccccgtcggttgcctgtggggccacttcttcgagctctggccacatgtcacgctctgtctagactacaagacacacccgtaggagatcccatggatctgaaaatggtggagtcaacagggtgggtcctggaggaagagccagccgctgattctgcctttggcactcaggtcctcgccgtgatgcggccaccgctttgggaaccacagctccaagcgatggaggagccaccagttccagtgtctgtgctacacaggtttcctttctcttcggccctgcaacgtatgtcagtggtggtagcctggcctggggcaacccaaccagaggcctatgtgaagggttcacctgagctggtcgcagggttgtgtaatccggagactgtgccgaccgacttcgcgcagatgctgcagtcttataccgctgccggttatcgtgtcgtggcgcttgccagcaagccactccccacggttccaagcctcgaagctgctcagcaactcacacgtgataccgtggagggggaccttagtctccttgggctgttggtgatgcggaaccttcttaagccccagaccactccagtgattcaggctcttcgaaggacgcggattagggcggtgatggtgaccggagataatcttcagaccgccgtgaccgtggccagggggtgtggaatggtggctcctcaggagcacctgatcatcgtccacgcaactcacccagaaagaggccaaccggctagcctggagttcctccccatggagtctcctactgctgttaatggcgtgaaggtgctcgtccaaggcacggtattcgccagaatggcacccgagcagaaaacagaactcgtgtgtgagctccagaagttgcagtattgcgttggcatgtgtggagatggggctaatgactgcggggctctcaaagctgctgacgtgggcatatcactgagccaggcagaagcttctgtagttagtcctttcaccagctcaatggcatccattgagtgcgtgcccatggtgatacgagaaggacgctgcagcttagacacctcctttagtgtgttcaagtacatggcattgtattctttgacccagttcatatctgtgttgatcctctataccattaacacaaacctgggcgacttgcagttccttgcgattgaccttgtgataacgactacggtcgcggtgctcatgagcaggacaggaccagcactggtgctaggacgggtccgccctcctggcgctctattgtccgtaccagtgctttccagccttctgttgcagatggtcctggtgactggcgtccagttgggcggttacttcctcactctcgctcagccttggtttgttccactgaacagaaccgtggctgccccagataacctccccaactacgaaaatacggtggtattcagcctctccagctttcagtacctgattctcgcagccgctgtgtctaagggggctccttttcggaggccattatacacgaacgaaagggccagaccggtcccaccgaggttgcctgccccaccacctgcccaagcaggccttcaggaagcccttcaggcagcgggaacgcgggctggtcgcgctgccctagctgcagcggcaaggcgccctcccgaggtagttcaggcccatgggcacccccgacactggaactccctgccccttagtcaccagctagacccctctccagccacaccacctcctccccctccaaccagcttgaggctggccaccgtgtatacccccccaccacgccctccacctccgtggggtagcgtcgattactgtcccttgccgtggacaatcccccgaaggggcggtagtcctcaacttccgagcgtgctgctgtcagtttag

SEQ ID NO: 215144 - DNA, 3528 bp, Artificial Sequence
  Description of Artificial Sequence: Synthetic coding sequence
atgagtgcagatagtagcccactggttggttctacacctacgggctacggcaccctaaccattggtactagtatagaccccttgtccagtagcgtttcctctgttcgcctgtccggctactgtgggtccccctggagggttatcgggtatcacgtggtggtgtggatgatggccggaattcctctcctgcttttcaggtggaaaccactatggggtgttcggctccgactgcggccatgcaacctggcccatgctgaaacgcttgtaattgaaatcagagacaaggaagactctagttggcagctgttcaccgtgcaagttcaaacagaggctattggcgaaggctcattggagccatccccgcaaagtcaggcagaggacggcagaagtcaggctgccgtcggagctgtccctgaaggagcttggaaggacactgcacaactgcataagtcagaggaggcaaagcgtgtgctgaggtattatctttttcaggggcagaggtatatctggatcgagactcagcaggcattctaccaggtgagcctgttggaccacgggaggtcttgtgatgatgtgcaccgaagccggcacggccttagtttgcaggatcagatggtccgcaaggcaatttacggaccgaatgtgatcagtatccccgtgaagagttaccctcaactcctggtggatgaggctcttaacccgtattatgggttccaggctttctcaattgccctgtggttggccgaccattattattggtatgcactctgcatctttctcatcagtagcataagcatctgccttagtctctacaagacccggaagcagtcccagacactccgggacatggtgaagttatccatgcgggtctgtgtgtgcagacctggaggagaagaggagtgggtagacagctccgaattagtgccgggtgactgtctcgtgcttcctcaggaggggggtttaatgccctgtgatgccgcattagtggcgggagaatgcatggttaatgagtcttccctgactggcgaatccatccccgttctgaagacagcattacccgagggtcttggtccctactgcgctgaaacgcatcgtagacataccttgttttgtgggacactaatcctgcaggcacgtgcatacgtaggtccacacgtcttagcggtcgtgacaaggacaggcttctgcactgccaagggaggtctggtatcaagcatcctccaccctcggcctatcaactttaagttctacaaacatagcatgaagttcgtcgcagccttgagtgttctggctctgctgggaactatatacagtatatttattctataccggaaccgagtgcctctgaatgagatcgtgatccgggctctcgacctggtgactgttgtagtgccaccggcactaccagcagccatgaccgtatgcactctttatgcccagtcacggctgaggcggcagggcatcttctgcattcatcccttgagaatcaacttgggaggaaaactgcagctggtttgctttgataagactggtacactgacagaagatggtctggatgtcatgggtgtggtgcctctgaaggggcaggctttcttacctttggtccccgaaccgagacggctccctgtgggccctctgctgcgcgctctcgctacctgtcacgcacttagtcggctgcaggacacccctgtaggagatcccatggatctcaagatggttgaatccacaggctgggtgctagaggaagaacccgcagccgattctgcctttggcacgcaagtgctggcagtgatgagacctcctctctgggagccacagcttcaggcaatggaggaaccgccagtgcctgtgagcgtcctccaccggttccctttcagtagcgctttacagcgcatgtcagtcgtcgtagcctggcctggcgctacacaaccagaagcgtacgtcaaaggtagcccggagcttgtggcgggtctctgcaatccagagaccgtgccaactgatttcgctcaaatgctacagtcatacacagccgctggttatcgggtggtggctcttgcatcgaagcctctgccaacagttccttcacttgaagccgctcagcagctcacacgcgacactgtagagggtgacctgtctctgctgggcctgctggtcatgcgcaatctgctgaagccacagaccaccccggttatccaggccctgcgcagaactaggataagagccgtcatggtcaccggcgacaatttgcaaacagctgtgacggtggcacggggttgtgggatggtagcccctcaagaacacctcatcattgttcatgcaacccatccagagcgcggacagcctgcaagtctcgaatttcttcctatggaatctccaaccgcggtgaatggggtcaaagacccagaccaagctgcgagttatacggttgagcctgaccctaggagcagacacttggcactgtcaggacccacattcggcattatcgtcaaacatttccctaaacttcttcccaaagtgctggtccagggaacagtgtttgcgagaatggcgcctgaacaaaagactgagctggtctgcgaactgcaaaaactccagtactgtgtgggaatgtgtggggacggggcaaatgattgtggcgctctaaaagccgcagatgttgggatctcacttagccaagctgaggcatccgtggtgtccccgttcactagttcaatggctagcatagaatgcgtcccaatggtaataagggagggcagatgttccctagacacgtcttttagtgtttttaaatatatggcattgtactcactcacccaattcatttctgtgctaatcctctatactatcaacaccaacctcggagacttgcagttcctcgccatcgatctagtgataactactactgtggcagtgttgatgtccaggaccggcccagcccttgtgctgggaagggttcggcctcccggagcgttgctgtctgtgcctgtgctatctagtctgctcctgcagatggtactggtcaccggagttcagcttggagggtacttcttgacattggcacagccatggtttgtccccctgaataggacggtggccgctcccgacaacttgcccaactatgaaaatactgtggtcttttccctgagcagcttccagtacttgattttggctgctgcggtgagtaaaggtgcgccatttcgcagacccctctatacaaatgtgcctttcctagtggctctggctctgttatcaagcgtccttgtggggctcgtgttggtgcctggcctcctgcagggccctctggctctcaggaacataaccgatactggatttaagttgcttctgttgggcctcgtaacactgaactttgtgggagcatttatgctggagagtgttctggaccaatgtctccctgcctgtttacgccgacttaggcccaagcgggcaagtaagaagcgctttaaacaactcgaaagggaattagcagaacagccgtggccccctctccccgcaggtcccctgaggtag

SEQ ID NO: 215145 - DNA, 3372 bp, Artificial Sequence
  Description of Artificial Sequence: Synthetic coding sequence
atgtcccgggcaacctctgtaggtgatcaactggaagcgcctgccagaactatttacttaaatcagccacaccttaataaatttagagacaaccaaatttccaccgccaagtacagcgtattgacctttctgccacggttcctgtatgagcaaatcagacgggcagccaacgccttttttctatttatcgctctcctccaacaaattccagacgtgagcccaacaggcagatatacaacccttgtgcctctgattattattctgacaatcgcgggaattaaggagatagtagaagacttcaagcggcacaaggctgataatgccgtcaataagaagaagacaattgtactgagaaacggaatgtggcacaccatcatgtggaaggaagtggcagtcggcgatatcgtgaaagtagttaacgggcagtacctccccgcagacgtggtgcttttgagctcctccgagcctcaggcgatgtgttacgtagagacggccaacctcgatggcgagactaatctgaagatcaggcaaggcttgagccatacagccgacatgcaaaccagggaggtgttaatgaaactctcagggactatcgagtgcgaggggccaaaccgtcacttgtatgactttaccggcaacctgaacctagacgggaaaagcttggtggctctgggccctgatcagatcttgttgaggggcacgcaattacgcaatactcagtgggtgttcgggatcgtggtgtacaccggccacgacaccaaactgatgcagaactccactaaggcacctctgaagcggtcaaacgttgaaaaggtgaccaacgtgcagatcctagtcctcttcggcattttgcttgttatggccctggtgtcctctgcaggggctttgtattggaatcggtcccatggagaaaagaattggtatattaagaagatggatactacctcggacaactttggatataaccttctaactttcattatcttatacaataacctgatccccatctccctgctggtgaccctcgaagtagtcaagtatacccaggccttgttcatcaactgggacaccgatatgtactatattggaaacgacacccctgctatggctcgtacctctaatctgaacgaagagctaggacaggtcaaatatctgttttcggacaagacaggcacactgacatgtaatatcatgaacttcaagaagtgcagcatagcgggtgttacatacggccacttccctgaattggcacgtgagccctcatccgacgacttttgcagaatgccaccaccgtgttcagatagttgtgacttcgacgacccaaggctcttaaagaatattgaggaccgccatcctaccgccccttgtattcaggagtttctgacgctgcttgccgtctgccatacagttgtgccggagaaagatggcgacaatattatctatcaagcatcctcccctgacgaggcggctcttgtcaagggggctaagaagctgggattcgtcttcacagctaggacacccttttcagttataattgaggcgatgggacaggagcaaacattcgggatcttaaacgttctggagttcagctctgacagaaaacgtatgtcagtgatcgtgcgtactccctccggcagactgaggctgtattgcaagggagcagacaacgtgatttttgagcgactgtctaaagattctaaatacatggaggagactctgtgccacctggaatactttgcgacagaggggttacggacactctgcgtggcatatgccgacctgtcagagaatgagtacgaagagtggctgaaggtttatcaggaggccagcaccatcctcaaagatagggcgcagagattagaggagtgttacgaaatcatcgagaaaaacctacttctgttaggcgctaccgctatcgaagatcgcttgcaggctggagtgccggagacgattgccaccctcctgaaagcagagatcaaaatttgggtgttgacaggcgacaagcaggagacagctattaacatcggttactcttgccgactggtgtcacagaacatggccctcatcctccttaaagaagactccctggacgccactagggcagcaatcactcagcattgtactgatctgggcaatctcctgggaaaggagaacgatgtggccttgatcatcgacggacacacgctaaaatacgccctgagtttcgaggtgcggaggtcctttttggaccttgccctgagctgcaaggcagtgatctgctgcagagtttccccactccagaaaagtgaaatcgtggacgttgtgaagaaaagagttaaagcaatcacccttgccataggggacggcgcaaatgatgtgggaatgatccagacggctcatgtgggggtcggcatcagcgggaatgaggggatgcaggcaaccaacaactccgactacgccatcgcacagttctcttaccttgagaagcttctgctcgtgcatggggcatggagctataaccgggttacgaaatgcattctctactgtttttacaaaaacgtagtcttatacattatcgaaatcttcacggccctgccaccttttacactgggtattttcgagaggtcatgtacacaggaatcaatgcttcgcttcccgcagctctacaagattacccagaatggggagggctttaatacaaaggtgttctggggacattgtattaatgcgctggttcatagcctgatattgttctggtttcccatgaaagcgctggaacacgataccgttcttacgtctgggcatgccaccgactatctgtttgttgggaacatagtctacacatatgtggtggtgactgtgtgcttaaaggctggtctggagacaaccgcatggacaaaattctcccatctcgcggtgtgggggtcaatgctgacatggctggtgttttttggaatttactcaaccatatggcccaccatccccatcgcccctgacatgcgtggtcaggccacgatggttctctctagcgcgcacttctggctgggtctgtttcttgtcccgactgcttgtctaatcgaggatgtcgcatggcgggctgcaaaacatacgtgcaaaaaaaccctgctggaggaggtgcaggagctagaaacaaaatcccgggtgctgggaaaggctgtgttgagagactcaaatggtaaacgcctgaatgagcgcgataggttaattaaacggcttgggcgtaagacacctcccacgttatttcgtggaagcagcctacagcagggcgtcccacatgggtacgcgttctcccaggaggaacacggagccgtgtcacaggaggaagtgatccgtgcatatgataccactaagaaaaaaagccgaaaaaaatag

SEQ ID NO: 215146 - DNA, 426 bp, Artificial Sequence
  Description of Artificial Sequence: Synthetic coding sequence
atgtcgagggctactagtgtgggcgaccagctcgaggctcctgctagaaccatctacctgaatcagccacacctgaataagttcagggataatcagatttctaccgcgaagtactccgtgttgacgttcctccccagattcttatacgagcagattaggagagcggctaatgcttttttcctgttcatcgctctcctacaacagattccagatgttagcccgactgggagatacactacactcgtgcccctgattatcatcctgacgatcgccggtataaaagagatagtcgaagacttcaagcgccacaaggctgacaacgccgtaaacaaaaagaagacgattgtgctgcggaacggaatgtggcacactataatgtggaaagaggaaaactcaccacccttcaaggaaatttccccactgtag

SEQ ID NO: 215147 - DNA, 3567 bp, Artificial Sequence
  Description of Artificial Sequence: Synthetic coding sequence
atgttgaatggtgctggactggacaaggccctgaaaatgtctttgccccgtcgatccagaatccggagcagtgttggtcctgtgcgctcaagtctgggttataagaaggccgaggacgaaatgagccgggcaacatctgttggggaccagttggaagcacctgcaagaacaatttatctcaaccagccccatctgaacaaatttagggataatcagatttccacagccaagtattccgtcctgaccttcctaccacggtttctttatgagcagattcgcagggccgctaacgcattcttcctgtttattgctttgttacagcagattccagatgtctcacccacagggagatacaccactttagtacccctgattatcatactgacgatagcaggtatcaaggagatagtggaggatttcaagcgacacaaggccgataatgccgtgaacaagaagaagaccatagtccttaggaatggtatgtggcataccattatgtggaaagaagttgctgtaggcgatattgtcaaagttgtgaatggtcaataccttcccgcagatgtggttctcctgtcttcttcagagcctcaggccatgtgctacgtcgagaccgccaacctcgacggggaaacaaatcttaaaatccggcaggggctatcgcatacagccgacatgcagacgagggaagtactcatgaagctgagtgggaccatagagtgtgaggggccaaacaggcacctgtatgacttcaccggcaatcttaatctggacgggaagagcctggtggctcttggtcccgatcagatactgctgaggggtactcagttgcgaaacacccaatgggtctttggtatcgtggtatacactgggcatgacacaaaattgatgcagaatagtacaaaggccccactgaagagaagcaacgtggagaaagtaactaacgtgcagattctggtcctttttggaatactactcgttatggcacttgttagtagtgcgggtgccctatactggaatagatcacacggagaaaagaactggtacataaaaaaaatggacaccactagcgacaattttgggtataatcttctcacgttcatcatcttatataacaacttgatcccaatcagtctcctcgtgactctggaagtggtgaaatacacccaagctctctttatcaattgggacactgacatgtattacatcgggaatgatacacccgctatggctcggacgagtaatctgaatgaagagttgggtcaggtgaagtatctcttctctgacaaaactggaacactcacatgtaatatcatgaattttaagaaatgtagcattgccggtgtcacttatggtcacttcccagagctcgcaagggaacctagtagcgacgacttctgcaggatgcctcctccatgcagcgattcatgtgactttgacgaccccagactgcttaagaacatagaggataggcaccccaccgcaccctgtatccaagaattccttaccctcctggcagtctgtcacaccgtggtgcccgagaaagatggggacaacatcatataccaagcctcatcccctgatgaagccgctctcgtcaagggagctaagaagcttggattcgtgtttacagcgaggactcccttttctgtgattattgaagctatgggtcaggagcagacatttggtatacttaatgtgctcgagttttcttccgataggaagagaatgtctgttatcgtcagaactccatctggtcggttacggctgtactgtaagggagcagacaacgtgattttcgagcgtctcagtaaggattcaaaatacatggaggaaaccttatgccatctggagtattttgctacagagggactgaggactctttgcgtcgcctacgccgacctgtccgagaatgagtacgaagagtggctgaaagtgtaccaggaagccagcaccatcctgaaagaccgcgctcaaagactggaagaatgctacgaaattatcgaaaaaaacttattactgctaggcgcaactgccattgaggatcgtttgcaggccggagttcccgaaaccattgcgactttgctaaaggctgagatcaaaatctgggtgttgacaggcgataaacaggagacggccatcaacattggatatagctgtaggctagtatcccaaaatatggcactgatcctccttaaggaagacagcctggatgccacacgcgctgctataacccagcattgcacagatctcgggaacctgttaggtaaggaaaatgatgtcgcactaatcatcgatggacatactctcaagtacgcattaagcttcgaggtcaggcggtcctttctcgacctggctctcagctgcaaagccgtaatatgttgtagagtgagccctctgcagaaaagcgagatagtggatgtagttaaaaaaagagttaaagcaatcactctggccatcggggatggcgcaaatgacgttggaatgattcagaccgctcacgtcggggtgggaatttccggcaacgagggtatgcaagcgacgaacaatagtgactacgctatagcccagttctcttatttagagaagctcctgctcgtgcacggcgcttggtcttataatcgcgtgacaaagtgtattctgtactgtttttacaagaatgtcgtgctttacataatcgagctgtggttcgcttttgtgaacggattctctggacagatcctattcgaacggtggtgcatcggcctatacaacgttattttcactgccctgcccccttttaccctgggtatcttcgagaggagttgcacccaagaatctatgcttcggttcccacagctctataagatcacgcagaacggagaagggttcaatactaaggtgttctgggggcattgcatcaacgcacttgtccacagtctcattctcttttggttcccaatgaaggcattagagcacgacacagtgctgacatccggccacgccacagactacttgttcgtcggtaatatcgtttacacatatgtggtggtgacagtttgcctcaaagccggactagaaactacagcctggactaagttttcgcacctcgcggtctggggaagcatgttaacctggctggtcttctttggcatttactccaccatatggcctactatccctatcgcgcctgatatgaggggccaggccaccatggtgctcagctctgcccatttttggctgggtctcttccttgtccctaccgcttgtctcatcgaggacgtggcctggcgcgcagctaaacatacatgcaagaagacactgttggaggaggttcaggaactcgagaccaaatctagagtacttggcaaagctgtcctcagagattctaacggcaagcggttgaatgagagagacagactaataaagaggctgggacggaagacaccacctacacttttccggggatcgtctctacaacagggcgttcctcatggctacgctttcagccaggaggagcacggggctgttagccaggaggaggttatccgtgcttatgataccaccaagaaaaagtcacgcaagaagtag

SEQ ID NO: 215148 - DNA, 2907 bp, Artificial Sequence
  Description of Artificial Sequence: Synthetic coding sequence
atgagatgtcctggacccaggttactggaaaccagttggcggcaccctcctgcaccttttacatccactaatcgacacctgtatgacttcacaggaaatctgaatctggacggcaagtctttggttgcactgggcccagaccagatcctgttgcggggaacccaattaagaaatactcagtgggtcttcgggattgtggtatacactgggcacgatacaaaactcatgcaaaattccactaaagccccactgaagcgctctaatgtggagaaggtcacaaatgtgcaaattctggtcctgttcggtatcctcctggttatggccctggtgagcagtgcgggtgcattgtactggaatcgtagccatggcgaaaagaactggtatatcaaaaagatggacaccacatctgacaatttcgggtacaatctcctgacgttcatcatactttacaataatcttataccaatttccctgttggtgactctggaggtggtgaagtacacacaagccttattcatcaactgggacaccgatatgtattacatcggaaacgatactcccgcaatggcacggaccagtaatctgaacgaagaactggggcaggtgaagtacctgttctcagataagacaggcacactgacttgtaacatcatgaatttcaagaaatgcagtatcgctggtgttacctatggccacttcccagaactggcgagggaaccaagctctgacgacttctgcaggatgcccccaccatgctctgacagctgcgattttgatgatccccgattacttaagaacattgaggaccgacaccccacagcaccatgtatacaggagttccttactctgctggcagtgtgccatacagtcgtccccgagaaggatggtgacaatatcatataccaggcaagttctcctgatgaggcggcactggttaaaggggcaaagaagctgggattcgtgtttacggcccgtacccccttcagtgtgataatagaggccatggggcaggaacagaccttcgggatcctgaacgtcctggaattcagttcagatcgcaaacgtatgagcgtcatagttcggactccatcaggcagactgagactttattgcaaaggagccgacaacgtgatcttcgagcggttatccaaggactcaaaatacatggaggaaactctttgtcacctggagtactttgccacagagggactccggaccttatgtgtggcttatgctgacttaagtgagaatgagtacgaagagtggttgaaggtgtatcaggaggccagtacaattttgaaggatcgggctcagcgcttagaagagtgctatgaaatcatcgagaagaatctcttgcttttgggtgctaccgccatagaagacagactgcaggcaggtgtgcctgagactattgctactcttctgaaagctgaaatcaaaatttgggtgctaacaggagataagcaggagactgctataaacatagggtacagttgcaggctagtgtcccaaaacatggccttaatacttttaaaagaggattctctcgatgccacccgcgctgccataactcaacactgcacagacctcggaaatctcctcggaaaagagaacgacgttgcactgattatcgacgggcacaccttgaagtatgccctctcatttgaggtgcggaggagttttctggacctggcactgtcatgcaaggctgtgatttgctgcagggtgagcccattgcagaagtcagaaattgtggacgtggtgaagaagagggttaaagccatcactctcgcgattggggatggagctaatgacgtgggtatgattcagaccgctcatgtcggagtgggaatcagcggaaacgaggggatgcaagccacaaacaacagtgattacgcaatcgcgcagttttcatacctggaaaaacttttgttggtccacggagcatggagctataatcgggtgacaaaatgtatcttgtactgcttctataaaaatgtcgtgttgtatataatcgagctgtggttcgccttcgtgaacggtttttctggccagattctgttcgagagatggtgtattggcctttataacgtgatatttactgctttacccccatttactctgggaatcttcgagcgatcctgtacgcaggaaagcatgcttaggttcccacaattgtacaagatcactcaaaacggagagggtttcaatactaaggtgttctggggacactgcattaacgcacttgtgcatagcctgatactgttctggttccccatgaaagccctcgagcatgacaccgtcctgacatctggtcacgctaccgactacttatttgtgggtaacattgtgtacacttacgtggtcgtcacagtttgcttaaaggctggacttgagacaaccgcctggacaaaattctcccacctcgccgtttggggaagtatgttaacgtggctggtgttctttggcatctattccacaatttggccaaccattccaatcgccccagatatgagggggcaggcaactatggtgttatcttccgctcacttttggcttggtctgttcttggtacccacagcttgtctcatcgaagacgtcgcctggagagccgctaaacacacctgtaagaagactctcttggaggaagtgcaggagttggagacaaaaagcagagtgctgggaaaagccgtccttagggactccaatggtaagaggctgaatgagcgcgatcgactgatcaagcgccttggtcggaagactcctccaaccctgttccgcggatccagcttgcagcaaggcgttccacatggatatgcttttagtcaagaggaacatggcgctgtaagccaagaagaagtcatcagagcttacgatactacgaaaaagaaatcaaggaagaagtag

SEQ ID NO: 215149 - DNA, 3903 bp, Artificial Sequence
  Description of Artificial Sequence: Synthetic coding sequence
atgggtaccggacccgctcagacgccgaggtctacaagggccggaccagaacccagcccagccccacccggtccaggggacactggtgactcagacgtgacccaggagggctccgggccagctggaatccgtggtggcgagactgttattcgcgcaggcatgggagatagtcccggacggggagctccagagaggaggcataaggcccagcccggacgggcaagaaagtacgagtggaggccagaaggcccaacctccatgggctccctcgggcagagagaagacttgcaggacgaagatcgtaatagcgcatttacatggaaagtccaggccaacaaccgggcttacaacggccagttcaaggaaaaggtgatcttgtgctggcagaggaaaaaatacaaaacaaacgtgatacgtaccgcgaaatacaatttttattctttcctgcccttaaacctttacgagcagtttcatagggttagcaacctgtttttcctgattataataatcttgcaatctataccagacattagcacactcccttggttttctctgagcacacctatggtgtgtctgttatttatacgggcaacccgggacctggttgacgacatggggagacacaagtccgaccgggctataaataacaggccatgccagatcctgatgggaaaatctttcaaacagaagaaatggcaggacctctgcgtgggcgatgtggtgtgcctcagaaaggataatattgtccccgctgatatgctgctgttggcatcaacagagccttcgagcctatgttacgttgagacagtggacattgatggggaaaccaacctcaagttccgccaagctctgatggtgactcacaaagaactggcgaccataaagaaaatggcatcattccagggaacagtgacttgcgaagcccctaattctcgtatgcaccactttgtgggttgcctggagtggaacgacaaaaaatatagtctcgacatagggaatctgctactgagaggctgccggatccggaatacagatacctgttatgggctagtaatctatgccggattcgatactaagatcatgaagaattgtgggaagatccatttgaaaagaaccaaactggacttattaatgaataaactggtcgttgtcatatttatcagcgtggttctggtttgtcttgttttggcttttggattcggattctctgtgaaggaattcaaagaccaccactactacttgagcggggtgcatgggagctccgtggctgcagaatcttttttcgtgttttggtcctttctgatattgctgtctgtgacgattcccatgagtatgtttatcttgtcggagtttatctacctcggcaacagcgtcttcatcgactgggatgtgcagatgtactataaacctcaggacgtgcccgctaaggcgagatctacgtccctgaacgatcaccttggtcaggttgagtacatcttctctgataaaacaggaacactgactcagaacatactgacatttaacaagtgctgtatctcaggtagagtttatggaccggattctgaggccacaacacgtcctaaagagaatccttatctatggaacaaattcgctgatggcaaactcttatttcacaacgccgctctcttgcatttagttcgcacaaacggggacgaggccgtaagagagttttggcgcctgcttgctatttgtcacaccgtgatggttagagagagcccaagggagcgacctgatcagttgttatatcaggccgcatcccccgacgagggagcattggtcacagccgcacgtaactttggttacgtcttccttagtaggacacaagatacagtgactatcatggaactgggggaagagcgggtctatcaagttctagcaattatggatttcaacagtactaggaaacgaatgtccgtgttagtgagaaaaccagagggcgctatttgtttgtacacaaaaggcgctgataccgtgatcttcgaaaggctccatcgccgaggtgccatggagttcgcaacagaagaagctttagcagctttcgcccaggagacactgcgaacactgtgcctcgcgtacagggaagtggccgaagatatttacgaggattggcagcaaagacatcaggaggccagcttactcctgcaaaatagagcacaagctctacagcagctgctaggagcgacagcgatcgaggatagactgcaggacggcgtcccagagaccatcaaatgcttgaagaaatctaatatcaagatctgggtactcaccggagacaaacaggagacagcggtcaacatcggattcgcatgcgagttgctgtctgagaacatgttaatcctggaagaaaaagagatctcccgcattttagaaacatactgggagaactctaacaacctgctgacaagagagtcactgtctcaggtaaagcttgcgttggtgatcaacggagacttcctcgataagctcctcgtaagcctgagaaaggagccacgggcactggcacaaaacgtgaacatggatgaagcttggcaagaactgggacagagtcgtagggactttctatacgcccgacggctgtctctcctgtgtaggcggtttggcctgccactggcagccccacccgctcaagatagtcgcgctcgccgaagcagcgaggtactgcaagaaagagcttttgttgacctcgcatctaagtgtcaggcggtgatttgttgcagggtgacccccaagcagaaagcccttattgtggcacttgtgaagaaataccatcaggtggttacactggctattggtgatggtgcaaacgacatcaatatgatcaagaccgcggatgtgggcgtcgggcttgcaggccaggaggggatgcaggcggtacagaacagcgactttgtcctgggtcaattctgctttctccagaggctactgctcgtgcatgggagatggagttacgtaagaatttgcaagttccttcggtattttttttataagtctatggcatccatgatggtgcaggtgtggtttgcctgttacaacggattcactggacagcccttgtacgagggatggtttttagctctgttcaatctcctgtacagcactctcccagtcttatacatagggctattcgaacaggatgtcagtgccgagcagtccttggagaaacccgaattgtacgtcgttggtcaaaaggatgagctgtttaattattgggtctttgtgcaggcaatagcgcatggcgttaccacctcacttgtcaattttttcatgacactctggatcagccgagacactgccggaccggcatcattttctgaccaccagagctttgctgtagtggtggcactttcatgtttgctttctatcactatggaggtcattttgataatcaagtattggacagccctgtgcgtagccacgattctcctgtccctcggattctacgccataatgactacaactactcagtcattttggctttttagagtaagtccaaccacgtttccgttcttatacgctgatttgtctgtcatgagttcccctagcatcctgttagttgtcctcttatccgtatcaataaacacatttccagtgctagctcttagggtgatcttccccgctctaaaggagctgcgggcaaaggaggaaaaagtggaggaaggcccttctgaggagatttttactatggaacccctacctcatgttcaccgggagagcagagccaggcgatcctcttatgccttttcccacagggagggctacgctaatctgattactcagggtaccattctgcgacggggacccggagtaagttccgacatcgcctcggagtctctggatcccagcgacgaggaggccgcaagttcacccaaagagtctcagtag

SEQ ID NO: 215150 - DNA, 1737 bp, Artificial Sequence
  Description of Artificial Sequence: Synthetic coding sequence
atgggggattcacccggtagaggggcaccagaacggagacataaagctcagcccggtagggccagaaaatatgagtggcggcctgagggcccaaccagcatgggctctctgggccaaagagaggacttacaggacgaagatcggaactctgcgttcacctggaaggtccaggccaataacagggcatataacggacagtttaaagaaaaggtcatcctctgttggcagcggaagaagtacaaaacaaacgtcatcaggacagccaaatataacttctactccttcttacccctgaatctgtatgaacagtttcacagagtgagtaatctgttttttctaatcatcatcattctccagtccattcccgacattagcacattaccctggttctcgctgtctacacctatggtttgcttacttttcattagggcaaccagggatttggttgatgatatgggcagacataaatccgatagggcaatcaacaaccgcccttgtcagatcctgatgggcaagtcttttaaacagaagaaatggcaggacctgtgtgtcggagatgtagtttgcctgcgaaaggacaacatagttccagccgacatgttgttgcttgcttctacggagcccagtagcttatgttacgtggaaactgtggacatcgatggagaaacaaatcttaaatttcggcaggctctaatggtgactcataaggagctcgcaaccatcaagaagatggcctcattccagggcacagttacttgtgaggcccctaattcacggatgcatcatttcgtcgggtgtctcgagtggaatgacaagaagtactctctggatattggcaatctcctcttgcgcggttgtcgcatcagaaataccgacacttgctacggcctggtgatctacgcgggtttcgacaccaagataatgaaaaattgtgggaaaatacacctgaagcgcaccaagctcgatctgcttatgaacaagctggttgtcgtcattttcatcagcgtggtgcttgtgtgtttagtgctggcatttggcttcggcttttcggtcaaggagttcaaggatcatcattattatctctctggagtccatggatccagtgtggccgctgagagtttctttgtcttttggagctttctgatacttttgtctgtcacgatccctatgagtatgttcatactttccgagtttatctatctaggcaactccgtcttcattgattgggatgttcagatgtactacaagcctcaggatgtccctgctaaggctcgtagcacgagcctgaatgatcacctgggacaggtagagtatatttttagtgacaagaccggaacactgacccagaatatcctgactttcaataagtgctgcatcagcggcagagtgtatggggcagcgccaactcccgagctgccagccggaagtagcatctttaaaggcctgagggtacccgagaaccagtctcacgtttggcctcatgcgcagcacctaagacctaatttgaatcaggggactgtggccagatggcctggctttctgtggagggggccaggcaagttcttcttttttcttcgccaatccctcactttgagcacccaggccggtatgcagtggtgtaatcttgggtcactccagtcaccaccgccaagatttaagcggttttcttggctttccctgccatccagctgggattaccgacaccttcctcctcatctgattttcctttatttttag

SEQ ID NO: 215151 - DNA, 3792 bp, Artificial Sequence
  Description of Artificial Sequence: Synthetic coding sequence
atgggggattcgccaggacgcggagcccctgaaagacgacacaaggcccagccaggcagagcacggaagtatgagtggcggcctgagggcccaactagcatggggagcctgggtcaacgggaagatctgcaagatgaggatcgtaatagcgctttcacatggaaagtccaggcaaataatcgagcgtacaacggccagtttaaagagaaagtgattctgtgttggcagaggaagaagtataaaacaaatgtaattaggaccgccaaatacaatttttattccttccttccgctgaacttgtacgaacaattccaccgtgtcagcaatctcttcttcctcatcatcatcatcctccagtcaattccagacatcagcacgctcccatggttctctctgtccacccctatggtgtgcctactttttataagggctacccgcgacctggtagacgatatggggcgacataagtccgacagagccattaacaatagaccatgccagatcctaatgggcaaaagctttaaacagaaaaagtggcaagacctgtgcgtgggggacgtcgtttgcctgagaaaagataatatcgtgccagctgatatgttactgctcgcctctactgagccctcttccctttgctatgtggaaactgttgatattgatggcgagactaatctcaaatttcgacaggcacttatggtgacgcacaaagagctggcaaccataaagaagatggcctcttttcaaggaaccgtcacgtgtgaggccccaaatagtcgcatgcatcacttcgtcggctgcctggaatggaacgataaaaagtacagcctcgatattggaaatcttctcctgcggggatgccggatccgcaacactgacacttgctatgggctggtgatatatgccgatggctatatgtttgtaggcttcgacacgaagataatgaagaactgcggaaaaatccatttgaagagaactaagctggaccttctaatgaacaaactcgtggtcgtgattttcatttccgtggtgttagtttgtctcgtgctcgctttcggttttggattctcagtgaaggagttcaaggatcaccattactatttatcgggggtccacggctcgagcgtggccgctgaaagcttctttgtcttctggagcttcttgattctgttgtccgtcaccatccccatgagcatgttcatcctgagcgaattcatatacctcggcaatagtgtgtttatcgattgggacgtacaaatgtattataaaccgcaggatgtgccagccaaagccaggtccacttccctgaacgatcacctgggccaggttgagtacatctttagcgacaaaacaggaacattgacacagaatattcttacatttaacaaatgctgtataagcggtagagtttacgggccagattcagaggcaactactcgccctaaagagaatccctatctctggaacaaatttgctgacgggaaactgttgttccacaatgcagccctgctacatctggtacgcactaacggcgacgaggccgtgcgcgaattctggcgcttactggcaatctgtcataccgtgatggtgcgagagtcaccacgcgaaaggcccgaccagttactgtatcaggcagcctcaccggatgaaggggctttggtcaccgcagctagaaactttggatacgtgtttctttctaggacccaggatacggtgacgatcatggaattgggggaagagcgggtgtatcaggtactagccataatggacttcaattccacaagaaagcgtatgagtgtactggtgaggaagccagagggcgcaatatgtctttacaccaaaggagcagacactgtgatctttgagaggcttcatcgtcgaggtgccatggaatttgctacagaggaagcactagctgcatttgctcaggaaaccctgaggactctctgcctcgcatacagggaggtagctgaggacatctatgaagattggcagcaaaggcaccaggaagcttcgctcctgctgcagaatagagctcaggcgctccagcaggtgtacaatgagatggagcaggatctgaggctgctcggggctactgctatagaagaccgcctccaagatggagttccagagacgatcaaatgcctgaagaaaagcaatataaagatctgggtcctgaccggagacaagcaagaaaccgcggtgaatatcgggtttgcctgtgaactactttctgagaacatgctgattctggaggaaaaggagatcagccgaatcctggaaacctattgggaaaacagcaataacctgcttactagggaaagtttgagtcaagtgaaactggccctggttataaacggcgactttctggacaaactgttggtcagtctgcggaaagaaccaagggccttagcacagaatgtgaatatggacgaggcttggcaggagttgggtcagtcaaggcgtgactttctctacgcgaggagactctcactgctgtgtagacggtttggcctgcctctggccgctcctcccgcacaggacagtagagccagacgctcttcggaggtgcttcaggagagggctttcgtggatctggccagcaaatgccaggcagtcatttgctgcagagtaacgcctaaacaaaaggccttgatcgtggccctggtgaagaagtaccaccaagttgtgacgctagcaattggggacggcgcaaatgatattaatatgatcaagacagcagatgtaggagttggcctggctgggcaggaaggaatgcaggcggtgcagaatagcgattttgtgctggggcagttctgctttcttcagcggttgctactggtgcatggccgttggagttacgtccgaatctgcaagttcctgcgctactttttttacaaaagcatggccagcatgatggtccaggtctggtttgcttgctacaatgggtttaccggtcagcccttgtacgaggggtggttcctggccttgttcaatctactgtatagcactctccccgtcctatatatcggactgtttgagcaggacgtatctgccgagcagtccttggagaaacctgagctgtatgttgttggacagaaagacgagcttttcaattactgggtctttgtgcaggccattgcacatggcgtgactacctctctggtgaacttttttatgacactgtggatcagccgcgataccgctggtcctgcctccttctctgaccatcagtcattcgcggtggtggttgctctgtcatgtctgctctctattaccatggaggtcattcttattattaaatattggactgctctatgcgtcgcaacaatcttactgtcactgggcttttacgcaattatgacgacaaccacgcaatccttctggctgttccgcgtctcccccactacattccctttcctctacgccgacctgagcgttatgagttccccttctatcttgctcgttgttttactgagtgtgagcattaacactttcccagtgttagcccttagagtcatctttcctgccctgaaggagctccgtgctaaggaggagaaggtggaggagggaccctccgaggagatctttaccatggagccccttccccacgttcatcgcgaaagccgggctaggagatcctcgtacgccttctcacaccgggagggctacgcaaaccttattacacagggcactatcctgaggcgaggtcccggagtctctagcgacatcgcctcagaatcacttgacccaagtgacgaagaggccgctagctcccctaaggaatctcagtag

SEQ ID NO: 215152 - DNA, 3933 bp, Artificial Sequence
  Description of Artificial Sequence: Synthetic coding sequence
atgggaaccgggcctgctcagacgcctcggtcaactagggccggtcccgagccaagccccgcacctccgggtcctggggacacaggcgactctgatgttacacaggagggttctggtccggctggcatccggggtggcgagactgtgatcagagccggaatgggcgactctcctgggagaggcgctccagagaggcgccacaaggcacagcccggaagggcccgtaaatatgagtggcgcccagagggtcccactagtatgggtagtctgggccagcgggaagacctgcaggacgaagacagaaactctgccttcacgtggaaagtgcaagcgaacaaccgggcttataatggtcagtttaaggaaaaagtgatactctgctggcagaggaaaaagtacaagacaaacgttattcgaacagcaaaatacaacttctacagcttcctgcctctcaatctgtatgaacagtttcatcgggtgtcaaatcttttcttcttgattatcattatactccaaagtatacccgacatttccactctgccatggttttccctgagcacaccaatggtgtgcttgctctttatccgagccacccgggacctggtggacgatatgggcagacacaaaagcgatagggccatcaataaccggccatgccagattctgatgggtaaatcattcaaacagaaaaaatggcaggacttatgcgttggagacgttgtgtgcttgcggaaagataacatcgttccagccgacatgttgctattagcaagcacagaaccgagctcattatgctacgtggagaccgtagatatcgacggcgagactaacctgaagtttcgacaggctttgatggtgacccataaagagcttgcaactataaagaaaatggccagctttcaaggcactgttacatgtgaagccccaaattctcgaatgcatcactttgttggatgcctcgagtggaatgacaagaagtattcccttgacatcggcaatctcttgctgcggggttgtcgcattcgtaatacagacacctgttatggcctagtcatttacgcgggatttgacaccaaaattatgaagaactgtggcaagatccaccttaagagaactaagctcgatttgttgatgaacaagctggtcgtcgtcattttcatatcggtagttctggtttgcctggtgctcgccttcggcttcgggttctcagtcaaggaattcaaggaccaccactactacctgagtggtgtacatggcagttcggtggctgctgagagcttttttgtgttctggtccttccttattctactctccgtcacaattccaatgagcatgttcattctgagtgaattcatctaccttgggaacagtgtttttatcgactgggatgtgcagatgtattacaagcctcaggacgtgccagccaaggccaggtccacgtccctcaacgatcacctcggccaagtggagtatatcttttccgataaaacagggaccctaactcagaacattttgacttttaataagtgctgtatcagtgggagagtatatgggcctgatagcgaggcaaccactcggcctaaggagaatccgtacctttggaataagttcgccgatgggaagctcctctttcacaacgccgcattgttgcacttagtgagaaccaacggagacgaggctgtgcgggagttctggaggctcctagcgatttgccatactgtcatggtccgcgagtcacctcgtgaacgaccagaccagttgctgtaccaggccgctagtcccgacgagggcgctctggtcacagccgctcggaatttcggatacgtgtttctctcacgcactcaggacaccgtcactatcatggaactgggagaagaaagggtctatcaggttctggccattatggattttaattccaccaggaagcggatgtctgtacttgtccggaagcctgagggcgctatctgcctctatacaaaaggggctgacaccgtgatttttgagagactacataggcgtggcgcaatggaattcgccactgaagaagcgctcgccgcttttgctcaggaaacactgcggaccttatgccttgcctacagagaagtggccgaggacatttatgaagattggcagcagagacatcaggaggcaagtctcctgctccaaaacagagcacaggctctgcagcaggtttacaacgagatggagcaggacctgagacttctcggcgctaccgccattgaggaccggctgcaagacggcgtgcccgagaccatcaaatgcctcaagaaaagcaatatcaaaatttgggtcttgaccggggacaaacaggaaaccgctgttaatatagggtttgcttgcgagttgctgtctgaaaacatgttaatacttgaggaaaaggagattagtaggatcctggaaacctactgggagaactccaataatctgctcacccgagaatctttatcccaagttaaactggctctcgttattaatggagattttctggataagcttcttgtaagcctccgaaaagaaccacgagctctagcccaaaatgttaatatggatgaggcatggcaggagctggggcagagcagacgggacttcctgtacgctaggcggctgagtctgctctgtcgcagattcggactcccccttgcggcacccccagctcaagattcaagggctaggcgttcaagtgaagtgctccaagagagggcctttgtggacttggcctcaaagtgccaggccgttatctgctgtcgtgtgacaccaaagcagaaggcgttgatcgtcgccctcgtgaaaaaataccaccaggtcgtcacgctcgctataggagatggcgcaaatgacattaacatgattaagacagctgatgtgggcgtgggattagccggacaggaggggatgcaggccgtgcagaattcagactttgtgctaggtcaattctgtttcctacagagactgcttcttgtgcacggtagatggtcgtacgtccggatatgcaaatttctcaggtatttcttttacaagagtatggccagcatgatggtgcaggtgtggttcgcttgctacaatggctttaccgggcagcctctgtacgagggctggttcctggctctgtttaacctgctgtactctaccctgcccgtgctctatatcgggctgttcgaacaggacgttagcgcggagcagagcctcgagaagccggagctctacgtcgtggggcagaaggatgagctgttcaattattgggtgttcgttcaagccatagcccatggcgtgactactagcctggtaaattttttcatgactctctggataagccgtgacactgccggtccagccagcttcagcgaccaccagtcatttgctgtggtggtggccctgagctgtttgctgtcaatcacaatggaggtgattctgattataaaatattggacagctctgtgcgtggccacaattctgctatctttaggattctacgcaataatgaccaccaccacacaaagtttttggctgtttagagtgtcccctacaacgttccccttcctatacgccgatctgtcagtcatgtcttccccctctatattgctggtggtgttgctgtccgtctctatcaacaccttccccgtactggcccttcgcgtgatattccccgcactgaaagagttgagagctaaggaggaaaaggtggaggaaggcccatctgaagagatctttacgatggagcctttaccgcacgtgcatagagagtcccgagctcggaggagctcatacgcattctcccaccgcgagggttatgccaatttaatcacacaagggacaatcttacgcaggggcccaggagtgtcttccgacatcgcatcggagtctcttgatcctagtgatgaggaggccgcaagtagcccgaaagagtctcagtag

SEQ ID NO: 215153 - DNA, 3006 bp, Artificial Sequence
  Description of Artificial Sequence: Synthetic coding sequence
atggaagcagcacacgctaagaccaccgaagaatgcctcgcatactttggcgtctctgaaactacaggtcttacccctgatcaagtcaagcgaaaccttgagaagtatggactgaatgagctccccgctgaggagggcaagacactgtgggaactggttattgaacagttcgaagacctcctagttcggattctactgttagccgcatgtatttcatttgtgctcgcctggtttgaagagggagaggaaactattaccgcttttgtggagccttttgtgattttactgatcttaatcgccaatgccattgtaggtgtgtggcaggagcggaacgccgaaaacgcaattgaagcactcaaagagtacgagccggagatgggcaaagtttacagggctgaccggaagtctgtgcaacggatcaaagctcgcgacatagtacccggagacatagtggaagtcgctgtgggcgacaaagtccctgctgatattcgaatcttggcaatcaagagcacaactctccgggtcgaccagtcgatcctgaccggtgagtcagtctctgtcatcaagcacacagagccagtgccagaccctcgggctgttaaccaggacaaaaagaacatgttgttttctggtacaaatattgcagctggcaaggcgttagggatcgtggcaacaacaggcgtcggcaccgagattggtaaaattcgtgaccagatggccgctacggagcaggacaaaacacccctgcagcagaagctagacgaattcggagagcagctcagcaaggtgattagtctgatctgcgtagccgtatggctaatcaacattggacattttaacgaccctgtgcatggagggtcatggtttcggggagcgatctattatttcaagatagccgtggccctggcagtcgccgctatcccagagggcctacccgcagtgatcaccacctgtcttgccctgggcaccagaaggatggcaaagaagaacgccatcgtccgcagtttgccttctgtggaaacgttgggatgcacgagcgtaatttgttccgacaagaccggtacactgaccactaaccaaatgtctgtctgcaagatgtttattatcgacaaggtggacggagacatctgcttgctgaatgagttttccattaccggatccacctacgctcctgaaggggaggtcctcaaaaacgacaaaccggttcgcccaggtcaatatgacgggcttgtggagcttgcaactatttgcgcactgtgtaatgactcctcactcgacttcaatgaagctaagggagtgtatgaaaaagtcggcgaagcaacggagacagcactgacgacattagtagagaagatgaacgtgtttaatacggatgtgcgaagtctgtccaaagtcgaacgcgcaaacgcttgcaactccgtgatccgccagctcatgaaaaaagagttcaccctcgagttcagtcgggataggaagtccatgtctgtgtactgctcgcctgccaaatcatctagagctgcagtgggcaacaagatgtttgtgaagggcgctcccgagggcgtaattgatagatgcaactatgtcagagttggaactaccagggtccctttgacaggcccagtcaaagaaaaaataatggctgtgatcaaggagtggggcactggaagagatactcttcgttgtctggcacttgccactcgggatactcctcctaagcgtgaagaaatggttctcgacgacagcgccagattcctggaatatgagacggacctcacatttgtaggggttgtagggatgcttgatccaccaagaaaggaggtgactggaagcatccagttgtgcagagatgccggtatccgtgtgataatgattaccggggataataaagggacggcgattgccatttgtcggcgtattgggatcttcggagaaaacgaagaagtggcggaccgggcatatacagggagagagttcgatgatctgcccttagccgagcaacgcgaggcatgccgtcgtgcctgctgctttgccagggtcgaaccttcgcataagagcaagattgtagaatatctgcagtcgtacgacgagataaccgccatgacaggagatggtgtgaatgacgctcctgccctgaagaaagcagagatcggcatcgctatgggcagcggtaccgcagtagcgaaaaccgcttctgagatggtacttgccgacgacaatttctcgacaatcgtagccgcagtggaagagggacgcgctatctataacaacatgaagcagtttataagatatctcatctcaagtaatgtgggagaggtggtatgtatcttcctgacagcggctttgggactcccagaagcccttatcccggtccaacttctctgggtaaacctggtgactgacggccttccggctacagcacttggcttcaacccccctgatctggacatcatggacagacccccacgttcacctaaggagcctctgatatcagggtggttattttttcgatatatggccatcggcggttatgtcggtgcagctaccgtgggcgctgccgcttggtggttcctgtacgccgaagatgggcctcacgtcaattatagtcagttaacccatttcatgcagtgtacagaagacaacactcatttcgaaggcatagactgcgaggtcttcgaagcacccgagccaatgactatggccctgtccgttctggttaccattgagatgtgcaacgcgctgaactccctctcggagaatcaatctctccttaggatgccaccgtgggttaatatttggctgctggggagcatttgtctgagtatgagcctgcacttcttaatattgtacgtcgacccactacccatgattttcaagctgagagcccttgatcttactcagtggttgatggttcttaagattagccttccagttatcggacttgacgagatcctgaaatttgttgctaggaattatctcgaggacccagaggatgagcgaaggaagtag

SEQ ID NO: 215154 - DNA, 2535 bp, Artificial Sequence
  Description of Artificial Sequence: Synthetic coding sequence
aaaaggaggaaccctgggaggcaggccgttggtcatactgaagaggacccccctagggttggaactccatggaaagaacacacaggtcccggaccccaggaaggatctacgatggaagctgctcatgctaagacaaccgaagagtgtttagcctactttggcgtcagtgagaccaccggtctgacccccgatcaggtcaaacggaacctggaaaagtacggactgaatgagctgcccgctgaggaggggaaaacgctgtgggaattggtgatagagcagtttgaggatctgctggtgaggattttgctgctagcagcatgcatatctttcgtgctcgcgtggtttgaagagggcgaggagactattaccgcgtttgtggaaccattcgtgattctgctgatcctgatagccaacgcaattgtgggggtgtggcaggagagaaatgctgagaatgccatcgaggcccttaaggaatatgagcccgaaatgggcaaggtctatcgagctgatagaaagtctgtgcaaagaataaaagccagagatatcgtgcccggagacatagttgaagttgcggttggggacaaagtaccagccgacattagaatcctggccattaaatccacaaccctgcgagtggatcagagcattctcaccggcgaatccgtcagcgtcattaaacatacggagccagtccctgaccccagggccgttaatcaagataaaaagaacatgctgtttagcggaactaacattgccgcagggaaagctctggggatcgtggcaactacgggagtcggcacagaaattggaaaaatccgggatcaaatggcagccacggagcaggacaagaccccactgcagcaaaagctcgacgagtttggcgagcagctgtcaaaggtgatttccctgatatgcgtggccgtctggctgataaacatcgggcattttaacgaccccgtacacgggggatcctggtttaggggcgcaatctactattttaaaattgccgtcgctcttgccgtagcagccataccagagggcctccccgctgtgatcacaacctgccttgccctcggtacgagacgcatggccaaaaaaaatgccatcgtgaggagcctacccagtgtggagacattaggctgcacctccgtgatatgctcagataaaacaggcacattgacaacgaatcagatgtcagtgtgcaaaatgttcatcatcgataaggtagatggagacatctgtctcttgaatgagttctccattacggggagtacctacgctcccgagggcgaggtcttaaagaatgacaagccagtgagacctggacagtatgatggtttggtcgagctggccaccatatgtgcgctctgcaatgacagtagcttagatttcaacgaagccaagggcgtgtacgagaaggtaggcgaagccacagaaacggctctcacgacactggttgaaaagatgaatgtgtttaatacagatgtccgctcactgtcgaaggtggagcgcgctaatgcatgcaactcggtgattaggcagcttatgaaaaaggaattcaccctggaattcagtagggatagaaagtcaatgtccgtgtattgcagtcccgctaagtcgagtcgcgcagctgtagggaacaagatgttcgtgaagggggctcctgaaggggtgatcgatcgctgtaactacgtccgtgttgggacgaccagagtccccctcaccgggcctgttaaagagaagattatggcagtaatcaaagaatggggtacggggagagacacccttcgatgccttgccctggctacccgggatacacctcctaaacgggaggagatggtcttggacgattcagcacggtttcttgagtacgagacagacctgactttcgtcggcgttgtagggatgctcgaccccccaagaaaagaggtcactgggtccatccagctctgtagggacgccggaatcagggtgattatgattaccggagataataaaggaacagccatcgccatctgtcggaggattggcatctttggagaaaatgaggaagtcgcagatcgggcatatacgggacgcgaatttgacgatcttcctcttgccgaacagcgggaagcctgcagaagagcttgctgcttcgctcgtgtggaaccttcgcacaaaagcaaaatagtcgagtacctgcagtcctatgacgaaattactgctatgactggcgatggagtaaatgatgccccagctttgaagaaggccgagataggcatcgccatgggctcagggacggccgtcgctaagacagcatcagagatggtgttagccgacgacaacttctctaccatcgtggccgctgtcgaagagggaagagctatatacaacaacatgaaacagtttatccggtacctgatttccagtaacgttggagaggttgtgtgcatctttttgacagcagcattagggctccctgaggcccttatcccagtgcagctactttgggttaacctggtgactgattgcgccgagctacttatatactag

SEQ ID NO: 215155 - DNA, 2985 bp, Artificial Sequence
  Description of Artificial Sequence: Synthetic coding sequence
atggaggccgctcacgccaagaccacagaagagtgcctggcctatttcggcgtgagtgaaaccacgggattaacccctgaccaggtgaaaagaaacctggagaagtatggcttgaacgaactcccagctgaggagggtaaaacactgtgggagctcgtaattgagcagttcgaagatcttctggtgcggattctcctccttgcggcttgcatcagcttcgtgctcgcctggtttgaggagggcgaggagaccattactgctttcgtagagcctttcgttatactcctaatcctgatagccaatgccatagtaggggtctggcaggaacgcaatgcagaaaatgcaatagaggctcttaaagagtacgaacctgagatgggcaaggtgtacagggctgacaggaaatcagtccagagaatcaaagcaagagatatcgtgcctggggacattgtcgaagttgctgtgggcgacaaggtgcctgcggacattcgcatcctggctattaagagtacaaccctccgtgtcgaccagagcattttaactggcgagtcggtgtctgtgataaagcatacagagcctgtgcccgaccccagggcggtgaatcaagacaagaaaaatatgctgtttagcggcactaacatagccgcagggaaggccctgggcatcgtggcaactaccggggtgggcactgagatcgggaaaatcagagatcagatggccgctaccgaacaagataaaacacctttacagcagaagctggacgagttcggtgagcagctttcgaaagtgatttctctcatttgtgtggccgtgtggctcattaacatcggccattttaacgatccagtccatgggggatcttggttcagaggcgcaatttactacttcaaaattgccgtggcattggcggttgcagcaataccagaaggactgcccgcagtgattacaacttgcttggctctaggcactcgccgaatggccaagaaaaacgcaattgtccggagtctcccttcggtggaaactctgggctgcacctccgtcatttgctccgataaaaccggcaccctcaccaccaaccagatgtctgtttgcaaaatgttcatcatcgataaagtggacggcgatatttgcctgctgaacgaattttccattacagggtcaacctacgctccggagggagaagttttgaaaaacgacaagccagtgaggcctggacaatacgatggtttggtcgagctggccactatctgtgcattatgtaacgacagctcccttgacttcaacgaggccaagggagtgtacgagaaagtcggagaggcaacagagaccgccctgactacgctagttgagaagatgaacgtgttcaacaccgacgtccggtctctgtccaaagtagagcgggcaaatgcatgcaattcagtgataagacagctgatgaagaaagagtttactttagagttctcgagggatcgaaaaagtatgtccgtctattgtagccccgcaaaatccagtcgtgctgcagtcggtaacaaaatgttcgttaagggagcacccgagggtgttatcgacagatgcaactacgtccgcgtaggaacaacacgtgtgcctctgactgggcctgtgaaggaaaaaatcatggccgtcatcaaggagtggggtacgggcagggacacccttaggtgtctggccctcgccactcgggatacccccccaaagagagaagaaatggtattggacgacagtgccagatttctggagtacgagaccgacttgacgtttgttggggtggtggggatgctggaccctcccaggaaggaggtgacaggttctatccaactgtgcagagacgccggaattcgggtaattatgatcacgggcgacaataaaggtactgctattgcaatatgtcgtagaattgggattttcggggaaaacgaggaagtcgccgatagggcatatacgggcagagaattcgacgatctccccttggccgaacagcgggaggcctgcaggagggcttgctgttttgctagagttgagccttcacataaaagtaagatcgtggagtacctgcagagctatgacgaaataaccgctatgacaggagatggtgtgaacgacgccccagctctcaaaaaggctgaaattggcattgccatggggtctggtacggctgtggctaagacagcctctgagatggtactcgcggacgacaacttctccacaattgtggctgcagtagaggaaggacgggctatatataacaacatgaagcagtttatcaggtacctgattagctctaacgtcggagaagttgtgtgtatctttctcactgccgcactgggactgcctgaagctttgattccggtccagttgctgtgggtgaacctcgtgaccgatggcctacctgcaacagctctggggtttaacccccctgatctggacatcatggacaggcctccccgtagccctaaggagcccctcatcagtgggtggttgttttttcgatatatggccattggtggatacgtgggagcagctaccgtgggagccgctgcctggtggtttttatatgccgaggatggcccacacgtgaattatagccaactgacgcattttatgcaatgtacagaagacaatacccattttgagggcattgactgtgaggtctttgaagcccctgaacctatgaccatggcgctctctgttctcgtcacgattgaaatgtgtaacgccctcaatagtctttcagagaaccagtcactgctgcgcatgccaccctgggtcaatatatggctgctgggatccatttgccttagcatgtcgctccattttctgattctctacgtcgatcctctcccaatgatttttaagctgagagccctggaccttactcagtggctcatggtcctgaaaatcagcctacctgtgattggcctggacgaaatactgaaattcgtggctaggaactacctggaaggttag

SEQ ID NO: 215156 - DNA, 2610 bp, Artificial Sequence
  Description of Artificial Sequence: Synthetic coding sequence
atggggaaagtgtaccgagcggaccgcaagagcgtccagaggatcaaagccagggacattgtgcctggtgatatcgtcgaggtggccgtcggggataaggtgccggcagatatcagaatcttggcaatcaagtcaaccaccttgcgggttgatcagtctattttaactggtgagagcgtgtccgtgataaagcacacagaaccagtgcccgacccaagagctgtgaaccaagacaagaaaaacatgctgttcagcggcaccaatattgctgccggaaaggctctgggcatcgttgctactacaggtgtggggacggaaattggcaagatcagggatcagatggcagccacagagcaggataaaacacccctccagcagaagcttgatgaatttggcgaacagctcagtaaagtgatcagcctgatctgtgtggctgtctggctcattaacattggccacttcaacgatccagttcacggcggtagctggttcaggggcgcaatatactatttcaaaatcgctgttgccctcgccgtcgccgcaattcccgaaggtctacctgcggtcatcactacatgtttagcactaggcacacgcaggatggccaaaaaaaatgccatcgtacgctccctgccttccgtggaaactctgggatgcaccagcgtcatatgctccgacaagaccggcactctgacaaccaatcaaatgagcgtttgcaaaatgtttatcattgacaaagtggatggtgacatctgcttactcaacgaattttctattacaggatcaacatacgccccagagggggaggttctcaaaaacgacaagccagtccgaccaggccaatatgatgggctggtggagctggccaccatttgcgcattgtgcaacgattcatctctggatttcaatgaagctaagggggtgtacgagaaagtgggtgaggcaactgagacggcacttacaacgctagtggaaaagatgaatgtgttcaacaccgacgtccgcagcctgtctaaagttgagcgggctaacgcttgtaacagtgtaatccgccagttaatgaagaaggagttcactttggaattttcccgcgaccggaaaagtatgtctgtctattgttcaccagctaagagcagcagggcagccgtgggcaataagatgtttgtcaagggcgcaccagaaggggtaatcgataggtgcaattacgtgcgcgtcggaactacgcgggtccccctgactgggccagtgaaagaaaaaattatggccgtaattaaagagtggggcaccggacgcgacaccctccggtgcctggccctcgctacccgcgacacccctcccaaaagagaggaaatggtactcgacgactctgcgagatttttagaatacgaaaccgatttgactttcgtcggcgtggtcgggatgctcgacccacccagaaaggaagttacgggatcaatccagttgtgtcgagacgccggaattcgtgtgattatgataaccggcgataacaagggcacagcaatcgccatctgtagaagaataggaattttcggcgaaaacgaggaagtcgccgatagggcgtatactggaagagagtttgatgatttgcctctggctgagcaaagagaggcatgcagaagggcctgttgcttcgccagggtcgagccttcccacaagagcaaaattgtcgagtacctccaatcatacgacgaaattactgccatgactggcgacggtgtaaacgatgcaccagctcttaagaaagcagaaatcgggatcgccatggggtccggtacggccgtggcaaaaactgctagcgaaatggtgcttgctgacgacaatttttcaaccatcgttgcggctgtggaagagggcagagccatatacaacaacatgaaacagttcattcgttacctgataagctcaaacgttggggaggtggtgtgtatcttcctgacggctgcattaggcctgcctgaggcactaatcccagtgcaactgctgtgggtcaatttggtcacagatgggcttcctgctactgccctgggcttcaatcctccagaccttgacatcatggatcgtccccctagatctcctaaagaacccctgatctctggctggctgttcttccgctacatggccatcggtggctatgtcggtgcagcaacagtgggcgcagccgcttggtggttcctgtatgctgaagatgggcctcatgtaaactattcccagctgacccatttcatgcagtgtacggaggataatactcatttcgaggggatcgactgcgaagtctttgaggctcccgagcctatgactatggccctgtctgtcctcgttaccatcgaaatgtgcaacgctctgaacagcctttcagaaaatcagtccctgttgaggatgcccccttgggttaacatctggctcctgggcagcatatgtctatctatgtcactgcacttccttatactgtacgttgaccctctgccaatgattttcaagctaagggccctggatctgacccagtggcttatggtgctgaagataagcttgcctgtgatcggccttgatgagattttaaagttcgtggccagaaattaccttgagggatag

SEQ ID NO: 215157 - DNA, 2994 bp, Artificial Sequence
  Description of Artificial Sequence: Synthetic coding sequence
atggaaaacgctcacactaagaccgtggaagaagtcttgggtcattttggggttaacgaatccactgggttatctttagaacaggttaagaagttgaaggagcgatggggcagcaacgaattgccagctgaggaggggaagactctgctggaactcgtgatcgaacaatttgaggaccttcttgtacggattttgttactggcagcctgcatatcttttgtactggcttggtttgaggagggcgaagagactattactgcttttgtcgagccatttgttattctattgattctcgtggccaacgcaatcgtcggagtgtggcaagaacgcaacgccgagaatgctattgaggcactcaaggagtatgagccagagatgggcaaagtgtatcggcaagatcgaaaatcagtgcagagaatcaaagccaaggacattgtgcctggcgacattgttgagatagcagtgggggataaggtgccagctgacatccggctgaccagcattaagtcaactactcttagagtggatcagtctatcctgaccggcgagagcgtgtctgtcattaaacatacggacccagtccctgatcctcgcgctgtcaaccaagacaagaaaaacatgcttttttctggcactaatatcgccgcaggaaaagcgatgggtgtggtcgttgcgactggggttaatactgaaataggtaaaatccgcgacgaaatggtcgccaccgaacaggagagaacccccctccaacagaaacttgatgaattcggagagcagttaagtaaagttatatctctaatttgtatagcagtgtggattatcaacattggccacttcaatgaccccgtgcacggtggctcctggatccgcggagccatatattactttaaaatcgctgttgccctggccgtagctgccattccagagggactccccgcagtgatcacaacttgtcttgctctgggcaccagacgcatggccaagaaaaatgcgattgtgcgatctcttccttccgtggagacacttggatgtacaagcgtgatctgctctgataagactggtacactcaccaccaatcaaatgagcgtttgcaggatgttcattctggatagggtggaaggcgacacctgctctttaaatgaatttactatcacgggcagcacttacgcccctatcggtgaggtgcacaaggatgacaagccagtgaattgccaccagtacgatggtttggttgaattggcaactatctgcgcattgtgtaacgacagcgcactcgattacaacgaggctaagggcgtgtacgaaaaagtcggggaagctaccgagacagcactaacctgtttggtcgagaaaatgaacgtgttcgacaccgaattgaagggactgtctaagatagaacgcgctaacgcatgtaattctgtgatcaaacagcttatgaagaaggagtttacacttgagtttagccgcgatcgcaagagcatgtctgtgtactgcaccccaaacaaaccgtccaggaccagcatgtcaaaaatgttcgtcaaaggggcacctgaaggcgtgattgaccggtgtactcatattcgggtcggtagcaccaaggtgcctatgacatccggggttaaacagaagatcatgagtgtaattcgggagtggggttcagggtccgacacactgcggtgcctggccctggcgactcacgacaaccctctgcggcgagaggagatgcatctcgaagattcagctaactttatcaagtacgaaacaaacttgaccttcgtcggttgcgtgggcatgctggaccctccgcgaatcgaagtggcttcatccgtcaagctgtgtagacaagctggaatccgcgtgataatgatcaccggtgataataaaggtacagcagttgccatttgtaggcggatcgggatcttcggtcaggacgaggatgttacttccaaagcttttacaggccgtgagttcgatgagctgaatccttccgcacagagagatgcgtgcctcaacgccagatgtttcgcaagagttgaaccatctcataaatccaagattgtggaattccttcaatcttttgacgaaattactgcgatgactggtgacggagttaacgacgcaccagctctgaagaaggctgagataggcatcgcaatggggagtggtactgctgtcgcgaagacagcatctgaaatggtccttgccgacgacaacttttccaccatcgtcgccgcagttgaagagggacgcgcaatttacaacaacatgaagcagtttattaggtacctgatatccagcaatgtgggcgaggtcgtctgtatctttctcactgccgctctgggctttcctgaagctctgatccctgtccaactcctctgggttaacctggtaaccgacggcttacctgcgacagcactggggttcaacccacccgatttggacatcatgaacaaaccacctcggaacccaaaagaaccactgatttctggctggctctttttccgctaccttgccatcggttgttacgttggcgctgctacagtgggcgcagcagcttggtggttcatcgcggctgatggcggaccgcgtgttagcttctaccagttgtcgcattttctgcaatgcaaagaggataatcccgattttgagggggtagattgcgcaatcttcgaatccccttatccaatgacaatggccctgtctgtgttggtcacaatcgagatgtgtaacgccctgaattccctatccgagaatcagtcgcttctcagaatgcccccttgggagaatatttggttggtcgggtctatttgtctctccatgtctctccactttcttatcctctacgttgaacctctcccgctgatcttccagatcaccccgcttaatgtgactcagtggctgatggttttgaaaatcagtctacccgtcatattaatggatgagacactgaaattcgtggcacgaaactatctggaaccagcaatcctcgagtag

SEQ ID NO: 215158 - DNA, 3048 bp, Artificial Sequence
  Description of Artificial Sequence: Synthetic coding sequence
atggagaacgcccacacgaagactgtcgaggaagtgttgggacactttggggtcaacgaatccactggcctcagccttgagcaggtgaagaaactcaaggagaggtggggatcgaacgaacttcccgctgaggagggaaaaaccctgctcgagttggtgattgaacagttcgaggatcttctcgtacgcatccttctgctggcggcttgtatatcctttgtcctggcttggttcgaagagggcgaggaaacaatcactgccttcgtcgagcctttcgtgatcctcctcattttggttgccaacgcaatcgtgggggtgtggcaggaacggaatgctgaaaatgccattgaggccctgaaggaatacgagccagaaatggggaaggtgtaccggcaggatcggaaatcagttcagcggatcaaggccaaagacatcgttcccggtgatatagtcgaaattgctggagaatctgtgtcagtgattaagcacaccgacccagtaccggaccccagggcggtcaaccaggataagaagaacatgctcttttccggtaccaatatagccgcagggaaagcgatgggcgttgtggtggccaccggtgtcaacactgagatagggaaaattagagacgagatggtagccactgaacaggaacggacaccactgcagcagaagctggacgaatttggagaacagcttagcaaggtaatctccttaatctgcattgccgtctggatcatcaatattggacatttcaacgacccagtgcacgggggttcatggattaggggtgctatttactacttcaaaattgcagtggccctggcagtggccgcaattcccgagggtttgcccgctgttatcaccacatgtctcgccctgggcacccgtcggatggccaagaagaacgccattgtacgtagcctcccatccgtggagactcttggatgtaccagtgtgatttgctctgataagactggtaccctcacaaccaaccagatgagtgtatgtcgcatgttcatcctggaccgcgtggaaggggatacttgcagtctaaacgagttcaccataactggcagcacttatgcaccgattggggaggtccataaagacgacaaaccagttaactgccaccagtacgatgggctggtagaactggccaccatctgcgcgttatgtaatgattctgctctggactataacgaggcaaagggagtctatgaaaaagttggcgaggccaccgaaactgcactaacctgtctcgttgagaagatgaatgtcttcgacacagagttaaaaggattgtcaaagatcgagcgcgctaatgcctgtaattccgtgattaagcagctgatgaagaaggaattcacccttgagttctcacgtgacaggaaatcgatgagcgtgtactgcacacccaacaaaccctcgcgcacttccatgtctaagatgttcgttaaaggcgcacctgaaggcgtaatcgatagatgtacccacatccgcgtgggcagcacaaaagttccaatgaccagtggtgtgaaacagaagatcatgagtgtgattcgcgagtggggttcagggagcgataccctcaggtgtctagccttagccactcatgataatcctctgcgcagggaggagatgcatctcgaagattccgccaattttattaaatacgagacgaacttaacgttcgttggctgcgtaggcatgctggaccccccaaggattgaagtggcatcatctgtcaaattgtgtcgccaggcaggcatcagggtcataatgattactggtgacaataagggcaccgccgtcgcaatatgccgacgcatcggaatcttcggccaggacgaagacgtgaccagcaaggccttcaccggcagggagttcgatgagctcaatcctagtgctcagcgtgacgcttgcttgaatgcacgttgcttcgcccgagtggagcccagtcacaaatcaaaaatcgttgagtttctgcagagcttcgacgagatcaccgccatgacaggggacggtgtcaatgacgccccagcccttaaaaaggccgaaataggcatcgctatgggctctggcaccgccgttgcgaaaacagcgagtgaaatggtactcgcggatgataatttttctaccatagttgcagccgtggaggaaggtcgtgccatttataataatatgaagcagtttatccggtatcttatcagctcaaacgtcggcgaagtcgtgtgcatctttcttaccgccgctcttggctttcccgaagctctgatccctgtgcaattgctgtgggttaacctggtcactgacggactcccggctaccgcccttggattcaaccccccagacctggatataatgaacaagccccctaggaacccaaaagaacccctgatcagtggttggctgttcttcaggtatcttgccattgggtgttatgtgggagccgcaacagtcggggcagcggcttggtggtttattgcagccgatggaggtcctcgggtctctttctaccagctcagccacttcttacagtgtaaggaagacaatcccgacttcgagggtgtagattgcgcaatattcgagtccccatatcccatgaccatggcactcagcgttctcgtgaccattgaaatgtgcaacgccttgaacagcctgtccgagaaccagtcattgctgcggatgcccccatgggagaatatttggctggttggtagtatttgcctatcaatgtcccttcacttcctgatactctatgtggagccactgcctcttattttccagatcaccccactaaacgtgactcaatggctgatggtcttgaaaatttctttgccggttattctcatggacgaaactctgaaatttgttgcacggaattacctcgagccaggaaaggagtgcgtccagcctgcgacgaagagctgctccttcagcgcttgtactgacgggatttcttggccatttgtactcctgatcatgcccctggtgatttgggtgtactctactgacactaatttttccgatatgttctggagctag

SEQ ID NO: 215159 - DNA, 3129 bp, Artificial Sequence
  Description of Artificial Sequence: Synthetic coding sequence
atggagaatgcccacacaaagacagtggaagaagttctgggacacttcggcgtaaatgaaagcacaggtctctccctggaacaggtgaagaagcttaaggaacgctggggatccaacgaactgcccgctgaagagggtaagaccctcctcgagctcgtgattgagcagttcgaggatctgttggtccgcatcttgttgctggccgcttgcattagtttcgtcctggcatggttcgaggagggcgaggagacgatcactgcattcgtggagcccttcgtgattctcctcatcttggtggccaacgcgatcgtcggtgtgtggcaggaacgtaatgccgaaaatgccatcgaggccctgaaagaatatgagccagagatgggcaaggtctataggcaggaccggaagtccgttcagcgtattaaagccaaagacatagtgccaggcgacatcgtcgagatcgccgtgggcgacaaggtgcccgctgacattcgtctgacaagcatcaagtccacgacgctgagagttgaccagtcaatcctgaccggagaatcagtgtccgtgatcaaacacaccgatcccgttcccgatcctagggctgttaatcaggataagaagaacatgctgttctccggtacaaatattgcagccggaaaagctatgggcgtggtcgtggccaccggggtgaacaccgagatcggtaagatccgcgacgagatggttgctactgaacaggaaaggactcctctgcagcaaaagctggatgagtttggcgagcaactgtccaaggtgatctctcttatctgtattgcagtctggataatcaacatcggtcatttcaatgaccccgtacacgggggttcatggatcagaggagccatctattactttaagatcgccgtcgctctcgctgtcgcagccattcccgagggactccctgcagtcattaccacctgtctcgctttgggcacccgcagaatggctaaaaagaatgctatagtccgttctcttccgtctgtggagaccttagggtgtacctctgtaatctgtagtgacaaaaccggcactttgactactaatcaaatgtcggtatgtcgcatgtttattctggaccgtgtcgagggagacacatgcagtcttaacgagtttactataaccgggtctacttacgcacccatcggtgaggttcataaagacgataaacctgtcaactgtcaccagtatgacggcttggtcgagctggctaccatttgtgcattatgtaatgacagcgctctcgactataacgaggcaaagggggtgtacgagaaagtcggcgaagccaccgaaactgccttaacctgtctcgtcgaaaaaatgaatgtgtttgacaccgaactaaagggtctgtctaagatagagcgggctaacgcatgtaattctgtgattaaacagctgatgaagaaggagttcaccttggagttcagcagagaccgcaaaagcatgtcagtgtattgtacacctaataagccatcacggacctcgatgtcaaaaatgttcgtcaagggcgctcccgaaggtgtcatcgacaggtgcactcatatacgcgtcgggtcaacgaaagtcccgatgactagtggcgtcaaacagaagatcatgtcagtcataagagagtgggggagcggctccgatacgttacgctgcctggccctggctacgcacgataaccctcttaggagagaggagatgcacctggaagatagcgccaactttatcaaatacgaaactaacctcacttttgtgggctgtgttggtatgcttgaccctccacgcattgaagtagcttcatccgtaaaactgtgtaggcaggccggaatacgagtgatcatgatcaccggagataataagggaacagccgtggctatatgccggagaatcggcatcttcggtcaggatgaggatgtgacgagtaaagcctttaccggcagagaattcgacgaactcaatccgagtgctcagagggacgcatgccttaatgctagatgttttgcgcgtgtcgaaccaagccacaagtctaagattgtggaattcttgcagtccttcgatgagatcactgccatgactggcgacggcgtgaacgatgcacccgcactgaagaaagccgaaataggaattgccatggggtccggcaccgccgtggctaaaacagcgtccgagatggtattggcagacgacaacttctcaactatcgtcgccgctgtggaggagggtcgggctatctacaataacatgaaacaatttattaggtacctgatttccagcaacgttggagaagttgtgtgtatcttcctgactgccgcactgggatttcctgaagctctcattcctgtacaactgctctgggtaaacctggtgacagatgggctgcctgctaccgccctgggctttaaccccccagatctcgacatcatgaacaagcccccacgtaatccgaaagaacccctcatctcagggtggctcttctttcggtacctggccatcggatgctacgtgggagccgcaacagtgggtgcagccgcttggtggttcattgcagctgacggaggtccacgcgtttccttttaccaactttctcatttcctacagtgtaaggaggataacccggactttgaaggcgtggactgtgccatttttgagtcaccataccccatgacgatggctctgtccgtactcgtgactatcgagatgtgcaatgcactaaacagtctgtccgagaatcaaagcttactgaggatgcccccttgggagaacatttggctggtggggagtatatgcctgagtatgagcttgcactttctgatcctgtatgtggagccactcccgcttatttttcagattactcccctcaatgtaacacagtggcttatggtactaaagattagtctccccgtgattctcatggacgaaacattgaaattcgtggctcgtaactacctggagccagggaaagagtgtgtgcagccagctactaagagctgtagcttttctgcgtgcacggacggcatctcttggcccttcgtgctgcttattatgcctttagtcatctgggtctactccacagataccaatttctccgatatgttctggagctag

SEQ ID NO: 215160 - DNA, 2802 bp, Artificial Sequence
  Description of Artificial Sequence: Synthetic coding sequence
tagactatcactgctttcgttgagcccttcgtaatattgcttatacttgtggcaaatgcaatcgtcggggtgtggcaggagcggaatgccgagaatgccattgaggcgctgaaggagtacgaacccgaaatgggcaaggtttatcgccaggacaggaaatccgtgcagaggattaaggcaaaagatatagtccctggggacattgtcgagatagccggagaatccgtgtcagttataaagcacacagaccccgtaccggacccacgtgccgtgaaccaggacaaaaaaaacatgttgttttcagggacaaacatcgccgcaggtaaagccatgggggtcgtggtcgccacaggcgtgaatacagagatagggaagatccgggatgaaatggttgcgacggagcaggaaagaacgccactgcagcagaagctggacgaattcggcgagcagctcagcaaagtgatctccctcatttgtattgccgtatggatcataaacatcggccacttcaacgatcccgtgcatggcggttcctggatcagaggtgcgatttactactttaagatagccgtggccctagccgtagcggctattcccgaggggcttcctgcagtgataaccacatgcctcgcattaggaactagaaggatggcaaagaagaatgctattgtgaggtccctgcccagcgtggagacactaggctgcacgtccgtcatatgttctgataaaactgggacacttaccacaaaccagatgagcgtttgtaggatgttcattctggacagggtggaaggggacacctgttcattgaacgagttcacgatcaccggaagtacctatgcgccaatcggtgaggtacacaaagacgataagccagtcaactgccatcaatacgatggactggtggagctcgccacaatttgcgcactgtgtaatgactctgctctggattacaacgaggcaaaaggtgtatacgagaaagtgggtgaagccacagagacagctctcacatgcctggtagaaaagatgaatgtgttcgatacagagctgaaggggcttagtaagatcgaacgcgctaatgcttgtaatagtgtcatcaaacagcttatgaagaaggagtttacgctggagtttagccgcgaccgcaaatccatgtccgtgtattgtacacccaacaagccctcaaggacctctatgtccaaaatgttcgtgaaaggtgcaccagagggagtcattgatcgatgtacccatattcgtgttggctccactaaggtgcccatgactagtggcgtgaagcagaagattatgtcggtgattcgcgaatgggggtcgggttccgatacccttaggtgtctcgcgctggcaacccacgataaccctctaaggagggaggaaatgcacctggaggattcggctaatttcatcaagtatgagacaaatcttaccttcgtgggttgcgtgggcatgctcgacccgcctaggatcgaagtagcctcctcggtgaagctgtgtcgtcaggctgggatccgcgtcatcatgattacgggggataacaagggtaccgctgtggcaatttgccggcgaatcggtatcttcggacaggacgaagacgtgacatcaaaggcattcacagggcgagaatttgacgaattaaatcctagtgcacaacgggatgcctgtcttaacgctcgatgtttcgccagagtcgaaccttcacataaaagcaagatagtggagttcctccagagctttgatgaaatcactgcgatgacaggggacggagtgaacgatgcacctgctctcaagaaagcagagatcgggattgccatggggagtggtaccgccgtggccaaaaccgccagcgaaatggttctagccgatgataacttttctaccatcgtggcagcggtggaagaagggagggcaatatacaataatatgaagcaatttattagatacctgataagctccaacgtcggagaggtggtgtgtatctttctcacagccgcattggggtttcccgaggctctgattcctgtacagctcctctgggtgaatttggtgactgatggcctccccgctaccgccctcggcttcaatccaccagatctggacattatgaataagccaccgagaaatcctaaggaacctctaatttccgggtggctgttcttcagatatctggccattgggtgttatgtgggtgccgcaacagtgggcgcagctgcctggtggtttattgctgctgatggcggaccccgtgtctctttctaccagctgtcacacttcctgcagtgtaaggaggacaacccagatttcgaaggtgtcgactgtgccatcttcgagtcgccgtatccaatgactatggccctctctgtactcgttactattgaaatgtgcaacgcactcaacagcctttctgagaatcagagtctgctaagaatgccaccttgggagaacatctggctggtgggcagtatctgcctcagcatgtcattgcacttcctgatcctgtacgtggaacctctgcctcttatttttcagatcacccctctgaacgtcactcagtggttgatggtcctgaaaatttcactgcctgtcatcttaatggacgaaactcttaaatttgtcgcaagaaattacttggaacccggtaaggagtgtgtccagccagctacgaaatcatgctctttcagcgcatgtacagacggcataagctggcccttcgtactgttaatcatgcctctggtgatctgggtttacagcacagacaccaacttttccgacatgttctggtcttag

SEQ ID NO: 215161 - DNA, 3663 bp, Artificial Sequence
  Description of Artificial Sequence: Synthetic coding sequence
atgggtgacatggccaataacagcgtggcttactcaggggtgaaaaatagcctgaaggaggcaaaccacgatggcgatttcggaataaccctggccgaacttagagccctcatggaacttaggagcacagatgccctgaggaaaattcaggagtcgtacggcgatgtctacggcatctgtaccaagctaaagacctccccgaacgaaggtctttctgggaatccagcagatcttgaaaggcgagaagccgtcttcggcaaaaatttcatccctcccaagaagcccaagacatttctacagttggtgtgggaagcactacaagatgtgaccctgatcatcctcgaaattgccgcaatagtgtcactgggcctgtcattttaccaacctccagaaggagataatgctctttgtggagaagtttctgttggggaagaggagggagagggggaaacgggctggatcgagggagccgcaattttgttgagtgtagtctgcgtggttctggttacagctttcaatgattggagtaaggagaaacagtttcggggactgcagtctagaattgagcaagaacaaaagttcacggtcattcgcggaggacaagtgatccagattccggtggctgatatcaccgtcggcgatattgcacaagtgaagtacggcgatctgttgccagctgacggaatcctgatccagggaaatgatcttaagatagatgagtcttccctcactggcgagtccgaccatgtcaaaaagtccctcgataaggaccctctgctcctatctgggactcatgtgatggagggcagcggtaggatggtggtcactgcagtcggtgttaattcgcagacaggtatcatttttaccctgctgggagccggaggtgaggaggaggaaaagaaggacgagaagaaaaaggagaagaagaacaagaaacaggatggagcaatcgagaaccggaataaagcgaaggctcaggacggcgcagcaatggagatgcagcccttaaagagcgaggaaggtggcgacggcgatgagaaagataaaaagaaagctaacctccctaaaaaagagaagtcagtgctgcagggaaaacttactaagctagcagttcagattggaaaggccggattgctcatgtccgccatcaccgttattattctggtgctctacttcgttatagatacgttctgggttcaaaagaggccatggctggctgaatgcacaccaatctatatccagtacttcgtaaaatttttcattattggtgtcaccgtcctggtggtggccgttcccgaaggccttcccctggctgtcaccataagcttagcatacagcgtcaagaagatgatgaaggataacaatctggtccgtcacttagacgcatgcgaaactatggggaatgccactgctatttgcagtgataaaactggaacactgacgatgaatcggatgacggtggtccaggcctacataaatgaaaaacattacaaaaaggtgccagaacccgaggcaatcccaccaaatatcttatcctacctggtgaccgggataagtgtgaactgcgcttacactagcaagatactgccccctgagaaggaggggggactgcccaggcacgtggggaataagaccgagtgcgccttgttaggcctcttactcgatttgaagcgcgattatcaggacgtcagaaatgagatcccagaagaggctctttacaaagtgtatacattcaattctgtgaggaagagcatgagtaccgtgttaaagaacagtgacggaagctaccgcatcttcagtaaaggcgcttctgaaattattctcaagaaatgcttcaagatcctatcagcaaatggggaagctaaggtgttcaggcctcgagatagggacgatatcgtcaaaactgtgatagagcccatggcctccgagggtctccggacgatctgccttgcgttcagagacttccctgccggagagccagaaccggagtgggacaacgagaatgacatcgtgacaggcctaacttgcatcgccgttgttgggattgaagaccccgtccgcccagaggtgccagacgctatcaagaagtgccagcgggctggtataactgtcaggatggttacgggagataacatcaatacagcaagagcaatcgctaccaagtgtggcatacttcaccctggggaagactttctgtgtcttgaaggcaaggattttaatcggaggatcaggaacgaaaagggagagatcgagcaggagagaatcgataagatctggcctaaactacgtgtgctcgctcgctccagccctacagataaacataccctcgtgaagggcatcattgattcgactgttagcgaccagagacaggttgtggcagttacaggcgatggaacgaacgacggacccgcactaaagaaggccgatgtgggctttgccatggggattgctggcacggatgtggccaaagaggcctctgatatcattcttactgacgacaacttcactagcatcgtaaaagcggtgatgtgggggcgaaacgtatacgattctataagtaagttcctgcagtttcagttgactgtcaatgtcgtggcagtgatcgtggcgtttacaggagcttgcatcacccaagactcccccttgaaagccgtacaaatgctgtgggtcaacctgattatggacaccctggcctcactcgcattggccaccgagccgccaaccgaaagtctgcttttgcgcaaaccgtacgggcgaaacaaaccgctgatcagccgaaccatgatgaagaatatccttgggcacgccttttatcagctggtggtcgtttttactctgctgttcgccggagagaaattcttcgatattgacagcggaagaaatgcgccactccatgcgcctccctctgaacactacacaatcgtgtttaacactttcgtgctgatgcagctgttcaatgagattaatgcacgaaaaatccatggtgagcgcaacgtgttcgaagggatctttaataatgctatattttgtacaatcgtgttgggaacgtttgtcgtacagatcattatcgtgcagttcggtgggaaaccttttagttgtagcgagctcagcatagagcagtggctgtggtctattttccttggcatgggaacactactttggggacaattaatatccactatccctactagcaggcttaagtttcttaaagaagccggtcacggcacacaaaaagaggaaatccctgaagaggaactggccgaagatgtcgaagagatcgatcatgcagagcgggaattgcgccgtggccagatactgtggttccgcggactgaatagaatccagactcagattcgagttgtgaatgcatttagatcaagtttatacgagggcctggagaaacccgaatcccggtcttccatccataattttatgacacatcccgaattcagaattgaggattctgaacctcacatccctttgatagatgacaccgatgctgaagatgatgcccctaccaagaggaattcctccccccctccaagccccaacaagaacaataatgccgtggatagcggaattcatctgactattgaaatgaacaagagcgctacatcctccagccctgggtctcctcttcattcattggagactagcttgtag

SEQ ID NO: 215162 - DNA, 3555 bp, Artificial Sequence
  Description of Artificial Sequence: Synthetic coding sequence
atgggagacatggccaacaacagcgtggcatacagcggtgtgaaaaactcgctgaaagaagctaatcacgacggcgattttgggatcacattagccgaactgagggccctgatggagctccgctccacagacgctcttaggaaaatacaggagagttatggagatgtgtacgggatatgtaccaagctcaaaacctctcccaatgaggggctgagtggaaacccagccgatctggagcgacgcgaggccgtattcgggaaaaactttatccctcccaagaagccaaagaccttcctgcagttagtctgggaggctctgcaggacgtaacactcatcatcctcgagatcgccgcaattgtcagcttaggtctgagtttctaccaaccccctgagggggacaatgcactgtgcggagaggttagtgtgggagaggaagagggagagggtgagacgggatggattgaaggggctgccatactattgtccgtggtctgcgtagtgttggttacagcatttaatgattggagtaaagagaagcagttcagagggctgcagtcgcggattgaacaggagcagaaattcacagtgatccggggtggacaggtgattcagatcccagtggcagatatcacggtgggggacatcgcccaagtaaaatatggtgatctgctcccagccgatggtatcctgatacagggcaatgatttgaagattgatgagagttctcttactggagaaagcgaccacgtgaaaaaaagcctagacaaggatcctttgctcctgtcaggcactcacgtgatggaaggcagcggccgtatggtggtgactgccgtcggcgtgaactctcaaacaggaattatcttcactctacttggtgcgggaggcgaggaagaagaaaaaaaagatgagaagaagaaagaaaagaagaacaagaagcaggatggggcaatcgagaaccgtaacaaagcaaaagcacaggacggcgctgcaatggagatgcagcctctgaagtccgaagaaggcggagatggcgatgagaaagacaaaaagaaagccaatctgccaaaaaaggagaaatcagttctgcagggaaaactaactaagctcgcggtccagattggaaaggctggcctgctgatgtctgccataaccgtgataatacttgtcctctattttgtgatcgacacattctgggtacagaagcggccatggcttgcagagtgcacccctatttatattcaatatttcgtgaagttttttattattggggtgacagtgctggtagtagcagtgcctgagggcctgcctctggccgtgacaatcagcctcgcatatagcgttaaaaagatgatgaaagataacaacctggtgaggcacttagatgcttgcgagactatggggaacgctaccgctatctgctctgacaagacagggactctgacaatgaacagaatgaccgttgtccaggcgtacattaatgaaaagcactataagaaagtccctgagcccgaggctatacccccaaatattctgagttacctcgtcaccggaatatcagtgaattgtgcctatacatccaaaatcctgcctcctgagaaggaagggggactccccagacatgtcggcaacaagacggaatgcgctcttttagggctcctcttagaccttaaacgcgactatcaagacgtgagaaatgaaatcccagaggaagctctgtacaaggtgtatacattcaactccgtgcgaaaaagtatgagcaccgtgctcaagaattccgatggctcgtacaggattttcagcaagggagctagcgagattattctgaaaaagtgttttaagattctgtctgcgaatggtgaagctaaggtgttcaggccacgcgatagagatgatatcgtgaaaaccgtgatcgagcctatggctagtgagggactgaggactatttgtttggcgttcagggacttccctgccggagaacctgaacctgagtgggataacgagaacgacatcgtaaccgggctcacttgtatagcagtagtcggcattgaggaccctgtgcggcctgaggtgccagacgccatcaagaagtgtcaacgcgcaggcataacggtgagaatggtgaccggcgataatattaataccgccagagctatcgcgacaaagtgtgggatactgcaccccggagaagattttttatgtttggagggcaaggattttaacagacgcattcgcaatgagaaaggggagatcgaacaggagcgcatcgataagatctggcctaagttgagggtgctcgcaagatcatcccccaccgataagcacacactcgtcaaagggatcatcgattccaccgtttctgatcagcgccaggtggtggcggtaacaggggacggtacgaatgatggaccagccctgaagaaggctgacgtcggatttgccatgggaatcgcagggactgatgtggccaaggaagcatccgatatcatcctcacagacgacaactttacatctatcgtgaaggccgtaatgtgggggagaaacgtgtatgattccattagtaagttcctgcagtttcagttgaccgtgaacgtagtagctgtcattgtcgcattcactggcgcatgtataacgcaggatagtccattgaaggccgtgcaaatgttgtgggtgaatctgatcatggacaccttggcctctctggccctcgcaaccgaacccccaacagaaagtctactgctgcgcaagccatatggacggaataaacccctgatcagccgaacaatgatgaaaaacatcctcgggcatgccttttatcaactggtggtcgtgtttacgctccttttcgcaggggagaaattcttcgacatcgactccggacgcaacgcaccactgcacgcaccaccctctgaacactacaccatcgtgtttaatacattcgtgctcatgcaactgttcaatgaaattaacgccagaaagatccacggagagcgcaacgtctttgaagggatctttaataacgctatcttctgcactatagtactgggaacttttgtagtgcagttaatttctacgatccccactagcagactgaaattcctgaaagaagctggacacggcacacagaaagaggaaatccctgaggaggaacttgccgaggatgtagaggaaatcgaccatgcggagcgcgagctgcgacgcggacagattctctggttccgtggtctgaatagaattcagacccaaattagggtggtgaacgcatttcgctcctctttgtacgagggcctggagaagcctgaatctcgcagcagcatacataattttatgacacatccggagttccggattgaggactctgaaccccatataccactgatagatgacaccgacgcagaagacgacgcccctaccaagagaaattctagccccccaccctcccccaacaagaacaacaatgccgttgactctggcatccatttaacaattgagatgaacaaaagtgctacttcttcttcacctggctcgccactacattctcttgaaacaagtctgtag

SEQ ID NO: 215163 - DNA, 3531 bp, Artificial Sequence
  Description of Artificial Sequence: Synthetic coding sequence
atgggtgatatggccaataactcagtcgcatactcaggagtaaaaaactccttgaaagaagctaatcacgacggagactttggcattaccctcgcagagctgcgcgctctgatggaactgcgcagcaccgatgctctgagaaaaatccaggaatcctatggagatgtgtacgggatttgcacaaagctgaagacctcacccaacgaaggcctctccgggaatcccgcagatctggagaggcgcgaagccgttttcgggaagaattttattcctcctaagaagcccaaaacttttttacagctggtgtgggaagctctgcaggatgtaactttgattatccttgaaatcgccgcaatcgtctccttgggcctgtctttctatcaaccacccgaaggggataacgcgctctgcggggaagtaagcgtgggtgaagaggagggggagggcgagacgggctggatagagggagcagctatcttactgtccgtggtttgcgttgtgctcgtgaccgccttcaacgactggtcgaaagagaaacagtttagagggttacagagtcgcattgaacaggaacaaaaattcacagtgatacggggaggccaggtgatacagatcccagttgccgacattaccgtaggtgacattgcgcaagtcaaatatggagatctgctgcctgccgacggaattctcatccaagggaatgatcttaaaatcgatgagagttcactgactggcgaatctgaccacgtcaagaagagcttagacaaggatccgctcctgttgtcagggacccatgtaatggaaggatccggcagaatggtcgtgactgccgtgggagttaacagtcagaccgggattatcttcacactgctgggggcaggaggggaagaagaagaaaagaaagatgagaaaaagaaggagaagaaaaacaagaaacaagacggggcaattgaaaatagaaacaaagctaaagcccaagatggggcagctatggagatgcagcccctgaaatctgaagaagggggagacggcgatgagaaggacaagaagaaggccaacctgccgaaaaaagaaaagagcgtcctgcagggcaagctgactaaactagccgtgcagatcgggaaagccggattgctgatgtccgcgatcaccgtcatcatccttgtcttgtacttcgtaatcgataccttctgggtccagaaaagaccatggctggctgaatgcactcctatctatattcaatacttcgtgaagttttttatcattggtgtgactgttcttgtagtggccgtcccggaggggttgccactggccgtgactatatctctcgcctatagtgttaagaaaatgatgaaggataacaacctggtacgacacctggatgcatgtgaaaccatgggcaatgcaaccgcaatatgcagtgacaaaacaggcaccctgacaatgaacaggatgacggtcgtccaagcatacatcaacgagaaacactataagaaggtcccagagcctgaagccattccccctaatatccttagctacctggttacaggcataagtgtgaactgtgcctatacgtcgaaaatcctgcctcccgaaaaggagggtggactcccccgacatgtcggcaacaagacggaatgtgccctactcggccttctgctggatcttaagagggattaccaagacgtgaggaatgagatccccgaagaagccctgtataaagtgtatacgttcaattcagtaagaaaaagcatgtcaacagtgcttaaaaatagcgacggatcctacaggatcttttccaaaggtgcttccgagatcattttaaaaaaatgctttaaaattttgtccgcgaatggagaagccaaagttttccgacccagggacagagacgacattgtgaaaactgtgattgagccgatggcttccgagggcctccggacaatctgcctcgcttttcgggatttccctgccggagagcctgagccagaatgggacaatgagaacgacattgtgactgggctgacctgcatcgctgtggtggggatcgaggacccagtgcgccctgaggtgccagacgcaatcaaaaagtgccagcgggctggcattactgtcagaatggtgacaggtgataatatcaacaccgcccgtgccatcgccactaagtgcgggatcctccacccaggcgaggactttctgtgcttagaagggaaggatttcaacaggcgtattcgaaatgaaaagggtgagattgaacaggaacggattgacaaaatttggcctaagctgcgggtcctggctcgctcttctccaaccgacaagcacacccttgtgaaagggatcatcgactcaactgtgtccgaccagcgacaagtagtcgcggtcaccggtgacggcacaaatgatggcccagccctgaagaaggccgatgtgggttttgctatgggtatcgcagggaccgacgtggctaaggaagcaagtgacatcatccttaccgacgacaattttacgagcatcgtgaaagccgtgatgtgggggagaaacgtttacgattccatttctaagtttcttcaatttcagctgaccgttaacgtggtggcagtgatcgttgcattcacaggagcctgcattacccaggatagtccgctcaaggccgtgcagatgctgtgggttaacctgattatggacaccctcgcttctctggcgctggctaccgagcccccaaccgaatcactgctcttgcggaagccctatggtcgcaacaaaccattaatctcccgtaccatgatgaaaaatatattaggccacgccttttaccagctagtcgttgtgtttacccttctgttcgctggcgaaaagttctttgatattgacagtggaagaaacgctcccttgcacgcgcctcccagcgagcactatacaattgtttttaacacgttcgtcctcatgcagctgttcaatgagatcaacgccagaaaaattcacggagaaaggaacgtgtttgaaggtatattcaacaacgctatcttttgcaccattgtcctgggaacattcgtcgtgcaaataataatcgtgcagttcggcggtaagccgttctcttgtagtgagcttagtattgaacagtggctgtggtccatttttctcgggatgggaaccctcctgtgggggcagttaatctctaccattccgaccagtaggctgaaattccttaaggaggcagggcatggaacacaaaaagaggagatccctgaggaagagctggccgaagacgtggaggagattgaccacgccgagcgggaactacgtaggggtcagatcttgtggtttcgcggtctgaatagaattcagacccagatggatgtggtgaatgcttttcagagtggcagctccattcagggcgcactgagacggcaaccttctatcgcttcacagcatcacgacgtcacaaatatcagcactcccactcacgtggtgttctcgtcttccacagcttccaccacagtgggttatagtagcggtgagtgtatttcatag

SEQ ID NO: 215164 - DNA, 2892 bp, Artificial Sequence
  Description of Artificial Sequence: Synthetic coding sequence
atgttcctggtcatcggaacccacgttatggaaggaagtgggagaatggtcgttactgctgtgggggtcaatagtcagacgggaattatctttacgctgctgggtgcgggaggagaagaggaagagaaaaaagacgagaagaaaaaagagaaaaagaataaaaaacaggacggtgctattgagaaccggaacaaggctaaggcacaggatggcgctgcaatggagatgcagcctctgaagtcagaggagggcggtgacggcgacgaaaaggataaaaagaaagccaacctcccaaagaaggagaaaagtgtcctgcaagggaagctgaccaagctggctgtccagatcggaaaggccggactgttgatgagcgctattaccgtaatcattcttgttctgtactttgtgattgataccttctgggtccagaaacgaccttggcttgcagagtgcacacccatatacattcaatactttgtcaagttctttataattggcgtaacggttctcgtcgtcgcggttccagaaggactgccgctagcagtcacgatttcactggcctattccgtcaagaagatgatgaaggacaataacttggtaagacacttggatgcctgcgaaactatggggaacgctaccgcaatctgctcagacaagaccggcaccctgactatgaatcggatgactgtggtgcaggcttacatcaacgagaaacattataaaaaggtacccgagccagaagcaatacccccaaatatcctcagttacctggtaacagggatttctgtgaattgcgcgtatacttccaagattctgccacctgaaaaagaagggggactccctcgccatgttggaaataaaaccgaatgcgctttgctgggcctcctactggatctgaaacgagattatcaagatgtgaggaatgagatcccagaggaggccctgtacaaagtgtacacgttcaattctgtgagaaagagcatgtccactgtgctgaaaaactccgacggaagttatcgtatcttttccaagggcgcttctgagattatacttaaaaagtgttttaagatcctttcggcaaatggtgaggccaaggtcttccgaccccgagatcgcgacgatatagtaaaaaccgtcattgagcccatggcatctgagggactccgcaccatctgtttagcctttagggacttccccgcaggggagccagagccagagtgggacaacgaaaacgatatcgtgacgggactcacttgcatagctgtggtgggcatagaggatcccgtcagaccagaggtgcccgatgccataaagaaatgccaaagggctggaattacggtgagaatggtcactggcgacaatattaacaccgccagagctatcgctactaagtgtgggatcctgcatcctggggaagacttcctttgcctggagggtaaagactttaataggagaattaggaacgagaaaggcgaaattgaacaagaacgaatcgacaaaatatggccaaagctaagagtcctcgcccgtagcagcccaaccgacaagcacaccctggtgaagggaatcatcgactctacggtgagcgaccagcggcaagttgtcgccgtcacgggcgacggtacgaatgacggccctgctctcaagaaggctgatgttgggtttgccatggggatagcgggaaccgacgtcgccaaagaggcgtccgacattatcctgacagacgacaatttcacatctattgtcaaggctgttatgtgggggagaaacgtgtacgattcaatttccaagttcctgcagtttcagctgaccgtgaatgtggtggccgtgattgtggcatttaccggagcctgtataacccaggactcaccattgaaagccgttcagatgctctgggtgaacctcatcatggacactcttgcatccctggccctggctaccgagccgccaaccgagagccttctcctgcgcaagccatacggtaggaataagcccctcatcagtagaaccatgatgaaaaatatcctggggcacgccttctatcaactggtggttgtgtttactctgctctttgcaggagagaaatttttcgatattgacagtggacgtaatgctcccctgcacgctcctccttcggaacactacacgatcgtgttcaacacgtttgtccttatgcagttgtttaatgaaatcaacgcgagaaaaatccacggggaacgaaacgttttcgaaggcatctttaacaacgctatattttgtactatcgttctggggactttcgttgtgcagattataatcgtccaattcggtgggaaacccttcagctgttcagagctgagtatagaacaatggttgtggtcaattttccttggaatggggaccctgttatggggccagctcatctccaccattccaacaagccgcctcaaatttctaaaggaagccggtcacgggacacagaaggaagagattcctgaggaagaattagcagaagacgtggaagagatcgaccatgccgagcgggagctacgccgtggtcaaatattatggttcaggggtctgaaccgtattcaaacccagatccgggtggtaaacgctttcaggtcaagtctctatgaaggattagaaaagccggagagccgcagctccattcacaactttatgacacatcctgagttcaggattgaggacagtgagcctcacatcccgttgatcgatgacacggacgctgaggacgacgcacccactaaacgcaattcctcacccccaccatcccctaacaagaacaataacgcagtggattctggaattcatttgacaatcgaaatgaataaatctgccaccagttcatcaccaggcagtcctctacacagtctcgaaacaagcctatag

SEQ ID NO: 215165 - DNA, 3663 bp, Artificial Sequence
  Description of Artificial Sequence: Synthetic coding sequence
atgggagacatggctaacaattccgtagcgtacagcggtgtcaagaactcactgaaagaagctaatcatgacggtgactttggcataacgctggccgagctaagagccctgatggaactccgtagcaccgatgccctacgcaagatccaagaatcctatggtgatgtgtacggaatctgcaccaaactcaagacttctccgaatgagggtctgtccggcaatcccgcagatttagagagaagagaagctgtattcggaaagaacttcattccccctaagaagcctaagaccttcttacagttggtttgggaagcattgcaggatgtcaccttaattattcttgagattgcggctatcgtatctctgggactgtccttttatcagccacccgagggtgataacgctctttgcggggaggtcagcgtgggcgaagaggagggagaaggcgagactggctggatagagggagctgccatcctgctatctgtggtgtgtgtggtacttgtcacagcctttaatgattggagtaaagagaagcagtttagggggctgcaaagtaggatcgagcaggagcagaagttcaccgtcatcaggggaggccaagtgatccagatcccagtggcggatataaccgtaggcgatatcgctcaggtgaaatacggcgatctcctgcccgctgacgggattttgatccagggcaatgatctgaagattgacgagagcagcctgactggagagtcagatcacgtcaagaagagcctggacaaagatcccctcttgctttcagggacacacgtcatggaaggatcagggagaatggtggtgacggccgtgggtgtaaattcccagaccggcattattttcactttgctgggcgctggcggtgaagaagaagagaagaaggatgaaaagaagaaggaaaaaaagaataaaaaacaggacggcgctatagaaaacaggaacaaagcgaaggcgcaagatggcgctgctatggagatgcagcctctgaagtcggaggagggaggtgacggtgacgaaaaagacaagaaaaaggctaatctacccaaaaaggaaaaaagcgtgttgcaggggaaactgacaaaactggctgtgcaaattggcaaagccggactgcttatgagcgcaattacagtgatcattctcgtcctatacttcgttatagacacgttctgggtgcagaagcgtccatggcttgccgagtgcaccccgatatatatccagtatttcgtaaagttcttcatcattggggttaccgtgttggtggtcgctgttcctgaagggctgcctctggcagtaaccatcagccttgcatactctgtaaagaaaatgatgaaggataacaaccttgttagacacctggatgcctgtgagaccatggggaatgcaacggctatctgctctgacaaaacgggtacgctgacaatgaacagaatgacagtagtgcaggcatacattaacgagaaacactataaaaaggttcctgaaccggaggcaataccgcctaatattctgtcctatctggtgacaggtatttctgtaaattgcgcctatactagcaagattctcccccctgaaaaggaggggggtttacccaggcacgtagggaataagacagaatgcgcccttcttgggctgctccttgatctgaagcgtgactaccaggatgttagaaacgagatcccggaggaagcactctacaaggtgtacaccttcaactccgttcggaagtctatgagcaccgtcctgaaaaattcagatgggtcctacaggattttcagtaagggggcttcagagatcatcttaaaaaaatgcttcaagattctgtccgctaatggggaggctaaggtgtttaggcctagggaccgagatgacattgtcaagacagtaattgaaccgatggcctccgaagggcttaggacaatttgtcttgcattccgcgattttcctgcgggtgagccagagccggaatgggacaacgaaaatgatattgtgacaggcctgacttgcatcgctgtcgtggggattgaggaccctgtgcgccctgaggtcccagacgcgatcaagaagtgccagcgggcaggcatcactgtgcggatggtgacaggggacaacatcaacacggccagagcaatcgccacaaagtgtggaattttacatcccggagaagactttctgtgtctggaggggaaggattttaaccggaggattagaaacgagaaaggcgagattgaacaggagcggatcgacaagatctggcctaagctgagggttctggcgaggtcttccccaaccgacaaacacacattggtcaagggtataatcgactctactgtgtccgatcagcggcaggtggtagctgtcaccggtgacggcactaatgatggaccagctcttaagaaagcagacgttgggtttgctatggggatcgcaggaactgacgtggccaaggaggccagcgacatcatactgacggatgataatttcactagtattgtcaaggcagtgatgtgggggcgaaacgtctacgacagcatttctaagttccttcaatttcagttgactgtcaatgtggtggcggttattgtggcatttactggagcatgcatcacccaggattcccctcttaaagccgtccagatgctgtgggttaatctcattatggacacgctggcctctttggctcttgctactgaacccccaacagaaagcctgctgctgagaaaaccctatggccgtaataagccgctgatcagcagaactatgatgaagaatatcctcggtcatgctttctaccagctcgtcgtcgtctttaccctcctttttgcaggagagaaattttttgacattgactccggcagaaatgcacccttgcatgccccaccttccgaacattacactatcgtgtttaacacgttcgtgttgatgcagttatttaacgaaatcaatgccaggaagatacacggggaaaggaatgtgtttgaggggatcttcaacaatgccatcttctgcaccatcgtgctcggaaccttcgtggtgcaaattatcatcgtgcagttcggcggaaaacctttttcctgtagcgaactgtccatcgagcagtggctctggagtatctttctcggtatgggaaccctgctgtgggggcagctgatctcaactatcccaacaagtcgtttaaagtttctgaaggaagccggacacgggacgcagaaggaagaaattcctgaggaagagctggccgaagatgtggaggaaatcgatcacgcagaacgggaattgcgtagaggtcagatcctgtggttcaggggtctcaacagaatccagactcagatccgcgtggttaacgcgtttcggtcttccctttatgagggactggagaaaccagagtctaggtcttcgatacacaattttatgacccacccagaattccggatcgaggactcagagcctcatattccactgatagacgacaccgatgccgaagacgacgcaccaaccaagagaaacagctccccaccgcctagcccaaataagaataataatgctgttgactccggcattcatcttacaattgagatgaacaaaagtgccacctccagctctcccggtagtccactccattctctcgagacttctctgtag

SEQ ID NO: 215166 - DNA, 306 bp, Artificial Sequence
  Description of Artificial Sequence: Synthetic coding sequence
atgggggacatggccaacaacagcgtggcctacagcggagttaaaaactccctgaaagaagccaaccatgatggagactttggcataacactcgctgaattacgcgcacttatggaactgaggtccacggatgcgctgaggaagatccaagaatcttatggtgacgtgtatgggatttgtaccaaattaaaaacttcccccaatgagggtgagttttactatgcctgcttttggtttttcgtccaaagggtgctgtacatctggttgattaatgaacacgcctatatcattttggcaatcgtttag

SEQ ID NO: 215167 - DNA, 3600 bp, Artificial Sequence
  Description of Artificial Sequence: Synthetic coding sequence
atgggggacatgaccaactccgacttctacagtaaaaatcagcggaacgagagctcccacgggggtgagttcggatgcacaatggaggagctgagatcactaatggaactgaggggcactgaagccgtggtcaagatcaaggaaacctacggtgacaccgaggccatctgcagacgcctgaaaacaagccccgtcgaggggctgccaggcaccgcccctgacctggagaagcggaaacagattttcgggcaaaattttattccccctaaaaagccaaagactttcctgcagctggtctgggaagccctccaggacgtgacgctcataatacttgagattgccgctattatctccctaggtctttccttctaccaccctccaggagaggggaatgagggctgcgcaacggcccagggtggcgcagaagacgagggcgaagctgaagccggatggatcgaaggcgctgcaatactgctctccgtcatttgtgttgtgctcgtgaccgccttcaacgattggtctaaagagaagcagttccgcggtctgcagagtcgcatcgaacaggagcagaaatttaccgtagtgagagctggtcaggtggtgcagatccctgtcgcggagatagtcgttggggatatcgcccaggtaaaatatggcgatctgctacctgcggacggcctctttattcaggggaatgatttaaagattgacgaatcttctctgacaggtgagtctgaccaggtacggaaatctgtggataaagaccccatgctcctcagcggcactcacgttatggagggatccggcagaatgttggtgactgccgtgggcgtgaattctcagaccggcatcatctttacactgctaggagccggaggcgaagaggaggagaaaaaggacaaaaagggagttaagaagggcgatggacttcagcttccagccgcagatggagccgctgcctctaacgccgcagacagcgctaacgcgtcattggtaaatggcaaaatgcaggatggcaacgttgatgcatcccagtccaaggctaaacagcaggacggtgccgctgccatggagatgcagcctctgaagtcagctgaaggcggtgatgctgacgatcggaaaaaagcttctatgcacaagaaggagaaaagcgttctgcaggggaagttaacaaaactggccgtccagatcgggaaggccggtctggtcatgtccgccatcactgtgatcatcttggttctgtatttcacggtggacacattcgtggtgaacaagaaaccctggctgcctgaatgcaccccggtatacgtgcaatactttgtcaagtttttcataatcggggtgaccgtgcttgttgtggcggtgcctgaaggactgcctctcgctgtcactatttcacttgcctactccgtgaaaaagatgatgaaggacaacaacctggtgagacatctcgacgcctgtgaaaccatgggtaacgccactgccatttgtagtgataagacgggtacgttgacaaccaatcggatgacagtggttcaggcgtacgtaggcgatgtgcattataaagaaatccccgacccctcctccattaatactaagacgatggaactcctaataaacgcgattgctattaattccgcttacacgaccaagatccttcctcctgagaaagagggtgctcttccacggcaggtcggtaacaagacagagtgtggcctgctgggcttcgtcttggatctcaaacaggactacgagcctgtaaggagccagatgcccgaggaaaaattgtacaaagtgtacaccttcaattcagttcgtaaaagcatgagtacggtgatcaagcttcccgacgagtcttttagaatgtactcaaagggggcatccgaaattgtgttgaagaaatgttgcaagatattgaatggggcaggcgaacctagagtatttcgcccacgggatagagacgaaatggttaagaaggtgattgagcccatggcttgcgacggattgcggacaatttgtgttgcctatcgggattttcctagctccccagagcctgactgggacaatgaaaatgacattctgaatgagctcacgtgcatttgcgtcgtggggattgaggaccccgtgcgccctgaagtacctgaggccatccgaaaatgtcagcgtgctgggatcaccgtaaggatggtgaccggcgacaatatcaacacagcccgagcgattgctatcaagtgcggaattattcacccaggcgaagatttcctttgcttggaaggtaaggagtttaaccgacgcatccgaaacgagaagggggaaattgagcaggaacgaatcgacaaaatctggccaaagctgagagtgctggcacgatcaagtcctaccgacaaacatacattggtgaaaggaatcatcgatagcactcatacagagcagcgccaggtggtcgccgtgacgggcgatgggactaatgacggaccagcgctcaagaaagctgacgtgggcttcgccatgggtattgctggcacagatgtagccaaagaagctagcgacataatcttgactgacgacaatttttcatccatcgtaaaggcggtcatgtgggggaggaacgtttacgatagtatctccaaatttcttcaattccaactgacagtgaatgtcgtcgccgtgatagtagcattcaccggtgcttgcatcacgcaagattccccactgaaagcagttcagatgctatgggtaaacctcatcatggatacatttgccagccttgctcttgccactgaacctccaacagaaaccctcctgctccgtaaaccctacggtcgcaacaagcctctcatctcaaggaccatgatgaaaaacattctgggacacgctgtgtaccagctggcactcatcttcactctcctgttcgttggagaaaagatgttccaaattgacagcggtaggaacgcgcctctgcactctcctccgtcagagcactacacaatcattttcaataccttcgttatgatgcagttattcaacgagattaacgccaggaagatccatggagagagaaatgtatttgatggcattttccgaaatcccatcttttgcacgatcgtactgggtacatttgcaatacagatcgtgattgttcagttcggcggaaagcctttcagttgtagccccctgcagctagaccagtggatgtggtgtatctttattgggttgggtgaactggtctggggccaggttatagctaccatcccgacatctcgtcttaaatttctaaaggaggccggtagactgactcagaaagaagagatccctgaggaagagctgaacgaagacgtcgaagagatcgaccatgccgagcgggagctgcgccgaggccaaattctgtggtttcgaggcttaaataggattcagactcagatcgaagtagtaaacacttttaagagcggggcttcctttcagggtgctttgcggagacagtcttctgtcacctcccaaagccaagacgtggcgaatctgtcctcacctagccgtgtaagtttgagtaacgccttaagctcacctacatccctgccacccgctgccgctggacgtgagtag

SEQ ID NO: 215168 - DNA, 3690 bp, Artificial Sequence
  Description of Artificial Sequence: Synthetic coding sequence
atgggggacatgactaactcagatttttattcaaagaaccagcgcaatgaaagttcccacgggggagagtttggttgtacgatggaggaactccggagcttaatggagctgcggggtactgaagctgtcgtcaagataaaggagacatacggcgataccgaggctatttgtagaaggctgaaaactagcccagtggagggactgccagggaccgcccctgatctggagaagagaaagcagatatttgggcaaaactttataccaccaaagaaaccaaagacctttctgcagttggtgtgggaagctctgcaagatgttactctgataattctagaaatcgctgccattattagcctgggtctgagtttttaccatccccctggagagggcaacgaaggctgtgctacagcgcagggaggcgctgaggatgagggagaagctgaagccggttggattgagggagccgctattcttttgagcgttatttgcgtggtcctggtgactgcctttaatgattggtcaaaagaaaagcagttcagggggctgcagagccggattgagcaagagcagaaatttacggtagtgcgagccggacaagtcgttcagattccggtggctgaaattgtggtgggagacattgcccaagtgaaatacggggacctactgcctgcggacggtttgttcatccaggggaatgacttaaaaattgacgaatcaagcctgacaggggagtccgatcaggtgcgaaaatcagtcgacaaggatccaatgcttctgagcggaacgcatgtcatggagggttccggccgaatgttagtgacggctgtgggcgtgaactcccaaaccggaatcatcttcactctgctgggggcagggggagaggaagaggagaagaaggataaaaagggcgtgaaaaagggagatggactgcagttgccggctgccgatggcgctgcagctagcaacgccgcagacagtgcaaatgcctcattggtcaatgccaaacagcaagatggggctgctgccatggaaatgcagcctctgaaaagcgccgagggaggcgatgctgatgatagaaaaaaagctagtatgcacaagaaagagaagtctgtccttcaaggaaaactgacgaaattagccgtccagattgggaaggcaggcctggtcatgtctgcaataactgtgattatcctcgtgctgtacttcacggtagacacatttgtagtgaataagaaaccctggctgccggagtgcacacccgtctatgtgcagtacttcgtgaaattctttataattggtgtaaccgttctggtagtcgccgtgcctgaaggactccctctcgccgtgaccatatctcttgcctatagcgtcaagaaaatgatgaaggataataacctcgtccgccacctggacgcgtgtgaaaccatggggaacgcaacggccatctgttcagacaagactggtaccctcaccacaaaccgaatgacagtggtgcaggcctacgtcggcgatgtgcactacaaggagattcctgatccttcttctataaacaccaaaacgatggaactgctgataaacgctatcgcaatcaatagcgcttacacgacaaaaatcttacctccggagaaggaaggcgctctcccaagacaggtcggaaacaaaaccgaatgcggcctgctgggctttgttctagatctcaaacaggattacgaacccgtgcgatcccagatgcctgaggaaaaactctacaaggtttacacattcaattctgtacgcaagagtatgtctaccgttatcaaattgcctgatgagtcgttcagaatgtactcaaaaggcgctagcgagatcgtcctgaaaaagtgttgcaagattctcaacggcgctggcgaaccccgagtctttaggcctagggatcgtgacgagatggtcaagaaggttatagagccaatggcctgtgatggactgaggacaatctgtgtagcttatcgggattttccgtctagtccagagcctgattgggacaatgaaaacgatatccttaacgaactgacttgtatctgcgtggtggggatagaagaccctgtgaggcctgaagtgcctgaggccatcaggaagtgtcagagggcaggcatcactgtcagaatggtaactggggataacattaacaccgcgagagctatcgctataaagtgcggaattattcatccaggggaagatttcctgtgtctggagggcaaggagttcaatagaagaatccgtaatgagaagggggaaattgaacaagaaaggatcgataagatttggcccaaacttcgggtcctagctaggtccagcccgacagacaaacatacactagtgaagggaatcattgactctacacacacagagcagcgccaggtggtcgccgtgaccggtgatggaacgaacgacggacctgcattaaaaaaagcagacgtgggatttgctatgggtattgctggaacagatgtagcgaaagaagcctcagatataatactgaccgatgacaatttctcatcaatcgtgaaggctgtcatgtggggtcgtaacgtgtatgattccataagtaaatttcttcaattccaattgacagtgaacgttgtggccgtgattgtagcttttacgggcgcttgtattacccaagatagtccattaaaggccgtgcagatgctgtgggtgaaccttatcatggatactttcgcatccctggccctggcgaccgaacctccaaccgagaccctgctgctccggaagccttacgggagaaacaaaccattaatctcaaggaccatgatgaagaacattcttgggcacgctgtttatcagctggctctgattttcaccctgctctttgtcggagaaaaaatgttccagatcgattctggacgaaacgcaccactgcattcccctccgtctgagcactacactataattttcaacacattcgtgatgatgcagctgtttaacgagattaacgccagaaagatccatggggagaggaacgtgttcgatgggattttccgcaaccctatattctgcacgattgttctgggcacctttgccatccagatcgttatcgtgcagtttggtggcaaacctttcagttgctcaccactgcagttggaccaatggatgtggtgcatttttataggactgggggagttagtgtggggacaagtgatagctaccattccaacgtcacgtctcaagttccttaaagaagcgggaagactgacgcagaaggaagagattcccgaagaagagttgaatgaggatgtcgaagaaatcgatcatgccgagagagagctgcgcagaggccagatcctgtggttcaggggcctgaatcggatccagactcaaataagagtagtgaaggcatttcgctctagtttgtacgaaggcttggagaaacccgagagccggacctcaattcacaactttatggcccacccagaatttcgcatagaggactcccagccacacataccattaattgatgatacggacctggaggaggacgccgcactgaagcagaacagcagtccgccatcctcattaaataaaaataactcagcgattgattcaggcatcaacctgaccaccgacacttctaaatccgctactagctccagtcccggtagcccgatacactccttagaaacttcactgtag

SEQ ID NO: 215169 - DNA, 3732 bp, Artificial Sequence
  Description of Artificial Sequence: Synthetic coding sequence
atgggagacatgacaaactcagacttttatagcaagaatcagcgaaacgagtcctcccatggcggagagttcggttgtacaatggaagagctgcgctccttgatggagctgcgcggtactgaagccgtcgtgaagattaaagagacttacggcgacacagaagcaatctgtagacgtctcaagacatctcccgtggaaggcctgcctggaactgcacccgacctggagaagaggaaacagatcttcggccagaacttcatcccccctaagaaacccaagacttttctacagctggtatgggaagcattacaggatgtcacactcatcattcttgaaattgctgccattatttcccttggccttagtttctaccacccacctggggagggaaatgaaggctgcgccacagctcagggaggagctgaggatgaaggagaagccgaagccggatggattgagggcgctgcgattctgttaagcgttatatgcgtagttctggtaactgcttttaatgactggtccaaagaaaaacagtttagagggttgcagtctcgcattgagcaagaacaaaagtttacagtcgtccgggcagggcaggttgttcagatcccagtcgccgaaatcgtggtcggggatatcgctcaggtgaaatatggcgatctcctgcccgctgatgggctgtttattcaaggaaacgacctgaagatagacgaaagtagcctgaccggagagagcgatcaggtgcgcaagtctgttgataaggatcccatgcttctcagcggaactcacgttatggagggcagcggcagaatgcttgtcaccgccgtcggggtaaatagccagactggcattatttttaccctcctgggggcaggcggtgaggaggaggagaagaaggataaaaaaggcgtgaagaagggcgacgggttacagctgccggctgcggatggtgcagccgcttcgaacgccgctgactctgcaaacgcgtccctagtgaatggaaagatgcaagacgggaacgtggacgcttcacagagcaaggctaagcagcaggatggcgctgctgctatggagatgcagccactgaagagtgctgagggcggtgacgccgatgatcgaaaaaaagcctccatgcacaagaaggagaaatcagtattgcagggcaagctaaccaagctggccgtgcagatagggaaggccggattagtcatgtcggccatcacagtgatcatactcgtgctgtactttactgtcgacacctttgtggtcaacaaaaaaccctggttacccgaatgcactcccgtgtacgtgcagtactttgtgaaatttttcatcatcggcgtgacagtgctggtagtggccgtgcctgaagggctgccactggcagtcaccataagcctggcttacagtgtgaagaagatgatgaaagataataatctggtaaggcacctggatgcttgcgaaactatggggaatgctactgccatttgctcagataagaccggtacccttaccacgaacagaatgactgtggtccaggcctatgtcggggatgtacattataaagaaatacccgatccttcatctatcaataccaagactatggagctgctgatcaacgcaatcgccattaatagcgcttataccaccaagatcttgccacccgagaaggaaggtgctctacccagacaggtggggaataagacggaatgcggattattaggtttcgtgctagatctgaaacaagactacgaaccagtgagatctcagatgcccgaggaaaagctctacaaggtgtacactttcaactcagtccgcaagtctatgagtacagttataaagctccctgacgagtcttttcgcatgtactccaagggcgcatcagaaattgtactgaagaagtgttgcaagattctgaatggggctggggaaccacgtgttttcagaccccgtgacagggacgaaatggtgaaaaaggtcatagagcctatggcctgtgacggactgcgaacaatctgcgttgcctacagggattttccctccagtccagagcccgattgggataatgagaatgatattttaaatgagttgacatgcatctgtgtcgttggcatcgaggacccagtaaggccagaggtgcctgaagccatccgtaagtgtcagcgtgcaggtatcaccgtgaggatggttactggtgataacattaataccgcacgagccatcgccatcaaatgtggtatcatacacccaggagaggatttcctgtgtctggagggcaaagaattcaatcgtcgcatccgtaacgagaaaggggagatcgaacaggagaggattgataagatctggcctaagctgagggttctggctaggtcatctccaactgacaagcataccctcgttaaagggattattgactctactcataccgagcaaagacaagttgtagcagttacaggtgatgggaccaacgatggacctgcgttgaaaaaagctgatgtgggatttgctatgggcattgccggaaccgacgttgccaaggaagcctctgacatcatactcacagacgacaatttttccagtattgtaaaagctgtgatgtggggacgaaacgtgtatgactccatcagcaagtttcttcagtttcagctcactgtgaacgtcgtcgcagttattgtcgcctttactggcgcatgcatcacacaggattctccattgaaggccgtccagatgctgtgggtgaatctaatcatggacactttcgcgagccttgctctggcgaccgagcccccaacagaaactctgctgctgaggaaaccctacgggaggaataagccgctgatttcaagaaccatgatgaagaacattctggggcacgctgtgtaccaattggcactaatattcaccctgcttttcgtaggagagaaaatgtttcagatagattccgggagaaatgcacctctgcacagcccccctagcgagcattatacaattattttcaatacattcgtgatgatgcagctgttcaacgagatcaatgccaggaagatccatggggaacgtaacgtatttgatggcatttttaggaacccaatattttgcacaattgttctgggcacttttgccattcaaatcgtgattgtgcagtttggcggaaagcccttctcttgctctcccttgcagctggatcagtggatgtggtgtatctttataggccttggagaactggtgtgggggcaggtcatcgccacaattcccacgtcacggctaaagttcctaaaagaagctgggagactcacccagaaggaggagatccctgaggaagagctcaacgaagacgtcgaagaaatcgatcacgcagagcgagagttaagacgagggcagatcctctggtttcggggactaaaccggattcagacccagatcagagtggttaaggctttccgcagctccctgtacgaagggctggagaaaccagagagtaggacgagtattcataatttcatggcccacccagagtttagaatcgaggactctcaaccccatatcccactcatcgatgatacggacctcgaagaagacgctgccttgaaacaaaactccagtcctccttcctcgttgaacaagaacaattcagctattgatagcgggatcaacttaacaaccgatacgtctaagtccgccacaagcagctcccctggtagccctatacactcactggagactagcctgtag

SEQ ID NO: 215170 - DNA, 3732 bp, Artificial Sequence
  Description of Artificial Sequence: Synthetic coding sequence
atgggggacatgactaacagcgacttttacagcaaaaatcaaaggaacgagtcttcacacgggggagaattcggatgcacaatggaagagctgaggtccctgatggagctgcgaggtactgaggctgtggtgaagattaaagagacatatggtgataccgaagcaatttgccgcaggttaaagactagtcctgtggaggggctgccgggtacagctcccgacctggagaagagaaagcagatctttgggcagaatttcattccgccaaagaagcctaagacttttctgcagctggtctgggaggccctgcaagatgtaaccctgataatcctcgaaattgccgctataatcagtttaggcctgtcgttctaccatcctcctggcgaaggcaacgaaggttgcgccacagcccagggcggagccgaagacgagggcgaagctgaggcgggatggatagaaggcgcagctatcctgctgtccgtaatctgcgttgtgctcgtgacagcattcaacgattggagcaaggaaaagcagttccgaggactgcagtcaaggattgagcaggaacagaaattcaccgtggttcgtgccggacaagtagtgcagatccccgtggccgaaattgtcgtgggcgacatcgcccaggtcaaatatggtgatttgctgccagcagacggcctttttatccagggtaacgacctgaagatagacgaatcatctctgactggagaaagtgatcaggtgcggaagtcagttgataaggatcctatgttgttaagcggtacccatgtgatggaggggagcggcagaatgctggtgacagcagtcggcgtcaatagccaaacagggataattttcactctgctgggagccggaggagaagaagaagaaaaaaaggataagaaaggagtgaaaaagggagacggcttacagcttccagcggcagatggcgcagctgcaagtaacgccgcagactccgcgaacgcgtccttggtaaacggtaagatgcaagacgggaacgtggacgcttcccagtctaaggccaaacagcaggacggtgcggcagccatggagatgcaacccctgaagtctgccgaaggcggagatgcggacgatcgtaagaaggcctctatgcacaagaaggagaaaagcgtgttgcagggcaagctcacaaaactggctgtgcagattggaaaggccggattagtgatgagtgcgataaccgtcatcattctggtgctgtacttcacagtggacaccttcgtggtcaacaaaaagccttggttgccagaatgcacaccggtgtacgtgcagtatttcgtaaaattctttattatcggggtgactgtgttggtggtagccgtccccgaagggcttcccttagccgtcacaatcagcttggcttacagcgtgaagaagatgatgaaggataacaatttggtgagacacctcgatgcctgtgagacaatgggcaacgcgacggccatatgctccgataagacggggactctgactacaaacaggatgaccgttgtgcaagcttatgtgggtgacgtgcattataaagaaattcctgacccttctagcattaacaccaagacaatggaattgctgatcaatgccattgcaatcaactctgcctatacaacaaagatactgcctccagaaaaggaaggcgcattgccacgacaggtggggaataagactgaatgtggcctccttgggtttgttcttgatttgaaacaagattacgaacctgttaggagccagatgccagaggaaaaattgtataaggtttatacattcaactccgtccgcaagagtatgtccactgttataaagcttcctgacgaatcctttagaatgtatagcaagggcgcatctgagatcgtgcttaagaaatgttgcaagattctgaacggcgcaggtgaacctagggtcttccgaccacgggacagagacgagatggtgaagaaggttatcgagcctatggcctgcgacggattgcggactatatgcgtggcttaccgcgactttcccagttctccagaaccagattgggacaacgagaacgacatcctgaacgagctgacttgtatatgcgtcgtggggatcgaggacccagtgcgccctgaggtgcccgaggcaattaggaagtgccaacgcgcagggatcaccgtccggatggtaacaggcgacaatatcaatacggctcgggcaattgcaatcaagtgtggtattatacatcccggagaggatttcctttgcctggagggtaaagagtttaacagacggattaggaatgagaaaggcgagatcgagcaagagaggatcgataagatttggccaaaactgcgtgtgctcgcccgaagtagcccgactgacaagcataccctcgtcaaaggcataatagattccacccacaccgaacagagacaggttgtggctgtcacgggtgatggaacaaatgacggccctgcactgaagaaagcggatgtcgggttcgctatgggaattgcagggaccgacgttgctaaagaagcatcagacataattctgaccgatgacaatttttcctctatcgtgaaagctgtgatgtggggaagaaatgtgtacgattccatctctaaattcctccagttccagctgaccgtgaatgtagtcgcagtgatcgtcgccttcactggggcatgtatcacacaagactctccattaaaagccgtgcaaatgctttgggtgaaccttatcatggatacctttgcaagtctcgcactggcaacagaacctccaaccgagaccctcttactccgaaagccatatggtcgcaataagccactcatctctcggactatgatgaaaaatatcttgggccatgctgtgtaccagttagcactgattttcaccctgctgttcgtaggtgagaagatgtttcaaatagactcggggaggaatgcccctctccactcacccccttcagagcattatactattatttttaacactttcgtcatgatgcagctttttaacgaaatcaatgctcgcaaaattcacggggaacggaacgtatttgacggtattttccgtaatccaattttctgtacaattgtgctaggcaccttcgccatccaaattgtgatcgtgcagttcggcggaaagccatttagctgttctcccttgcagttggaccagtggatgtggtgtattttcatcgggcttggggagttagtgtggggccaagtcattgctaccattcccacctcaaggttgaagtttctcaaggaggccggaaggcttacccagaaagaagagatcccagaggaggaacttaacgaggatgtcgaggaaatcgatcatgccgagagggaattacgcagaggtcaaattttatggttccgcggacttaatcgcatacagacccagatacgggtagtgaaagctttcaggagtagtctgtatgaagggcttgaaaaaccagagtctaggacctccattcataactttatggcccacccagagttccgaatagaggactctcagcctcacatcccactcattgacgatactgacctcgaagaggacgccgctctcaaacagaattccagcccaccatcctccctgaataaaaacaactccgccatcgacagtggtatcaacctcaccacggacacatctaaaagcgctacttcttcctcccccggatctcccattcacagcttggaaacctccctgtag

SEQ ID NO: 215171 - DNA, 3597 bp, Artificial Sequence
  Description of Artificial Sequence: Synthetic coding sequence
atgggggacatgacgaattccgacttctattccaagaatcagagaaacgagagctcccacggaggcgagtttggttgcacaatggaggagttgcgcagcctgatggagctcaggggaaccgaagctgtggtaaagatcaaggaaacatatggtgatacggaggcaatctgccgaagactgaaaaccagcccagttgaggggctccctggaacagccccagacttggaaaagaggaagcagatctttgggcagaacttcatccccccaaagaaacctaaaacgttcctccagttggtgtgggaggcactgcaggatgtaacactgatcattctagagattgcggctatcatcagtcttggtctgtccttctaccaccccccaggggagggaaatgaaggatgtgctaccgcccaggggggagctgaagacgaaggagaagccgaggcaggatggatagagggtgctgccatcctgctctccgtgatctgcgtggtcctggtgactgctttcaatgattggagcaaagagaaacagtttcgagggctgcagagccggattgagcaagagcaaaagtttactgtcgtgagggctggtcaagttgtacagatccctgtggccgaaatagtggttggagacatcgcacaagtgaagtacggcgatctgctacccgctgatggcctgtttatccaagggaatgatctcaagattgacgagagtagcctcacgggggaaagtgatcaggtgcgtaaatctgtggacaaagatcccatgttattgagtggcacccacgtgatggaaggatccgggagaatgttggtgacagctgtcggagtgaactcacaaacaggtatcatattcactctcctgggagccggaggtgaggaggaagaaaagaaagacaagaaggctaaacagcaggatggagccgcagccatggaaatgcaacccttgaaaagcgcggaaggcggtgacgctgatgacaggaagaaggcctcaatgcacaagaaagaaaaaagcgtgctacagggaaaattaactaaactcgcggtgcaaataggaaaggctgggcttgttatgtcagccataaccgtaatcatcctagtactttattttactgtggatacttttgttgtgaataaaaagccttggctgccagaatgcacccctgtgtacgtacagtatttcgttaaattctttatcatcggcgttacagtgttggttgtggcagtccccgaggggctcccactggctgtgaccatttctctagcctattctgtaaagaaaatgatgaaagacaataatctcgtcaggcatttggacgcatgtgaaactatggggaatgctactgctatctgctcagataagacggggacactcaccactaatagaatgacggtggtgcaggcctacgttggggacgtgcactataaggaaattcccgatcccagcagtataaatacgaagacaatggagctgttgatcaatgctatagcaattaactccgcttataccaccaaaattcttcctccagagaaagaaggcgctcttccacgacaggtagggaacaagacggagtgcgggctgctggggttcgttctggacctgaaacaggactatgaacccgttcggtcccaaatgccagaagagaagctctataaagtgtataccttcaattcggttcggaaatccatgagcacagtgatcaaactgcctgatgagtccttcaggatgtatagcaaaggcgcttctgaaattgtgttgaagaagtgttgtaaaattcttaatggagcaggcgagcctcgtgtctttcgaccccgtgatcgtgacgaaatggttaagaaagtcatcgagccaatggcatgcgacggactgcggaccatctgcgttgcgtaccgggacttcccgtcatcacctgaaccagactgggataatgagaacgatattcttaatgaactcacatgtatttgtgtcgtcgggatcgaagatcctgtgcggcctgaagtgccagaagccatcaggaagtgccagcgcgctggcatcaccgtgaggatggttactggggataatatcaacaccgcaagagctatcgcaatcaaatgcggtatcatccatcccggtgaggactttctgtgtttggaaggcaaggaattcaaccgccgaatacgcaacgaaaagggggagattgaacaggaaaggatcgacaaaatctggcctaagcttcgggtcctcgctcggagctcaccgactgacaagcacacactggtaaaggggattatcgacagcactcacacggaacaaaggcaggttgtggccgtcactggagacggaacaaatgatggccctgctctcaagaaggcggatgttggattcgccatgggcatcgccggaactgatgtggctaaagaggcctctgatattatcctcactgacgacaattttagctctatcgtcaaggccgtgatgtggggacgaaatgtatacgatagcataagtaaattcctccaattccaactaacagtcaacgtcgtggccgtgatcgtggcctttaccggggcttgcatcactcaggactccccattaaaggccgttcaaatgctgtgggtgaaccttataatggacaccttcgcttctttagcccttgctactgagcccccaacagaaactctcttgctccgcaagccatacggtaggaacaaacctctcatcagccggacgatgatgaaaaatatcctcggccatgcggtctaccagcttgccttaatatttacgttgctgttcgtgggagagaaaatgtttcaaatcgatagcgggcgaaatgcccctctccatagccccccatccgagcactataccatcatttttaacacatttgttatgatgcagttattcaatgaaataaatgccagaaaaattcatggcgaacgcaacgtgtttgacgggatcttcagaaatcccattttttgtacaatcgtgttgggcacatttgccattcagatcgtgattgtgcaatttgggggaaaaccctttagttgtagccccctccagctagaccagtggatgtggtgcatcttcatcggcctcggagaacttgtctggggacaagtgatcgccactatcccgacctctaggctgaaattcttgaaagaagctggtaggctgacgcaaaaggaagaaatccctgaggaggagcttaatgaggatgtggaggagatagaccacgccgagcgggaactcagaaggggacagatcttgtggttccgaggcctgaatagaatccaaacacaaattcgcgtcgtgaaagcgttcagatcttcattatacgaagggctcgaaaagccagagagcagaacctccattcacaactttatggcacacccagagtttaggatcgaggactcccagccccacatcccgctgattgatgacacggatctcgaggaggacgccgcactcaagcagaattcttcgccgccttcctcgctgaacaaaaacaacagtgcgattgactcgggcattaatctaacaacggacacctcgaagtccgctacgagctcaagccctgggtcccccatccatagcctggagacatccctctag

SEQ ID NO: 215172 - DNA, 3597 bp, Artificial Sequence
  Description of Artificial Sequence: Synthetic coding sequence
atgggagatatgaccaactccgacttttacagtaaaaaccagaggaatgagagctcccatgggggtgaattcgggtgtaccatggaggagctgcgttctctgatggagctccggggtaccgaagccgttgtgaaaattaaggagacttacggcgataccgaagcaatatgtcgaagactgaaaacctcccctgtagaggggttgcctggaacagcaccagatcttgagaaacgaaaacaaatctttggacaaaacttcatcccacccaaaaaacccaagactttcctgcagcttgtgtgggaggccctacaagacgtcaccttgatcatcctagagatcgcggcaataatttccctgggcctcagcttttatcacccccctggtgaaggcaatgaagggtgtgccaccgctcaggggggagcagaggatgagggcgaggccgaggcaggttggattgagggggctgcaatcctgctgtctgttatctgcgtggtcctggttacagcctttaatgactggagcaaggagaaacagtttagagggcttcagagtagaattgagcaggagcagaagttcactgtggtgagagccggacaggtggtgcagatcccagtcgcagagatcgtcgttggagacattgcccaagtgaagtatggggacttactgcccgcagatggactcttcatacaagggaacgacctgaaaatcgatgaatctagtttgaccggggagtcagatcaggtgaggaagtctgtcgacaaagaccccatgctccttagcggaacgcacgtgatggaggggagcggtcgcatgcttgttacagccgtgggcgtgaatagtcagaccggcattattttcactttgctgggcgctggaggtgaggaggaagaaaaaaaggataagaaagccaaacagcaagacggcgcagcagcgatggagatgcagccactgaagagcgctgagggtggcgacgctgatgacagaaagaaagcctcaatgcacaaaaaggaaaaaagcgtattgcaggggaaactgaccaaactggctgtacaaatcggaaaggccggactggtcatgtctgcaatcaccgtgattattctggtcctctacttcaccgtggacacattcgtggtgaacaagaaaccttggctgcctgaatgtacccccgtctatgttcagtacttcgttaaattctttattatcggagtaacagtgctggtagtcgctgtccccgagggcctcccgttagcagttaccatttcactggcatattcagtgaagaaaatgatgaaggacaacaatctagttcgccatctggatgcctgtgagaccatgggaaatgccaccgctatttgttcggataagaccggtacgctcacgacaaataggatgaccgttgtccaggcgtatgtcggagatgtacactataaagagattcctgatcccagctccatcaacactaaaacaatggaactcttgattaacgcaatcgcaatcaacagcgcttatacaacaaagatcctgccccctgaaaaggagggcgctctccccagacaagtgggtaacaaaactgagtgtgggctcctgggctttgtgcttgatttgaagcaggattatgagcccgtccgatctcagatgccagaagagaagctttataaggtatatacgttcaactccgtcagaaagtctatgtcaactgtgattaagctccctgatgagtctttccggatgtattcaaaaggcgcatcagagatcgtcctgaaaaaatgctgcaaaatcctcaacggagctggtgagccaagggtgttcaggccccgagacagggacgagatggtgaaaaaagtgatcgaacccatggcatgtgacgggttgcggaccatttgcgttgcgtacagagattttcccagcagccccgagccggattgggacaacgagaacgacatactgaacgaactcacatgcatttgcgtggttggaattgaggatcccgtgcgcccagaggtcccagaagccattaggaaatgccaacgtgccggaataaccgtgcggatggtgacaggagacaatattaatacggccagagccattgcaatcaagtgcgggattattcacccgggtgaagacttcttatgtctggagggaaaggagttcaatagacggatccggaacgagaaaggcgagattgaacaagagaggatagataagatttggcctaagctgagggtcctggctaggtcatccccaaccgacaagcacacactagtgaaaggcattatagacagcacacataccgagcagaggcaagttgtggcggttacgggcgatgggacgaacgacgggccagccctcaagaaggcagacgtcgggttcgcgatgggcattgctgggacggatgtggccaaggaggcctctgacatcatcctgacagacgacaattttagctctatagtgaaagctgtaatgtggggaaggaacgtgtacgactccatttctaagttccttcaattccaactcactgtgaacgtagtggcggtgatagtcgcgtttacaggagcttgcataactcaggactcgcccctgaaagccgtgcaaatgctctgggtgaatttgattatggacacatttgccagtttggcgctggcgacggaaccacccactgagaccctgctgcttcggaagccgtatgggcgtaataaaccgctgatttcccggaccatgatgaagaacatcctgggtcacgcagtatatcaactcgccctgatattcaccctcttgttcgtgggcgagaagatgtttcaaatcgacagcggacgaaatgccccactccattcaccacctagcgagcactatacgatcattttcaatacattcgttatgatgcagttatttaatgaaataaacgccaggaaaatccacggtgagcggaatgtcttcgacggcattttcagaaatcctatcttctgcacgattgtcttggggacattcgcaatccagatcgttatcgtgcagtttggaggtaagccgttcagctgcagccctctgcagctggaccagtggatgtggtgcatctttattggccttggcgagctggtctggggacaggttatagccaccatccccacatctcgacttaaattcctgaaggaggcaggacggctcacacagaaggaggagattcccgaagaggaactgaatgaggatgtggaggagatcgatcatgccgagcgggaactgcggcgaggccaaatactgtggtttcgcggtttgaacaggatccagacgcaaattcgagtcgtgaaggcatttcgaagctcattatacgagggactggagaagccagagtcacgaacgtccatccataacttcatggcacaccctgaattcagaattgaggattctcaaccgcatattccactgatcgatgatactgatcttgaggaagatgccgctctgaagcagaattccagtcctccatctagtctgaacaagaacaatagtgccattgacagcgggataaatctgactaccgacacctcgaagtcagccaccagttctagcccaggatccccaatccacagtctcgagacaagcctgtag

SEQ ID NO: 215173 - DNA, 1299 bp, Artificial Sequence
  Description of Artificial Sequence: Synthetic coding sequence
atgaccgtggtgcaagcctatgttggggacgttcactacaaagaaattccagacccctctagtattaataccaaaacaatggagttgctgattaatgcaatcgcaattaacagcgcttataccacaaagatcctccctccagaaaaagagggtgccctaccccgtcaagtgggaaacgtgtatgacagtattagcaaattcctgcagttccagctcactgtcaatgtggtggcagtgattgtggcctttacgggagcatgtataacccaagatagccctttgaaagccgtccagatgttgtgggtgaacttgatcatggataccttcgcgagtctagctctggctaccgaaccgccaactgaaaccctgctcctacggaaaccttacggacgcaacaagccccttatatctaggaccatgatgaagaacattctgggccacgctgtgtaccaactcgctctgatattcacgctattgtttgtgggagagaagatgtttcagattgatagcgggcgtaacgcgcctctgcatagccccccaagcgaacattacaccattatcttcaataccttcgtcatgatgcagctatttaatgaaatcaacgctcgcaagatccacggcgagcgtaatgtcttcgacggcatttttcgcaatccaattttttgcaccatagtgcttgggacatttgcaattcagattgtgattgtccaatttggcggtaagccattttcctgctcaccactgcaactggatcaatggatgtggtgtattttcatcggactgggggagctcgtgtgggggcaagtcatcgctaccattccgacctcaaggcttaagtttctcaaagaagcaggtcgtctcactcagaaggaggagatccccgaggaggagctcaatgaagatgtagaagagatagaccacgccgagagagaactgcggagaggtcaaatcctttggtttcggggactcaacaggattcagacccagatcagggttgtgaaggcctttcggtctagcctgtacgagggacttgagaaacccgaaagcagaactagcattcacaattttatggcacatcccgaatttcgaattgaagactctcagccccatataccacttatagatgacaccgatctggaggaagatgcagcacttaagcagaattctagtccaccgtcatctttgaacaaaaataacagcgcgatcgattctgggatcaatcttactaccgacacatccaagagtgccacaagctcctccccaggatctcccattcacagcctggagacatcgctgtag

SEQ ID NO: 215174 - DNA, 3537 bp, Artificial Sequence
  Description of Artificial Sequence: Synthetic coding sequence
atggaattgagaggtacagaggccgttgtcaaaattaaagaaacctacggagacacagaagcaatctgccgccgactgaaaacaagcccggtcgaaggcctgcccggtactgcaccagacctagagaaacgcaagcagatctttggacagaatttcattccacctaaaaaacccaagacattcctccaacttgtttgggaggctcttcaggacgtgactctaattatcctggagatcgctgccatcatatcgctgggcctgtcattctatcatccacccggtgagggtaatgaggggtgtgccaccgctcagggtggggctgaggacgaaggagaggcagaggccggttggatcgagggggcagccatactgctctcagttatatgtgtggtgttggtcacagcctttaatgactggtcgaaagagaaacaatttcgaggactgcagagcaggatagaacaagaacagaagttcacagtggtgcgcgctggccaagttgttcagatccccgtggctgagatcgtagtaggggatatagcccaggtgaagtacggcgacctgctccccgctgacggattattcatccagggcaacgatctcaaaatcgacgaatcgtcactcacaggggaaagtgatcaagtgcgaaaatctgtagacaaggaccctatgctgctctctggtactcatgtcatggagggctccgggagaatgctggtgaccgccgtcggagtgaactcccagacggggattatctttacactgttgggtgctggaggcgaggaagaagagaaaaaagacaaaaagggcaagatgcaggatgggaacgtggatgcgtcacaatcaaaagctaagcagcaggacggtgccgcagctatggagatgcagcctttaaaaagcgctgaagggggtgacgcggacgatcggaaaaaagcttcgatgcacaagaaggagaagtctgtgcttcagggcaaactgaccaagcttgcagtgcagatcggaaaagcagggcttgtgatgtccgctatcaccgtcattatcctggtcttatatttcactgtggacacattcgtagtgaacaaaaagccgtggttgcctgagtgcacgccggtctacgtccaatactttgtcaagttttttatcatcggtgtgactgtcctggttgtcgccgttcctgagggcctccccttggctgtgactattagcttggcttacagcgttaaaaagatgatgaaagataacaacctggtacgacacttagatgcatgtgaaacgatggggaacgccacagccatctgctctgataagacagggaccttgacaacaaatcggatgacggtcgtgcaggcctacgtaggggatgtgcattataaggagattcctgacccctcctcgatcaataccaagaccatggagttactgatcaatgctatcgctataaacagcgcgtataccaccaagattttgcccccagagaaggaaggtgcactcccccgacaagtgggtaataagacagagtgtggactactggggtttgtgttagacctgaaacaagattatgaaccagttagatcacaaatgcccgaggagaaactctataaggtctacacgttcaatagcgtaagaaaaagcatgagcaccgtaatcaagctcccagacgagtcttttcggatgtattcaaagggggctagcgagattgtgctcaaaaagtgctgcaaaattctgaacggcgctggcgagccccgagtgttccggccaagagatcgggatgagatggtgaagaaggtcatagaaccgatggcctgtgacggattacgtaccatttgcgtcgcttatcgggacttcccaagcagcccggaaccagactgggataacgaaaatgacatcctaaatgagctcacgtgtatctgtgtggtgggaatcgaagaccccgtgcgccctgaggtcccagaggctatcaggaaatgccagcgcgctgggatcaccgtgaggatggtgaccggcgataacatcaacaccgcgagggcaattgctattaagtgcggaataatacaccccggagaagattttctctgtctggaaggtaaagagtttaacaggcgcatccgtaatgagaagggggagattgagcaggagaggatcgataaaatttggccaaaattaagggtgctggccaggtctagccccacggataaacataccctcgttaagggtatcatcgactctacccatacagagcagcgacaggtggtggccgtgactggggacggcaccaacgatggcccagcgctgaagaaggccgatgtggggtttgccatgggaattgctggaacagatgtggcaaaagaagcgtctgatatcattttgaccgatgataacttctcttcaatcgtaaaggcagtgatgtggggaagaaatgtttatgactcgatctcaaagtttctccagttccagttgaccgtcaatgttgtcgcggtcatcgtcgctttcactggggcatgcatcacccaggacagtcccctaaaagcggtccagatgctctgggttaacctgatcatggatacgttcgctagcctcgcactagcaaccgagccacctactgagacattgttgctgcgtaaaccttacggacgaaataagcccctgataagtaggacaatgatgaaaaacatccttggccatgccgtatatcagctggccttaattttcaccttactgttcgttggagagaaaatgtttcagatcgattctggacgtaacgcaccccttcactctcctccaagcgagcactacacaatcattttcaataccttcgtgatgatgcaactgttcaatgaaatcaatgctaggaaaatccatggtgaacgcaatgtattcgacggtatctttcggaatccaatcttttgcaccatcgtgcttggcactttcgctatccaaattgtcattgtgcagttcgggggaaagcctttttcttgcagtccactacagctggaccagtggatgtggtgcatctttattggtctgggtgaattggtatggggccaggttattgccaccatacccactagtagattaaagttccttaaagaggccggacgccttacccagaaagaggagatcccagaggaggaactgaacgaggacgtggaagagattgaccacgcagaaagagaactgcgccgtggccagatcctttggttccggggattgaacagaatccagactcagattagggtggtgaaagccttcagaagctctctgtatgagggcctcgagaagcctgagtccaggactagtatccataatttcatggcacatccggaattcagaattgaggactcgcaaccccacattcctctcatagacgatacagatcttgaggaggacgcagcgctgaaacaaaactcatccccgccatccagtctcaataagaataactccgctatcgactccggtatcaatcttaccaccgacacctctaagtctgcgacctcaagttctcctggctcacctattcactccctagagacctccctttag

SEQ ID NO: 215175 - DNA, 3663 bp, Artificial Sequence
  Description of Artificial Sequence: Synthetic coding sequence
atgggcgacatggccaactcgagtatcgagttccacccgaaaccccaacaacagcgcgatgtcccacaggccggagggtttggttgcaccctggccgagctgaggactttaatggagttacgaggagccgaggcattgcagaaaattgaagaagcctacggcgacgtctccggactgtgtcggcgtcttaagacaagcccgactgagggcctggcagataataccaacgacttggaaaagcgccgacagatctacggacaaaattttattcctcccaagcagcctaaaacattcctgcagctcgtgtgggaggccctgcaggacgtcaccctaatcatcttagaggtggcggcaattgtctctttaggcctgtccttttacgcccctcctggggaagaatccgaggcttgcgggaatgtaagcgggggagctgaagacgaaggcgaagccgaggccggttggatcgaaggcgctgcaatactgctctcagtgatctgcgttgtgcttgtcacagccttcaacgactggtcaaaggaaaagcagtttcgcggtctgcagagcagaatcgagcaagaacaaaaattcaccgtgatccggaatgggcaactcctccaggtacccgtcgctgccctggttgtgggcgatattgctcaggtgaagtacggtgatctccttcctgccgacggggtgctgatacaggccaacgatctgaagattgatgagagctcactcaccggtgagagtgaccatgtgcgcaaatctgccgataaagatccaatgctgctatccggaacccacgtcatggaagggagcgggaggatggttgttactgcagtgggagtcaatagtcagacaggtataattttcacattattgggggcaggcggagaagaggaggagaagaaggataagaaagggaagcagcaggacggagccatggagtctagccagacaaaggctaagaagcaggatggcgcagtggcaatggagatgcaacctctgaagagcgctgaagggggagagatggaggaacgtgagaaaaaaaaagccaatgcaccaaaaaaagaaaaatctgttctgcagggaaaactgacaaaactcgcggtgcagattgggaaggccggtctagtgatgtctgcaatcacggtgatcattcttgtcttatatttcgtgattgaaactttcgtcgtcgagggcaggacatggcttgctgagtgtacccccgtctacgttcagtacttcgttaaattcttcatcatcggggtgaccgtgttagtggttgctgtgcctgagggccttccccttgcagtgacaatcagcctggcttactccgtcaaaaagatgatgaaggacaacaatcttgtcaggcatctggatgcttgtgagacgatgggcaatgccacagccatctgctcagacaagacagggacactgacgactaaccggatgacagtggtgcagagctatctaggggatacacattacaaggagattccggcaccttcagcgctgacccccaaaatactggatctgctggtgcatgccatttccatcaattcggcctataccactaagatcctgccaccggaaaaagaaggtgcccttccaaggcaggtaggtaataagacagagtgtgctctgctgggcttcgttctcgacttgaagcgcgacttccagccagtgcgcgaacagatccctgaagacaagctgtacaaagtctatacttttaattcggttaggaagtctatgtcaacggtcatccgtatgcctgacggcggtttcaggctcttcagtaagggcgcttcggagatcctgctcaagaaatgcaccaacatacttaattcaaacggagaactgagaggttttaggccgagggatcgtgatgacatggtgcgaaaaatcatagaacccatggcctgtgacgggctgcgaaccatttgtattgcctatagagacttcagcgcaggccaagaaccggactgggataatgaaaacgaagtggtgggcgatcttacctgcattgcagttgtggggatcgaggatccagtccggcctgaggtgccagaagctatccgtaaatgtcagagggccggtatcacagttcgcatggtaacgggagacaatataaacaccgcaagagccatagccgcaaagtgtggaatcatacagccaggtgaagactttctgtgtttggagggcaaggagttcaatcggcgaatacgtaatgaaaagggcgagatcgaacaggagcggctggataaggtatggcccaagctccgcgtgttagcgaggagttcccctacagataaacacaccttggtgaagggcatcatagatagcacaacgggagagcaacggcaagtggtcgccgtgactggcgacggcaccaatgacggcccagcattaaagaaggccgacgtggggttcgctatgggaatcgccggaactgacgttgccaaggaggccagcgatataatactgactgatgacaattttactagcatcgttaaagccgtcatgtggggcagaaacgtatatgattccatctctaaatttctgcagtttcaattgaccgtgaacgtcgtggctgtgatcgtagcctttaccggcgcatgtatcacccaagattcccccttaaaagctgtgcagatgttgtgggtgaacttaattatggatacctttgcttctcttgccctggctaccgaaccacctacagagtccctgctgttaagaaaaccttacggacgtgacaaaccacttatcagtaggaccatgatgaagaacattttggggcacgctgtctatcagttagccatcattttcactctccttttcgtaggtgagctgtttttcgacatagatagtggaagaaatgcccctctccactctcccccatcagagcattacactatcatttttaatacctttgttatgatgcagctgttcaatgaaattaatgccagaaaaattcacggtgagcggaatgtgttcgacgggatcttctccaatcctatattctgtactatagtgctcggcacttttggcatacagattgttattgtccagttcggcggtaaaccattctcttgtagccctttaagcacagaacaatggttgtggtgtttatttgtgggggtgggtgagctggtgtggggacaggtgatagccactattcctacctctcaacttaaatgcctcaaagaggcgggtcacggcccaggaaaagacgagatgacagatgaggaactagcagagggtgaggaagagatcgaccacgccgagcgagaactgcgcagaggtcaaattctgtggttccgaggccttaatcggatacagactcagattagggtggtgaaagctttccggagctcactgtatgagggtctcgagaaacccgagtctaagacctctattcataattttatggccaccccagagtttctcatcaatgattatactcataacatcccacttattgacgatactgacgtagacgaaaacgaagaacgtctgcgggctcctccccctccctcaccaaaccagaataacaatgctattgatagcggtatttaccttaccacacacgttaccaagtccgctaccagctcggttttctcatcatcaccaggatctcctctgcactccgtggagacctcgctgtag

SEQ ID NO: 215176 - DNA, 3663 bp, Artificial Sequence
  Description of Artificial Sequence: Synthetic coding sequence
atgggcgacatggctaatagtagcatagagtttcatcccaagccccagcaacagcgcgatgtcccacaggccggagggtttggttgcaccctggccgagcttcggaccctgatggagttgcggggtgcagaagcgttgcagaagatcgaagaggcctacggcgacgtgtccgggctttgtcggagacttaaaacatcacctaccgaaggcctggccgacaacaccaacgatctggagaaacggcgacaaatatacggtcaaaacttcatcccgcctaagcagcccaaaaccttcctccagttagtctgggaggccctacaggacgtgactctcattattttggaggtggcagccattgtctcccttggtttgtctttctatgcgcctcctggggaagagtcggaggcttgcggcaatgtctctgggggagcagaggatgagggcgaggcggaagctggatggatcgaaggtgcggcaatcctgcttagcgtaatctgcgtcgtgctcgtgacagcctttaacgattggagtaaggagaagcaatttcgaggtctgcaaagcaggatagagcaggaacaaaaatttacagtgataagaaacgggcaactccttcaggtcccggtggccgctttggtggttggggacattgctcaagtaaaatacggcgatctgctgcctgcagatggggtactcatacaggccaatgacctgaaaatcgatgagtcctccttgaccggcgagtcagaccacgttagaaagtctgccgacaaggatccaatgctcctctctggtactcatgtgatggagggatctggtcgtatggtagttaccgccgtcggggttaattctcaaaccggcatcattttcaccctgctgggcgcaggcggagaggaggaggaaaagaaggacaagaaggggaagcagcaggatggcgcaatggaaagctcacaaaccaaggctaagaaacaggacggtgccgtggccatggaaatgcaaccactcaagtccgccgagggcggagagatggaggagagagagaagaaaaaagccaatgcaccgaagaaagaaaaaagcgtacttcagggcaaactcaccaaactggccgtgcaaatcggaaaggctgggctagtgatgtccgcgattactgtgatcatcttggtgctgtatttcgtgatcgaaacatttgtggtggagggacgaacttggttagccgagtgtactccggtgtatgtccaatatttcgtcaagttcttcatcattggcgtgacagtgctggtcgttgccgttcccgaagggctccctctggctgtgaccatcagcctggcctattctgtgaaaaagatgatgaaggacaataaccttgtccgccaccttgacgcctgtgagacaatgggtaacgccaccgccatatgctcggacaagacaggaacattaaccactaataggatgactgtggtgcagtcctacctgggcgacacgcactataaggagatccccgctccctcagccctgaccccgaagatcttggatctcctcgtgcacgccatttctataaattcagcttacactaccaaaattcttcccccagaaaaagagggggcactgccacgacaggtgggcaacaagacggagtgcgccctgctcggattcgtgcttgacctgaaaagggactttcagcccgtcagagagcagattccggaggataagctgtacaaagtctacacgtttaactcagtgcgtaaaagcatgagcactgtgatcagaatgcccgatggtggctttcgcctattttcaaagggcgcatcagagatcctgctgaaaaaatgtacaaacatcctgaattctaacggtgaactgcggggatttaggccacgcgatcgcgatgacatggtgcgcaaaatcattgagccgatggcttgtgatggattgaggaccatttgcatcgcgtacagggacttctctgcgggtcaagaaccagactgggacaatgagaatgaggttgttggagacttgacatgcattgccgttgtaggtatcgaggatcccgtccggcctgaggtccccgaggcgatcagaaagtgtcagcgcgctgggatcaccgtgaggatggttaccggcgacaacattaatactgccagggccattgccgcaaagtgtggaatcatccaaccgggagaggactttctctgtttagagggaaaagaatttaatcggcgtatcaggaacgaaaagggcgaaatcgagcaggaaaggctggacaaagtatggcccaaacttcgcgtgcttgctagaagttccccgacggataagcacactctggttaaaggcattatcgactctaccactggtgagcagcgccaagtagtggcagtaactggtgacggcacgaacgatggacctgccttgaagaaggctgacgtcggttttgcgatgggaatcgcaggaactgatgtcgccaaagaagcaagcgacattattcttaccgacgataatttcacaagtatcgtcaaggctgtaatgtggggtcgcaatgtctacgacagcatctcgaaatttttgcagtttcagctaacagtgaacgtggtagcggttattgtcgcgttcaccggggcatgtatcacccaggattcccctctaaaagccgtgcagatgctgtgggtgaacctgataatggacacgttcgctagtctggctctggcaacagagccacctaccgagtctcttctgctcagaaagccttacggccgtgacaaacccctgattagcagaactatgatgaagaacatcctaggacatgcagtgtaccaactcgctattattttcaccctcctattcgtgggcgagctcttttttgacatagatagtgggcgtaacgcccctctccactccccacctagcgaacactatactattatcttcaataccttcgtgatgatgcagctgttcaatgaaattaatgccaggaaaatccatggagagcggaacgtgtttgacgggatattcagtaatcccatcttttgtacaattgttctaggcaccttcggaatccagatcgtcattgtgcaattcgggggaaagccgttcagttgctcccccctgagcaccgagcaatggctgtggtgcttgttcgtgggggtgggggaacttgtgtgggggcaggttatcgccacaattcctactagtcaactgaaatgtcttaaagaagccggtcatggtcccggtaaggacgagatgacggacgaggagctggccgagggcgaggaggagatcgaccatgctgagagggagctcaggcggggacagatattatggttccggggactgaaccggattcagacgcagatccgagttgtgaaggctttccggtctagtctgtacgaggggctggaaaaacccgagagcaaaaccagcattcataattttatggccacaccggaatttctgatcaatgactatactcacaatattccgttgattgatgataccgacgttgacgaaaatgaggaacgcctgagggcccctccaccgccaagtcctaaccagaataacaatgctattgacagcggcatctacctgacaacacatgtgacaaagtcagccacatcttccgtattttcctctagtcctgggagtcctctacacagtgtggagacctcactctag

SEQ ID NO: 215177 - DNA, 3522 bp, Artificial Sequence
  Description of Artificial Sequence: Synthetic coding sequence
atgggagacatggctaactcatcaatcgagtttcaccccaagccacagcagcagcgagacgtccctcaggcagggggatttgggtgcaccctggcggagttgcgaaccctcatggagctgcgtggggcagaggctctgcaaaagattgaagaggcctacggcgatgttagcgggttgtgcaggcgattaaagacgagcccgacggaggggcttgccgataatacaaacgatcttgaaaagcgaaggcagatttatggtcagaactttattccacctaaacaaccaaaaacattcctccagctggtgtgggaggctcttcaggatgtgactctgatcattcttgaagtcgctgccatcgtctccttgggtttgtctttctatgcccctcctggggaagaaagcgaggcttgcggaaacgtgagcggaggcgctgaggacgagggcgaggcggaggcaggttggattgagggcgctgcaatattgctcagtgtaatttgcgtcgtacttgtgaccgcatttaacgattggtctaaggagaaacagttccgcggacttcaatcaaggattgagcaggaacagaagttcactgtgatcaggaacggccaactgctgcaggttccagtagcagccctggtcgtcggcgacatcgctcaggtgaagtatggagacctgttgcccgctgacggggtgttgattcaggccaatgatctgaaaattgacgaatcctccctgactggagaatccgaccacgtcaggaagtcagcagataaggatcctatgttactgtccggcactcatgtgatggagggcagtggccgtatggtggtcaccgcggtgggggtaaattctcagaccggtattatatttacactcttaggggctggaggcgaggaggaggaaaaaaaggacaagaaagggaagcagcaagatggggcaatggagagcagccaaactaaggctaagaaacaggacggtgcggtcgccatggaaatgcagccactcaaaagcgcagagggtggagagatggaagaaagagagaaaaagaaagctaatgccccaaaaaaagagaaatcggtgctgcagggcaaactgacaaagctggcggttcagattggcaaagcaggcctcgtaatgtccgcaatcaccgtcatcattttagtcctgtactttgtcatcgagacatttgtcgttgaggggcgaacttggctggctgagtgcacccctgtgtatgtccagtactttgtcaaattctttatcataggcgttactgttttggtcgtagcagtaccagagggattacctctggcagtgaccattagcctggcatattctgtcaagaaaatgatgaaggataacaacctagtaagacacttggacgcttgcgagactatgggtaacgcaaccgccatttgctccgacaagacaggcacgcttacaactaatagaatgaccgtcgtgcaatcctatttgggcgacacccactacaaggagattcccgctccatccgccctcacccccaagatcctcgacttactggtccacgctataagcataaattccgcctacactaccaaaatccttccgcctgaaaaagaaggggctctccccaggcaggtgggcaacaagactgaatgcgccctgctaggcttcgtactggatctgaaaagggattttcagcccgtgcgcgagcagattcctgaggacaagctctacaaggtgtacaccttcaacagcgtccgaaagtccatgtctacggtaatccgcatgcctgatggcggatttcgactgttctctaaaggcgcatcggaaatactactgaagaagtgtaccaatatcctcaactccaatggtgaattaagaggtttccggcctcgggatcgggatgacatggtccgcaagattatcgaacccatggcatgcgacggcttgcgcacaatttgcatagcctaccgcgatttttcagctggtcaagaacctgactgggataacgaaaacgaagtcgtcggagacttgacttgtatcgcggtagttggcattgaagatccggtccgcccagaagtccccgaagctatcaggaagtgccagcgcgctggaatcaccgtgcggatggtcacgggagataacattaatactgccagagccatcgcagctaaatgcgggattattcaacctggcgaggacttcctgtgtctcgagggcaaggagttcaataggcgtatccggaatgagaagggtgaaatagagcaggagcggctcgataaggtgtggcctaaactccgggttctggctaggagttctcctaccgacaagcatactctcgtgaaggggatcattgactctaccactggcgagcagcgccaggtggtggcagtaacaggggacggtaccaacgatggacccgcactgaaaaaggccgatgttgggtttgccatgggaatcgcaggcaccgacgttgctaaggaagcatcggatattatcctcaccgatgacaattttacgtctatcgtgaaagcagtcatgtggggtcgcaacgtctacgactcaatcagcaaatttctccagtttcagttgactgtcaacgttgtggccgtgatcgtggcttttactggcgcttgcattacacaggatagcccactaaaggcagtccagatgctttgggttaacctaattatggacaccttcgcatccctggcactcgccactgagccaccgaccgagtctttattattgcgtaagccttatgggcgagataagccactgatctccaggacaatgatgaaaaacattcttggccacgctgtttatcagcttgccattattttcaccttgctattcgtgggggagctgttctttgatattgactcagggagaaatgcccctctgcattcccctccatccgaacactataccattatttttaacaccttcgtgatgatgcagctcttcaatgaaattaatgcgaggaagatacacggtgaaagaaacgtgttcgacggaattttcagtaatcccattttttgtaccatcgtgcttgggacgtttggcatccagatcgtgatcgttcagttcggcggtaaacctttcagctgcagccctctgtctaccgagcaatggctctggtgtctctttgtgggagttggagagctggtgtggggtcaggtgatagcaaccatccctacaagccaactaaagtgtctaaaagaggctggccacggcccaggtaaagacgagatgactgacgaggaactcgccgagggagaggaggaaattgatcacgcagagagagaactacggaggggacagattctgtggttcaggggcctgaataggattcagacgcaaatggaagtggtctccaccttcaaaagatcgggcagcgtccagggggcagtgcgtagaagatctagcgtactgagccagttgcatgatgtgaccaacctgtctacgcccacccacgctatcctcagcgccgctaatcccacgagcgccgcaggaaatcccggaggcgaatccgtaccttag

SEQ ID NO: 215178 - DNA, 3480 bp, Artificial Sequence
  Description of Artificial Sequence: Synthetic coding sequence
atgggggatatggccaacagctcaatcgaatttcaccctaaacctcagcaacagagagatgtgcctcaagccggtggattcgggtgcacactcgctgaactgcgaactctgatggaactaaggggagctgaagctttgcagaaaatcgaagaagcatacggtgacgtgtctggtttgtgtcggagactgaagactagtccaaccgagggtctcgccgacaacacaaatgacttagaaaagagacggcaaatctacggtcagaactttattcctcccaagcaacctaaaactttcttgcaactcgtgtgggaggctctgcaggatgtgacgttgatcattctggaggtcgcagccattgtgagcctggggttaagtttctatgcccctcctggcgaagagtctgaagcttgcggtaacgtctccggtggcgctgaagacgagggcgaggcagaggctggatggattgagggcgctgccatcctgttatcagttatttgtgtggtactcgtcacagcatttaacgactggagcaaggagaagcagttccgtggattgcagagtcgcatcgagcaagagcagaagttcaccgtcataaggaacggacaactcctgcaggtgcccgtggcagcactggtggttggtgacattgcacaggttaagtacggtgacctgcttccggctgatggcgtcttaatccaagcaaacgatctgaagattgatgagtcgagtttgacaggagagagtgaccacgtgcgcaaaagcgccgataaagatcctatgctcctctctggaacccacgtgatggaaggctcaggcaggatggtcgttaccgctgttggcgtcaactcacagacaggaattattttcaccttactgggcgcagggggtgaggaggaggagaagaaggataaaaaggcaaagaagcaggacggtgctgtcgcaatggaaatgcagcctctgaaatcagccgaaggaggggaaatggaagagcgggagaagaaaaaagctaacgcacccaaaaaggaaaaatccgtccttcagggaaagcttactaagctggccgtacaaattggcaaggccggattggtcatgagtgcaattacagtgattatcctggtgctgtactttgtcatcgaaacatttgttgttgaagggaggacatggctcgctgaatgtacgccagtgtatgtgcagtacttcgtgaagttcttcattatcggggtcaccgtcctagtcgtggctgtgccagaagggctgcctctggctgtcactatctccttggcctattctgtgaaaaagatgatgaaagacaataacctggtaaggcatcttgacgcatgtgaaactatgggcaacgcgacagcaatctgttccgataagacaggcacactgactacgaacagaatgacagtcgtgcagtcatacctgggcgacacacactataaagagattccagccccatctgcccttacgcccaaaatcttggatctcctggtccacgccattagtataaatagcgcctacactaccaagatccttccgcctgaaaaggaaggcgcactaccccgtcaggttgggaacaaaaccgaatgtgccctgctggggtttgttttggacttgaaaagagactttcagcctgttcgagaacaaatcccagaagacaagctgtacaaagtgtataccttcaactctgtgcgcaagtccatgtcaaccgttatccgcatgccagacggcggattcagactgttcagcaagggggcatctgagattttgcttaagaagtgtacaaacatcttaaactcaaacggggagctgcgtggattcagaccccgagatagagatgacatggtaaggaaaattattgagccgatggcctgtgacgggttacgaacgatctgtatagcctaccgggatttttcagcgggacaggagcctgattgggacaatgaaaacgaggtggtcggggacctgacatgcattgcggtggtgggcatcgaagaccccgttcggcctgaggtaccggaggctatccggaaatgtcagagggcaggtattacggtcagaatggtaacaggagataatatcaacactgcacgcgctattgctgccaagtgtggtattatccagcctggcgaggactttctctgtctagagggcaaagagttcaaccgccgaatccgcaacgagaagggggaaattgagcaggaacgcttggacaaagtgtggcctaaactgagggtactggccaggagcagtcctactgacaagcataccctagtgaagggcataattgattctactacaggagaacaacgtcaagtggtggctgtgaccggggatgggaccaacgatggccctgctctgaagaaggctgatgtgggatttgccatgggcattgccggaactgatgtagcaaaggaagccagtgacattattctcacagatgacaacttcacttcaattgtgaaagctgtaatgtggggcaggaacgtgtatgactctattagtaaatttctccagtttcagctaactgtcaatgtggtagccgtgatcgtggccttcacaggcgcatgtatcacccaggattccccgcttaaggcggtgcagatgctgtgggtgaacctcatcatggacacctttgcctccctggcactcgcaacagagccgcctacggagtcgttactgcttaggaaaccatacggcagagacaagccattgatttctaggaccatgatgaagaatatcttgggacacgctgtttaccaattagcgattattttcacactcttgttcgtgggagaactgttcttcgacatagatagcggacgcaacgcccctctgcactctcctccatcagagcattatacaatcatcttcaacacatttgtgatgatgcaactgttcaacgaaatcaacgcgcgaaagattcatggtgaacggaatgtgttcgatggcattttttctaatcccatcttctgtaccatagtgctgggcacctttggcatccagattgtcattgtgcagttcggaggcaaacccttctcttgcagccctttgtctaccgaacagtggttgtggtgtctgtttgtgggggtgggcgaactggtatgggggcaagtgattgctactatcccaacctcgcagttaaagtgcctgaaggaagctggccacggtccgggaaaggatgagatgactgacgaggaactcgcagagggggaagaagagatcgaccatgcagagagggaattgcgcagagggcagatattgtggttccgcggactcaatcggatccaaacccagatggaggtagtgtcaacgtttaagaggtcagggagcgtacagggggctgtgcggagacggagcagtgtccttagtcaactgcacgatgtcactaacctgagtacccctacccacgcaattttatcagcggcaaaccctacttccgcagcagggaaccccggtggggaatccgtgccttag

SEQ ID NO: 215179 - DNA, 3480 bp, Artificial Sequence
  Description of Artificial Sequence: Synthetic coding sequence
atgggagacatggcaaattcctctatcgagtttcatccgaaacctcagcagcagcgcgatgtgccacaagctgggggatttggttgtaccctggccgagcttcggacattgatggaactgcgcggagccgaagcgcttcaaaaaattgaggaagcctacggagatgtttccggactatgccgtaggctaaaaactagtccgacagaggggttggctgataatacaaacgacctggaaaagcgacgacaaatttacggccaaaacttcatacctccgaaacagcccaagacctttctgcagctggtgtgggaagccctacaggacgtaacattaatcatccttgaagtggcagccattgtctcacttggactgtccttttatgccccacccggagaggagtctgaggcgtgcggcaatgtctctggaggagccgaagatgagggggaagctgaggccggttggatcgagggcgcagcaatcctgctgagcgtgatctgcgtagtgctagtgaccgctttcaacgactggtctaaagagaaacaatttcgaggcctgcagagccgcattgagcaggagcagaaattcaccgtgattcgcaacggacaactgctacaggtgccagtcgcagcattagttgtgggcgacatcgcacaggtgaaatacggcgacctgctgcccgcagacggggtgttaattcaggcgaacgatctcaagatcgacgaaagctctctcaccggcgagtctgatcacgtcagaaagtctgccgataaagaccctatgttgctctcgggaactcatgttatggaagggtcaggacggatggttgttactgcggtcggcgtcaactcacagactggaataatatttactctcttgggcgctggaggggaggaagaagaaaagaaggacaagaaggctaagaagcaagatggcgcagttgctatggaaatgcagccgctgaaaagtgcagaaggtggggagatggaagagagggagaagaagaaagctaacgctcctaagaaagaaaaaagcgttctgcaaggtaagttaaccaagctcgccgtgcagattggaaaagcgggtttagtcatgtcagccattaccgtgataatattagtcctctatttcgtcatcgagacatttgtggtggaagggcgtacttggctggctgaatgcacacccgtctacgttcagtatttcgtcaaattctttattatcggagtcactgtgctcgtagtggctgtgcccgagggtttgccactggcagtcaccatctccttggcatatagtgtgaagaagatgatgaaggacaacaacctggtgagacatctggacgcgtgtgagactatgggtaacgccactgcaatctgctcagacaaaacaggtactctgacgacaaataggatgaccgtggtgcagtcctaccttggcgacacccattataaagaaattccagctcccagtgcgctgacacctaagattttggacctgctggtgcacgccatcagcattaatagcgcctataccactaagatcttaccacctgagaaagaaggagccctgccgcgtcaggtcggaaacaaaaccgagtgtgctctgttaggcttcgtgttagacctgaagcgggatttccagccagttcgagaacaaattcccgaagataagctctataaagtctacacattcaatagtgttagaaaatcgatgtcgaccgtcattcgaatgcccgacggcggtttcagactcttcagcaagggcgctagtgaaatcttgttaaaaaagtgtaccaacattctcaactccaacggtgaactgcgcggattcaggcctagggacagggatgacatggtcaggaaaattattgaaccaatggcgtgtgatggcctgaggactatttgcattgcttatagagattttagtgctggacaggagccagactgggataacgagaatgaagtggtaggtgacttgacgtgcatagcagtggtcggaatcgaggatcccgtgagacccgaggtccccgaagccattcgaaagtgccagcgagctggcatcacagtgcgcatggttaccggcgataacataaacactgcaagggccatagccgctaagtgtggcattatccagcccggagaggatttcctgtgccttgaaggcaaagagttcaaccgaagaatcaggaacgaaaaaggagaaatcgagcaggagcggctggacaaggtgtggccgaaactcagggttttagcaaggtccagcccaaccgacaagcataccttagtcaaaggcatcatcgactccacaacgggagaacagcgccaggtggtggctgtgaccggcgatggcaccaacgacggaccagcattaaaaaaggcagatgtgggctttgccatgggaatagccggaaccgatgtggccaaggaggccagtgacattattttgacagacgacaacttcacatccatcgtgaaggcagtcatgtggggaagaaacgtgtacgactcaatttccaagttcttgcaatttcagcttactgtcaacgtcgtggcagtcattgtcgcatttacgggagcttgcatcacccaagattctcctttaaaggccgtccaaatgctttgggtaaatctcattatggatactttcgcaagtttggccctggcaacagagcctcctaccgagagtttgcttctcaggaaaccatacggacgcgataaaccgctgataagccgaaccatgatgaaaaatattctggggcatgccgtctaccagctcgccatcatcttcacccttctgtttgtgggcgagctcttctttgatatcgactcaggcaggaacgctccactgcactctccgcctagcgaacactacaccatcatatttaatacgtttgtgatgatgcagctatttaacgagattaatgccaggaagatacatggagagcggaatgtgttcgatggtatcttcagcaaccccattttttgcactatagtactgggcaccttcggtatacagatcgtgatcgtgcagtttggcggtaagccttttagttgctctccgttatccactgagcagtggctgtggtgcctgttcgtcggagttggtgagcttgtgtggggccaggtgatagctaccatacctacatcccaacttaagtgtctcaaggaagctggccacggtccaggcaaagatgagatgacggatgaggagttggcagagggtgaagaggaaatcgaccacgcggaacgggaattgagaagaggtcagatcttatggtttagaggtttgaacagaattcagacacagatggaagtagtctccacattcaagagaagcggtagcgttcagggagccgtccggagaaggtcctctgtgctctctcaattacacgatgtgacaaatctgtcgacccccacacacgccattctgagcgctgctaatccaacgagcgcagccggaaatcctgggggagagagcgtcccctag

SEQ ID NO: 215180 - DNA, 3465 bp, Artificial Sequence
  Description of Artificial Sequence: Synthetic coding sequence
atgggagatatggccaattcctccattgagtttcacccaaaaccgcagcagcagagagacgtgccccaggcgggaggcttcggatgtactctggccgagttacgcacactgatggaactgagaggcgcagaggcgctccagaagatcgaggaagcctacggagacgtgagcggcttgtgccggagactgaaaacctctccaactgaaggacttgccgacaataccaatgacctcgagaagaggaggcagatctatgggcagaactttataccacccaagcaacccaagaccttcctccagttggtgtgggaggcccttcaggacgttacactgatcatcctggaggtggccgctatcgtgtctctggggttatctttctacgcaccgcctggcgaggaatctgaagcttgtggcaacgtcagcggaggggctgaggacgagggggaggcagaagcaggctggatcgagggtgccgcaatcctcttgtcagtcatttgcgtggttctggtgaccgcatttaatgactggtcaaaggagaaacaatttcggggtttgcaatcacggatcgaacaagagcagaaatttactgtaattaggaatggccagctgctgcaagtccctgtggctgcactggtcgtcggtgacatcgcgcaagtgaaatacggagatctgctgcccgctgatggtgtgctgattcaggcaaatgacctaaaaatcgacgagtcaagcctgacaggagaaagcgaccacgtgagaaaatccgcagataaggacccaatgctgctctccggtacccatgtgatggagggcagtgggagaatggttgtcacagctgttggtgtgaattcccagaccgggatcatcttcaccctgctgggcgcaggtggggaggaagaggaaaagaaagacaagaaagctaaaaagcaggacggcgcagtggctatggagatgcaacctctaaaatccgccgaaggcggagaaatggaggagcgtgaaaaaaaaaaggcgaatgctccaaagaaagagaagtcggtacttcaggggaagttgaccaagctcgctgtccagataggtaaggccggacttgtgatgtctgctatcactgtgattattcttgtgctctacttcgtaatagagaccttcgtagtggaaggtaggacatggcttgcagagtgtacccccgtctacgtgcagtatttcgtgaaattcttcatcattggagtgacagtgctggtggtggccgtgccggaggggttgcctctggccgtgactatcagtctcgcttacagcgtgaaaaagatgatgaaagataataatttagtgagacatctagatgcctgtgaaactatgggtaatgccaccgctatatgctccgacaagactgggacgcttacaacaaacagaatgactgtagtccagagttacctgggggatacacactacaaagagattcccgcaccaagcgcccttactcctaagatcttggatttgcttgtccacgcgatctcaataaactcagcctacacaaccaagatactcccacccgagaaggagggagccctgccacgtcaggttggaaacaagaccgaatgtgcactactgggctttgtgctagacctgaagcgagatttccagccagttagagaacagatccctgaggacaagctatataaggtctatacttttaactcagtgaggaagtccatgtccacagtcatccggatgccagatgggggttttaggctgttcagcaagggagccagcgaaatactcctgaagaagtgcacaaatattctgaattccaatggtgaacttcggggattccgccctcgagaccgggatgacatggtgaggaaaatcattgagcccatggcgtgcgatggacttcgaacaatatgtatcgcctatcgagatttttccgctggccaagagccagactgggacaatgaaaacgaggtagtcggagacctcacgtgtattgcggttgtgggtatcgaagacccagtaagacccgaggtacccgaagcaatccgcaaatgtcagcgagctgggataacggtgcgaatggtgaccggtgacaatattaacacagcacgggcaatcgcggctaagtgtggaattattcagcctggagaagatttcctgtgcttggaaggcaaagagtttaatcgacgcatccgcaatgagaagggcgaaatcgaacaagagagactggacaaggtgtggcccaagcttcgcgtgctggcccgttcatccccgaccgataagcacacgctggtcaaaggcattattgacagtactacaggcgaacagcggcaggtcgtagccgtgacgggcgacgggaccaatgacgggccagctttgaagaaggccgacgttgggtttgccatgggcattgctgggacagatgtagcaaaggaagctagtgatattatactcacagatgataattttactagtattgtcaaggcagtgatgtggggtcgtaacgtgtacgactctatcagcaaatttctacagttccaactgacagtcaacgtcgtggccgtgattgtagctttcactggcgcttgcattacccaggatagccccctgaaagcagtccagatgttgtgggttaatctcatcatggatacattcgcttctcttgcactggctactgagcctcccaccgaatccctgttgcttcgcaaaccctatggacgcgacaagccacttatcagccgcacaatgatgaagaacattctaggtcatgctgtgtaccagctggcaattatattcactctgctcttcgtgggcgagttatttttcgacatcgatagcggcagaaatgccccactccactccccaccctctgagcactacacaataatcttcaacacgttcgtgatgatgcaactctttaacgagattaacgcacgcaaaatacatggtgagaggaacgtgttcgacggcatcttttctaaccccatcttttgtaccatcgtgctcggcacattcggaattcagattgtaatcgtgcaattcggtgggaaaccattcagttgttctccgcttagcactgagcagtggctgtggtgccttttcgttggtgtcggtgagctggtttggggccaggtgatagcaactattccaacctcccagctgaagtgcctcaaagaagcaggccacggcccagggaaggatgaaatgacggacgaagaactggcagaaggcgaggaggagatcgaccacgctgagagggagctgagaaggggtcaaatcttgtggttccgaggattaaatcgaatccagacacagatggaggtggtttctacttttaagcggagtgggtccgtccagggagcagtacggagacggagttccgtgctatcgcagttgcacgatgttacgaacctttctacacctactcacgccatcctgtctgctgccaatcccaccagcgccgctggcagcgagtcttag

SEQ ID NO: 215181 - DNA, 3513 bp, Artificial Sequence
  Description of Artificial Sequence: Synthetic coding sequence
atgactaacccatcggatagagtcctccccgctaattccatggctgagtccagagagggggattttggttgcaccgtgatggaactcagaaagctcatggagctaaggagcagagatgccttgacacaaattaatgtgcactacggcggtgtgcagaatctatgctcccgtctcaagacgagccctgtcgaagggctgtctggcaatcctgcagacttggaaaagaggcgccaggtattcggacacaatgtgattcccccaaagaagcccaaaacttttctagagctggtctgggaggcactgcaagacgtcacattaattattctagaaattgctgccattatctcactggtcctgtctttttataggccagccggtgaagagaacgaactgtgtgggcaggttgccactactcccgaggacgaaaatgaggcccaagcaggttggatcgagggagcagccatcttatttagcgtcattatcgttgtcttggtgacagctttcaacgattggtccaaggagaaacagttcaggggactgcagtgccggatagaacaagagcaaaagttctctattattcggaacggccagctgatccagctgcctgtggccgaaattgtggtcggcgatatcgctcaggttaagtacggagaccttctccccgctgatggaatactgatccagggcaacgaccttaagatagatgagtcatcactaaccggagaaagtgatcacgttaagaaaagccttgacaaagatcctatgttgctgtctggaactcatgtcatggagggctccggccgaatggtagtgactgccgtgggagtgaactcccagacaggcatcatcctgactctactgggtgtgaacgaggatgacgaaggcgaaaagaagaaaaaggggaagaagcagggggttcccgagaataggaataaggcaaaaacgcaagacggtgttgcgctggagattcaacctctcaattctcaggaaggcattgacaatgaggagaaagataaaaaggccgtgaaagtccctaaaaaagagaagtccgtgttgcagggaaagctgacacgactggcagtccagattggcaaagccggtttgttaatgtccgctcttactgtgttcattctgatcttgtacttcgtcatcgataatttcgtgattaatcgacgcccttggctgcctgaatgcacccctatctatatccagtattttgtaaagttttttattataggaattaccgtgctggtcgtagctgtccccgaaggccttcccctggcagtcaccatctcactcgcctactccgtaaaaaaaatgatgaaagacaacaacctggtgagacaccttgatgcttgtgaaacaatgggaaacgcaaccgccatttgctctgacaagactggtacattgaccatgaacagaatgaccgtggttcaggcctacatcggcggtattcattacagacagatcccctcccccgatgtttttctccccaaggtgttggacctgatagtgaacggaatctctatcaacagcgcctatacctctaaaatactgccgccagagaaggaagggggactgcccagacaggtgggaaataaaacagagtgcgccctgctgggctttgtgaccgacctgaagcaggattaccaggccgtgcggaacgaagttcccgaggaaaaactgtacaaagtgtacacattcaacagtgtgcgcaagtcgatgtccactgtgatcagaaatccaaatgggggattcagaatgtactcaaaaggtgccagcgaaataatactgcggaagtgcaacagaattctggaccgcaaaggggaagccgtgcccttcaagaataaagacagggacgatatggtgcgcactgttatcgaaccaatggcatgcgacggcctacgcactatatgcatagcctaccgggacttcgacgataccgagccatcttgggacaatgaaaatgaaatcctcacggagctgacgtgcattgccgtcgtgggcatcgaggatcccgttcgaccggaggtccctgacgccatcgctaagtgtaagcaggctggtattaccgtgagaatggtgacaggcgataatatcaatacggccagggccattgccactaaatgcggcattcttacccccggagacgattttctgtgtctcgagggtaaagagttcaaccgactgatcagaaacgagaagggcgaggtggagcaggagaaactggacaagatctggccaaaactcagagtgttggctagaagttctccaaccgataaacatactctggttaagggcattattgacagtacagtaggggagcaccggcaagttgtcgccgtaacaggcgatggtacaaacgacggccctgccctgaaaaaggcagacgttggcttcgctatggggatcgccggaactgacgtggcaaaggaagcatccgacatcattctgaccgacgataacttcacttcaattgtcaaggccgtgatgtgggggagaaacgtgtatgactctatcagtaaatttctccagtttcagctgactgtgaacgtcgtggctgtgatcgtcgcatttaccggtgcctgtatcacacaagactcccccctgaaggctgttcagatgctctgggtgaatctgattatggacacctttgcctccctggccctggcaactgagcccccaacagagagcctgctcaagcgacgcccttatgggcgaaataagccactgatctctaggactatgatgaagaatattctcgggcatgcattttaccagctcatcgttatttttatcctggtgtttgcaggcgagaaattcttcgacattgattccggcaggaaggcaccactgcactctcccccatcacagcactacactattgtcttcaatacatttgtgctaatgcagctttttaatgagattaatagtaggaaaatccacggtgagaagaatgtcttctccggcatataccgcaacataattttctgctctgtggtgctggggacgtttatttgtcagatctttattgtggaatttgggggtaaacctttctcctgtacttcactgagtctgagccagtggctctggtgcctgtttattggcatcggagaattgctctgggggcagttcatctcagcgattccaaccagaagcctcaaattcctgaaagaagccggtcatggcactacaaaggaagaaattactaaggatgctgagggcctggatgagatcgaccatgcagaaatggagctgagacggggacagattttgtggttccgcggactaaaccgaattcagacccagatcgatgtaatcaacacatttcagaccggcgcttctttcaagggcgtgttgcggcgtcaaaatatgggccagcacctggatgtcaaactcgtcccatcctccagttacgtggcggttgcccctgtgaaatctagccctactacttcagtgccagccgtttcgtcgcctcccatgggcaaccaaagcggacaaagtgtgccatag

SEQ ID NO: 215182 - DNA, 390 bp, Artificial Sequence
  Description of Artificial Sequence: Synthetic coding sequence
tgaattggggagctcctctgggggcagttcatatcagccattcccacacgctctctgaagtttctcaaagaggccggacacggcaccacgaaggaggaaattaccaaggacgctgagggactggatgagattgatcatgcggaaatggaactgcgcagggggcagatcctgtggttcagaggtctgaatagaattcaaactcagatcgatgtaatcaatacattccagactggagcctcattcaaaggcgttctacgcagacagaacatgggccagcacctggatgtcaaattggtcccttcgtcgtcttatgtggccgttgctcccgtgaaatcctcaccaacaactagcgttcccgcagtgtcctctccacctatgggctccgaatag

SEQ ID NO: 215183 - DNA, 3618 bp, Artificial Sequence
  Description of Artificial Sequence: Synthetic coding sequence
atgaccaatccctctgacagggtactgcccgcaaacagcatggccgaatcgcgggaaggcgactttggatgtactgtcatggagctcaggaaactcatggaactgcgctccagggacgccctcacccagattaacgtgcactacgggggagtccagaacctttgcagccgtctgaagaccagccccgtagaagggctatcagggaacccagcagatttagagaagcggaggcaagtttttgggcataacgtgatcccaccaaagaaaccaaagacgttcctggagttggtgtgggaggccctacaggacgtcacgctcataatcttagagattgccgctatcatcagcctcgtcctctccttctatagacccgctggggaggaaaatgagctctgcgggcaggtggctaccacaccagaagacgagaacgaggcccaagctggctggattgagggtgccgctatcttgttttccgttataattgtcgttttggtgaccgccttcaacgactggagcaaagagaagcagtttcggggactccagtgtaggattgagcaggagcaaaagttttcaattatccggaatgggcagttgattcagctgcccgtggctgaaatcgtcgttggcgatatcgcccaggtgaagtatggagatctgcttcccgctgatggaatcctgatccaggggaacgatcttaaaattgacgagagtagcctgaccggagagagcgatcatgttaaaaaatccctagataaggatcctatgctattgtcgggaacgcacgtgatggaggggagcggcagaatggtggtgacagcagtgggtgtcaactcccagaccgggatcatactcaccctgctaggagttaatgaggatgacgaaggtgaaaagaagaagaagggtaagaaacagggggtgcctgagaataggaacaaagccaaaacacaggatggagtcgctctggaaatccagccccttaatagccaggaggggattgataacgaggaaaaagacaagaaggcagtgaaagtcccaaagaaggaaaagtcagtcctacaagggaagctgacccgcctggccgtacagatcgggaaggccggacttttaatgtcagcactgactgtcttcattctgattctgtactttgttatagataacttcgtcatcaaccggagaccctggctgccagagtgcacgcccatctacatccagtatttcgtgaaatttttcattattggaattactgtcctggttgtggccgtgccagagggcctccctttggccgtgaccatctccctggcttattctgtaaagaagatgatgaaggacaacaacctggtgcggcacctggacgcttgtgaaactatgggcaatgcaactgcaatttgttctgataagacgggaaccttaactatgaaccgaatgacagtagtgcaagcctatataggcggaattcactaccgacagatccccagtcccgacgtctttctccccaaagtgcttgacctcattgtcaatggaatctcaatcaactcagcttatacatctaaaatcctgccacccgaaaaagaaggcggactgcctagacaggtaggtaataagactgaatgcgcgctcctgggttttgttacggatttaaaacaagactatcaggctgttcgcaacgaggtgcccgaggagaagctgtataaggtttacaccttcaacagtgtacgtaaaagtatgagcacagtgatccgcaaccccaatggcggatttcggatgtattccaaaggcgctagtgaaattatcctccgtaagtgtaatcgcattctggatcgtaagggagaagccgtcccttttaagaacaaagaccgcgacgacatggttagaacagtgattgaaccaatggcctgcgatgggctccgcaccatttgcattgcctatagagactttgacgacactgaaccatcctgggacaacgaaaacgagatcctaaccgagttgacatgcattgcggtggtgggtatagaagacccagtaaggccagaagtgcctgacgccattgccaagtgcaaacaagctggcattaccgtccgcatggttaccggggacaacataaataccgcacgggctatagccacgaagtgtggcattctcaccccaggggacgatttcctgtgccttgaaggcaaggagtttaatcgtttaatacgtaacgagaagggtgaggtggaacaggagaaacttgacaaaatttggcctaagctgcgcgtgctggccagatcttccccaacagacaaacatacacttgttaagggtatcattgatagtactgtgggcgagcatcggcaggtggtcgccgtgaccggtgacggtacaaatgacgggcctgctctgaagaaagctgacgtgggtttcgccatggggatcgcagggaccgatgttgccaaagaagccagcgatattattctgactgatgataatttcacttctatagtgaaggcagtgatgtggggacgaaacgtatatgattcaatttctaagtttctgcagtttcagcttactgtgaatgttgttgctgtcatagttgcgtttacaggagcttgtatcactcaggattccccactgaaagccgttcagatgttgtgggttaacttgattatggacacttttgcctcactcgcccttgccacagagccaccaaccgaaagtctgctgaaacgacggccatacggcagaaacaagcccctgatctctaggactatgatgaagaatattttgggccatgccttttatcagctgatagtaatcttcattctcgtgttcgcgggtgagaaattcttcgatatcgacagcggtagaaaggctcccctacatagcccaccgtcacagcactacactatcgtttttaacacgtttgtcctgatgcagttattcaacgaaatcaattctagaaagatccacggtgaaaagaacgttttctctggcatttatcgcaacataatattttgcagcgtcgttttgggaacctttatctgtcagatctttattgtggagttcggcggaaaacctttttcgtgcacctccttaagcctgagtcagtggttgtggtgtctattcatcggcatcggggaactactttggggtcagtttatcagcgcgatccctactagatccttaaagtttctcaaagaggccggacatggaacgaccaaggaagagatcaccaaggatgccgaggggctggatgagattgaccatgctgaaatggaacttcggcgaggacagatcctttggtttagaggcctcaataggattcagacccagatcaaagttgttaaagcctttcactctagtttgcacgagtccattcagaaaccttacaaccagaaaagcatccactcttttatgacccaccctgagtttgcaatcgaggaggaactgccgagaactccgctcctggacgaagaggaggaggaaaaccctgacaaggcctccaagttcggtaccagggtactcctgctcgacggcgaggtgactccttatgcgaacaccaacaacaatgcagtggactgcaaccaggtgcagctcccacagagtgacagttctttgcagtcactcgagactagtgtgtag

SEQ ID NO: 215184 - DNA, 3513 bp, Artificial Sequence
  Description of Artificial Sequence: Synthetic coding sequence
atgacaaacccatctgatagagtgctgccagctaattcaatggccgaatctagagaaggggacttcggatgcactgtgatggagctgcggaagctcatggaacttaggtcacgggacgccctgacacagatcaatgtgcactatggcggtgtccaaaacttatgcagtcgactaaaaacatcgccggtggaaggtctgagtgggaaccccgcagacctggaaaaacggaggcaggtgtttgggcataacgtgattcctcccaagaagcccaagacatttcttgagttggtatgggaggccctgcaggatgtaaccctcataatcctagagattgcagcaatcatctcacttgtccttagcttctatcgcccagcgggagaggaaaatgaactgtgtggccaggttgccaccacacctgaggacgagaatgaagcccaagcaggctggatcgaaggcgctgctatcctgtttagtgtaattatagtagtcctagtgaccgccttcaatgattggtctaaggaaaaacagtttaggggactgcagtgtcgaatagaacaggagcagaaattctctatcattcgaaatgggcaattgatccagctccccgtcgcagaaatcgtcgttggtgatatcgcccaggtgaagtacggcgacctcctgccagctgatggaattctaatacagggaaacgacctgaagattgacgaaagctcccttactggcgaaagcgatcacgtgaagaagtccttggacaaagatccgatgctgttaagcgggacacatgtgatggagggctcaggaagaatggtcgtcacagccgtcggggtaaactcccagacaggcatcatattgaccctgctgggcgtcaacgaggacgacgaaggtgaaaagaaaaaaaagggcaagaaacaaggcgtgcctgagaatagaaataaggctaagacgcaggacggtgtcgcgctcgaaatacaacccctgaattcccaggaaggcatcgacaatgaagagaaggataagaaggcggtcaaggtacctaaaaaagagaaatcagtactgcaaggcaagctgactagactggctgtacagatcggcaaagccggactactaatgtcagcactcaccgtcttcatactgattctctacttcgtgatcgataattttgttatcaatagacgtccatggctccccgaatgtacccctatctacatacagtatttcgtgaaattcttcatcatcgggatcacggtcctggttgtggctgtgcctgagggacttccactcgcagtgaccataagcctggcatacagtgtaaaaaaaatgatgaaagataacaacctcgtccgccatctggatgcgtgcgaaacaatgggcaatgcaactgccatctgttctgacaagactgggacactgaccatgaatcggatgaccgtagttcaagcgtatatcggcggaattcactacagacaaatcccatcacccgatgttttcctccccaaagtgttagacctgatagtgaacggaatctcgatcaattcagcgtatacatcaaaaatcctgccacctgagaaagaaggcggtctgcctagacaggtgggcaataaaactgagtgtgcgttgctcggatttgttacggaccttaagcaagactaccaggccgtgagaaatgaagttcccgaggagaagctgtataaggtttatacattcaattcggtaagaaaaagtatgtccactgtgataaggaatcccaacggaggattccggatgtactctaagggtgcctccgagattatcctcagaaagtgcaaccggatcctggaccggaaaggggaagcagtcccattcaagaataaagaccgggatgatatggtgcgtacagttattgagcccatggcttgtgatggccttaggacaatctgcatagcatacagagattttgatgatactgaacccagctgggacaatgaaaatgagattctaacggagctcacctgcatcgcagtggtgggcattgaggatcccgtgcgtcccgaagtacctgacgcgattgccaaatgtaagcaggccggaatcaccgttaggatggtgaccggggataacatcaacacagcacgtgccatagcaaccaagtgtggcattttgaccccaggcgacgatttcctatgtctggaaggcaaggagttcaaccggctgatcagaaacgagaagggcgaagtcgaacaggagaagctagataaaatctggcccaagctccgggttctggccagaagttccccaacagacaagcacacattggtcaagggaattattgacagcactgtgggcgaacatcggcaggtcgtagcggtgaccggcgacgggaccaacgatggacccgcacttaagaaggccgacgtcggctttgcaatgggaattgcaggcaccgatgtggccaaagaagctagcgacattatcctgactgatgacaacttcacttcgattgtcaaggctgttatgtggggtcggaacgtatatgatagcattagcaagttccttcagttccaattgaccgtgaacgtggtggccgttattgtggcattcactggcgcatgcattacccaggattcacccctgaaagccgtgcagatgttgtgggtgaacttgatcatggacaccttcgcaagccttgccctggccaccgagccccctaccgagtccctcttaaaacgcaggccttacggcagaaacaagccgctgatatcccggactatgatgaaaaatatactggggcatgcgttttatcagctgatcgtgatttttattctggtgtttgccggagaaaagttctttgatatcgatagtgggagaaaggcccctctgcactcccccccaagtcaacattatactatagtgttcaatacatttgtgcttatgcagttgttcaatgaaataaattctaggaagatacatggagagaaaaacgtgttctcaggtatatatcggaacatcatattttgtagtgtcgtcttgggtacatttatctgtcagatattcatcgttgagtttggtggcaagcccttctcttgcacttccttgtctttgagtcagtggttatggtgcctatttatcgggatcggagaacttttgtggggtcagttcattagcgccattccaacccgaagtctcaagtttcttaaagaggccggtcacggcacaaccaaagaggagatcacgaaggatgccgaaggactggacgaaatcgatcatgcggagatggaactgagacggggacaaatcctctggtttcgcggactcaaccggatccagacccaaattgacgtgatcaacacttttcagactggcgcttcctttaaaggcgtccttcgacgacaaaacatgggccagcaccttgatgtcaagttagtgccttcctcctcttacgtggcagtggctccggttaagtcctcccccacgacgtccgtgcctgccgtgtctagtcctcctatgggaaaccagagcggccagagtgtgccatag

SEQ ID NO: 215185 - DNA, 3477 bp, Artificial Sequence
  Description of Artificial Sequence: Synthetic coding sequence
atgacaaaccccagcgatcgggtcttgcctgccaacagcatggctgaaagtagggagggggacttcggttgtacggtgatggagttgcgtaaactgatggagcttagaagcagggacgctctgacccagattaacgtgcattacggtggagtgcagaacctgtgttcgcgactgaaaacgagccccgtggaggggctttccgggaatcccgctgatctggagaagagacggcaagtctttggccacaacgtcattcctcctaaaaagcctaagacattcctggagctcgtttgggaagcacttcaggacgtgaccctgataatactcgaaatcgcagcgattatctccctcgtgctttcattttaccgccctgctggcgaggaaaatgaattgtgcgggcaagtcgcaaccacgcctgaggacgaaaacgaggcacaagccggatggatcgaaggggctgccattctgttttctgtcataatcgtggtcctagtcacagcatttaacgactggtccaaagagaagcagttccgaggtctccagtgtaggatcgaacaggaacagaaattttccatcatccgtaatggtcagttaatacagctccctgtggccgagattgtcgtcggagacatcgcccaggtaaaatacggagacttgctccctgcggatggcatcttgatccagggaaatgacttgaaaatcgatgaatcctccctgacaggagagtccgaccacgtgaagaaaagcctggacaaggatcctatgctgcttagtgggactcacgtcatggagggatctggcagaatggtggtgactgcggtgggtgttaatagccagacggggattatattaacactgttgggagttaatgaggatgatgaaggagagaaaaagaagaaggccaaaactcaggatggcgtagctctggagatacaaccactgaactctcaggaaggtattgacaacgaggagaaagacaagaaggctgtgaaggtccctaaaaaggagaaatcagttttacaggggaagctgacacgcctggctgtgcaaatcggcaaggcgggactgctcatgagtgccctcacggtgttcattctcatactttactttgtgattgataatttcgtgattaaccggagaccctggctgcccgagtgtacacccatttacatacagtatttcgtaaaattcttcataatcggtatcacggtgctcgtcgtcgctgtccctgagggattacccctggccgttacaatttccctggcctattccgtcaagaagatgatgaaggataacaatctcgtgaggcatttggacgcttgcgagacaatgggcaatgccactgccatctgctcggataaaaccgggaccttgaccatgaaccgcatgacagtggttcaagcctacataggtggcatccactatcggcagattcctagccctgatgtgttcctgcccaaggtgctggatctgattgtgaatggcataagcataaacagcgcatatacaagcaaaatccttcctccagagaaggagggtggtctgcccaggcaagttgggaataaaaccgaatgtgcgctgcttggtttcgtaaccgatctcaaacaggattatcaggccgtgcgcaatgaagtccccgaggaaaagctgtacaaggtctacaccttcaatagcgtccgcaagtctatgagcaccgtaataagaaatccgaacgggggattccgaatgtactcaaagggagctagtgaaatcatcctcaggaagtgtaacaggatcctcgatcgtaagggggaagctgtcccctttaagaacaaggacagagacgacatggtgcggacagttattgaacccatggcttgtgacggccttaggacaatttgtatcgcttaccgagatttcgacgacactgaacccagctgggacaacgagaatgagatactgacagaactaacatgtatcgcagtagtaggcatagaggaccctgtgcggccagaagtccctgatgccatagctaaatgcaagcaagctggtattacagtcagaatggtcaccggcgacaacattaatacagccagagccattgctacgaagtgcggaatcctgacacctggtgacgattttctttgtcttgagggtaaggagttcaacagactcattagaaacgaaaagggagaagtagaacaggagaagttggacaaaatctggcccaagctgcgcgtcctcgccaggagctcacccacggataagcacactttggtgaaaggaatcatcgattcaaccgtaggggagcaccgacaggtcgtcgccgtgacaggagatggtaccaacgatggaccagcgctgaagaaagcggacgtggggtttgcgatgggcattgccggaacggacgtcgccaaagaagcatctgacataattctgaccgatgacaacttcacaagcatcgttaaggctgtcatgtggggcagaaacgtgtatgattcgatttctaagtttctgcagttccagctgactgtcaacgtggttgcagtgatcgtcgcttttaccggagcctgtattactcaagactctcctctaaaagccgttcagatgctctgggtgaatctaattatggacacttttgcttctcttgcgctggctacggagccaccgactgagagcttgttgaaaagacgcccttatggaagaaataagcccctcattagccgcacgatgatgaaaaacatattgggacacgccttctaccaactgatagtgatcttcattcttgtgttcgccggagaaaaattttttgatattgacagcggcagaaaggcaccattacattcacccccttctcagcactatactatcgtatttaataccttcgtcttgatgcagctgttcaatgaaatcaattcaagaaagatacacggtgagaagaacgttttcagtggcatctatcgtaatattattttctgttctgtggtgctgggaacgtttatctgtcagatatttatcgtggagttcggcggaaaacctttttcctgtacatctttgagcctaagccagtggctgtggtgtctattcatcggcatcggtgaattgctttggggacaatttattagcgctatcccaacacgttctctcaagtttctcaaggaagcaggccacgggactacaaaggaagaaattacgaaggacgccgagggcctcgacgagattgaccacgccgagatggaactacggcgaggccagattctttggtttaggggcctgaacagaatccaaacccagattgacgttattaatactttccaaacaggtgcctcatttaagggagtgttgagacgacagaatatgggacaacacctggacgttaagctggtgccaagctcaagttatgttgcagtggcacccgtcaagtcttccccaactaccagcgtacctgccgtgagctcccctccgatgggcaatcagtctggacagtctgtgccctag

SEQ ID NO: 215186 - DNA, 3405 bp, Artificial Sequence
  Description of Artificial Sequence: Synthetic coding sequence
atgacaaacccttccgatcgagtgctgccagcaaatagtatggccgaatctcgggagggcgattttggatgcactgtcatggaactaagaaaattgatggagctaagaagcagagacgcgctgacccagattaacgtccactacgggggtgtgcagaatctttgctcacgcctcaaaacatcccccgtggagggactttccggcaatcctgccgacctcgaaaaaaggcgtcaggtgtttggccataacgtgatcccacctaagaaaccaaagacgttccttgaactggtgtgggaagccttgcaggatgttaccctgataatcttggaaattgctgccatcatttccctggttctgtcattttataggccagcgggtgaagagaatgagctgtgcggacaggtcgcaaccacccccgaagatgagaacgaggcacaggctggctggattgagggcgcagcaatccttttcagcgttattatagtagtactggtgacagcgtttaacgactggtctaaagaaaaacagtttcgtgggctccaatgtcggattgagcaggaacaaaaattttcaattattcgaaatgggcagttgatccagctgcccgtcgctgaaatcgtagtgggagatatcgcacaggtcaaatatggagatctcctgcccgcagacggcatcctgattcaggggaatgacttaaaaatcgacgaaagctctctgacaggggaatctgatcacgtcaaaaaaagcctcgataaggacccaatgctgttgagcggaacccacgtcatggaaggcagcgggaggatggtcgtcacggccgtgggggttaactctcaaactggaatcatcctgaccctcctgggagtcaatgaggatgacgagggggaaaaaaagaagaagggcaaaaaacagggcgtgccggagaacagaaacaaagctaagacacaggacggggtggcactcgaaatacagccactgaattcacaggaggggatcgacaatgaggagaaggataagaaagctgtaaaagtaccgaaaaaagagaagtctgttctccaagggaaactgacacgcctagcagttcaaatcgggaaagcaggattgctgatgagtgcacttactgtgttcatcctgatcctgtactttgtaattgataacttcgtaattaaccgccgtccatggctgcccgagtgcactcccatctatattcagtatttcgtaaagttcttcattataggcataacagtcctggtcgtagccgtgcctgaagggctgcctcttgctgtgacaataagcctggcttacagtgtaaagaagatgatgaaggataacaacttggtcaggcatttggacgcttgtgagaccatggggaatgcgacagccatctgctccgacaagacagggacattaactatgaatagaatgactgtggtacaggcctatatcggcggaatccactatcgtcagatcccttcgcccgatgtgtttctcccaaaggtgttagacctcatcgtcaatgggatctccattaattccgcctacacttcaaagatattgccccctgagaaggaggggggacttccccgtcaagtgggcaataaaacggaatgcgccttgttagggttcgtgactgacctgaaacaggattaccaagccgtgcggaatgaagtacccgaagagaaattgtacaaggtgtatacgtttaactccgttagaaagtcaatgagtaccgtgattagaaatcctaatggaggattccggatgtactctaagggggcatctgagatcattctgcggaagtgtaatcgcattctcgacaggaagggtgaggcggtgccatttaaaaacaaagatcgggacgatatggtccggactgttatagagccaatggcgtgcgatggcctacggactatctgtattgcatatcgcgattttgatgacaccgaaccaagttgggacaatgagaacgaaatcctcaccgagttaacatgtatcgccgtggtggggattgaagacccagtgcgcccagaggtgccagatgcaattgcaaagtgtaagcaggccggaatcaccgtgagaatggtgacaggtgataatatcaacactgctcgggctatcgcaacgaagtgtgggatcctaactcccggagatgatttcttatgtctcgagggtaaagagtttaatagactgattcggaacgagaaaggagaggttgagcaggaaaagctggataagatatggcctaagctacgtgtcttggctaggagctctcctactgataagcacaccctggttaagggcattattgactctactgtaggagagcaccggcaggtcgtggctgtgaccggagatggcacaaatgacggtccagctctgaagaaagccgacgttggtttcgcaatggggatcgcgggtacagatgtggccaaggaggcctccgatatcatactgacagacgataacttcacgagtattgttaaggctgttatgtggggcagaaacgtatacgattcaatttcgaagtttttacaattccagctgacggtaaatgtcgttgccgtcattgtggcattcactggagcctgcataacccaggactctcccctgaaggcagtgcagatgttgtgggtcaatctgatcatggacaccttcgcttccttggctctcgctaccgagcctcccactgaaagcctgctcaaacggaggccttatggtagaaacaagccccttatcagccgaacgatgatgaaaaatattctcggccacgcattctatcagctgatagtgattttcattctggtatttgccggagaaaagtttttcgatatcgattccggcagaaaggcacccctgcattcaccaccctctcagcactataccattgtgtttaataccttcgtactgatgcaactattcaacgaaatcaacagccgcaagatacatggggagaaaaatgttttctcgggtatatacagaaacatcattttctgctctgtggtattaggcacctttatttgccagtttatatcagcaataccgaccaggagcctcaagtttctcaaggaggccggacatggcacaactaaagaggagattacgaaggatgcggagggccttgacgaaatcgatcacgctgagatggagctaaggcgcggtcagatcctgtggttcagaggactgaaccgtatccagactcagatagatgtcatcaatacctttcagacaggcgcttcctttaaaggtgtgctgcggagacagaacatgggacagcatctggacgtcaagttggtcccatcttcttcgtacgtagcggttgctcctgtgaaaagctcccccacgacaagtgttccagcagtcagctcaccacccatgggaaaccagtctggacagagcgttccctag

SEQ ID NO: 215187 - DNA, 354 bp, Artificial Sequence
  Description of Artificial Sequence: Synthetic coding sequence
tgaggcggaaagcccttcagttgcacctcgttgtctttatcccaatggctgtggtgtttatttatcggaatcggcgaattgctgtggggccagttcatctcagccatacccacacgcagcttaaaatttctcaaggaggccggacacggcacaacgaaagaggagattacaaaagatgcagaaggattggacgagattgatcatgccgagatggagctcaggcgcggacagattctgtggttccgcggattgaaccggatccaaactcagcacttgctccaagacagcgacttgctccccgacaaagaagaagccatcatctctagcagcctgtttcctagctgcaacttctag

SEQ ID NO: 215188 - DNA, 2667 bp, Artificial Sequence
  Description of Artificial Sequence: Synthetic coding sequence
atgaaggtggctcggtttcagaagatccccaacggcgaaaacgaaactatgatccccgtgctgacttccaagaaagcctcagagctacccgtgtccgaggtggcctcaattctccaggctgacttacagaatgggcttaacaagtgcgaggtgagtcatagacgcgcatttcacggctggaatgagttcgatatttccgaggacgaacctctctggaaaaaatatatctcccagttcaaaaacccgctcattatgttactgcttgcttccgccgtcatttcagtcttgatgcatcaatttgatgacgccgtgtcaattaccgttgcgattctgatcgttgtgaccgtggcattcgtgcaggaataccgatccgagaagtctctggaagagttgagcaaactcgtgcctcccgagtgccactgcgtcagagaggggaagctcgagcacacgctggctcgtgacctggtccctggagatactgtgtgtctgtctgtgggggatagggtgcctgctgatcttaggttgttcgaggccgtggatctatccatcgatgagagttctcttaccggggaaaccaccccctgctccaaagtgacagccccacaaccagctgcgaccaacggagacctcgcttcccggagcaatattgcgtttatggggactcttgtgcggtgtggcaaagcaaaaggtgtcgtgatcgggaccggggaaaattccgagtttggggaagtcttcaagatgatgcaagccgaggaagccccaaagacccccctgcagaagagtatggacctgctggggaagcagctgtcgttttatagcttcggcatcattggaataatcatgttggtgggttggttactggggaaggacatcctggagatgttcacaattagtgtttctcttgctgtggcagcaatccccgaggggctgcctattgtggttactgtcaccctcgctctcggagtgatgcgcatggtcaagaaacgtgctatagtcaagaagttgccaattgtcgagactctgggatgctgtaacgttatatgcagcgataaaaccggcaccctaactaaaaacgagatgaccgtgacacacatcttcacctccgacgggttacacgctgaagttacaggagttggatataaccagtttggtgaagtgatagtcgacggggacgtggtacacgggttctacaaccccgctgtgtcacgtatcgtcgaagcaggctgtgtctgcaatgatgccgtgataaggaacaacactttgatgggaaagcccacagaaggtgccctgatcgccctggccatgaaaatgggacttgacggtctccagcaggactatattaggaaagccgaataccctttttcctccgaacaaaaatggatggccgtgaagtgcgtccatcgaactcagcaggatcgcccagaaatttgcttcatgaaaggggcatatgagcaggtgattaaatactgtactacctaccagtccaagggacagaccttaacactgactcagcagcagagagacgtttaccaacaggagaaagcacgcatgggcagcgctggtcttcgggtcctcgcccttgcgtctggacctgaattgggtcagctaacctttctgggtttggtgggaattattgatcctccgagaacaggcgtgaaggaagctgttaccacactcattgcctctggcgtgtcaattaaaatgattactggcgactctcaggaaaccgcggtggccatcgcgagccggctggggctttacagcaagacttcccagtccgtgtcaggggaggagatcgatgctatggacgtgcaacagttgtctcaaatagtgcctaaggtcgccgtgttttaccgtgcctcccccagacataaaatgaaaatcatcaagtcccttcagaagaacgggtctgtggtagccatgaccggcgacggggtgaatgacgctgtggctttgaaagccgcagacattggagtggccatggggcagacagggacagacgtatgcaaggaagcggctgacatgatcctggtcgacgatgacttccagacaattatgtctgcaatagaagaaggtaaaggaatatataataatatcaagaactttgtgagatttcagctttcgacgtcgatcgcggctcttaccctgatctcactcgccacccttatgaactttcccaatcctcttaatgccatgcagatcctctggataaatatcattatggacggtccgcctgcacaatcactaggtgtggaaccagtggacaaggacgtgattaggaaaccaccgaggaactggaaagactccattctcacaaaaaaccttatcctgaaaatactggtgagctcaatcatcatcgtatgcgggaccctatttgttttttggagagaacttcgcgacaacgtcattactccacgggacaccacaatgacctttacctgtttcgtttttttcgacatgtttaatgccctaagcagccggtcccagacaaagtcagtcttcgaaatcgggctatgttcgaaccgcatgttctgctatgccgttctaggatcaatcatgggacagttgctggtaatttatttccctcccctacaaaaggtctttcaaacagagagtctgagcatactcgggttagccctgggggaagaatggacagcagccggatag

SEQ ID NO: 215189 - DNA, 2877 bp, Artificial Sequence
  Description of Artificial Sequence: Synthetic coding sequence
aaagtggctagatttcaaaagatacccaacggtgaaaatgaaacgatgattcccgtgctgactagcaagaaggcttccgaactccctgtgtcagaagtggcttcaatactgcaggcagatttgcagaacgggctaaacaagtgtgaggtgagccatcgcagggcttttcatggatggaatgaattcgacatcagcgaggacgaaccattatggaaaaagtatatctctcaattcaaaaaccctctcatcatgcttttactggccagcgcagtaatttctgtattgatgcatcaattcgacgatgccgtcagcattaccgtagcgattctcatcgtggtgaccgtcgcttttgtacaggagtacaggagtgaaaagtccttggaggaactctctaagttggtcccccctgaatgccactgtgtgagagaaggcaagctcgaacatacactcgctagggatctggtgcctggagacactgtgtgcctgagcgttggcgatagggtgccagccgatctaagactgtttgaagccgtggatctgagcatcgatgaaagcagcctcacgggagagactactccttgttcaaaagtgaccgccccacagccagccgctaccaacggagacttggcctcacggtccaatatcgcattcatgggcaccttggtacgttgcggcaaagccaaaggtgtcgtgattggaaccggtgaaaattccgaatttggtgaagtgttcaagatgatgcaggctgaagaggctcccaagacccctcttcaaaagagtatggatctactgggtaaacagctatctttttatagcttcggaatcatcggcattatcatgctagtgggatggttactgggtaaggacatcctggagatgtttactataagtgtgtccctggcggttgcagccatccctgaaggcctgccaatagtcgttacagtgaccctggcacttggggtgatgcggatggtaaagaaaagagcaatcgtcaagaaattgccgatcgtggaaaccctcggttgctgcaatgtgatttgctctgataagacaggtaccctgactaagaatgagatgactgtgacccatatctttacatcggacggtctgcacgctgaggttaccggagtggggtataaccagttcggcgaagtcattgtggacggcgacgtggtgcatggcttctataatccagccgtaagccggatcgtggaggccggttgcgtctgcaacgatgcagtgatccggaacaacaccctgatgggaaaacctactgaaggcgctttaatagccctggcaatgaagatgggcttagacggcctccaacaggactacataaggaaagccgagtatcccttttctagcgaacaaaaatggatggcagtgaaatgcgtgcaccgcacccaacaagatcgccctgagatatgcttcatgaagggagcctacgagcaggttattaaatattgtaccacttatcagtccaaaggtcagactctgactttaacacaacagcagagggatgtgtatcagcaggagaaggctaggatgggttctgccggacttcgagttctggcactcgctagcggaccagagctgggccagctcactttcctgggtctggtggggatcattgacccacccagaacaggcgtgaaggaagcggtgacgaccctgattgcctccggggtgagcattaaaatgatcaccggcgatagtcaagagaccgctgtcgccatagcctctaggcttgggctgtactccaaaacatcgcagtctgtctccggggaggagatagacgccatggatgtccagcagcttagccagattgtgcccaaggtggctgtattttatcgcgcaagccctaggcacaagatgaaaatcattaaaagccttcagaagaatgggtcagtcgtcgcgatgacgggagatggggtaaatgacgctgtcgccctgaaggctgccgacataggggtcgctatgggacagacagggactgatgtgtgcaaggaagctgcagatatgatccttgtggacgatgactttcagaccatcatgtctgctatcgaagagggcaagggcatttataacaatatcaagaacttcgtccgctttcaattgtccacctccatagccgctctcactctcatttcactggctacgcttatgaactttcccaatccgttgaatgccatgcaaatcttatggattaatatcatcatggatggtccacctgcacagagtctaggcgtggagcccgttgacaaagacgtgatccgcaaaccccctcgtaattggaaagattcgattctgaccaagaacttgatcctgaagatcctggtatctagtattatcatcgtctgcggcactctgttcgtgttttggagggaactgagagacaacgtgatcaccccacgggataccactatgacattcacatgcttcgtgttttttgatatgtttaatgcactgagtagtaggtcccagacaaaaagcgtgtttgaaatcggtctgtgttctaaccgaatgttttgttatgctgtgctgggaagtattatgggacagttgctcgtcatctacttcccacccctccagaaagtgttccagaccgaaagcctcagtatccttgacctactttttctcctgggactcacctcctctgtttgtatcgtagcagagattatcaagaaggtcgaacgctccagagagaagatccagaagcatgtgtcttcaacatcctcatctttcctggaggtgtcgtcgtccagcggcaattttgtcgctgtatggctatgggaaagaagcgggcagcagctggtcgagattcacccccacctagaaacgggtcttccactgacggaggacgtgtcctgcgtgtag

SEQ ID NO: 215190 - DNA, 2850 bp, Artificial Sequence
  Description of Artificial Sequence: Synthetic coding sequence
atgaaagttgctcggttccagaagatacctaatggcgagaatgaaaccatgatccctgtgctcacatctaaaaaagcgtcagagctaccagtctccgaagttgctagtattctgcaagccgatctccagaatggcctgaataaatgcgaagtatcccataggcgcgcttttcacggttggaatgagtttgacattagcgaggacgagccactgtggaagaagtacattagccagttcaaaaatcccctcataatgctgctgttggcgtcagccgtgataagtgtgctgatgcatcagttcgatgacgctgtctcaatcactgtagccatattgatagtggtcacagtagctttcgtgcaggagtatcgcagcgaaaaatcactggaggagttgtcaaagctagtgccccctgaatgtcactgtgtccgagagggaaagctagagcacaccttggctcgcgatctagtaccgggagatacagtttgtctcagtgtgggggatagggttccagcagatctgcggctcttcgaggcagtggacctcagtattgatgagagctccctgacaggggaaacaaccccttgctctaaagtaacagctcctcagccagcagcaaccaacggcgacctcgcatctcgttctaacatcgcctttatggggactctagtgcgctgtgggaaggcaaagggtgtcgtgatcgggaccggcgaaaattcagaattcggcgaggtgtttaagatgatgcaggctgaggaggctcctaaaaccccgctgcagaagtcaatggatctgctgggtaaacagctctcattttacagctttggtatcattggcatcatcatgttggtggggtggctcctcggcaaggacatcttggagatgtttaccatatctgtgtctctagccgtggcagccatccctgaggggcttcccattgtggtcactgttaccttagcgttaggggtgatgcgcatggtaaagaagcgggctatcgtgaagaaactgccaatagttgaaaccttgggatgctgtaatgtgatatgctccgataagacagggacgctcacaaagaacgaaatgactgtgacccacatcttcacctcagacggattacacgccgaagtcaccggggtcgggtacaatcaatttggtgaagtgattgtcgacggggatgtcgttcacgggttttataatccagctgtaagccgcatagtcgaggctgggtgcgtgtgcaatgacgcggtcatccggaacaacaccttgatgggaaaacctacggagggcgcactcatcgctctagccatgaaaatgggactcgacggtctgcagcaggattacatccgaaaggccgagtatcccttctctagtgagcaaaagtggatggccgtgaaatgcgttcaccggacacagcaggatcgtcctgagatttgtttcatgaagggagcatacgagcaagtgattaaatattgcacaacctatcagtcaaaagggcagactctgacactgacccagcagcaacgcgacgtataccagcaggagaaagccaggatgggctcagctggcttgcgtgtgctcgccctggcctcaggtcctgaattgggtcagctgactttccttgggttggtggggattatcgaccccccacggaccggcgttaaggaagccgtgacaacacttattgctagtggtgtctctattaaaatgattaccggtgatagccaggaaacagctgtagccatagcctcacgcttgggtctatacagcaaaacttcccagagtgtatcaggagaggaaatcgatgctatggacgtgcagcaactgagccaaatcgtccctaaggtggcagtattctaccgggcatcaccccgacacaaaatgaaaattattaagagtctgcagaaaaacggaagcgtcgtcgctatgaccggggacggggttaacgatgccgttgccctgaaggctgcagacattggtgtcgcaatgggacaaaccggaaccgatgtgtgtaaggaggccgctgacatgatcttagtggatgatgacttccaaacgattatgtctgctattgaagaaggcaaagggatttataacaacatcaagaatttcgtgcgtttccagctttctacgtcaatcgctgccttgaccctgattagcttagccacgctcatgaacttcccgaacccacttaacgcaatgcagatcctctggataaatataattatggatggacctcctgcccagtcattgggagtcgagccagtagataaggacgtgatccgcaagcctccaagaaattggaaagatagtatccttaccaaaaatctgatcctcaaaattctcgtttcctcaataattatcgtctgtgggacgttattcgtgttctggcgcgaacttcgggacaacgtcatcactcctcgcgacaccaccatgacattcacatgtttcgtgttcttcgatatgtttaatgccctctctagccgctctcagaccaaaagcgtgttcgaaatcggcctgtgctcaaataggatgttctgttacgccgtgctggggtcaattatgggacagttgctggtaatttatttccccccactccaaaaagtgttccagactgaaagtctcagcatcttggatttgctatttctccttggtttgacgtcctccgtgtgcattgttgcagagatcataaaaaaagttgaacgatctcgcgagaagatccagaagcacgtgtcctcgactagctcttcttttttggaagtgtggttgtgggaaaggtccggacagcagctcgtcgaaatccatccacatcttgaaacaggcctgccgttgacagaagacgtgtcctgcgtgtag

SEQ ID NO: 215191 - DNA, 2922 bp, Artificial Sequence
  Description of Artificial Sequence: Synthetic coding sequence
atggactctctgctgcctccctcaagattctcttattttaaaaaatacccattacacgcgatacgccgatacttgtcgaccctacggaatcagcgcgctgaggaacaagtggccagattccagaaaattccaaatggtgaaaacgagacaatgatccccgttttgacctcaaaaaaggcctccgagctgcccgtctctgaggtagcgagcattctgcaggcagacctgcagaatggactaaataagtgcgaggtttctcatcgcagggctttccacggatggaatgaattcgacatcagcgaagacgagcccctttggaagaagtacattagtcaatttaaaaaccccctcattatgctgctgctcgctagcgctgtcatctcggtacttatgcatcaattcgatgatgcagtttccataaccgtcgccatcctaatcgtcgtaactgttgccttcgtgcaggagtatcgatctgagaaatcactggaggaactctcaaaactggtaccgcctgaatgccactgcgttcgggaaggtaagctggaacatacattggctcgcgatctggtcccaggcgatactgtgtgtttatccgtcggagatagagtgcccgcagacttgcgactgttcgaagccgtggacctctctatcgatgagtcttcactgactggagaaaccacgccttgcagcaaagttaccgcaccacaaccggctgctaccaacggggatctggctagcaggagcaatattgcgtttatgggaactttggttcggtgtgggaaggcaaagggcgtggtgatcggaaccggtgaaaattcggagttcggcgaagtgttcaaaatgatgcaggccgaggaagccccaaagacaccactgcaaaagtctatggatctgctcggcaagcagctgtcattttactcattcggaatcatcggaatcatcatgttagttgggtggctcctggggaaagacattttggaaatgtttactatatctgtgagcctcgcggtagcggcaattcccgaaggccttcccattgttgttacagtgacacttgctttgggagtgatgaggatggtcaaaaaaagagctattgtgaagaagctacccatcgtagaaactctgggctgctgcaatgtgatatgcagcgacaaaactgggaccctaaccaagaacgaaatgacggtgactcatatattcacatctgacggcctgcacgcggaggtgacaggggtcgggtataatcagttcggcgaagtgattgttgacggagatgtggtgcatggattttacaatccggcagtatcgcggattgtagaggccggatgtgtgtgcaacgacgctgtgattcggaataacactctcatggggaagccaactgagggtgcacttatcgccctggccatgaagatgggtctggatggactgcaacaggactatatcagaaaagcagagtatcccttctcctcagaacagaagtggatggcagtaaaatgcgtgcacaggacacaacaggatagaccagagatctgtttcatgaaaggcgcttacgagcaggttatcaaatactgtaccacttaccagtcaaagggtcagactctgactttaacccagcagcagagagacgtgtaccagcaggaaaaggctaggatggggtcagccggtctacgcgtactggccttagcgtctggacccgaacttggacagctgacattccttggcctcgtcggaatcatcgatccacctagaaccggtgttaaggaagccgtaaccactttgatcgcatccggcgtgagcatcaagatgatcacaggcgattcccaggaaaccgccgtggctatcgcttcccgcttgggcttgtattccaaaactagtcaaagtgtgtccggggaagaaatcgacgccatggatgtgcaacagctctcacagattgtgccaaaagtcgccgtcttctaccgggcatctccaagacacaagatgaagatcatcaaaagtttacaaaagaacggctctgtcgttgctatgactggggatggagtgaatgacgccgttgccctgaaggcagccgacatcggagtggcaatgggccagactggaaccgacgtatgcaaagaggccgctgatatgatcctggtcgatgacgattttcaaactattatgagcgctatcgaggagggcaaaggtatctacaacaacatcaaaaactttgtccggttccagttatccaccagtattgctgctctgaccctgatctcactggcaacactaatgaacttccctaatcccctaaatgctatgcagatcctgtggattaacatcataatggacggcccacctgcccaatctctgggcgtcgagcccgtagataaagacgtcatacgaaaacccccacgcaactggaaggactctatcctgacgaaaaatctgatcctaaaaattttggtgtcttcaatcataattgtgtgcggcacgctcttcgtcttttggcgggagcttcgtgacaatgtgattacacccagagatacaactatgacattcacctgctttgtcttctttgacatgttcaatgcgctgtctagccgaagccaaactaaatctgtatttgagatcgggctttgcagcaaccgcatgttctgctatgcagtcttgggatctattatgggacagctgttagtcatttatttcccaccgcttcaaaaagtgttccagactgaaagtttgagtatcctcgacctcctgttcctcttgggcctgactagttctgtttgcatcgtggccgaaattattaaaaaggtggagcggtccagagagaagatccagaaacacgtgtggctctgggagcggagcgggcaacagttagtggagatccatccccacctggaaaccggtctgccacttaccgaggacgtgtcgtgcgtgtag

SEQ ID NO: 215192 - DNA, 2820 bp, Artificial Sequence
  Description of Artificial Sequence: Synthetic coding sequence
atgaaggtggcccgtttccagaaaatccccaacggggagaacgagacaatgatacccgtgctgacctccaagaaggcctctgagctccctgtctccgaagttgcatccattctgcaggcagatctgcagaatgggctaaacaagtgtgaggtgtcacacaggcgggcatttcatggatggaacgaattcgacatctccgaagatgaaccgttgtggaaaaagtatatctctcagttcaaaaatcccctcattatgttactcttggcttcggccgtgatcagcgtgctcatgcatcaatttgacgatgccgtgtctatcacggtggctatcttgattgtcgtgacagtggcattcgtgcaggagtaccggtcagaaaagagccttgaggaattaagcaagctcgtcccgccagagtgccactgcgtcagagagggaaagttggagcatactctggcacgcgacttggtccccggtgatactgtgtgcctgtctgtcggagatagggttccggcagatctgagactctttgaagcagttgatctgagcatcgacgagagttccctgacaggagagaccactccctgctccaaagttacagctccgcagcccgctgccacaaatggcgacctggctagtaggagtaatatcgcctttatgggtaccctagtgcgctgcggaaaagcgaaaggcgtcgtaattggcactggtgagaactccgagtttggagaggtttttaaaatgatgcaagctgaggaggcacccaaaacacccttgcagaagtccatggacctgcttggtaagcaactgagcttctacagcttcggcatcatcggaatcattatgctggtgggatggttattgggcaaggacatcctagagatgtttaccattagcgtctccctggcagtggccgctatccccgagggactcccaatcgttgtgactgttactctggccctcggcgttatgaggatggtgaaaaagagggcaattgtgaaaaaactcccgattgtcgagactctgggctgttgcaatgtgatctgttcggacaagaccggtacgctcacgaagaatgagatgactgtgacccatattttcaccagcgacggactccacgcagaggtgacgggggttggatacaaccagtttggcgaggtaattgtggacggggacgttgttcatggtttttataacccagcagttagccgcattgtggaagccggttgcgtttgcaatgacgcagttatccgaaacaacaccctgatgggcaaacccacggaaggggctcttattgcactggccatgaagatgggtctcgatgggttgcagcaagactacatccgtaaggctgagtaccctttcagctctgaacaaaagtggatggccgtgaagtgcgtgcaccgcacccagcaggatagacctgaaatctgctttatgaaaggggcatatgagcaggtgataaagtactgcacaacataccagtccaaaggccagactctgaccctaacccagcagcagcgagatgtgtatcagcaggaaaaagcacgaatgggctcagctggccttcgagtgttggccttggctagcggacctgaacttggccagttgaccttccttgggcttgtgggcattattgatcctccgcgtacaggagtaaaagaggctgttaccaccctgatcgccagcggcgtctcaatcaagatgattacaggggatagtcaagagacagccgtggctatcgctagccgcttaggcctttattctaaaacctcccagagcgtgtccggcgaggagatcgacgctatggatgtgcagcagttgtctcaaattgtgcccaaagttgcagtcttctatagggcatctcccagacataaaatgaaaatcataaaatctctccaaaagaacggtagtgttgtcgccatgacaggagatggcgtgaatgatgccgtcgcactgaaggctgctgatatcggtgtggccatggggcagaccgggacagacgtgtgcaaagaggcagctgatatgatccttgtggatgatgactttcagaccattatgagcgcaattgaagaaggcaagggcatttacaacaatattaaaaatttcgtgcgttttcagctgagcacctctattgctgcacttacgctcatctccctggcgaccctgatgaactttccaaatccattgaacgctatgcagatcctctggatcaacatcattatggacggtcctcctgcccagtccctgggcgtcgagcctgtggataaagacgttattagaaaacccccacgcaactggaaggactctatcctgacgaaaaatcttatactcaagatactggtaagtagtatcataatcgtgtgcggaacgctatttgttttctggagagagttgcgggataacgtgatcaccccccgagacaccaccatgacctttacatgcttcgtctttttcgacatgtttaacgcccttagctcccggagtcagactaagtctgtctttgaaattggtctgtgctctaacaggatgttttgttatgcggttctggggtctatcatggggcagttgctcgtgatctacttcccccctcttcagaaggttttccagactgagtccctgagtatcctagatctcctctttctgctggggctgacatcatcggtctgtatcgtggccgagattatcaaaaaagtggaacggtctagagagaagattcagaaacatgtctggctctgggagcgttccgggcagcaacttgttgaaattcaccctcatctggagacaggtttacccctgacggaggatgtgtcatgcgtgtag

SEQ ID NO: 215193 - DNA, 2760 bp, Artificial Sequence
  Description of Artificial Sequence: Synthetic coding sequence
atgaaagtggccagatttcagaagatcccaaacggggagaacgaaacaatgatcccggtgctgacttccaagaaggccagcgagctccctgtgtctgaagtggcctctatcctgcaggcagatctgcagaacggcttgaataaatgtgaggtgagtcacagacgtgcatttcacggttggaatgaatttgatatctcggaagacgagcccctctggaaaaagtacatctcccagttcaagaatcctttgattatgctgttactcgcatcagccgtaattagcgtattgatgcaccagtttgacgatgccgtgtctattactgtggctatcctgattgtcgtgacagtggcattcgttcaggagtatcggagcgaaaagagcctcgaagaactgagcaaacttgtcccaccagagtgtcattgtgtcagggaaggaaagttggaacatacgctagcgagagatttggttcctggtgatacagtctgcctgagcgtgggggatagagtacccgcagatcttcgtctgtttgaggcagtggacctgtccattgacgaatcttctcttaccggagaaactacaccatgttctaaggttacagcaccacagccagccgcaacaaacggggaccttgcaagccgctctaatattgcttttatggggactctcgttagatgcgggaaggctaaaggcgtagtcattggaacaggcgaaaactctgagtttggtgaggtgtttaagatgatgcaagcagaagaggccccaaagacgccactccagaaaagtatggacctgctgggcaagcagctgagcttctatagttttgggatcatcggcattattatgctggtgggatggcttctcggaaaggacatactggaaatgttcactatctccgtctcactcgcagtggcagccatcccggagggcttgccaatcgtggtcaccgtgactctggcccttggtgtcatgcggatggttaagaaacgtgccatagtgaaaaagttgcccattgtcgaaaccttgggctgttgtaacgtgatttgctcagataaaacaggcacactgaccaaaaacgagatgactgtaacccacattttcacaagcgacgggctgcacgctgaggtgacaggagtgggctataaccagttcggcgaagttatcgtggatggggatgtggttcacggcttctataatccagccgttagccgcatcgttgaggctgggtgcgtgtgcaacgatgctgttatcaggaacaacacactcatgggaaagcccacagaaggcgcactcatcgccctggccatgaagatgggactggacggcctacagcaagattacatccgtaaggccgagtacccgttcagcagtgaacaaaaatggatggctgtgaaatgcgtgcaccggacccaacaagacaggccagaaatttgttttatgaaaggagcttatgaacaggtgataaagtactgcacaacttaccaaagtaaaggccagactctcactctgacacagcaacaacgtgacgtttatcagcaggaaaaggctcgaatgggctcagcgggattaagagtgctggctctcgcgtcgggccctgagctcggccagctgacattcctggggctggtggggataattgacccaccgaggacaggggttaaagaagccgtgacaacccttatcgcgtccggcgtgtctatcaagatgattaccggtgattcgcaggaaaccgcggtagcgattgcatcacgcttaggactgtacagtaaaaccagccagtcagtgagcggagaagagatcgatgcgatggatgtccagcagctgtctcagattgtgcccaaagtagctgtcttctacagggcatcacctagacataagatgaaaattatcaaatccttgcagaaaaacgggagcgtggtggccatgacgggcgacggggtaaatgacgcagtggccctgaaggcggctgacattggagtggccatgggtcagactggcaccgacgtatgcaaggaggcagccgatatgatcctggtggacgatgactttcagacaattatgtctgccattgaggagggaaaaggcatctacaacaatatcaagaacttcgttaggttccagctgtcaacttccattgccgctcttacattgattagcctggccacattaatgaattttcccaacccccttaacgcgatgcagatcctttggattaatatcataatggacgggcctccagctcagagtctaggggtggaacccgtggacaaagatgtcatccgcaagcctcccaggaattggaaggattccattctgacaaagaacttaatcctcaaaattcttgtttcatccattatcatagtttgcgggacactatttgtgttttggcgggagctccgcgacaacgtgattacacctagggatactactatgactttcacctgtttcgtcttttttgacatgttcaatgcacttagtagccgctcacagaccaagagtgtgttcgaaatcggactttgcagcaacagaatgttctgttacgccgtcctagggtcgatcatgggtcagctgctcgtcatttattttccccctctgcagaaggtattccagacagagtccctgtctattttggacctgctgttcctgctcgggctaaccagttccgtgtgtattgtcgccgagattataaagaaagtggagcgctctagggagaagatacagaaacatgtcagttctacgagctctagcttcctcgaggtttag

SEQ ID NO: 215194 - DNA, 2712 bp, Artificial Sequence
  Description of Artificial Sequence: Synthetic coding sequence
atgatccccgtgctgacttctaagaaagccagcgagctaccagtcagcgaagtcgcctctatcctgcaagccgacctacaaaatggccttaacaagtgtgaagtatcacatagaagggcgtttcacggatggaatgaatttgatatctctgaagatgagccactgtggaagaagtacattagccagtttaagaatccactcattatgttactcctcgccagtgcagtcatcagtgttcttatgcatcaatttgatgacgcagtgtctatcacagtggcaatcctcatcgtcgtgacagtggcgttcgtgcaagagtatagaagcgagaaatcactggaagagctgtcgaaactcgtaccgcctgagtgccattgcgttcgagaaggcaagctcgagcacaccttggcacgagatctggtgcctggagataccgtgtgcttgtccgttggagaccgggttccagccgacctgaggctgtttgaggctgtagatttatctattgacgaaagttccctcacaggggagaccactccgtgcagcaaggttaccgctccccagcctgcggcaaccaatggcgacctggctagtcggtcgaatatcgctttcatgggcaccctggtgagatgtggaaaagctaaaggagttgtaattgggacaggagagaatagcgagtttggcgaggtgttcaaaatgatgcaggctgaggaggcacccaagactcccctgcagaagtcgatggatctgttaggaaagcagttatccttctatagttttggcatcattggtatcatcatgttggtcgggtggctgctgggcaaagatattctggagatgtttaccatctcagtcagccttgccgtggcggcaatcccggagggcttgcccatcgttgttaccgtaacgctggccctcggagtgatgcgtatggtgaagaagcgcgcaattgttaaaaaattacctatcgtcgagactctgggatgttgtaatgtgatctgttccgacaaaactggaacgctcactaagaacgagatgacagtgactcatattttcacttctgacggcttacatgcagaggtcacaggggttggatacaatcagttcggtgaagtcatcgtagacggagatgtcgtgcatggattctataatcccgctgttagtcgaatagtggaagcaggttgtgtgtgcaatgacgccgttattaggaacaatacattgatgggaaagccgactgaaggcgctctcatcgccctggcgatgaaaatgggattggatgggctccaacaggattatattaggaaagctgaataccccttctctagcgaacagaaatggatggccgtaaagtgcgtgcatcgcacacagcaggatcgccctgaaatctgttttatgaagggcgcatatgaacaggtcatcaagtattgtactacataccaatctaaagggcagacattgacgctgactcagcagcagcgtgacgtctaccaacaggaaaaagctagaatgggctcagcaggactacgcgtattagccctcgcatctggacctgaactcggtcaactcacattcctcggccttgttggcattattgaccctccaagaactggtgtcaaagaagcagttacaacacttattgccagcggcgtcagcattaaaatgatcactggcgatagtcaggaaaccgctgtggcaatagcgagccgtctgggcctgtactctaagacctcacaatccgtgtccggagaggaaatagatgctatggatgtccagcagctttcccagattgtacctaaggtggcagtcttctacagggccagccctcggcacaagatgaagatcataaagagtctgcaaaagaacggaagcgtggtggcaatgaccggcgatggggtgaatgacgccgtcgcacttaaggccgcagatataggtgtggccatgggacagaccggcactgatgtttgtaaagaagccgctgacatgatcctggtcgatgacgatttccagacaatcatgtccgctatcgaagaaggtaagggcatctataacaacattaaaaattttgtgcgatttcagctgagtacaagtatcgccgcactcaccctgatttctcttgccaccctgatgaacttcccaaacccactaaatgcaatgcaaatcctttggattaacattattatggatggtcccccagctcagagcctgggagtggagcccgtggacaaagatgtcattagaaaacctccacgaaactggaaggatagcattctgactaaaaaccttattctgaagattctcgtttcctccatcattattgtgtgtggaactctgttcgtcttttggagagaactcagggacaatgttatcacccccagggacacaaccatgacttttacttgttttgtgttctttgacatgttcaacgcgctgtcatctcgttctcagactaagtctgtcttcgaaatcggactgtgctctaatcgcatgttttgttacgccgtcctgggcagcatcatgggacaactcctggttatttactttccaccgttgcagaaggtgtttcaaactgagagtctgagtattctggacttgttatttctcctggggcttactagttctgtgtgcattgtcgccgagattatcaagaaggtggagaggtcccgggaaaaaattcagaaacacgtttcaagcacatcttcttctttccttgaagtgtag

SEQ ID NO: 215195 - DNA, 363 bp, Artificial Sequence
  Description of Artificial Sequence: Synthetic coding sequence
atgaaagtggcgcgatttcagaagatccctaatggtgagaacgagacgatgatccctgttctaacatccaaaaaagcctccgagcttccggtgtccgaagtggcctctatccttcaagcagatctccagaacggcctgaacaagtgtgaagtgtcacaccggagggcttttcacggatggaacgaatttgacatctccgaggatgagcccctatggaagaagtacatcagccagttcaaaaatcccctcattatgctgctattagcctctgccgtgatctcagtactcatgcaccagttcgatgatgcagtgagtattaccgtggctattttgattgtagtgactgtggcttttgtacagtag

SEQ ID NO: 215196 - DNA, 2712 bp, Artificial Sequence
  Description of Artificial Sequence: Synthetic coding sequence
atgatccctgtcctgacctccaaaaaggccagcgagcttcctgtgtctgaggttgccagcattttgcaggcagacctgcaaaacggattaaataagtgtgaggtaagtcatagacgagcttttcacggctggaatgagttcgacataagcgaggacgagcccctgtggaagaaatacatttctcaatttaaaaacccgctgattatgcttctactggcttccgccgtgatatctgtactgatgcatcaattcgatgatgccgtgagcattaccgtcgcgatcctgatcgttgtgacagtggcattcgtgcaggaatatcgtagcgagaaatctctagaggaactgtccaagttagttcctcccgaatgtcattgtgtgcgagagggaaagcttgaacatacgctggcaagagacctggtgcccggagacaccgtgtgtctgagcgtgggggatagggttcctgctgatctgaggctgtttgaggccgtggatctgagtatcgacgagagctccctcaccggcgagactaccccatgctctaaggtcaccgcccctcagccagccgcaaccaatggggacctcgcctcgcgatcaaacatcgcttttatgggtactctcgtgcgctgtggaaaggccaaaggcgtcgtcatcggaaccggggaaaatagcgaatttggggaggtttttaagatgatgcaggccgaggaggcgcctaaaacccctcttcagaagtctatggaccttctcggaaagcagctgtcattctattcttttggtatcataggaatcattatgttggtcggatggctgctgggcaaggatatactggaaatgttcaccatttcagtgtctctggcagtcgccgcaattcccgagggactccctattgtggtcaccgtgaccctggcgctgggagtgatgcggatggtgaagaagagggctatcgtaaaaaagctccctattgtggaaacacttggctgttgcaacgtgatttgctctgataagactgggaccctgaccaagaacgagatgactgtaacacacatcttcacctcagacgggctgcatgcagaggtcacaggcgtcggttacaaccagttcggggaagtcattgtggacggggatgtggtgcacggcttttacaacccagctgtaagccgcatcgtagaggcaggatgcgtctgtaatgatgcggtgatcaggaacaatactctgatgggaaaaccaactgagggcgcactgattgccctggctatgaagatgggccttgatggtctgcagcaggattacataaggaaggccgagtacccattctcatcagaacagaagtggatggcagttaagtgcgttcacagaacccagcaggatagaccagagatttgcttcatgaaaggggcatacgagcaggtaataaaatactgtactacctaccagagcaaagggcagacactgacactgacacagcaacagagggatgtgtaccaacaggagaaagccagaatggggagcgccggtttgagggttctcgccctggcctccgggcctgagctgggccagttaacttttctgggcctggtaggcatcatcgaccctcctagaaccggagtgaaagaagctgttacaactttaattgcctcgggggtgagtattaaaatgatcacaggagactctcaggaaaccgcagtcgcgatcgcttccaggctcggcctgtattcaaaaacctcccaatccgtgtccggcgaggaaatcgacgccatggatgtccagcaactgagtcagatcgttcccaaagtggccgttttctacagagcctcgccacgccataaaatgaagattatcaaatcactccagaagaacggtagcgtcgtggcaatgacgggcgatggcgtgaatgacgcagtggccttgaaggccgcagacatcggtgtggccatgggacagacagggacggatgtttgcaaggaggctgcggatatgatcctggtggatgacgactttcagactatcatgtcagcaatcgaagagggaaagggaatttacaataacatcaagaattttgtaaggtttcagctcagtacgtcaatcgcagccctgacactgattagtttggctaccctgatgaacttcccaaatcccctgaatgcgatgcagatcctgtggataaacatcatcatggatggtccgccagcccagagccttggagtcgagcccgtagacaaggatgttatccgaaaaccccctaggaattggaaagactcaatcctgactaagaatctgatcttgaagatcctggtgagttccattatcattgtatgtgggacattgttcgttttctggagagagttacgggataatgtgatcactccaagagacaccaccatgacctttacctgtttcgtgtttttcgatatgttcaacgctctgtcctctagatcacagaccaagtccgtctttgagattggcctgtgctccaataggatgttctgttatgctgttttggggagcataatgggccagcttctagtcatctacttcccccctctgcagaaggtcttccagactgaatccctgtccatcctggatctgctatttctactgggtctgaccagctcagtctgtattgtggcagagataatcaaaaaggttgaacgaagtagggagaagattcagaaacatgtatcttccacatcatcaagctttttggaagtgtag

SEQ ID NO: 215197 - DNA, 2772 bp, Artificial Sequence
  Description of Artificial Sequence: Synthetic coding sequence
atgatccccgtgctgacctccaaaaaggcttcagagcttcccgtgtccgaggtagcctcaatcctccaggccgatctgcagaacggactcaacaaatgtgaggtctctcatcggcgtgccttccatggctggaatgagttcgacatttccgaggacgaaccactctggaagaagtacattagtcagtttaagaatccattgataatgctcctcctcgccagcgcggtgataagcgtcctgatgcaccaattcgacgatgctgtgagcatcacggtcgccattttgatcgttgttaccgtagccttcgtgcaagagtacagatctgagaagagcctcgaggaattgtccaagttagtgcctccagaatgtcattgtgtacgcgagggtaagctggagcacacactcgccagagacctggtgccaggtgataccgtgtgtcttagcgtaggggatagggtgcctgcagatctgaggcttttcgaagctgtcgacctgagcattgatgaaagttccctcacaggagaaactaccccttgttccaaagttacagctccccagcctgctgccacgaatggcgaccttgcttcccggtccaacatcgctttcatgggcacccttgtccggtgcggcaaagcaaagggcgtcgtcataggtacaggtgaaaacagcgaattcggcgaagttttcaaaatgatgcaggccgaggaggctcccaaaacgcctctgcaaaagtctatggatctactgggaaagcagctgagcttttattctttcggtatcatcgggataattatgctagtcggttggcttctgggtaaagacattctggagatgtttacgatcagtgttagcctcgctgtggcggctatccccgagggcctacccatagttgtaactgtcactctggctctcggggtgatgagaatggtcaagaaacgggcaattgtaaagaagctcccaatcgtcgagacgctgggctgttgcaatgtaatatgttctgataaaaccgggaccctcacaaaaaatgagatgacagtcacacatatctttacttctgatggactccatgccgaagtcacaggcgtagggtacaatcagtttggggaggtgatcgtggatggcgacgtagtgcacggtttttacaaccccgctgtgtctcggattgttgaagctggctgtgtgtgcaacgatgccgtgatccggaacaatacattgatgggtaaacccaccgaaggcgcactgattgctctcgcaatgaaaatggggttggacggtctgcagcaggactatatccgaaaggccgagtatccctttagctcagagcaaaagtggatggccgtgaagtgtgttcatagaactcagcaggatagacctgagatctgtttcatgaagggagcctacgagcaggtgattaagtactgcactacttatcagtcaaagggccagaccctgactctcacccagcagcaaagagacgtttatcagcaggaaaaggccaggatgggcagcgcgggacttcgagtcctggctctggcctcgggtcctgagttgggccagttgactttcctgggacttgtgggtataatcgatccccctagaaccggcgtgaaagaagccgtgaccaccctcatcgctagtggtgtcagcattaagatgatcacaggggactctcaggagaccgctgtcgccatcgcctcaagacttggcctctattcgaaaacttctcagtcagtgtcgggagaggaaattgatgctatggatgtacagcaactgagccagattgttcccaaggtagcagtgttttaccgcgcaagtccaaggcacaaaatgaagatcattaaatcactgcagaagaatggctctgttgtagctatgacgggggatggggttaacgatgcggtcgccctgaaagcagccgacatcggagtggccatgggccagaccggcactgatgtgtgtaaggaggccgctgatatgattttggtggatgatgatttccagactattatgtctgctatcgaagagggtaaaggaatctataataacatcaagaatttcgtaagattccagctgtcaacatcaattgcggctttaaccctgattagtctggccaccctgatgaattttcctaatccattgaacgccatgcagatactctggattaacattatcatggacggaccacccgctcagtcactaggcgtggagcctgtcgataaggatgtcatccgcaagccgcctagaaattggaaagactccatcttaaccaaaaacctgatcctcaagattctggtgtcgagcattattatcgtttgcgggacgctatttgttttctggagagaacttcgggataacgtgattacgcccagggatactacgatgacttttacctgtttcgtctttttcgatatgtttaacgctctttcctccagatcccagaccaaaagcgtgtttgagatcggcctgtgctccaaccgcatgttctgttacgccgtccttgggtccattatgggccagttactggttatatattttcccccactgcagaaagtctttcagaccgaaagcctgtcaatcctggatttgctgttcttgttggggttgacgtcatccgtgtgcattgtagcggagattattaagaaagtagagcgttctcgcgagaaaatccagaagcacgtgtggctgtgggaaagaagtggacaacagttggtggagatccatcctcacctcgaaaccggactcccactgactgaagatgttagttgcgtgtag

SEQ ID NO: 215198 - DNA, 249 bp, Artificial Sequence
  Description of Artificial Sequence: Synthetic coding sequence
atgatcccagtgctaaccagtaagaaagcttcagaattgccagtttcagaagtcgccagcattctgcaggctgacttgcagaacggtctgaataagtgtgaggtatctcatagacgcgcattccatggctggaacgagtttgacatttcagaggatgagcccttgtggaagaaatatatcagccagtttaagaatccgcttataatgctactactggctagcgcagtaatatcagtgctgatgcactag

SEQ ID NO: 215199 - DNA, 2760 bp, Artificial Sequence
  Description of Artificial Sequence: Synthetic coding sequence
atgaaggtagccaggttccagaaaattccaaatggcgagaacgaaacgatgattccggtattgacttcaaaaaaagcgtccgagttacccgtatcagaggttgctagtattctccaagccgatttacagaacgggctgaataaatgcgaagtgagtcatcggagagcatttcatggctggaacgagttcgacatttctgaggatgaaccattgtggaagaaatacatcagccaatttaagaatccactgatcatgctgttgctagcgtcagccgttatctcagtgctcatgcaccagtttgatgatgcggtgtctataacagtggctatactgattgttgtgaccgttgctttcgtccaagagtaccgctccgagaagagtcttgaagaactgagtaagctggtgcccccagagtgccattgtgtccgggaaggcaaactagagcacacccttgcacgtgatctggtcccaggggacacagtgtgtctgtccgtgggggaccgagtaccagcggatctgaggctctttgaggcggtcgacctgtctatagacgagagtagcctcaccggcgaaacaactccctgctccaaggttaccgcccctcagcctgctgccaccaatggcgacctggcgagcaggagtaatatcgcctttatgggcaccctcgtgagatgcggtaaggctaagggagtagtaatcggaacaggtgaaaactctgaattcggagaggtgtttaaaatgatgcaggcagaagaagctcctaagacccccctccagaagtccatggatctcctgggaaagcagttaagcttctactccttcgggatcattggaatcatcatgcttgttggttggctcctcggcaaagacatattggaaatgttcaccatatctgtctccctggctgtagctgctataccagagggcctcccaatcgtggtcacggtcaccttggccttgggtgtgatgcgaatggtgaagaaacgcgcaattgtcaaaaaactccctattgttgagactctcggctgctgcaacgtgatctgctcagacaaaaccggaacacttacaaaaaatgaaatgacagtgactcatatcttcacatctgacggcctgcacgcagaggtcactggagttgggtataatcaattcggagaagttatcgtggatggtgacgtcgttcatggtttttataatcccgctgtgtcgcggatagtggaagcgggatgtgtatgtaacgacgctgttattagaaataatacccttatgggcaaacctaccgagggggcactgattgccctagccatgaagatgggactcgatggcctacaacaggactacatccggaaggcggagtatccattctcctctgaacagaaatggatggcagtcaaatgtgttcaccgcactcagcaggaccgcccagagatttgcttcatgaaaggcgcttacgaacaggttattaagtattgtaccacctatcagagcaaaggacagacccttaccctgacgcagcagcagcgcgatgtctaccagcaggaaaaagctcgaatgggctcggctggactgagagtgctggcactggcatctgggcctgagctcggtcagctaaccttcttagggttggtcggaatcatcgacccaccaaggacgggcgtaaaggaggctgttaccaccctgatagccagcggagtgtctattaaaatgattactggcgacagtcaggagactgcagtcgccatcgcttctcgcttggggttgtatagcaaaactagtcagagcgtgtccggggaagaaatcgacgctatggacgtgcagcagctctctcagattgttcctaaggtcgctgtgttctaccgagcatcccccagacacaagatgaagataatcaaatccctacaaaagaacggctcggtagtggcaatgaccggggacggtgtgaacgatgctgtggcgctcaaagccgctgacatcggcgtcgctatgggccagacgggtacagatgtctgcaaggaggcagctgatatgatcctggtggacgatgattttcagaccataatgtccgccatcgaagagggtaaggggatctataacaacataaaaaattttgtccggtttcagttatctacatctatcgcagccctgaccttgatctccctcgccaccttaatgaactttccaaatcccttaaatgcaatgcagatcctgtggattaacatcatcatggatgggccaccagcacagtccctgggagttgagcctgtggataaagacgtgattcgtaaaccaccaagaaattggaaggactctatcctcacaaaaaacctcattctgaaaatcttggtatctagcataatcatcgtgtgtgggaccctgtttgtgttttggagagagctccgggataacgtaattacgcctagagacacaacaatgacttttacctgctttgtgttcttcgacatgtttaacgctctgtcaagcaggtctcaaacaaagtccgtctttgagattggcctctgttctaacagaatgttctgttacgcggtgttgggctccatcatgggacagctgctcgtgatatatttccccccactgcagaaggtgttccaaactgagtcactatcaatactggatctcctgtttctgctaggtttgacgtcaagcgtgtgtatcgtggcagagattataaagaaagtggagagatcccgggagaagattcagaaacacgtttcttcgacaagctcatcttttctcgaggtctag

SEQ ID NO: 215200 - DNA, 309 bp, Artificial Sequence
  Description of Artificial Sequence: Synthetic coding sequence
atgaaagttgcaagattccagaaaataccaaacggcgagaatgagaccatgattccagtgttgacgtccaaaaaggcctctgagctgccggtttctgaagtcgcaagcattttgcaagccgacctccagaacggactgaacaagtgtgaggtctcacaccgtcgcgcttttcatggttggaacgagtttgacatcagcgaagatgaacccctatggaaaaagtacatcagccagtttaaaaatcccctaatcatgcttctgctggcttcggccgttatctcggtgctgatgcatcagttcgacgactag

SEQ ID NO: 215201 - DNA, 2760 bp, Artificial Sequence
  Description of Artificial Sequence: Synthetic coding sequence
atgaaggttgctagatttcaaaagatacccaacggtgagaacgagacaatgatccccgtccttaccagcaaaaaagcctctgaactgcccgtgtccgaggtggcatctatcctccaggcggatctgcagaacgggcttaataaatgcgaggtgagccatagaagagccttccatggctggaacgagttcgacatttcagaggacgaacccctctggaagaagtacatcagccagttcaagaacccactgattatgctgttacttgcatcagcggtcatttccgtgctgatgcaccagtttgatgacgctgttagtatcacggtggcgatcctgatcgtcgtgacagtcgcctttgttcaggaataccgttcagaaaagagcctcgaagagctatcaaagctcgtgccacccgaatgtcactgcgtgcgcgaagggaaattggagcacaccctggcccgagatcttgtccccggagatactgtctgtctgagcgtgggggatagggtgcctgccgatctgagactttttgaggctgtggacctcagcattgatgagtccagtctgacgggagagacaaccccctgctcaaaagttaccgcgcctcagccggcagccacaaacggcgacctggcatccaggtcaaacatcgcttttatggggactctcgttcggtgcgggaaagccaagggcgtcgtgatcggcactggagagaatagtgaatttggcgaagtgtttaagatgatgcaggcagaggaagcccctaaaacacctctgcagaaaagcatggatcttctcggtaagcagctctcgttttatagctttggaataatcggcataattatgctcgtcgggtggctcttgggaaaagacattctggaaatgttcactatttcagtgagcctcgcagtcgcggctattcccgagggcctccctatcgtggtcaccgtgaccctggccttgggcgtgatgcgcatggtcaaaaagcgagccatcgtgaagaagctgcccattgttgagactctgggctgctgtaacgtcatctgttctgacaagacgggcacccttactaagaatgagatgactgtgacacacattttcacgagcgatgggcttcatgctgaggtaacaggggtaggatataatcagttcggggaggtgattgtggatggagacgtggttcatggattctataatccagccgtgtctagaatcgtcgaagccggatgtgtgtgcaacgatgcagtgattagaaataacactttgatgggcaaaccaacggagggggcacttatcgctctcgctatgaaaatgggattagatggacttcagcaggattacatcaggaaagccgagtacccattctctagtgagcagaaatggatggctgttaagtgcgtgcacaggacacaacaggaccgacccgagatctgcttcatgaagggagcttacgaacaggtcatcaaatactgtacaacgtatcagagcaagggtcagacactaacgctcacacaacaacagcgggatgtctatcagcaggaaaaggctcgcatggggtctgccggactccgagtgctggctttagcctctggacccgaactcggccagttgacctttctgggactggtgggaattatagacccccctaggacaggcgtgaaggaggccgttactactcttattgcctcaggcgtttcaataaaaatgatcaccggggacagccaggagaccgccgtcgctatcgcctctcggctcggtctctatagtaagacgagccagtccgtgagcggcgaagagatagacgctatggacgtgcagcagctgtctcagatcgtgcctaaagtggctgtcttctaccgcgctagccccagacacaagatgaagattattaaaagccttcagaagaatggctcagtggttgctatgacaggggacggcgtgaacgatgcagtagccctcaaggcagccgacattggggtggccatgggacaaactgggacagacgtgtgtaaagaggcagcagacatgatactggtggacgacgacttccagaccataatgagtgccattgaagaaggtaagggtatttacaacaatattaagaactttgtgaggttccaactttctacttccatagccgctctgaccctgattagcttggcgacccttatgaactttccaaatcctctcaacgccatgcagattctctggattaatataatcatggatgggccacctgcccagtctctgggagtggaaccagtggacaaagatgtcatacgcaagcctcctagaaattggaaagacagtatcctgacgaagaatctgatcctcaagatcctggtatcaagcattatcatcgtatgtggcacgcttttcgtgttctggcgcgaactgcgtgacaacgtaatcactcctagagatacgactatgacgtttacctgcttcgtatttttcgacatgttcaacgcgttgtcttcccgcagccagacgaagtcggttttcgagatcggcctctgttctaatcgcatgttctgctacgctgttctcgggtcaattatgggacagctgcttgtgatatactttccacctctgcaaaaggtttttcaaacagaaagcctgagcattcttgatctgctctttctgctgggcctcaccagcagcgtgtgtatagtcgccgagatcattaagaaggtggagagatccagagagaagatccagaagcacgtaagttctacttcttctagtttcctcgaagtctag

SEQ ID NO: 215202 - DNA, 2772 bp, Artificial Sequence
  Description of Artificial Sequence: Synthetic coding sequence
atgataccagtgctcactagtaaaaaagcatcagaactgccagtgtctgaagtggcctctatcctacaggcagatctgcaaaatggcctcaataaatgcgaggtaagtcaccgcagagcttttcacgggtggaatgaattcgacattagcgaagatgaaccactctggaagaagtacattagccaatttaaaaatcccctgatcatgctcctgctggcttctgctgtcattagcgtgctgatgcaccaattcgatgacgctgtctccatcacagtggccatcctgatcgttgtgacggttgcattcgtgcaggagtaccgctccgaaaaaagccttgaagaactatccaaactcgtccctccggaatgccactgcgtcagggagggaaagttggagcacaccctcgctagagatttagttcctggcgatactgtttgtttatcagttggcgacagagtcccagctgacctgcgcctttttgaggcagtagatctgtctattgacgaaagttctctcacaggcgaaacaaccccttgtagtaaggtgacagctccacagcccgctgctaccaatggggatctggcctcgcgatcaaatatcgccttcatgggaaccctggtgcgatgtggcaaagccaaaggcgtcgttattgggacaggcgagaatagcgaatttggcgaggtcttcaagatgatgcaggccgaagaagcaccaaagactccgctacagaaaagtatggatctgttgggtaagcagctgtccttctactccttcggaattatcggcataattatgctggttgggtggctgctgggtaaggatattctggagatgtttactatcagcgtgagcctcgccgtcgcagcaatccccgaggggctgcccatcgtggtgacagtgacgctcgcactgggcgtcatgcgcatggtaaaaaaacgcgctattgttaaaaagctgccaatcgtggagaccctgggatgttgcaacgtgatatgctccgataagactggtactttaaccaaaaacgaaatgacagtcactcatatcttcacttctgacggcctgcacgctgaggtgacgggggtcgggtacaaccagttcggcgaagtgattgtggatggggatgtggtgcacggattctacaatcctgctgtgtcccgaatcgtggaggcaggttgcgtgtgtaatgatgctgtgattcgcaacaacactctgatggggaagccaactgaaggtgccctcattgcccttgctatgaagatgggattggacggcttgcaacaagattatattcggaaagctgagtatccctttagttcggagcagaagtggatggccgtgaagtgcgtgcataggacccagcaggaccgtccagaaatctgttttatgaaaggcgcttacgaacaagtgattaaatactgcactacgtatcagtccaaggggcagaccctcacactcacgcaacaacagcgagacgtgtatcagcaggagaaggccaggatgggctcagctgggctgagagtgcttgccctagcaagcgggcctgaattggggcaacttaccttcctcggattggtcggcattattgacccaccgagaacaggcgtgaaagaggcagtgacaactttgattgcatctggagtatcgattaagatgattaccggtgactcccaggagaccgccgtggcgattgcctctcgattaggattgtactctaagacgtctcagtcagtctcaggggaagaaatagatgctatggatgtgcaacagctcagtcagatcgtgccgaaggtggccgtgttttatcgggcttctcctaggcacaagatgaaaatcattaagtccctgcagaaaaacgggtctgtggtggccatgactggggatggagtcaacgatgctgtagccctgaaagctgccgacataggcgtggccatggggcaaacaggcactgacgtttgtaaagaggcagcagatatgatcctcgtcgacgatgacttccagaccattatgtcggctattgaggagggtaagggcatctataacaacattaagaattttgtgcgctttcagctctccacaagcattgccgcacttaccttaatcagtctggcgaccttgatgaatttccccaatccactgaacgcaatgcagattctgtggatcaacatcatcatggacggccctccagcacagtcactgggagtggagccagtcgacaaggatgtcatccgcaaaccgccacgcaactggaaggacagcatcctgaccaagaacttgatcctgaaaatacttgtgtcctccatcatcatcgtgtgcggtaccctgtttgtgttctggagagagttacgagacaatgtcattactcctcgagacactacaatgaccttcacatgcttcgttttcttcgatatgtttaacgctcttagctccaggtcgcaaacaaagagcgtgttcgagatcggtctctgcagcaacagaatgttctgctatgcggttctaggaagcattatgggtcaactgctcgtaatttactttccccctctgcagaaggtcttccaaacagaatccttatctatcttggatctccttttcctcttgggtctgacgagctcagtctgcatagtcgccgagattatcaagaaagtggagcggagcagagagaagatccagaaacatgtatggctgtgggagcgcagcgggcagcaactggtagaaattcatcctcatctcgaaacggggctgcccctcactgaggacgtgtcctgcgtatag

SEQ ID NO: 215203 - DNA, 2835 bp, Artificial Sequence
  Description of Artificial Sequence: Synthetic coding sequence
atggatagtctgcttccacctagtaggttttcgtacttcaaaaagtaccctcttcatgcaataaggaggtacttaagcacactgagaaaccagagagcggaagagcaagttgccagatttcagaagattcccaatggcgaaaacgagacaatgatcccagtattgacttccaagaaggcttccgagttaccagtgtctgaagtcgcctcaatcctgcagtttaaaaatcccctgattatgcttctgctggccagtgccgtcatctctgttctcatgcatcaatttgacgatgcggtttcgatcacagtggcaattcttatcgttgttactgtggcattcgtgcaggaatataggagcgaaaagtccctggaggagctttccaagctcgttcctccagagtgtcattgcgtacgggaaggcaaactggagcacactctggccagggatttagtgcctggagacaccgtgtgtctctcagtgggcgacagggtgccagctgacctgcggttatttgaggcggtcgatcttagtatcgacgagagttcgctcaccggcgagaccacaccctgtagcaaggtaacagccccacagccagccgcaaccaacggcgacctggcctctagatctaacatcgctttcatggggaccttggttcggtgcggtaaagctaaaggagtcgttatcgggaccggcgaaaattcagaatttggcgaggtattcaaaatgatgcaggcggaagaagccccaaagacacctctgcagaaaagcatggatcttctagggaagcagctatcattctactctttcggcattataggcatcattatgctcgtcgggtggctgctgggcaaggatatcctggagatgtttacaatctccgtgtcactggccgtcgccgcaatccccgaaggcctccccatcgtcgttaccgtgacactagcattgggcgttatgcggatggtgaaaaaacgagcaattgtcaaaaaactgccaattgtggagactctgggatgctgcaacgtgatctgttctgataagaccggcaccctcactaaaaatgagatgactgtgactcacatcttcacctctgacggactgcacgctgaagttaccggcgtcggctacaatcagttcggagaagtcattgtggatggggatgtcgtgcatggattctacaacccagcagtatcacgcatcgtcgaggctggttgtgtgtgcaatgacgccgtgatcagaaacaatacactcatgggtaaaccaacagaaggtgctctgattgccctcgctatgaagatgggcctggatggtctgcaacaggactatattagaaaggccgaatacccttttagcagtgagcaaaaatggatggcagttaagtgtgtgcataggactcagcaggacaggcctgagatctgttttatgaagggggcatacgaacaggtaattaaatattgtactacataccaaagtaaaggacagactctcacactcacccagcaacagagagacgtgtatcagcaggagaaggcgaggatgggatcagcgggtcttcgggtcctggctttagcatcgggacctgagttaggccagcttacctttctgggcctggtgggtattatcgacccgccacggacgggggtgaaagaggctgtcacaacgcttatcgctagtggggtttccattaaaatgattaccggcgatagccaggagacagcagtcgctattgcatctcggctgggcctgtattccaagacctcacagtccgtctctggtgaagagatagatgccatggacgttcaacagctgtctcagattgtgccgaaggtggccgtcttttaccgcgcatccccaaggcacaagatgaaaataataaagtccttacagaagaacggatctgtcgtagctatgacaggcgatggcgtgaatgacgctgttgctttgaaagctgccgacatcggagtcgcaatggggcaaacaggcaccgatgtttgcaaagaggccgctgatatgatccttgtggacgacgatttccagaccatcatgtctgccattgaagaaggcaaagggatctacaacaatatcaaaaactttgtgcgctttcaactctctacttcaatcgcagccctcaccctcatttctctggccacactgatgaactttccaaacccccttaacgcaatgcagatcctgtggatcaacatcattatggacgggcctccagctcagagcctgggggtcgagcccgtcgataaagatgtgattcgcaagcctcctaggaattggaaggactctattttaacgaagaatctcatcctgaagattctagtttcttcaatcattatcgtctgcggcaccttatttgtattttggagagagctccgcgacaacgtcatcacccccagagacactactatgacttttacttgctttgtcttcttcgacatgttcaacgccctctccagtaggtcccagaccaaaagcgtgtttgagatcggactgtgttccaaccggatgttttgttacgccgtccttggtagtatcatgggacagctgctcgtcatctacttccctccactccagaaagtattccagaccgagtctttatccatactagacctgctgtttctgctcggtctcacttcatcggtgtgcatcgtggctgaaattatcaagaaagtcgagcgttctcgggagaaaattcagaagcacgttagcagtaccagttccagttttctggaagtgtggctctgggaacggagcgggcaacaactggtggagattcacccacatctggaaaccggcctccctttaacagaagacgttagttgtgtgtag

SEQ ID NO: 215204 - DNA, 2841 bp, Artificial Sequence
  Description of Artificial Sequence: Synthetic coding sequence
atggtcgagggtcgggtgtccgaattcctcaagaaactgggcttctctggcggtggtcgccagtaccaggccctcgagaaggacgaagaggaagccttgatagacgagcagagcgagctaaaagctattgaaaaagagaaaaaagtgaccgccctccctcctaaggaagcctgtaagtgccagaaggaggacctggcaagagcgttttgtgtcgacctgcacaccggactgtctgaattctctgttacgcagcggaggttggcccacggatggaacgagtttgtcgcggataacagcgagcctgtttggaaaaagtatttagatcagtttaaaaatccgctgattttgctgctgttgggatcagcgctggtatctgttctgactaaagagtatgaagacgctgtgtctattgccactgctgtgctagttgtcgtaaccgtggcgttcatccaggaataccgtagcgaaaagagccttgaggaattaactaaaatggtcccccctgaatgcaactgcctgagggagggaaaattacagcatctcctggcgagggagctggttcccggagatgttgtgagccttagcattggcgaccgtatacccgctgacatcagactgaccgaggttacggatcttctggtggacgagagtagtttcactggagaggccgagccttgctcaaaaaccgactcgcccttaactggagggggtgatctaaccacactatccaacattgtctttatggggacattggtgcagtacggccgtggacagggagttgtaatcgggacaggagagtcatctcagttcggcgaagtgtttaagatgatgcaggctgaggaaactccaaagacaccactgcagaaatctatggatagactggggaaacagcttacgctattttcttttgggataatcggtctcataatgctcattggatggtctcagggaaagcagctgctgtctatgttcactattggggtgtctttggccgttgccgcaattcccgagggactccctattgtggttatggtgaccctcgtcctcggagttttgagaatggctaagaagagggtgatcgtcaagaaactgcccatagtcgagacgctggggtgctgcagcgtgctgtgtagtgataagactggcaccctgacggccaacgaaatgacggtgacccagctagtgacctccgatggccttagagccgaggtcagcggtgtgggctatgacgggcagggcacagtctgtctgctccctagtaaagaagtgattaaggagttctcaaatgtgtctgtcggcaagctagtggaagctggctgtgtggcaaacaacgcggttattcggaaaaacgctgtcatggggcaaccgaccgagggggctctcatggcgctggctatgaagatggatctcagtgatataaaaaatagttacattagaaaaaaggaaatcccctttagcagtgagcagaagtggatggctgttaagtgcagccttaaaacagaagaccaggaagatatctactttatgaagggggctctcgaggaagttatccgctactgcactatgtataataacggcggaatccctctgcctttgaccccccagcaaaggagtttttgtctacaggaagagaagcgcatggggagccttggcctcagagtgctggcactcgcctccgggccagagcttgggcgtctcacatttctgggattggttgggattatcgatccacccagagtaggtgtaaaggaagccgtgcaggtgctttcagaatcaggggtttccgtgaaaatgatcacgggcgacgcactcgagacagccttagcaatcggcagaaatataggtctatgtaacggcaaactgcaggctatgagtggagaggaggtcgacagcgtcgaaaaaggagagcttgccgacagggtcggtaaagtttccgtgttcttccgaactagcccaaaacacaagctgaaaatcattaaagctctccaagaaagtggcgcaattgtggccatgactggagatggagtcaatgacgctgtggcactgaaaagcgcggacatcggcatagctatggggcaaaccggaaccgacgtgtcaaaagaggctgccaacatgatcttggtagacgacgacttctcagcaataatgaatgctgttgaggagggaaaggggatcttttataatatcaaaaacttcgtgcgtttccaactgagcactagcatttctgcacttagtctgataacactctcaaccgtctttaacctcccatccccactcaacgccatgcagatcctgtggatcaacattatcatggacggaccacccgcacagagcctgggcgtggaaccagtggacaaggacgccttcagacagcccccacgctccgtgcgcgataccatcctgtctcgcgcactgattttaaaaatcctaatgagcgctgccattatcatcagcggaacattatttatcttctggaaggagatgccagaggacagagcctccaccccaaggactactaccatgacttttacctgtttcgtgttctttgacctgttcaacgcactgacatgcaggtctcaaaccaaacttatctttgaaatcgggtttctgcgcaaccacatgttcctatacagcgtgctgggctcaattttgggccaactggcagtgatttatatccccccactgcagagggtgttccagaccgagaatctgggagcacttgacctgctctttctgaccgggctggcatcgagcgtttttattctttcagaattattgaaactgtgcgagaaatactgctgttcccccaaaagagtacagatgcaccccgaagatgtgtag

SEQ ID NO: 215205 - DNA, 2928 bp, Artificial Sequence
  Description of Artificial Sequence: Synthetic coding sequence
atggttgaaggaagggtatctgagttccttaagaagttagggtttagcggcggtggtagacagtaccaagctctggaaaaggacgaagaggaagctctaatcgatgagcagtccgaattaaaagctattgagaaagagaagaaggtcactgccctccctcctaaagaggcatgtaagtgccagaaggaggacctggccagagccttctgcgtggacctgcacactggcttgtctgagttcagtgttacacagcgtcgactggcccacggctggaatgagttcgtagccgacaattctgagccagtctggaaaaaatacctggaccagttcaagaacccgctgatactgctactcctgggaagtgccttggtttcggtcctcaccaaggaatatgaagatgccgtgagcattgcaacagcggtcctcgtcgttgtgacagtcgcatttatccaggaatacaggtccgagaagtcccttgaagagctgactaagatggtccctccagaatgcaattgtctgcgggagggcaagctgcagcatctgcttgcccgtgaactcgtgccgggagacgtggtgagtctgtcaatcggcgatcgcatcccggctgacatccggctgacagaggtaacagacctgcttgtggacgaaagctctttcacaggggaggccgagccctgcagcaagacagactccccgctcaccggaggaggcgacttgaccacactgagcaacatcgtatttatgggaaccctggtacagtacggcagggggcaaggggtggtcattggcacaggcgagagctcacaattcggggaagtctttaaaatgatgcaggctgaggaaactccaaaaacacccctgcagaagagcatggatagactggggaagcagttgacgctcttttccttcgggatcatcggtctgatcatgcttattggctggtcacaggggaaacaactcctcagtatgttcaccataggagtctcactggcagtagccgcaattccagaggggctccccatcgtggtcatggtcacactggtcctgggagtgttacgcatggccaagaaacgagtcattgtgaaaaagttaccgattgtggagactctgggatgctgttctgtgctttgttctgacaaaacaggcaccctcacggctaatgaaatgactgtgacacaattggtgacgagcgacggtttacgagcagaggttagtggggtgggctatgatggccaagggactgtgtgtctactgccaagcaaggaagtaataaaagaattttctaacgtgagcgtggggaaactggtggaggccggatgcgtggctaacaacgccgtgatacggaaaaacgctgtgatgggccagccaacagagggagccctgatggccctggctatgaagatggatctgagtgatattaagaatagctacatcaggaaaaaggagattccattctcttcagagcagaagtggatggccgtgaagtgttcgctgaagacagaagatcaagaggatatatacttcatgaaaggtgctcttgaggaagtgatcaggtactgcaccatgtacaacaatgggggaattccactgccacttaccccacaacagaggtctttctgtttacaggaagagaagcggatgggatcgctggggctacgggttctcgccctcgcatctgggccagagctcggccgattaactttcttgggactggttggcatcatcgatcctcccagggtcggtgtcaaagaggccgtgcaagtgttatcggagtctggcgtttctgttaaaatgattaccggagatgcactcgaaaccgctttagccataggtcgaaatattggattatgcaatggaaaacttcaggccatgtctggagaagaagtggactctgtggagaagggtgagttagccgacagggtggggaaagtgtcagttttcttccgtacgagtccaaaacacaagcttaaaatcataaaggcacttcaggaaagtggcgcaattgtggccatgacaggggatggagtgaacgacgctgtggcgctgaagtctgccgacattgggattgctatgggtcagaccggcacagatgtgtcgaaagaagcagctaacatgatcctggtggacgatgatttctccgcaattatgaatgctgtcgaggaaggaaaaggcattttctataatattaagaactttgtccgctttcaattgtccacaagcatctctgctctgtccctcatcactttatcaaccgtgttcaatctccctagcccgctgaacgccatgcagatcctttggattaacattatcatggatggcccaccagctcagaggtcgagccaaaaaacagaagtttgctgcaccgcggtgagactaggcgtcgaaggcaggggggaatccacctgggctggtcgggcagggctgggagtggaaccggtagataaggacgctttccgtcagccacccaggagcgtgagagatacaatcctgtctagagccttgattcttaaaattctgatgtccgcagctattataatcagcgggactctattcattttttggaaagaaatgccggaggacagagctagcactcctagaacaacgaccatgactttcacgtgctttgttttttttgacctgtttaacgcgcttacctgtagatctcagacaaagctaatctttgaaatcggcttcctgcgtaatcatatgtttctctatagcgttctgggcagtatcctggggcagctcgcggtgatttacattcctccactccagagggtgttccaaacagaaaacctcggcgctttggatttactctttctgaccggccttgccagcagtgtctttattctgtctgaactgctgaaattatgtgagaaatattgttgctcccctaagagggttcagatgcatccggaggacgtttag

SEQ ID NO: 215206 - DNA, 2388 bp, Artificial Sequence
  Description of Artificial Sequence: Synthetic coding sequence
atgcgcaccccttcagcctctcccaggcagtgtttgtcatggtcactctcccccagtagcagtctccgcgaaggcaaattacagcacctattagccagggaactggttccaggagacgtcgtgagtctgtccatcggcgatcgcattcccgcagacattcgcctcactgaagtaacagatctgttagtcgatgaatctagctttaccggtgaagccgagccgtgctctaaaaccgattctcccctgaccggagggggagacctgacgacgctgagtaacatcgtattcatgggtaccttagttcaatatggccgagggcagggcgtggtaatagggaccggggaaagttcacagtttggggaagtgttcaagatgatgcaggctgaggagacccccaaaacccctctccagaagagcatggaccgcctgggtaaacaactcacgttgtttagctttggcattatcgggctaataatgctcatcgggtggtcacagggtaaacagctcctgtctatgtttaccatcggggtatccctggccgtcgccgctatcccagaaggactgcctatcgtggttatggtcaccctggtactgggggtgcttaggatggccaaaaaacgcgtgatcgtgaagaagttaccgattgtggaaacacttggatgttgcagcgtgctgtgctccgacaagacaggaactctgacagccaatgaaatgaccgtgacccagctggtcacatcagatggacttagagcagaagttagtggcgtcgggtacgatgggcaggggacggtttgtcttctgccctccaaggaggtgattaaagagttttctaacgttagtgtgggaaagctggtagaggcgggttgtgtggcaaacaatgccgtgattagaaagaatgctgtgatgggacagcctacggagggtgctcttatggccctggccatgaaaatggacctgagcgatatcaagaactcttatatccggaagaaagagatcccattcagcagcgagcaaaaatggatggcagtaaaatgcagtctgaagacggaagatcaagaggatatctatttcatgaagggagctctcgaagaagtgattagatactgcacaatgtacaataacggcggtatacctctacctctgacccctcaacagcgcagcttttgtctccaggaagagaaaagaatggggtccttgggattaagggtgctggcattggcctcagggcctgaactgggacgcttaacttttcttggactggtaggcatcatagatcctccaagggtgggcgtcaaagaagccgtgcaagtcctgtccgagtcaggagtttcggtcaaaatgattacaggcgacgccctggagaccgcgctggctataggccgaaatatcgggctctgcaatggtaaactgcaggcgatgtcaggcgaggaggttgactctgttgagaaaggagagctggccgaccgcgtgggcaaggtctccgtgttttttcgcacctcaccaaagcataagctaaaaattatcaaggcactccaggaatctggcgcaatcgtggctatgacaggagacggcgtaaacgacgctgtggcgctaaagagcgccgatattgggattgccatgggacagacaggaaccgatgtgtctaaggaggcagccaatatgattctcgtcgatgatgacttcagtgcaattatgaacgcagtggaggagggtaaaggcattttttacaatattaaaaatttcgttaggtttcagctatccactagtatctctgctctttccctcatcacgctgtccactgtttttaatctcccctccccactgaatgcgatgcagatcctgtggattaacataatcatggacggccctccggctcagtcgcttggggtggaaccggtcgataaggacgcctttagacaaccccctcggtcagttcgcgatactatcttgtcccgcgcactgattcttaaaatcttgatgtccgctgctatcatcatcagtggaaccttgtttatcttttggaaagagatgccagaggatcgagcttcaactccccgtacaaccactatgaccttcacatgcttcgtcttcttcgatctgtttaacgcactcacctgtcggagccagaccaagcttattttcgagatcggctttctgagaaaccacatgtttttgtattccgtcctaggcagcattcttgggcagctcgctgtcatttacatcccccctctgcaacgtgttttccagaccgagaatctgggcgcactggacctcctgtttctgacgggcctcgctagctctgtgttcattctcagcgaactgctgaaactgtgtgagaagtactgctgttcacccaagcgcgtccagatgcaccccgaggatgtgtag

SEQ ID NO: 215207 - DNA, 3090 bp, Artificial Sequence
  Description of Artificial Sequence: Synthetic coding sequence
atggaagcagctcacctgttacccgcagcagacgtcctacggcacttctcagttactgccgagggaggcctcagcccggcacaggtgaccggcgcacgtgaacgctatggacccaacgagctaccatccgaggagggtaagtcattgtgggagctggtgctggagcaattcgaagacctgcttgtgaggatactgctgttggccgcactggtaagcttcgtcctggcatggtttgaagaaggtgaggaaacaaccacggcatttgtcgaacccctggttattatgctgattctagtggccaatgctatcgtgggggtttggcaggaaaggaacgcagagagcgccattgaggctctgaaagagtatgaacctgagatgggaaaagtaattagatctgatcgcaaaggggtccagcggattagagcacgagatatagtgccgggagatattgtggaggtggccgtcggagacaaagtccctgccgatctgagactgatcgagatcaaatcaacaacactgagagttgaccagagtattctcacgggggagtccgtgtccgttactaaacacaccgaagctatccctgaccctcgtgccgtcaaccaggataaaaaaaatatgcttttttccgggacgaatatcaccagtgggaaggcagtcggagtcgccgtcgcgaccggcttacatactgaactcggtaagattaggtcccagatggccgctgtggaacccgagcgcacacctctgcaacggaaactcgacgagttcgggaggcagcttagtcatgctatctcggtgatctgtgtggcagtctgggttataaacattggccattttgcagacccagcccatgggggtagctggctcaggggggctgtatactattttaagattgcggttgccctggccgtcgcagcgatccctgagggactgccagccgtaatcaccacttgcctagccctggggacccgtcggatggccaggaaaaatgctatcgtacgcagcttacctagtgtggagactctgggatgtactagtgttatctgctcagacaagactggcacccttaccaccaaccaaatgagcgtgtgtaggatgtttgtggttgcggaggccgacgctggatcttgcctgttacacgagttcacgattagtgggaccacatacacccctgagggcgaagtgagacaaggcgatcagcccgtgagatgcggacagtttgacgggctcgtcgagctggccacaatctgtgccctatgcaatgatagtgcactggactataatgaagctaaaggagtatacgagaaagttggagaagccacggagaccgccctgacgtgtctggtggagaagatgaatgtgtttgatactgacttacaagccctgagcagagtggagcgcgctggcgcttgtaacacagtgattaaacagctgatgaggaaggagtttaccttggagttctcccgtgaccgcaagagtatgtccgtgtattgtacacctacaagaccccaccctaccggacagggctcgaaaatgttcgtgaagggtgcaccagagagcgtgatcgagagatgctcgtcagtccgcgtaggatctcgcaccgcaccactcacccctacctctagggagcaaatcctggccaagattcgtgactggggcagcggctcagacaccctgagatgtctggccttggccaccagagacgcccctcctaggaaggaggacatggaactggacgattgtagcaaatttgtccagtacgagactgacctaacgttcgtgggttgtgttggaatgctagatccgccacggccagaggttgcagcatgcattacacgctgctatcaggcaggaattagggtggttatgatcaccggcgataataagggaaccgccgtggctatctgccgacgccttgggattttcggtgacaccgaagacgttgctggtaaggcctacacggggagggagtttgatgaccttagcccagagcagcagagacaggcgtgccgcacggcaaggtgctttgctagggtggaacctgcacacaagtctcgcatagtagaaaatcttcagtcttttaatgagatcaccgctatgaccggtgacggtgtgaacgacgcccctgccctgaagaaagcagagatcggcatagccatgggcagcgggactgccgtggccaagtctgcggcagagatggtgctgagcgatgacaacttcgcaagcattgtggctgctgtggaagagggacgcgcaatctactcaaacatgaagcagtttattcggtatctgatctcctccaacgtgggagaggtcgtctgcatttttctgactgccattttagggttgccagaggcactcatcccggtgcagctgctttgggtgaacctcgtcacagacggactgccagccaccgctctcggcttcaatccccctgatctggacatcatggagaaattaccccgttctccccgtgaagctctcatcagcggctggctgttcttccgctatctggcaatcggcgtatacgttggcctggctactgtggcggcagccacctggtggttcgtttatgatgctgagggcccacacattaacttctaccagctgcggaattttctcaaatgctccgaagataacccactgttcgccggaatcgattgtgaggtgttcgagtcacggtttcctactaccatggcactgagtgttctggtaactattgaaatgtgcaacgctctcaatagcgtctcagagaatcagtctttgctcaggatgcccccatggatgaacccttggttattagtcgctgtcgccatgagcatggcattgcattttctaatactactcgtaccacctcttcccctgatttttcaggtgacaccactgagcggaaggcagtgggttgtggtgcttcaaattagcctgccagtgattctgcttgacgaggcactgaaatatttatcccgcaaccatatgcacgcctgtctctaccctgggttgctcagaaccgtgtcgcaagcatggtcacgccagcctcttaccacctcctggacacctgatcacacaggtttagccagtctgaagaagtag

SEQ ID NO: 215208 - DNA, 3132 bp, Artificial Sequence
  Description of Artificial Sequence: Synthetic coding sequence
atggaagctgctcaccttctgcctgcggctgatgtcttgcggcacttcagtgtgaccgcagaggggggtttgagtcctgctcaggtgactggcgcacgtgaaagatacggtcccaacgaactccctagtgaagagggcaaaagtctatgggagcttgtgctcgaacaattcgaagacctattggttcgcattctgttgttggccgcactcgtgtcatttgtgctcgcctggttcgaggagggggaggagacaacaactgcgttcgtggagcctctggtaatcatgctaattcttgtggccaacgctatagtgggagtgtggcaagaaagaaacgccgagagtgcgatagaggcactgaaggaatacgagcctgaaatgggcaaagtcatccggtccgaccgcaaaggggtgcaacggattcgggctagagacatcgtccctggcgacatcgtggaagtcgccgtaggggataaagtgccggcagacctccgcctgatagaaataaagagcactacactgagagttgatcaatcaatactcaccggagaaagtgtgagcgtgaccaaacacacagaggccattcccgaccctcgtgccgtcaatcaggataaaaaaaacatgctcttcagcggcactaatatcacgagtgggaaagccgtgggagtagccgtggcaacaggactgcacacagaactgggtaaaatacgcagccagatggctgccgtggaaccggaacggacccccctgcagaggaagctggatgagtttgggcgtcaactgagtcatgcaatcagcgttatttgtgttgcagtgtgggttattaacattgggcatttcgccgatcccgctcatggaggttcatggttgaggggcgctgtatactatttcaaaattgccgtcgctcttgcggtcgccgcaattccagaaggactccccgctgtgattactacatgcctggcgcttggcacccggaggatggcgaggaaaaacgctatcgttcggtcattgcctagtgtcgagacacttggctgtacatcagtgatttgttcagacaagacaggcacgctaaccaccaatcagatgagtgtctgtaggatgtttgtggtcgcggaggccgacgctggtagctgcctgctgcacgagttcaccatcagtgggacgacctataccccagaaggagaagtgaggcagggagatcagccagtgagatgcgggcagttcgacggcctggtggagctcgccactatatgcgcactctgcaacgactcagcattggattataatgaggccaaaggggtgtatgagaaggtcggcgaggcaaccgagacagcactgacgtgccttgtcgaaaaaatgaatgtatttgacaccgacctgcaggccctaagccgagtggaaagagccggagcctgcaacaccgtgattaagcagcttatgcgcaaggaatttaccctggagttcagcagagaccgcaagagcatgtccgtgtactgtacaccaacaaggcctcatcccacgggacaaggctccaaaatgtttgtaaagggtgcaccggaaagcgtcattgaaaggtgctcaagcgttcgcgtcggtagtcgtacagccccattgaccccaacaagccgagaacagattctagccaaaattcgcgactggggctccggcagcgacacattaagatgtcttgccttagctacaagagatgcaccgccaagaaaagaagatatggaattggacgactgttccaaatttgtgcaatacgaaaccgatttaacatttgtcggatgcgtgggaatgctggatccacctcgtcctgaggtcgccgcttgtatcacacggtgctaccaggctggcatccgtgtggtaatgattacaggcgacaacaaaggtacagcagtcgcaatttgcaggcgcttaggaatttttggagataccgaggacgtggcgggaaaagcctatacgggtcgagagtttgacgatctgagccctgagcaacagcgacaggcctgtagaacagccagatgttttgctcgtgtggagccggctcataaaagccgtatagtggagaaccttcagagctttaatgaaataacggcgatgaccggagacggagttaatgatgccccagccttgaagaaagctgagatagggatcgctatgggctctggcacagccgtcgccaaatccgccgctgaaatggtgctctcagacgacaactttgcatccattgtggctgctgtcgaggaagggagggcaatctactccaacatgaaacagttcattcgctaccttatttcatccaatgtcggagaagtggtgtgtattttcctgacagcaatactgggacttccagaggcattgatccctgtacagctcctgtgggtcaatttggtgaccgacggtctacccgctactgccctggggttcaacccccctgacctggacattatggaaaaattgcccagaagtcccagggaggcgcttataagtggatggctgtttttccgataccttgcaataggagtgtatgtcgggcttgccacagtcgccgctgcaacctggtggtttgtgtacgatgccgagggcccacacatcaatttttaccagctgagaaatttcctcaagtgcagcgaggataaccctctattcgccggaatagactgcgaggtgttcgaaagcaggttccccacaactatggctctgtctgtgttggtaacaattgagatgtgtaatgccttaaactcagtatccgagaaccagtcattgcttagaatgcccccttggatgaatccttggctgctggtggctgttgcgatgtcaatggccctccacttcttgatcctgcttgtcccccctctcccgctgatctttcaggtgactcctctatccgggaggcagtgggtcgttgtactgcaaattagcctgccagtcatattgctggatgaggcactcaagtacctgtcccgcaatcacatgcatgcctgcctgtatcccggtttgctgcgcaccgtttcacaagcctggagtcgccaacctctgaccaccagctggacacctgaccatacaggacgaaacgaacctgaggtgtctgctggaaatcgggttgagtccccggtttgcacctcagactag

SEQ ID NO: 215209 - DNA, 3159 bp, Artificial Sequence
  Description of Artificial Sequence: Synthetic coding sequence
atggaggctgcgcacttgcttcccgctgccgatgtgctgaggcacttttctgtgacagccgagggcggtctttcacctgcacaggtgacaggggcacgggaaagatacggccctaatgagcttccgtccgaggaagggaaatctttatgggagctggttttagagcagttcgaggatctgctggttaggattctgttgttagcggctttagtctctttcgtgcttgcatggttcgaggaaggtgaagagaccactacagccttcgtggaacctctggtgataatgctaattttagtcgctaatgctatcgtgggcgtatggcaagaacgaaacgccgagagtgccatcgaggccctaaaggaatacgagcctgagatggggaaggtcatcaggtctgacagaaaaggcgttcagagaattcgagcccgagatatcgtcccgggagacatcgtcgaggtagcggttggcgataaggtaccggcagacttgaggctcattgaaattaaaagcactacacttcgcgtcgaccaatctatcctgacaggagagtctgtttctgttaccaaacatactgaggcgattcctgatcccagggccgtaaaccaggacaagaagaacatgttgttcagcgggactaacatcaccagtgggaaggccgtaggcgttgccgtggccactggcctgcacaccgaactgggtaaaattaggtcccagatggccgcagttgaaccagaaagaacaccgctgcagaggaagctggacgagtttgggcgacagctctcccacgctatctcagtcatatgtgtggctgtttgggttataaacatcggccacttcgccgatcccgctcatgggggtagttggttgagaggggctgtgtattacttcaagatcgccgtggcactcgctgtggccgcaataccggaagggctgcccgcagttatcaccacttgcttagccctggggactagaagaatggcacggaagaacgcaattgttcggtcactgccaagtgtggagacgctgggatgcacaagtgtaatctgctcggacaagaccggcacgctgacaaccaaccagatgagtgtgtgtagaatgttcgttgtggcggaggccgacgccggatcctgcctgttacatgaatttaccatctccgggacaacatatacacctgaaggagaggtacgccaaggtgatcagccagttcggtgcggccaatttgacggtctcgtggaattggctacaatttgtgctctgtgtaacgattcagccctggactataatgaagcaaaaggtgtgtacgagaaggtcggggaggcaacagagaccgctttaacatgtctcgtggaaaagatgaacgtgttcgatacagatttacaggcgcttagtcgagtggaacgagctggcgcatgcaataccgtcataaagcaactgatgcgaaaggagttcaccctcgaattcagcagggatagaaagagcatgtctgtgtactgcactcctacccggcctcatcctacaggacagggatctaagatgtttgtcaaaggagcccctgagtcagtgatcgaacgatgcagtagtgtcagggttgggtccagaacggcacccttgacccctacctctcgagaacaaatactcgctaaaatcagagactggggttccggcagcgacaccctccgctgtcttgccctggccaccagggatgcccctcctagaaaggaagatatggagctggatgactgctccaagttcgtccagtacgaaacagacctcactttcgtggggtgtgtaggtatgctggacccaccacgcccagaagttgccgcatgtatcacaagatgctaccaagctgggattcgcgtagtgatgattaccggcgacaataaaggcacggctgtagcaatttgcaggagactaggcattttcggcgacaccgaagatgtggctggaaaggcctacaccgggagggagtttgatgacctatctcccgagcaacaaaggcaggcttgccgaaccgccaggtgcttcgctagggtagagcctgcccacaagtcacggatcgtggaaaacctccaatcctttaatgaaatcacggccatgactggggatggagtgaatgacgctcccgcactcaagaaagcggagataggcatcgcaatgggatccggcactgccgtggcgaagtctgccgctgagatggtcctgagtgacgataattttgcaagcattgtggccgcagtggaggagggaagggcgatctactcgaatatgaaacagtttattcgttacttaatctcctcaaatgtgggcgaggtggtctgcatttttctgacagccatcctagggttaccagaagcattgatcccagttcaactgctgtgggttaacctagtgacagacggcctgccagctaccgccctcggctttaatccgcctgacctggatatcatggagaaactgccgcgttccccccgagaggctctgatttctgggtggctgttcttcagatacctggccattggtgtttacgtcggtttagccaccgtcgcagccgctacatggtggtttgtctatgacgccgagggcccacatataaacttttatcagctacgaaactttctcaagtgctcagaagacaaccccctctttgctgggatcgattgtgaagtgtttgagtcgagattcccaaccacaatggctctgtccgttttagttacaattgaaatgtgtaacgcactcaactccgtgtcggagaaccagtccctgttgcgcatgccaccatggatgaatccgtggctgttggtcgccgtggctatgagtatggcgctccacttccttatcctgctagtgccaccactgccactcattttccaggtcacgcccttgtccggtcggcagtgggtggttgtgctgcagatttctctgcccgtcatcctcctggatgaggcacttaagtacctgagtcgtaatcacatgcacgcttgtctgtaccctggcctactccggactgtatcacaggcttggtcccggcaaccacttacaacctcctggactcctgatcacacaggtctggcaagcctgggtcaaggccatagcatcgtttccctttcagagctacttagagaagggggaagccgagaggaaatgtcccagaagtag

SEQ ID NO: 215210 - DNA, 3090 bp, Artificial Sequence
  Description of Artificial Sequence: Synthetic coding sequence
atggaggcagcgcacttactacctgcagccgatgtgctgagacactttagcgtcacagccgagggtggcctatctcctgcccaggttaccggggctcgtgaacgatatggacctaacgaactgccgagcgaggagggaaaatccctgtgggagctggtactagagcagttcgaagatctactggtgcgaatactgttgctggctgccctggtgagctttgtgctggcctggtttgaggaaggcgaggagactacgacagcttttgtggaaccactggtgattatgcttatccttgtcgcaaatgcgattgtgggagtgtggcaggaaagaaacgctgagtcagccatagaggccctcaaagaatacgagccagaaatggggaaggtgataagatcagaccggaaaggggtccagcgcattcgggcacgcgatatcgttcctggcgacattgtggaagttgcagtgggagacaaggtaccggctgacctgagactgattgagatcaagtccacaaccctgagagtggatcagagtatcctgactggcgagtctgtgtccgtgaccaagcacaccgaggcaattccagaccctagggcagtgaatcaagataagaaaaatatgctattttccggtacgaatatcacatccggaaaggccgtcggggtcgcggtggctaccgggttacacactgaactcggtaaaatccgcagtcagatggctgctgtggagcccgagcgtacgcctctgcaaagaaagcttgacgaatttggtaggcagctgtctcatgctatctccgtgatatgtgtggcggtatgggtaatcaacatcggccatttcgccgatcccgctcatggcggaagctggcttagaggcgcagtgtactatttcaagatcgctgtagctctggctgtagcagcaattccggaaggcctaccagccgttattactacttgcctcgcgctgggcacccggagaatggcccgaaaaaatgcaattgttaggagtttgccgtccgtagaaacattagggtgtacgtctgttatatgtagtgacaagactggtactctcaccacaaatcagatgtctgtttgcagaatgttcgtagtggccgaggccgatgccggaagttgcctcttgcacgagttcacaatatctggaacaacctacacacccgaaggggaggtccgacagggtgaccagccggtgcgatgcggacagttcgatggcttagtggaactggcaaccatttgcgccctctgtaatgacagtgccttggactacaacgaggctaaaggcgtgtacgagaaagtgggagaggccacagaaaccgcgttgacttgtctggtggagaaaatgaacgtttttgatacagatctgcaggcgctgtcccgagtggaacgcgcaggtgcttgtaataccgtgattaagcaactcatgagaaaggaatttacactagagttcagccgcgatcggaagtccatgagcgtgtattgtacccctactagaccacatcctactgggcaggggagcaagatgtttgtcaagggtgcacctgaatccgtcattgaaagatgtagcagcgtccgcgtgggctcgcggaccgcccctcttacccctaccagtcgggaacagatcttagcaaagattcgggactggggctcaggatctgacaccctcagatgtctggcactggcgacaagagacgcacctcccaggaaagaagacatggagctggacgattgcagtaaatttgtgcaatacgagaccgacctgacattcgtgggctgtgtaggaatgctcgacccacctaggccagaggtggcagcatgtataaccagatgttatcaggcaggaatcagagtggtgatgataaccggagacaacaaaggcactgctgtggctatttgccggagactggggatattcggcgacacggaggacgtggccggaaaggcctacaccggaagagagttcgacgatctgtcccccgaacagcagcggcaagcctgtcggacagctcgctgcttcgctcgagtggagccagcgcataaaagcaggatcgtcgaaaatctgcagtcgttcaacgagatcaccgcaatgacaggagatggggtcaacgatgcgcctgcgctgaaaaaagccgaaattgggatcgccatgggaagcggaaccgctgtggctaagagcgccgcagaaatggtcctaagcgatgataatttcgcatccatcgtcgctgctgtcgaagaaggccgtgcgatctactccaatatgaagcagttcataagatatttaatatcatctaacgtcggcgaggtggtatgtatctttctcaccgcaatcctaggattgccagaggcgctgattcccgttcagttgctgtgggtcaacctggtgaccgatgggctgccagcaactgcactggggtttaatccccctgacctggatattatggagaagctcccgaggagtccaagagaagcgttgatcagcggttggctgtttttccgctacctcgccattggggtgtatgtgggacttgctactgttgccgctgctacatggtggtttgtttacgacgccgaaggcccacatattaacttttatcagctgcggaacttcctgaagtgctctgaagacaatccactgtttgcagggatcgattgtgaagtgtttgagtccaggtttccaaccacaatggctctgtccgtgcttgttacaatcgaaatgtgtaatgccctgaacagcgtgagcgaaaatcagagtctgcttcggatgcccccatggatgaacccatggctcttggtggcagtggccatgagtatggccttacacttcctcattctgctggtgccccctctgccattaatctttcaggttactccgctctcagggcgtcagtgggtggttgtgctacaaatctcactgcccgtcattctgcttgatgaggctctgaaatacctatctcggaaccacatgcatgcctgcctgtatcccggtttactgaggaccgtgagtcaggcctggtcgcggcagcccctgactacttcctggacccccgatcataccggcctggcctcccttaagaagtag

SEQ ID NO: 215211 - DNA, 651 bp, Artificial Sequence
  Description of Artificial Sequence: Synthetic coding sequence
atggagaaattgccgagatcgcctcgtgaggccctgattagtgggtggctattttttaggtatctggcaatcggagtgtacgtcggtctagccacagtggcagctgcaacgtggtggttcgtgtatgatgctgaggggccacacatcaatttctatcagctgcgtaactttctgaagtgcagtgaggataatcccctatttgctggtatcgactgcgaagtgttcgaatcccggttccctacaacaatggctctgtctgtcttggtgaccatcgagatgtgtaatgcacttaacagcgtaagcgagaatcaatcgctgcttagaatgcctccctggatgaacccttggctgctggtcgcagtagccatgtctatggcactgcatttcctcattctccttgtgccgcctctgccccttattttccaggttacacccttgtcgggacgtcagtgggttgtcgttctgcagatcagtttacccgtgatcctgctggacgaggcattaaaatatctgagtcggaatcatatgcatgggcctggaactcagcatcgattagccgtccgcgctgcccagaggggcaggaagcaaggcaggaacgagcccgaggtcagcgccggtaatcgggtggaatcacccggtcctggcggttag

SEQ ID NO: 215212 - DNA, 3000 bp, Artificial Sequence
  Description of Artificial Sequence: Synthetic coding sequence
atggaagctgctcacctcctgcccgcagccgacgtgctccgccattttagcgtgacggctgaagggggactgtccccagcccaggtaaccggagctagagagcggtatggcccaaatgagctgccttctgaagagggaaagtcgttgtgggaactcgtcctggaacagtttgaggacttgctcgtcagaattctgctccttgccgcattggtgtcgtttgtgctggcctggttcgaggaaggggaagagacaaccaccgcattcgtggaacccctggtcattatgcttatcctggtggccaacgcaatcgttggagtctggcaggaaagaaacgcagagagcgccattgaagccctcaaagagtacgagccggaaatgggtaaagttatacgctcagataggaaaggcgtccaaaggattcgcgcaagagacatcgtgcccggagatattgtggaggtggccgtcggtgataaggtacccgcagatctccgccttatagaaatcaagagcaccacactgagagtggaccaaagcattctgacgggggaaagtgtaagtgtaaccaagcacactgaggctattcctgaccctagggccgtgaatcaggacaaaaaaaatatgctcttttctggaaccaacatcacctctggaaaagcggttggagtcgcggtggccacgggcctgcacaccgagttagggaaaataaggtcacaaatggcagcagttgagcccgagagaactcccttgcaacggaagctcgatgaatttgggagacagctgtctcatgctattagcgtgatctgcgtcgctgtctgggtaatcaatatcggccactttgccgatccggcacatggcggatcttggctccgcggtgcagtctactattttaaaatagccgtcgctctggccgtggccgctatccctgagggcctacctgccgttattacgacctgccttgctctgggcactcggaggatggctagaaaaaatgcaattgtgaggtcactaccttcggttgagaccctgggctgtactagcgtgatctgtagcgataagactgggacactgaccacaaatcagatgtccgtttgcaggatgtttgtcgtggctgaggctgatgctggatcctgcctgctgcacgagttcaccatatctggaactacctacacaccggagggcgaggtacggcagggagaccaacctgtcagatgtggacaatttgatggtctcgtggagctggccaccatctgcgcgctgtgcaacgacagcgcgcttgactataatgaggccaaaggagtttacgaaaaagttggcgaggctacggaaacagcactcacatgccttgtggagaaaatgaatgtttttgacacagacctccaagcattgagtagagttgaacgtgcgggtgcctgcaacacagtgattaaacagcttatgagaaaagagtttaccctggaattctctagggatcggaaatccatgtcggtttactgcaccccaaccagacctcatccaactggacagggaagtaagatgtttgttaagggcgctccagaaagcgtaattgagcgttgctcctctgttagagtaggctcacgcaccgcacccctgactcctaccagccgagagcaaattctcgccaaaatccgcgattgggggtcagggagcgacacacttcgatgcctcgccctcgcgacccgggacgctcccccaagaaaagaggacatggagttagacgactgcagtaagttcgtgcagtacgagacggacctgacatttgtcggatgcgtagggatgttggatccacctaggcccgaggttgccgcatgtatcactagatgttaccaggctggcattcgcgtggtcatgatcaccggcgacaataagggaaccgccgttgccatttgccggcgactcggaatctttggcgatactgaggacgtcgccggtaaagcctatacaggtcgcgaattcgacgatctgtcgcctgagcagcaacgccaagcctgccggaccgctagatgttttgcgagggtagagcccgctcacaagtctagaatcgtggaaaatttgcagagcttcaacgaaatcacggccatgacaggtgatggcgttaatgatgcccctgcactgaagaaggccgaaatagggatcgcaatgggttcggggacagccgtggccaaatctgccgcagagatggtgttgtcagacgataatttcgccagtatcgtggcagccgtcgaagaaggtcgagctatttacagcaacatgaagcagtttatcaggtatctgatcagctccaatgtcggagaggtggtctgcatttttttaaccgctatcctgggccttcccgaggccctaattcctgtccagctgctgtgggtcaatctcgtcactgacggcctgccggcaaccgccctcggttttaacccccctgaccttgacatcatggaaaagctgccgcgaagcccacgtgaggctctaatatccgggtggctgttttttcgctatctagctattggtgtttacgtgggactagccacggtcgccgctgctacttggtggttcgtgtatgacgctgagggacctcatatcaatttttatcaattgcgcaatttccttaaatgctcggaagacaaccccctgtttgccggaatcgattgtgaggtgtttgaatccagattccccacaacgatggcccttagcgtgctggtcaccattgagatgtgtaacgctctgaatagcgtgtcagaaaaccagtcattattaaggatgccgccttggatgaacccctggctgctggttgctgtggccatgagtatggctctgcattttctcatattactggtgcccccactccctttaatctttcaggtaactccattatccggcaggcaatgggtagtcgtcctgcagatcagccttcctgttatcctactggacgaggcactgaagtacctaagcaggaaccacatgcacgaagaaatgtcacagaagtag

SEQ ID NO: 215213 - DNA, 2997 bp, Artificial Sequence
  Description of Artificial Sequence: Synthetic coding sequence
atggaggcagctcatctgctgcctgcagcagacgttctccgacacttctctgtaaccgcagaggggggattatctccagcacaagtgacaggagcacgcgagagatatgggccaaatgaattgccttccgaagaaggaaaatccctttgggaactggtgctcgagcaatttgaagatctgctggtgcgcatcttgctcctcgcagcacttgtctcatttgtcctggcatggtttgaagagggggaagagacaacaacagccttcgtggagcctctggtgattatgttaattctcgtggcaaatgccattgtgggagtgtggcaggagcgcaatgccgaaagcgccatcgaggccctgaaagaatatgagccagagatgggtaaggtcatccgctcagaccgcaaaggagtgcaacgtatacgagcgagggacatcgtcccaggagacatcgtagaggtcgctgtgggtgacaaagtgcccgctgacttgcggctgattgagatcaagtctaccacactgcgagtcgaccagtccatcttgacgggggaatccgtatctgttaccaagcatactgaggccattcccgacccccgagcagtgaaccaggataagaaaaacatgctgttctcggggaccaatatcacgtctggaaaagccgttggcgttgctgtcgcgactggcctgcacacggaactcggaaagatcagatctcagatggccgctgtggaacccgaacggacgcccctgcagaggaagctggacgagttcggtcgacaactgagccatgccatctccgtgatttgtgtggccgtctgggtgattaatattggacattttgccgatccagcacacggcggatcttggttgcggggagctgtgtattacttcaagatcgcagtcgcacttgcggtcgcagcgatccctgagggcttgcccgcagtgatcacaacctgcttagccctggggaccagacgcatggcacgcaagaatgctatcgtgcgaagccttccatcagtggagactctgggctgtacatccgtgatttgttccgataagacagggactctgacgacaaatcagatgtcggtgtgtaggatgttcgtagtggcagaagccgatgccggatcctgcttgttgcacgagtttacgatatctggcaccacctacacccccgaaggggaggttagacagggtgatcagccggtccgctgtggacagttcgacgggctggtggagcttgccacaatttgtgccctgtgtaatgactcagctctggattacaacgaggccaagggggtctatgagaaggtcggcgaggccaccgaaaccgctcttacttgcctcgtcgaaaaaatgaacgtcttcgacactgatctgcaagccctgagtcgcgtagaacgagccggtgcctgcaatactgtgattaagcagcttatgagaaaggaattcactctggaattcagcagagaccgcaagtccatgtccgtgtactgcaccccaaccaggcctcatcctactgggcaggggagcaaaatgtttgtgaaaggagcaccagagtcagtgatcgaacggtgctcttccgtaagagtcggatctcgtacagcaccccttacccccacctcacgcgaacagatccttgccaagattagagactggggtagcggcagtgacacactgagatgcttggctctcgccaccagagatgcaccccctcgaaaggaagatatggagctcgatgattgctcgaaatttgtccaatatgaaactgacctcacattcgtgggctgtgtgggaatgctggaccctccacggcctgaggtggcggcttgtatcacccggtgctaccaggccggaattcgcgtggtgatgatcacaggtgacaataagggaactgcagtggcgatctgccgaaggctggggatcttcggcgatactgaggatgtcgctggaaaggcgtacaccggcagggagtttgacgacctttctcccgagcagcaacgccaggcctgcagaacagccagatgtttcgctagagtcgagccagctcacaaaagcagaatcgtcgagaatctccagagttttaacgagatcactgccatgactggcgatggggtgaatgacgctcccgctttgaaaaaggctgagattgggattgccatgggatccggcacagccgttgcaaaatccgcggctgagatggtgttatcagacgacaacttcgcgtccatcgtggcagctgttgaggagggacgtgctatctactccaatatgaagcagtttattaggtacctgatttcaagcaacgtcggcgaagtggtctgtatcttcctgactgctatacttggcctgccagaggctttgattcctgtgcagctcttgtgggttaacctagtgacagacggtcttcctgccaccgccctcgggttcaacccgccagacctcgatattatggagaagcttcccagaagtccacgagaagcactgatatctggatggctgttctttcgatatttagccattggagtgtatgtgggtcttgctacagtagcggcagcaacctggtggttcgtgtatgacgctgaaggcccacatatcaacttttaccagcttcggaactttcttaagtgtagtgaggacaatcccctcttcgcaggtattgattgtgaagttttcgaaagccggttccctactaccatggccctttctgtgttggtcaccatcgaaatgtgcaacgccttgaacagcgtgtccgagaaccaaagcctgctccggatgcccccttggatgaacccctggcttcttgtcgcggtggctatgtccatggcgcttcactttctgattctgctagtgcctccactgccgctgattttccaggtgactcctctgagcggcaggcagtgggtggtggtcttacagatctcactgcccgtgatcttgttagacgaggctttgaaatacttgtctcggaatcatatgcatgggcatacccagtcctag

SEQ ID NO: 215214 - DNA, 2997 bp, Artificial Sequence
  Description of Artificial Sequence: Synthetic coding sequence
atggaggcggcacaccttttgcccgctgcggatgtcctcagacatttctctgttacagccgagggtgggctgagtccagcgcaggtgaccggagccagagagagatatggacccaatgagttgccatcggaggaaggcaaatcactgtgggagctggttctggagcagttcgaggacctgctggtaaggatactgcttctcgccgcactcgtctccttcgtcctagcgtggttcgaggagggcgaagagaccactaccgcgttcgttgaacccctcgtgatcatgctcattctggtggctaacgccatagtgggagtctggcaagaacgaaacgccgagagcgccattgaggcgctaaaggagtacgaacctgagatgggaaaggtcatcaggtctgacagaaaaggggttcagcgcattcgtgcacgcgatatagtgccaggagatatcgtggaggtggctgtgggagataaggtccctgcagacttacgcctgatcgaaatcaagtccaccacactgcgggtcgaccagtctatcttaacaggagaatcagtttcagtcaccaagcatactgaggctattcctgacccacgcgcagtgaaccaagacaaaaagaatatgctcttctccgggaccaacattacgtctggtaaggcagtgggcgtagccgtggccacagggctccatacagaactgggtaaaatcagatcgcagatggccgctgtggaacccgagcgcacgcccctgcagagaaagctggacgagttcggtaggcagttatcacacgcaatctctgtcatctgtgtggccgtatgggtcattaatatcgggcatttcgccgaccctgcccatggaggatcctggttgaggggggcagtatactactttaagatcgccgttgccctggctgttgccgcaatccccgaaggtcttccggcagtgatcaccacctgtctggccctcggaacaagacggatggcacgaaaaaatgccattgtaaggtcattacctagcgtggagacactaggatgtactagcgtaatttgctcggataagactggcaccctgacgactaaccagatgtctgtgtgtaggatgttcgtcgtggcggaggcagacgccggttcttgccttctgcacgaatttactatcagcggaaccacgtatactcccgagggtgaagtgcgtcaaggagatcagcccgttcgatgtgggcagtttgacggtttggtcgaactcgccaccatttgcgcactgtgtaatgattctgcgcttgactataacgaagcgaaaggggtttatgaaaaggtgggagaagccactgagacagccctcacttgcctggtagagaagatgaacgtgttcgatactgatctacaggcgctgtcacgcgtggaacgggcaggggcttgtaatacagttattaaacaactgatgcgaaaggaattcaccctggagttctcacgggatagaaagagcatgtcggtgtactgcacccccacacggccacaccctactggtcagggatccaaaatgttcgtcaagggagctcctgaatctgtgatcgagcgttgcagctccgttagagttggctccaggactgctccactcacccctacctcacgagaacagatcctcgccaagattcgggattggggctccggctctgatacactacggtgcctggcactggcaacccgagacgcaccccctcgcaaggaggatatggagctggacgattgctccaaatttgttcagtatgagacagatctaaccttcgtgggttgtgtaggcatgctggatcccccacgacccgaggtggccgcatgcatcacccgctgttaccaggctgggattagggtcgtaatgattaccggagataacaaggggaccgcagtggctatctgcagacgcctcgggatcttcggcgacacagaagacgttgcgggtaaggcttacaccggaagggaattcgacgatctttccccagagcagcagaggcaagcatgccgaacagccaggtgttttgctcgcgtggagcccgctcacaagtcacggattgttgagaatttgcagtcctttaatgagattaccgcaatgacgggcgacggcgtgaacgatgctccagccttgaagaaagccgagataggaatcgccatgggaagtgggaccgccgtggctaaatctgcagcggaaatggtcctctcagatgataacttcgcctctatcgtggccgctgttgaagagggtcgcgctatctattcaaatatgaaacagttcatcagatatctaatctcatctaatgtgggcgaggtggtgtgcatcttcctgaccgccatcctaggattgcccgaggcactgatcccagttcagctgctgtgggtcaaccttgtgactgacggcctccccgcaactgctttgggatttaacccacctgacctggacataatggagaaactaccacgctcacctcgcgaagccctgatctcggggtggcttttttttagatacctggctataggcgtttacgttggacttgccacagtggccgcagctacctggtggtttgtgtacgatgccgaaggtccccatatcaacttttaccaactgcggaactttttaaaatgctccgaagacaatccgctgttcgcaggaattgattgcgaagttttcgaaagtaggttccctaccaccatggcgctatcagtgctggtgacgatcgagatgtgcaatgccctcaactctgtctctgagaatcagtcactcctcaggatgcccccatggatgaatccatggcttcttgtagctgtggcaatgtcaatggctctccactttctgattctgctggtgcctcccctacccctcatctttcaagtcacaccgctatctggtagacagtgggtagttgtgctgcagatcagcctacccgtcattctgctagatgaggcccttaagtatctttcaagaaatcatatgcatgaaatgtcccagaaatag

SEQ ID NO: 215215 - DNA, 1386 bp, Artificial Sequence
  Description of Artificial Sequence: Synthetic coding sequence
atgacagtgcccaaggagatgcctgaaaagtgggccagagcgcaggcccctccgtcttggagccgaaaaaagccctcctgggggacagaggaagagcggagggcacgggctaacgacagagaatacaatgagaaatttcagtacgctagcaactgtatcaaaactagcaagtacaatattctaacattcctgcctgttaacttattcgaacagttccaggaagtcgccaacacctatttcctctttttgctcatcctccagctcattcctcagataagttcactctcatggtttaccacaatagtgccgttagtgctcgtgctcactatcaccgctgtgaaggacgccacagacgattatttccggcataaaagcgacaatcaggtgaacaaccgacaatcccaggtgcttatcaacgggatcctgcagcaagaacagtggatgaacgtctgcgttggcgatatcataaagctggagaataatcagttcgtggcagcagacctgctactcctgtcctctagcgaaccacacgggctatgctatatcgagacagccgaactcgatggggagaccaatatgaaagtgcggcaggcaattccggtgacctcggagcttggcgacatttctaaactcgcaaaattcgacggggaggtaatatgcgaaccccctaataacaaacttgacaaattttcaggaactctatattggaaagagaacaagtttccactgtctaatcaaaacatgctcctcagagggtgcgtgctgaggaacactgagtggtgtttcggtttggtcatatttgccggtccagacaccaaacttatgcagaacagcggccgtacaaaatttaaaagaacaagcatcgacagactgatgaacacactcgtcctgtggatcttcggttttctggtctgcatgggggtaattcttgccattggcaacgccatctgggagcatgaggtggggatgcggttccaggtgtatctgccctgggatgaggcagtggatagcgctttcttcagcgggttcttgagcttttggtcatacatcatcattcttaacactgtggtgccgatatcactctacgtgtctgttgaggtgatacggttggggcactcttacttcattaattgggacaaaaaaatgttttgcatgaaaaagcgcacccctgcagaggcaagaactactactctcaacgaggagttggggcaggtggagtacattttttctgataagaccgggacattgacacagaacatcatggttttcaacaagtgctctataaacggtcattcctacgttggatcggagggccctcggaggaagggaccatcgtggccaggcactgtggcacatgcgtactctcactccacccttggtgggtag

SEQ ID NO: 215216 - DNA, 1164 bp, Artificial Sequence
  Description of Artificial Sequence: Synthetic coding sequence
atggctgtctgtgctaaaaaaaggccaccagaggaagagaggagagcaagggccaatgaccgtgagtacaacgaaaaatttcagtacgccagcaactgcataaagacctcaaaatacaacatcctaacatttctgccagtcaatctgtttgagcagtttcaggaggtggccaatacctacttcttgttcctcctaattctccagttaataccccagatcagtagtttaagctggtttaccaccatagttccactggtcctggtattaacaattacagccgtgaaagacgccactgatgactactttcgacacaagtctgataatcaagtaaacaatcggcagagccaggtcctgatcaacggcatactacagcaggaacagtggatgaatgtgtgcgtgggcgatatcatcaaactggaaaacaaccagtttgtggccgctgaccttctcctacttagtagctccgagccgcatggactttgttatatcgagactgccgaattagatggggaaacaaacatgaaggtgcgtcaggccattccagtcacctcagaactcggtgatattagcaagctggccaagtttgacggcgaggtgatatgcgaacccccaaataataaactcgataagttctctggcactctatactggaaggaaaataaatttcccctgagtaaccagaatatgctgctcagagggtgtgtgttgcggaacacggaatggtgttttgggttagtgatttttgctgggcctgacaccaagctgatgcagaatagcggcaggacaaaatttaagcgcactagcatcgacaggttaatgaacactttagtactgtggatatttggcttcctggtgtgtatgggcgtcatcctcgcgatcggcaacgctatttgggaacacgaggtaggcatgcgctttcaggtctacttgccatgggatgaagccgtagactcagctttcttttccggcttccttagtttttggagctacattatcatactgaataccgtggtgcccatcagcctttatgtgagatatgtgccatccttgacgtggggcctgtctagagagagcggcggacctatcgaactttttttttccatgaagatgaagagcttgcgaagtaacgaaaagagttcttctagctgcacggtgaacatctag

SEQ ID NO: 215217 - DNA, 3672 bp, Artificial Sequence
  Description of Artificial Sequence: Synthetic coding sequence
atggatacactacgtgccgtaccgctattttccatctctggcttgttcagcttcccctatcgagtcagtcatgggatcgccggtattctgttgggagagatggcagtatgtgctaagaagcggccacctgaggaggagcggagggcccgtgccaacgacagggagtacaatgagaaattccagtatgctagtaattgcatcaaaactagcaagtacaacattctgacttttcttccagtgaatctttttgagcagtttcaggaggtggcaaatacctactttctcttcctgctgatcctgcaactcatcccccaaatcagttccttaagttggttcaccactatcgtccccttggttctggtgctgacaattacagcagtgaaggatgccaccgatgattactttcgccataagagcgataaccaggtgaacaatcgacagtcacaagttcttatcaacggaatcctgcaacaggagcagtggatgaacgtctgcgtgggagacattatcaaattggagaataaccagttcgtcgctgccgacctgctgctcctgtcaagcagcgaacctcacggattgtgttatattgaaacagccgagctggatggagaaactaacatgaaggtgaggcaggctatccctgttactagtgagctcggcgatattagcaagctggctaaatttgacggagaagtaatttgtgagcctccaaacaataagcttgataaattcagcgggactctttactggaaggagaataagttcccactgtcaaaccagaatatgctgctgcgaggctgcgtcctcagaaacacggaatggtgctttgggttggtcatttttgccggacccgataccaagctaatgcagaacagcggccgaacaaaatttaagcggacgtctatcgatcgtctcatgaacactctggtgctgtggatttttgggttcctggtgtgtatgggtgtgattttggccattggaaatgctatctgggaacatgaagtgggtatgcggttccaagtctatctgccgtgggacgaggcagtggacagtgcattttttagcgggttcctatcattctggagctacattatcatccttaacaccgtcgtcccaatctcactctatgtgagcgtggaggtcataaggttaggtcatagctacttcataaactgggacaaaaagatgttttgtatgaagaagcgtaccccagcagaagccagaacaactactctgaacgaggaactgggacaagtagagtatatattttcagacaaaacggggactctgactcagaacatcatggtatttaataaatgctctatcaatggccacagttacggggacgtgttcgacgtgttgggtcacaaggcggagctgggggaacgccctgaacctgtggatttctcctttaacccattggctgacaaaaagtttctgttttgggacccatccttactagaggcagtaaagattggggacccccacacccatgagttctttcgcctcctgtcactgtgccacacagttatgagtgaagaaaaaaacgagggggaactctattacaaagctcaaagtcctgatgagggggctttagtgaccgcagcgagaaatttcgggtttgttttcagaagccgcactccaaagacgatcaccgtacacgaaatggggaccgcaatcacctatcaactactggccatcttagacttcaacaatatacgtaaacggatgagcgtgatcgtcagaaatcccgaaggcaaaatcaggctgtattgcaaaggagcagacactatactcctcgaccgcctgcaccactccacacaggaactcctaaacacgaccatggatcatctaaacgagtacgcgggagagggactgcgaacactcgttctggcctacaaagatctggacgaggagtactatgaggaatgggccgagcgtaggctgcaggcctccttagctcaggattcacgggaggaccggctggcttctatatacgaagaagtggaaaacaatatgatgttgctgggagcaaccgcaattgaggacaagctgcagcagggcgtgcctgagaccatagcgcttcttacgctcgcaaacataaagatttgggtgctgaccggggataagcaggagacagcagtgaatatagggtactcctgtaaaatgctgacagacgacatgactgaagtgtttatagtgaccggccatacagtgttggaagtgagagaagaattgaggaaagcaagggagaagatgatggatagctctagaagtgtcggcaacggtttcacttaccaggacaaactttcatccagcaagctgacttccgtgctcgaggcagtcgctggagagtatgctcttgtgataaacggtcacagcctggctcacgcacttgaggccgacatggaacttgaatttctggagacagcttgcgcttgcaaggccgtgatctgctgccgtgtcactcctctgcagaaagctcaggtcgttgagctggttaaaaaatataaaaaggccgtgactttagctattggcgacggcgcaaacgatgtgtctatgatcaagacggcgcatatcggcgtcggtatcagtgggcaggaaggaattcaagccgtcctggcttccgattattccttctcacagtttaaatttcttcagagattactattggtccacggccgttggagttatttaaggatgtgtaagtttttgtgctacttcttctacaagaatttcgcattcacaatggttcacttctggttcggcttcttttgcggattttctgcccagaccgtatacgaccagtattttattactctctataacattgtgtacacctccctgcccgtccttgcaatgggtgtttttgaccaggatgttcccgagcagaggagcatggagtacccaaagctgtacgagccaggacagcttaacctgctgttcaacaaacgggagttctttatctgcatcgctcaagggatttacacctctgtcctaatgttcttcataccatatggcgtttttgccgacgccacacgagatgacgggacccagttggcggactatcagtctttcgctgtcactgtggccacatctctcgtgatcgtagttagtgtccagatcgggctagacaccggctactggaccgccatcaatcattttttcatctggggatcgctagcggtctacttcgctattctgttcgctatgcattccaatggactgttcgacatgtttccaaaccaattccgctttgttggtaacgcccagaacacccttgcccaacctacggtctggctgaccatcgtgctcacaaccgtggtctgtattatgccagtagtggcctttaggttcctgcgtctgaacttaaagcccgatctttcggacacagtgcgatatactcagctggttcggaagaagcagaaggcccagcaccgctgcatgcggagggtgggtcgaacaggatctcgcagatctggctacgcgttttcacaccaggagggctttggcgagctgatcatgagcggaaaaaacatgcgattaagctctcttgccctgtcctcctttactacccgctcaagcagtagctggattgaatccctgaggaggaaaaagtctgattccgcttccagtccaagcggcggagctgataagcccctcaagggatag

SEQ ID NO: 215218 - DNA, 3444 bp, Artificial Sequence
  Description of Artificial Sequence: Synthetic coding sequence
atggccgaccagatcccgctctaccctgtgagatcagctgccgcagccgctgccaacaggaagcgcgctgcctactactcagccgcagggcctaggccaggagctgataggcacagccgctaccagctagaggacgagagtgcacacctcgatgagatgccactgatgatgtctgaagaaggcttcgagaatgaagagagcgactatcatactctgcccagagcgagaattatgcagaggaaacggggtttggaatggttcgtctgtgacgggtggaagttcctatgcacgtcttgctgtggatggttaattaatatctgtcgcaggaagaaagagttgaaagcccgtactgtttggctgggatgtccagagaagtgcgaggaaaagcaccctaggaacagtatcaaaaaccagaagtacaatgtcttcactttcatccccggtgtgctgtatgaacagtttaagttttttttgaatctgtactttcttgttatctcctgttcacagtttgttcccgctctcaaaattggctacctgtatacctattgggctcctctcggctttgtgctcgctgtaaccatgacgcgcgaagctatcgacgaattccggaggttccagcgcgataaggaggtcaacagccaactgtactccaagttaaccgtccgtggaaaggttcaggtcaagtctagtgacatccaggtcggcgaccttattatcgttgaaaagaaccaaaggatcccctcagacatggtattcctgcgaacttctgaaaaggccggatcttgtttcatacgcactgatcagctggacggcgagaccgactggaagctgaaggtggccgtgagctgtacgcaacagttaccagcactgggagatttgttttctatcagtgcctacgtgtacgcccagaagccacagatggatattcactcctttgaagggaccttcaccagagaagacagtgacccgccaattcacgagagtttaagcattgaaaatacactgtgggcgtcaacaatcgtggctagtggaacagtcattggggtcgtgatctataccggcaaggagacgcgttctgtgatgaatacgtcaaatcccaaaaacaaagtgggcctgctcgacctggaactgaatcggctgactaaggcactgttcctcgccttagttgctctgtctattgtgatggtgaccctgcagggctttgttggcccttggtaccgtaacttgttccgctttttgcttctgttttcctacatcattcctattagtttaagggtaaatttggacatgggtaaagcagtgtacggctggatgatgatgaaagacgagaatatcccaggcaccgtggttcggacgtccacaattcctgaggagctgggacgactggtctacttgctgactgataagaccggtacccttactcagaatgagatgatctttaaacgcctgcatctgggaacggtctcttatggggcagatactatggacgaaatacaatcacatgtgagagactcctattcgcagatgcagagccaggccggagggaataacacagggtcaacccccttaaggaaagcccaaagcagcgcccctaaagtacggaagagcgtatcgagccggattcatgaggctgtgaaggccatagtcctttgtcataatgtcacaccagtgtacgagtcacgcgctggcgtaacagaggagaccgaatttgcggaggcagaccaagacttctcggacgagaatcggacctaccaagcttcgtcccccgacgaggttgcactagtgcagtggactgaaagtgttgggctcacactcgtgtcaagagatttaacatccatgcagctcaagacccctagtggccaggtactgtcgttctgcattctccagttattccctttcacaagcgaatctaaacggatgggcgtgattgttcgagacgagagtactgctgagataacattctatatgaagggcgctgacgtcgcaatgtccccaattgtccagtacaatgattggctcgaggaggaatgtgggaacatggctcgcgagggcctgcggacactggtcgtcgctaagaaggcactgactgaggaacagtaccaggatttcgagtctagatacacccaagctaaattgtctatgcatgaccgctccctgaaggtagcagctgtggtcgagagtctagaacgggaaatggagctcctgtgcttgaccggagtcgaagaccagttgcaggccgatgtcaggcccacgctcgaaatgctaagaaacgcgggtataaaaatttggatgctgaccggagacaaactggagactgccacatgcatagccaaaagtagccacctcgtttcacgtactcaagacattcatatcttccggcaggtcacgagtaggggtgaggcgcacctcgaattgaacgcatttcgtcggaagcatgattgcgctctggtgatttccggagacagcctcgaagtctgcttgaaatattatgaacacgagttcgttgaactcgcgtgtcagtgccccgcagtggtgtgctgcagatgttcccctacacagaaagccagaatagtaactctgctgcaacagcataccggtaggaggacctgcgctattggagacggtggcaacgacgttagtatgattcaggcagccgactgcggaattggcatcgaagggaaggaagggaaacaggcctcgcttgctgctgatttttctattactcaattccggcacattggcaggttactgatggtacatggtcgtaacagctacaagcgatcagctgccctgggccagtttgtcatgcatcgcggactcattatcagcaccatgcaggccgtcttcagctccgtcttttacttcgcttctgtgcccctgtatcagggattcttgatggtgggctatgccactatctatacgatgtttccggtgtttagtctcgttctcgatcaggatgtgaaaccggagatggccatgctctatccggagttatataaggatctgacaaagggaagatcactgagttttaaaacattcttgatctgggtcttaattagcatttaccagggaggcattctgatgtatggggctttagtgttatttgagtctgagttcgtgcacgtggttgcaatcagtttcacagccttgattctcactgaattactcatggttgccctgactgtacgcacatggcactggctgatggtggtcgccgaattcttgagtctcggctgctacgtgagcagcctcgccttcctgaatgagtattttggaataggaagagtctcgttcggcgcttttctggatgtggcgtttatcaccacagtcacctttctgtggaaggtgtcagccatcaccgttgtctcatgccttccgctgtatgttctcaagtacttgcgcaggaagctgagccctccaagctactgcaagcttgccagctag

SEQ ID NO: 215219 - DNA, 408 bp, Artificial Sequence
  Description of Artificial Sequence: Synthetic coding sequence
atgcaggctgttttttccagtgttttttatttcgcttcagtgcccctatatcaagggtttctgatggtcgggtacgccaccatttacaccatgttcccggtgttctcactggtgctagatcaggacgtgaaacctgaaatggcaatgctctatcctgagctgtacaaagatctgaccaaaagccaacaggatgggcgttcaaaccgacgtcagcacgagcggctgacgtctgggacttcagggcacgtatgggatcccggaagctttttccggatccgagtcagcgggaagggcgcacgaaacgcaggtaagattctcgtcctccagaacctgccgcacctgggttttaacaaataccttccaaggcgccacccccatgtctggggcccaggggctctgagagtgtag

SEQ ID NO: 215220 - DNA, 3411 bp, Artificial Sequence
  Description of Artificial Sequence: Synthetic coding sequence
atggcggatcagatccccctctatcctgtgcggagcgcagctgctgctgccgcaaatcggaagcgagccgcttactacagcgccgcaggcccacgcccaggggctgacagacattcccgataccagctagaggacgagagcgctcatctcgatgaaatgcctctgatgatgtccgaggagggatttgaaaatgaggaaagtgattaccacacccttccacgggcacgcataatgcaaaggaagagaggtctagaatggtttgtatgtgatgggtggaagttcctgtgcacctcctgttgcggctggttgatcaatatctgccgtcggaaaaaagaactaaaggcccgaactgtttggctcggatgccccgagaagtgtgaggagaaacaccctcgcaattcaatcaagaaccagaaatataacgtctttacgttcatcccaggtgttctctatgaacagttcaagttttttctgaacctctacttcctagttatttcatgcagccaattcgtcccagccctaaagatcggctacctttatacatattgggccccattgggctttgtgctggcagttaccatgaccagggaggcaattgatgaatttaggagatttcagcgggataaggaggtgaactctcagctgtactcaaaactaactgtgcgcggaaaggtccaagtgaaaagctcagatatccaggtgggggatttaattattgttgagaagaatcaacgtatcccttcggacatggtctttttgcgtaccagtgagaaagccggtagttgtttcattagaaccgatcagcttgacggggaaacagattggaagttaaaagtggctgtatcttgtactcagcagctcccagcactgggagatcttttttcgatctcagcctacgtttacgctcaaaaaccacagatggacattcatagtttcgaggggaccttcaccagagaagatagtgacccccctatccatgaatctctgtcgatcgagaatactttatgggcctctaccatcgtcgcctccggcacagttataggggttgtcatttacaccggtaaagagacccggtctgtaatgaatacctcgaatcctaagaacaaggtgggactgttagacctcgagttgaataggttgaccaaagccttgttcctcgccctggttgctctcagcatcgtgatggtgactttgcagggtttcgtggggccatggtatcgaaatctgttcagatttctgctgttattttcgtatatcatccccatttcactgcgagtcaacctagatatgggcaaggctgtgtacgggtggatgatgatgaaagacgaaaacattcctggcaccgtagttagaacctccaccatccccgaagaattggggcgactagtttatctgctgaccgataagacgggaactctcacccaaaatgagatgatcttcaagcgacttcatctgggaaccgtgtcatacggtgcagacaccatggatgagatccaaagtcatgttagggactcatactcacaaatgcagtcccaagccggaggaaacaacaccgggagcacccccctgcggaaggctcagtctagcgctcctaaagtgcgcaaatccgtctcatcccggatccatgaggctgtgaaagctatcgtgctgtgtcacaacgtcaccccagtgtacgagtcacgggctggtgtaaccgaggaaacagagttcgcggaagcagatcaagatttttcggatgaaaatcgcacgtatcaggccagttcgcctgatgaggtcgccttggtgcagtggacggagtccgtcggcctgaccttagtgtctcgcgacctcacctctatgcagctgaaaaccccatctggtcaggttttgagcttttgcatactgcagctgtttcccttcacctctgagagcaaacgaatgggggttatcgtacgggatgagtcgacggcagagatcactttttacatgaaaggggcagacgtcgcaatgtcccctatcgtgcagtataacgattggcttgaggaggagtgcggcaacatggctcgtgagggcttgcgaacactcgtggtagcaaaaaaggctttaacagaagagcaatatcaggattttgagtccagatacacccaggcaaagctgtccatgcacgataggtctctgaaggttgctgctgttgttgagagtctggagcgcgagatggagttactgtgtctcactggagtggaggatcagctccaggccgacgtgaggccaacactcgaaatgctgaggaacgccggaatcaagatttggatgctgacgggcgacaaattggaaactgcaacatgcattgcgaagtcctcacacctggtgtcccgaacacaggatattcacattttccgccaggtgacatcacgcggagaggcacacctagaattgaacgctttcaggagaaagcacgattgtgcactggtaattagtggcgatagtttagaggtgtgtcttaaatattacgaacatgagttcgtcgagctcgcctgccagtgtcccgctgtcgtgtgttgccgttgtagtccaacacaaaaggctcgtatcgtaacactgctccagcagcacacaggccgtaggacatgtgctattggggatggcggtaacgacgtgtccatgatccaggccgcagattgtggaattgggatcgaaggcaaggaaggcaagcaggcctcacttgccgcagattttagtattactcagtttcgacacataggccgactgctgatggttcacgggaggaacagttataagaggagtgccgctctgggtcagtttgtgatgcacagaggcctgatcatttcaacaatgcaggcagtgttttccagtgtattttatttcgcgagtgtgcctctctaccagggttttctgatggtgggttatgcaaccatttacacaatgttccctgtgttcagtcttgtgctggaccaggacgtgaaacccgagatggccatgctctacccagagctgtacaaggacttaactaaaggaagaagtcttagctttaagactttcctaatatgggtgctaatcagcatatatcaaggcggaatattgatgtatggagccctcgtgctcttcgagagcgaatttgtgcacgtggtcgccatttctttcactgccctcatcctaaccgagctccttatggttgccctcaccgtaagaacttggcattggttgatggtggtagccgagtttctatcgctcgggtgttacgtgagtagtctggcttttctcaacgagtatttcgatgtggctttcatcactacagtaacgtttctgtggaaggtgtccgcaatcaccgtggtcagctgtctgccactctatgtgctgaaatatctccgtcgcaaacttagcccccctagttattgtaagctcgctagttag

SEQ ID NO: 215221 - DNA, 411 bp, Artificial Sequence
  Description of Artificial Sequence: Synthetic coding sequence
atgcctttaatgatgtctgaagaagggtttgagaacgaagagtcggattaccatacattaccgagggctaggatcatgcaacgaaagagggggctcgagtggtttgtgtgcgacggatggaagtttttgtgcacttcctgctgcgggtggttgattaacatttgcaggcgaaaaaaggagctcaaggccagaaccgtgtggctaggctgtccagaaaagtgtgaggaaaagcatccacgtaattctattaagaatcagaaatataacgtgtttaccttcattcccggtgtcctctacgagcagttcaagttcttcctgaatctttactttcttgtgatctcttgcagtcaattcgttcctgccctgaagataggctatctgtacacttattgggccccactgatgacatag

SEQ ID NO: 215222 - DNA, 609 bp, Artificial Sequence
  Description of Artificial Sequence: Synthetic coding sequence
atgcagagaaaacgtggtctggaatggttcgtttgcgacggatggaagtttctttgtacgtcttgttgcggctggcttatcaacatatgcagaaggaagaaggagcttaaagcccgaacggtttggttagggtgcccggagaaatgtgaagagaagcacccgaggaatagtatcaaaaaccaaaaatataatgtgttcaccttcatccccggtgtgctgtacgaacagttcaaatttttcttaaacctgtattttctcgttatttcatgttctcaattcgtgcctgcactgaaaattggatacctctatacctactgggcgcctctgggattcgtccttgccgtgacaatgactcgggaggctatcgatgagttcagaagatttcagcgggacaaggaggttaattcacagctgtactcaaagctgaccgtaagaggcaaggtgcaggtaaagagcagtgacatccaggtcggcgatctgattatcgtggagaagaaccagagaattccatcagatatggtgtttctccggacgtctgagaaggccgttagtaataatcttgattattgctctcacctcgtactctttattttctgtttcctgaattag

SEQ ID NO: 215223 - DNA, 1374 bp, Artificial Sequence
  Description of Artificial Sequence: Synthetic coding sequence
atggccagagagggcctgagaaccctcgttgtcgccaaaaaggcactgaccgaggagcagtaccaagattttgaaagcaggtacactcaggctaagctgagtatgcacgataggtctctgaaggtggctgccgtggtggaaagcctggagcgggagatggaactactatgcttgactggcgttgaagatcagttgcaggctgatgtacggccaacactcgaaatgctgcgaaatgccggaatcaagatatggatgcttaccggtgataaactggaaacagctacttgcattgccaaatcaagtcacctcgtgtccagaacccaggatatccacatttttagacaggtgacgtctcggggagaagcacacttagaactcaacgccttcaggcgtaagcacgattgtgccctggtgatcagcggggactcgctcgaagtgtgtttgaagtattacgagcatgagttcgtcgaactcgcttgccagtgtcctgccgtggtttgctgtcgctgttcacccacccagaaagcccgtatcgtgactctgctccagcagcacacaggaaggcgtacttgcgctattggggatggcggaaatgatgttagcatgattcaagcggcagattgtggtattggcatcgaaggcaaggaaggcaagcaggctagcctggcggcagactttagtatcacacagtttcgtcacatcgggaggttacttatggtgcacggacggaatagttacaaaaggagcgctgccctgggccagttcgtcatgcaccgaggcctgatcatcagtaccatgcaggccgtattttcctcggtattttactttgcctctgtgcctctctaccagggcttcctcatggtcggctacgcaacaatatatactatgtttcccgtattctctctcgtgttggatcaggatgtgaaacctgagatggccatgttgtatcctgaactgtacaaagacctcaccaagggcagaagcctctcctttaaaacatttttgatatgggtcttgatctccatttaccaggggggtattctgatgtatggggctctcgtattgtttgagagcgagtttgtccacgtcgtggcgatttcattcactgccttgatcctgactgaactcctcatggtggctctgaccgtacgaacatggcattggctcatggtggtagctgagttcctatctctgggttgctacgtgtcttccctcgctttcctaaatgaatatttcgacgtggcattcatcactactgttacattcctgtggaaggtaagcgccattacggtggtgagctgcttgcccttgtatgtcttgaagtacttgcgcagaaaactatcacccccttcgtactgcaaattggccagttag

SEQ ID NO: 215224 - DNA, 4500 bp, Artificial Sequence
  Description of Artificial Sequence: Synthetic coding sequence
atggagcgcgagcctgcaggcaccgaagagcctggccctcctgggaggaggcggaggcgagaaggcaggactcggaccgtcagatccaatctgctgccaccccctggagcagaagatcccgcagccggagccgctaaaggtgagaggcgtcgtcggagaggatgtgcacagcatttggccgataaccgcctcaaaaccaccaaatacaccttactgtcctttctccctaaaaacttgttcgagcagttccatcgtcccgctaatgtgtatttcgttttcatagccctgctcaatttcgtaccggctgtgaacgcattccagcccggacttgctcttgcccctgttcttttcattctcgcaatcaccgcattccgcgacctctgggaggactactcccgccatcggagtgaccacaagattaaccacctgggctgcctcgtattcagcagggaggaaaaaaaatacgtgaacaggttctggaaggaaatccatgtgggggatttcgtgcgcctgcgttgcaacgagatcttcccagccgatattctgctgctgagcagtagcgatccggacgggttgtgccacattgagacagccaacttggatggagagactaatttaaaaaggcgccaggtggttcgcggattttccgaactggtgtccgagtttaaccctttaacgtttactagcgtgatagaatgtgaaaaaccaaataatgatctgtcccggttccgcggttgcattatccacgacaacgggaaaaaggccggtctctacaaggaaaaccttctcctacggggatgcactttaaggaatacggacgccgtagtgggaattgtcatctatgcgggacacgaaacaaaggccctgttgaacaattccgggcctcggtacaagagatctaagctggaacggcaaatgaattgcgatgttctgtggtgcgtcttacttctggtgtgtatgtccttgttttcagccgtggggcatggcctatggatctggcgttatcaagagaaaaaatcactcttctacgtcccgaagtctgatggctcctccctttcccctgtgaccgctgccgtctactcgttccttacgatgatcattgtcctgcaggtcttgattccaatcagcctctacgtgtcaatagaaattgtaaaggcctgccaggtttactttatcaaccaggacatgcagctgtatgacgaggaaaccgattcccaattgcaatgtcgagcgctcaatatcactgaggacctcggccagatccagtacatttttagtgataagacaggtacgctcacggagaataagatggtattcaggcgttgcacggtcagtggagtcgagtactcacacgatgcaaacgctcagagattagctagatatcaggaggccgactccgaagaagaagaagtggtgccacgcggaggatcagtgtcccagcggggtagtatcggatcccaccagagcgttagggtggtgcacaggacacagtctaccaagagccatagaaggaccggatctcgggctgaagcgaagcgagcatctatgctgtcaaagcacacagcattttccagtccgatggaaaaggacataacccccgatcctaagcttttggagaaagtctcagaatgtgataaaagtctcgccgtggcacggcaccaggagcatctgctggctcacctctccccagagctttctgacgtgtttgacttttttatagctctcacaatctgcaatactgtggttgtgacatcgccagatcagccaaggaccaaggtgagggtgaggttcgaattaaaatctccggttaagacgattgaggacttcctccgaaggtttaccccttcctgcctgactagtggctgttcttccatagggagtttagccgcaaacaagagctctcacaagttaggatcctcatttccctccacccccagctcagacggtatgcttctcagattggaagagagactgggccagccaacgagcgccatcgcatccaatgggtatagctctcaggctgacaactgggcatcggaactcgcacaggagcaggagtcagagagggagctgcgctatgaggcggagtctcctgacgaggcagctcttgtgtatgccgcacgggcttataattgtgttctggtggaacgactgcatgaccaggtgtctgtagagctcccccacttgggtaggctgaccttcgaactgctgcacacgttgggattcgactctgtgagaaagcgcatgagcgtggtcattcgccatcccctgacagatgaaattaacgtctacacaaagggcgctgactcagtggtaatggacctgctgcaaccatgtagcagcgtcgacgctcgtgggagacatcaaaaaaagattaggtccaagacccagaactatctaaatgtctacgctgcggagggattgcgaacactgtgcatcgccaagcgagtgctgtccaaagaggagtacgcgtgctggcttcagtcccaccttgaggcggagtcatccttggagaatagcgaggagttgttgttccagtccgcgatccgtctcgagaccaacttgcatcttctcggtgctacggggattgaagaccggttgcaggacggggtgccggagaccatttctaaattgcgccaagctgggctccagatttgggtccttacgggtgataaacaggagacagcagtcaacatcgcttatgcctgcaagttactggaccacgacgaggaggtcatcaccttaaatgcaacttcacaggaagcctgcgccgctctactcgatcagtgtctgtgctatgttcagtcaaggggcctgcagcgggctccggagaaaaccaagggcaaggtgtctatgcggttctcttcactgtgtccgcctagtacctctaccgccagtggtcgccgtccatcactggtcatcgatgggagatcccttgcttacgccctcgagaaaaacctggaggataagttcctgtttctcgcgaagcaatgtcgatcagtcctgtgttgcagaagcaccccactgcaaaagagcatggtggttaagcttgttagaagcaagctcaaggcgatgaccttggcgatcggcgatggcgctaacgacgtatctatgatccaagtggccgatgttggggtggggatctctggacaggagggcatgcaggcagtcatggccagtgatttcgctgttcccaagtttagatacttggagagactgctcatccttcacggccactggtgctacagtcggctggccaacatggtcctgtacttcttctataaaaacacaatgtttgttgggctcctgttttggttccagtttttctgtggattttctgccagcactatgatcgatcagtggtacctaattttttttaacctgctcttcagtagcctgccacctctcgtgaccggagtgctcgaccgggatgttccagcaaacgtgttgctcactaaccctcagctctacaagtcgggccaaaacatggaagagtatcggccaaggacattctggtttaacatggccgacgccgcttttcagtcactcgtctgtttctccattccctacctcgcatattatgatagcaatgtcgatcttttcacatggggaacgcccatcgtgacgatcgctctgctcacattccttctgcacctagggattgaaacaaagacgtggacgtggttaaactggattacctgcggattctccgtgctcttgttcttcaccgtggcccttatatacaatgccagttgcgccacctgttaccccccttctaacccgtattggactatgcaagcactcctcggggaccctgtcttctaccttacctgcttaatgacccccgtggccgctctcctgccccgtttgttctttaggtctctccaggggagagtgttcccaacacaactgcagttggcacgccagctgacccggaaatcgccacgacggtgttccgcacctaaggagacattcgcacagggtcgtttgccaaaggatagtggcacagagcacagcagcgggcgaaccgtgaagacaagcgtcccattatctcaaccaagctggcacacccagcagcctgtatgctcactggaggcctccggagagccctcgacagtggatatgagtatgcctgttcgcgagcacacgctgttggaaggcctctccgctcccgcaccgatgagttcggcgcctggcgaagccgtccttcgatcccccggagggtgcccagaggagagtaaggtaagagcagcctcaacagggagggtgacaccgttgtcctctctatttagcctgcctacattctctctgctaaactggatctcgtcctggagtttagtgtcccgcctaggctcggtgctccagttttccaggacagagcaattagcggatgggcaggctgggagaggcttacccgtccagccacactccggaaggtctggacttcagggtccggaccacagattactaatcggcgcatcctcgcggaggtctcagtag

SEQ ID NO: 215225 - DNA, 3405 bp, Artificial Sequence
  Description of Artificial Sequence: Synthetic coding sequence
atggattgcagcctggtgaggactttagtgcacagatattgcgcaggcgaggaaaactgggtcgactcacggacgatttacgtcggccaccgggagccgccacccggtgctgaggcttacatcccgcagaggtaccctgacaacaggatagtaagcagcaagtatactttttggaactttatcccaaaaaatctcttcgagcagtttaggagggtcgccaatttttattttttgatcatctttctcgtccaactgattattgacacccccaccagccccgtgacgtctggactcccactgttttttgtaataacagtgaccgctatcaaacaggggtacgaggactggctcaggcataaggccgacaacgccatgaaccagtgcccagttcattttatacagcatgggaagcttgtaaggaagcagtcccgcaagctgcgggtcggcgacatcgtgatggtgaaggaagacgagacattcccctgtgacctcattttcctgtcatccaacaggggagatggcacatgccatgtgacgactgccagcctcgatggtgaatccagccacaaaacacactacgcggtgcaggacaccaaggggttccataccgaagaagacatcgggggactgcatgctactattgagtgtgaacagccccagccagacctctacaagtttgtgggtagaattaacgtttacagcgatctcaacgatcctgtggtaaggcctctcggctctgagaacctcctgctgcgaggggctacactaaagaatacagagaagattttcggcgtcgcgatttatacaggcatggagacaaaaatggctttaaattaccaatccaagtcccaaaaacgctccgccgtggagaaatccatgaacgctttccttattgtgtacctgtgtattctcatatctaaggccctaatcaacacagttctcaagtatatgtggcagtcagaaccattcagagacgagccctggtacaaccagaagactgaatctgaacgccagcgaaacctcttcctaaaagccttcacagacttcttggcttttatggtgctctttaactatattatacccgtctcgatgtacgtcacagtggaaatgcagaaattcttggggtcttacttcattacttgggacgaggacatgttcgacgaagagactggggaggggccactggtaaacacaagtgatcttaatgaggagctgggccaggtagaatatatcttcacagacaagactggcacactgaccgagaataacatggaatttaaagaatgctgtatcgagggacatgtgtatgtcccccatgtgatttgtaacgggcaagtgctgcccgagtcctccggcatcgatatgatcgacagcagtccctctgtgaacgggcgagagagggaggagctctttttcagagccctctgtctgtgtcacaccgtgcaggtcaaggacgatgatagcgtggacggacccagaaagtcacccgacggaggaaaatcctgtgtctatatttcatcctcgccagatgaagtcgctctggtagagggggtgcagagattgggttttacatacctgcgccttaaggataactacatggaaattcttaacagggaaaaccatatcgaacgctttgaactcctcgaaatcttgagcttcgactctgtgagacgcaggatgtcagttattgtgaagtcagctactggggagatctatttattctgcaagggtgcagacagctccattttccccagggtcatcgaaggcaaggtcgaccagattcgggcaagagtggagaggaatgcagtggaggggttacgtacattgtgcgtggcatacaaaaggctgatccaggaagaatacgaaggcatctgcaaacttttgcaagcagctaaggtcgccctacaggaccgcgaaaaaaaattggctgaagcgtatgagcaaattgagaaagacctgaccctgttgggggctacagccgtcgaggatagattacaggagaaggctgctgatactatagaagcacttcagaaggccggtattaaagtgtgggtgctcactggcgataaaatggagactgccgctgcaacctgttacgcctgcaagctgtttagacgcaatactcaacttttggagctgacaacaaaaagaattgaggaacagagcttacacgacgtgcttttcgagctaagtaaaaccgtcttgcgacattccggatcccttactagagacaatctctcgggattatcagcagacatgcaggattacggcctgattatcgacggcgctgccctctccctcattatgaaacccagggaggacggatcttcaggcaattacagggaacttttcttggaaatctgccgatcctgttcggcagtactgtgctgcaggatggcccctctccagaaagctcaaatcgttaagctcattaagttctctaaagagcacccgatcaccctagcaattggcgatggagctaatgacgtatcaatgattctggaagcccatgtcggcatcggagtcatcggtaaggaaggaaggcaggccgctaggaatagtgactatgccattcctaagtttaagcacctgaagaagatgcttctggttcatgggcatttctactacattcgaatttccgagctggtgcagtacttcttctataagaatgtctgctttatctttccccaatttctctatcaattcttctgcggatttagccagcagacactgtacgatactgcctatctcaccctgtacaacatttccttcacgagtctccccatcctcctgtatagcctgatggagcagcatgttggcattgacgtgctaaaacgcgaccctactctttacagagacgtggctaagaatgcactactgcgctggcgagtgttcatttattggacactcctggggctgttcgacgcgcttgtatttttctttggagcgtactttgtttttgagaacacaaccgtcaccagcaacgggcagattttcggcaattggacattcgggactcttgtgttcaccgtcatggtttttactgtcaccctcaaactcgcacttgatacccattactggacctggatcaatcactttgtgatctggggatccctgttattttatgtggtttttagtttgctgtggggaggcgtcatatggccctttctgaattaccagcggatgtactacgtcttcatccagatgctgagctcaggaccggcatggctagctattgtcctgctcgtgacaatcagtctcctgcctgatgtgttaaagaaggtgttgtgccgacagttatggcctacggccacagagcgggtgcaaactaagtcccaatgtctctctgtggaacagtccaccattttcatgctttcacagacctcaagctcactaagcttctag

SEQ ID NO: 215226 - DNA, 3576 bp, Artificial Sequence
  Description of Artificial Sequence: Synthetic coding sequence
atggactgctccctggtccggacactggtccaccgctattgcgccggtgaggaaaattgggtcgactcaaggacaatctacgtgggccatcgcgagccccctcccggtgcagaggcttacatcccacagcgataccctgataacaggatcgtaagcagcaaatacaccttctggaattttatcccgaagaacctgttcgagcagttccggagagtcgctaacttctatttcctgatcatattcttagtacagcttattatcgacactcccacttcaccagtgacttcaggcctgccactgttttttgtcattactgtcactgccatcaaacaggggtatgaggactggctgcgccacaaggctgacaatgccatgaaccagtgtccggttcattttattcagcatggcaagttagttagaaaacagtctcgcaaactcagggttggagacatcgttatggtgaaggaggacgagacctttccatgtgatctgatcttcctgagttcaaacaggggcgatgggacctgccacgtaacgactgccagcttggacggtgaatcttcccataaaacacattatgcagtgcaggatacaaaaggctttcataccgaggaagatatcggaggcctccatgcgaccatcgaatgcgaacagccacagcctgacctgtataagtttgtcggtcggataaacgtgtactcggaccttaacgacccggtggttagaccactgggatccgagaacctactgctccgcggtgctacgctgaaaaatactgaaaagatcttcggtgtggccatttatacggggatggagacaaagatggcactaaattatcagtccaagtctcagaagcgatctgccgtggagaaatcgatgaatgcttttctcattgtgtacctctgcatattaatttctaaggctctaatcaacactgtactgaagtacatgtggcagagcgagccttttcgggatgagccatggtacaatcagaagacagagtccgagcggcaaagaaacctgttcctgaaggcctttacagattttctggcattcatggtcctctttaactatataatccccgtctctatgtacgtgaccgtggagatgcaaaaattcctaggatcgtactttatcacctgggacgaggacatgttcgacgaggaaactggcgagggtcccctcgtgaacacctccgacttaaatgaggagttgggccaagtggagtacatctttaccgacaagacaggtaccctgacggagaataatatggagttcaaggagtgctgtattgaggggcacgtttacgttccgcacgtcatctgcaacggtcaggtcctccctgaatcttccggtatagacatgattgacagttctcccagtgtgaatgggagggaaagagaagagctgttttttcgggctctctgtttgtgccatactgttcaggttaaggacgacgacagcgtggacggaccgcgaaagagccccgatggtggaaaatcgtgtgtctacattagttcatcccccgacgaagttgccctcgtcgaaggcgttcagcggctgggattcacctaccttagactgaaagacaactacatggaaatcctgaaccgggaaaatcatatcgaaaggttcgaactcttggagatcttatcctttgactctgtgagacgacgcatgagcgtcatcgtgaagagcgccactggagagatctaccttttctgtaagggcgctgattcttcaattttcccgcgtgttatagagggcaaagtagatcagattcgggctagagtcgagcgcaacgctgtagaaggtctgcggaccctgtgtgttgcttacaaacgactgatccaggaagaatacgaagggatttgcaagttactgcaggcagctaaggtggcgttgcaggacagagagaagaagttggctgaagcatatgagcagatagagaaggatctcacactcctgggagccactgcagtagaggataggctgcaggagaaagcagcagacaccatagaggccctccaaaaggctggaataaaggtatgggtgcttactggcgataaaatggagaccgccgctgccacttgttacgcctgcaagctgtttcgcagaaatacccagctcttagagctgactactaaacggatcgaggaacagagcctgcatgacgtcctctttgagctgagtaagaccgtgctgagacatagtgggagcctgacacgagataacctcagcggtcttagcgccgatatgcaagattatggcctgattatcgatggtgcagctttatccctgatcatgaaacctcgggaagatggtagcagcggcaattatagagagctgtttcttgagatctgtcgctcttgttccgcggtcctgtgctgccgcatggccccactacagaaagcgcagatcgtaaaacttataaagttttccaaagaacatcctatcacccttgccatcggggacggggcaaacgatgtgagcatgatcctggaagctcatgtgggcattggagtgatcggcaaagaagggcgacaggcggcaaggaacagcgattacgccatcccaaagttcaaacacctcaagaagatgctgctcgtccacggccatttctactacattaggattagcgaacttgtgcagtattttttctataagaacgtgtgtttcattttcccccagttcctctaccagttcttctgcggttttagtcaacagactctgtacgatacagcgtacctcacactttacaacatttcgttcacaagcctcccaatactactgtattcgctcatggaacagcatgtgggtattgatgtacttaagagagatcctacactttatcgggacgtagcaaagaacgctctcttacgatggcgagtcttcatctactggaccctgctgggattatttgacgccctcgtgttcttcttcggagcatattttgtcttcgaaaacaccacagtcacaagtaatgggcaaatctttggaaattggactttcggcaccctcgtgtttactgtgatggttttcacggtcacactgaagctggcactcgatacacactattggacatggattaaccatttcgtgatctggggctcactgttgttctacgtagtgttcagccttctgtggggcggtgtgatttggcccttcctcaattaccagaggatgtactacgtgttcatccagatgctctcttccggacccgcatggctggctattgtgcttctcgtgacaatttcattattgccagatgtattgaagaaagtgctgtgtaggcagctttggcctactgccaccgagcgggtgcagaacggctgcgcccagccccgagaccgcgactcagaattcacccctctcgcttctctgcaaagtccaggttaccagtccacttgcccttcagcagcatggtactcaagccactctcagcaagtgactctcgccgcatggaaagagaaggtgagcaccgaaccacctcccatactgggaggatcacatcatcattgttcttccataccctctcatagttgtcctcgttcgagggtagggatgctggtttag

SEQ ID NO: 215227 - DNA, 3405 bp, Artificial Sequence
  Description of Artificial Sequence: Synthetic coding sequence
atggattgctccttagttagaactttagtgcatagatattgcgccggagaagagaattgggttgattcccggactatttacgtgggccaccgggagccacctcctggagcggaggcatatattccccagcgttatcccgataatcgaatcgtgagcagcaagtacaccttctggaattttatcccaaaaaatctgtttgagcaatttaggagagtggccaacttttactttttaattatattcctagttcaactgatcatcgataccccaacctctcccgtgacatcaggcctgccactcttttttgtgatcactgtgaccgccataaagcagggatatgaagattggctgcggcataaggctgataatgccatgaaccagtgccctgttcacttcatccaacacggcaagctcgtcaggaagcagagcaggaaattaagagtgggtgatatcgttatggttaaagaggatgagaccttcccctgtgaccttatctttctatcctccaatcgaggggacggcacttgtcacgtgacaacggcctccctggatggcgagagttctcacaaaacacattacgctgttcaggacactaagggatttcatacagaagaagatatcggaggcctgcatgcgacgatagagtgcgagcaaccgcagccagatttatacaagtttgtgggaagaatcaatgtgtatagtgaccttaatgatcctgtggtgcgcccactaggtagcgaaaacctcctcctgcgcggtgcgacactcaagaacaccgaaaagatcttcggggtcgcgatatatacgggaatggagaccaagatggccctgaactatcagtcaaaatcacagaaacgcagcgctgtcgagaagagcatgaatgcgttcctcatagtttacctgtgtatactcatttcaaaggccctgattaatactgttctcaagtacatgtggcaatccgaacctttccgtgatgagccttggtacaaccagaaaaccgagtcagagcgtcagcggaacctttttctcaaggcttttacagacttcctggcgttcatggtcctgttcaattacatcatcccagtgtccatgtatgtgactgtggaaatgcagaagttcctcggctcgtacttcatcacttgggatgaggatatgtttgatgaggagaccggcgaagggcctttggtgaatacatccgacctgaacgaagaactgggccaggtcgaatacattttcaccgacaagacaggcacattgactgagaataatatggaattcaaggagtgctgtattgagggccatgtgtatgtacctcatgtgatctgcaatggtcaggtcctcccggaaagcagcgggattgatatgattgattcctctccgagcgttaacgggagggagcgggaggagctgttctttagggcgctgtgcctttgtcacaccgtgcaggtgaaagacgacgatagcgttgacggacctaggaaatctcccgatggcggtaagtcttgtgtctatatctcttcctctcccgacgaggtggcgcttgttgaaggtgtccagcgccttggctttacatatctaaggctgaaggacaattatatggaaatattaaacagagagaatcatattgaaaggtttgagttactagaaatcctttcttttgacagcgttaggcgcaggatgtctgtgatcgtgaagtcggccacaggcgaaatctacctgttctgcaagggtgcggattccagcatatttccgcgagttatagagggaaaagtggatcagattcgagctagggtcgagaggaacgccgttgagggtctacgcaccctgtgcgtggcctataaacggctcattcaggaggagtatgaggggatttgtaaattactccaggccgctaaagtcgcactccaagatcgtgaaaaaaagctggctgaggcttatgaacaaatagagaaagacctaactctgttaggcgctacagctgtggaagaccggcttcaggaaaaggccgctgacactatcgaagcactgcagaaagcaggaattaaagtctgggtcctgacaggggacaagatggagacggctgctgccacatgctacgcatgcaagctgtttaggagaaatacccaactgctggagttgaccactaagcgcatcgaggaacagtccttacacgatgtgttgttcgagttgtccaagaccgtgcttcgtcattccggctctctcaccagggacaatctcagcggtctgagcgccgatatgcaagattacgggctcatcatcgacggggcagccctttccctgattatgaagcccagggaagatggttcttcaggcaattaccgagaactgttcctggagatctgccgctcctgcagcgctgtgctctgttgccggatggcgcctctccaaaaggcccagattgtgaagttaataaaattcagcaaagagcatcccattactctggcgattggggatggtgcaaatgacgtgagcatgatcctggaggctcatgtgggtatcggcgtcatcggtaaagagggcagacaggccgctaggaacagcgactacgccatccccaaatttaagcatctaaaaaaaatgctgctcgtgcatggtcacttctattatatccgcatctccgagctcgttcagtattttttctataagaatgtttgttttatcttcccacagttcctgtaccaatttttttgtgggtttagtcagcagacattatacgataccgcttacctgactctgtacaacataagttttacaagtctgcctattcttctgtattctctgatggaacagcacgttgggattgatgtgctgaagagagatccaaccctgtatcgggatgtcgcaaaaaatgctttgcttagatggagggttttcatatactggactctcctggggctgtttgatgctctggtttttttctttggcgcatacttcgtgttcgaaaatacaaccgtgacttccaacggacaaatctttggtaactggacttttggtaccctggtgttcaccgtgatggtctttacggtgactttaaagctggccctggacacacattattggacttggattaaccactttgtcatctggggttcactgctgttctacgtcgtgttctccctgctctgggggggagtgatatggcccttcctcaactatcagcggatgtactacgtgttcattcaaatgctgtctagcggccctgcatggttagcaatcgtgttactagtgaccattagcctcttgcccgacgtactaaaaaaggttttgtgcaggcagctctggccaaccgccacggaaagggttcagaccaaatcccaatgcctgagtgtggaacaatccaccatatttatgctctcacagacatcttcctccctgtctttttag

SEQ ID NO: 215228 - DNA, 2808 bp, Artificial Sequence
  Description of Artificial Sequence: Synthetic coding sequence
tagtacgtggggcatagagaaccgccaccaggggcagaggcgtacatccctcagcggtaccccgacaatcgcattgtcagctctaagtacactttttggaacttcattcctaaaaatctgtttgagcagttccgtcgcgttgctaacttttacttcctcataatcttcttggtacaacttataatcgatacccctacatccccagttacctccggcctgcctctatttttcgtgatcacggttacagccattaagcaagggtatgaggattggctgcgacataaggcagacaacgccatgaaccaatgtcctgtgcactttatccagcacggaaagctcgtgcgtaagcaatcccgcaaactgcgcgtgggcgacatcgtgatggtcaaagaagacgaaacctttccgtgcgacttgatttttctgtcttctaaccggggtgacgggacttgccacgtgaccacagccagtctcgatggtgaatctagtcacaagacgcactacgccgtccaggacactaagggctttcacacagaagaggacattggagggcttcatgccactatcgaatgcgagcagccacaacccgatctgtataagttcgtcgggaggatcaatgtttactcagacttaaatgatcctgtcgttcggccacttggatccgagaacctgttattgcggggagcaacactgaaaaacacggaaaagatcttcggagtggccatctacaccggcatggagacaaaaatggcccttaactaccagtccaagtcccagaagagaagcgctgtggagaagtcaatgaatgccttccttatcgtctacctatgtattcttatatcaaaagcattgatcaatacggtcctgaagtatatgtggcagtctgaaccatttagagacgaaccttggtataatcagaagacagagtcggagaggcagcgaaatctcttcctgaaggcctttactgacttcttagctttcatggtgttgttcaactacattatacctgtgtcaatgtacgtgacagtggaaatgcagaagtttctcggcagctatttcattacgtgggatgaggatatgttcgacgaagagacaggggagggacccctagtaaatacctccgacctaaatgaagaactgggtcaggtagagtacatctttacggacaaaacggggactctgacagagaataacatggagttcaaagagtgctgtatcgaaggacatgtctatgtccctcatgtgatctgcaatggccaggtgttgcctgagtcctcaggtattgatatgatcgattcgagtccatcggtcaatggtagagagcgggaggagcttttcttccgtgcattgtgcctatgccacacggttcaagtgaaagatgatgactcagtcgatgggccacgcaagtctcctgacggcggaaagagttgtgtctacatatcctcgtcacctgacgaagttgctctggtcgagggcgtgcaaagactgggttttacgtacctccgcctgaaggataactatatggagattctgaacagagagaatcacatcgagcgatttgagttattggaaatcttaagcttcgattccgtgaggagaaggatgtccgttatcgtaaaatctgccaccggtgaaatctacctgttttgcaagggcgctgacagcagtatcttccctcgcgtcatcgagggcaaggtggaccaaattcgggcaagggtcgagaggaacgctgtagagggcctacgaacgctgtgtgtagcgtacaagagattgatccaagaagagtacgagggcatctgtaaattacttcaggcggctaaagtggccctgcaggaccgggagaagaagctggccgaagcatacgaacagatcgagaaggatctgaccctccttggggcaactgcagtggaggacagactccaggagaaagcagctgataccatcgaggcactccaaaaggcaggcataaaggtctgggtgctgaccggcgataagatggaaacggccgcagcaacctgttacgcttgcaagctattcagaaggaacacccagcttttagaactgaccactaagcgtatcgaagaacagtcactgcacgacgtcttatttgagttgagcaagacggtgttgcgtcatagcggctccctgacgcgcgacaatttgagcggcctctccgccgatatgcaggattacggactgataattgatggtgccgctctgtctcttatcatgaaacctagagaggatggcagtagcggcaattacagggagctatttctcgaaatttgtcgaagttgcagcgccgttctgtgctgtcgtatggctcccctgcagaaagcccaaatcgttaagctgataaaattttcaaaagagcatccaatcaccctggcaattggagacggtgccaacgatgtctccatgatcctggaagctcatgtcggcataggagtgatcggcaaagaaggaaggcaagctgcccgaaactccgattatgccataccaaagtttaagcacttgaagaaaatgctcttagtgcacggacatttttattacatcagaatttcagaacttgtgcaatacttcttctacaagaatgtctgtttcatcttcccccagtttctttaccagttcttttgtggttttagccaacagacactatacgacaccgcctatctgacgctctataatatcagtttcactagcctgcctattttactgtacagccttatggagcaacatgtcggtatagacgtactgaagcgagacccaaccctctacaggtaccatccacccaacagcctcagctag

SEQ ID NO: 215229 - DNA, 1119 bp, Artificial Sequence
  Description of Artificial Sequence: Synthetic coding sequence
atgtcagtgattgtgaaatccgcgaccggcgagatttacctattctgtaagggcgctgactccagcatttttccccgagtgatagaggggaaagtggatcagataagagccagggttgaacgcaatgccgtagagggcctaagaacactctgcgtggcttacaagagactcatccaggaagagtatgaagggatctgcaaactcctacaggccgctaaggtggccctgcaggatcgagaaaagaagctcgctgaagcgtacgagcagatagagaaggatctgaccctgcttggggcaacggctgtggaagatagactgcaggagaaggctgctgacaccatagaagccctccaaaaggccggtatcaaggtctgggttctgacaggcgacaaaatggaaacagctgcagctacctgctacgcttgtaagctattcagacggaatactcagttactggagctaacaaccaagcgaatcgaggagcagtcccttcatgacgtgctctttgaactgtccaaaacagtgctgcgccactccggcagcctgacccgggacaatttgagcggactaagcgcagacatgcaggattatggtttaattatcgacggcgctgcactgtccctgattatgaagccacgcgaagatggaagctccggcaattatcgagaactgtttctcgaaatctgcaggagttgctcagcagtgttatgttgtcggatggcacccttacagaaggcccagattgtgaaactgattaaatttagcaaggagcatcctataacgttagccatcggcgacggagctaacgacgtttcaatgattcttgaggcgcatgtggggatcggcgtcatcggaaaagagggcagacaagccgcacgcaatagcgactatgccattcctaagtttaagcacctcaagaagatgctgctggttcatggtcacttctattacatccggatcagtgagctcgtgcaatacttcttctacaagaacgtgtgcttcatctttcctcagttcctgtaccagtttttctgtggatttagccaacaggggaggaggcaagagtgccccgctgcactggctcgcgtgcatttactggatgcgcctgggactgtgtag

SEQ ID NO: 215230 - DNA, 1059 bp, Artificial Sequence
  Description of Artificial Sequence: Synthetic coding sequence
tgaagcatcttcccgcgagtcatcgagggcaaagtcgatcaaatcagggctcgcgtcgagcggaatgctgtggaagggttgagaactttgtgtgtcgcgtacaagagactcatccaggaggaatacgaaggtatttgtaaacttctgcaggccgcaaaagtcgctctgcaggaccgagagaagaagctggcagaggcgtatgaacagattgagaaggacctgactctcctaggagccaccgcagtagaggatcggctccaggagaaggcagcggatactatagaagcgctacagaaagcaggcatcaaggtctgggtgctcaccggcgataagatggagaccgccgcagctacctgctacgcatgtaaactgttccgtcgcaatactcaattacttgaactgactaccaaaaggatcgaagagcagtctctgcatgacgtcctttttgagctgagcaaaactgtgcttaggcacagcggctccctcacccgggacaacctgtcaggtctaagtgcggacatgcaggattacggcctgattattgatggcgctgcactctctctgatcatgaagcctagagaagacggctcaagtggcaactacagggaactgtttcttgaaatttgtagaagctgtagcgccgttctttgttgtcgcatggcccctctccagaaggcacagattgtgaagctgataaagttctcaaaggagcaccctattaccctggcaatcggggacggggcaaatgacgtgagcatgattctagaggcccacgtaggtattggagttatcggcaaggagggtaggcaggccgctagaaactccgattatgctataccaaagtttaaacacctgaagaagatgttgttagtgcacgggcatttctactacatacggatttcagagttggtgcagtactttttttataagaatgtctgcttcatcttcccacaattcctgtatcagttcttttgtggcttctcacagcaaggacggcgtcaggagtgccccgctgcactggctcgagttcatctactggacgctcccggtaccgtctag

SEQ ID NO: 215231 - DNA, 3405 bp, Artificial Sequence
  Description of Artificial Sequence: Synthetic coding sequence
atggattgcagcctggtcaggacactcgttcatagatactgcgccggtgaagagaactgggtcgactctaggactatctacgtagggcacagggaacctccacccggtgctgaagcctatattccacagaggtaccccgataataggatcgtctcttccaaatatactttttggaattttatccctaagaacttattcgagcagttccggagggtggctaacttttactttctgatcatctttcttgtccagctgattattgacaccccaaccagcccggtcacatcaggcctcccattgtttttcgttatcacagttactgccattaagcaggggtatgaggactggctgaggcacaaagccgataatgctatgaaccagtgtccagtgcactttatccaacatgggaagctggttcgcaagcagtcaaggaagcttcgcgtgggggacatcgtgatggtaaaagaagatgagacttttccttgtgacctaatcttcctctcatcaaatagaggtgatggcacttgtcacgtgacaactgctagcctggatggagagtcatcacacaagacccactacgccgtccaggacaccaaaggctttcatacagaagaagacatcggtggcctgcatgccactattgaatgtgagcagccccagcctgacctatacaagtttgtggggcgtattaacgtgtacagcgacctgaacgatcccgtcgtgcgcccactggggtctgaaaacctgcttttgagaggcgctacactgaagaacaccgaaaagatattcggggttgcgatctacacgggcatggagacgaagatggccctgaactaccagtctaagtcccagaagcgcagcgccgtggagaagagcatgaacgccttccttattgtctatctgtgcatcctgatcagcaaggcactgataaacacggtccttaagtatatgtggcagagtgagccatttcgggacgaaccctggtataaccagaagacagagtctgagcgacagcgcaatctcttccttaaggcttttaccgacttccttgctttcatggtgctgtttaattatataattccggtctcaatgtacgtcacggtcgaaatgcagaagtttttaggaagctattttataacgtgggacgaagatatgttcgatgaagaaacaggtgaagggcctctggtgaacacctctgacctgaacgaagaattggggcaagtcgaatatatcttcaccgataagacgggcacactgacagagaataatatggagtttaaagaatgctgcatcgagggccatgtgtacgtgccgcatgttatctgcaacggccaggtactccctgagagctcgggaatcgacatgattgacagctctcccagtgttaacggtagagaaagagaggagctgttcttcagagccctttgtctgtgccatactgtccaggtgaaggatgatgacagcgtagacggccctagaaagagtcccgacggcggaaagagctgcgtctacatttcgtccagccctgacgaagtggcccttgtggaaggcgtacagagactggggttcacatatcttcggttgaaggataactatatggagatcttgaatagagaaaaccatattgaaagatttgagctgttggaaatcctatcttttgacagtgtgcgccgtaggatgtcagtgattgtaaaaagcgccactggggagatttacctcttctgcaagggcgctgattcttcaatcttccccagagtgatagaggggaaggttgaccagatccgcgctagagtcgagagaaacgcagtagaggggttgagaaccttatgcgtggcttacaaacgcctgatccaggaagaatacgagggaatctgtaaactcctccaggcagccaaggtggccttacaggacagagaaaaaaaactcgcggaggcttatgaacagatcgagaaagacttaactctgctcggagccactgccgttgaggatcgactgcaggagaaggctgccgacaccatcgaagccctgcagaaggcgggaatcaaggtgtgggtgctcacaggagacaaaatggagaccgccgcagccacgtgctacgcctgtaagctgttccgacggaacactcagcttttagaactgacaaccaagcgcattgaggaacagagcctccatgacgtcctatttgaactgagcaaaacagtcctaagacatagcgggagtctgacaagggacaacctgagcggactttctgcggatatgcaagattacggactcataattgatggggctgcgttaagcctgatcatgaaaccaagagaagacgggtcttccggcaactacagggagctgttcctggagatctgccggagttgcagtgcggtgctctgttgtcggatggcaccactgcagaaggctcaaatcgtgaagctgattaaatttagtaaggagcacccaatcactctagcaataggagacggggcaaatgatgtctccatgatcctggaagcccatgttggcattggggtgattggtaaagaaggtcgacaggcggctcgcaacagcgattacgccattcctaaatttaagcacttgaaaaaaatgctactggtccacggacatttttattacatccggatatctgaactagtgcagtactttttctataaaaatgtgtgttttatctttccgcaattcctctatcaattcttctgcggtttttctcagcagacgctgtacgacacagcctacttaactctctacaacatcagctttacctcgctccctattctgctctattctctaatggaacagcatgtaggcattgatgtgcttaagagggaccccacactttaccgagacgtagccaaaaatgctctgctgagatggagggtgtttatctactggacattgctggggcttttcgatgcacttgtcttcttttttggtgcgtattttgtctttgagaacacaactgtgacttccaatgggcaaatcttcgggaactggacctttggaacacttgtttttacagttatggtgttcacagtcactctgaagctggccctcgatacccattactggacctggatcaatcactttgtgatctggggttcccttttattttatgtggtcttctcactcctctgggggggagtgatctggccttttctgaattaccagcggatgtattacgtgtttattcagatgctaagcagcggacccgcttggctggctatcgtgttactagttacaatctctttattaccggatgttttgaagaaggtgctttgccgacagctctggccgaccgcaaccgaaagggtccagaccaagtctcagtgcttgtcagtcgagcaaagcacaatctttatgctgtcccagacctcctcttccttgtcgttctag

SEQ ID NO: 215232 - DNA, 3534 bp, Artificial Sequence
  Description of Artificial Sequence: Synthetic coding sequence
atgtggaggtggatcaggcaacagttggggttcgatccccctcaccaatcggacacccgcacaatatacgtggcaaataggttcccccaaaacggactttacactccacagaagtttatagacaatagaatcattagttccaaatacacagtttggaacttcgtgccaaagaatctttttgaacagttccggagagtcgcaaatttctattttctgatcattttccttgttcaactgatgatcgacacgccaaccagtccagtgacctccggactgccactgttcttcgtaattactgtgaccgccataaagcaggggtacgaagactggctgcggcataactctgataacgaagtgaacggagccccagtgtatgtggtgagaagtggtggactcgtcaagactcggtcaaagaatattcgggtcggggatatagttcggattgctaaggatgagatctttccggctgatctagtcctgttgtcttccgaccgcctggacggaagttgccacgtgaccactgcaagtctggatggcgaaaccaacctgaagactcatgtggcggtccccgagaccgcgctgcttcagaccgtcgccaatctggacacattagtggcggtcattgagtgccaacagcctgaggccgatctgtatcgcttcatgggacgaatgatcattacccaacaaatggaagagattgttcggcctctcggacccgagagcttgctgcttagaggcgcacggctcaaaaacacaaaagagatcttcggcgttgctgtgtacacaggcatggaaactaagatggccctcaactataagagtaagagccaaaaaaggtcggcagtcgaaaagtcgatgaataccttcttgattatatacctcgtgatcctcatttctgaggctgtgatttccactattcttaaatacacatggcaggcagaggaaaagtgggatgagccctggtacaaccagaaaacagagcaccagagaaattcatcaaagatcctacggtttatctccgactttctagcatttctcgtcctgtacaattttattatccctatttccctttatgtcaccgtggagatgcagaaattcctgggaagtttcttcattgggtgggatcttgatctgtatcacgaagaatctgaccagaaggcccaggtgaatacctccgatttgaacgaggaattagggcaggtagaatatgtgtttaccgacaagacgggaacactcactgagaacgaaatgcagtttcgagagtgtagtattaatggcatgaaatatcaggagattaatggacggttagtgcccgaaggacccactccagatagctcagaaggcaacctttcttacttatcttctctgagccacttaaataatctgagtcacctcacgactagttcctcattcagaacaagtccggagaacgaaaccgagctcattaaggaacatgacctgtttttcaaagccgtcagcctgtgtcataccgtccagatctcgaacgtgcagacagactgtaccggagacggcccatggcaatctaacctagctccatctcagttagagtactacgcgagcagtcccgacgaaaaagccctggtggaggcagctgctagaattgggatcgtcttcatcggtaactccgaggaaactatggaagtcaagactctaggcaagctcgagaggtataaattacttcacattctcgaattcgattctgacagacggaggatgtccgtgattgtgcaggccccatccggggagaaattgctgttcgctaagggcgcagagtcaagcattctccccaagtgcatagggggtgaaatagagaaaaccagaattcatgtggatgagttcgcactgaagggcctgaggacgctgtgtatcgcataccgcaagttcacgagcaaggaatatgaggagatcgataagcggatattcgaagcacgtacagctcttcaacaaagggaggaaaagctggccgctgtattccagttcattgagaaggatttgatcctcttgggcgcaacggctgtggaggatcgcctccaggataaagtaagagaaaccatcgaagccctaagaatggccggtatcaaagtctgggttttgactggcgacaaacacgagactgcggtgtcggtgagcttatcttgcgggcatttccatcgtactatgaacatcctagagctcataaaccaaaagagtgactctgaatgcgctgaacagttgcgtcagctggccagacggatcacagaggatcatgtgatccagcacggattagttgttgacggcacatccctatcacttgccctcagggaacatgagaagctatttatggaagtctgtcgcaactgtagcgccgtgctttgttgcagaatggcacccctgcagaaagcaaaggttatccgccttatcaaaatcagccctgaaaaaccaataactctggcggtcggagacggagccaacgacgtctcaatgatccaggaggctcatgttggcatcggcattatgggcaaagagggacggcaggctgccaggaattcggactatgcaattgctcgatttaagtttctttccaaacttctattcgtccacggccatttttattatattagaattgctacgctcgtgcagtactttttctacaaaaatgtctgctttattacaccccagttcctgtaccaattttattgcctcttttcgcagcaaaccctctacgattcagtttacctcacgctctacaatatttgttttacaagtcttccaatactgatatacagtctcctcgaacagcatgtggatccacacgtgttacagaacaagccaactctttaccgagatataagtaagaacaggctactgagcatcaaaacctttctatattggaccattctgggattcagccacgctttcatattcttcttcgggagttacctcttaatcggtaaggatacgagcctccttggaaatggccaaatgttcggtaattggactttcggcaccctcgtctttactgtaatggtgatcacggtcacagtgaaaatggctctggaaacccatttctggacatggatcaatcatctcgtaacctggggatctattatcttttattttgtattttcactgttctatggaggcattctctggcctttcctgggctcacagaatatgtacttcgtatttatccagttactcagctccgggagtgcctggtttgctataatactgatggttgtgacctgtctgtttttggatatcatcaagaaggttttcgaccgccatctacacccgacatcaacagagaaagcccagttgactgaaaccaacgccggaattaaatgcctggactcaatgtgctgtttccctgaaggggaggcggcatgcgcctcagtcggccgtatgctggagcgagttatcggacgttgtagccccacccatataagccggtcatggtccgcatccgatcccttctacactaacgatagaagcatactgacgctgagtacaatggactcttctacctgctag

SEQ ID NO: 215233 - DNA, 315 bp, Artificial Sequence
  Description of Artificial Sequence: Synthetic coding sequence
atgtattttgtttttatccagctgctgagctcaggatctgcttggtttgctattattctcatggtcgtgacctgtcttttccttgacattatcaaaaaggtgtttgaccgtcatctgcaccctacgtcaaccgagaaggcgcagatgtactctaatactgtggccctgtcagacgaattcatagcactgcagcctctgagtagggcaaggaaccaattgagcaaactcaggtggaaaaagataagggtgcaaagcgcgcagcacatgaacctcttaaaggcctctaccgaaggacgcacagtggggacttgctag

SEQ ID NO: 215234 - DNA, 4503 bp, Artificial Sequence
  Description of Artificial Sequence: Synthetic coding sequence
atggatccttccatgggggtgaacagcgttaccatctcagtggagggcatgacatgtaacagttgcgtgtggactatagaacagcagataggaaaggtgaacggcgtccaccatattaaggtgtctctggaggagaagaacgccactatcatatatgaccctaagctgcaaactcctaagacccttcaagaagccattgatgacatgggcttcgacgctgtgatacacaatcctgaccctcttccggtattaacggacaccctctttcttactgttaccgcttctttgacactaccttgggaccacatccagtccacattgttgaagactaaaggcgtcacggacatcaagatctatccacaaaagaggactgttgcagttaccatcattcctagcattgtgaatgctaaccagattaaagaacttgtgcccgagttgtcccttgacactgggaccctggagaaaaaatcaggggcttgcgaggaccattccatggcccaagccggtgaggttgtgctaaaaatgaaagtggagggtatgacttgtcactcttgtacgtctactattgaggggaagatcggtaaactgcagggtgtacagagaatcaaggtaagcctagataatcaggaggctacgatcgtgtatcagcctcacctgatctccgtggaagagatgaagaaacagatcgaggctatgggcttccccgcattcgtaaaaaaacagccaaagtatctgaagcttggggctatagacgtcgaacgtctgaagaataccccagtcaaaagttcagaggggagccagcagcgaagccccagctatacaaacgattctacagcaacatttatcatcgatggcatgcattgtaaaagctgcgtcagcaacatcgagagcacccttagcgcattgcagtatgttagtagcattgtggtgtcgctcgagaacagatccgccatcgtgaaatacaatgcttcaagtgtgacacctgagtccctgcggaaggccattgaggccgtatcacccggactgtacagagtatccatcacaagcgaagtagaatccacttcaaattccccaagcagcagcagcctgcagaaaatccctcttaacgtcgtatcccagcccctgacacaggaaactgtgattaatatcgatggaatgacgtgtaattcttgtgtgcaatctattgagggagttatttccaaaaaacctggagtcaaatccatccgagtgagtctcgccaattcaaatgggacagtggagtatgatccccttctcacctcaccagaaactcttcgcggagccatcgaagatatgggattcgacgcaactctgagtgatacgaacgagccactggttgtgattgcacaacccagcagtgagatgcctctgcttactagtactaatgagttttacacaaaaggaatgacccccgtgcaggataaggaggaaggcaagaacagttctaaatgctatatccaggttaccggcatgacctgcgcctcctgcgtggcgaatatcgagagaaacttaagacgagaagaggggatttacagcattctcgtggcgctcatggcaggcaaagccgaagtgaggtacaacccggcagtgattcaaccacctatgatcgctgaattcattcgcgagctcggatttggcgcaacagttatcgaaaatgccgacgagggagacggtgtgctcgagctcgtcgtaagaggcatgacctgcgccagctgcgtgcataaaatcgagagttccctgacgaagcatagaggcatcctgtactgttctgtagcattggcgactaacaaggcacacattaagtatgacccggagattatcgggcctcgtgacatcattcatacaattgagagcctaggatttgaggcttcgctggtaaagaaggatcgttcagcatcacacctggaccacaagcgagaaattcggcaatggcgcagaagcttcttggtatctctctttttttgtatccccgtcatgggcctgatgatttacatgatggtgatggatcatcatttcgccaccctccatcataaccaaaacatgtccaaagaggaaatgatcaatttacattcatccatgtttctcgagagacagatcttgcccggtctgtccgtgatgaatctgctctcttttcttctttgtgtgccggtgcaattctttgggggatggtatttctacatccaggcatataaggccctgaaacacaaaaccgccaacatggatgtgttgatcgtgctggccactacaatcgccttcgcttactcgctcatcattctgctggtagcaatgtacgaacgagctaaagtaaacccaataactttttttgataccccacccatgctgttcgtctttatcgcacttggcagatggctggagcacattgcgaaggggaaaacctcagaagccttggctaaactgatatccctgcaggcaaccgaagcaacgatcgtgaccctggactccgacaatattctcctgtccgaggagcaagtcgatgtggaactcgtacagcggggtgacatcattaaggttgtgccgggaggcaagttccccgtggacggtagggtgattgaggggcattcaatggtcgatgagagcctcatcactggagaagccatgcctgttgctaagaagcctggaagtaccgttatcgcaggttccatcaatcagaatggctcactgctcatctgtgcaacccatgtgggagctgatacgactctaagccaaatcgttaaactcgtcgaggaagcccagacatcaaaagctcccattcagcagttcgctgacaaactttccggctatttcgttccatttattgtgttcgtgtccatcgccacattactcgtttggatagtaataggctttctgaatttcgagattgtggaaacctacttccccggatacaatcgatccattagccgtactgagactatcatccggtttgctttccaggcctctatcaccgtgttgtgcattgcttgcccatgcagtttgggcttggccacaccaaccgctgtgatggtcgggactggagtcggtgcccagaatggcatacttatcaagggcggagagccactagagatggcccacaaggtgaaggtggttgtgttcgacaaaaccggcactatcacgcacgggaccccagtagtgaaccaggtgaaagtcttgacggagtctaataggatatcccatcacaaaatcctggctatcgtgggaaccgccgagagcaattcggagcacccccttggcaccgccattaccaaatattgcaaacaggaactggatactgaaactctgggaacgtgcatcgactttcaagtggtgccaggatgtgggataagttgcaaagtaaccaacatagagggtctgctgcacaagaataattggaatattgaagataataacataaagaacgcttcattagtgcaaatcgatgcctccaatgagcagagctcaaccagtagttccatgattatagatgcccagataagcaacgcactgaacgcccaacagtataaggtactgatcggtaacagggagtggatgatccgtaatggactggtgattaacaacgacgttaatgattttatgacagaacacgagcgaaagggaagaaccgccgtgctggtcgcagtggacgacgagctctgcggtctcattgctatcgccgacacagtgaaacctgaggccgaactagccattcacatattaaagtctatggggctcgaagtcgtgctgatgactggagataattctaagaccgcgcgatcaattgctagccaggtcggcatcaccaaagtgttcgcagaggtcttgccttctcacaaagttgcgaaggtgaaacagcttcaagaagagggtaaacgagtggccatggtaggcgacggtatcaatgactcgcccgctctggcaatggcgaacgtcggtatagctatcgggaccgggacggacgtggcaatagaggctgctgatgttgtgcttatacgcaacgatctgttggacgtagttgccagcattgatctgagtagggagaccgtaaaaagaatccgcattaatttcgtgtttgccctgatttacaatctggtgggtattccaatagctgctggagtatttatgccaataggcctggttctgcagccttggatgggttcagctgccatggccgcaagttctgtttccgttgtgctgagttcattgtttctcaagctgtacaggaaacctacttacgaatcttacgaactgccggctaggtctcagattggccagaagtccccaagtgaaattagcgttcatgttggaattgatgacacatcccgcaactcccctaagcttgggctactggaccggatcgtaaattattcaagggcctcaatcaattctctgctcagcgacaagagaagcctgaactccgtggtgacatctgagcccgacaagcactctctcttggtgggggatttccgggaggatgacgacacggccttatag

SEQ ID NO: 215235 - DNA, 4269 bp, Artificial Sequence
  Description of Artificial Sequence: Synthetic coding sequence
atggatcctagcatgggagtgaactccgtaacaatttcagttgagggcatgacatgtaattcctgtgtgtggaccatcgagcagcaaatcggaaaggttaatggcgttcaccacattaaggttagtcttgaagagaaaaacgccactattatctacgatcccaaactacagactcctaagaccctccaagaggccatagatgacatgggattcgacgccgttattcacaatcccgacccccttcctgtccttaccgatacgttgttccttaccgtgactgcctccttaactctgccttgggatcatattcagtctacactgttaaagacaaaaggagtcaccgacattaagatctaccctcagaagcggactgtggctgtgacgataatcccatccattgtcaacgccaaccagattaaagagctcgtgcctgagctgtctctcgacacgggaaccttggagaagaagagtggagcatgcgaagaccactctatggcccaagcaggagaagtggtgctcaaaatgaaggtggagggaatgacctgccactcatgcacctccacaattgaaggcaagatcggcaagctccagggagtgcagcgcattaaggtgtctctggacaatcaggaagccacaatcgtttaccagccccatctcatctcagtggaagagatgaaaaagcaaatcgaagccatggggtttcccgctttcgtgaagaaacagcctaagtatctgaaattaggcgctattgatgttgagagacttaaaaacacgcccgtaaagtcttcagagggatcacaacaaaggagccctagttacacaaacgattctaccgccacatttatcatcgacggaatgcattgtaaatcgtgcgtttccaacatagaatcaaccttgtcggccttgcagtatgtgtcttcaatagtggtgtcactagaaaatcgcagcgccattgttaaatataacgccagttctgtcacaccagaatccctcaggaaggccattgaggcagtgagtcctgggctgtacagagtgtctatcacatctgaagtggagagcaccagtaactccccttcgtcatcatcactgcagaaaatccctctaaacgtcgtatcgcaacctttgacccaggagaccgtgatcaacattgatggcatgacatgtaactcttgtgtccagtctatcgagggggtgattagcaaaaagcccggtgtaaaatcaatcagggttagcttggccaatagcaacggaacagtcgaatacgatccgttattaacgagccccgaaacactccgtggagctatagaggacatgggcttcgacgctactctcagtgacacaaatgagcctttggttgttatcgcacagccaagtagcgaaatgcctctgcttacatccaccaacgaattctacacaaagggaatgacccctgtccaggataaggaggagggtaagaacagttctaaatgttatatacaggtgaccggaatgacctgcgcatcctgcgtggcgaacatcgagagaaatctgagacgagaagagggcatatattccatcctggtagctttgatggctggcaaggccgaagtcagatacaatccagcagtaatccagccacccatgatagccgaattcattcgcgaactggggtttggggcaacggtcatcgaaaatgccgacgagggagatggcgtccttgagctggtcgtcaggggcatgacctgcgcttcgtgcgtgcacaagattgaatccagcctgactaaacatcgcggtattttatattgttccgtggccctcgccaccaataaggcgcatattaagtacgaccctgagattatagggcctagggatatcatccacactatcgagtctctggggtttgaggcttctctggtgaaaaaagaccgctcggcctcccatctggaccacaaacgtgagataagacaatggcggaggtctttcttagtcagcttgttcttctgtattccggttatggggctcatgatttacatgatggtcatggaccaccattttgcaaccctgcatcataatcaaaatatgtctaaagaggagatgatcaacctccactcatcaatgtttttagagaggcaaattttgcccggtctctccgtcatgaacttgctatccttccttctgtgcgtgcccgtgcaagggaagaccagtgaagccctggcaaaacttatctcgctccaagccacagaggccaccattgtgaccctggatagtgataatattctcctgtctgaggaacaggttgatgtggagctcgtgcaaaggggtgatataatcaaggtcgtgccaggaggaaagttcccggtggacggcagggtcattgagggacacagcatggtagacgagtctctgatcacaggggaagcgatgccagtagcgaagaagccgggttccacagtcatcgccggtagtatcaatcagaacgggagcctgttgatttgtgctacgcacgtgggcgctgatacgacgctgagtcagattgtcaagcttgtagaagaagcacagacaagtaaggcacccatacagcaattcgcagacaagctgagcggctatttcgtcccgttcatcgtgttcgtctcaattgccacacttctagtgtggattgtgattggctttttaaattttgaaatcgtggagacatatttcccaggctataatcgcagtatttcaaggaccgagaccattattcggttcgcctttcaggcgagcatcacagtgttatgtatcgcttgtccatgctcactcggcctcgcaacccccacagccgttatggtgggtactggagtgggcgcacagaacggaatcctgatcaagggaggagagcccctggagatggcacataaggtcaaagttgtggtctttgataaaacgggcaccatcactcatggtactcccgtcgtgaaccaggtgaaggttctgaccgagtccaacaggatctctcatcacaagattctagccattgttggtactgcagagtcaaattcagaacatccactgggcactgcaataaccaaatattgcaagcaggagcttgacaccgaaactctgggcacatgcattgattttcaggttgtcccaggatgtggcattagctgtaaagtgaccaatatcgagggtctgttgcacaaaaataattggaacatcgaggacaataacatcaagaatgccagtttggttcagattgacgcttcaaacgagcagagtagcactagtagttccatgatcattgacgcacaaatttctaatgcattaaacgcccagcaatataaggtgctcatcggcaatcgggagtggatgatccgaaacggccttgttattaataacgacgtaaacgattttatgactgagcatgagagaaaggggcgaacagcggttctagtggcggtggatgatgagctctgtggtctgatagctatcgccgatacagtaaagcccgaggcagagcttgccatccacatcctgaagtccatgggtctggaagttgtgttgatgaccggggataattctaaaacagctcgctcgatcgcctcccaggtgggcataactaaagtttttgccgaagtgttaccatcacacaaggttgcgaaagtgaagcagctgcaagaagagggcaagcgtgtcgctatggtcggcgacgggatcaatgattcgcccgcattagcaatggcaaacgtgggcattgccattgggacgggaacggatgttgcgatcgaggcggcagacgtggtgttaattcggaacgacctgctcgatgtggtggccagcattgatctttctcgagagactgtgaaaaggattagaattaatttcgttttcgctttaatctacaacctggtcggcatccctatagctgccggtgtgttcatgcccatcggactggttctgcagccatggatgggaagtgctgccatggccgcatctagcgtgagcgtggtgctttctagcctgtttttaaaactataccgtaagcccacctacgaaagctatgagttaccagccaggtctcagattggtcagaaatcgcctagcgaaatatccgtgcatgtcgggatcgatgatacatccaggaattcgcccaagctagggctgctggaccgcattgtgaactattctcgagctagcattaactctttgttgagcgataaacggagtttgaattcagttgtgacctcagagccggataagcactccttgctcgtgggcgattttcgcgaggacgatgacacagctctctag

SEQ ID NO: 215236 - DNA, 264 bp, Artificial Sequence
  Description of Artificial Sequence: Synthetic coding sequence
gagtgcaatgaggagatcaagatggatccttcaatgggcgtcaatagtgtgacgattagcgtggagggcatgacatgcaacagttgcgtttggactatcgagcagcagataggaaaagtcaatggcgtccaccatatcaaggtctccctcgaagagaagaacgccacaatcatattctatgcccattggttcggctttgccgcattggacggcatatgctctaacggctgcttcatctgcttctgctctactttctttagttag

SEQ ID NO: 215237 - DNA, 1512 bp, Artificial Sequence
  Description of Artificial Sequence: Synthetic coding sequence
atggatccgtcaatgggcgtgaactcagtgactatcagtgtggaaggtatgacatgtaactcctgcgtgtggaccatcgaacaacaaatcgggaaggttaatggagtgcaccacatcaaagtcaaagttgtggttttcgataagactggcaccataacccacggaacaccggtggttaatcaggttaaggtcctgacagagtctaacaggatctcccaccataagatcctggccatcgtgggcactgcagagtccaactcagagcatcctctcggaacagcaatcaccaaatattgcaagcaagaacttgacactgaaacgctgggcacctgcatcgatttccaggtggtgcctgggtgtggcatcagttgcaaggttaccaatatcgaaggcctgttacataagaacaactggaatatcgaggacaacaatattaagaacgcatctctggttcagatcgacgcttccaatgagcagagttctacctctagttcaatgatcatcgatgcgcagatttccaacgcgctcaatgcccagcagtacaaggtattgataggcaatcgggaatggatgataaggaacgggctggtcataaataatgacgtgaatgattttatgaccgagcatgagcggaaaggacgcactgccgtgctggtggccgtggatgacgagctgtgtggcctgatagctatagccgacactgttaaacccgaggctgaactagcgatccatattctcaagtcgatgggacttgaagtggtgttgatgacaggcgacaatagcaagacggcacgcagtattgcatctcaggtgggtatcacaaaagtcttcgcagaagtgctgccaagccacaaagtcgctaaggtgaaacagcttcaggaggaggggaaacgcgtcgcaatggtcggtgatggaattaatgatagtcccgctttggccatggcaaatgtagggatagctatcggtaccgggactgatgtcgcaatcgaggcagcagacgtcgtgttaatacgcaacgacttgttggatgtggtggcctcaatcgacctgagcagggagactgtaaaacgcattaggatcaacttcgtcttcgcgctaatatacaacctggtcggaataccaatagctgccggtgtgtttatgcccattggcctcgtgctgcagccatggatggggtcagcagccatggccgcatcatcagtatctgtggtgctgtcgtccctgtttctcaaactctacaggaaaccaacctatgaatcatatgaactccctgctcgaagtcaaataggccagaaatcaccctctgagatatcggtacatgtggggatcgacgatacttctagaaatagtcccaagctcggactgttagacaggatcgtcaactacagcagagcaagtatcaactccctactgtccgataagagatcgctgaactcggtcgtgacatctgagcctgataaacactctctcctagttggcgattttagagaggacgacgatacggcattgtag

SEQ ID NO: 215238 - DNA, 2049 bp, Artificial Sequence
  Description of Artificial Sequence: Synthetic coding sequence
agaaatcaggagtgtaatgaggaaataaaaatggatcccagcatgggtgtgaactctgtgaccatcagcgtggagggtatgacgtgcaattcctgcgtttggaccatcgagcagcagatagggaaggtaaatggagttcaccatattaaggtatcactggaagaaaagaacgcgactatcatctacgatccaaagcttcaaaccccgaaaacattacaggaagcaatcgatgacatgggatttgacgctgtgatacacaaccccgatcctctcccagtgctgacggataccctcttcctgactgtcactgcctccctgacccttccttgggatcacatacaaagtacccttctgaaaacaaaaggcgtgactgacatcaagatatacccccagaagcggaccgttgctgtgaccattattccctccatcgtgaatgcaaatcagatcaaagaattggtgcctgaactttcactcgatacagggactctcgagaagaagtccggcgcatgtgaagatcacagcatggcccaggccggagaagtcgtgctgaaaatgaaggttgaaggcatgacttgtcatagctgcaccagcaccatcgaagggaaaattgggaagctgcagggtgtacagaggattaaggtgtcgttagacaatcaggaggccactattgtctatcaacctcaccttatttcagtggaagagatgaaaaagcagattgaggctatggggtttccagcctttgtcaagaagcagcctaagtatctcaagctgggagccatagacgtggagcgtttgaaaaatacaccagtgaagagctctgaaggcagtcagcagcgaagtcccagctatacaaacgacagtacagctacctttatcatcgacggcatgcattgcaaaagctgcgtgtcaaacatcgaaagcaccctcagcgctctacagtatgtgtctagtatagtggtgtccctggagaatagaagcgcaatcgtgaagtataatgcatcatctgtcactcccgaaagcctgagaaaagcaatcgaggctgtcagccctggactatacagggtctccattacatcagaggtggaatcaaccagtaacagccccagttcaagcagcctgcagaagattccgcttaacgtagttagtcagccactcactcaggagactgtaatcaatattgacggtatgacttgcaactcatgcgtgcagagtatcgaaggggttatctctaaaaaacccggtgtgaagagtatcagggttagcctggcgaacagcaatggaactgtggagtacgatccactactgactagccctgaaacactgcgtggtgccattgaggatatgggctttgatgctacgctgagcgacacgaatgagccgctcgtggttattgcccagccttcatctgagatgcctctgttgacatccactaacgagttctacacaaaaggaatgacaccggtgcaagataaggaagaagggaagaattcctctaagtgctacatccaggtgactggcatgacctgtgcttcctgcgttgccaacattgagaggaacttgcgtcgcgaggaaggtatctacagcatcctggtcgccctcatggcgggtaaggccgaggtgcggtacaatccagcggttatccagccccctatgatcgccgagtttatccgtgagctcggatttggtgccactgtaattgaaaatgctgacgaaggcgatggggttctggagctggtggtccgcggaatgacatgtgccagctgcgtgcataagatagagagtagtctcaccaaacatcgaggtatactctactgctcagtcgctcttgccaccaataaagctcacattaagtacgacccagagatcataggcccaagggatatcatccatactattgaggtctcagcaaaaaacctctgtttttgtgtcttaacctatcttatttctactcctgtaaatcacttttggttcgccagcgaccgaggcaacgaaaagaagagcaattccttcgagcattttaagcaagatctctcccagaatctcatgtag

SEQ ID NO: 215239 - DNA, 825 bp, Artificial Sequence
  Description of Artificial Sequence: Synthetic coding sequence
atggacccatctatgggcgtgaattccgtgacaatttccgtggaggggatgacctgcaattcatgtgtgtggacaattgaacagcagatcggcaaagtgaatggggtacaccacattaaggtcagcctggaggagaaaaacgcaacaattatatacgatcccaaacttcagacccccaagacattacaggaagctatcgacgacatgggcttcgacgccgtgatacataatcctgatcccctcccggtgcttactgacacactgttcctcactgtgactgccagcctcacgttgccttgggatcatattcagtcaacactgcttaagaccaaaggagtaaccgacattaagatctaccctcaaaaacggacggtagccgtgaccattattccatcaatcgttaacgcaaaccagatcaaagagttggtacccgagctgtccctggacacggggacgctggaaaaaaaaagcggtgcttgtgaagatcattccatggctcaggccggagaagtggtcctgaaaatgaaggtcgagggcatgacctgccattcttgcacaagcacgatcgagggcaagatcgggaagcttcagggagtacaacgcattaaagtttctttggataatcaggaagctacaattgtgtaccagccgcacctcatcagtgtggaagaaatgaaaaaacagatcgaagccatgggattccccgcttttgtgaaaaagcaacccaaatatctgaaactcggagcaatagatgtggaaaggcttaagaacacccctgttaagtcctcagaaggaagccagcaaaggtctccgagctatcagtag

SEQ ID NO: 215240 - DNA, 546 bp, Artificial Sequence
  Description of Artificial Sequence: Synthetic coding sequence
atgagaccatccggtacatgcgcttcgtgtggtagcgatccaccgccacctacccaagtgccctctagtcgcaatgactgtggcagcacagtcccggacaacccctttgtgagaacgcttcctcacacaaccatgagtggccaccagctccccccagcgggtacccagcgtcctggacctgccgcatgtcttgtccctggctccctcccctcactgccctcccagcccggtccatggggggctttggggaccgccgcagccgagggtatgagttgcagtaatacgaggacagcactggaatttgccctgtttcccaaagaaatgctactgggaagctggtatggctggggtttgtctttatacaggcgtggacgatgccaagactccgcacacccggaagaggatacctgcccccatggcgaaggcgctcctgctcaggctggagagtcggtgcctagccaacagctatgtcatcaccccgctggaaactggggtggtctctactgggtgatcggtaaagctttttcccttgcatggaattgctag

SEQ ID NO: 215241 - DNA, 642 bp, Artificial Sequence
  Description of Artificial Sequence: Synthetic coding sequence
atgcgggtgaggggtccagctcgtcttatcgcctccggtgctaggttactgctaagaatgttatctgcacttcctgggtggggcccagctcatcttcagcgcccactactcggacccgcttcatgccttgggattctcagaccagcgatgactgcccactctttcgccctgccagtgatcatcttcaccacgttctggggcctggtgggtatcgccggaccttggtttgtgccaaaaggtcctaacagaggtgtgatcatcacgatgctcgtagctaccgcagtctgttgctatctcctgtgtcctgcattgggcatgacagtggcacccctgtccttaactaccccctcaagcggcccatcaccgactcaactgtgtctagtaacttcaagcctgctgctggctcccagggatcccgatccccaaggcttgcccggatcctggaaatccagccagtcctcccagcccgctcgagccctagggagtcccggtcatagcagcggaagaggggatgtcctgctccaatacccacactgtagcggagtgtgcccactctctcagggcgacgcagccggtgaattggtgtgggtcggtagctttcctctccagacaggtcagatgcccggtttgtcccccagttag

SEQ ID NO: 215242 - DNA, 495 bp, Artificial Sequence
  Description of Artificial Sequence: Synthetic coding sequence
atgactgcacattcgtttgcacttccagtgattatcttcacaaccttctggggcctggtaggcatagctggtccctggttcgtcccaaaaggacctaatagaggggtaatcattactatgctggtggccacggcggtctgttgttacctgctttgcccagcactcggaatgacggtagcccctttgagcctgactaccccgagctccggcccaagcccaacacagctgtgtcttgtcacatcttcccttctactcgctccgagagatcctgatccacaaggcctgcctggttcttggaaatcaagtcagtcgtcccagccagccagggcgctgggttcacccggtcatagctcaggacggggagacgtgcttttgcaatatcctcactgcagcggcgtatgccccctctctcagggagatgctgctggcgagctagtgtgggtggggtcatttccattgcagacaggacaaatgcctggcctgtccccttcttag

SEQ ID NO: 215243 - DNA, 393 bp, Artificial Sequence
  Description of Artificial Sequence: Synthetic coding sequence
atgagggttagagggcctgcgaggctcatcgcttctggagcgagactgctactgcggatgttatccgccctgccgggttggggacctgcgcatctgcagcggcctcttctgggaccagcttcctgcctggggattctgagacccgctatgacagcccactctttcgctctcccggtgataatctttacaacattctggggactggtcgggattgctggcccatggtttgtccccaagggccctaatcgtggagtcattatcacaatgctggtggcgacggccgtttgttgttatctcttctggctcatcgccattctggctcaactgaaccctctattcggtccacaattaaaaaacgagacgatctggtacgtacgctttctttgggaatag

SEQ ID NO: 215244 - DNA, 246 bp, Artificial Sequence
  Description of Artificial Sequence: Synthetic coding sequence
atgacagcccattccttcgccctccctgtcatcattttcactacattctgggggcttgtaggtattgctggaccatggtttgtgccaaagggccctaaccggggagtcatcatcaccatgctggtggctaccgctgtgtgctgctatttgttttggctgattgccattctggcccagcttaatccactctttggaccccagctcaagaacgaaacaatctggtatgtgaggttcctctgggagtag

SEQ ID NO: 215245 - DNA, 564 bp, Artificial Sequence
  Description of Artificial Sequence: Synthetic coding sequence
atgacagcacacagtttcgccctccccgtcatcatctttacgaccttttggggtttggtagggatcgccggtccttggtttgtgcctaaggggccaaacaggggagtaatcatcaccatgctggtcgccacagcggtctgctgttacctcttctggctgatcgcaatcttagctcagttaaacccacttttcggaccacaactgaagaacgagacaatttggtgccccgcactcggaatgactgtggcacccctatccctcacaactccatcttcaggacccagtcctactcagttgtgccttgtcacaagcagtctgctgctagcacccagggatcccgacccccagggactcccgggatcttggaagtcttctcaatcatcccaacccgcacgggcactggggtctccgggacactccagtgggcgaggggacgtgctattacaatacccacattgctcgggagtttgcccattgtcccagggcgacgccgctggagaattagtctgggtggggtcgtttcctctccaaacggggcagatgcccggtctgtcaccttcctag

SEQ ID NO: 215246 - DNA, 357 bp, Artificial Sequence
  Description of Artificial Sequence: Synthetic coding sequence
atggcctcccagtcccagggaatacagcagctactgcaagcagagaagcgcgcagctgaaaaagtgagtgaggctcggaaacgtaagaacagacgcctgaaacaggcaaaagaagaggcccaggccgagatcgagcaatataggctacagagagagaaggagttcaaggctaaagaggcagcagccctgggatctagagggtcttgctccaccgaagtcgagaaggagactcaggaaaaaatgaccatcttacagacatattttcggcaaaacagagatgaggtccttgacaatcttctcgcttttgtgtgtgatataaggccggagatccacgagaactaccgcattaacggatag

SEQ ID NO: 215247 - DNA, 357 bp, Artificial Sequence
  Description of Artificial Sequence: Synthetic coding sequence
atggcctctcagtcccaggggatccaacagctgcttcaggccgagaagagggccgcagaaaaggtggcagacgcaaggaagcgcaaggccaggcgactcaaacaggccaaagaagaagcccaaatggaagttgaacagtatcggagggagcgcgaacacgagtttcaaagtaaacagcaggcggcaatgggctcccaaggaaatttgagtgccgaagtcgaacaggccactcgcagacaagtgcagggcatgcaatcgtcacaacagaggaatcgagaacgagtgctcgcgcaactcctcggaatggtgtgtgatgtgagaccacaggtccatccaaactaccgcatctcagcctag

SEQ ID NO: 215248 - DNA, 237 bp, Artificial Sequence
  Description of Artificial Sequence: Synthetic coding sequence
atggcatcccagagccaggggatacagcagcttcttcaagccgaaaagagggccgcagagaaggtggccgacgcccgaaaacggaaggccagaaggttgaaacaggctaccagacgccaagtgcaggggatgcagtcaagtcaacagcggaatcgcgagcgggtgcttgcccagctgttgggtatggtttgcgatgtccggccacaagttcatccaaattatcggatttccgcctag

SEQ ID NO: 215249 - DNA, 357 bp, Artificial Sequence
  Description of Artificial Sequence: Synthetic coding sequence
atggcatcccagtcacaggggatccaacagttactgcaggcagaaaaacgcgcagccgaaaaggtggccgatgccaggaaacgtaaagccagaaggttaaagcaggccaaggaagaggctcagatggaggtcgagcagtacagaagggagcgcgaacacgagttccaatcgaaacagcaggctgccatgggaagccaaggtaatctgtcagcagaggtggagcaggcaacgcgacggcaagtccagggaatgcaatctagtcagcagcgtaatagagagagggtcctggcccaactactcggtatggtgtgcgacgtgcgtccacaggtccacccgaattatagaatctcagcctag

SEQ ID NO: 215250 - DNA, 477 bp, Artificial Sequence
  Description of Artificial Sequence: Synthetic coding sequence
ggaggccaacagcacgcggtgccatgtccgcatggcggaccaggtggtcaggggcagcctagggcagaggccgctggcacaggacagggccatcggggaggacatcggcctggagctgtggtaggggctgcccaacatctccaccgaggtctaggagtagccggaggcggacccggaccgggaccggcagtgctgcagactaggaaggcccgtaggctcaagcaggcaaaggaggaggcacaaatggaggtggaacagtaccgtagggaacgggaacatgagttccagtctaagcagcaggcagcaatgggcagccaaggtaatctgtccgctgaagtagaacaagccactaggagacaggttcaagggatgcagtccagccagcagcgaaatcgagagcgagtgctggcacagcttctcggcatggtgtgtgatgttagaccacaggttcaccccaactaccgcatctcagcctag

SEQ ID NO: 215251 - DNA, 237 bp, Artificial Sequence
  Description of Artificial Sequence: Synthetic coding sequence
atggcgagtcagtcccagggtatccagcaattgctgcaggctgagaaacgagcggctgagaaagtcgccgacgctcggaagaggaaagctcgccgactgaagcaggcgactcggagacaagttcaaggcatgcagagcagccagcaacgcaatagagaacgggttctggcacagctgctggggatggtgtgcgatgtacggcctcaggtgcatcctaattaccgaattagtgcgtag

SEQ ID NO: 215252 - DNA, 237 bp, Artificial Sequence
  Description of Artificial Sequence: Synthetic coding sequence
atggcaagccagagccaggggatccagcagctcctgcaagccgagaaaagagcggctgagaaagtagccgacgcgcgaaagcggaaagcgagaagattaaagcaggccactagaagacaggtgcaaggcatgcaaagtagtcagcaacgcaacagggaacgtgtgctggcccagcttttaggaatggtgtgtgacgtccgtcctcaggtccaccctaattatcggatctctgcctag

SEQ ID NO: 215253 - DNA, 357 bp, Artificial Sequence
  Description of Artificial Sequence: Synthetic coding sequence
atggcctcccagtctcaaggaatccagcagctccttcaggccgagaaaagagccgctgagaaggtggccgatgcgaggaagcgcaaagccagacgcctcaagcaggcaaaggaggaggcccagatggaggtcgagcagtatcgacgggagagggagcacgaatttcagagcaaacaacaagcagcgatggggtctcaggggaatctatctgccgaagtggagcaagcgacacgcagacaggtacagggcatgcaatcctctcagcagaggaaccgcgagagggtgttagcacagctgctgggtatggtgtgtgacgtgcggcctcaagtacatcccaactatcggatctctgcctag

SEQ ID NO: 215254 - DNA, 237 bp, Artificial Sequence
  Description of Artificial Sequence: Synthetic coding sequence
atggcgtcacagtcgcagggcattcagcagctcctgcaggctgagaaaagagctgccgaaaaagttgctgacgcgagaaagcgcaaggcaaggcgtctcaagcaggctactcgacggcaggtccaagggatgcaatcctcacagcagcgtaacagagagagggtactggcacagctgctgggcatggtgtgcgacgtgagaccccaagtgcaccctaactaccgaatctccgcttag

SEQ ID NO: 215255 - DNA, 357 bp, Artificial Sequence
  Description of Artificial Sequence: Synthetic coding sequence
atggctagccagtctcaggggatacagcaactgttacaggcagaaaagagagccgcagagaaagttgctgacgcccgaaaacggaaagcacggcgactcaaacaggccaaagaagaggcccagatggaggtcgaacagtatagaagggagcgtgaacacgaattccaaagtaagcagcaagccgctatggggagccagggcaacctgtcagccgaagtggaacaagcaaccaggcgccaggtgcaggggatgcaaagctcacagcagcgaaatcgggaaagagtgttggctcagctcttgggcatggtgtgcgacgtccgaccacaggtgcaccctaactacagaatcagcgcgtag

SEQ ID NO: 215256 - DNA, 237 bp, Artificial Sequence
  Description of Artificial Sequence: Synthetic coding sequence
atggccagccaaagtcaaggaatccaacagttgcttcaggctgagaagcgcgctgcggaaaaggtggctgacgcacgcaaacgcaaagccaggcgcctcaaacaagccacccgacggcaagtgcagggaatgcagagcagtcagcagcgtaatagggaacgtgtcttagctcagttgctgggaatggtttgcgacgtccggcctcaggtccaccctaactatcggatttcagcctag

SEQ ID NO: 215257 - DNA, 237 bp, Artificial Sequence
  Description of Artificial Sequence: Synthetic coding sequence
atggcctctcagtcccaaggcatccagcagctgctgcaggccgagaaacgagccgctgagaaggtggccgatgccaggaagagaaaagcacggagactcaagcaggctaccaggagacaagtgcagggcatgcagagtagtcagcagcgaaatagggaaagggttctggctcagctactgggcatggtgtgtgatgtgcggcctcaagtgcaccctaattatcgcatctccgcgtag

SEQ ID NO: 215258 - DNA, 357 bp, Artificial Sequence
  Description of Artificial Sequence: Synthetic coding sequence
atggcgtctcagtcacagggaatccaacagctgctccaagccgaaaaacgcgctgccgagaaggtcgccgatgcgaggaagcgaaaagctagacggctgaagcaggccaaggaggaagcacagatggaggtggaacagtatagacgcgaacgggagcatgagttccagagtaagcagcaagcagccatgggctcccaaggaaacctttctgccgaagttgaacaggcaactagacgtcaggttcagggaatgcaaagctcacaacagagaaatcgggaacgcgtcctcgcccaactgctgggaatggtgtgcgatgtgaggcctcaggtccaccccaattaccgcattagcgcttag

SEQ ID NO: 215259 - DNA, 237 bp, Artificial Sequence
  Description of Artificial Sequence: Synthetic coding sequence
atggcatcccagagtcaaggaattcagcagctcctgcaggcagagaagagggccgctgagaaggtggccgacgctcgcaagagaaaggcaaggcggctgaagcaggcgaccagacgccaggttcaaggaatgcagagctcacagcagcgcaatagagaaagagtgctggctcaactgcttggtatggtatgcgacgttcggccacaggtacaccccaattatagaattagtgcgtag

SEQ ID NO: 215260 - DNA, 357 bp, Artificial Sequence
  Description of Artificial Sequence: Synthetic coding sequence
atggcctcccagtcccagggaattcaacagttattgcaagcagaaaaaagagctgctgagaaagtggccgatgctagaaaaaggaaggctagacgcctcaaacaagccaaggaagaagcacagatggaggttgagcagtacagaagggagagagagcacgaattccagtcaaaacagcaggcagccatgggaagccaaggcaacctcagcgccgaagttgaacaggcaacaagacgacaggttcaggggatgcaaagtagccagcaaagaaatagggaaagagtccttgcacagctgcttgggatggtgtgcgacgtcaggccgcaggtgcatccgaactacagaatctctgcatag

SEQ ID NO: 215261 - DNA, 357 bp, Artificial Sequence
  Description of Artificial Sequence: Synthetic coding sequence
atggctagccagtcccagggaatccagcagctgctgcaggccgagaaacgtgcagcagagaaggtagcagatgccagaaagcgcaaagcacgaagactcaaacaggctaaggaagaggctcagatggaggttgagcagtaccggagggagcgagagcatgagtttcagtccaagcagcaagctgctatgggttcccaggggaatctctcagccgaggtggagcaggctactaggcgccaggtgcagggtatgcagtcatcacagcagcgcaatcgggaacgtgtgcttgctcagcttctcgggatggtgtgtgacgtccggccacaggtgcatcctaattatcgtattagcgcctag

SEQ ID NO: 215262 - DNA, 234 bp, Artificial Sequence
  Description of Artificial Sequence: Synthetic coding sequence
atggaggtcgaacagtatcgccgtgagagggaacatgaatttcagagtaaacagcaagctgctatgggaagtcagggcaatctatctgccgaggtcgagcaggctaccaggaggcaagttcagggaatgcaatcttctcaacagaggaatcgcgagagggttctcgcccaacttctggggatggtttgcgacgtaagaccccaggtccaccccaattataggatctcagcttag

SEQ ID NO: 215263 - DNA, 348 bp, Artificial Sequence
  Description of Artificial Sequence: Synthetic coding sequence
gtcgagccagggatccagcagctcctgcaggcggaaaaacgagcagctgagaaggtggcagacgcccgtaaaaggaaggcaaggagactgaagcaagcgaaagaggaggctcagatggaggttgagcaatataggcgcgaaagggagcatgagttccagtctaagcaacaggcagctatgggatcacaaggaaacctttcagccgaggtggaacaggcaacccgccgacaggtgcaagggatgcaaagcagccagcaacggaaccgcgaacgtgtactggctcagcttctaggaatggtatgtgatgtcaggcctcaggtccaccccaattacagaatctccgcatag

SEQ ID NO: 215264 - DNA, 468 bp, Artificial Sequence
  Description of Artificial Sequence: Synthetic coding sequence
atgagcgaatccaagtcaggaccggaatacgcttcttttttcgctgtcatgggagcttctgccgcaatggtgttctctgctctcggcgctgcctatgggacagcaaagtctggaaccggcatcgccgcaatgtctgtgatgagaccagagcagattatgaaaagcatcatacccgtggtgatggcaggcatcatcgcgatctatggcctggtcgttgccgtacttatcgccaactctctgaacgacgacatctcattgtacaaatcttttctacagctgggcgcagggctgtcagtggggctctccggcctagcggctggctttgccatcggaatagttggggacgcaggcgtccgaggtacagctcagcagcccaggctgttcgtgggaatgatactgatcttaatattcgccgaggtgttgggattgtacggtctgatcgtggccctcattctctcaactaagtag

SEQ ID NO: 215265 - DNA, 477 bp, Artificial Sequence
  Description of Artificial Sequence: Synthetic coding sequence
atgtggagcaacctggggatcggtctggccattagtctaagcgtagtgggcgctgcctggggtatatatatcaccggttcatcgattattggtggaggagttaaagccccacggatcaaaacaaaaaacctcgtgtccatcatattttgcgaagccgtcgctatctacggtattatcatggcaatagtgatttcaaatatggcagagccctttagcgccactgaccctaaagccatcggccatcgcaactaccatgcaggttactctatgtttggggctggactaaccgtcgggctgtcgaacctgttctgtggagtctgtgtgggaatagtgggcagcggagctgcacttgccgatgctcaaaatccaagtctgttcgttaagattctgatcgtcgaaatatttggatccgccatagggctcttcggggtgattgtggccatcctgcagacaagccgcgtcaagatgggagactag

SEQ ID NO: 215266 - DNA, 129 bp, Artificial Sequence
  Description of Artificial Sequence: Synthetic coding sequence
gtggggtctggagctgcgcttgccgacgctcaaaatccaagtctgtttgttaagattctgatcgtggaaatattcggttccctggcatccttgggtagttcaagccaattctttcgaccccctgagtag

SEQ ID NO: 215267 - DNA, 759 bp, Artificial Sequence
  Description of Artificial Sequence: Synthetic coding sequence
atgactggtctggccctcttgtactctggggtgtttgtcgctttttgggcatgtgctctagccgtaggcgaagcagggagttggcgggcaggggcagccagccggccttcttggcccggacgcaactcagccggtaaatggccggcagggaacaccggcccaccaagggctctgcaccctagattatggggcctggccccagctcgggcaagcgacagtgataaaggggacccagattttcagctccttgaggagggcttcctgaccgaaacctcacctttcatgtggagcaaccttggcataggactggccattagtctgtccgtggtaggagccgcttgggggatctacataacaggctccagcattattggcggaggtgtgaaggcccctaggatcaagacgaaaaacttggtgtcaatcatcttctgcgaagccgtagcaatatacggaataattatggccatcgtgatctccaacatggctgagcccttcagcgccactgatcccaaagccattggccatcgcaattaccacgcgggatatagtatgttcggtgcgggactgacagtggggctgtccaacctgttttgtggggtctgcgtgggaatagttggctctggagcggcattagctgatgcccagaatccatccttgtttgtcaagatactgatcgtggaaattttcggctctgccataggattgttcggagtgatcgttgccatccttcagacttctagagtaaaaatgggtgactag

SEQ ID NO: 215268 - DNA, 618 bp, Artificial Sequence
  Description of Artificial Sequence: Synthetic coding sequence
atgactggacttgcactcctgtactccggcgtgttcgtcgccttttgggcctgtgcactggcagtgggtgtgtgttacaccatctttgacctaggattcaggtttgatgttgcatggtttttgaccgagacaagccctttcatgtggtcgaacctgggaatcggtctggcgatctcgttaagcgtggttggagcggcttggggaatctacattactgggagttctataatcgggggaggagtgaaggcgccaaggataaaaaccaaaaacctcgtgagcattatcttctgtgaggcagtggccatatacggtattatcatggcaatcgtgattagcaacatggccgaaccattttcagccaccgacccgaaagctatcgggcaccgcaattatcacgccggttattccatgttcggtgcgggacttactgtggggctgtcaaacctgttttgtggtgtctgcgtgggcatagtcggaagcggcgctgctttggccgacgcccagaacccttccctgtttgtgaagattctaatcgtggagattttcggctctgccatcgggttgttcggcgtgatcgtagcaatacttcaaacttctagagtaaagatgggcgattag

SEQ ID NO: 215269 - DNA, 261 bp, Artificial Sequence
  Description of Artificial Sequence: Synthetic coding sequence
atgtggtcaaatctcggcatcggcttggctatcagtctgtctgtcgtgggtgccgcttgggggatttatatcaccggatcttccattatagggggaggagtgaaggcaccgcgaatcaaaaccaagaacctggtctctattatcttctgcgaagccgtggcaatttatggcattataatggccatagtcataagtaacatggcggagccattcagcgcaaccgacccaaaggcaattggacataggaattaccacgcctag

SEQ ID NO: 215270 - DNA, 477 bp, Artificial Sequence
  Description of Artificial Sequence: Synthetic coding sequence
atgtggtctaatttgggcataggactagcaatctccctgtccgtggtgggtgctgcctgggggatctacatcacgggttcgtccattattggaggtggcgtcaaagccccacggattaaaactaagaacctagtgtcgattatcttctgcgaagctgtggctatctacgggatcattatggccattgtgatcagtaacatggccgagccattctcagcaacagacccaaaagcaatcggtcacagaaactaccacgctggctactcaatgtttggcgcagggttgacagtggggctatctaatctgttctgtggggtctgtgtgggtatcgtggggtcgggggctgcattagctgacgcccagaacccaagcctatttgtgaaaattctgatagtcgaaatcttcggatcagccatcggactttttggagttatcgtggcaattttgcagacaagccgtgtgaaaatgggagactag

SEQ ID NO: 215271 - DNA, 786 bp, Artificial Sequence
  Description of Artificial Sequence: Synthetic coding sequence
atgacagggcttgctctcttgtatagcggtgtgtttgtcgccttctgggcatgtgcccttgcggttggagtctgctataccatattcgacctgggcttccgctttgatgtggcctggtttctgactgagacgagccctttcatgtggagcaacctgggaatcggccttgctatttctctgtccgtggtgggagcggcatggggcatttacattaccggatcctcgattatcggcggaggcgtgaaggcccctagaatcaagaccaaaaatctcgtgtctattatcttctgcgaggccgtggccatatatggcattatcatggccattgttatttctaatatggccgaaccgttctccgctacggatcctaaagccataggccatcgcaactaccacgctgggtactcaatgtttggcgcagggctgactgtcgggctgagtaatctcttctgtggggtttgcgtcggaattgtgggctcaggggcagcactggccgatgcgcaaaacccaagtttatttgtgaagattctcattgttgaaatcttcggctcagccatcgggctattcggggtgatagtcgcgatcctgcaggttatgaatcctctgggaaaacccctgtgtccttgccctcagccaagcctcaccctcctgctggaaaaacttaaatgctccccttcgctccctattaccatcgactcaccgaagcagcttcccccaccacacttccatctattagtgttttcgtaccgcggaagtctgttcttgagcctcatctggtgtcactag

SEQ ID NO: 215272 - DNA, 681 bp, Artificial Sequence
  Description of Artificial Sequence: Synthetic coding sequence
atggctctaagcgacgctgatgtgcagaagcagataaagcatatgatggctttcatcgaacaggaggcaaacgagaaagcagaagaaattgatgcgaaagccgaggaggagttcaacattgagaaaggcaggcttgttcagactcagcgtctaaagataatggagtattacgagaagaaggaaaagcagattgagcagcagaagaaaatccagatgagtaatctaatgaaccaggcgagactgaaggtgctgcgcgcacgcgacgacctcatcactgatctcttgaacgaggctaaacagcgactctcaaaagtagtcaaagataccacacggtaccaggtgctcctagacggcctggtcctgcagggcctctaccagctgttagagccccgaatgattgttcggtgtcggaagcaggactttcccctcgtaaaggcggcagtacaaaaggccatccccatgtacaagattgccactaagaatgatgtggacgttcaaatcgatcaggaatcctacctgcccgaagacattgctggtggtgtagaaatttacaatggcgatcgtaagatcaaggtgtctaatactcttgagtccaggctggacctcatagcacagcagatgatgccagaggtgcgcggagcactgttcggggcaaacgcaaaccgcaagttccttgattag

SEQ ID NO: 215273 - DNA, 591 bp, Artificial Sequence
  Description of Artificial Sequence: Synthetic coding sequence
atggccctgtccgacgccgacgtgcagaaacagattaagcacatgatggcttttatcgaacaggaagccaatgaaaaggcagaggaaatcgatgcgaaagccgaagaggaatttaatatcgagaaaggcagactcgtacagacccagcgtctcaaaatcatggagtattatgaaaagaaggagaaacagatagaacagcagaaaaagattcagatgtccaatctgatgaaccaggcacgcctgaaagttttaagagccagagacgacctcataaccggcctgtatcaactgctggagcccagaatgattgtgaggtgccgtaagcaggattttcctcttgtgaaggctgcggtccagaaggccatccccatgtacaaaatcgctaccaaaaatgacgtcgacgtgcagatcgaccaggagagctatctgcccgaggatattgccggaggggttgaaatttacaacggagacagaaagataaaagtgagtaatacactggaatctcgtcttgacctgatcgctcaacagatgatgccagaggtaaggggggctctgtttggagccaacgccaatcgtaaatttctagactag

SEQ ID NO: 215274 - DNA, 615 bp, Artificial Sequence
  Description of Artificial Sequence: Synthetic coding sequence
atggccttatcggacgcggatgtccagaagcaagccgaggaagagtttaacattgagaaggggaggctggtgcaaactcagagattaaagataatggaatactacgaaaagaaggagaagcagattgagcagcagaagaagatacaaatgtccaaccttatgaaccaggccagactgaaggtgctgcgcgcaagagatgatctgataacagacctgttgaatgaagccaagcagagactgtccaaggttgtgaaggacacaacaaggtaccaagtgctcttagatggactcgtgctgcagggtctctaccagctgcttgagccgaggatgatcgttcgttgccggaaacaggactttccgttagtcaaggctgctgtccagaaggcaatacctatgtacaagatagctactaaaaatgatgtggacgtccagatcgatcaggaatcctacttacccgaagacatcgcagggggagttgagatctataacggcgatagaaaaattaaggtgtcaaatactctcgagagccggctcgatctgattgcgcagcagatgatgcctgaggtccggggagctctgtttggggctaacgcaaatcggaagttcctcgactag

SEQ ID NO: 215275 - DNA, 1056 bp, Artificial Sequence
  Description of Artificial Sequence: Synthetic coding sequence
atgagtttctttcccgagttgtacttcaacgtggacaacggatacttagaaggtttggttcgcggactcaaggctggtgtgctgagccaggctgactacctgaatctcgtccagtgcgaaactctcgaagatctcaagctgcatctccagagtactgactacgggaattttttagcaaatgaggcctccccactgacagtgtcagtcattgacgatcgactaaaggagaaaatggtcgttgagttccgccacatgcgcaaccacgcttacgaaccactagcctctttcctggatttcatcacctactcttatatgatcgacaatgtgatccttctaatcacagggaccctacaccagcggtccatcgctgagttggtgcctaaatgccacccattagggtccttcgaacagatggaagccgtaaacatcgcgcagacaccagctgagctttacaacgccatcctggtcgacactcccctcgccgcattctttcaggattgcattagcgagcaggaccttgatgaaatgaatattgagatcattcgtaatacactgtacaaagcatacctcgaaagcttctataagttctgcaccctcctgggaggcacaacagctgacgccatgtgccctatcctggaattcgaggcagaccgacgggcattcattatcacaatcaattcattcgggacagagctttccaaagaagatagagcaaagttattcccacattgtggtcgtctctatccagaaggcctcgcccaactggcaagggcagatgactatgagcaggtgaagaatgtggcagattactatccagaatacaagctactgtttgaaggcgcaggcagcaatcccggagacaaaacactcgaagaccgtttcttcgaacacgaggtgaaactcaacaagctggctttcctgaatcagttccactttggtgttttttacgcgttcgtaaaactcaaagaacaggagtgtagaaatatcgtttggatcgcagagtgcatagcacagaggcaccgagcaaaaatcgacaattatatacctatcttttag

SEQ ID NO: 215276 - DNA, 825 bp, Artificial Sequence
  Description of Artificial Sequence: Synthetic coding sequence
atggtggtagaattccggcatatgcgcaatcacgcctatgaacctctggccagctttcttgatttcataacctattcttatatgatcgataatgtgatactactaataacagggacattgcatcagcggtccatcgccgagctggtcccaaagtgccaccctttgggcagtttcgaacaaatggaggctgtaaacatcgcccagactccagcggaattgtataacgccattctcgtggatacccccctcgccgcttttttccaagactgcattagcgagcaggacctcgatgagatgaatatagaaattatcaggaataccctttacaaagcctatcttgaaagtttttacaaattttgcacccttttggggggtaccacagctgacgcaatgtgccccattctggagtttgaagcagaccgccgagcgttcatcattacaatcaacagctttggtaccgagttatcgaaggaggatagagccaagctcttcccacactgtggaaggctttacccggaggggctggctcagctagcacgggcagacgattatgaacaggtcaagaacgtggccgactactatcctgagtacaagctgctttttgaaggcgcaggaagtaaccctggagacaaaacccttgaggacaggttctttgaacacgaagtcaagttaaacaagcttgccttcctgaaccagtttcattttggggtgttttacgcctttgttaagctcaaggagcaggagtgtcgcaacattgtgtggattgccgagtgtattgcacagcgacatcgcgctaagatcgacaattatattcccattttttag

SEQ ID NO: 215277 - DNA, 1179 bp, Artificial Sequence
  Description of Artificial Sequence: Synthetic coding sequence
atgagctttttcccagagctgtattttaatgtcgacaacgggtatctggaggggctcgtacggggtttgaaggcgggagtgctaagtcaagccgactatctgaatctcgtgcaatgcgaaactctcgaggaccttaagctccaccttcagtccaccgattatggaaacttccttgctaatgaagcgtccccgctgactgtgagcgttattgacgacaggctgaaggagaaaatggtggtggaattccggcatatgagaaaccatgcctacgaaccacttgccagctttctcgactttatcacacaggaatcagaggcagggactccagagggccctgggaatatgcctaagctcggttccagaccgagcccaggccatagacccccttttttaagggtgtctttgctgccttggccacccagtagctatagctacatgatcgataatgttattctgctgatcactggcactttacatcagaggtccatcgctgagctggtccctaagtgccatcccctcggatcgtttgaacagatggaggccgtgaatatcgcacaaaccccggcagagctgtacaatgcaatcctggtggatactccattggctgctttctttcaagactgtatatccgagcaggacctggatgagatgaatatcgaaatcattaggaacaccctgtacaaggcttacctggaaagcttttataaattctgcactctgcttggcggaaccacggctgatgcaatgtgtcccattctcgaatttgaggccgacagaagagccttcataattaccattaatagcttcggcaccgagctgtccaaagaggaccgcgctaaactttttccccactgcgggcgactttaccccgagggcttagctcagctggcccgagcagatgattacgaacaggtgaagaacgtagccgattattaccccgagtacaagttgttattcgaaggagcaggttccaacccgggtgataaaaccctcgaggacagattcttcgagcatgaggtcaagctgaacaaacttgcctttttgaaccagttccacttcggtgttttctatgcattcgtgaaacttaaagaacaggagtgccgcaacatcgtatggatagccgaatgtattgcccagagacacagagccaagatagataattacattccaatcttttag

SEQ ID NO: 215278 - DNA, 1149 bp, Artificial Sequence
  Description of Artificial Sequence: Synthetic coding sequence
atgaccgaattttggcttattagcgcccctggcgagaagacttgtcagcagacctgggaaaagctgcatgctgccacatccaaaaataacaaccttgccgtgacctctaagttcaatatccccgatctgaaagttggcaccttagacgtcttagtgggcctgtctgatgagctggcaaaactcgatgccttcgttgagggggtggtgaagaaagtggcccagtacatggcagacgttcttgaagactcaaaggacaaggtgcaggagaacctgttagctaatggagttgacctggtgacctacatcactcggttccagtgggacatggcaaaatacccgataaagcagtcactcaaaaatattagcgaaatcattgcaaaaggagtcacacaaatagacaacgatctgaagagcagagccagcgcctacaacaatctaaagggcaatctgcagaatctagagcgcaagaacgcaggcagcttgctcacccgctctctcgccgagatcgtgaaaaaagatgacttcgtactagacagtgagtacctcgtgaccttactggtggtcgtgcccaagctcaaccataatgattggattaaacagtacgagacactggccgagatggtggtgccgagatcatcgaatgttttgagcgaggatcaggacagttacctctgcaacgttacactatttcgaaaggcggtggacgatttcagacataaggcaagggagaataagttcatagtgcgggatttccagtacaatgaggaggagatgaaagctgataaggaggaaatgaaccgactcagcacagataaaaagaagcagttcggaccactggttagatggctgaaggtgaatttttcagaagcgtttattgcctggattcacgttaaggccttgagggtattcgtcgaatcagtgctgcgctacggacttcccgttaacttccaggctatgctactgcagccaaacaaaaaaacactgaagaaactgagggaggtgttgcatgagttgtataagcatctcgattccagtgcagccgcaatcatagacgcccctatggacatacctgggttgaacttgagtcagcaggagtactacccctatgtctattacaagatcgactgtaatctcctcgagtttaagtag

SEQ ID NO: 215279 - DNA, 1149 bp, Artificial Sequence
  Description of Artificial Sequence: Synthetic coding sequence
atgacagagttctggttgatttcagcaccaggagagaagacttgccagcagacttgggaaaagctgcatgccgctacaagtaaaaacaataatctggccgtcactagcaaatttaacattccagacctgaaggttggtaccctggatgtcctggtaggactgtctgacgaactggccaaattagatgcattcgttgagggtgtcgtgaagaaggtcgcccagtacatggccgacgtattagaggatagcaaagacaaagtgcaggaaaacttgctagccaacggcgtcgacctggtcacttatatcacacggttccagtgggacatggccaaataccccatcaagcaatcgctgaaaaatatcagtgaaattatcgctaagggcgttacccagattgacaatgatttgaaaagcagggcctctgcctacaacaacctcaagggcaacttgcaaaacctggaacggaagaatgccggatcactactgactcggtcacttgcggagattgtgaaaaaggacgactttgttctcgattcagaatacttagtgacactcctagtagtggttcctaagttaaatcataatgactggatcaaacagtacgaaacccttgctgaaatggtggttcccagatcaagcaacgttctctccgaggaccaggattcatacctgtgcaacgtgactctatttcggaaggccgttgatgatttccgacataaggcgcgtgaaaacaagttcatagtgcgggatttccagtacaacgaggaggagatgaaagcggataaggaggagatgaatcggttgagtacggacaaaaagaagcagtttggccctctcgttagatggctgaaggtgaacttttcagaagcctttatcgcttggattcatgttaaagctctgagagtgtttgttgaatctgtgctacggtacggactccctgtgaatttccaggccatgctgttgcaaccgaataagaagactcttaagaagctgagagaggttttgcatgagctctacaaacatctggattcttcggcagcggctatcattgatgctccaatggacatcccgggactgaatctgtcacagcaggagtattacccatatgtgtactacaagatcgactgcaacctactagaatttaagtag

SEQ ID NO: 215280 - DNA, 1053 bp, Artificial Sequence
  Description of Artificial Sequence: Synthetic coding sequence
atggctgtgttcgtagtgctcctcgcactggtggcaggtgttttagggaatgagttcagcatcctcaagtcgcctggatcggtagtgtttcgtaatggcaactggccaataccaggggaacggatccccgacgttgccgcattatcgatgggcttttccgtgaaagaggacctttcttggcctggactagcagtagggaacctgttccataggccccgtgcgaccgtgatggttatggttaagggggtaaacaaattagccctgccccctggcagcgtaatcagttacccactggagaatgctgtgcccttttctctggatagtgtggccaatagcatccactcactgttttccgaggaaacccctgtggtcctccagctcgctccgtctgaagagagagtctatatggtggggaaagcaaatagcgtctttgaagatttatcagtgacacttagacagcttcgcaacaggttgtttcaagagaatagcgtgctgtcgagcttaccccttaactctctgagtcggaacaatgaggtggatttgctgtttctctccgaactccaagttttgcatgatattagcagtttgctttccagacataaacacttagccaaagatcatagcccagatctgtactctctggaactggcagggctggacgagattggaaaacgctatggtgaggatagcgagcaattccgtgacgcttccaaaatacttgtggacgcacttcagaagtttgcagatgatatgtactccctctatggaggtaatgctgtcgtagagctggtgactgtgaagtccttcgacactagcctgatcagaaagacacgcaccattctggaagctaagcaggccaagaaccccgcatcaccatataatctggcttataaatacaatttcgaatacagtgtcgtgttcaacatggtgctgtggatcatgattgctctcgctcttgctgtgataatcacctcctataatatctggaacatggaccctggctacgactcaatcatataccgtatgacgaaccaaaagatcagaatggattag

SEQ ID NO: 215281 - DNA, 732 bp, Artificial Sequence
  Description of Artificial Sequence: Synthetic coding sequence
tgatgtcccgcaggcccttttcgcgtggctccccaatgttgtggaagacgtgggacaatggcagtgtttgtcgtgctactcgctctggttgccggagtgcttggtaacgaattttctatactgaagtctcccggtagcgttgtgttccggaacggtaactggcctatccccggagagcggatacctgacgtcgcggctctcagcatgggctttagcgtgaaggaggatctgtcctggcctggcttagctgtcggcaatctgtttcaccgacctcgcgcaacagtaatggttatggtgaagggagtgaacaagcttgccctcccccctggatcagttatttcatatccactggaaaatgtagatctcctgttcctgtccgaactgcaggtccttcatgacatttcctccctgctctcacgccacaaacatcttgccaaggaccacagtccagatctgtatagcctggagctcgccggtttagacgaaataggaaaaagatatggagaggatagcgaacaattccgcgatgcttcgaagatcctcgtggatgccctacagaagttcgctgatgacatgtactcactgtatggcggaaacgctgtagtcgagctggtgacagtcaaatcattcgacacctcactgattcgcaaaactcggactatcttagaggcaaagcaggctaagaacccagcgtcaccttacaatctggcttacaagtataatttcgagtag

SEQ ID NO: 215282 - DNA, 612 bp, Artificial Sequence
  Description of Artificial Sequence: Synthetic coding sequence
gaaagtgaacgcgtcactagctccaggtgtgggtgccgtccatgccccgcaggcccattcagagtggctccgcagtgctgtgggaggcggggtaccatggccgtgtttgttgtactactggccctggtagcgggagtattgggaaacgagttcagtattttgaaatctcctggctcagtggtgttcagaaacggcaattggccgattccaggagagaggatcccagacgttgcggctctttctatgggcttctccgtgaaggaggatctgtcctggcccggactggctgtgggaaacttgttccacaggccacgcgcaacagtgatggtgatggtcaaaggtgtaaataagttggcgctgccacccggatctgtgatatcgtaccctctcgagaaccgagtctatatggtgggaaaagccaacagcgtcttcgaggatctctccgtgaccctacggcagctccggaatcggctgtttcaagagaatagtgtgctgtcgtccctccctcttaacagcctgtccaggaacaatgaagttgatttgctattcctgtccgaactacaggtgctccacgacatatctagcctcctgagccgtcataagcatctttag

SEQ ID NO: 215283 - DNA, 780 bp, Artificial Sequence
  Description of Artificial Sequence: Synthetic coding sequence
taagtaccaccagccaggagcgttagccccaggtccgccgcagctgccgctgccccttggctgtgtctgtcatgttcttggagatggtggagggatttaagttggccaggactggccgtgggtaacttgttccaccgccctcgcgcaaccgttatggttatggttaagggtgtcaataaattagctctcccccctggctccgtgattagttatccattggagaacgcagtcccattttcgctggatagcgtcgctaactcaatccattcactgtttagcgaagagacacccgtggtcctccagctcgctccatcagaagagcgggtttatatggttgggaaggccaacagcgtgttcgaggacttatctgttacactgagacaactacgcaacaggctttttcaagagaattcggtgctgagttcgctgcccttaaatagtctatctagaaataacgaagtggacctccttttccttagtgaactgcaggtcctgcacgatatatcatccctgctttccaggcataagcatctagcaaaggaccactcccctgatctctactctcttgaactggccggactcgacgagatcggtaagaggtacggggaagacagcgaacagttccgagacgcctctaagatcctcgtggacgccctacagaagttcgcagatgacatgtactcattgtatgggggaaatgcagtggtggagctagtgaccgtaaaaagctttgacacatcactgataagaaagacaaggactatcctagaagccaagtag

SEQ ID NO: 215284 - DNA, 957 bp, Artificial Sequence
  Description of Artificial Sequence: Synthetic coding sequence
atggccgtttttgttgttttgctagcactggttgcgggtgtgttgggcaacgaatttagcatcctgaaatcaccagggtcggtggtgttcaggaatggtaactggcctatacctggcgagcggatccccgatgtggccgcactctctatgggcttttccgtgaaagaggacttgagctggccaggacttgcagtcggcaacctgttccataggccaagagccacggttatggttatggtgaaaggcgtgaataaactggccttgcctcctggctccgtgattagctacccactcgagaacagggtatatatggtgggaaaggcaaatagcgtcttcgaagaccttagcgtaaccctacgccagctgcggaatagactgtttcaggagaacagtgtgctctccagcctcccattgaacagcttgtcgcgtaataacgaggtggacctgctattcttgtctgagttacaggtacttcacgacatttcctccctgctgagtcggcacaagcaccttgccaaggatcattcacccgacttgtacagcttggaacttgccggactcgacgagattggaaaaagatacggcgaggactcagaacagttcagggacgcctctaaaatactggtggatgcccttcagaagtttgccgacgatatgtactctctgtatggtggtaacgctgtcgttgagcttgtgactgttaaatcctttgatacctccttaattcggaagacacgcacaattttggaggcaaagcaggcaaaaaaccctgcttcaccgtacaatctcgcctataagtacaactttgagtattcagtggtattcaatatggtgctctggatcatgattgcactggccttagccgtaatcataacctcttataatatttggaacatggatcctgggtatgatagtattatttacagaatgaccaaccagaaaattcggatggactag

SEQ ID NO: 215285 - DNA, 819 bp, Artificial Sequence
  Description of Artificial Sequence: Synthetic coding sequence
atggctgtgtttgtggttctcctggccctggtggctggggtgctgggaaacgagttttctatcctgaaatctccgggatcagtcgtgtttcgcaatggtaattggcccatccccggtgagcgtatacctgacgtggctgcgctaagtatgggcttctctgttaaagaagatctgtcttggccagggctggctgtgggtaatctctttcaccgcccacgcgcaacagtgatggtcatggtcaaaggtgtcaataaactcgcccttcccccaggttccgtcatctcataccccctcgaaaacgtcgacctactctttttgtcggaactgcaggtcctgcacgatatttcttcattgctgtctcggcataagcacctcgccaaagaccactcaccagacctgtactctttagaactcgctggactggatgagattgggaagagatacggagaagatagtgagcaatttcgtgatgcgagtaaaattttggtcgacgcccttcagaagttcgccgatgatatgtattctttgtacggtggcaacgccgtggtcgaactggtgacggtaaaatcctttgacacatccttaatcaggaagacaagaactattctagaggccaagcaggctaagaaccccgcatccccatataatcttgcctataagtacaatttcgagtatagcgtggtctttaatatggtcttgtggatcatgatcgctctcgccttagctgtaattatcacatcctataatatatggaacatggacccgggatacgactccatcatttatcgtatgaccaatcagaagataaggatggattag

SEQ ID NO: 215286 - DNA, 498 bp, Artificial Sequence
  Description of Artificial Sequence: Synthetic coding sequence
atggcagtattcgtagttctcctggccttagtggcaggtgtgctgggcaacgaatttagcatcctgaagtctcctggaagcgttgtattcagaaacggcaattggcctattcctggagagcgcattccggatgtcgcagccctgagcatgggtttttctgtcaaggaagacctttcctggcccggactggccgttggaaatctgttccatcggcctcgcgcaaccgtgatggttatggtcaagggggttaacaagttggccctgccccctggatctgtgatcagttatcccctggaaaacgccgtacccttttccctggactccgtcgcaaatagcatccactctctgttcagtgaagagacccctgtggtcctccagctggcaccaagtgaagagagggtgtacatggtcgggacgatgaagctaacatgcagtttttttctgaactgcaagtgttatatgatattccaggcttgttgcctggtcatctctatatag

SEQ ID NO: 215287 - DNA, 825 bp, Artificial Sequence
  Description of Artificial Sequence: Synthetic coding sequence
atggtaatggtgaagggagtgaacaagctggccctgccgcctggttccgttatcagctaccctttggagaatgcagtgcccttttctctcgattcagtagctaacagcatacatagcctgttctctgaggagacccccgtcgttcttcagctcgccccaagtgaggaacgcgtgtacatggtgggaaaggccaatagtgtcttcgaagacctctctgtgacactccgacagttgcggaacaggctgttccaggaaaactcggtcttatccagcctgcctctgaactccctgtcacgcaacaacgaggttgatttgctctttctgagcgagctgcaggtgctccacgatatcagctcactattgtcccggcacaagcacttggcgaaggatcacagccccgatctctactcattggagctggccggactggatgaaatcgggaagcgctatggggaggatagtgagcagtttagagatgcaagcaaaatactggtcgacgccctccagaagttcgccgatgacatgtatagcctgtacggtgggaacgcagtcgtggagctcgtcaccgtgaagtctttcgatacatccctgatcaggaagacacgcaccatcttagaagccaaacaagccaaaaatccagcgtccccttataatttagcctacaaatataattttgagtattccgtcgtgtttaatatggtcctttggataatgattgctctggcccttgccgttataattaccagttacaatatttggaacatggaccccggttatgactcaatcatttaccgaatgactaaccagaagattcgcatggattag

SEQ ID NO: 215288 - DNA, 2517 bp, Artificial Sequence
  Description of Artificial Sequence: Synthetic coding sequence
atgggtgaattattccgttcagaagagatgactctggcccagctctttcttcagtcggaagccgcttattgctgtgtgtctgaactgggggagttgggtaaggtgcagttccgggaccttaatccagatgtgaacgtgttccaacgtaaattcgtaaacgaggtgcgcaggtgcgaggaaatggatcgaaaacttcggtttgtcgagaaagagatccggaaagccaatatcccaattatggacacaggcgaaaaccctgaggttccattccctagggacatgatcgaccttgaggcaaatttcgaaaaaatcgagaatgagcttaaggaaatcaacaccaaccaggaggcacttaagcgcaactttttggagttgacagagctgaagttcatcctgagaaagacccagcagttttttgacgaggctgagctccaccaccagcagatggctgaccctgatctgcttgaagaatctagctcactccttgagccctccgagatgggcagaggtacccctctccgattgggctttgtggcaggcgtgatcaacagggagcgaatcccaacttttgaaagaatgctgtggcgggtctgtcgcggaaatgtgtttttacggcaagccgaaatagagaatcccctggaagaccctgtgaccggggattatgtgcacaaatccgtctttattatcttttttcaaggagaccagctgaaaaatagggtcaagaagatctgtgaaggcttccgagcatctctttacccctgtcccgaaaccccacaggaaaggaaagagatggcctcaggcgtgaacacccgcattgacgacctccaaatggtgttgaaccagactgaggatcatcggcagcgggtgctccaagccgcagcaaaaaacatacgggtttggttcatcaaagtgcgaaagatgaaagctatctaccacaccctgaatctatgcaacatcgatgtcactcagaaatgcctgatagctgaggtgtggtgtccagtcactgatctggactcgatccaatttgcacttagacgcggaactgagcacagtggctctactgtcccatcaattctgaatcgaatgcagactaaccagacccccccaacctacaacaaaactaataagttcacttatggctttcagaatattgtggatgcctacggaattggcacctatagggagattaacccagctccatatactatcattaccttcccattcctattcgcggtgatgttcggcgacttcggccacggcattttaatgaccttgttcgctgtatggatggtgctaagagaatcacgaatcttgtctcaaaaaaacgagaacgagatgttctccacagtgttctccggtcggtacattattctgcttatgggtgtattctcaatgtacaccgggctgatttacaacgactgcttctctaaatcattaaacattttcggaagctcctggtctgtgaggcccatgttcacttacaactggactgaggagactttacgtggtaatccagtcttacagctcaacccggctctgcccggtgtgtttggcggaccctaccctttcggaatcgatcccatttggaacatcgccaccaacaagctgacattcctgaattcctttaagatgaagatgagcgttattcttggcatcatccatatgctcttcggcgtaagtcttagcctgtttaatcacatctactttaagaaaccgttaaacatatactttggattcatcccggagattatctttatgacgagcctgtttggatacctggtcatattgatcttttacaagtggaccgcatacgacgcccacacgtcagagaatgcccctagcctcctgatccattttatcaatatgtttttgttctcctacccggagagcggctactcaatgctctacagcgggcaaaaaggaatacagtgcttcctggtggtcgtagcgctcctttgtgtcccctggatgctgctctttaaaccgctcgtccttcgacgtcagtatctgcgcaggaagcacctaggaactctgaacttcgggggtatcagagtcgggaacggtccaaccgaagaagatgctgaaatcatccagcacgaccaactgagtacacactcagaagatgccgacgagtttgatttcggtgacacaatggtacaccaagctatacacactatcgagtactgcctgggatgtattagtaacaccgcatcgtatctgcgcctgtgggctctgtccttggctcacgctcagctgagcgaggtgctttggactatggtgattcatattggcctcagcgtgaagagcctcgcaggtggtctcgtgttatttttctttttcacggctttcgccacattaactgtggcaatattgcttataatggagggtctttccgcatttctccacgccctgcgactgcactgggttgagtttcaaaataagttctattctgggacaggcttcaagtttctgcctttcagcttcgagcacattcgggaggggaagttcgaggagtag

SEQ ID NO: 215289 - DNA, 2514 bp, Artificial Sequence
  Description of Artificial Sequence: Synthetic coding sequence
atgggggaactgttccgctctgaggagatgactctggcccagctgttcctccagtcagaggccgcatattgttgtgttagcgagctgggggaactcggcaaagtgcagttccgggacctcaaccccgatgtgaacgtgttccaacgtaagttcgtcaacgaggtgcgtcggtgcgaagagatggaccgcaagctaaggtttgtagagaaggagattcgcaaagctaacatccccatcatggacacgggagagaatcctgaagttccattcccaagggacatgatcgacttggaggcgaatttcgagaagatcgaaaacgaactgaaagagattaatactaaccaggaagccttaaagcggaatttcctcgaactcacagaactgaagttcatcttaagaaaaacgcagcagtttttcgatgaaatggccgatcctgacctcctagaggaaagctcctccctcctggagccatccgagatgggcaggggaacacctctgagacttgggtttgtggcaggggtaatcaaccgcgaaaggatccccacgttcgagcgaatgctgtggagggtgtgccggggaaatgtctttcttcgccaggctgagatcgaaaaccctctggaggaccccgtcacaggggactatgtccacaagtccgtgtttatcatttttttccagggagatcagctcaaaaacagggtcaaaaaaatttgcgaaggctttagggcctccctttacccgtgcccagaaacgcctcaggagcggaaggagatggcctctggggtaaatactagaatagatgatcttcaaatggtccttaaccagacagaggaccatcgacaacgggtgttacaagcagccgctaagaatatacgggtctggttcatcaaggtgaggaagatgaaggcaatttaccacactcttaacttgtgcaacatagatgtgactcagaagtgcctaattgccgaagtatggtgccctgtcaccgatctggattcgatccagtttgcacttcggcgagggactgagcactctggctccactgttccgagcatactgaatagaatgcagactaatcagaccccacccacttataacaaaacaaacaagttcacctacggattccagaacattgtcgatgcctacggcataggaacttatcgtgagattaatcccgcaccatatacaataattaccttcccatttctcttcgctgttatgtttggagattttgggcacgggattctcatgactctgtttgcggtctggatggtactccgggagagtaggatccttagccagaaaaacgagaatgagatgtttagcacagttttttcaggccgatacattatattattgatgggagtcttttctatgtacactggccttatttacaacgactgctttagtaaatcccttaacatctttgggagcagctggtcggtacggcctatgtttacatacaattggaccgaggagacactgagaggaaatcctgttcttcagcttaacccagccttgcccggtgtattcgggggtccctacccttttggcatagaccctatttggaatattgctaccaacaaactcactttcctcaacagcttcaagatgaaaatgtctgttattctgggcatcatacacatgctgttcggcgtcagcctatcgctttttaatcatatctatttcaagaagcctctgaacatctacttcgggttcattcctgagatcatttttatgacgtctctgttcgggtacttagtcatcctgattttctacaaatggaccgcttacgatgcccatacttctgaaaatgcgccttcactcctcatccatttcatcaacatgttcctgttctcctacccagaatctgggtacagcatgctgtacagtggccagaaaggcatacagtgtttcctggtggtggtcgccttattgtgcgtcccatggatgctgttgttcaagccactagtcctgagacgtcaataccttaggcgcaagcatctgggtacactaaactttgggggaatccgggtaggcaacggccctaccgaggaggacgcggaaataatccagcacgatcagctctccacacactctgaagatgctgatgagcctagcgaagacgaggtctttgattttggtgacaccatggtccaccaggccattcacaccatcgaatactgcctaggctgcattagcaataccgcgtcctacctgaggctgtgggctctctcattggcccacgctcaactgtcagaagtgttgtggactatggtcatccacatcggcctcagtgtgaagagcctggcaggagggctggttctcttttttttctttacggccttcgctactctcaccgtggctatactcttaataatggagggcctgtctgctttcctccacgctctgcggttgcattgggtggagttccagaataagttctactcagggaccggtttcaagttcctgccctttagcttcgagcatattcgtgaaggaaaattcgaagaatag

SEQ ID NO: 215290 - DNA, 2496 bp, Artificial Sequence
  Description of Artificial Sequence: Synthetic coding sequence
atgggcgagctgttccgctctgaagagatgacccttgcccagctgtttttgcagtcagaggcagcatactgctgcgtgagcgagttgggtgaattggggaaagtgcagtttagggaccttaatcctgacgtgaatgtgttccaacgtaaatttgtgaacgaggtacgcaggtgcgaagaaatggatcgcaagctgagattcgtggagaaggaaatccggaaggctaatatcccaatcatggataccggggagaatccagaagtacctttccccagagacatgattgatctcgaagcgaactttgagaaaatcgagaatgagttgaaggagattaatactaaccaggaggctcttaagcggaatttccttgaactcaccgaattaaagttcatcttaagaaaaactcagcagttcttcgatgagatggctgaccccgatctcctagaagagagctcatctctgctggagccatccgaaatgggcagagggacgcctttgaggttggggttcgtggccggtgtgatcaaccgagagaggatacctaccttcgagagaatgttgtggagggtgtgccgagggaatgtgtttctgagacaggctgaaattgagaatcctctcgaggaccccgtcaccggagactacgttcataaatctgtgtttatcattttcttccagggcgaccagttgaagaatcgcgtgaagaaaatctgcgaaggctttcgcgcaagcctgtatccatgtcctgagacgccgcaggaaaggaaagagatggcatcaggggtgaatacaagaattgacgacctgcagatggttttgaaccagacggaagatcaccgtcagagagtcttgcaggctgccgcaaaaaacattagggtctggttcattaaggtgcgcaaaatgaaggccatctatcacacactgaacctttgtaacatcgatgttactcagaaatgtctcattgcagaggtctggtgccccgtgacggatctggattccatccaatttgcgctgagaagggggaccgagcatagcgggagtactgtgcccagcatcctgaacaggatgcagaccaatcagacgcctccaacttataacaagacgaataaattcacttatggctttcagaacatcgtcgacgcttacggaatcgggacttaccgcgaaataaacccagccccttacacaatcattacttttcctttcttgttcgccgtgatgttcggcgattttggccacggtatactcatgaccctcttcgcggtctggatggttctgcgagaaagcagaattcttagccagaagaatgagaacgagatgttctcaacagtcttttctggtagatacattatcctcctgatgggagtcttttcaatgtacaccggactgatttataacgattgttttagtaagtcactcaacatcttcgggtcaagctggagcgtgcgaccaatgttcacctataattggactgaggagactctgcgcggaaaccccgtcttacagctgaacccagcgctaccgggtgtatttgggggaccttacccctttggtattgacccaatctggaacattgcaaccaataagcttacgttcctgaacagtttcaaaatgaagatgtctgtgatcctgggcattattcacatgttgtttggggtgtcactgtctctttttaaccacatttactttaagaagcccctgaatatctatttcggcttcattcccgagatcatttttatgaccagtcttttcggctacttggttatactgattttttacaagtggaccgcctacgatgctcacacaagtgaaaatgccccatccctacttatccatttcataaacatgttcctgttctcatatcctgaaagcggctatagcatgctatattcaggacagaaagggatacagtgttttctcgttgtggtggcactgctgtgcgttccttggatgctcctctttaaaccactggtcctgcgtcggcaatatttaaggcgtaaacatctgggcactctcaatttcggaggaattcgtgtgggcaacggacctactgaagaggatgccgaaatcatccagcacgaccaactgtccacccactctgaggacgccgatgagtttgactttggcgatacgatggtgcaccaggccatccacactatcgaatactgccttggatgcatcagcaatactgccagttatcttagattgtgggccctgtcattagcacatgcccagcttagcgaagtgttgtggaccatggtgattcatattgggcttagcgtcaaatcgctggcagggggattagttctcttttttttcttcacggcctttgcaaccttgacagtggcaatactgttgattatggaagggctgtctgctttcttacacgccttgaggttacactgggttgaattccaaaataaattttacagcggaactggtttcaagtttctgcccttctcatttgaacatatcagagagggcaagttcgaagagtag

SEQ ID NO: 215291 - DNA, 2367 bp, Artificial Sequence
  Description of Artificial Sequence: Synthetic coding sequence
atgggggaactttttagaagcgaagagatgactctggctcaactgttccttcagagcgaagccgcttactgctgtgtgtccgagctgggcgagctcggcaaagtacagttccgagacctaaacccagatgtaaatgtcttccaaaggaagttcgtgaacgaggtgaggagatgcgaggagatggaccggaaattgaggtttgtggaaaaggagatccggaaggctaatattcccatcatggataccggagagaatcctgaggttccatttccacgcgatatgatcgatctcgagatggcagatcccgacctgctggaagaatcaagctctctgctagaacccagcgagatgggcagaggtactcccctgcgcctcggttttgtggcaggggtcattaacagagaaagaattccgacctttgagaggatgttgtggagagtgtgcagaggcaacgtgtttctcagacaagctgagatcgagaatcccctagaagaccctgtcacaggtgattacgttcataaatccgtattcattatattttttcagggcgatcagttgaagaaccgggtgaagaaaatttgcgaaggtttccgcgcatctctttatccttgccctgaaacaccccaggagcgcaaggagatggcttccggagtaaacacgcgcattgatgacctgcagatggtattaaaccagactgaggatcatcggcagcgggtgctccaggccgcagccaaaaacatcagggtttggtttatcaaagtgaggaaaatgaaggctatataccacactttaaatttgtgtaacatagacgtgactcagaaatgtctgatagccgaggtctggtgcccagtgactgatcttgactccattcaatttgcactccgcagggggaccgagcatagcggcagcacagttccatctattttaaaccgcatgcagaccaaccagacaccacccacctataacaagaccaataagttcacatatgggtttcagaatatagtcgacgcgtacggaattggcacttatagggagatcaatcccgcaccttatacaattattacattccccttcctcttcgcagttatgttcggcgattttggtcacgggatattgatgacccttttcgcagtctggatggtcctgagagagtctcggatattatctcagaaaaatgagaacgaaatgttctctactgttttttctgggaggtacataatcctgcttatgggcgttttttctatgtatactgggttaatatacaatgattgcttctcgaagagcctgaacatttttgggagctcttggagcgtccggccaatgtttacatacaactggacagaagaaacgctccgtggaaacccagtactgcaactgaatccagctttgcccggagtgtttgggggaccctatccgttcggcattgaccctatctggaatatcgctactaataagttgacctttctgaactcctttaagatgaaaatgtctgtgattctcggaattatacatatgctgtttggcgtaagtctatcactgttcaatcacatttatttcaagaagccgctgaatatatactttgggtttatccccgagattatatttatgacatcactcttcgggtacctggtgatcctgattttttacaagtggactgcttacgatgctcacacgtccgaaaacgcacccagcctgctcatacattttataaacatgtttttgttttcttaccctgagtccggatacagcatgctatactcggggcagaaaggtattcaatgttttctggtggttgtggccctgctgtgcgtgccctggatgctgctcttcaagcccttagtcctgaggcgccagtaccttagaagaaaacacctgggaacactgaattttggtggtattcgggtgggaaatggccctactgaggaagacgcagagatcatccagcacgaccagcttagtacccacagcgaggacgctgatgaattcgattttggcgacactatggtccaccaggctatccacacaatcgagtactgtctcggatgcatctccaacaccgcaagctacttgcgcctgtgggctctttcattggcacatgcccagctgtctgaggtgctgtggactatggtgatccacattgggctcagcgtaaaatccctcgccggaggcttggtgctatttttttttttcactgcgtttgccaccctgaccgtcgccatcttactcattatggaaggcctgagtgccttccttcatgctcttaggctgcactgggtggaattccagaataagttctatagcggcacaggtttcaagtttcttcccttcagcttcgagcacataagggaagggaagtttgaagagtag

SEQ ID NO: 215292 - DNA, 1452 bp, Artificial Sequence
  Description of Artificial Sequence: Synthetic coding sequence
atgcagaccaaccagacacccccaacatacaacaagacgaacaagtttacctacggtttccagaatatagttgatgcctatggcattggcacctatcgggaaattaaccctgcgccttataccattatcactttccccttcctctttgcggtcatgtttggggactttggccacggcatcttaatgaccctatttgctgtatggatggttttgagagaatcccgtattctcagtcagaaaaatgaaaacgaaatgttctccacagtcttctctggcagatatattatactgcttatgggcgtgttttctatgtatactgggctgatatataatgactgttttagcaaaagcctcaatatctttggtagctcctggtctgtgaggcctatgtttacgtacaattggaccgaggagactcttcggggaaatcccgtactgcaactgaatccagctcttcccggagtattcgggggaccctaccccttcgggattgatcctatttggaacatagctacaaacaaacttactttcctcaatagtttcaaaatgaaaatgtcagttatcttgggtattattcatatgctgttcggtgtgtctttgtctcttttcaatcacatctatttcaagaagccgctcaacatttatttcggcttcatccctgaaatcattttcatgacttccctttttgggtatctcgtgatccttatcttctacaaatggaccgcctatgacgcccacacatctgagaacgccccttccctgctgatccattttatcaacatgttcctgttctcatatcctgaatctgggtattctatgctgtacagcggacaaaagggcattcaatgtttcctggtcgtggtggctctgctgtgcgttccctggatgttactattcaagccacttgtgctgcggcgtcagtacctccggaggaaacatctgggcacacttaatttcggcggaatccgcgtgggcaatggaccaactgaagaagacgccgagattattcagcacgaccagctgtctacacatagcgaggacgcggatgagccttcggaggacgaagtcttcgacttcggcgacactatggtgcatcaggcaatccacacaatcgaatactgtctcggctgtatctccaacactgcctcgtacttgcgactgtgggccttgagcctggctcatgcacagctgtctgaggtgctgtggaccatggtgatacatataggtctgagcgtgaagtccctggccggtgggctggtgttgttcttttttttcacggctttcgccactcttaccgttgccatcctgctgatcatggaaggcctgtcagcatttctgcacgccctccgattgcattgggtcgagttccagaacaaattttactcaggtacgggcttcaagttcctccccttctcttttgagcacattagagagggcaagttcgaagagtag

SEQ ID NO: 215293 - DNA, 2514 bp, Artificial Sequence
  Description of Artificial Sequence: Synthetic coding sequence
atgggcgagcttttccggagtgaggagatgaccctcgcccagctgttcctccagtccgaggcggcttattgctgcgtgtctgaactgggcgagcttggcaaagtgcaattccgtgaccttaacccggacgttaatgtctttcagcgcaaattcgtgaacgaagtgcggagatgcgaggaaatggatcgcaaattgcggttcgtggaaaaggagatcagaaaggctaacattcctatcatggacacgggcgaaaatccagaagtcccctttccccgagatatgatcgatctggaggctaactttgaaaagattgaaaatgaactcaaggagatcaatactaaccaggaggctttaaagagaaactttctggaacttacagagctgaagtttatactgaggaagacccagcagttctttgatgagatggctgatcccgatctgctggaggaatcttctagcctgcttgagcctagcgagatgggacggggaactcctttacgactgggctttgtggcgggagtcatcaaccgggaaaggatccccacattcgagagaatgctttggcgcgtgtgccgcggaaacgtcttcctcagacaggcagaaatcgagaaccctctggaggaccccgtaacgggagactacgtgcataagagtgtgtttatcatttttttccaaggcgatcagctgaagaaccgagtaaaaaaaatctgcgaggggtttagggcgtctttgtacccatgtccagaaacgccgcaagaaagaaaagaaatggcctccggcgtgaacactcgtattgatgatctccaaatggtgctgaaccagaccgaggatcatcgccagagagtactgcaggccgctgcaaagaatattcgtgtttggtttattaaagttcgaaaaatgaaagctatttatcataccctaaatttgtgcaacattgatgtgacacagaaatgtttgatcgccgaagtttggtgtcccgtcacggatctggacagtatccagttcgcgttacgccgaggaacggagcacagtggatcgacggtccctagtattctgaataggatgcaaaccaaccaaaccccacctacttacaataagaccaacaaattcacttacggctttcagaacattgtggacgcatatgggatagggacatatcgtgaaatcaacccagcgccatatacaatcattaccttcccatttctgtttgcagtgatgtttggagatttcggacacgggatattgatgactctatttgccgtgtggatggtgctccgggagtcccgaatcctgtctcaaaaaaacgagaatgagatgttctcaaccgtgttcagcggaaggtacatcattttactgatgggtgttttcagcatgtatactggtctgatttataacgactgtttctctaaatccctgaacatctttggcagttcatggagcgtgcgaccaatgtttacttataactggaccgaggagacactacgcggaaaccccgttctgcaactcaacccagcgttgcctggtgtgttcggaggcccataccccttcggtattgatcccatttggaatatcgcaacaaacaagcttacctttctcaattcgtttaagatgaagatgtctgtgattctgggcatcatccacatgctattcggcgtttcactgagtttgttcaaccatatttatttcaagaagcctctgaatatttactttggcttcatcccggagatcattttcatgacgagtctattcggctatctggttattttgattttctacaagtggactgcttacgacgcccacaccagcgagaatgccccttcgttactgattcactttattaatatgttcctcttttcctatccggagagcggatactcgatgttatactccggacagaaagggattcagtgctttctggtcgtggtggctctcctgtgcgttccgtggatgttactgtttaagcctctggttttgcgcaggcagtacctacgcaggaagcatctaggaacactgaactttggcggaatccgagtcggcaatggtcctacagaagaggatgcagaaatcatccaacatgatcagctcagtacccactccgaagacgccgacgaaccctccacttcaggccagtttgactttggcgatacaatggtgcaccaggcaattcataccatcgagtactgtctggggtgtataagtaatactgccagttatctgcggctctgggccttgagtttggctcatgctcagctgtccgaagtcctgtggactatggtgattcacatcggccttagcgtcaagtcattggcaggtggtctggtactattcttcttttttacagccttcgccaccctgaccgttgctatcctccttatcatggaggggctttctgcattccttcatgcactcaggcttcactgggtcgagtttcagaacaagttctactccgggaccggttttaagtttctgcccttctcttttgagcatatccgggaggggaagttcgaggagtag

SEQ ID NO: 215294 - DNA, 2571 bp, Artificial Sequence
  Description of Artificial Sequence: Synthetic coding sequence
atggggagcctgttcaggtctgagaccatgtgcttggcacagctcttcctgcagtcagggacggcttatgagtgtctgtccgcattgggcgaaaaagggctggtgcaattccgtgatctgaatcaaaacgtgtcctctttccagaggaaatttgtgggagaggttaagagatgcgaagagctagagcgcatcctcgtgtacttagtgcaggagatcaaccgcgcagatatcccgctgcccgagggggaggcctcccctcccgcaccacctctgaagcaggtacttgagatgcaggagcaactgcagaagctggaggtagaactgcgggaggtgacaaagaataaggaaaaattgcgaaagaatcttctggagctcatcgaatacacacacatgctaagggtcacaaagacctttgtcaagaggaatgtggagttcgaaccgacctatgaggagttcccatctctcgaaagtgactcactcctggattactcctgtatgcagcgtttgggggctaaactgggtttcgtcagtgggctaatcaaccaagggaaagtcgaggccttcgaaaaaatgctttggagggtttgtaagggatatacgattgtttcgtacgccgaacttgatgagagccttgaggatcccgaaactggcgaagtcataaaatggtatgtgtttttgatctcattttggggagaacagatcggacacaaagtcaagaaaatctgcgattgttaccactgccacgtttatccttatcccaacacggcagaagaaagaagggaaatccaagagggactcaatacgcggattcaagatctgtacactgtgctgcacaagacagaggattaccttcggcaggtcctttgcaaggctgctgaatctgtgtactcccgggtgattcaggtaaaaaaaatgaaggctatataccacatgctgaacatgtgctccttcgatgtgactaacaagtgtcttattgccgaggtttggtgccccgaggcagatttgcaagatctgcgaagggcgctggaagaaggcagccgcgaatctggcgctactatcccttccttcatgaacataattcccacgaaagagaccccgccaactcggatacgtaccaataagttcactgaaggtttccagaatatcgtggatgcctacggggtgggttcatacagagaggtgaaccccgcactgttcactattattacattcccattcctgtttgccgtgatgtttggggacttcggacacgggtttgtgatgtttctattcgccttgcttctagtactgaacgagaaccatccacgcttgaaccagtcccaagaaattatgcggatgtttttcaacggaagatacattctgctcctgatgggcttgttttcagtatatacaggactgatatacaatgactgcttttcgaagtctgtgaatctgttcggcagcggatggaacgtgtcggcaatgtacagcagttctcaccctcccgcagaacataagaaaatggtactgtggaatgactctgttgtacgacacaatagcattttacagcttgatccaagtattcccggagtgttcaggggaccttatccactcgggatagatccaatctggaatttggccaccaaccgcttgacgttcctgaatagcttcaagatgaagatgtcagttattctgggaataatccatatgacctttggagtgattctgggtattttcaaccacctccactttcgtaagaagtttaacatttatcttgtttcaatacccgagcttctctttatgctatgtatcttcgggtacctgatcttcatgatcttttataagtggctggttttctccgcagagacctcgcgcgttgcaccaagcatcctaatagagtttatcaatatgttcctcttccctgctagcaagactagtggactttatactggacaagaatatgtgcagcgagtcctcctagtcgtgacagcactttctgtacccgtcttattcctgggaaaaccattatttctgttatggcttcacaacgggagatcgtgctttggggtgaaccgcagcggttacacgctgattagaaaggattcagaggaagaagtgtctctcctcggctcgcaagacatagaagagggcaaccaccaagtggaggacggctgtcgcgaaatggcctgtgaggagttcaactttggggagatcctgatgactcaggtgatccattcaatcgagtattgtcttggatgcataagtaacactgcttcctacctgcggctctgggccctgagtctggcccacgcgcagctgtctgacgtcctctgggccatgcttatgcgggtgggcttgcgggtcgacaccacatacggtgtcctgctgctgttacccgtcatcgcgctgtttgcagtcttgactatctttattctcctcatcatggaaggccttagtgcttttttgcacgcaataaggctgcattgggtggaatttcagaataagttctatgtgggggctggcactaagtttgtgccgttttcatttagcttgctctctagtaagttcaataatgatgattcagtcgcatag

SEQ ID NO: 215295 - DNA, 1119 bp, Artificial Sequence
  Description of Artificial Sequence: Synthetic coding sequence
atgggcagtctattccgaagtgagaccatgtgtcttgctcagcttttcctacagtctgggaccgcgtatgagtgcctgagcgcgctcggcgagaaaggcctcgtgcagtttcgcgacctgaatcagaatgtgtctagtttccaacgcaaattcgttggggaagttaagcggtgtgaagagctcgagagaatcctagtttatctggtccaagaaattaaccgagctgacatccctcttccagaaggcgaggcatctccaccggcaccaccactgaaacaggtgttggagatgcaggagcagttgcaaaaattggaggtggagctgagagaagtcacaaaaaataaggaaaagctgcggaagaatctgctggaactaatcgaatacacacacatgctgcgggtgaccaaaaccttcgtcaagcggaacgtggagttcgagccaacatacgaagagttccctagcctggaaagcgactcattgctggactatagctgcatgcagcggctgggtgccaaactgggtttcgtgtccgggcttatcaatcagggaaaggtggaagcattcgagaagatgctttggcgcgtgtgtaagggctacacaatcgtatcctacgccgaactagacgaaagcttagaggatccagaaacaggggaggtgattaagtggtatgtcttcttaatctctttctggggggagcagattggacacaaggttaaaaaaatttgtgactgctatcattgtcatgtctacccctaccctaatactgccgaggaaagaagggagattcaggaagggctaaacactagaattcaagatctctatactgttcttcacaaaacagaggattacctccgtcaagtgctctgcaaagcagcagagtcagtttattctagggtgattcaggtgaagaagatgaaggcaatctaccatatgttgaacatgtgcagctttgacgtgacaaataagtgtctgatagccgaagtctggtgtcctgaggctgaccttcaggatttgcgcagggccttggaggagggctcagtgagactgcccagttccccccttccaggaaccgaggaacgcctgatggagctgatcaattcagagaagaagaggaagtag

SEQ ID NO: 215296 - DNA, 2523 bp, Artificial Sequence
  Description of Artificial Sequence: Synthetic coding sequence
atggtgtctgtcttccggtcggaggaaatgtgtctgtctcagctatttctgcaggtcgaggccgcttactgttgcgtggcagagctcggggagcttgggctagttcagttcaaagaccttaatatgaatgtgaacagctttcagcggaaatttgtgaatgaggtgcggagatgtgagagcctggaaagaattctgaggttcttagaagatgagatgcagaacgagatcgtagttcaactcctggaaaaaagccccctcactccactgccacgagagatgataacactggagacagtcttagagaaactggaaggggagcttcaggaggccaaccagaaccaacaggcgctcaagcagtctttcctagaactcaccgaactgaagtacttgctgaaaaaaactcaggacttttttgagacagaaaccaatttagcggatgatttctttacagaagatacctctgggctgcttgaactgaaggcagtgccagcttacatgacagggaagttgggtttcatagccggtgttattaatcgcgaacggatggcttccttcgaacgtctgctctggcgcatctgccgcggtaacgtctaccttaagttttctgagatggacgcacccctggaggatcctgtcactaaggaagagatacagaagaacatctttattatcttctaccagggagaacaattaaggcagaaaatcaagaaaatctgcgacgggttcagggcaacagtgtatccctgccccgaacctgccgtagaacgccgtgagatgctcgagtccgtgaatgttagactggaagatctgataacagtgatcacccaaaccgagagtcataggcagagactgctgcaggaggctgccgctaactggcactcctggctcatcaaagtgcagaagatgaaggccgtgtaccacattctgaacatgtgtaacatcgatgtgacgcagcaatgtgtgattgctgagatttggtttccagttgcagatgccacccggataaaacgagcactcgaacagggcatggaactcagtggatcttccatggcgccaatcatgaccaccgtgcaatcaaaaaccgccccacctacgtttaacagaacaaacaagttcaccgctggctttcaaaacatagtggatgcctacggagtaggatcatatagagaaattaatccagcgccttataccatcatcacattcccatttctcttcgcagtaatgttcggggattgtggacatggaaccgttatgctactagccgctctgtggatgattctaaacgagcggcgtctgctcagccaaaagacggataatgaaatttggaacacttttttccacgggaggtatttgatcctgttaatgggcatattcagcatttatactgggctgatctacaatgactgtttttccaagtctctgaatatattcggttcatcctggagtgtgcagccaatgtttcgcaacggcacctggaatacccatgtaatggaggaaagcctttaccttcagctcgatccagctatccctggggtgtactttggaaatccgtatcccttcgggattgaccctatttggaatctggcgtctaataaactcacttttttaaatagctataagatgaaaatgtctgttattttaggcattgtgcagatggttttcggagtgattcttagcttattcaatcatatttacttccggcgtaccctgaacatcatcttacagttcatacccgaaatgatcttcatcctttgcctcttcggctatctcgtattcatgattatcttcaagtggtgctgttttgacgtccacgtgagtcagcatgccccttccattctgatccattttatcaatatgtttctgttcaactactccgactctagtaacgctccactgtataagcaccagcaggaagtgcagtcatttttcgtcgtgatggcattgatctccgtgccttggatgctccttataaagccattcatcttacgagccagccaccgcaaaagccaactgcaggccagcaggattcaagaggacgcaaccgaaaatatcgaaggggacagctcctctcctagcagtcgatcagggcagcggactagcgctgatacacacggtgctttggacgatcatggagaggaattcaatttcggggatgtattcgtccatcaggctatccacaccatcgagtattgcttagggtgcatctccaacactgcaagctacctgcgcctgtgggcactctctttagctcacgcccaactgtctgaagtcctgtggacaatggtcatgaactccggactgcagactagaggctgggggggaattgtgggcgtcttcataatttttgccgtctttgccgtattgaccgttgctatcctgcttattatggaggggttgagtgcctttctccacgccttgcgacttcattgggtggaatttcagaataagttttacgtcggcgatgggtataaatttagccccttcagcttcaagcacatactggatggaaccgccgaggaatag

SEQ ID NO: 215297 - DNA, 2523 bp, Artificial Sequence
  Description of Artificial Sequence: Synthetic coding sequence
atggtaagtgtgtttcgctccgaggagatgtgtctcagccagctgttcttgcaagtggaggctgcgtattgctgcgtggcggagctaggcgagctgggattagtacagtttaaggatttgaacatgaacgtgaactccttccagaggaaattcgtgaacgaagtgcggaggtgcgagagtctggaacgaatccttagatttcttgaggacgagatgcagaacgagatcgttgtgcagcttctcgagaagtcccccctgactcctttgcctcgagagatgataacactggagaccgtgctggagaagctagaaggtgagttgcaggaggccaaccagaatcagcaagccttgaagcagtcattcttagaactcacggaattgaagtatttgctgaagaaaacccaggacttcttcgagacagaaactaacttagcggatgacttcttcactgaggataccagcggattgctcgagcttaaagctgtccctgcatatatgacggggaagttgggattcatcgcaggtgtgatcaatcgagagcgtatggctagcttcgagaggttactgtggaggatttgtagaggcaacgtgtacttaaagttctctgaaatggatgccccactcgaagaccccgtcaccaaagaagaaattcaaaaaaatatcttcattatattttatcagggtgaacagctgcgccaaaaaatcaagaagatttgcgatggattccgggcaacggtctatccgtgtcccgaaccagccgtggagaggagggagatgcttgagtctgtgaatgtgcgactggaggatctgattaccgtgattacccagacagagtctcacagacagaggctgctacaagaagccgcagctaattggcactcttggttaataaaagttcagaaaatgaaagccgtgtaccacatactgaacatgtgtaatatcgacgtgacacagcagtgcgtgattgcagaaatctggttcccagtggcggatgccactcggattaagcgagctctggaacagggaatggaactgtccggttcgagcatggcacccattatgacaaccgtgcaatccaaaaccgctcctcctacgtttaatcggactaataagttcacagccggattccagaatatagtcgatgcgtacggtgtcggcagctatcgtgaaattaaccctgctccctatacaataatcaccttccccttcctgttcgcggtgatgttcggcgattgcggccacggcactgtgatgctgttagctgctctttggatgattctgaacgaacgtaggctgctctctcagaaaactgataatgaaatttggaataccttttttcacggcagatatctaattctcctgatggggatttttagcatctataccggcctgatttataatgattgctttagtaagagtctgaatatttttggttcctcatggagtgtacaacccatgtttcgaaatggaacctggaatactcatgtaatggaggaatcattgtatttgcagcttgacccggcaatcccaggagtttacttcggtaacccttaccctttcggcatagatccaatctggaacctcgctagcaataaactgacattcctgaactcctataagatgaaaatgagtgtgatacttgggattgtgcagatggtgtttggcgttatcctgtcactttttaatcatatatatttccgcagaacgcttaacatcatcctgcaatttattccagaaatgatcttcatcctgtgcctgttcgggtacctcgttttcatgattatatttaagtggtgctgctttgacgtacatgtatcacagcacgcacccagcattctgatacatttcatcaatatgttccttttcaactacagtgactctagcaacgctcccctgtataaacatcagcaggaggtccagtcctttttcgtggttatggcactgatttcggtcccatggatgttgttaattaaacctttcatcttaagagcaagtcatcgtaagagtcagctccaagctagcagaattcaggaagacgctactgaaaatattgagggagattccagtagcccctctagccggtcagggcagcgaaccagcgctgatacacacggggcactcgatgaccacggggaggaatttaatttcggcgacgtattcgtacaccaggctatacatacaattgagtattgtctcggctgtatcagtaacacggcctcatatctgagactatgggctctgtcactagctcacgcacaacttagcgaagtactctggaccatggtgatgaactcgggactgcagacccgcggttgggggggtatcgtcggcgtgtttattatcttcgccgtgtttgccgttcttacggttgccattcttctgataatggaggggttgtcagctttcctgcatgctttgcgacttcattgggtggagttccagaataagttctacgtgggcgacggatacaaattcagccccttttcctttaaacatattctggatggcactgccgaagaatag

SEQ ID NO: 215298 - DNA, 2523 bp, Artificial Sequence
  Description of Artificial Sequence: Synthetic coding sequence
atggtgagtgtgttcaggagtgaggagatgtgtctgtcccagctttttctgcaagtggaggccgcttattgttgcgtcgcagaattgggtgaattaggattggttcaattcaaggacctaaacatgaatgtgaatagctttcagagaaaatttgtcaacgaagtccgcagatgtgagtccctggaaaggatcctgagatttctcgaggatgaaatgcagaacgaaattgtggtgcaattgttggaaaaaagccctctcacaccacttccgcgtgaaatgatcaccctggaaaccgtgcttgagaaactggagggggagctccaggaagccaaccagaaccaacaagctctcaagcaatcattcctggaactgactgagcttaagtatctattgaaaaagacccaggatttttttgagactgaaaccaacctggcggacgacttctttacggaggacacttccggactgctggaattaaaggcagtacccgcatacatgacggggaagctcggctttattgcaggggtgatcaaccgtgagaggatggcctcctttgaaaggctgctgtggcgcatctgccggggtaacgtgtaccttaaatttagtgaaatggatgctccactggaagaccccgtgacaaaagaggagatacaaaagaatatcttcatcatcttctaccagggagagcagctgcggcaaaaaattaagaaaatctgtgatgggttccgggctacagtgtacccatgtcccgaaccagccgtcgagagacgagagatgttggaatctgtcaacgtcaggttggaagacctcataaccgtgataactcagactgagtctcatagacagagactgctgcaggaggcagcagcgaattggcacagttggctcatcaaggttcaaaaaatgaaggctgtgtatcacattctgaatatgtgcaatatcgacgtgactcaacagtgtgtgatcgcggaaatttggttccctgtggctgatgccaccagaattaagcgcgcactggagcaaggtatggaactgtctggaagctcgatggcacctataatgactactgtgcagtcaaagaccgcccctccaacctttaaccgcactaacaagttcaccgcaggatttcagaacattgtagatgcctacggtgtagggtcttatcgtgagatcaatcccgcaccttacactattattacctttccttttctgtttgcagttatgttcggagactgcgggcacggcaccgtcatgttgctagctgcactgtggatgattttgaacgagcgaagactcctttcccagaaaacagacaacgagatttggaataccttcttccacggacggtatctgattctgctcatgggaatattttctatatacactgggctcatctacaatgattgcttctctaagagcctgaacatctttgggtcgagttggtcggttcagccgatgttccggaatgggacctggaacacccacgtcatggaggaatccttatatcttcaactggatcccgctatacctggcgtatattttggcaacccatatccgtttggaattgaccctatttggaatctggccagtaataagttgacattcctcaactcatataaaatgaagatgtctgtcatcctgggcatagtacaaatggttttcggagttattctctctctgtttaatcacatttattttagacgtactctgaatatcatcttgcaatttattcccgagatgatatttatcctatgtctattcggatatctagttttcatgatcatcttcaagtggtgctgtttcgatgtgcacgtgtcacagcatgcaccgtccattctcatccacttcattaacatgtttctgtttaactattccgattcttctaatgcccctctgtacaaacatcagcaagaggtccagtctttttttgtggttatggccctgatcagcgtaccatggatgcttcttatcaagccttttattctcagagcaagccacaggaagagtcagctccaggctagccggattcaggaagatgccacggaaaacatcgagggagatagctcaagtcccagctcccggtccgggcaacggacgtccgctgacacgcacggtgccctggacgaccatggggaagagttcaacttcggcgacgttttcgtgcatcaggcaatacacacgattgaatattgcctaggatgtatctcaaatactgcttcatacctgaggctttgggctttaagcctggcccacgcccagttgagtgaggtgctgtggactatggtgatgaacagtggcctgcagacacgtgggtggggcggtatcgttggagtcttcatcatcttcgcggtatttgcagtactgaccgtcgcaatcctattaatcatggaaggactctcagcattcctgcatgctctccgtctacattgggtggagtttcagaacaagttctacgtgggggacggttacaaattttcacccttctcctttaaacacatactggacggaacagccgaggaatag

SEQ ID NO: 215299 - DNA, 3108 bp, Artificial Sequence
  Description of Artificial Sequence: Synthetic coding sequence
atggggaaagcagagaattacgaactgtatagtgttgaactgggccctgggccaggtggggacatggccgcaaaaatgagcaagaaaaagaaagccggagggggaggagggaagagaaaggagaagctggaaaacatgaagaaagagatggagataaacgatcatcagttgagtgtggcagaactggaacagaaataccagactagcgcgaccaagggcctgtcagcatctttggcagctgaactgttactgcgcgacggccctaacgcactgaggcctccaagaggcacccccgaatatgttaagttcgcgaggcagttagctggaggcctacagtgtctgatgtgggtggctgcagcaatatgcttaattgctttcgcaattcaggcgagtgagggtgatctgaccactgatgacaatttgtacctggcgatcgccctgatcgcagtggtcgtcgtgaccggctgtttcggctactaccaggagtttaagtctacaaacatcatagcttcattcaagaatctcgttccccagcaagctacggtgatccgagatggagataagttccagatcaatgcggatcaactggtagtaggagacttggtggaaatgaaaggaggcgaccgcgtgcccgcagacattagaatactcgccgctcagggttgtaaggttgacaacagctccctgacgggggagtctgagccccagactcggtctcccgaatgcactcacgagtctccgctggagactcgtaatatcgccttcttctcgacaatgtgcctcgaaggtacggtgcagggcctggtggtgaacacgggggacaggaccatcatcggccgtatagcgagcctggcttcgggcgtggagaatgagaagaccccaatcgccatcgagatcgaacactttgtagatatcatcgccggtctcgctattctttttggggcaacatttttcattgtagcaatgtgcattggctatacattcctgcgggctatggtcttcttcatggcaatagttgttgcgtatgtgccggaggggctcctggctacagtgactgtatgcctgtccctaaccgccaagaggttagcgtccaagaactgcgtggttaagaacttagaggcggtggagactctgggatcaacaagcgtgatttgttctgataagaccggaacactaacccagaaccgcatgactgtttctcatctgtggttcgacaatcacatccacactgcagacactaccgaggatcagagtggtcagaccttcgaccagagctccgaaacttggcgtgcactttgccgagttctaacgttgtgcaaccgggcagcctttaagagtggacaggacgcagtgcctgtgcctaaaaggatagtgattggagacgcctccgagacggccttgctgaagttctcagagctgactctgggcaatgcaatgggctacagagacagattccccaaagtgtgtgagatcccattcaacagtacaaacaagttccagctgtccattcacacactggaagatccacgggacccacgccatctgctggtgatgaaaggtgcaccagagcgcgtgctggaaagatgttccagcatcctgatcaaagggcaggagctcccgctagatgagcagtggagagaggcatttcagaccgcatatttgtccctaggaggactgggggaaagagtgttggggttctgccagctgtacctgaatgagaaagattatccccctgggtatgcctttgacgtggaagccatgaatttccccagctcaggcttatgctttgctggccttgtctccatgatagaccctccacgggcaacagtccccgacgcagtgctgaaatgtcgcacagcgggtatccgcgtgatcatggtgactggagatcatccgatcaccgcgaaagcaattgctgcgtccgtcggaatcatcagtgaggggtcggagactgtcgaggacattgctgcccgtctccgggtgccagtggatcaggttaatcgaaaggacgccagagcgtgtgtcattaatggtatgcagttgaaggatatggacccctccgaactggttgaggcccttaggacccaccctgagatggtgtttgctaggacaagcccccagcagaagctagtaatcgtggagtcctgccaacgtctgggggcaattgtcgctgtgactggggatggggttaacgactcccccgcattaaagaaagccgacatcggtgtagccatgggcattgcgggatctgatgctgccaaaaatgccgctgatatgatcctgttggatgacaattttgcgtcaattgtaacgggtgtggagcagggacggctcatattcgacaaccttaagaagagcatcgcctacaccctaactaagaacattcctgaactaaccccgtatctgatttacatcactgtttcggtgcccctccctctaggttgcattaccatcctcttcatcgagctgtgcacagatattttcccgtcggtgtctctggcctacgaaaaagctgagtctgatatcatgcacttaaggccccgtaatcccaaaagagaccggttggtcaacgagccgttggccgcttattcttatttccagatcggtgctatccagagttttgcgggattcaccgattatttcaccgcgatggcacaggaaggatggttccctctgctgtgcgtggggctgagagcccaatgggaggaccaccacctgcaggatcttcaggacagttacggccaggagtggacatttggccaaagattatatcaacagtatacatgctacaccgttttctttatctccattgaagtgtgccagattgccgatgtactcatccgaaagaccaggaggctaagcgcctttcagcaggggttcttcaggaacaagatcctggtgattgccatcgtgtttcaggtttgtatcggctgtttcctgtgttattgcccaggcatgcccaatatattcaatttcatgccaatccggttccagtggtggttggtccctctcccgtatggaattcttattttcgtctacgacgagatacggaaactaggcgtcagatgttgtcccggaagctggtgggatcaagagctttattactag

SEQ ID NO: 215300 - DNA, 876 bp, Artificial Sequence
  Description of Artificial Sequence: Synthetic coding sequence
atggccgctcttcaggaaaagaaaacttgtggccaacggatggaagagttccagcggtattgctggaatcctgacacaggtcagatgctaggacgcactctttcccggtgggtttggatcagcttgtactatgtcgccttttatgtggttatgacagggctgtttgctctctgtctctacgtcctgatgcaaacagtcgacccttacacccctgattatcaggaccagctgaggtctccaggggtcacactgaggcccgacgtgtacggggaaaagggactcgaaattgtttacaatgtctccgacaaccgaacatgggccgatctaactcagacactgcacgcttttctagcaggatacagtcccgcagcccaggaagactcgataaattgtacaagcgaacaatacttctttcaggagagcttcagggctccaaaccatactaagttttcctgcaaatttacagccgatatgttacagaattgcagcggtttggctgaccccaatttcggatttgaagaggggaagccttgctttatcattaagatgaatagaattgttaagttcttgccgtccaacgggagtgccccacgcgtggactgcgctttcctggatcagccgagagaactaggacagccattgcaggtgaagtattaccctcctaacgggacgtttagtctccattattttccatattatggcaaaaaggcgcaaccacactattccaatccgctggtcgccgcaaagctgctcaatattcccagaaatgctgaagtggctatcgtctgcaaagttatggcagagcatgtcaccttcaataacccccacgatccttatgagggcaaggttgagttcaagcttaaaatagaaaaatag

SEQ ID NO: 215301 - DNA, 1290 bp, Artificial Sequence
  Description of Artificial Sequence: Synthetic coding sequence
atgcagctgaggaaccccgaacttcatcttggatgtgctctcgctcttaggttcctggctctagtaagctgggacataccaggagccagagctctcgacaacggcctggctagaacccccaccatgggctggcttcattgggaaagatttatgtgtaacctggactgccaggaagaacccgactcatgtatttccgaaaagctgtttatggaaatggccgagcttatggttagtgaagggtggaaagatgctggctacgagtatctgtgtattgatgattgttggatggctccgcagcgcgactcagaagggcgtctgcaagccgatccccagagatttccgcacggcatacgccagttggcgaactatgtgcattcaaaaggattgaagctgggcatttatgctgacgttggcaacaagacttgtgctggattcccgggatcctttgggtattacgacatagatgctcaaactttcgccgattggggcgtagatctactgaaatttgatggctgttactgtgactctctggaaaatctcgccgatggctataagcacatgtccctggccctcaaccggaccgggagaagcattgtgtactcatgtgaatggccattatacatgtggccttttcaaaagccaaactacaccgaaatccgtcaatactgcaatcactggcggaattttgcagatatcgacgattcatggaagtccatcaagtctatcctcgattggacatcgttcaatcaggaacgaattgtcgatgtggcaggaccaggaggatggaacgatcccgatatgttagtgattgggaacttcggactctcatggaatcagcaggtgacacagatggccctttgggcgattatggccgcaccgttgttcatgtccaatgacctacgacacatatctcctcaagcaaaggcactactgcaggataaagatgttatcgctatcaaccaggacccactcggtaagcaagggtatcagctgcgccagggcgacaattttgaagtttgggagcggcctctgtcagggctggcctgggctgtggccatgatcaatcgacaagaaatcggcggacccagaagctacactatcgccgtggcatccctggggaaaggggtcgcttgtaaccccgcatgcttcattacccagctcctgcccgttaaaagaaaattaggattttacgagtggacatcacgactcaggagtcatattaatccaacggggaccgtcctgctacaactggaaaatactatgcagatgtccttgaaggacctgttatag

SEQ ID NO: 215302 - DNA, 3120 bp, Artificial Sequence
  Description of Artificial Sequence: Synthetic coding sequence
atgcatcagaaaacccctgagatctactctgtcgagttgagcggcactaaagacatcgttaagacagacaaaggggacggcaaggaaaaatacaggggactaaagaacaactgcctggagctgaagaaaaagaaccataaggaagagtttcaaaaagaactgcacttagacgatcacaaactgtctaatcgggagctggaagagaagtatgggactgatatcatcatggggctctcgagcaccagagctgcagaactgctggccagagacggacccaacagcctgaccccacccaagcaaactcccgagatagtgaagttcctcaagcaaatggtaggtggtttctccatcttattatgggtaggcgcattcctctgctggattgcatacggcatacaatattctagtgataagtctgccagtctcaataatgtctacctaggctgtgttttaggccttgtggtgatcctgaccggtattttcgcttattaccaggaggccaagtctacaaatattatgagctcattcaataagatgatcccccagcaggctctagtaattagagacagcgagaagaagactatcccatctgagcagctggtggtgggggatattgtggaggtgaaaggtggtgatcagataccggcagacatccgggtccttagctcacaaggatgccgggttgacaacagcagcctaacgggtgaatccgaaccgcaacccaggtcatctgaatttactcatgagaatccactggagacaaaaaacatatgcttttactccacgacatgtctagaaggcaccgtcactggtatggtgatcaataccggagaccgcacaattatcggccatattgcttccctggctagtggcgtggggaatgaaaagacccccatcgcaatagaaattgagcattttgtgcacattgtggccggagtagctgttagcattggaatactgttctttattatcgctgtgtccctgaagtaccaagtgctggatagtatcatctttctgatcggaatcattgtggccaacgtccccgagggactgctggctacagttacagtcactcttagcctgaccgctaaaagaatggcgaagaagaactgcttggtgaaaaaccttgaggctgtagagactctgggatccacctctatcatttgcagcgataagaccggtacactcacacagaatagaatgaccgttgcccatctgtggttcgacaatcagattttcgtagcagatacgagtgaagaccattctaaccaggtctttgatcagagcagcagaacatgggcaagcctatccaaaattatcacactctgcaaccgcgcagagtttaaacccggacaagaaaacgtcccgatcatgaagaaggcagtgattggggatgctagcgaaacagcactgctgaagttttccgaggtcatactgggggacgtgatggagatacggaaaaggaaccgaaaagtagcagagatacctttcaattcgacaaataagtttcaactgtctattcatgaaatggacgatcctcacgggaaaaggttccttatggtcatgaagggggcaccagaacggatcctggaaaaatgttccacaatcatgataaacggggaggaacatcctctggataagagcaccgcaaagacttttcacacagcctacatggaactgggcggactgggtgagagagtcctagggttctgccacttgtacttgcctgctgatgagttccctgagacatatagcttcgacattgacgctatgaatttcccaacctctaatttgtgttttgtcggcttgctgtccatgatcgatcctcccaggtctaccgtgccagacgcagtgactaaatgtaggagcgctggcatcaaggttattatggtgaccggcgaccaccctatcaccgccaaggcaattgctaaatcggttggaataatatctgccaactccgaaacagtcgaggatatcgcccacagactgaacatcgccgttgagcaggtgaacaagagagacgccaaggcggctgtcgttacaggtatggagctgaaagacatgtcctcggagcagctcgatgaaattctggccaattaccaggaaatcgtgttcgcacgaacgtcacctcagcagaagctgatcatcgtcgaagggtgtcagaggcaggacgccgttgtggccgtgacaggtgatggggtcaatgacagcccagcgctcaagaaggccgatatcggcattgccatgggaatcgccggttccgacgctgctaaaaacgcggcagatatggtgctgctcgatgacaacttcgctagcattgtgacgggggttgaggagggcagactgatctttgataatctgaaaaagactatcgcctactccctgacaaaaaatatcgccgagctctgtccatttctgatttacattattgtgggtttacccctcccaattggcacaattaccatccttttcatcgacctcggcaccgacatcataccgagcatagcacttgcttacgagaaggcagaatctgatattatgaatcgcaagcccagacacaagaataaagatcgcctcgtgaaccaaccacttgcggtgtattcatacctacacataggtctgatgcaagcgttgggcgcattcctggtatatttcaccgtgtatgcccaggagggcttccttcccagaactctcataaatctacgggtcgagtgggagaaggactacgtaaacgatcttaaggacagctatgggcaggagtggacaagataccaacgcgaatatttggagtggactggatatacggccttctttgtgggcatcctcgtgcagcagattgccgacctgatcatcaggaagacgaggcgcaacagcattttccagcaggggctgttccgcaataaagttatctgggtcggtatcacttcacaaatcatcattggcttaattctgtcctatggtctggggagtgtaactgcactgtcctttaccatgctccgcgcacagtactggtttgtggccgtaccccacgcgatcctgatttgggtttacgacgaagttcggaaactgttcatcaggctgtaccctgggtcctggtgggacaagaacatgtactactag

SEQ ID NO: 215303 - DNA, 3072 bp, Artificial Sequence
  Description of Artificial Sequence: Synthetic coding sequence
atgggaaagggagtgggcagggataaatatgaacccgcagctgtctccgaacagggtgataagaagggcaaaaagggcaaaaaagatcgggatatggacgaactgaaaaaagaggtatcaatggacgatcacaaactgtccttggatgagttacatagaaaatatggcacagacctgagcagggggctcacttctgcacgggctgcagagatcttggctagggacggcccaaatgcgttgactcctccaccaactaccccagagtggattaaattctgccgtcaactgtttgggggattttcaatgcttctttggatcggcgcaatattgtgctttctggcctactccattcaagccgctacagaggaggagccgcagaacgacaatctgtatctgggtgtcgtgctctccgcagtcgtgattataactggatgtttcagttactaccaggaagctaagagcagcaagatcatggaatcctttaagaacatggtgcctcagcaggcacttgtcatccgcaatggtgaaaagatgtcaatcaatgcagaggaggtcgtcgtgggggacctagtggaagtaaagggcggtgatagaatcccagctgaccttcggattatctctgcgaatggatgtaaggttgacaacagctcccttaccggcgaaagtgagcctcagacgagatctcccgatttcactaacgagaaccctcttgagactaggaacatcgcgtttttttcgaccaactgcgtcgagggtacagcgagggggatcgtcgtgtatactggtgataggaccgtgatgggaaggatcgcaaccctggctagtggtcttgagggcggacaaacccctatcgcagccgagatagaacacttcatccacataattacaggagtggctgtgttcctgggcgtgtccttcttcatcttgtccctgatactcgagtacacatggctcgaggctgtgattttcttaataggcatcattgtggccaatgttcccgagggtctgctggccaccgtaaccgtttgcctcactctgactgctaagaggatggcaagaaaaaactgcctcgtgaaaaaccttgaggcggtcgaaacccttgggagcacgtctacaatctgctctgataagacagggacactgacacagaacagaatgaccgtggcccacatgtggtttgataaccagatccatgaggcagacactaccgagaaccagtcaggtgtgtcctttgacaagactagcgccacttggctggcattgtcgagaatcgccggactgtgtaatagagccgtattccaggctaaccaggagaacctgcccatcctaaaacgtgctgtcgcgggagatgcatcagagtccgctctgctcaagtgcattgagctatgctgcggcagcgtaaaggaaatgcgtgagagatatgcaaaaattgttgaaatcccttttaactctacgaacaaataccagctgagtatccacaaaaatccaaatacttccgagccccagcaccttctggttatgaagggggcacctgagagaatcttggaccggtgctcttcaatcctgttgcacggcaaagaacagccactggacgaggagctgaaagatgccttccagaacgcctatctagaactgggcggtctgggagagagggtcctgggcttctgtcacttgtttttgccggacgagcaatttccagagggatttcagtttgacactgacgatgtaaactttcccattgataacctttgtttcgtagggcttatctccatgatcgatccccctcgcgctgctgtaccggatgccgttggcaagtgtcggagcgccggtatcaaagtgatcatggtgactggagatcatccgattactgctaaggctatcgccaagggagtcggcattatcagtgaggggaacgaaacagtggaagatattgccgctaggctgaacattccagtgtctcaagtcaacccacgcgatgccaaagcttgcgtagtgcacgggtccgatctgaaggacatgacctcggagcagctggacgatattctgaaataccataccgaaattgtgttcgccagaacaagcccccagcagaaactgataatcgtggagggctgtcagcgacaaggcgcaattgttgcggtaacaggggatggcgttaatgattctcctgccctgaagaaagcagatatcggggtagcgatgggtattgctggaagcgacgtatcaaaacaagccgctgacatgattctgcttgacgataactttgctagcatagtgactggcgtggaggaggggagattgatttttgataacctgaaaaagtctattgcatacaccctaacaagtaacattccggaaatcactcctttcttaatctttattattgcaaacatcccactcccccttgggaccgtcacaatactgtgcatagacctggggactgatatggttccagctatctccctcgcctacgaacaggcggagtctgacattatgaaacggcagcccagaaatcccaagaccgataagctggtgaacgagcgactcataagtatggcctatggtcagatcgggatgatccaagcactgggaggattctttacgtattttgttattcttgctgagaatggcttccttcccattcatctattggggttacgcgtcgactgggatgacaggtggatcaatgatgtggaggatagttatgggcagcagtggacctacgagcagcggaaaattgtggaatttacgtgtcacacagcgttcttcgtgtccatagtggtcgtacagtgggcggacctggtgatttgcaagacccggaggaattctgttttccagcagggaatgaagaacaaaatccttatctttggactatttgaggagaccgccctcgccgcattccttagttactgtccaggaatgggcgtagccctgcgaatgtatccattgaagcctacctggtggttttgcgcctttccttattctcttctcatattcgtctatgatgaggttcggaagctgatcattagacgccgtcccggaggatgggttgagaaggagacgtactattag

SEQ ID NO: 215304 - DNA, 2043 bp, Artificial Sequence
  Description of Artificial Sequence: Synthetic coding sequence
ggcaaggaggttggccgagacaagtatgaacctgcagccgtatcagagcagggagacaaaaaagggaagaaaggcaagaaggatagagatatggacgaattgaaaaaggaagtctccatggatgaccacaagttgagcctggacgagctgcatcgcaaatatgggaccgatttgtcccgtggactgacaagcgctagagcggcagagatccttgcccgagatgggccaaatgcgctgacaccacccccaacaacccctgagtggatcaagttttgccggcagctattcggcggattctccatgctactttggattggggcaatcctgtgcttcttagcctattctatccaggccgcaactgaggaagagccccagaacgataacttgtatctcggcgtggtgctcagtgccgtcgtgatcataacaggctgcttctcttactaccaggaagccaagtccagcaagatcatggagtcatttaagaacatggtaccccaacaggccctggttatccgtaatggtgagaagatgagtatcaatgccgaagaggtggtggtgggcgacctggtggaggttaaaggaggagacaggatccctgccgatctccggattattagtgccaatggctgcaaggtcgacaacagctctttgactggcgaaagtgagccgcaaacgcgtagccccgatttcactaatgagaacccactggaaactcgtaatatcgcattctttagcaccaattgcgtcgagggcacagctcggggtatcgtagtgtatacaggggataggactgttatgggcagaatagctacactggcgtccggcctcgaagggggacagactccaattgccgcagagattgaacattttatacatatcatcacgggagtagccgtctttctgggtgtcagttttttcatacttagcttaatcctggaatatacctggcttgaagccgtgatcttcctgatcgggattatcgtggccaatgtgcccgagggcctcctcgcaactgttaccgtgtgcttaaccctgacagcaaaaagaatggcacgcaaaaattgcctcgtgaagaacctcgaggcggtcgagaccctggggagcaccagtaccatctgttctgataagaccggaacacttacccaaaatcgtatgacggtggcacacatgtggttcgataaccagattcatgaagccgacacaaccgagaaccaatcgggagtgagcttcgacaaaactagtgccacttggcttgctcttagccgcatagcaggcctgtgtaatagagccgtcttccaggcgaaccaggagaaccttccgatccttaaacgcgcagtcgcaggtgacgcaagcgagagcgcactgctgaagtgtattgaactctgttgcggaagcgtaaaggaaatgcgggaacgctacgctaagatcgtggaaattccattcaattcaacaaacaagtatcagctgtctattcataaaaatcctaacacctccgagcctcagcacctcttggtgatgaagggggctcctgagagaatcttagatagatgttcgagcatcctgctacacggaaaagagcagcctcttgatgaagagctcaaggacgcatttcagaacgcctatctggaacttggaggactcggagaaagagtactcgggttctgtcacctgtttctgccggacgaacagttccctgagggtttccagtttgataccgatgacgtgaattttcccattgacaatttgtgcttcgtcgggctgatatccatgattgacccccctcgtgccgctgtgccagacgccgtgggaaagtgcaggtcagccggaatcaaggtgattatggtaaccggggatcatccaatcacagccaaggcaatcgccaaaggggttggcataattagtgaaggcaacgagccaatgagtaggggcaaaagctggtcaagccctgccacacagccatcaagcagtgtctcctggtggtgctcagggcctacatggagcagcgtaagacccggaggcatccgctctagcagccggggttag

SEQ ID NO: 215305 - DNA, 435 bp, Artificial Sequence
  Description of Artificial Sequence: Synthetic coding sequence
atggacgaactgaaaaaggaggtttctatggacgaccacaagctgagccttgatgaactacacaggaaatatgggacggatctgtcaaggggcctcactagtgcaagggctgcagaaatccttgctcgcgacgggccaaatgctctgactcccccaccaactactccggagtggatcaaattctgcaggcagctgtttggaggattcagcatgctgttgtggattggggctattttgtgctttctagcctatagtatccaggcagccaccgaggaagagcctcagaatgataacctgtacctgggagtagtcctcagcgctgtggtgataatcaccggttgtttttcatactatcaggaagcaaaatcctccaaaattatggagtctttcaaaaatatggtgccacagcaggcactcgtcattcggaacggatag

SEQ ID NO: 215306 - DNA, 2979 bp, Artificial Sequence
  Description of Artificial Sequence: Synthetic coding sequence
atggacgagcttaaaaaggaagtgagcatggatgaccacaagctgagtttagatgaactgcataggaagtacggcactgacctgagtcggggtctgacatccgccagggcagccgagatcctggctagggatggccctaacgctctaacacccccaccaacaaccccagagtggattaagttctgtcggcagctgttcggcggattctctatgctcctgtggattggggctatcttgtgtttcctcgcatactccattcaagcagccactgaggaggagccacaaaacgataacttatacctgggcgtagttctctcggccgtcgttatcatcacaggatgtttttcttactatcaggaagccaaatccagcaaaattatggagagctttaaaaacatggtgcctcagcaagctctggtgattcgtaatggggaaaagatgagcatcaatgccgaggaggttgttgtaggtgaccttgttgaggtcaagggcggtgataggattcctgccgacttgagaattatttccgctaatggctgcaaagtcgataattccagcctgaccggcgagtccgaacctcaaaccagaagcccagactttactaatgaaaaccctctggaaacaaggaacattgccttcttttctaccaattgtgtggaaggcactgccaggggaattgtggtctatacaggcgacaggaccgttatgggcaggatcgctaccctggctagcggacttgaaggcggtcagacaccaatcgctgccgagatagaacattttattcacatcatcaccggagtagccgtcttcctgggtgtgtcattttttatcctgagtttgattctcgagtacacctggctggaggccgtgatcttcctgataggcattatagttgctaacgtgccagaggggttgctggcaacagtcacagtttgtctgaccctgaccgcaaagaggatggcacgcaaaaattgtctggtgaagaacctcgaggctgttgagaccctgggatccacatctactatttgctctgacaagaccgggacgcttacgcagaaccgcatgacagtggcacatatgtggtttgacaaccaaatacacgaggccgacactacagagaaccaatcgggtgtgagttttgataagacctcggccacctggctcgctctgagtagaattgccggtctgtgtaatagggccgtgtttcaggctaaccaagagaatcttccaatccttaaacgcgctgtggctggcgacgcctcagaatcagcgctgctcaaatgcatcgagctttgttgcggatctgtaaaagaaatgcgagagcggtacgcaaaaatcgtggagattcccttcaatagtactaataaatatcaactatccatccacaaaaacccgaacacgtctgagccccagcacctgcttgttatgaagggcgctcctgaaagaatactagataggtgtagctccatcctgctgcatggcaaagagcagcctctggacgaggagcttaaagatgcttttcaaaatgcctatctcgagttaggcggacttggcgagagggtgctagggttttgtcacctgtttctgcctgacgaacagttccctgaaggcttccagtttgatactgatgacgtaaactttccaatcgacaacctgtgctttgtgggcctgatctccatgatcgatccacctagggctgcagtaccggacgctgtgggcaaatgtcgatctgctggtataaaagtcatcatggtaaccggagaccacccaattaccgctaaagcaatagccaagggcgttggcatcatcagtgagggtaacgagactgtagaagatatcgctgccagactaaatattccagtatcacaggtgaatcccagagacgctaaggcgtgtgtcgtacatggctctgatcttaaggatatgacaagtgagcagcttgatgatatattaaaataccataccgagatagtgtttgcccgtaccagtccccagcagaagcttatcatagtggagggatgtcagaggcagggcgctatagtggctgtgaccggagatggcgttaatgactctcccgcacttaagaaagcagatattggggtggcgatgggcattgcgggttctgatgtctctaagcaggccgcagacatgatactgctggatgataattttgcctctatcgtcaccggagtcgaagagggacgcctcatatttgacaacttaaaaaagtcgattgcgtacacgctcacctctaatattcccgaaattacaccatttctgattttcatcatagctaatattcctttgcccctggggacggtgacgatcttgtgtatagacttgggaaccgacatggtccccgcaattagcctggcctacgagcaggccgaatctgacatcatgaagcggcaacccagaaatcccaaaactgacaagctggttaatgagcgactcatctcaatggcctatggccagattggtatgattcaggcccttggaggttttttcacctatttcgtaatcctggccgagaatggcttcctccccatccacctactaggccttagagtggactgggacgaccgctggattaacgatgtggaggacagttacgggcagcagtggacctacgagcagcgaaaaatagttgagttcacttgtcacaccgctttttttgtgtcaatcgtggttgttcagtgggcagacttagtcatctgtaagactcggaggaatagcgtatttcagcaaggcatgaaaaacaaaattctgattttcggtctgtttgaggaaaccgctctggccgcatttctgtcttactgccctggcatgggtgtggccctgagaatgtatcccctcaagcctacgtggtggttctgcgcttttccttattctttgctgatcttcgtgtacgatgaagtcaggaaacttattataaggagacgaccagggggttgggttgagaaagagacttattactag

SEQ ID NO: 215307 - DNA, 321 bp, Artificial Sequence
  Description of Artificial Sequence: Synthetic coding sequence
atggatgaacttaagaaagaagtgtccatggacgatcataagctgagcctagatgagctgcatcgtaaatatggcactgacctgtccaggggattgacttctgctagagcagcagagatcctcgcaagagatggacccaacgctctgactccccctcctacaactccagaatggattaagttctgtcgacagctttttggcggtttctccatgctgttgtggatcggcgcaatcctgtgtttcctggcctactctatccaggcagccactgaagaagaaccgcagaatgacaatctctaccttggcgtggtgctgtcctag

SEQ ID NO: 215308 - DNA, 474 bp, Artificial Sequence
  Description of Artificial Sequence: Synthetic coding sequence
cgacaacctcgtaaccctaagaccgacaagcttgtgaacgagagactgataagcatggcctacggacagatcgggatgatccaggccctcgggggtttttttacgtacttcgtcattctggctgagaacggttttctgcccattcacctcttgggcctccgggtcgactgggatgacaggtggatcaacgacgtcgaagatagctatgggcagcaatggacctatgagcaacgcaaaatagtggaattcacttgccacacagcatttttcgtttcaattgtcgtggtccaatgggccgatctggtgatatgtaaaacccggcgtaatagcgtttttcaacaagggatgaagaataaaattttgatcttcgggcttttcgaggaaacagccctcgccgcattcttatcctattgccccggtatgggcgttgctctacgtatgtaccccctgaagaccctgacacaatactcctag

SEQ ID NO: 215309 - DNA, 480 bp, Artificial Sequence
  Description of Artificial Sequence: Synthetic coding sequence
atgaagcggcagcccagaaacccaaagaccgacaagctagtgaatgagcggttaatcagcatggcctatggccaaattgggatgattcaggccctgggaggctttttcacttatttcgtgattctggctgagaacggcttcctacccattcacctcctgggactgcgagtcgattgggatgacaggtggataaacgacgttgaggattcttacggccagcagtggacttacgagcaaaggaagatagtggaattcacttgtcatactgccttcttcgtgtccatcgtagttgtgcagtgggccgacttggtgatctgcaaaacgaggagaaattccgtgttccagcagggtatgaaaaacaaaatcctgatcttcggactgttcgaagagacagcgctggccgcatttttatcttactgtccaggcatgggcgttgccctgcgtatgtatcccctgaagacattgacacaatactcctag

SEQ ID NO: 215310 - DNA, 3072 bp, Artificial Sequence
  Description of Artificial Sequence: Synthetic coding sequence
atggcctttaaagtgggcagagataagtacgagccggcagcagtgtcagagcagggtgataagaaagggaaaaaagggaagaaggacagggatatggacgaattaaagaaagaagtttcaatggatgaccacaaactcagtctggacgagttacaccggaagtacgggacagacctgtccaggggcctgaccagtgcccgagcagctgaaatccttgccagagacggaccaaacgccctaaccccccctccgacaacgcccgagtggattaagttttgtcggcagctgtttggcggtttctccatgctcctgtggatcggggcaattttatgttttcttgcatactcaattcaggctgcaaccgaggaggaaccgcaaaacgataatctgtatcttggggtggtgctgtctgccgtggtcataattacaggctgcttctcctattaccaggaggcgaagtcaagtaaaattatggagtcattcaagaatatggttccccagcaagccctcgtgatccgaaacggggaaaagatgtcaatcaacgcagaggaagtagtggtgggtgacctcgtcgaggtaaagggaggagacagaattcctgccgaccttcgcattatttctgccaatggatgcaaggtggacaattccagtctgacaggagagtctgaaccacagactcggagtccagattttactaacgagaatccgctggaaacccgcaatatcgcctttttctccacgaactgtgttgaagggaccgcgagaggcatagtcgtctacacaggcgaccgaacagtgatgggaagaattgcaactctggcctccggccttgagggaggacagacacctatcgccgctgaaattgagcacttcatccacatcatcaccggggtagccgtgttcctgggtgttagtttttttattctctccctgattttagaatacacctggctggaggccgtcatttttctcataggcattatagtggccaacgtaccagaaggattactggccactgtaactgtgtgtctcacattgacagccaagcgcatggccagaaaaaactgtctggttaagaatctcgaagctgtggaaacacttgggtcaacatccaccatatgtagcgacaaaacaggtacactgactcaaaatcggatgaccgtcgcgcacatgtggttcgataaccaaattcacgaggccgatacaaccgaaaatcagtccggcgtcagttttgacaagacctctgcgacctggctggcactttctagaatagccggtttgtgtaaccgtgccgtctttcaggcaaatcaggagaacctcccaatcttaaagcgggcagtggccggagacgcatctgagtcagccctgctgaagtgtatcgagctttgctgtggcagtgtcaaagaaatgagggaacgctacgctaaaatcgttgaaatcccgttcaactcaaccaacaaatatcagttaagcatccacaagaatccaaatacatctgagccccaacacttgttggttatgaaaggcgctcctgaacgcatactggatcgatgttcgtccatcttgttacacggcaaggagcagcctctcgacgaggaattgaaagatgctttccagaatgcatacctggagctggggggtctgggagaaagagtccttggtttctgtcatctttttctgcctgatgagcagtttcccgaagggttccaatttgacacagatgatgtaaacttcccaatcgataacctttgcttcgtgggtttaataagtatgatcgatccaccacgtgctgccgtacctgacgcagtcggcaaatgccggagcgctgggattaaggtgatcatggtgaccggtgatcatcctatcacggcgaaggccattgcaaagggcgtcggcattataagcgagggcaacgagactgtggaagacattgctgcaagattaaacatccccgtatctcaggtcaacccaagagatgccaaagcctgtgtggtccatggatctgatctgaaggacatgacttccgaacagctcgatgacatattaaaataccacacggagattgtgttcgccagaacctctccccagcagaagttgataatcgtcgaagggtgtcagcgccagggtgcgatagtggccgtgactggtgatggagtgaatgacagtccagccctgaaaaaagctgacattggcgtggccatgggtatcgcgggatccgatgtcagcaaacaagcagcggacatgatcctcctggacgacaactttgcctcaatagtgactggtgtggaggaaggacgcctaatatttgataacctcaagaaatccatagcatataccctcacgtcaaacataccggagatcaccccattcctgatttttataatcgccaacattccactaccgcttgggaccgtgactattctctgtatcgatttggggaccgacatggtaccggcaatctcactagcctacgagcaggcggagagtgatattatgaaacggcagccacgaaaccccaagaccgataaactggtgaatgagagattaatcagcatggcctacggtcagatcggcatgatacaggccttggggggattttttacgtatttcgttatcctggctgagaacgggttcttgcctattcaccttctgggtctgcgagtggattgggacgatcgctggatcaatgatgtggaggacagctacggccagcaatggacatatgaacaaaggaaaattgtggagttcacttgccacactgctttttttgtatccatcgtagtggtacaatgggccgatctggtgatctgcaaaactaggaggaatagcgtcttccagcagggcatgaagaacaaaatactcattttcggcctctttgaagagactgcactcgccgcttttttatcttactgtccaggcatgggagtggcactgcggatgtacccccttaagcctacttggtggttctgtgcttttccctattccctgctgatcttcgtgtacgatgaggttcgcaaactcataatccgcagaaggccaggtggatgggtcgaaaaagagacgtattattag

SEQ ID NO: 215311 - DNA, 3063 bp, Artificial Sequence
  Description of Artificial Sequence: Synthetic coding sequence
atgggacggggagccggaagggagtacagccctgcggcaactaccgcggaaaacggagggggaaagaaaaagcagaaggaaaaggaactcgatgagctgaaaaaagaagtggctatggacgaccacaagctctccctggatgaactgggacgcaagtatcaggttgatctgtccaagggtctaacaaaccagcgagcccaagacgtgctagccagagacggcccaaatgctcttaccccccctcctacgactcccgagtgggttaaattctgtcgccagttattcggtggtttttcaatcctcttatggatcggggctattttgtgtttcttagcctacggcattcaggcagccatggaggatgagccctctaacgacaatctttatttgggagttgtgttggccgcagtcgtgattgtgacaggttgtttctcgtactatcaggaggctaagtctagcaagattatggactcatttaaaaacatggtgccccaacaggccctcgtcattcgcgaaggagaaaaaatgcagattaatgctgaggaggtggttgtgggggacctagtcgaagtcaagggcggagatcgcgtgccagccgacctgcggataatatcttcccacggttgcaaggttgataactcctctctaaccggcgaaagcgagccccagacacgtagccctgagtttactcacgagaacccactggagacgcgaaacatctgcttcttctctaccaattgtgtggagggcacagcacgcggaattgtgattgcaacgggagaccgcacagttatgggacgaatagccactcttgccagcggactcgaagtgggcaggacacctattgccatggaaattgagcacttcatacagctgatcacgggcgtcgctgtgttcctgggggtgtccttcttcgtcctttccctaatcttggggtattcttggctcgaggcggtgatatttctcattggcataattgtcgccaatgtccctgagggcctgctggcaacggttactgtgtgtctcaccctgacagcgaaacgcatggcgagaaagaactgcctggtgaaaaatttggaagctgtggaaacactgggtagtactagcacaatctgcagcgataaaactggcacactcacccagaataggatgacagtagcacatatgtggtttgataatcagatccacgaagctgatacaactgaggatcagagcggcgctaccttcgacaaacgcagccctacttggacggcacttagccgtatagcagggctgtgtaaccgagcagtgtttaaagccggtcaagaaaatatatctgtctctaaaagagacactgcaggtgatgcttctgaaagcgccctgctaaaatgtattgagctttcatgtggaagcgtcagaaagatgagggaccggaatcccaaagtagccgaaatccccttcaactccacgaacaagtaccagctgtccatccacgagcgggaggacagtccgcagagccatgtgcttgtgatgaaaggagcacccgaacgaattctcgacaggtgtagcacaatcttggtgcaaggtaaggaaatccctctcgataaggagatgcaggacgctttccaaaacgcctacatggagctgggaggcttaggggaacgggtgctgggattctgtcagctcaatctcccctcaggtaagtttcccaggggattcaagttcgatactgatgagctgaattttcccacagaaaagctctgttttgtcggtcttatgtccatgattgacccgcctagagctgctgtcccagatgctgtagggaaatgtcgctcagccggaattaaagtcattatggtgacaggtgatcatccaattactgcaaaggctattgcaaagggcgttggtatcatttcggaaggcaatgagaccgtggaggatattgctgcacggctcaacattccaatgagtcaggtgaacccacgggaggccaaagcttgcgttgtccacggaagcgacctcaaggatatgacctccgaacagctggatgaaatcttgaaaaaccacaccgagatcgttttcgcccgtacatctccccagcagaaactgattatcgtcgagggttgccaacgccagggagcaatcgtggccgtgaccggggatggcgtgaacgatagtccagcactcaagaaagctgacattggaattgcaatgggcatcagtgggagtgacgtctctaagcaagctgctgatatgatactgctcgacgataacttcgctagcatcgttaccggtgtcgaggagggacggctgatcttcgacaacttaaaaaagtccattgcctacaccctgactagtaacattccagagatcactccgttccttttatttatcattgcgaatatccctttaccactaggcactgtgactattctgtgtatagacctaggcactgatatggtgcccgcaatctcccttgcctacgaagctgcagagtccgatattatgaagcggcaaccacgaaatagtcaaacggacaagcttgtgaatgagaggcttattagtatggcttatgggcaaattggtatgatccaggccttagggggattttttacgtattttgtgatactcgccgaaaatgggtttctgcccagcaggctgttggggatcagattggattgggacgaccgaactatgaacgacctggaagatagctatggccaggaatggacttatgaacaaagaaaggtcgtggagttcacctgtcacacggcattcttcgcctcaatcgtggtcgtccagtgggctgatttaatcatctgtaagaccagacgcaacagcgttttccagcagggcatgaaaaataaaattctcatttttggacttctggaggaaacagctctggctgcgtttctgtcatattgtccaggtatgggcgtggcactcaggatgtaccctctcaaggtgacatggtggttttgtgctttcccctactcactgttgatcttcatttatgatgaggtaagaaaattgatcttacgccgatacccgggtgggtgggtggagaaagagacgtattactag

SEQ ID NO: 215312 - DNA, 3030 bp, Artificial Sequence
  Description of Artificial Sequence: Synthetic coding sequence
atgggtcgaggggcaggaagggagtacagcccagcggcaacaaccgcagagaacggtggaggcaaaaagaagcagaaagaaaaagagctggacgagctcaagaaggaagtggctatggatgatcacaagctctcccttgacgagctcgggaggaaataccaagtagacctgtctaaggggttgacaaatcaacgggctcaggatgtgctggccagagacggtcccaatgctctgacgcctccacctacaacccccgaatgggtgaaattttgcagacaactgtttgggggtttcagcattctgctatggatcggtgcgatcctgtgcttcctcgcatatggtatccaggcggctatggaggacgagccaagcaatgacaatctgtacctgggcgtggttctggcggctgtagtcatcgtgacagggtgtttctcctattatcaagaggccaagtcaagcaagatcatggattcattcaagaacatggttcctcaacaggctctggttattcgcgagggcgaaaagatgcagattaatgctgaggaagtggtggtgggagacttggttgaggtcaaaggtggggatagagtgcccgcagacctgagaatcatatcctctcatggttgcaaggtggataactcttccctcaccggcgaaagtgaacctcagacacgtagcccagaattcacacacgagaatcccctggaaactaggaacatctgcttcttctcaactaactgtgttgaagggaccgccaggggcattgtgattgccacaggggatcgcacggtcatgggacggattgcaacactggcatcaggccttgaagtgggccgaactcccatcgcaatggaaattgagcatttcatacagctcattacaggcgtggcagtgtttctcggcgtaagtttcttcgtactgtctctaattctgggttattcgtggctggaggccgttatcttccttataggcatcatagtggccaacgtaccagagggcctgttggcgaccgtgactgtgtgcctgactctcacagcaaagcgcatggctaggaaaaactgtcttgtgaagaatctggaagccgttgagaccttaggctccacctccactatctgcagcgataaaacaggcactctaactcagaacagaatgacggtagcccacatgtggttcgacaaccagattcacgaagctgacacaaccgaggatcagagcggcgctaccttcgacaaacgatcacccacgtggacagccctttcgcgaatagcgggattgtgtaacagagcagtgttcaaagccggacaggagaatatatccgttagtaaaagagacactgccggagatgcaagcgagagcgccctcctaaagtgcattgagcttagttgtggatcggtgaggaaaatgagagaccgaaacccaaaggtggctgagattccatttaattctactaacaagtatcagttaagcattcacgaacgcgaagatagccctcagtcacatgtgctcgtgatgaaaggcgcacctgagaggatacttgaccgctgttccaccatcttggtacagggcaaggagatccctctggataaggaaatgcaagacgcttttcagaatgcttacatggaactgggcggactcggcgaacgcgtgctcgggttttgccagctcaacttaccttctggtaaatttcctcgtggatttaaatttgacaccgacgagctgaacttcccaaccgagaagctgtgttttgtaggacttatgagcatgattgacccccctcgcgcagcagtaccagacgccgttggaaagtgtcggagcgccggaattaaggttatcatggtgacgggtgatcaccctatcacagcaaaagccattgccaagggagtggggatcatttccgaaggcaatgagacagtggaggacatcgccgcaagactgaatatccctatgtcacaggtaaatcccagagaggccaaagcctgtgtggtgcatggttctgatcttaaggatatgacaagcgagcagctcgatgaaattctcaagaaccacaccgaaatcgtgtttgcacggaccagcccacagcagaaacttataattgtggagggctgccagcggcagggcgctatcgtggccgtgaccggagacggtgtaaacgattctcctgccctcaaaaaggctgatataggtattgccatgggaatttcaggaagtgatgttagtaaacaagccgctgatatgattcttctggacgataactttgcaagcatagtgactggtgtcgaagagggccgactgattttcgacaatcttaaaaagagtattgcctacacactgacttcgaacattcccgagataacaccatttctgctgttcatcattgcaaatatacctttgcctctggggacggtgaccatcttgtgtattgatctgggcactgatatggtgcctgcgatcagcttggcctatgaagctgccgagtctgatataatgaagcgccagccacggaactctcagaccgataaactggtaaatgagcggcttatctccatggcatatggccagatcggcatgatccaggctctgggcggtttcttcacatactttgttatcctggccgagaacggtttcctgccatcccgcttattagggatacgcctggattgggatgaccggaccatgaacgacctcgaggatagctacggacaagaatggacttacgagcagcgcaaggttgttgaattcacctgtcacacagccttcttcgcttcaatcgtggtcgtgcagtgggcagatcttatcatttgtaaaactcgacgcaatagcgtattccaacaggggatgaaaaataagatcctcattttcggattactagaggaaacggccctcgccgcttttctaagctactgcccgggtatgggagtggccctgcgcatgtatcctctgaatctgctcatctttatctatgacgaagtacggaagctcattctacgcagatatccaggcggttgggtggaaaaagagacctattactag

SEQ ID NO: 215313 - DNA, 2172 bp, Artificial Sequence
  Description of Artificial Sequence: Synthetic coding sequence
atgcttagcagtgctctggccctgtccggagccctggttaagagactgaaaccgccaaacggccatttcattctgactgacacacacgatctgaacacctcaaaaatcgagcactctctgtttacggtgtgtctgactcttacggcaaagagaatggccagaaagaattgcttagtgaagaacttagaagctgttgagaccctgggctctacctcaacgatctgttccgataaaaccgggactctcacacagaacagaatgacggtggcccatatgtggtttgataatcaaatccacgaggcggataccacggaagatcaaagcggagcaacttttgataagcgcagcccaacctggacagccctctccaggatagcgggactgtgtaatcgggcagtgtttaaagccggtcaggaaaatatcagtgtgtcaaaacgggacaccgccggagatgccagcgagtcagcattattaaaatgcatcgagctttcctgcggttctgtgcggaaaatgcgggatcgtaatcctaaggtggcagagattccctttaacagtactaacaaataccagctctcaatccacgaacgagaggatagtccacagtcccatgtgctggtaatgaagggcgcaccagagaggatcctggatcgctgttccaccatcctcgtccaaggtaaggagatacccctggacaaagaaatgcaggatgccttccaaaatgcatatatggagttgggtggcctcggggaacgggtccttgggttttgtcagttgaacttgccgtctggtaaatttcccagagggttcaagtttgatacagatgagcttaacttcccaactgagaagctgtgcttcgtcggtcttatgtctatgatcgacccgccaagggctgctgtgcccgatgcagtcgggaagtgccggtccgccggaattaaggtgataatggtaactggcgaccaccccataacagcgaaagccattgcaaagggggtgggcatcatctctgaagggaacgaaacagtggaggacattgccgctcgcctgaatattccaatgtcacaagttaatcccagggaggcgaaagcatgcgtagtccacgggtcggacctgaaggacatgacctcggaacaactggacgagatcctcaagaatcacacggaaatcgtgttcgcgcgaacatcaccgcagcagaaacttattattgtagagggatgccagcgccagggtgccattgttgctgttactggtgatggcgtgaatgattcccccgctctgaagaaagccgatattggcatagccatgggcatctctggttccgatgtctccaagcaagccgctgatatgatactgctcgacgataacttcgcttcaatagttaccggtgtggaagaggggaggctaatctttgacaatcttaaaaagtcgattgcttatacgctgaccagcaacatcccagaaattactccctttttgctgttcatcattgctaacattcccctgcccttgggcaccgtaacaattctgtgtatcgacctcggcactgacatggtgcccgctatctccctggcatacgaggccgctgaatcagatattatgaagaggcaaccccgaaatagccaaactgataaactcgttaacgaacgcctgatatctatggcatacgggcagataggcatgatccaggcgctgggaggcttcttcacttattttgtgatattggccgagaatgggtttcttccctcacgcttgttaggtattagactggattgggatgataggaccatgaatgatctggaagactcatatggacaggagtggacttacgagcagagaaaagttgtcgaatttacttgccatacagccttttttgcctcaatcgttgtggtccaatgggcggacctaattatctgcaaaacaagaaggaactccgttttccagcaggggatgaagaacaaaatcctgatatttggtctgcttgaggagactgcgttggccgctttcctatcctattgccccggaatgggagttgccctgcggatgtatccattgaaagttacctggtggttttgtgcttttccgtattcgttgctgatctttatctacgacgaggtacgtaagctgatactgaggcgctaccccggtggatgggttgagaaagaaacttactattag

SEQ ID NO: 215314 - DNA, 2145 bp, Artificial Sequence
  Description of Artificial Sequence: Synthetic coding sequence
tgacagcttataactggggtggccgtgttcctaggtgtaagtttttttgtgctaagtttgatcttaggttatagttggttggaagccgtcatttttctcatcgggatcatcgtcgccaatgttcccgagggactactagctacagttacggtttgtctcacccttaccgccaaacggatggccaggaagaattgcctggtgaaaaaccttgaagccgttgagactctcgggagcacgagcacaatttgcagcgacaagacagggactctcacacaaaatcgcatgacggtagctcacatgtggttcgacaaccagattcatgaggccgatactaccgaagaccagagcggagccaccttcgataagaggtcccccacttggacagctctcagtagaattgctggtctgtgcaacagggccgtctttaaggcaggtcaagagaacatctcagtgtccaaacgggatacagccggtgatgcctccgagagtgccttattgaagtgtattgaactctcctgtggaagtgtgagaaaaatgagggacagaaacccaaaggtagccgaaattccgttcaacagcacaaataagtatcagctctccattcacgagcgggaagattctcctcagtcacatgtattggtgatgaagggggctccagagagaattttggaccggtgcagcacgatcctagtgcagggcaaagaaatacccctcgataaggagatgcaggacgcctttcagaacgcgtatatggaactgggcggattaggagagcgagtgttagggttttgccaactgaatttacccagtggcaaatttccgagaggttttaagtttgatacagatgagctcaatttccctacagagaaactgtgcttcgtcggcttaatgtcaatgatagatccccctcgcgctgcggtgccagatgccgtaggtaagtgtagaagtgcgggtataaaggtgattatggtgaccggggatcaccccattaccgcaaaggctatcgctaaaggagtagggattatctccgaggggaacgagacagtggaagatatcgcggctcgcttgaatataccaatgtcccaggtcaacccccgagaggctaaggcgtgtgttgtgcacggttctgacctgaaggatatgaccagcgagcagctcgacgaaatcctgaaaaatcacacagagatcgtgtttgctcgcacatcacctcagcagaaattgatcattgtcgaggggtgccagcggcaaggagccatagttgctgtgactggggatggggtcaacgactccccggcactgaaaaaagctgacatcggcatcgcaatgggcatctcgggatccgatgttagcaagcaagcggctgatatgatcctgctggacgataatttcgctagcattgtcacaggcgtggaagagggtcgtctcatttttgacaatttgaaaaagtcaatagcctatactctaacttctaacatcccagaaatcacccccttcctccttttcattatagcaaatatccctctgccactgggcaccgtgaccatactgtgtattgacctaggcacagatatggttcctgccatcagccttgcatacgaggcagccgagtccgacattatgaagaggcagcctagaaactcccaaactgacaaacttgttaacgagcgcctgatcagtatggcctacggccagatcgaaaatggatttttacctagccgtctgctaggcattcggttagattgggacgacaggaccatgaacgacctcgaagattcctatgggcaggagtggacatacgagcaacggaaagtggtcgagtttacctgtcacacagccttcttcgcctcaatcgttgtcgtacaatgggcggatctaattatctgtaaaaccaggagaaactcagtctttcagcagggcatgaaaaacaaaattctcatctttggcctgttagaggagactgctctggctgctttcttgtcatattgtccaggcatgggcgttgccttacgaatgtacccactgaaagtcacctggtggttttgtgcctttccgtacagcctgctgattttcatatatgatgaagtgcggaagctgattcttcgacggtacccaggtggatgggtagaaaaagagacatactattag

SEQ ID NO: 215315 - DNA, 819 bp, Artificial Sequence
  Description of Artificial Sequence: Synthetic coding sequence
atggattccttcaaaaacatggtcccacagcaggcactggtgattagggagggggaaaagatgcagattaatgcagaggaagtggtggttggggatttggtcgaagtcaaagggggagacagagtgcctgccgatctgaggattatatctagccacggatgcaaggtcgacaactcttcactcaccggagaaagcgagcctcagacgcggtcacccgagttcactcacgagaacccactggagacccgaaatatctgtttcttcagcacaaactgcgtggaaggaacggcgcgagggattgtcatagctaccggagaccgtacggtgatgggcagaattgctacgttagcctcaggactggaggtgggcagaacacccatagcaatggaaattgaacattttatccaactcattactggcgttgccgtgttcttgggggtatctttcttcgtactgagcctcatcctgggttacagctggctggaagctgtcattttcctgatcgggataatcgtggctaacgtgcctgagggcttgctcgctaccgtgaccgtctgcctcacactcacagcgaaaagaatggcaaggaaaaattgccttgtgaaaaatcttgaggccgtggaaacattggggagtacatccactatctgttctgacaaaaccggtacacttacccagaataggatgacagtagcacacatgtggtttgataaccaaatccatgaagccgataccacggaagaccagtcaggcgattgggtcctccagaggggatggatcggactggaagaagctgaaggctcaggtgtcgttggatag

SEQ ID NO: 215316 - DNA, 3042 bp, Artificial Sequence
  Description of Artificial Sequence: Synthetic coding sequence
atgggagataaaaaagatgacaaagacagccctaagaaaaacaagggaaaggaacggagagatttagatgatctcaaaaaagaggtggccatgacagagcacaaaatgagtgtagaggaagtgtgccgtaagtacaacacggactgcgtgcagggactgactcatagcaaggcgcaggaaattctggcccgagacgggccaaacgcccttacccctccccctaccacccccgagtgggtgaagttttgtcggcagctattcgggggtttttcaatcttgttgtggatcggagcaatcctgtgtttcctggcctacggaattcaagcaggcactgaggatgacccgtctggagacaatctctacctcggaatcgtgttagctgccgtcgttattataaccgggtgtttttcatactaccaggaggccaagtccagcaagatcatggaatcgttcaagaatatggtccctcaacaagccttggttatcagggagggtgagaaaatgcaggtaaacgccgaggaagtggtggtgggcgatctggtcgagatcaaggggggtgacagagtgccagccgacctgagaattattagtgcacatggctgcaaagtagacaactcttctctgactggcgagtcagaacctcagacccggagccccgattgtactcacgacaacccattggagactaggaacatcactttcttcagtaccaactgtgttgagggtactgcgagaggcgtggttgtggccactggagatcgcaccgttatgggacgaatcgccacccttgcatccggtctggaggtcgggaaaactcctattgcgattgagatcgaacacttcattcaactgataacaggagttgctgtgttcttgggggtgagctttttcatcttgtccttaatcctggggtacacctggctggaagctgtcatcttcctgattggaattatagtggcaaacgtccccgaggggttactcgcgacggtaactgtgtgtctgactttgaccgctaaacgtatggccagaaagaattgtctggtgaaaaatctggaggccgtcgaaactctgggtagcaccagcactatttgcagcgataaaaccggcaccttgactcagaatagaatgaccgtggcccatatgtggttcgacaaccaaattcacgaggccgacaccacggaggatcagtcagggacctctttcgacaaaagctctcatacttgggtcgcgctgtcgcatatagctggtctttgtaatagagctgttttcaagggaggccaggacaacatccctgtactcaaaagggacgtggccggagacgcgagtgaaagcgccctgctcaagtgcatcgaactgagctctggtagtgttaaactgatgagggaacggaacaagaaggtggccgagatcccgttcaactcgacgaacaagtaccagctgtcaattcacgagacggaggacccgaatgataaccggtatttgttagtgatgaaaggggctcccgagagaatcctggaccgatgcagcacaatattgctgcagggaaaggaacaacccctcgacgaagaaatgaaggaggcctttcagaacgcctacctcgagctgggtggtctgggcgagagagttctgggattctgccactattacctccccgaggagcagtttccaaagggattcgcgtttgattgtgatgatgtcaatttcaccacagacaacctctgctttgttggcctgatgagtatgattgacccaccacgtgcggctgtaccagacgccgtgggcaaatgcagaagcgcaggcatcaaggtcattatggtcaccggggaccaccccatcacagccaaagccattgcgaaaggcgtgggcatcatcagcgaaggtaatgagactgtcgaggatatagctgctcggctgaatatccctgtgtcacaagtaaaccccagggatgcaaaggcctgcgtgattcacggaacagatcttaaagatttcacctcggagcagatagatgaaattctacagaatcatactgaaatcgtattcgcccgtacttcaccccagcagaagcttattatcgtggagggctgtcagagacagggcgctatagtggcagtgaccggtgatggcgtcaacgattcccctgcccttaagaaagcagatataggcgtggccatgggtattgccggtagtgacgtgtcgaagcaggcagccgacatgattcttctggatgataattttgcatcaatcgtaacaggcgtcgaagaagggaggcttatttttgacaacttgaaaaagtcaattgcatacaccctgaccagcaacatcccagaaatcacgcccttcctccttttcatcatggcaaacatacctctgcctctaggtacgataaccattctctgcattgatctcggaacagatatggttcctgctatatccctggcatatgaagcagcagagtccgacattatgaagagacagccgaggaacccacgaacagataaattagtcaacgaaaggctcatctctatggcctatggccagatcggcatgattcaggccctcggaggctttttctcctattttgttatcttagccgaaaacgggttcctgcctggaaatctggtgggtatcaggcttaattgggatgaccggaccgtaaacgacctggaggattcttacgggcaacagtggacatatgagcagagaaaggtggtagaatttacctgtcataccgcctttttcgtttccattgtagtggttcaatgggctgaccttattatctgcaaaacccgacgcaacagtgtttttcagcagggaatgaaaaacaaaatcctgatcttcggcctattcgaggaaactgccttggcagccttcctttcatattgccccggtatggatgttgctttaagaatgtatcctctgaagccctcctggtggttctgcgcctttccctatagtttcctcatatttgtgtacgacgagattaggaagctaatattaaggcgaaaccctgggggttgggtagagaaggaaacgtactattag

SEQ ID NO: 215317 - DNA, 2952 bp, Artificial Sequence
  Description of Artificial Sequence: Synthetic coding sequence
atgactgaacacaagatgagtgtggaagaggtttgtcgaaagtataatactgactgcgtgcagggccttacccatagcaaagcccaggagatactcgcaagggatggaccaaatgcactgactcctccacccactacgcccgagtgggttaaattctgccgccagctcttcggtggctttagcatactgctgtggataggcgctattctctgtttcctggcctatggaattcaggccggtaccgaagatgacccatctggagataatttatatctgggcatagtactagcggctgtagttataatcactgggtgcttcagctattatcaggaggccaagtcaagcaagataatggagtctttcaagaatatggtgccacagcaggcccttgttatccgggaaggcgaaaagatgcaagtcaacgcagaagaagtcgttgtaggagacctcgtcgagatcaaagggggtgaccgagtgcccgctgatcttcggataatttctgcgcatggatgtaaagtcgacaattcgagcttgactggagagtctgagccccaaaccagaagtccggattgcacccatgacaatccactggagaccaggaatatcacgtttttttccactaactgcgtggagggcacggcccgtggggtagtggtggcgactggggatcgtacagtgatgggtcgaatcgcgactcttgcaagtggtctggaagtggggaagaccccaatagccatagagatcgaacatttcatacagctgattacaggcgtggccgtgttcctgggagtgtcattcttcattctgagcttgattttgggatacacctggcttgaggccgttatcttcttaatcggcataattgtggctaatgtccctgaaggtctgctggccactgtcaccgtatgtttgactcttactgcgaaacgaatggctcgaaagaattgcctggttaagaacttagaggctgtggagacactgggttctacctccacaatatgctcggataaaacgggaacacttactcaaaaccggatgactgtggcccatatgtggttcgacaaccagatacacgaggcagataccactgaagatcaatccggcacaagcttcgataaaagttctcatacttgggtggcgctgtcgcacattgccggactttgtaatcgggcagtctttaagggaggccaggataacatacccgtcctcaaaagagacgtggctggagacgctagtgaatccgctctgttgaagtgcattgaattgtcatcaggatccgtgaaactgatgagagaacgaaataagaaggtagccgagatccctttcaactcaaccaataaataccagttatccatacatgagactgaggacccgaacgataatcgttatttactggttatgaaaggtgctccagaaagaattctagaccgctgctctacaattctgctgcaaggcaaggaacaacccttggacgaggagatgaaagaggctttccaaaatgcttacctggagctgggtggcctgggggagcgggtcctgggtttttgccattactaccttcccgaggagcaattccccaaagggtttgcctttgactgtgacgacgtgaattttaccacagacaatctttgtttcgttgggctgatgagcatgattgatccgcctcgggcagctgtccccgatgctgtcgggaaatgtaggtccgctggaatcaaggtgattatggtgaccggtgatcatcccataactgcgaaggcaatcgcaaaaggtgtggggatcatcagcgagggcaatgagacggtggaggacatagctgccagactgaatatcccggtctcccaggtgaacccgagggacgcaaaggcctgcgtcatccatggcactgacctaaaggattttacttcagagcagatcgacgaaattcttcagaatcataccgaaatcgtctttgccagaacctccccccagcagaagttaatcatcgtcgagggatgccagcgtcaaggtgccatagtcgccgtcactggagacggcgtgaacgattctccggctttaaagaaggctgacatcggagtggcaatgggaatagccggttctgacgtgtcaaaacaggcggcagatatgattttgctggacgacaacttcgctagcattgtcacaggcgttgaggaaggacgactcatttttgacaatctcaaaaagagtatcgcttatactttgacaagcaacatcccagagataaccccattcctattgttcattatggcaaatattcctttaccactgggcaccattactattctgtgtatcgacttgggtacggatatggtccccgctatctccctggcctatgaagcagcggagtccgatattatgaagaggcagccccgaaatcccagaacagacaaattagttaatgagcgtctgatctcaatggcttatggccagattggcatgatacaggcactcggaggtttcttcagctacttcgtgatcctagctgagaatggcttcctgcccggaaatcttgtgggcatacggttgaactgggacgatagaaccgttaacgacctcgaagactcctatggccaacagtggacttacgagcagcgcaaagttgtagaatttacctgtcatacagccttcttcgtttccatcgtggtcgtgcagtgggccgatctcattatctgcaagacccggagaaattcagtctttcagcagggcatgaagaacaagatcctgattttcggactgtttgaagagaccgcattggccgcatttctgtcctattgcccagggatggacgtcgcgcttaggatgtatccactcaagccttcctggtggttctgtgcatttccatacagctttctaatctttgtgtatgatgagataagaaaactgatccttcggcgaaatccaggagggtgggtggagaaagagacttattactag

SEQ ID NO: 215318 - DNA, 3681 bp, Artificial Sequence
  Description of Artificial Sequence: Synthetic coding sequence
atgggtgataagaaggatgacaaggatagtcccaagaaaaataaaggcaaggaaaggagagatttggacgacttaaaaaaggaagttgccatgactgagcataaaatgtctgtggaagaggtttgtcggaagtataatacagactgtgtgcagggccttactcactccaaagctcaggagatcctcgcacgcgacggccctaacgcgcttaccccgccacctacgacgccagaatgggttaagttttgccggcagctattcgggggtttctcaatcctactgtggatcggagctatcctctgcttcttggcctacgggatccaagctggtaccgaggatgacccctctggcgataacctatatttgggaattgtcctggcagccgtggtgatcatcactggttgtttctcatactaccaggaagccaaaagtagcaaaattatggagtcattcaaaaatatggttccacagcaggccctggtgattagggagggggagaaaatgcaggtgaatgcagaggaagttgtggttggagatttggtcgagatcaagggtggcgacagggtgccagccgacctgcgcatcatctcagcgcatggatgtaaggtcgacaactcaagcctgactggagagtctgagccacagactagaagccccgactgtacccacgataatccgttggagaccagaaacatcaccttcttttccacaaactgcgttgagggaactgcacggggtgtggttgtcgccacaggggaccgtacagtgatgggtcggattgcaaccctggcctcagggctcgaggtgggtaagacgccaatcgccatcgagatcgaacatttcatccagttgatcaccggcgtagcagttttcctaggggtatccttcttcatcctgtcgctgattctgggatacacttggctggaggcggtcatattcctcatcggcatcattgtagctaacgtgcccgaggggttgcttgccactgtcacagtgtgtctgactctcactgcaaaacgcatggctagaaaaaactgtctggtgaagaacttagaggccgtagaaacactgggatccacttccactatctgtagtgataagacagggaccctgacacaaaatagaatgactgtggcccatatgtggtttgataaccagattcatgaagccgatacaaccgaagaccagtctggcactagcttcgacaaatcatcacacacctgggtggctctatcgcatatcgccggtctctgtaaccgggcagtttttaaaggcggacaggataacatccctgtgcttaaacgggacgttgccggagacgccagtgaatcagcactactgaaatgtatcgagctgagttccggttctgtgaagctcatgcgcgaacgtaataaaaaagtggccgagatcccttttaattccactaacaaatatcagctctccattcacgagacagaggacccaaacgataatagatatctgctcgtgatgaagggtgctcctgagaggatcctggacaggtgttccaccattctgttgcagggcaaggaacaacctctcgacgaagaaatgaaagaggcctttcagaatgcatacctagagctgggcggacttggcgaacgagtgctgggtttctgccattattacctgcccgaggaacagttcccaaaagggtttgccttcgactgcgacgatgtgaacttcaccaccgataacttgtgctttgtagggttgatgagtatgatcgatccacctagggccgcagtccctgacgcagtaggcaagtgcaggtcagcagggattaaagtaatcatggtgactggggatcatcccataaccgcaaaggcaattgccaaaggcgtgggtattattagcgagggaaacgagactgtggaagatatagctgccaggctgaacattcccgttagccaggtaaatcccagagatgccaaggcctgtgttattcacggaacggaccttaaagattttacatcagaacagatagatgaaattctgcagaaccatactgagattgtttttgcaaggacgagtccccagcagaagctgatcattgtggaaggctgtcagcgtcagggtgccatcgtggctgtgactggcgatggagtgaatgattctccagccctgaagaaagcagacatcggggtggcgatgggcatagcaggctccgacgtgagcaagcaggcagccgacatgatcctgctcgacgataacttcgcctcaatagtcacaggcgttgaggagggccgtctgatctttgacaatctcaagaagagcattgcttacaccctgactagcaacattcccgaaattacacctttcctattgttcattatggccaacatacccttgcctctaggcactataactattctgtgtatagatctgggcactgatatggttccagccataagcctcgcgtacgaagcagccgaatcagatattatgaagcgccagccgcgaaatcctaggacagataaattggttaatgagaggctgatctccatggcctacggccaaatcgggatgatccaagcgctcggagggttttttagctattttgtcatcctggccgagaatgggtttctgcctggcaacttagtgggcatccggttgaactgggacgatagaaccgtcaatgatttagaggacagctacggccagcagtggacatatgaacagcgcaaggtcgtggagtttacttgtcatacagcattcttcgttagcattgtagtggtccagtgggccgatctgatcatttgtaaaacacgcaggaacagtgtcttccagcagggtatgaagaataagatcctcatattcggtctgttcgaagagacagctctggcggcttttctgtcctactgccccggaatggacgtggccctgaggatgtatcctcttaagccaagttggtggttctgtgcattcccgtatagtttcctgatctttgtatacgacgaaatccgaaaattgatactccgcaggaaccctggcggagagggagcacggcagggatctaggggaggcagaggcgcagcgggatctcaggccgctgggcctcggttgccatctccgtgctggatggcactgcccccaggaagccattcgtccctctcatcacacctgtccgggcatcccctatgtctgcttacaggactgtgcctatgtggattcttagtgagcctccctctctgcccttccctgtgttgggccgctaggctagcatgcctcagcccttctctgacattgtctctgtcttttctcctgtgtctgagcagactaggcggtgagggaaacttactgcttaccagtgcgcctcctcatagaccaagtctccctcgcccaccaggcccaggacctcctctttccgtcccccctatcttatactccggaggtagatccccccttttcttatggccccaccttggaccgcatcccctgcactatctcttaccccctccgttgtggctggcctcgcttccatgtccaaagccactgagttctctgttttccgtgtccgtgagcctcccactgctcaccccccttagcattccgcctgcccctgctacttccctgggttcattcctgctgcccttctccccccctgcagacgcgattagtgggtccgggcagctgagcaacattagtgttggacgcgaatag

SEQ ID NO: 215319 - DNA, 444 bp, Artificial Sequence
  Description of Artificial Sequence: Synthetic coding sequence
atgggatctggtggaagcgattcatacagaatcgctacttctcaagacaagaaggacgataaagattccccaaaaaaaaacaaagggaaagaaaggcgcgatctggacgacctaaagaaggaggtggctatgacggagcacaagatgtccgtggaggaagtatgtcggaagtacaacaccgactgtgttcaaggattgacccattcaaaagcccaggagattctagccagagatgggcctaatgcgctgactccacctcccactacacctgagtgggtgaagttttgccgacagttgttcgggggtttcagcattttgctctggataggagcaatcttgtgctttctggcatatggaattcaggccggaacagaggacgatccttccggcgacaatctgtacctgggtattgtgctagcagccgtcgtgattataactgggtag

SEQ ID NO: 215320 - DNA, 2049 bp, Artificial Sequence
  Description of Artificial Sequence: Synthetic coding sequence
atggggagaattgccaccttggcgtctggactggaagtggggaagaccccaattgctattgaaatcgagcattttatccaactaatcaccggcgtagcagtatttctcggtgtgtcgttcttcattctgtccctgatcctgggatatacgtggctagaagcagtgatttttttgattggaatcatcgttgcaaatgtgcctgagggtcttctggccacagtgacagtgtgcctcactcttactgccaaacgcatggctagaaaaaattgcctggtgaaaaatttggaggccgtggaaacactaggttccacatctacgatctgcagtgataaaacaggaacccttacacagaatcgaatgacagtcgctcatatgtggtttgataaccagatacacgaggcagacaccacagaggaccagtccggcactagcttcgacaagagtagccacacctgggtggctttgagtcatatcgccggtctttgcaatcgggcagtgtttaaagggggtcaggacaatattcccgtcctgaaacgtgacgtcgcgggagatgcctcggagtcagccctcctgaaatgtatcgaattgagctcagggtctgtaaaacttatgcgagagcggaacaagaaggtggcggagatcccgttcaactccacaaacaagtatcagctctctatccacgagactgaagaccccaatgacaatcggtatctccttgtgatgaagggtgcaccggagagaatactcgaccgctgctcaacaattctcttacagggaaaagaacagccactggatgaggaaatgaaggaggcatttcagaacgcttacctagagctgggcggacttggggaacgtgtactgggcttttgccactattacctgccagaggagcaatttccaaaaggcttcgcattcgactgtgatgacgtgaacttcacaaccgataatctgtgttttgtcggcctcatgtcaatgatagacccaccgagagcagcagtccccgacgcagtggggaagtgtcgcagcgccggtatcaaagtcattatggtgaccggggatcaccctatcactgccaaagcaatcgctaagggggtcggaattatcagcgaaggtaacgaaactgttgaagacattgccgcacgcctaaacatcccagtaagtcaagtcaacccacgcgatgccaaagcctgcgtgattcacggaacagatctgaaagattttacctccgagcaaatcgatgaaattctgcaaaatcataccgaaatcgttttcgcacgcacgagtccccagcagaagctgatcatcgtggagggctgccagaggcagggggctatagtcgccgtgacaggcgatggggtgaatgactctcccgctctgaagaaagcggatatcggagtggccatgggcattgctggttcagatgtgtcaaagcaggctgctgatatgattctgctcgatgacaactttgcctctatagtgacaggtgtggaagagggccgtctcatttttgacaacctgaaaaaatccatagcctacacactgacctccaatattccagagatcactccatttctgttgtttattatggccaacatccctctgcccctcggcacaatcaccatactttgtattgacttggggactgatatggtgccagcaattagcctagcatacgaggccgctgaaagcgacattatgaagcgtcagcctcgaaatccaaggactgacaagctggtgaacgaaaggctaatctccatggcttatggacagatcggaatgatccaagcactcggtggttttttctcctatttcgtgattctggcagagaacggatttctacctgggaaccttgtgggcattcggctgaactgggacgacaggaccgttaacgacctggaggattcgtatggccaacaatggacctatgagcagcggaaggtggtggaatttacttgtcacacggccttttttgtttcaatcgtcgtggtacagtgggcggatctcattatatgtaaaacaaggcgaactcgcagttcctcccgggcatag

SEQ ID NO: 215321 - DNA, 3075 bp, Artificial Sequence
  Description of Artificial Sequence: Synthetic coding sequence
atggggggttgggaggaagaacgaaacagaagagccaccgacaagaaggatgacaaagactctccaaagaaaaataaaggtaaggagagaagagacttagatgatctcaagaaagaagttgctatgactgagcacaagatgtcagttgaggaagtctgccggaagtataataccgactgtgtgcagggactgacccactctaaggctcaggagatattagccagagatggaccaaatgccttgactccccctccgaccacccctgaatgggtgaagttctgccggcaactctttggaggcttcagcatactgctgtggatcggggcaatactgtgtttcctcgcctacggaatacaagccggaacagaagacgatccatcgggagataacttgtatctgggaatcgtgcttgccgcagtagtaatcatcactggatgcttctcttattatcaggaggcaaaatccagtaagatcatggagagcttcaagaacatggttccccagcaggccctggtgattcgggaaggggagaagatgcaggtgaacgccgaggaggtcgtggttggcgatctggtggagatcaaaggcggtgatcgcgttccggcagacctcaggattatctccgctcacggctgtaaagttgacaatagttccctcacaggtgagtcagagccgcagacccgcagtcctgactgtactcacgacaatccattagagactaggaacattacctttttcagcacgaattgtgtcgagggcaccgccagaggtgtcgttgttgctacaggcgataggactgtgatgggtcggatagccaccctggcttccggtctcgaggttggcaagacgcccatcgcaatagagattgagcacttcatccagttgatcaccggagtggctgttttccttggcgtttcattctttattttatcgctcattctaggctatacctggttagaagctgtgatcttcctgatcggcatcatcgtcgcaaatgttccagaaggactgctcgccaccgtcacagtctgcctaaccctgaccgcaaagcgcatggcgcgaaaaaactgcctggtcaagaacctggaagccgtggagaccctgggatctacgtccaccatatgcagcgacaagactgggaccctcacacaaaataggatgaccgtggcacacatgtggtttgacaaccagattcacgaagccgacaccaccgaagatcagtctggaaccagctttgataagtcttctcatacatgggtggctctgtcccatatcgcaggcttgtgcaaccgtgctgtgttcaagggagggcaggacaatatcccggtgttgaagcgcgatgtggcaggagacgctagtgaaagcgcactgctgaaatgcatagagctatctagtggcagcgtaaaattgatgcgggagaggaacaaaaaggtggcagagatcccattcaatagcaccaacaagtaccagttgtccatccacgagaccgaagatcctaatgataacagatatctcctggtgatgaagggggcaccggaaaggattctcgacagatgttcaactattctgctccaaggcaaagaacagccgctagacgaagaaatgaaagaggccttccagaatgcatacctcgaattgggtggcctgggcgagcgtgtgttgggcttttgtcactattacctgccggaggaacagttccccaaaggcttcgcctttgactgtgacgacgtgaattttacaaccgacaatttatgcttcgttgggctaatgtcaatgatcgacccccctagggctgcagtcccggacgccgtgggcaagtgccgttccgcaggcatcaaggtaatcatggtaacgggggatcacccaatcaccgcgaaggccatagccaagggcgtgggcatcatttctgaaggaaatgaaaccgtcgaggatatcgctgctcgtctgaacatcccagtgagccaggtcaatcctagggatgcgaaggcctgcgtgatccacggcaccgatctgaaggatttcacctccgagcagattgatgaaattctccagaaccataccgagatagtcttcgctagaacgtctcctcaacagaaattgattatcgttgaaggatgtcaaagacagggagcaattgtggccgtcaccggggacggagttaacgattctccagccctgaagaaagctgatatcggggtcgccatgggcatcgcgggtagcgatgtgagcaagcaggccgcagacatgatcttactggacgacaatttcgcatctatagttaccggggtggaggaaggaagattgatctttgataatcttaaaaagtcaatagcctacactctaacaagcaacatccccgagattaccccattcctgctttttatcatggccaacatccctctgcccctaggaacaataacaatcttatgtattgatcttggaaccgacatggtgccagccattagtctggcgtatgaagctgcagagagcgacattatgaagagacagccacggaatcctcggactgataaactagtcaatgaacgactgatttccatggcctatgggcagatcggcatgatccaggcattgggtggctttttttcatacttcgtgatcctggctgaaaacggtttcctgccgggaaatctcgtaggtatccgccttaattgggacgaccgaaccgtgaatgacctggaagacagttacgggcaacaatggacttatgaacagaggaaagtggtcgagtttacatgccacacagccttcttcgtctccatcgtcgttgtccagtgggcagatctgatcatctgcaaaacgaggcggaatagtgtctttcaacagggcatgaaaaacaagatccttattttcgggctgttcgaggaaacagccctggcagctttcctgagctattgtccaggcatggatgttgctctcaggatgtaccctctgaagcctagttggtggttttgtgcatttccatactccttcctcatatttgtgtacgacgagataagaaaactcattttgaggcgcaacccgggaggttgggtagagaaggagacttattactag

SEQ ID NO: 215322 - DNA, 3081 bp, Artificial Sequence
  Description of Artificial Sequence: Synthetic coding sequence
atgggctccggcggaagtgactcgtacaggattgctacctcacaagacaagaaagacgataaagactcacccaaaaaaaacaaagggaaagagcggcgtgacctcgacgacctgaagaaggaggtagcgatgaccgagcataaaatgtctgtggaggaagtctgccgcaagtacaatacggactgtgtgcaggggctgactcactcgaaagcccaggagatcctggcacgggacggacctaatgctctcacccccccacctacaactcccgaatgggtgaagttttgcagacagctgtttggcggatttagtatccttctgtggatcggagccatcctgtgcttcctggcttatggaatccaggcaggaaccgaggacgacccatccggagataacctatacctcgggatagtcctggccgcagtggtcataattaccgggtgcttctcctattatcaagaggctaaaagcagtaagatcatggagagtttcaagaatatggtcccccagcaggccttggttattagggaaggagagaagatgcaggtcaacgctgaggaagtggtggtgggagacttggtcgaaataaagggaggcgatagagtccccgcagatcttcgcattatctccgcccacggctgtaaggttgataattccagcctgaccggtgaaagtgagccccagacaaggagccctgattgtacccatgataatcctctggaaacccgaaacattaccttcttctcaacaaattgcgtggagggaacagccagaggagtggttgtggctacaggtgatcgaactgttatggggcgtatcgccaccctggcgagcggcctggaagtcggaaagacaccgatcgcaattgaaatagagcattttatccagctgataacgggtgtggccgttttcttgggcgtcagtttctttatcctatcgctaattttgggctatacatggctggaggctgtgatttttctgattggcataatcgtcgccaacgtccccgagggtctcctagcaactgtgaccgtgtgcctcacactgactgccaaaaggatggctcggaagaattgcctcgtcaagaatctggaggccgtcgaaacactgggatccacgagcaccatttgctccgataaaacaggcacactgacacagaaccgtatgactgtcgcccacatgtggtttgataaccagatacatgaagcagatactacggaggaccagtcaggcacgagtttcgataaaagttcccacacctgggttgcacttagtcacatcgccggactgtgtaacagggccgtgttcaaggggggacaggataatatacctgttcttaagagggacgtggccggtgacgcttccgaaagtgctctcctgaaatgtatcgaactgtcctctggcagcgttaagctgatgagggagagaaacaagaaagtcgctgaaattcccttcaactctaccaacaagtatcagctgtcaatccacgaaacggaggacccaaatgacaatagatacctgctcgttatgaagggcgctccagaacggattttagacaggtgctctacgatactgcttcagggtaaagaacagccactggatgaggaaatgaaagaggcgttccagaatgcttacctagaactgggtgggctgggagagcgggtgcttggcttttgtcactactatctgcccgaagagcagtttccaaagggctttgccttcgattgtgacgacgtgaacttcactacggataatctgtgttttgtggggttgatgtctatgattgacccccctcgcgctgctgtgcccgacgccgttgggaagtgtcgctccgccggaattaaggtgataatggtgacgggggatcacccgattactgcaaaggccattgccaaaggcgttggtattatctctgagggtaatgagacagtcgaggatattgctgcccgtctgaatatccctgtatctcaagtgaatcctcgagatgccaaagcatgcgtgatccatggaacagatctcaaggactttacctcggaacaaattgatgaaattctgcagaatcacacagagatcgtgtttgccagaacttctccccagcagaagctgatcatagtcgaagggtgtcagaggcagggcgcaatcgttgcagtaacaggggatggagtgaacgatagcccagctctgaagaaagctgacatcggggtggccatgggcattgctggctcagacgtctccaaacaggcagcggacatgatcctgctggatgataacttcgcctctatcgttaccggggttgaggagggacgccttatctttgacaatctcaagaaatccatcgcatatactcttacttcaaacattccggaaattactccctttttactgttcatcatggctaacataccgctcccactgggaacaataacaatcctgtgtatcgatctggggaccgacatggtgccggctatttccttggcatacgaagccgctgaatcagatattatgaagcgacagccaagaaatccccgtactgataagcttgtgaacgagcgcctcatcagcatggcttatgggcagattggcatgatccaggccctgggaggattcttctcatattttgtgatactggcggagaacggattccttcccggtaatttagtgggaattcgcctgaactgggatgaccgaacagtgaatgatctagaagactcctacgggcaacagtggacgtacgagcagcggaaggtggtcgaatttacgtgccatactgcatttttcgtgtcaattgtagtggtgcagtgggctgatctgatcatatgcaagactcgcagaaattcagtattccagcaaggcatgaagaataaaatcttaatcttcggcctgttcgaggagacagccctggcagcctttctgtcctattgccccggaatggacgtcgccctgcggatgtacccgttaaaacccagttggtggttctgcgcattcccttattccttcctcatcttcgtgtacgacgaaattcgaaagctgatcctgaggcgaaacccagggggatgggtcgagaaggagacctattactag

SEQ ID NO: 215323 - DNA, 3090 bp, Artificial Sequence
  Description of Artificial Sequence: Synthetic coding sequence
atggggctctggggtaagaaaggaacagtggcaccccacgaccagtcgccccgaagaagaccgaagaagggcctcatcaagaaaaaaatggtaaagcgtgagaaacaaaagcggaacatggaggagctgaagaaagaggtggtaatggatgatcataaactgactctggaggaattaagtaccaagtactcggtagacctcacaaaagggcacagtcatcagagggccaaggaaattctcacacggggaggaccaaacaccgtgacaccaccccctacgacccccgaatgggtgaaattctgcaagcagctctttggaggtttcagtttgttactgtggacaggcgctatactttgtttcgtcgcatattccattcagatctattttaatgaagagcctacaaaggataatctctacctaagtatcgtgctgtccgtagtggtgattgtcacgggatgtttcagctactaccaggaggcaaaatcttcaaagatcatggagtcctttaagaatatggttccccagcaggcgcttgttataaggggaggcgagaagatgcaaattaacgtccaggaggtggtgttgggcgaccttgtggaaattaaggggggagaccgagtgcccgctgaccttcggcttatttcagctcagggctgtaaagtggataactcatccctaactggcgagagcgagccgcagtctcgatcaccagattttacccatgaaaatccccttgagactcggaacatctgtttcttttccactaattgtgtcgaagggactgcaaggggcattgtgatcgctaccggcgactctaccgttatgggcaggatagcgtcactaactagcggcttagcggtgggtcagacccctattgcggcagagattgagcactttatccatctcatcactgttgtggccgtcttcctaggggtgactttctttgccttatccttgctcttgggatatggctggcttgaagccattattttcttgattggcattatcgtggccaatgttccagagggcttgctggctacagtgactgtgtgcctcacgctcactgctaaaagaatggccagaaagaattgtttagtgaaaaaccttgaagctgttgaaaccctcggctccacctccactatctgtagtgacaagactgggacattgactcaaaacaggatgaccgtggcccatatgtggttcgatatgactgtgtatgaggcagacacgaccgaagagcagacaggcaagaccttcaccaagtcctctgacacgtggttcatgctggcccgaatagctgggctgtgcaacagggccgatttcaaggccaaccaggagattttgcccatcgccaagagagcgacgaccggggacgcctcagagagtgcattgctaaagttcatcgagcagtcttacagctcggttgcggagatgagagaaaagaaccccaaagtagccgaaatcccattcaacagtactaacaaataccagatgagcatccacctgcgcgaggacagtagtcagacccatgtgctcatgatgaagggagcaccagaacggattctggaattctgctctacgttcctgctgaatggccaagaatactcaatgaacgatgagatgaaagaagcctttcagaacgcatatctcgaacttggtggcctcggcgaacgagtcctcggattttgtttcctcaatctgccgagttcatttagcaaagggttcccctttaataccgatgaaatcaatttcccaatggataacctctgttttgtaggcctaatttcgatgatcgaccccccaagggcagcggtgcctgacgctgtgagcaagtgcagatctgcagggataaaggtaattatggtgacaggggaccatccgatcaccgctaaggccattgctaaaggcgtgggcattatcagcgagggaaccgagacagcggaagaagtggcagctcggcttaaaatccccatttccaaggtcgacgcctccgctgccaaagcgatcgtagtgcacggtgccgaactgaaagatattcagagcaaacagcttgaccagatcctgcagaatcaccctgagattgtctttgcgcgaacttctccccagcagaagctaataattgtcgaagggtgccagcggcttggggcagttgtggctgtgactggagacggcgttaatgacagcccagcactgaagaaggccgatatcggtattgccatgggtatatccgggtccgatgtttcgaaacaagcagcagacatgattttgctggacgataattttgcctcgatcgtgaccggagtggaggagggcaggctcattttcgacaatcttaagaagtctattatgtacaccttaacgtcgaacattcctgagattactcctttcctgatgttcatcatactgggtatccctctgccgctggggaccattacaattctgtgtatcgacctcgggactgacatggtacccgctatttctctagcttatgaaagtgccgagagcgacattatgaaaaggctcccaagaaatcctaagacagataatctggtgaatcatcggctgatcgggatggcatacggtcagattggtatgattcaggctctcgcaggcttcttcacgtattttgttattctcgcagagaacgggttccgcccagtagacctgctcggaattcggctccactgggaagataaatatttgaatgacctggaggactcttatggccaacagtggacatatgaacagaggaaagtggtcgagtttacctgtcaaaccgcttttttcgttactatcgttgtggtccaatgggccgacctaattatcagtaaaactaggcgcaattccctgtttcagcagggaatgcgcaacaaggtgttaatctttgggatcctcgaggaaaccctgctggccgcttttttaagttataccccaggcatggatgtcgcgcttaggatgtatccactgaagatcacttggtggttgtgcgctattccgtacagtatacttatctttgtgtacgacgagattcgtaagctcctcatcagacaacaccctgacggctgggtggaaagggagacttattactag

SEQ ID NO: 215324 - DNA, 498 bp, Artificial Sequence
  Description of Artificial Sequence: Synthetic coding sequence
atgatccaggctctggctggatttttcacatattttgtgatcctggcggaaaacggctttagacccgtcgacttactaggcatacgtctgcattgggaggataaatacctcaacgacctcgaggacagttatggccagcagtggacctatgaacaacgcaaagtcgtggagtttacctgccaaaccgctttttttgtgaccatcgtggtggttcagtgggcggatcttattatctccaagacaagaagaaactccctcttccagcaggggatgcggaataaagtgttgattttcggaatcttggaggaaactcttctggccgcattcctctcatatacccccggtatggacgtcgccctgagaatgtaccccctaaagattacctggtggctttgtgcgattccttacagtatacttatattcgtgtacgatgaaatccgcaagctgctaattaggcagcacccggatgggtgggtagagagagagacttactactag

SEQ ID NO: 215325 - DNA, 888 bp, Artificial Sequence
  Description of Artificial Sequence: Synthetic coding sequence
atggggaagaggaagtgttcaccagcatcacagtccctttttctcttccagtttcagaagatggagctgaaatttaagattctccttttctacgtcattttctatggctgcctggcaggtatttttattgggacgattcaagtcatgttactcactatttctgaattcaagcccacatatcaggaccgggttgcccctcctgggttgacccagatccctcaaatccagaaaaccgagatcagctttaggccaaatgacccaaagagctatgaggcttatgtgcttaatatcgtgcgtttcctggagaagtataaagactctgcacagcgggatgatatgatcttcgaagactgtggggatgtgccgtccgaacccaaggaacggggagattttaatcatgagagaggggaacgaaaggtgtgccggtttaagctcgagtggttgggcaactgctcaggcctcaatgatgagacatatggttataaggagggtaagccttgtattatcataaagctgaatagagtgctgggcttcaagcctaaaccacccaaaaacgagtccctggagacatatccggtgatgaagtataatcctaacgtacttcctgtccagtgcaccgggaagagggatgaagacaaagacaaggtcggtaacgttgagtatttcggcctgggaaattcaccaggcttcccgctgcagtactacccttattacggaaaacttcttcagccaaaatatctgcagcctctgctggcggttcaattcactaacctgacaatggacaccgagattagaatcgagtgcaaagcctatggagagaacataggctacagtgaaaaggatcggtttcagggtagatttgatgtgaaaatcgaagtgaagagttag

SEQ ID NO: 215326 - DNA, 912 bp, Artificial Sequence
  Description of Artificial Sequence: Synthetic coding sequence
atggctagagggaaggccaaggaggaagggtcatggaagaagtttatatggaactcggaaaagaaagaattcctgggccgaactggcggaagctggttcaaaattttgctgttctacgtgattttttacggttgcttggccggaatatttatcgggacaatccaggtcatgcttctgaccatctctgagttcaagcctacataccaggatagggtggcccctccaggacttacccagataccgcaaattcagaagacagagattagttttaggccaaatgaccctaagtcctacgaagcctacgtgctgaacatcgtcaggtttctggaaaagtacaaggactccgcacaaagagacgacatgattttcgaggactgcggagatgtgccatccgaacctaaagagcgcggagacttcaaccacgaacggggagaacgcaaggtgtgcagattcaaactggagtggctaggaaattgcagcggactgaacgatgagacgtatggttataaggagggcaagccatgcattataattaaactgaaccgggttctgggcttcaagccaaaaccacctaagaatgaatccctggaaacatatcccgtgatgaagtacaaccctaatgtgctccctgtccagtgcacaggaaaacgagacgaggataaggataaggtggggaatgttgagtatttcggactcgggaatagtcccggattcccgctgcagtattatccttactatggaaagttactccagcctaaatacttacaacctctgctggctgtgcaatttacaaaccttactatggatacggaaatacgaattgaatgcaaggcatatggcgagaatattggatactccgagaaagacagatttcagggtagattcgatgtgaagatcgaagtcaagagctag

SEQ ID NO: 215327 - DNA, 912 bp, Artificial Sequence
  Description of Artificial Sequence: Synthetic coding sequence
atggcacggggaaaagcgaaggaagaaggctcgtggaagaagttcatctggaactcagagaagaaggagttcttaggcaggaccggagggtcctggtttaagatcctgctcttctatgtgatcttttatggctgcttagccggaatttttattggcaccattcaggttatgctcctgacaatctctgaatttaaacccacctatcaggatagggtggccccaccagggttgacacagatccctcagatccagaagactgagatttcattccgacccaacgatcccaagtcatatgaggcctatgtactgaatattgtaaggttcctagaaaagtacaaagatagtgcgcaacgcgatgacatgatttttgaggactgtggagacgtgccttctgagccaaaggagcgtggtgactttaaccacgaaaggggcgagaggaaggtttgcaggttcaaactagagtggctaggaaattgtagcggtctcaatgacgaaacatatggctataaagagggcaagccatgcatcattatcaagctcaatagagttctggggtttaaaccaaaacccccaaaaaatgaatcattggagacttaccctgtcatgaagtataatcctaatgtccttccagtccaatgtactggcaagagagacgaggataaagacaaggtcggaaatgtggaatactttggacttggaaacagtcctggatttcctcttcagtactacccctactacgggaagctcctgcagcctaaatacttgcagccactgttggcggtccagttcacgaatctgacaatggacacggagatccgcatagagtgcaaggcatatggagaaaatattggatattcagaaaaagacagatttcagggccgtttcgatgtaaaaattgaagtgaagagttag

SEQ ID NO: 215328 - DNA, 744 bp, Artificial Sequence
  Description of Artificial Sequence: Synthetic coding sequence
atgcttctgacaatctcagagttcaagcccacctaccaggaccgcgtcgctccacctggtctgacgcagatacctcagattcagaaaaccgaaatttcgtttcggcctaacgacccaaagtcatatgaagcttatgtcttgaacatcgtgaggtttttggaaaagtacaaagactccgctcagagagatgatatgattttcgaggattgcggagacgtgccaagcgaacccaaagaacgtggcgattttaaccatgagcgcggtgagagaaaggtgtgtcgatttaagctggagtggttaggcaactgttctggtctcaacgacgaaacatacgggtataaagaagggaagccctgtatcattatcaagcttaatagggtccttgggttcaaaccgaaaccaccaaaaaatgagtcgctggaaacttaccccgtcatgaagtacaaccctaacgttttacccgtgcaatgcacagggaaaagggacgaagataaggacaaggtgggcaacgttgagtactttggattaggaaatagccccggtttccctctccaatactacccttattatggaaagttactgcagccaaagtatctccagcccctgttggccgtgcagttcaccaatttgacaatggacacagagatcaggatcgagtgcaaagcctatggtgaaaacatcgggtattccgagaaggacagatttcaaggtcgctttgacgttaagatcgaagtgaagagttag

SEQ ID NO: 215329 - DNA, 873 bp, Artificial Sequence
  Description of Artificial Sequence: Synthetic coding sequence
atggtaatccagaaagagaaaaagagttgtggccaagtcgtggaagagtggaaagagttcgtttggaatccaagaacccaccaattcatgggtaggaccgggacttcttgggcattcatcctgctcttttatctagtcttttatggattcctgactgcaatgtttaccctaactatgtgggtgatgctccagacagtgtctgatcacacgcccaaataccaggacaggctcgcaacccctggtctgatgattcggccaaagacagaaaacctcgacgtaatcgtcaatgtatcggatacagagagctgggaccaacacgtgcagaaactgaataagtttctagaaccttacaatgacagtatacaagcccaaaaaaacgacgtctgcagaccaggcagatattatgaacaacctgacaacggcgtcctgaattaccccaagcgagcatgccagtttaaccgaacacagctgggtaattgttccggcattggcgactcaacacactacggctatagcaccggccaaccgtgtgtttttatcaaaatgaacagggttatcaacttctacgcaggcgctaatcagtctatgaacgtgacctgcgccggtaagcgggacgaggacgccgagaatctggggaattttgtgatgtttcccgcaaacgggaacatcgatctcatgtactttccatactatggcaagaagtttcatgtgaactatacgcagcccctggtcgcagtgaagtttctgaatgtgacaccgaatgttgaggtgaatgtcgagtgtaggataaatgctgccaatattgctaccgatgacgaaagggataagttcgccggaagagtcgccttcaagctgcgcattaacaaaacatag

SEQ ID NO: 215330 - DNA, 840 bp, Artificial Sequence
  Description of Artificial Sequence: Synthetic coding sequence
atgacgaaaaacgaaaaaaaatctctgaaccagtccttagcagagtggaagctcttcatttataaccccacaacaggggaatttctgggccgtacagccaaaagctggggtttaatcctcctgttttatcttgtgttctatggctttctggccgctcttttttcatttacaatgtgggtaatgctacagactctgaatgatgaagtgccgaaatatagggatcagattcccagcccaggattgatggtgtttcctaagcctgttacagctctggaatacaccttcagccgcagcgacccaacctcctacgctgggtatatagaggacttaaaaaagttcctcaaaccctacacacttgaagagcagaagaacctgaccgtgtgccccgacggcgcactattcgaacaaaaaggaccagtatacgttgcttgtcagtttcccatctccctcttgcaggcttgtagtggaatgaacgacccggattttggatattcccagggtaacccttgtatcctggtgaaaatgaaccggataatcggacttaaacctgaaggagtgcccaggattgactgtgtgtccaagaacgaggatatccctaatgtcgctgtttatcctcacaacggaatgatcgatctgaagtactttccctattacggcaaaaaactgcacgttggctaccttcagccgctcgttgccgttcaggtgtctttcgcgcctaacaacaccgggaaggaagtgactgtcgagtgcaagatcgatggttctgcaaaccttaaatcccaggacgaccgcgataagttcctcggacgcgtgatgttcaaaatcacagcccgtgcttag

SEQ ID NO: 215331 - DNA, 582 bp, Artificial Sequence
  Description of Artificial Sequence: Synthetic coding sequence
atgttgagtgaaggcgatatcctatttagctctctactgagcagtccatctcttttctggcctcccggtctgatcttattgttttatctagttttctacgggtttctggcagctcttttcagctttaccatgtgggtcatgctacagacattgaatgacgaagtcccaaaataccgagatcagattccatctcctggcctgatggtgtttccaaaacccgtgactgctttggaatacacattttccagatcagatcccacttcttacgccggatacatcgaggatctcaagaaattcttgaagccttacaccctggaggagcaaaagaatctcaccgtgtgccccgacggtgcactcttcgaacagaaggggcctgtgtatgtggcgtgccaattcccgatcagcctgctgcaggcctgttcaggcatgaatgatcccgacttcggatatagccagggaaatccttgcattttagtaaaaatgaaccggatcatcgggctgaagccagaaggggtgccaagaatcgactgcgtttcgaagacgaataatgtcaaggatgggatgaaaatttatcagatgtag

SEQ ID NO: 215332 - DNA, 2139 bp, Artificial Sequence
  Description of Artificial Sequence: Synthetic coding sequence
atggccctgctcgcaatgcacagttggcgctgggctgctgccgctgcagcatttgagaaaaggcggcatagcgccatcttgattagacccttagttagcgtttctggcagtgggccacagtggcgccctcaccagcttggggctctagggaccgctcgggcatatcagattcccgagtccctgaagtctatcacatggcagaggctgggtaagggaaacagcgggcagttcctggacgctgcaaaggcccttcaggtttggcccttgatcgaaaagcgaacatgttggcacgggcatgcgggtggaggtctgcacactgaccccaaggagggcgcaatgaacatcgtcgtgccattcatgttcaaatatgccgtggattcactgaatcaaatgtcgggcaatatgctcaatctgtcggatgcgcctaacactgtggcgacgatggccactgcggttctgataggttatggagttagccgcgctggggctgccttctttaacgaggtacgtaacgcggtgtttgggaaggttgcccagaattccattcggagaattgcgaagaatgtttttctgcacctgcacaatctcgatttaggcttccacctgagtagacagacaggggctctgagtaaggcaattgatcgcggaacccggggaatcagtttcgtgctgagcgccttggtcttcaatctgctgcctatcatgtttgaagttatgctagtttccggagttctgtattataaatgcggcgctcagttcgctctggttaccttaggcacactcggaacgtacactgcattcacggtggcagtgacaaggtggagaacgagatttcgaattgaaatgaacaaggcagataatgacgccggaaacgccgcaattgattccttgctgaactacgaaaccgtgaagtatttcaacaacgagagatatgaggcgcagcgctacgacgggtttctaaagacttatgagactgcctctctgaaatctacaagcacactcgccatgctgaatttcggacagtcagctattttctcagttggtctcactgcaatcatggtcctggcaagccaggggatagtggcgggaaccctgactgttggagacttggtaatggttaacggacttttgttccagctgagcttgccccttaactttttaggcactgtgtatcgggagactagacaggccctgatcgacatgaacactttgtttactctgctaaaagtcgacacccagatcaaggataaggtcatggcgagtcccctgcagattactccgcaaactgcgactgtggcttttgacaatgtgcattttgaatatattgagggacagaaagttttgtctggcattagctttgaagtgcctgcagggaagaaggtggcaattgtgggcggttcaggaagtggaaaatctacgatcgtgagattactgttcagattctacgagccgcaaaagggctctatttatctcgccggtcagaatattcaggacgtatccttggaatctcttaggcgtgccgtaggagtggtcccgcaggacgctgtgctctttcacaacacaatctactacaatctgttgtacgggaatataagcgcaagtcctgaggaagtgtacgctgtggccaagttggcaggcctgcacgacgctattcttaggatgcctcacggctacgacacacaggtgggcgaacggggattgaaacttagcggtggtgagaaacagcgggtggctatcgcacgggctattctaaaggaccctcccgtgatcctgtatgacgaagcaacgagctctctggacagtattactgaggagacgatcctgggagcaatgaaggatgtggttaagcaccggacctctatttttatcgcccatcggctctccaccgtagtggacgcggacgagattatcgtgctggaccagggcaaagtagctgagcggggaacccaccacgggctattggctaacccacactccatctatagcgagatgtggcacactcagtccagcagggtgcagaaccacgataaccccaagtgggaagctaagaaggagaatatctctaaggaagaggagcggaagaaactgcaggaggagatagtgaactccgtgaagggttgcggcaattgcagttgttag

SEQ ID NO: 215333 - DNA, 2046 bp, Artificial Sequence
  Description of Artificial Sequence: Synthetic coding sequence
atgcgcctatggaaagcagtagtcgttactctggcatttatgagcgtggacatctgcgtgaccacagccatttacgtcttttcgcacctcgatcgctccctgctcgaggatattcggcattttaacatattcgatagcgtgttggatctgtgggccgcatgtctgtatcggagttgtctgcttctgggtgctaccataggcgtggctaaaaatagtgccttgggtcccaggcggctccgcgctagttggttagtaattacattggtctgcctgtttgtgggcatctatgcgatggtcaaactactgctgttctcagaagttcgcaggccaataagggacccttggttctgggccctcttcgtgtggacatatatctccctgggagcctccttcctcctctggtggttgctgtcgaccgtgaggcctggcacccaggcactggaacccggagctgccacagaagctgagggcttccccggttctggtagaccgcctccagaacaggcctccggggctacgctgcagaaactgttatcttatacaaagccagatgtggcttttcttgtcgcagcttcattcttcctgattgtggccgctctgggcgagacatttctgccttactataccggccgtgctatcgatgggattgtgatccagaagtcgatggaccagttttcaactgccgtcgtgatcgtgtgtctcctggcaatcgggtccagcttcgcggctgggatccggggtggtattttcaccctgatttttgctagactgaacattagactccgcaactgcctgtttagaagtctggtttcacaagagacatccttttttgacgaaaatcgcacgggtgatctcatctccagactaacatccgataccaccatggtcagtgatttggtgtcccaaaatataaacgtgtttctccggaataccgtgaaggtcacgggcgttgtagtgtttatgttctccttaagctggcagcttagtctggtcaccttcatgggtttccctataattatgatggtgtccaacatatacggcaagtattacaagagactgtccaaggaagtgcagaacgccctcgccagagcttctaatacggccgaggaaacgatttctgcaatgaagacagtgcggagcttcgctaatgaggaggaagaagccgaggtgtacctgagaaagctgcaacaggtgtacaagctcaatcgcaaggaagcagcagcgtacatgtactacgtctggggcagcggactgaccctcctggtggtgcaagtgtcaatcctttattatggaggacacctggtgattagcgggcagatgaccagtggcaacctgatcgcgttcattatctatgaattcgtacttggcgactgtatggaatctgtcggctctgtgtactctggactgatgcaaggcgtcggtgccgcagaaaaggtgtttgagtttatcgaccgccagccaactatggtgcacgacggctctcttgcacccgaccacctcgagggcagggtggatttcgagaatgtgacttttacgtaccggacaagacctcacactcaggttctgcagaacgtctcctttagtctcagtcccggaaaggtgaccgctttagtcgggccaagcggttcgggcaagtcttcttgcgtcaacatcttggagaatttctaccccctagagggcggtagagtcctgctggacggtaagcccatttccgcatacgatcacaagtatctgcaccgcgtcataagtttagtcagccaagagcccgtgctatttgctagatcaattacagataatatctcatacgggcttcccactgttcctttcgaaatggtcgtcgaggctgcacaaaaggccaacgctcacggctttatcatggagctgcaggacggctattcgaccgagaccggtgaaaagggtgcgcagctctccggtggccagaagcagcgggttgctatggcccgtgcccttgtaaggaatcctcccgtgcttatactggatgaagcaacaagcgcccttgatgctgagagcgagtacctcatatag

SEQ ID NO: 215334 - DNA, 2052 bp, Artificial Sequence
  Description of Artificial Sequence: Synthetic coding sequence
atgcggctttggaaagccgtcgtggttaccctagcctttatgtctgtggacatatgcgtcactacagccatatacgtgttctcccacctagataggagtctgctcgaagatattcgtcactttaatatctttgattcggtgcttgacctgtgggctgcctgtctgtaccggagctgcctcttgcttggggctaccattggcgtggccaagaactctgccttaggtcctagaagactccgggctagttggctcgtgattacactggtgtgtctatttgtgggcatatacgccatggtcaaactgttgctgttcagcgaagtgaggaggcctatcagggacccctggttttgggctttgtttgtgtggacctacatttccctcggcgcatcttttctgctatggtggctgctgtcgacggtgagacctggaacccaggcccttgaaccgggagctgctaccgaggctgaaggattccctggatccgggagaccacctccagagcaggcaagcggggctacattgcagaagctgctatcctataccaagccagatgtcgcattcctggtcgccgctagctttttcctgatcgttgctgccctcggcgaaacattcttgccctattacacaggccgtgccatagacggaattgtgattcagaagagtatggatcaatttagcaccgcagttgtgattgtttgccttctggccattggttccagttttgctgccggaattcgcggaggtatctttacactgatcttcgcccgtctgaacatcagacttcggaattgcctgtttcgaagcctggtgagccaggaaacttccttctttgatgagaaccggacgggtgatctgatttcacgcctgacctccgatactacgatggtgagcgacctggtttcccagaatattaatgttttcctgagaaacacagtgaaggtgaccggcgtggtcgttttcatgttctctttatcatggcagctgagtctggtaacctttatgggttttcccattattatgatggtgagcaatatttatggaaaatactacaagcgcttatccaaagaggtacaaaacgcgctggcacgcgcttcaaacactgccgaagagaccattagtgccatgaaaacagtgagatccttcgcaaatgaagaagaggaggccgaagtgtacctccgaaagctccagcaagtgtataagttgaatcgcaaggaagccgctgcttacatgtattatgtttggggcagcgggctcacattactcgtggtccaggtgagtatcctttattatgggggacatcttgtgataagcgggcagatgaccagcggcaatttaattgcttttattatctatgagttcgtgctgggtgactgcatggagagcgtcggaagcgtttattccggtctcatgcagggcgtcggagccgcagagaaggtgttcgagtttattgaccggcagcccacaatggtgcacgacggttcccttgcaccagatcacctggaaggccgtgtagactttgagaacgtgacgtttacatatagaacacgtccccatactcaggtgctgcagaacgtgagctttagtctctcccccggaaaagtgacagccctcgtcgggccaagtggaagtggcaaatcttcctgcgtgaacatcctggagaatttctatcccctagagggcggacgcgtcctgttagacggaaaacctatttccgcttacgatcacaagtacctacatcgtgttataagcctggtgagccaggaaccggtcttgtttgcccgttcgattacggacaatattagctatgggctcccgaccgtcccatttgagatggtggtcgaggcagcccagaaagcaaacgcgcatggatttataatggaacttcaagacggatactctacagagactggggaaaagggagctcagctgtccggaggacagaaacagcgagtggcaatggccagggctctcgtgcgcaatcccccagtgcttattctcgacgaagccacttcggccctggacgccgaaagtgaatacctgtgtgccggttag

SEQ ID NO: 215335 - DNA, 300 bp, Artificial Sequence
  Description of Artificial Sequence: Synthetic coding sequence
atggccgcaccagccgaaccttgcgccggacagggcgtctggaaccaaactgaacccgaacccgctgcaacctcactgcttagcctgtgctttttaaggactgctggagtgtgggtgcctccaatgtacctgtgggtcctggggcctatttacctgctgttcatccaccaccatggaagaggatatctcagaatgagccccctgtttaaggcaaaaatggtagctgcgatcccaggtagcctagagcctggcaacgttcggggaaggcagggtacaggatggaatttggtgaaaagctag

SEQ ID NO: 215336 - DNA, 372 bp, Artificial Sequence
  Description of Artificial Sequence: Synthetic coding sequence
atgccttccgcaggaacgctgccctgggtccagggcatcatctgtaatgctaataacccctgcttccgttaccctactccaggcgaggcccctggcgtcgtgggtaatttcaacaagtcgatcgtcgccagactttttagtgacgccagacggctcctcctttactctcaaaaggacacttccatgaaggacatgcgcaaggtgctgaggaccttgcagcagatcaagaagagctcgtcaaatttaaagctgcaggattttctggtggataacgaaacattcagcgggtttctctaccacaacctctctctcccaaagtccaccgtggataagatgttgagggccgatgttatcctgcacaaggttagttag

SEQ ID NO: 215337 - DNA, 6785 bp, Artificial Sequence
  Description of Artificial Sequence: Synthetic coding sequence
atggcctgttggccccagctgaggttacttctgtggaaaaaccttaccttccggaggagacagacatgccagctactgctcgaggtcgcttggccgctgttcatcttcctcatccttattagcgtgcgactctcctaccctccatacgaacagcacgagtgccattttccgaacaaggctatgccatctgctggaaccctgccctgggtacagggaatcatctgcaatgcaaacaatccatgctttcgttaccctaccccaggcgaggctcccggtgtggtcggaaattttaacaaatcgatcgtggcacgactcttttcagacgctcggcgactgttgctatatagccagaaggacacttccatgaaggacatgaggaaggtgctgaggaccctgcagcagattaaaaaatcaagtagtaatcttaaattacaagactttcttgtggacaacgaaactttttccggattcttataccataacctgagcctgccaaaaagcacggtagataagatgctgagagctgatgtcattctccacaaggtgttcctgcaaggctaccaactccatctaacctccttatgcaatggctctaagtccgaagaaatgatccagctcggggaccaggaagtgtccgaactgtgcggcctccctcgggagaagctcgcagccgcagaacgagtcctgcgcagtaacatggacatcctcaaaccaatcctgcggacacttaactccacatctccttttccatcaaaagaacttgcggaggccactaaaaccctgttgcattctcttggcaccctcgcacaggaactcttttctatgagatcatggagcgatatgcgccaggaagtgatgttcctgacaaacgtgaactcaagctcttcaagtacgcagatttatcaggccgttagccggatcgtttgcggacaccccgagggaggtggcctgaaaattaagtccttaaattggtacgaggataataattacaaagctctgtttggagggaatggcacagaagaagacgcggagactttctacgataactcaaccacgccatattgcaacgatctgatgaaaaacctggaatctagtccccttagccggattatttggaaggccctgaagcccctgttggtcggcaaaattctctacacgcctgacacacccgctactaggcaggtgatggccgaagtcaacaaaaccttccaagaactcgccgtgtttcatgatttagagggtatgtgggaagaattgtctccgaagatctggacgttcatggagaactctcaagaaatggacctcgtgaggatgctgctggacagtagggacaacgatcatttctgggagcagcaactggacggactggactggacagctcaggacatcgttgcatttctggccaagcatccagaagatgtacaaagctcaaatggcagcgtgtatacgtggagggaagcctttaacgagactaatcaggccattcgcaccatttctcgttttatggagtgcgtgaatctgaacaaacttgaacctattgcgacagaagtttggctgataaacaagtctatggagctgctggatgagagaaaattctgggctggcatcgtcttcactggcattaccccagggtctattgagctccctcaccacgttaagtataagatacgtatggacatcgacaacgttgagagaacaaataagatcaaggacggatactgggaccctggaccaagggcggacccatttgaagatatgagatacgtgtggggaggatttgcatatttgcaggatgtcgtggagcaggctataattcgtgtgcttacgggaacggagaaaaagacaggagtctatatgcagcagatgccttacccatgctatgtcgacgatatctttctgcgcgtgatgagccgtagcatgcctctcttcatgaccctcgcttggatctatagtgtggctgtgatcatcaaagggattgtttacgaaaaagaggctcgactcaaagagaccatgcggattatgggactggataatagtatactgtggttttcgtggtttattagctcactgattcccttgctggtaagcgctggactgctggtagtgatcctgaagttgggcaatttgttaccatacagtgaccctagcgtagtgtttgtgttcctctctgtgttcgccgtagtgacgattctacaatgtttcctgatcagcactttattctctcgagctaacctggccgcagcatgcgggggtatcatttattttactctttaccttccctatgtgctgtgtgtcgcctggcaggattacgtgggatttacactgaagatcttcgcttccctcttatctccagtcgctttcgggtttggctgcgaatacttcgccctgtttgaagaacaggggattggagttcagtgggataatttgttcgagtcacccgtagaagaggacggtttcaatctcactacctctgtctctatgatgctgttcgataccttcctgtacggagtaatgacttggtacattgaggcagtgtttcctggccagtatggcatcccgaggccctggtatttcccctgtaccaaatcctactggtttggcgaagaatcggacgaaaagtcacatcccggtagcaatcaaaagcgaatttccgaaatctgcatggaggaggaacccacacatctgaaactgggtgtgtctatacagaatctggtgaaagtgtaccgtgatggaatgaaggtggcggtcgatgggctggccctcaacttttacgaaggacaaatcacaagtttcctcggccataatggggcagggaaaaccacaaccatgtccattctgaccggcctgttccctcccacgtcaggcaccgcttatatcctggggaaggacattagaagcgagatgtccaccattcgccagaacctcggtgtctgccctcagcacaatgtactctttgacatgcttaccgtggaggagcatatctggttctacgctagactgaaggggctctccgagaagcacgttaaggcggaaatggagcaaatggccctggatgtgggcctgccttcctcaaaactaaagtctaaaacatcacagctgtcgggaggcatgcagcgtaagctgagtgttgcccttgcattcgtcggcggttcgaaagtcgtgatcttagacgagcccactgcgggtgtggacccctattcccgccgagggatctgggagttacttcttaaatacagacaagggcgtacaattatcctgagcacacatcacatggacgaggcagatgttctgggcgatcgcatcgccattatcagccatgggaagctctgctgcgtagggagttccctgttcctgaagaatcagctagggacagggtactacctgactctcgtaaagaaagacgttgaaagcagtctctcatcatgccggaactcctcaagcacagtatcctacctgaagaaggaggactctgtgagccagtccagctcggatgcaggcctggggtctgatcatgagtccgataccttgaccatcgacgtcagcgctatctctaacttaattcgaaaacatgtatcagaagccaggcttgtagaggatattggacatgagttgacctacgtcttgccctatgaagcagccaaggagggcgcttttgtagagcttttccacgagatcgacgaccgcctctctgacttagggataagcagttatggcatctcagagaccactctcgaggaaatttttttgaaggtagctgaggagtcaggggtggatgccgaaacttccgatggaacccttccagcaagacggaatagacgcgcttttggggataaacagagttgtctgcggcctttcacagaagacgacgccgcagaccctaacgatagtgatatcgatcctgaaagtcgggaaaccgatctcctgagcggaatggatgggaagggttcataccaggtgaagggatggaaactgacacagcagcagttcgttgccctgctatggaaacgtcttctgattgccagacgcagccgcaaggggtttttcgcccagattgtgctgcccgctgtattcgtttgtattgccctggtgttttcacttatagtgcccccttttggcaagtacccttcactggaactgcaaccctggatgtacaatgagcagtacacattcgtttccaatgatgcaccggaagacaccggcactcttgagcttctcaacgccctcacgaaggatcctggatttggcactagatgcatggagggcaatcctatcccagacaccccatgtcaggcaggggaggaagaatggacaacggcacccgtcccccaaacaatcatggacctgttccagaatggcaattggaccatgcagaacccatcccctgcgtgtcaatgcagctctgacaagattaagaagatgttacccgtatgccctcccggagccggagggctgccacccccacagcggaaacaaaacaccgcagatatcctacaggatctgaccggcaggaatatcagcgattatcttgttaaaacttatgtccaaattattgccaaatcgctcaagaacaaaatttgggtgaatgagtttagatatggcggtttctcgctcggcgtgagtaacacacaggctttacccccttcccaggaggtgaacgacgctatcaagcagatgaagaagcatctgaaattggctaaagattcatcagccgaccggtttctaaattctctgggacggttcatgaccggtcttgacaccaagaacaacgttaaagtctggtttaacaataaaggttggcatgccatatctagctttttgaacgtgataaataatgcaattctaagagccaatctccagaagggcgaaaatccatctcactacggcatcaccgcctttaatcatcccttaaatcttacgaagcaacagttatcagaggtcgcacttatgaccacgtccgtggacgtactagtttcaatctgtgtgatcttcgctatgtctttcgttcctgcttcatttgtggtgtttctgattcaagagcgcgtgagcaaagcaaaacacctgcaattcatcagtggcgtgaagcctgtgatctactggctcagcaattttgtgtgggacatgtgtaattatgtggtgcccgcaacacttgtcatcattattttcatttgcttccagcagaaatcgtatgtaagctccacaaacttgccagtacttgctctactcctgctcctctatgggtggtccattacccccctgatgtatcccgcttctttcgtgtttaaaataccctcaacagcgtacgtagtactcacaagcgttaaccttttcataggtattaacgggtccgtcgccacctttgttctcgagttattcactgacaataagctgaataatattaatgatattctcaagagtgtgttcctcatctttccacacttttgtctaggcagaggtctgatcgacatggtgaagaaccaggcaatggcggacgcactcgaaagattcggcgaaaatcgttttgtctccccattatcttgggacctggttggaagaaatcttttcgcaatggccgtggaaggcgttgttttttttctgatcacagtcctgatccagtaccgcttctttattcggcctcgcccagtgaacgcaaagctgagcccactgaacgacgaggacgaagatgtgcgcagggaacgccaacgcattctggatggtggcggacagaatgatattttggagattaaggaactgactaagatctaccggaggaagcgaaagcccgcagtagatcggatttgcgtgggaatcccacctggggagtgctttggtctcttgggagtgaatggagctggaaagagttctacctttaagatgctgaccggagacacaacggtgacaagaggtgacgccttcctcaacaaaaactcaatcctctcaaacatccacgaggtacatcagaacatgggctattgcccccagtttgacgccatcacagagctgctcacagggagggaacatgtggaattctttgctttgctaaggggtgtgcctgagaaggaggtaggcaaagtcggcgagtgggcgatcagaaagctcggcttggtgaagtacggagaaaagtacgccggaaactacagcgggggtaacaaaagaaaattgtctaccgccatggcccttataggaggaccgcctgttgtcttcctcgatgaaccaaccacggggatggaccctaaagcaaggcgatttctatggaattgtgctctgagtgtcgtgaaagaaggcagaagcgtcgtgctgacgtcccattccatggaggaatgcgaggcactttgcacccgcatggccatcatggtgaatggcagatttaggtgcctagggtcagttcagcatctgaagaacaggttcggagacggctatactattgtggtaagaattgcaggttccaaccccgatctcaagccagtgcaggattttttcggcttggcctttcctggctcagtgctgaaggagaagcacagaaatatgttgcaatatcaactgccaagcagcctgtccagtctggcaaggatcttctctattctgagccagtcaaagaagagacttcacattgaggactattctgtctcccagacgacgctggaccaggtgtttgtcaacttcgcaaaggatcagtctgacgacgaccatttgaaagatctcagtctacacaagaatcaaacagtcgtggacgtcgccgtgctcacatctttccttcaggacgagaaggttaaagagagctatgtcta

SEQ ID NO: 215338 - DNA, 1092 bp, Artificial Sequence
  Description of Artificial Sequence: Synthetic coding sequence
atggcatgttggcctcagctccgccttctattatggaagaacctgaccttcaggcgtagacagacttgccagctgttgctggaagtagcatggcccctgtttatctttctcatactgatcagcgttagactgtcttaccctccctatgagcagcatgaatgccattttcctaacaaagccatgccctcagctggcacgctcccttgggtgcagggaatcatttgcaatgctaacaacccgtgctttagatatcctacccctggcgaggccccaggagtcgtgggcaattttaacaaatctattgtggctagactcttttccgacgccaggagactgctcctgtattctcagaaggacaccagtatgaaagatatgagaaaggtgttgcgaacgctgcagcaaattaaaaaaagctcctcaaatctgaagttacaggattttctggttgataatgagaccttctctgggtttctgtatcacaacctgtctctcccgaaatcaactgtggacaagatgctgagagccgacgtgattttacacaaggtgtttctacaaggatatcagctgcatttaactagtctctgtaacggaagcaaatctgaggagatgatccagctcggagaccaagaagtaagtgagctgtgcgggctgcctcgggagaagctcgcggcagctgaaagagtgctgcggagtaacatggacattctgaaaccaatcctcatggatgtcacctgtgatgatatcgcacacggccagttgactgttcctaggtctgctgctgttgccgctacaggcgacgccaagccgaacatgatgggacgggagaccctcttgtcgatatgtgccagcgtccccaaggttgagtttcacgagagacatattcttaagcacttctccttttgcgtttgcgtcagcgtgtcactctttcctgcaaagggtatagtgtccttcagctgggcctcttttcggatctgggtgctgtggaaagccgtgttttggcagcacggggagagcatggcggtctgggagggacaactcggtctggggctgaatatagcgttcgagtattttacatcaatcgatgtcgggtag

SEQ ID NO: 215339 - DNA, 4632 bp, Artificial Sequence
  Description of Artificial Sequence: Synthetic coding sequence
atgaataaaatggccctcgccagcttcatgaaaggacggaccgtgataggcacccccgacgaggagaccatggacattgaattgccaaaaaagtatcacgagatggtcggggtcatcttctctgacacattctcctaccgattgaagttcaactggggatatcgcatcccagtgatcaaggagcattcagagtataccgagcactgctgggccatgcacggagagatcttttgctaccttgctaagtattggctgaagggctttgtggctttccaggcagccatcaatgccgcaattattgaggtaacaacaaaccattccgtgatggaagagctcacctccgtcatcggcatcaacatgaagatcccacctttcatctccaagggtgagatcatgaatgaatggttccactttacctgtttggtctcttttagctctttcatctattttgcgtcgcttaacgtagctagggaacgaggcaagtttaagaagttgatgacagttatgggactcagagagtctgccttttggctgtcttggggtctgacgtatatctgtttcatcttcattatgtcaatttttatggccctggtgatcacttccatcccaatcgtgttccatacgggctttatggtgatattcaccctctacagtttatatggcctgagcctgatagccctcgctttcctcatgagtgtgctgatcagaaaacccatgctggccggacttgcgggttttcttttcaccgtcttttggggctgtctcggatttacagtcctctacagacagttgcctttaagcctggggtgggtgctttccttactcagtccatttgcctttacagcgggtatggcacaaatcacccacctcgataactacttgtcaggagtcatcttccccgatccctcgggggacagctataagatgatcgccactttcttcattctcgcctttgatacactattctatctgatttttactctttattttgaacgtgttctgcccgataaggatgggcatggggattctccacttttctttctcaaatcctctttctggtctaaacaccagaacacccaccatgagattttcgagaacgaaatcaatcctgagcattcaagtgatgacagttttgagccagtgtcccccgagtttcacggcaaggaggccatccggattcggaatgtgatcaaagaatataatggaaaaacgggaaaagtggaggctctacagggcatcttcttcgacatttacgaaggtcagatcactgctatcttgggccataatggggcaggaaagtctaccctgctaaacatattaagcggcctgtcagtaagcacagaagggtctgccactatatacaatacgcaactctccgagatcacagatatggaggagatccggaagaacatcggtttctgtccccagtttaactttcaattcgatttcctgaccgtccgggaaaacttacgcgttttcgccaaaatcaaggggattcaaccaaaagaagtggagcaggaggtgaaacggatcataatggaattagatatgcaatctatacaggacattatcgctaaaaagctctcaggcggacagaaaagaaaactaactctcgggatagccatcttaggagaccctcaggtactcctgttagatgagcctaccgccggattggatcctttttctcgtcaccgtgtgtggtccctgctgaaggagcacaaggttgacaggcttattctgtttagtacccagtttatggatgaagcagatatactggcggaccggaaggttttccttagcaatggaaaacttaaatgtgccggaagcagtctgtttctcaaacgaaagtggggtattggctatcacctgagcctgcacagaaacgaaatgtgcgataccgaaaaaataacatctctcatcaagcagcacatcccagacgctaagctgacgacggaaagcgaggaaaaactggtctacagccttcccctggaaaagacaaataagttccctgatctgtacagtgacctcgataagtgcagcgaccaggggatccgtaactacgccgtcagtgttacttcactcaatgaggtgttcttgaacttagagggcaagagtgcgattgacgaacccgacttcgatataggcaagcaggaaaaaatccatgtgacacgcaatacaggcgatgagtctgagatggaacaggttctgtgctccctgcccgagacacgcaaagccgtctcatctgccgctctgtggcgcagacaaatttatgctgtcgcaactctgcggttcctgaaactcaggagggagaggagagctctgctgtgtctgctgctagtactcggtatagcctttattccgattattcttgagaaaattatgtataaagtcaccagggaaacacactgttgggagttctccccctctatgtatttcctgagcctggaacagatacccaagactccactgacatcactactcattgttaacaacacaggctccaatatcgaagacctggtgcactccttgaaatgtcaggacatcgttctggagatcgatgatttccgcaataggaacggaagcgatgacccttcatataatggagctatcatagtgtccggagatcaaaaggactacaggttcagcgtggcctgcaacaccaaaaaactgaactgtttcccagtgctgatgggcattgtgtctaacgctctcatgggcatcttcaactttaccgaacttatccaaatggagtcaacttcattttcccgcgacgatatcgtcctcgatctgggcttcatagacggcagtatctttctcctgcttataacaaactgcgtatccccatttattggaatgtcctcaatctctgactataagaaaaatgtgcaatctcaactgtggatctcaggtctatggcccagcgcctattggtgcggtcaagccctggttgacattcctttgtatttcctcatcctgttcagtatccacttgatttattattttatatttctgggattccaactgtcatgggagctcatgttcgtcttagttgtttgcatcattggatgtgctgtttctctcattttcttgacttatgttttgagttttattttcaggaaatggaggaaaaacaatggattttggagctttggcttttttatcattctgatctgtgtctctacgatcatggtgtcaacacaatacgaaaagcttaacctgatcctgtgcatgatattcattcctagcttcaccctgctgggatatgttatgttgctcatacagctggactttatgcgcaacctcgactcactggataaccggatcaatgaggtaaacaagaccattctgctcactacacttattccgtacttgcagagtgtcatttttctgttcgttattcgctgtttagaaatgaaatatggaaatgaaattatgaataaggacccggtgttcaggatctcccctagaagtagggagacgcacccgaaccctgaagaacccgaggaggaagacgaggacgtgcaggcagaaagggtgcaggctgcgaacgctctgaccgcaccgaaccttgaggaagagcccgttataactgctagttgtctgcacaaggaatactatgagacaaagaagagctgcttctctactcgcaagaaaaagatcgctatcaggaatgtgagcttttgtgtgaagaagggcgaagtcctgggcctcctaggacataatggagcaggcaagtccaccagcatcaagatgatcacaggatgtacaaagcctacggccggtgtcgtggtgttgcaaggttcacgggcttccgtgaggcagcaacacgataactccttgaagttcctcgggtattgccctcaggagaacagcctatggccgaaactgactatgaaggaacaccttgaactctatgcggctgtcaaaggcctcggtaaagaggatgcagcgctctcaataagcagacttgttgaggctctgaagttgcaggagcagttgaaggcgcctgtgaaaactctctcggaaggcattaagcgaaaactctgtttcgtcctcagcatcctagggaatccgtccgtggtgctcctcgatgaaccattcactggaatggatccggagggccaacagcagatgtggcagattctccaggcgactgtcaagaacaaggagcgcggaactctgctcacaacccactatatgagtgaagccgaggcggtgtgcgatcgaatggcaatgatggtgtcagggacactccgctgcatcggttcaatccagcacctcaagaataagttcggcagagactacctgctggagattaagatgaaagaaccaacccaggtggaggctctccacaccgagattttaaaacttttcccgcaggctgcctggcaggagcggtattctagcctgatggcctacaagctgcctgtggaggatgtgcacccattgtcacgcgctttctttaaactggaggctatgaagcagacttttaatttggaagagtacagcctgagccaagctacactagagcaggtcttcttagagctctgtaaagagcaagagctgggaaacgtggacgataagattgacactactgttgagtggaagctgctcccgcaagaggacccttag

SEQ ID NO: 215340 - DNA, 1401 bp, Artificial Sequence
  Description of Artificial Sequence: Synthetic coding sequence
atgaacaagatggccctggcaagcttcatgaaaggacgaaccgttatcgggaccccagacgaagagaccatggacattgaactgcctaaaaagtaccatgaaatggtgggcgtaattttttcagatacattctcctatcgcctgaagtttaattgggggtacagaatccctgttatcaaggagcatagtgaatatacagaacattgctgggcaatgcacggcgaaattttctgctaccttgcaaagtactggcttaaaggctttgtggcctttcaggccgcaatcaatgctgcgatcatagaagtgacaaccaatcattctgtcatggaggagctgactagcgtgattggcatcaatatgaagattcctccctttatcagcaaaggcgagatcatgaatgagtggttccatttcacgtgcctggtcagcttttccagctttatatatttcgctagtctgaacgtcgctagggagagaggcaaatttaaaaagctgatgacagtgatggggttgcgcgaaagtgccttttggctctcatggggactgacttatatttgttttatatttatcatgtctatctttatggcattagtcattacctcaataccaatagtatttcacaccgggttcatggttatatttaccctctattccctttacggattgagtctcattgcgctggccttcttaatgtctgtcctgataagaaaacccatgctggccggactcgctggctttctcttcaccgtcttctggggctgcttgggtttcacagtgctgtacaggcagttgccactatcgctgggctgggtactgtccctcctatccccttttgcctttacagctggaatggcccaaatcactcacttagataattacctcagcggcgtgatcttccctgatccctccggagactcttataagatgattgccaccttctttattttggcatttgatacactgttttatctgatatttactctctactttgagcgcgttttgccagacaaagatggccatggcgatagtccacttttcttccttaagtcctcattctggtcaaaacatcaaaacactcaccatgagatatttgagaatgagatcaatcctgaacactcaagtgatgacagctttgaacctgtgtcccctgaatttcatggaaaggaggccattaggatcaggaatgttataaaagagtataacggcaagacgggtaaagtggaggctctacagggcattttctttgatatttacgaagggcagatcacggcaatactcggtcacaacggggcaggcaagtctactctcctcaacatactctcggggctgtctgtctccactgaggggaagaaaaattataatggtatccgtcacgccaaacactctaggcactactgctag

SEQ ID NO: 215341 - DNA, 279 bp, Artificial Sequence
  Description of Artificial Sequence: Synthetic coding sequence
atgaataaaatggcgctcgcaagcttcatgaagggcagaaccgtgatcggtactcccgatgaagaaactatggacatcgagctgcccaagaaatatcacgagatggtgggcgtgatcttttctgatactttttcctaccgcctgaaattcaattggggttataggatccctgttataaaagaacactccgaatacaccggtcacaacaaatctttctgtaatgggggagttgacatcagttattggaataaatacgaagatacaacctttcatttctag

SEQ ID NO: 215342 - DNA, 1359 bp, Artificial Sequence
  Description of Artificial Sequence: Synthetic coding sequence
atgaacaaaatggccctcgcctcatttatgaaggggaggactgtcattggtacccccgacgaggagactatggacattgagttgccaaaaaagtaccacgagatggttggagttatattctccgacaccttttcctatcgactcaagtttaattgggggtacaggatcccagtcattaaggaacattcagaatataccgagcactgttgggccatgcatggagaaatcttttgctatctggccaaatactggctaaaggggtttgtagcgttccaagccgctattaacgccgcaatcatcgaggtaacgaccaaccactccgtgatggaggagttaaccagcgtgatcgggatcaacatgaaaatcccacctttcatatcaaaaggtgaaattatgaacgagtggttccactttacttgcttggtgtcctttagctcattcatctactttgcctcgctgaatgtggcacgagaacgcggaaaattcaaaaagttaatgacagtgatgggcctgcgcgagtcggcattttggctgtcctggggcctgacgtatatctgttttatctttattatgtccattttcatggccttagtcatcacaagcatccccattgtgttccataccggcttcatggtcatcttcactctgtattccctctatggcctttctttgatagcattggccttcctgatgtccgtcttgatacgaaaaccaatgctagcaggtcttgctggatttctcttcacggttttctgggggtgtctgggatttaccgtgctgtacagacagcttccattgtctctggggtgggtactaagtctgctgagtccttttgcattcacagctggcatggcacaaattactcacctggataactatcttagcggggtgattttccccgatcccagcggagattcctacaagatgattgccacatttttcatcctggccttcgatacccttttctacctcatctttaccttgtacttcgaacgggttcttccggacaaggacggccacggcgacagcccactgtttttcttgaaatcaagtttttggtccaaacatcaaaatacccaccacgaaatcttcgagaacgaaatcaacccagaacattcctcagacgactccttcgagcctgtctccccagaatttcatggcaaggaggccattcggattcgaaatgtcatcaaagagtataacggaaagacaggaaaagttgaagcccttcagggctctgaagaacgattgtgccctgccgctcacaggctgcggtgtggtgaacggctgtgcccagcagctcatcacttaggttgcgaggagaggccctgtccggctgcaactccttcaggcaattag

SEQ ID NO: 215343 - DNA, 7788 bp, Artificial Sequence
  Description of Artificial Sequence: Synthetic coding sequence
atggccagccttttccaccaactacagattttggtgtggaagaactggcttggggtgaagcgtcagcctctctggacgcttgtgctgatcttgtggccagtgataattttcataatcctcgctattaccagaactaagtttcctcctaccgctaagcccacctgttacctagccccaagaaatctgccttcaaccgggttctttccttttctgcagaccctcttatgtgacactgattctaagtgtaaagacactccctatggcccacaggaccttctgagaaggaaggggatagatgacgcactctttaaggactctgagatattaaggaaaagtagtaacctcgacaaagactccagtctcagcttccaaagtacccaggtgcctgagagaagacacgccagcctggctacggtctttccttcaccctcttcagacctggagatccctgggacatatacctttaacggcagccaggtgcttgctcggattctcggcttagagaagctgctgaaacagaatagcacatctgaagatatcaggagagaactgtgcgattcctactcaggctatattgtggacgatgccttcagctggacttttctggggagaaatgtgttcaataagttttgtctctcaaacatgacactgctggaaagttcacttcaggaactgaacaaacagttctctcagttgagctcagatcccaataatcagaaaatcgtttttcaggagattgtccgcatgcttagttttttctcccaggtgcaggagcagaaagcagtctggcagcttctctcctctttccccaacgttttccagaatgatacctcactctctaatctgttcgacgttctgcgaaaagcaaactcggtgttgctggtagttcagaaggtctacccaaggttcgccaccaatgaagggttccgaacgctccagaagagtgttaagcacctcctgtacactctggacagtcctgctcagggagatagcgacaacatcacccacgtgtggaacgaagatgacgggcaaacgttaagcccctctagtctcgctgcacaattgctcatcctggaaaatttcgaagacgccttactcaacatctcagcaaattcaccatacattccttacttggcatgcgtgcgtaacgttacagacagcctggcccgaggctctccggagaatctaagattactgcagtcaaccatccgtttcaaaaaatctttcctcaggaatggaagttatgaagactatttccccccagtgcctgaagtacttaagtctaagttatcccagctgcggaatttaacagagctactctgtgaatctgagacttttagtctgatagaaaagagctgccagctttctgatatgtcttttggttccctgtgcgaggaatccgaattcgacctgcaactgctcgaggcggcagaactcggaaccgagattgcggcttcacttttgtatcacgataatgttatctctaagaaagtcagagatctgctgactggagacccttccaaaatcaacctaaatatggaccagttcctggaacaggctctgcagatgaattaccttgaaaacattactcaattgatccccattattgaggccatgctccacgtgaataattcggccgacgcctctgagaagccaggacagctccttgagatgtttaagaacgtggaggaattgaaagaggacctgcgtagaacaactggcatgtccaaccgtacaattgataagcttctcgctatccccatccccgacaatcgggctgagatcatctcacaggtgttttggctccactcttgtgatacgaacattacaacaccaaagctagaggacgccatgaaggagttctgtaatctgtccctctcagagaggagtcggcagagctacctgataggattgactctgttacattacctgaatatttacaattttacatataaggtgtttttccctagaaaggaccagaagcctgtggagaagatgatggagctttttatcaggctcaaagaaatattaaatcagatggcgagcggtacacatcctctgcttgataagatgcgttcactcaagcaaatgcacctgccacgatccgtgcctcttacacaggctatgtatcgctccaacagaatgaatacacctcaaggcagctttagtaccatctcccaggctctatgcagtcaggggattaccacggaatatcttacagcgatgctacctagtagtcaacgacctaagggaaaccataccaaagattttctgacctataagctcactaaggagcaaattgccagtaaatatggcattccgatcaactctacacctttttgtttctcgctgtataaggatatcatcaatatgccagcaggtcctgtgatctgggctttccttaagcccatgctgttgggccgtatcctgtatgcgccttataaccccgtaactaaagctatcatggagaaatcaaatgtcacactgcgccagctcgctgaattacgggaaaaatcccaagagtggatggacaagtcaccactgttcatgaactctttccatttacttaatcaggctatcccgatgctgcagaacacacttcgaaacccattcgtgcaggttttcgttaaattttcagtaggactggacgcagtggagttactaaaacagatcgacgaactcgatattctgagactgaagctggagaataatatcgatatcatcgaccagctgaacacccttagcagtctgaccgtaaatattagctcctgcgtactatacgataggattcaggctgcaaaaaccatcgatgaaatggaacgcgaagctaagcgactctacaagtcaaacgaactcttcggttccgtgatttttaaattacccagcaaccgctcatggcataggggctatgattccggcaacgtgttcctgccacccgtgattaaatacacaatcaggatgagcctgaaaactgcacagaccacccggagtctccggaccaagatttgggcccctgggccacacaactcgccctctcataaccaaatttacgggagagcttttatttacctacaggactccattgaacgggcaattatcgagctccagaccggaaggaattcgcaggaaatcgccgtgcaggtgcaggcaattccctacccatgtttcatgaaggacaattttctgacatccgtcagttactcgctgcccattgtgctgatggtcgcgtgggtggtgtttatcgccgctttcgtgaagaagcttgtgtacgagaaagatctcaggcttcacgagtatatgaagatgatgggcgtgaacagctgttcacacttcttcgcttggctgatcgagtcagtcggtttcttattggtgactatagtcatactgatcattattctcaaattcggcaatatactacctaaaaccaatggattcatcctgtttctgtacttcagcgattattcattcagtgtgatagctatgagctacctgattagcgtattttttaataacacaaatatagctgccctcatcggctccttgatctacattattgctttcttcccgttcattgtcttagttactgtggagaacgaattatcttacgtcttaaaggttttcatgtcactactgagcccaacggctttttcctatgctagccaatatatcgccagatacgaggagcaaggcatcggtctccagtgggaaaatatgtacacaagcccagtacaggacgacactacgtcatttgggtggctctgctgcttaatattggcagacagcttcatctatttcctcattgcgtggtacgtgcgaaacgtgtttcccggaacatacggcatggccgctccatggtattttccaattctgccctcctattggaaggaacgtttcggatgcgcggaggtgaagccagaaaagagcaacggtctgatgttcaccaacatcatgatgcagaatacgaatcctagcgcctctcccgaatatatgttttcctctaacatcgaacctgagcctaaggacctcactgtgggcgtggcccttcatggcgtgacaaaaatttatggttcaaaggttgcggtggacaatttgaatctcaacttctatgagggacacatcacctcccttttggggccaaacggtgccggaaaaacaacaacaatttcaatgttaacaggcttgtttggcgcaagtgctgggaccatatttgtttatggaaaagacattaagacagatctgcacacagttagaaagaacatgggggtctgcatgcagcacgacgtgctgttttcttacctgaccactaaagaacatctgctcctttacgggagtatcaaggtgcctcattggactaagaagcaactgcacgaggaggtgaagcggaccctaaaggacaccggtttatatagccaccgccataagagggtgggcaccttgagcgggggtatgaagcgcaaactgtctatcagcatcgcgctcattggaggctctcgagtggtgatattggatgaaccatccactggcgtggatccctgcagcagaagatctatatgggatgtgatttccaaaaataagacagcgagaacaatcatattgtctacccaccatctcgacgaggctgaggttctgtcggatcggattgcgttcctggagcagggaggccttcggtgttgtggctcccctttctacctcaaagaggcatttggggatgggtaccacctgacactaaccaagaagaaatcccccaatctgaacgcaaacgcagtgtgtgacactatggcagtgactgccatgattcagtcacacctgcccgaggcttacctgaaggaggatattggcggtgagctagtttatgtcctgcctcccttttctaccaaggttagcggcgcttatcttagcttgctgcgggcactggataatggcatgggtgacctgaacatcggatgttatggcatttcagacaccacagtggaagaagttttcctcaatctcaccaaggaatcacagaaaaactcagccatgtcactggaacatctgacacagaaaaagatagggaattctaacgctaatggcatctcgacccccgacgatctgtcagttagcagcagcaatttcaccgaccgcgacgacaaaatcttgacacgtggggagcggctggatgggtttggtttactcctgaagaagattatggccattttgatcaagcgattccaccacacgagacggaattggaagggcctgattgcacaggtcattctgcccatcgtcttcgttactactgccatggggctcggcactctgcgtaactccagcaattcctaccctgagatccaaatctctcccagcctctatggtacctctgaacagaccgctttctacgcaaattaccacccctctactgaagctttagtttctgccatgtgggactttcctggcatcgacaacatgtgtctgaacacttccgacttgcagtgtttaaacaaggacagcctcgaaaagtggaatacaagcggagaacccataacaaactttggcgtctgctcctgcagcgaaaacgtgcaggagtgtccaaaatttaactacagccccccacataggagaacctattcgagccaagtgatttacaacctgactggtcaacgggtggagaactatctgatttccacagcaaacgaattcgtccaaaagcggtacgggggttggagcttcgggctccctctcactaaagaccttcgctttgatatcacgggggtgcccgcaaatcggaccctggctaaggtatggtacgatcccgaggggtatcactcattacctgcttatctgaactcactaaacaactttctgctccgtgtgaatatgagtaaatacgacgcggctagacatgggattatcatgtacagccacccttatcccggtgtacaggatcaggaacaggcaacaatctcttccctgattgatatactcgtcgccctctccatcctgatggggtactctgtaaccacagcatcgttcgtgacctacgtcgttcgcgagcatcagacaaaagctaaacaactccagcatatttctgggatcggcgtcacctgctactgggtaacgaacttcatctacgacatggtcttctatctcgtccccgtggctttctccatcggcatcattgctatcttcaagttgcccgctttctatagtgaaaataacctgggcgcagtgtccttgttgctattactattcggctatgctaccttttcttggatgtacttgttggccggactatttcacgagactggtatggctttcatcacatatgtctgtgtgaacctctttttcgggatcaacagcatcgtcagcttatccgtggtatacttcctttccaaggagaagcccaatgatcccacattagagctgatctccgagaccctcaaacgcatctttttaatttttcctcaattttgttttgggtatggcctcatagagctgagccagcagcagtcagtccttgattttttgaaggcttacggagtagaatatccaaatgaaacgttcgaaatgaacaagttaggcgctatgttcgtcgccctggtatcccagggaaccatgtttttttctctgaggctattgataaatgagagcttaataaaaaagctcaggctctttttccggaaatttaactcctcccacgtacgggagaccatcgacgaggacgaggatgtacgcgcagaacggctgcgggtggagagcggagccgctgagttcgatctggtgcagctctattgccttacaaaaacctatcagctgatacataaaaaaataattgcagtgaataatattagtattgggatcccagctggggaatgtttcggacttcttggggtgaatggagccggtaagacaactattttcaagatgcttacgggcgacatcataccttcctctggaaatattttaattagaaacaagacaggcagcctggggcacgtggattctcactcaagcttggtcggctattgcccacaggaagatgccctcgacgatctcgtcactgttgaggagcacttgtatttttacgccagagtccatggcatcccggagaaagacattaaggagactgtgcacaagctgttgcgacgattacatctaatgcctttcaaggatcgtgccacgtccatgtgttcctatggcacgaaacgcaagctgagtactgctcttgcactgataggcaagccatcgattctgctgcttgacgagccctcttctggaatggatcccaagtctaagcgccatctgtggaagataatatctgaggaagtgcagaacaagtgttctgttatcctcacatcccactctatggaggaatgtgaggccctgtgtacacgcctggctatcatggtgaacgggaagttccagtgcatcggctccctccagcacatcaaaagtcgcttcggccgaggcttcactgtgaaggtccacctcaaaaataacaaagtcaccatggagaccctgactaaattcatgcagttgcacttccccaagacctatctcaaggaccagcatttaagcatgcttgaatatcacgtgccagtaaccgctgggggtgtggcaaatatctttgacctgctggaaaccaataagacggctctcaacatcacaaatttcctggtgagtcagaccactctggaagaggtgttcatcaatttcgccaaggatcagaagtcttatgagactgccgacacttcctcacagggttccacaatcagcgtcgatagccaagacgaccagatggaatcctac

SEQ ID NO: 215344 - DNA, 6833 bp, Artificial Sequence
  Description of Artificial Sequence: Synthetic coding sequence
atgttcacatatatcaaaattatcacctctggagacagcgataacatcacgcacgtatggaacgaggatgatggccagacattgagtccctctagtctggcagcccagctgcttatcctggagaatttcgaggatgccctgcttaacatatccgcaaattccccttacataccctacctcgcctgtgtgcgaaatgtgaccgatagtctggcgagaggctctcccgagaacctgcggctgctgcagtccacaatccgattcaagaaatcttttctcaggaatggaagctatgaagactacttccccccagtgcccgaggttctgaaaagtaagctcagccagctgagaaacttgacagaactcttgtgcgagagcgagacctttagccttatcgagaagtcctgtcagctgagcgacatgagcttcggcagcctgtgcgaggaaagcgagttcgatttacaactgcttgaggcagctgaattgggcactgagattgctgcgtccctcctgtaccacgacaatgtgatcagcaaaaaggtgcgtgaccttttaaccggcgacccctctaagataaatctcaacatggaccagtttctcgagcaagcattgcaaatgaattacctcgagaacattacgcagctgatcccaattatagaagccatgttacacgtgaataattcggccgacgctagcgagaaaccgggacagctactggagatgttcaagaatgttgaggaactgaaggaggacctgcgcaggaccacaggaatgtccaataggactatcgacaagctgctagctattccgatacccgacaaccgtgccgaaattatctcccaggtcttctggcttcactcgtgcgacaccaatatcactactccaaagctggaggacgctatgaaagaattttgcaatctgagcctaagtgagaggagtagacagagctatctcatcgggctgaccctgttgcactacttaaatatttacaacttcacatacaaggtgttctttccgagaaaagaccagaagccagtggagaaaatgatggagttgttcattcgcctcaaggagatcctgaatcaaatggcttccgggactcacccactcttagacaaaatgaggtctctcaagcaaatgcatctccccagatcagtccctctgacacaggctatgtaccgcagcaatagaatgaatactccacaggggtcttttagtacaatcagtcaggccctttgttcccaggggatcaccaccgagtatttaactgctatgctgccatcctcccagagacctaaagggaaccatactaaagatttcctgacttataagctgactaaagaacaaatcgcctcgaagtacggcatccccattaacagcactccgttttgtttcagtttgtataaagacatcatcaacatgccagcagggcctgtgatctgggcatttctcaagcccatgcttttgggtcgtattctgtatgcaccctataatcccgtcacaaaggccataatggagaagagcaacgtgaccctgcggcagctggctgaattgcgcgagaagtcccaggagtggatggacaaatcgcccctcttcatgaacagctttcatctgctcaatcaggcaatccccatgctccaaaatacgctcagaaacccctttgtacaagtcttcgtgaagttcagcgtgggacttgatgcagtagagctgcttaagcagattgacgagctggacattctgaggctgaaattagagaataacatcgacatcattgatcagctgaacacattgtcgtctctgactgtaaacataagtagctgcgttctgtacgacaggattcaggccgctaagacgatcgacgaaatggagcgggaagcaaagaggctgtataagtccaatgaactcttcgggagcgtgatatttaagctgccctctaatcgctcatggcatcgaggctatgattccggcaatgtcttcctgccccctgtcatcaagtacactatccgcatgtctcttaagactgcccagacgacccgaagtctgagaacgaagatttgggcacccggaccgcacaactcacccagccataaccaaatttacgggagagccttcatttacctgcaagacagtatagaacgcgctattatcgagctccagaccggaaggaactctcaggagatcgctgtgcaggtacaggccatcccctatccctgttttatgaaagacaatttcctgacaagcgtctcctattctcttccaatagtgctgatggttgcctgggtcgtattcattgccgcattcgtcaagaaacttgtctatgaaaaagatttacgcctccacgagtacatgaagatgatgggcgtgaactcatgttcccatttcttcgcctggttgattgaaagtgtcggattccttctggtgactatagtgatcctgatcataatcctgaaattcggaaatatcctccctaagacgaacggtttcatcctgttcctgtacttctcagattactcttttagcgtgatcgcaatgtcctacctcatcagtgtcttctttaacaatactaatatagctgcactgataggctccttgatctatatcattgctttttttcccttcattgtactggttactgtcgagaatgagctctcctacgtgctgaaagtgtttatgtctttactctctcccaccgcctttagttacgcctcgcaatatattgcacgctatgaagaacagggaatcggcttgcagtgggaaaatatgtatacatcccccgtgcaggatgacacaacatcctttgggtggctgtgctgcctcattctggccgattcattcatctatttcctgatcgcctggtacgtgaggaatgtgtttcccggtacgtacggaatggcggctccttggtatttccccatcctgccctcctattggaaagagagatttgggtgtgccgaagtaaagcccgaaaaatccaacggccttatgtttacaaacataatgatgcaaaacaccaaccctagcgcttcccccgagtacatgtttagtagcaatatagagcctgagccaaaggatctaaccgtgggtgtagcgctgcacggcgtcacgaagatctacggatcgaaggtggccgtggataacttaaacctgaatttttacgaaggtcacatcacctcgctgctgggacccaatggcgctggtaagactactactatctctatgctaactggactgttcggcgcatctgctggcaccatatttgtctatggtaaggatatcaagaccgacctgcatacagttcgcaagaatatgggcgtgtgcatgcaacatgatgtgctgttttcatatctgacgaccaaggaacacctcctgctctacggaagtataaaggtgccccactggaccaagaagcagttgcacgaagaggtgaagcgaacgctgaaagataccgggctgtactcccacagacataaacgcgtgggcacattgtccgggggaatgaagcgcaagctgagtatttcaattgctctcattggcggtagtcgcgtggtcatcctggatgaacccagtacaggggtggatccatgctcgcggcgatctatttgggacgtgataagcaaaaacaagaccgctagaactatcattttgagtacccaccatctcgatgaagccgaagtgctatccgatagaatcgccttcttagagcagggcggtctccgttgctgtgggagtcctttctaccttaaggaagccttcggagatggttaccatctcacactcacaaagaaaaagagccccaacctcaatgcaaacgctgtctgtgacacaatggccgtcacagcaatgattcagtctcatttacctgaggcctatctcaaggaagacataggaggtgagctggtgtatgtattgcccccttttagcactaaagtttcgggcgcatacctgagcctgctgagggcactggataatgggatgggtgatttaaacattggctgctatggaatatccgacactaccgtcgaggaagtgtttctgaatcttaccaaggagtcacaaaagaattccgccatgtcactggaacacctgacccaaaagaagatcggaaactcaaacgcaaatggcatatcgacacctgacgatttgtccgtcagctctagcaactttactgacagggacgacaagattctcacacggggtgaacgcctggacggcttcgggcttctcctcaagaagattatggctatcctgattaaaagatttcatcatacaagacgaaactggaaggggctgattgcccaggtcatcttaccaattgtctttgttactaccgccatggggttaggcacgctaagaaactcgtccaactcctatcctgaaatccagatctcgccctccctgtacgggacttctgagcagacggcattttacgccaattatcatccgtctacagaagccctggtgagtgccatgtgggacttccccggaatcgacaacatgtgcttgaacacgagcgacctacagtgtttgaataaggactctctggagaaatggaacacgtccggggagccgatcaccaactttggagtctgttcctgctcagagaacgtgcaggaatgcccaaagttcaattatagtcctccccaccggagaacctattccagccaggtgatctacaacctgaccgggcagcgagtggagaactatctgatctctaccgccaatgagttcgtgcaaaagagatacggcggatggtcttttggcctgcccctgacaaaagatcttcggttcgacatcaccggagtacccgcaaatcgcacactggccaaggtgtggtacgacccagaagggtaccactcattacctgcctacctgaatagcttgaacaacttcctgctgagagtgaacatgagcaaatacgatgccgctcgtcacggaataataatgtattcacatccatatcccggagtgcaggaccaagagcaggccactataagcagtctcatcgatatactagtagctctctccatcttgatggggtactctgtgaccacagccagcttcgtgacctatgtagtgcgcgaacaccagaccaaagcaaagcagttgcaacatattagtggaataggggtcacttgctattgggtaacaaattttatatacgatatggttttttatctggtgcctgttgcattttctattggaattatcgccatcttcaaacttccggctttctatagcgagaataatctcggggctgtcagtctgttgctccttctgttcggttatgcgaccttcagttggatgtatttacttgccggtctcttccacgagaccggtatggccttcatcacatacgtgtgcgttaatctcttcttcggcattaatagtatcgtctccttgtcagtggtctactttttgagcaaagagaaacctaacgacccgaccttggaactgataagcgaaacactcaagagaattttcttgattttcccacagttttgtttcggatacggattaattgaactttctcaacagcaatctgttctcgattttctaaaggcctacggtgtcgaatacccgaacgagaccttcgagatgaacaaactgggtgccatgttcgtggccctggtaagccagggaactatgttttttagcctccgactgttgatcaatgaatcgctcattaagaagctgaggctgtttttccgtaagttcaattcctcgcacgttcgggagacaatagatgaggatgaggacgttcgcgcagagaggttaagagttgaatctggagccgctgaattcgacctggtccagttgtattgtctgaccaagacatatcagttaatccataaaaagatcatcgccgttaataacatatcgattggaattcccgctggagagtgcttcgggctcctaggagtgaacggggcagggaagacaaccattttcaaaatgctcaccggcgacattatccccagtagcggaaatatcttaatccgaaacaagaccggtagtctgggccatgtagacagccattcctctctggtgggttactgtccacaggaggatgccctggatgatcttgtcacggtggaagagcatctttatttttacgcaagggtacatggcattcctgagaaggacattaaggagaccgtgcataagctcttgcgaaggctgcacttgatgccttttaaggacagggctacttcaatgtgttcttacggtaccaagaggaagctgtctaccgccttggccttgatcggcaagcccagcattcttctcctagacgaaccaagttctggaatggatcccaaatcaaaaagacatctgtggaagataataagtgaggaagtgcaaaataagtgctctgttatcttgacgtctcatagcatggaggaatgtgaagccctctgtacaagactggccattatggtcaacggcaaatttcagtgtattggctcacttcagcacatcaagtcccgcttcgggagaggtttcaccgttaaagtgcacctcaaaaataataaagtgactatggaaacactcactaagtttatgcagctgcattttccaaagacctatctgaaggatcagcatctctcgatgttagagtaccacgttcctgtcacagcaggaggggtagcaaacatttttgatttactggagaccaataagacggccctcaatatcaccaactttcttgtgagtcagaccacactcgaggaggtgttcattaactttgccaaggaccagaaaagttacgagactgcggacactagctcccaagggagcacaatcagtgtggatagccaggatgatcaaatggagtcata

SEQ ID NO: 215345 - DNA, 15177 bp, Artificial Sequence
  Description of Artificial Sequence: Synthetic coding sequence
atggggcacgcaggatgccagttcaaggccttactctggaagaactggctatgtcgactgcggaatccagttctgttccttgcagaattcttctggccctgcatcctgttcgtgatcctgaccgtgcttcggttccaggagcctccaaggtacagagacatatgttacttacaacctcgcgacctaccctcttgtggggttataccctttgtgcagagcctgttgtgcaacaccgggtcccgctgccgcaatttctcgtacgagggatccatggagcatcattttagactgtcccggtttcagaccgccgctgatcctaagaaggtaaataatctggcttttctgaaggagatacaggaccttgctgaggaaatccatgggatgatggacaaggccaaaaatcttaagagattatgggttgagcggtccaatactcccgatagcagttacggatcatcattctttacaatggatctcaataagaccgaggaagttatcctgaaactcgagagcctgcaccagcagcctcacatctgggatttcctattattgctcccccgactccacaccagccacgaccacgttgaggatgggatggatgtcgccgttaacctgttgcagactattttaaacagtctcattagtctggaggacctcgactggctccctctcaatcaaaccttttctcaggtgtccgaacttgtgctgaacgtgaccatcagtactctaacctttctacagcagcatggggtggcagtgaccgaacccgtataccacctctccatgcagaatatagtatgggatccgcagaaagttcagtacgacctgaagagccaattcggtttcgatgatctgcacactgaacagattctaaactctagcgccgaattaaaagagatccctactgataccagtttagaaaaaatggtgtgctccgtactgtccagtacctctgaagacgaagccgaaaagtggggtcacgtcggcggatgccaccctaaatggtctgaagcaaagaactaccttgtgcatgcagtatcttggctcagggtgtatcagcaggttttcgttcagtggcagcaaggaagccttctgcagaagaccctgactggtatggggcacagcctggaggctttacgcaaccagtttgaggaagagtcgaagccatggaaggtagtcgaggcccttcacactgccctgctccttctgaacgactccttgtccgcggacgggccaaaagataaccatacatttcccaagatactgcaacatctgtggaaactccagtcgctgcttcagaatctcccccagtggccggcactgaaacgattccttcagctggatggcgctctgcgcaacgccattgctcaaaatctccacttcgtgcaggaagttctgatttgtctggagacctctgctaatgatttcaagtggttcgagcttaaccagctaaaactcgaaaaggacgtttttttttgggagctgaaacagatgctggccaagaatgctgtgtgtcccaatggtaggttcagtgagaaggaggtgttcctgccacccggaaactcctcaatctgggggggacttcaaggactactgtgttattgcaattcaagcgagacttcagtgctgaataaactgcttggctccgtcgaggatgccgatcgcattctccaggaagtcattacatggcataagaatatgtccgtacttattcctgaagagtacctggattggcaggagctggaaatgcaacttagtgaggctagtctgagttgcacacggctgttcctcctgctcggtgcagatccttcacccgagaatgacgtcttttccagcgactgcaaacatcagctggtatccacggttatctttcacactctcgaaaaaactcagttttttctggaacaggcatattattggaaggcatttaaaaagttcatccgaaaaacttgcgaggtggcacagtatgtgaatatgcaggagtcctttcagaatagactcctggcatttcctgaagaaagcccatgcttcgaagaaaacatggattggaaaatgatcagcgataattacttccagttcctgaacaatctcctaaagtcccctacagctagcatttctagggcactgaattttacaaaacacttgctcatgatggagaaaaaactgcacactctggaggatgagcagatgaattttctgttgagttttgtggagtttttcgagaagcttctgcttccaaacctcttcgatagctctatagttccgtccttccacagtctgccatctctgacagaggacatcctcaatatatcttccctttggactaaccacctgaagagtcttaagcgcgatccatctgcaacggacgctcagaagctgctggagttcggaaatgaggtcatatggaagatgcagactctggggtcccactggattagaaaagaacctaagaaccttctgcgttttattgaactcattttgttcgagataaacccaaaattgctagagttgtgggcatatggcatatcaaaaggaaagcgggctaaactcgagaatttcttcacactgctgaatttttccgtgccagaaaacgagattttaagtacatcattcaatttctcacagctcttccactccgactggcccaagtcacctgccatgaatatagacttcgtgcgactgagcgaggcgattatcaccagcctgcatgagttcggattcttagagcaagaacagatctcagaggcgttgaatactgtctatgccatcagaaatgcttcagacctgttttcagccctctctgagccacaaaaacaggaagtagataagatactcactcatattcacctaaacgtcttccaggacaaagacagtgctttgttacttcagatctatagctccttctatcgatatatttatgaactgctgaatatccagtctagaggatcatcactaaccttcctgactcagatatctaaacacatactggacattatcaagcagtttaattttcagaacatctccaaagcgtttgcctttctattcaagacagcagaagttttaggtggaattagcaacgtgtcgtactgccagcagttactgagcatctttaattttctagagctgcaagcacagagcttcatgagtaccgagggacaggaattagaggtgatccacacaacacttaccggtctaaaacaactgctgatcatcgatgaagatttcagaattagcctgttccagtacatgagtcagttcttcaatagttctgtcgaagatttacttgacaacaaatgcctgatctccgataataagcacatcagcagcgttaactactctacctcggaagagagctccttcgtgtttcctttggctcagatcttttctaatttgagtgccaatgtgtctgtgttcaacaaattcatgagcatccattgcacagtgagttggctgcaaatgtggaccgagatatgggagacaatctcacagttattcaagttcgatatgaacgtctttacatccctgcatcacgggtttacgcagctattggacgaattggaggacgatgtgaaagtttccaaatcctgtcaggggatacttcccacgcacaatgtggcccgactgattctaaacctcttcaagaatgtgacacaggctaacgacttccataattgggaagactttttggatctgcgagatttcctagttgccctaggcaatgcccttgtctccgtgaagaagctgaacctcgagcaagtcgagaaatccctattcacaatggaggctgccctgcatcaactcaaaacatttcctttcaatgagtctacctctagggaatttttgaattctcttttagaggtgtttatcgaatttagtagtacttctgaatatattgtgcggaacctggacagtattaatgacttcttgagtaacaacctgaccaactacggagaaaagtttgaaaatatcataaccgagctccgggaggctatcgtattcctgagaaatgtgagccacgaccgcgaccttttcagctgtgccgacattttccagaatgtcaccgagtgtatacttgaggatggctttctgtacgtgaacacctctcagcgtatgctccgtatactcgataccctcaattcaactttttcaagcgagaatacaatctcaagtttgaaagggtgtatagtatggctcgacgttataaaccacctttacctcctttccaactcttcattctcacaggggcatctgcagaatattttggggaactttcgggacattgaaaataagatgaattccattctgaagatcgtgacgtgggttctcaatatcaaaaagcccttgtgcagctccaacggatcccacattaactgcgtgaacatctacctgaaagacgtaacggatttcctgaacatcgtcctcactacggtgtttgaaaaagagaagaagcccaagttcgagatattactcgctctcctcaacgatagcactaagcaggtgcgtatgagtattaacaatttaaccactgattttgactttgcttcccagtcgaattggcggtatttcacagaactaatcttgagaccaattgaaatgagtgacgaaattcccaaccagtttcagaacatctggctccatctgatcacactgggtaaagagtttcagaaactggtcaagggcatctattttaatatcttggaaaataattcgagttctaaaaccgaaaatttgctcaatatcttcgccacctctcccaaagaaaaggatgtgaattccgttggcaattccatctatcatttggccagctatttggcctttagtctgagccacgatctgcagaactcaccaaaaattatcatttcaccggagattatgaaagccaccggcctcggaatccagctcatccgagatgtgtttaactcgctcatgcctgtcgtccatcacacaagtccgcaaaacgccggatatatgcaggccctcaagaaagtgacatcagtgatgcgcacgctgaagaaggcagacattgatctgcttgtggatcagctggagcaggtgagcgtgaacctaatggattttttcaagaacatctcttctgtgggcacgggtaatctcgtagtcaatctgcttgtagggcttatggagaaattcgccgactcaagccactcctggaacgtcaatcatctcctgcagctcagccgcttgtttcctaaggacgtggtagatgccgtgatcgatgtctattacgtgctgcctcacgctgtgaggctgttacagggagtacccggaaaaaatataacagaaggactgaaagatgtctatagctttaccttacttcacggtattacgatcagcaatatcacaaaggaggatttcgccattgtgataaagattctgctcgatactatcgagctggtgagcgacaaacccgatatcatttccgaagcccttgcatgtttcccagtggtttggtgttggaatcatacaaattccggttttagacagaattccaagatcgatccttgcaatgttcacgggctcatgtccagttccttttacgggaaagtggccagcatcctggatcacttccacttatcacctcaaggagaagacagtccatgctcaaacgaatcttccaggatggaaatcactcggaaggtggtgtgtattatccacgaactggttgattggaattccattcttcttgagctgagtgaggtgtttcatgtgaacatttccctcgtgaagacagtccagaagttctggcacaaaatcctcccctttgtaccaccatctatcaaccagacaagggactctatctccgagctctgtccatcagggtctatcaaacaagtggcccttcagatcatcgagaagttgaaaaacgtcaacttcaccaaagtcaccagtggcgaaaatatcctggataaactctcctcactcaataagattctgaatatcaatgaggacacagaaacctctgttcagaacattatcagctccaatcttgagaggactgtccagttgataagcgaggattggagtctggagaagtccacccataacctgctctccctcttcatgatgctacagaacgccaatgtgaccggttcttcattagaggccctctcatcatttattgaaaaatccgagacaccctacaacttcgaagagctttggcccaagtttcaacagattatgaaagacctcacgcaggacttccggatcagacatctgctgtctgagatgaataaaggcattaaatccatcaacagtatggccctccagaagataaccctgcaattcgcccactttctagaaatcttagatagcccgtcccttaagactctcgagattatcgaggactttctcctggtgactaaaaactggctgcaggagtacgccaatgaagattattcacgcatgatcgaaaccttgttcatacccgtaaccaatgagtcttcgaccgaggacattgctctgttggcgaaagctattgcgactttttggggatccctcaagaacatatctagggcagggaacttcgatgttgctttcctgacccacctgctgaaccaggaacagctgactaacttttctgtcgtgcagttactgtttgagaacatcctgatcaaccttattaacaatctggcaggaaactcccaggaagcagcgtggaacctgaatgacaccgacctgcagattatgaactttatcaatctgatcctgaaccacatgcagagcgagacctcgagaaagactgtcctgagcctgcggtcaatagtcgacttcactgaacagttccttaagacgttcttctcactctttcttaaggaggattccgagaacaagatctctctcctactcaagtatttccataaggacgtcatagccgagatgagcttcgtgcctaaagataaaatattggagattctgaaactggaccagttcttaacgctgatgattcaggatcgcctgatgaatattttttcctctctcaaggaaacaatctatcacctgatgaagagttcttttattcttgataatggtgagttttacttcgacacccatcagggtctaaagttcatgcaggacttgtttaacgccctcctgagagagacatctatgaaaaataaaaccgaaaataacatcgattttttcaccgtcgtgagtcagctgttctttcatgtgaataaatcagaagacctctttaagctgaatcaggatctgggaagcgctttgcatctcgtccgggagtgttctactgagatggcgaggctgctggacacgattctccattcccctaacaaggacttctatgcactataccccacactccaggaggttattctcgcaaatctgacagatctcttgttttttattaataattcgtttcccctacgaaatcgcgctacgctggaaatcacgaagcgtctcgtgggggcaatctcccgtgcttctgaggagtctcacgttttgaagcccctgttggagatgagtggcacactggtgatgctgcttaatgactcagcggacctacgtgacttggctacttccatggattctatcgtgaagttacttaaactggtaaagaaagtgtccggaaagatgtcaaccgtgtttaagacacacttcatttctaataccaaggactccgtgaagttcttcgacacgttgtactcaataatgcagcaatccgtgcaaaacctcgtcaaggaaattgccacactgaagaaaatcgaccactttaccttcgaaaaaatcaatgacctcttggttcctttcctcgacctagcttttgaaatgatcggcgtggaaccgtatatttctagcaactccgacattttttcaatgagccctagtatcctcagttacatgaatcaaagcaaagattttagtgatatcctggaggaaatcgctgaatttttgaccagtgttaaaatgaatttagaagatatgagatccctggctgtcgccttcaacaacgaaacgcaaactttcagtatggactcggtcaatctgcgggaagaaatcctgggatgtttggtgcctatcaacaacatcaccaatcagatggactttttgtatcctaacccaatctcgactcatagtggcccacaggatatcaaatgggagatcatccatgaggtgattcccttcctggataaaattctgtcacagaacagcaccgaaattggttctttcctgaaaatggtcatctgcctgaccctagaagcactatggaagaacctgaagaaggataactggaacgtgagtaatgttctgatgaccttcacccagcaccctaacaaccttctgaaaaccatcgaaactgtattagaggctagctccggcattaaaagtgactacgagggggacctgaataaaagtctctatttcgatacaccgctgtcccagaatatcacccaccaccagctggagaaggctatccataacgtactttccagaatagcgctttggagaaaaggactactcttcaacaattctgagtggataacgtcgacaaggaccttatttcagccgcttttcgaaatctttattaaggccactacaggtaagaatgtgacttccgagaaggaagaaaggactaagaaggaaatgatcgatttcccctattcattcaaaccgttcttttgcctcgagaagtacctgggagggctattcgtgctcaccaagtattggcagcagatcccgttaacagatcagagcgttgtggagatttgcgaggtgtttcagcagacagtgaagcctagcgaggctatggagatgttgcagaaggtgaagatgatggtggtgcgagtgctaaccatcgttgctgagaatccttcttggactaaggatatcctgtgtgccactctctcctgcaaacaaaacgggattaggcatttaatactctctgccatccaaggggtgacactggcccaggatcactttcaggaaatcgaaaagatttggtcaagccccaatcagctgaattgcgagtcactgtcaaaaaacctgagctccaccttagagtcatttaaatctagcctggaaaatgcgaccggccaggattgcaccagccagcccaggctggagaccgtccagcagcatctttacatgttggcgaaatccctcgaggagacttggtctagcggcaacccaatcatgactttcctgtcaaacttcactgtgactgaggacgtcaaaattaaggacctgatgaaaaacatcacaaaactcacggaggaattacggagttccatacagataagcaacgaaactatccactcgattttggaagctaatatctctcattcaaaagtgctgttctccgccttaactgtggccttgagcggcaaatgtgatcaggaaattttgcacctgctcctgacatttcctaagggagagaagtcgtggatcgcggctgaggaactttgcagtctcccgggttcaaaagtatacagtttaattgttctccttagccgcaacctcgacgttcgtgcttttatctacaagaccctaatgccaagtgaggctaacggtctcctcaacagcctgctggacatcgtgtcttcactgagcgcgcttttagcaaaggcccagcatgtcttcgagtacctgcccgagttccttcatacttttaaaatcacggctctgttagaaacattagacttccaacaagtgtctcagaacgtccaggctaggagctccgcatttggtagtttccaatttgtcatgaagatggtctgcaaagatcaggcttcctttctgagtgactcaaacatgttcatcaacctgcctcgagtcaaagagttactggaagatgacaaagagaaattcaacattcctgaggactcaaccccattctgccttaagctctaccaggagatcctccaactgccgaatggcgcactcgtttggaccttcctcaagccgattctccatgggaaaattctgtatactccgaacacaccagagataaacaaagtgatacagaaggctaactacacattctacatcgttgataagctaaaaaccttgtccgagactctactggagatgagctctctgttccaacgatccgggagcggccagatgttcaaccaactgcaggaagcgctgaggaacaagtttgtgaggaactttgtggagaatcaactgcatattgatgtggacaagcttactgagaagctacagacctatgggggtctgctggacgagatgtttaaccatgccggagccggtcggtttcggtttctggggtccatcctggtgaatctgtcttcatgtgttgcgttaaatcgattccaggctcttcagtctgtagacattctggaaacaaaggcgcatgaactgctgcagcagaacagctttcttgcgtctataattttcagtaattctcttttcgataaaaacttccgcagcgaatccgtgaaattgccccctcatgtatcttataccattcgcacaaacgttctgtatagtgtccgaaccgatgtggtcaagaacccaagctggaagtttcaccctcagaacctgcccgcagacggatttaagtataactacgtgttcgcaccattacaggacatgatcgagagagctattatcctggtccagaccggccaggaagcgcttgagcccgctgcacagactcaggccgcaccctacccgtgccacacgtctgaccttttcctgaataacgtgggcttctttttccccctaattatgatgctgacctggatggtctccgtagcctctatggtccggaaactggtgtatgagcaggagattcaaatagaggaatatatgcgaatgatgggagtccatcccgtcattcatttcctagcttggtttttagaaaacatggctgtcctcacgatcagttccgcaacgcttgctattgtccttaaaactagcggcatcttcgcccatagcaatacctttatcgtttttctgtttctgctcgatttcggcatgtccgtagtgatgctgagttacctgctctcagcattcttcagtcaggccaatacagcagccctgtgcacgtccctcgtatatatgatctctttcctgccttatatcgttctgcttgtgttgcacaaccagctttcctttgttaatcaaactttcctttgcctgctttcgacaaccgcatttggacaaggagttttcttcataacttttttggagggccaggagactggaatccagtggaataacatgtatcaggcgctggaacaaggcggaatgaccttcggctgggtttgctggatgatcctcttcgatagctctctgtatttcctctgtgggtggtacttgagtaatctcatccccggtactttcggactcagaaaaccatggtatttccctttcacagcctcctattggaagtccgtggggttcctcgtggaaaagagacagtattttctcagcagctctctcttcttctttaacgagaacttcgataacaaaggcagcagcctgcagaatcgggaaggcgagctggagggttcagcgccaggtgtcacgttagttagcgtgaccaaagaatatgaaggacacaaagcagtggttcaggacctgagtctgaccttctatcgtgaccagataaccgccctcttgggcacaaacggtgccggtaaaactaccatcatctccatgttgactgggctgcacccccctaccagtggcacgataataatcaatggtaaaaatctgcagacagacctgtcccgagtcagaatggaactcggcgtttgcccacagcaggacatcctcttggacaacttaacagtcagggagcacttgctgctttttgctagcatcaaggcgcctcagtggacaaagaaagagctccatcagcaagtaaatcagacactccaggacgttgatctgactcaacaccagcacaagcagacccgcgcactcagcggtgggcttaagagaaaactttcgcttggtatagccttcatgggaatgagcagaaccgtggtgcttgatgaacctacgtccggcgtggacccctgcagtcgccacagtttgtgggacatcctgctgaagtatcgtgaggggaggacgattatttttaccacgcaccatctagacgaggctgaggcattgagcgaccgagttgccgtgctacagcacggcaggctgaggtgttgcggcccacctttttgcttaaaggaggcatacgggcaaggtttgcgcctcacacttactcggcagccaagtgtcttagaagcgcatgatttgaaggacatggcatgtgttacgtccttgattaagatttatatcccgcaggcctttttgaaggacagctctggttcagagctgacatacaccattcccaaggacactgacaaggcgtgtctcaaaggactctttcaggctctggatgagaacctgcatcagctccatttgacaggctatggtatttccgataccactctggaggaggtctttctcatgcttctccaggactctaataaaaaaagtcatattgcgcttgggaccgagagtgagctgcagaaccaccgcccaacaggacatttgtctgggtactgcgggtctctggcgagaccagccactgtccagggggtacaattgctgagagcacaggtggctgctatactcgccaggcggctgagacggaccttgagagcaggaaaatcgaccctggcagaccttcttctccctgtgttattcgtcgccctggccatgggtctgttcatggtaaggccactggcaaccgaatatccccctctacgactgaccccaggccattaccagagagccgagacatactttttttcatcaggcggagataatctggatcttacaagggtactcctccgcaagttcagagaccaagacctgccatgcgccgacctcaacccccgacagaagaatagctcctgctggagaacagatccatttagccatcccgagtttcaagactcttgtggctgcttgaagtgcccaaacagatcagccagtgccccatatctcacgaatcacctggggcacaccttgcttaacctgtccggattcaatatggaagaatatctgctggctccaagtgagaaacctcggctcggtggctggagctttggtctgaaaatcccctccgaagcaggcggagcgaacggcaatattagtaagccccctaccctggcaaaggtctggtataatcaaaaggggttccatagcttacccagctacctgaaccacctgaataacctgatcctgtggcagcacctgcccccaaccgtggattggcgtcagtacggtattaccttgtattcccacccatacgggggtgccctgctgaacaaagataaaatcctggaatcaatcagacaatgtggcgttgctctgtgcatcgtgctcggcttctctattttaagtgcaagtatcggcagctcagttgtgagagatcgcgtcattggggctaagcgcctccagcacatctctggccttggctacagaatgtactggtttacgaatttcctgtatgacatgctcttttacctcgtgtctgtatgcctttgtgtggccgtcatagtcgcgtttcagctgactgcctttacattccggaagaatttagctgccaccgccctgctgctctcactcttcggctacgccacactgccttggatgtaccttatgtctaggattttctcaagttccgatgtggcattcatctcctacgtctccctgaacttcatttttgggctgtgcaccatgctgataaccatcatgccccgactcctggccatcattagcaaggccaaaaatttgcaaaacatatatgacgtgctgaagtgggtgtttactattttcccgcagttttgtctcgggcaggggctcgtcgaactgtgttataatcagataaagtacgatttgacgcacaattttggaatcgacagctacgtctccccgtttgagatgaactttctgggttggatcttcgttcagctcgccagtcaggggactgtacttcttctgttgcgagtgctcctgcactgggatctcttgagatggcccaggggccactcaacactccagggcaccgtcaaatcatctaaagatactgatgttgagaaggaagagaaacgggtatttgaaggaaggacgaatggcgacatcctggtgctgtacaatttaagcaagcactatcggaggttcttccagaacattatagcagtacaagacattagccttggaattcctaaaggcgagtgcttcggcttacttggcgtcaatggtgctggcaaaagcacaacattcaaaatgctaaacggcgaagtgtctctcacgtcaggacacgccatcatcagaacaccaatgggggacgcagtggacctgtccagcgctggcaccgccggtgtgctcataggctactgcccccaacaggatgcactggatgagctcctgaccggctgggagcatctttactactattgcagcctcagaggaataccccgtcagtgcatccccgaggtggctggagacctgattagaagactccaccttgaggcccatgccgataagcccgttgctacatactcgggcggaacaaagcgcaagctgagcactgccttggcactcgttggcaaacccgatatcctccttctggacgagccttcgagtggcatggacccttgctcgaaacgctacctgtggcagaccataatgaaagaggtgagagaggggtgcgctgccgtcctgacgagccattctatggaggagtgcgaggcattatgcaccagactagccatcatggtgaatggttccttcaagtgtttgggctcgccgcagcacatcaagaatagattcggcgatgggtacaccgtgaaggtgtggctgtgcaaggaggccaatcagcattgcaccgtgtcagatcatcttaagttgtattttcctggaattcagttcaagggccagcatctcaacctgttggagtaccacgtccccaagcgttggggatgtctagccgacctcttcaaggttatcgagaacaacaagacctttctaaacatcaaacactattccataaaccagaccaccctcgaacaagtcttcatcaatttcgcctccgaacaacagcaaactctccagtcgacattggacccgtcaacagactctcaccatactcaccacctccccatctac

SEQ ID NO: 215346 - DNA, 2367 bp, Artificial Sequence
  Description of Artificial Sequence: Synthetic coding sequence
atgggcctgttcatggtaagacccttggctaccgaatacccgcctctgcgtcttacaccaggccactatcagcgggctgagacgtacttttttaggaaaaactctagttgctggagaaccgaccctttcagccaccccgaatttcaggattcatgcggatgtctgaagtgccccaatcgatctgccagtgcgccatacttgactaaccacctaggccacactctgctgaacctgtccgggttcaatatggaggaatatctgctggcaccatctgagaaacctaggctgggtggatggagtttcggactcaaaatccccagcgaagctggtggagccaacggtaatatctcaaagcccccaacgctggccaaagtttggtataaccagaaagggtttcatagcttgccttcatatcttaatcacctcaataatctgattctctggcaacacttaccccctacggtggattggcggcaatacgggattactttgtactcccacccctatggcggtgcgctgttaaataaggataagatcctagagagcattagacagtgtggcgtggccctgtgcatcgtcctgggcttctcaattttatcggccagtattggctcttccgtcgtgcgtgacagagtgatcggagccaagcgcctgcaacacatttccggtctgggatatagaatgtattggtttaccaatttcctgtacgacatgttattttatctcgtctccgtttgtctgtgcgtcgcggttatcgtcgcctttcagctcactgccttcacattccggaagaacttggccgctacagcgttgttgctgtctctgtttggatacgcgacattaccatggatgtatctaatgtccagaatattcagttccagtgatgtcgcatttatcagctatgttagtctgaactttatcttcggcctctgcactatgctaatcaccattatgccccgtctgctagctatcatctctaaagccaagaatctgcagaatatctacgacgtgcttaaatgggttttcactatatttccccagttttgcctggggcaggggctcgtggaactctgctacaatcagatcaagtatgacctcacccacaacttcgggatcgatagttacgtaagcccatttgagatgaacttccttggttggattttcgttcagctggcatctcagggcactgtgctcctactgttacgtgtactgctccattgggatctcctcagatggcctcggggtcattccaccctacaagggacagttaagagctcaaaggatacggacgttgagaaagaggagaagcgggtgtttgaaggcagaacaaatggtgatattcttgtgctgtacaacctgtcgaaacactacaggaggttctttcagaatattatagccgtgcaagatatttccctcggcatacctaagggtgagtgtttcggcctgctgggcgtcaatggggctggcaagtcaacaactttcaagatgctcaatggagaggtgtccctgacaagtgggcacgccattattagaacccccatgggtgatgcggtcgacctgagttcagcgggaaccgcaggcgtcctgattggatactgcccgcagcaggatgccctggacgagctgctcacaggatgggagcacctgtactactattgtagcctgcggggtatacctagacagtgtatccccgaggtcgccggtgatcttattagacgcctgcacctggaggcccatgccgataaaccggtcgccacctactccggcggaaccaagcggaagctctccacagccctcgccttggtgggaaaacctgacatcctgcttctcgatgaaccatccagtggaatggacccgtgttcaaaaaggtacctgtggcagactattatgaaggaggtaagagagggatgcgcagctgtacttacctctcatagcatggaggaatgcgaagccttgtgcactaggctggcgattatggttaacggctccttcaaatgcctgggctcaccacagcacatcaaaaaccgttttggggatggctatacagttaaggtctggctctgcaaggaggctaaccagcattgtacagtgtcagaccacctgaaactgtactttccgggaattcagtttaaggggcagcaccttaacctgctggagtaccatgtaccaaaaaggtggggctgcttggccgacctgtttaaagtgatcgagaataataagacttttctgaatatcaagcattatagtattaatcaaactaccctcgagcaagtgttcattaatttcgcctccgagcagcaacagaccttacagagtactctggatccgagcacggacagtcaccacacacaccatctgccaatctag

SEQ ID NO: 215347 - DNA, 7311 bp, Artificial Sequence
  Description of Artificial Sequence: Synthetic coding sequence
atgggttttctccaccagctgcaacttctactttggaaaaacgtgacacttaaacgaaggagcccctgggtgctggcctttgagatctttatacctttagtgctgttttttattctgctgggtctgaggcaaaagaaacccaccatttctgtgaaagaagtggctttctatactgctgccccactaacgtccgccggtatcctgccagtgatgcagtctctgtgtcccgacggccagcgcgacgagtttggattcctccagtacgcaaacagtacggtgactcagctgctcgaacgccttgatcgcgtcgtcgaagaaggcaatctattcgaccctgcacgtcccagcctgggctccgagctggaggcccttcggcagcatttagaagcgttgtccgcaggtccgggtacctccggaagtcatctcgatcgtagtactgtgtctagcttctctttggattccgtggctagaaatcctcaggaattgtggcgtttcctcacgcagaatctctcattgccaaacagcactgcacaagcattgctggccgctcgggtcgaccctcctgaagtataccacctgctttttggaccttcgtcggctctcgactcgcaaagtgggttgcacaagggccaggagccttggagccggctcggtggcaaccccttattcagaatggaggagctcctcctggctccagccctgctggaacaactcacatgcacccccggatcaggtgaactgggcagaatccttacagtacctgagagtcagaaaggggcactccagggatatcgcgacgccgtgtgctccggtcaagctgccgctcgcgcaagaaggttcagcggtctatccgcggaactgcgtaaccagctagatgtggcaaaagtgtctcagcaactcggcctagacgcacctaacgggtctgactctagccctcaagcccctccacccagaaggctgcaggcactgcttggtgacttgctcgacgcacagaaagtgctgcaggacgtagatgtgctctctgctctggcactccttctgcctcagggtgcttgcactggacggactcccggaccacccgctagcggcgcagggggtgcagcaaatgggactggagccggagccgtcatgggccctaacgccactgccgaagaaggtgctccttctgcggcagccctagccacccctgataccctccagggccagtgctcggccttcgttcagctgtgggcgggtctccaacccatactgtgcggcaacaatcgcaccatcgagccagaggcgctgcgcaggggaaacatgagctcactgggctttaccagcaaagagcaacgcaacctcggactccttgtgcacctgatgacatctaatcccaaaatcctgtacgcacctgctgggagtgaagtagaccgtgtgatcctcaaggcgaatgaaacgtttgcattcgtgggcaatgtaacccactatgcacaagtgtggctgaacatctctgctgagatcagatcctttctcgaacaggggagactccaacagcacctgcgatggctgcagcaatacgtggctgagctgcgcctgcatcctgaggccttaaatctgagtctggatgagctgccgccagcactccgccaggataacttttcacttccctctgggatggctcttctccaacaactggatactatcgataacgcagcttgcggctggatacaattcatgtccaaggtgagcgtcgacatttttaagggatttcatgacgaggagagcatcgtgaactataccctaaaccaggcctaccaggataacgtcaccgttttcgctagtgtaatttttcagacaagaaaagacgggtcacttccacctcacgtgcactataaaatacgccaaaattctagctttaccgaaaaaacaaacgagatcaggagggcgtattggaggcctggacccaatactggcggacgattttatttcctctacggcttcgtttggattcaggacatgatggagagggccattatcgataccttcgtcggccacgacgtggtggagcctggctcctacgttcaaatgttcccatatccctgctatacaagagatgactttctcttcgtgatcgagcatatgatgcctctttgcatggttatttcctgggtttactccgtggctatgactatccaacacatcgtggcagagaaagagcaccgcctgaaggaggtcatgaagactatgggcctgaataacgctgtacattgggtcgcctggttcattactgggttcgtgcagcttagcatctctgtgacagccctcactgccatccttaaatacggccaagtgttgatgcatagccacgtggtgatcatttggttattccttgcggtctacgcagtggcaacgatcatgttttgtttcctggtcagtgtgttgtatagcaaggctaaactggctagcgcttgcggaggtattatctatttcctgtcgtatgtgccttacatgtatgttgcgatccgagaggaggtggcccatgataagataaccgccttcgaaaagtgcattgctagtctaatgtctaccacagctttcggccttggctcaaagtactttgctctgtacgaagttgccggtgtgggaattcagtggcatacgttttctcagtctccagtggaaggcgatgatttcaacctgttactggccgtgacgatgctaatggtggatgcagtagtatacggtatactgacttggtacatagaagctgtccaccccggaatgtatggcctacctagaccttggtactttcccctgcagaagagttactggctgggatctggtcggaccgaggcctgggaatggtcatggccttgggcccgtaccccacggctttctgtgatggaggaggatcaggcttgtgctatggagagccgcaggttcgaggagaccaggggcatggaggaggagcccacacatctaccactggtcgtatgtgtggataaactaaccaaggtttacaaggacgataagaaactggcattgaataaactatcactaaatctttacgaaaatcaagttgtatctttcctgggccacaatggcgcagggaagacgaccaccatgagtatcctgactggactcttccctcctacctctggcagcgccactatttatgggcacgatatccgaacagaaatggacgagattagaaaaaacctcggcatgtgcccgcaacataacgtgctgttcgacaggctgacagtagaagagcatctatggttttacagtcggcttaagagtatggcgcaggaggaaatccgaagggaaatggacaagatgatagaagacctggagttgtccaacaaaaggcattccctagtgcagaccctatcaggtgggatgaaacgaaaattgtccgtagctattgcattcgtggggggatctcgagcaatcatcctggatgagccgaccgccggtgtggatccttatgcgagaagggcgatctgggacctgatcctgaaatacaagcctggaagaacaatccttctcagtacacaccatatggatgaggcggacttgctgggtgaccggatagccatcatctcccacggaaaattgaagtgctgtgggagtccactatttcttaaaggaacttatggagatggatacaggctgacattggtgaaacgacctgctgagcccggtgggcctcaggagccgggtctcgcaagttcaccaccaggcagagctcccctgagcagctgctctgagctgcaggtgagccagtttatacggaagcacgtggccagctgtttactagttagcgatacctcaacggagctgtcatatatccttccctccgaggccgcaaagaagggggcatttgaacgcttattccagcatctggagagaagtcttgatgcgttgcatctgtcctctttcggactgatggataccactcttgaggaggttttccttaaggtgagcgaggaggatcagtccctcgagaattccgaggccgatgttaaggaaagcaggaaagatgttctacccggagccgaaggtccagcctctggcgaggggcatgctggtaatttggcaaggtgcagcgaactgacccagtcacaggcatccctccaatccgcctcctccgtcgggagcgcgaggggagacgagggagctggttatacagacgtctatggcgactaccgtcccctattcgataaccctcaagaccccgataatgtgtcactgcaagaggttgaagcagaggcactttcaagagtgggccaaggaagcaggaagctcgacgggggatggctgaaggtccgccaatttcatggactgctggtgaaaaggttccactgtgccaggcgaaactctaaagcactgttctcacaaatcttgctacctgccttttttgtatgcgtcgctatgacagtcgcgttaagcgtccctgagataggtgatctcccgccattggtgctttctcccagtcaataccataattatactcaacccagaggtaattttatcccttacgcaaacgaggagagaagggagtacaggttgcggttgtctcccgatgcatcaccgcagcaactggtctccaccttcagactacctagtggggtgggagctacgtgcgtgctcaaatctccagcgaatggatcactcgggccaactttgaatttgagttcaggcgaaagccggcttttggccgctcgctttttcgactcaatgtgtctggaatcatttacgcagggcctgcctctatctaactttgtcccaccaccgccatcacccgctccttctgactctcctgcgtcccccgacgaagacttacaagcttggaatgtgtccctacctcctaccgctggaccggagatgtggacctctgctccaagtctgccacgcttggtaagagaaccggtgagatgcacctgttctgcccaaggaacgggattcagctgcccatcctcagttgggggacaccccccacaaatgagggttgttactggagatatcttgactgacataacgggccacaacgtgtcggaatacctcctatttacctccgaccgattcagactgcaccgctatggtgcaatcactttcggcaatgttctgaaatcaatccccgcttcctttggcacccgtgctccgcctatggtacgtaagatcgcggtacggcgtgctgcgcaggttttctataataacaagggataccactccatgcctacctacctcaatagtctgaacaatgccatcctacgcgcaaacctgcccaaaagcaagggcaaccccgctgcttacggaatcacagtcaccaaccaccccatgaacaaaacatccgctagcctcagtttagactacctcctgcaaggaaccgatgtagttatcgcaatctttatcatcgtagcaatgtcattcgtacctgcgagcttcgtcgtgttccttgtggctgaaaagtctacaaaagccaaacatttacaatttgtgtccgggtgcaatcccattatttactggctcgctaactacgtctgggacatgctgaattacctagtccctgcaacctgctgcgtgataatcctgttcgtgtttgacttacccgcttacacctcccctactaatttccccgcagtgttgtcactgtttttgctgtacgggtggagtattacaccaatcatgtaccccgcatccttttggtttgaggtgcccagctccgcctatgtgttcctgattgtgattaacctctttatagggattactgccactgtcgccacctttttgctgcagctcttcgagcacgacaaggatttaaaagtagttaatagttacctgaagtcctgttttctgatatttcccaactacaacctgggccatggactaatggaaatggcttacaatgagtacatcaatgagtactacgccaaaatagggcagttcgacaagatgaagtccccgttcgagtgggacattgtgacccgcggtttggttgctatggctgtcgaaggcgtcgtcggtttcttgctcaccattatgtgtcagtacaacttcctcagacgtccacagcggatgcctgtcagcacaaagcccgtggaagacgacgttgacgttgctagtgaacgacagcgggtgttgagaggggatgcagataacgacatggtgaagattgagaatcttacgaaggtatacaagagtagaaagattggccgtatcctggcagtggatcgcctgtgcttaggagtgagacccggtgaatgctttggcttgctgggggtgaacggtgcgggtaagacttcaacttttaaaatgctcacaggagacgagagcacaacgggaggtgaagccttcgtcaatggacacagcgttctcaaggaattgctgcaggtgcagcagagtttgggatattgcccacagtgtgacgccctcttcgacgaactcactgcacgcgagcatctccagctttatactaggctgcgaggcattagttggaaggacgaggctagagtggttaaatgggccttggaaaagctggagctcaccaaatacgctgataagcccgcaggcacttacagcggcggaaacaagaggaagctgagcaccgccattgctctgatcggttaccccgcttttattttcttggacgagcctacaaccgggatggaccctaaagccagacgctttttatggaacctgatccttgatttgataaagacggggagaagtgtggtgctaacctcacattctatggaagagtgtgaggccctttgcactcgtctggccataatggtcaatggacgcctgaggtgcctcgggtccatccagcatttgaaaaatcggtttggcgatggctatatgatcacggtgcgtacaaaatcgagccagtcagtgaaggacgtggtgaggttcttcaacagaaacttccccgaggccatgcttaaagaacgacaccatacgaaggtgcagtaccagctgaaaagtgaacatattagcctggcccaagttttcagcaagatggagcaggtgagcggagtgctcggaatcgaagattatagcgtgtcacagaccacgctggacaacgtgttcgtgaattttgctaaaaagcagagcgacaacttggagcagcaggaaacagaaccgccaagcgctctacagtctcctctgggttgtttacttagccttctgcgcccacggagcgcccctaccgagttgagggctttagttgcagacgagccggaggatttagacacggaagacgagggactgatctcctttgaagaagaacgtgctcagctgtctttcaacacagacaccttatgctac

SEQ ID NO: 215348 - DNA, 7310 bp, Artificial Sequence
  Description of Artificial Sequence: Synthetic coding sequence
atgggattcttacatcaattgcagctccttttgtggaaaaacgttaccctgaagcgcagatcaccatgggtattagcctttgaaatatttattccattggtgctgttcttcatcctgctgggactccgacagaagaagcccacaatttctgtcaaagaggtcagtttctacacggcagccccactgacgtctgctggcattcttcctgtcatgcagagtctgtgtccagacgggcagcgggacgaatttggctttcttcaatacgccaactccaccgtgacacagctgctggaaaggcttgacagggtagtcgaggagggcaatctcttcgacccagccagaccatcactgggatctgaactggaagccctgagacaacacctcgaagccctgtccgctggcccaggaacctctgggtcccatctagatagaagcacggtgagctcttttagtctcgatagtgtggctaggaatcctcaggagttatggagattcttgacccaaaacctctcgctgccaaattcgacagctcaggcgctccttgccgctcgagtggaccctccagaggtgtaccatctgttattcggccctagctcagccctggatagccaaagtggcttgcacaaagggcaagagccctggtcccgactcggcggaaaccccttgttcaggatggaggaactcctcctggccccagcgctgttagagcagctaacatgcacccccggttctggagagctaggaagaatcctgactgtgcccgagagccagaaaggggcactgcaaggctatcgagacgcagtatgctcagggcaggctgctgcgagagcacgacgcttctccggcttatccgctgagctgaggaatcaacttgacgtagctaaggtttcgcaacaactggggctggatgccccaaacggctcggattcttcaccgcaggcacctccaccccgtagactccaggccctgttgggcgatctgctggatgcacaaaaggtcttacaggacgtggacgttctctccgccttagcccttcttctgcctcagggcgcatgcactgggaggacacctgggccaccagcctcaggcgctgggggagcagccaatgggaccggtgcaggcgcagtgatgggtcccaacgccactgcggaagagggagcaccaagtgccgctgccttagctacccccgacactctgcagggccagtgctccgccttcgtccaactatgggcaggattgcaacccatactgtgcggcaacaatcgaaccatagagccagaagcattgcggagaggtaatatgagtagccttggattcacttctaaagagcagaggaaccttggactactggtacacctaatgacctctaatcccaaaatcctgtacgctccggctggaagcgaagtcgatagagtcatcttgaaagccaacgaaacgtttgccttcgtcggaaatgtgacgcactacgcccaagtttggctcaacatttctgctgagattcgctcctttttggagcaggggagacttcaacagcatctgaggtggctccagcagtacgttgccgaactccgactgcatcctgaggccctcaatctcagcctggacgagctgccacccgcactgagacaagacaacttttctctgccctctggaatggcgttactgcagcagctcgatacgatcgacaatgcggcttgtggatggatacagttcatgagtaaggtcagcgtggacatatttaaggggttccatgacgaagagagcatcgtgaactataccctgaaccaggcttaccaggataacgtgactgtgttcgcttctgttatttttcagactcggaaagacggaagtctgccgcctcacgtgcactacaagatcagacagaattcctctttcacagagaagactaacgaaatcaggcgcgcatattggaggcccggtcctaacactggcggacgcttctactttctttacggatttgtatggattcaggatatgatggagcgcgctattatcgacaccttcgttgggcatgacgtggtggaaccgggaagttatgtgcagatgtttccttacccttgttacacccgggatgactttttgtttgtgatcgagcatatgatgcccttatgtatggtgataagttgggtttattcagtggcgatgactatccagcatattgtcgcagaaaaagagcacaggcttaaagaggttatgaaaacaatgggtctaaacaatgccgttcattgggtcgcttggttcattactggattcgtacagttatctatatctgtcacagccctcaccgctattcttaagtacggtcaggtgttaatgcattctcacgtggttattatctggctgtttctggctgtatacgcagtcgccacgataatgttttgtttcctagtctctgtcctgtattctaaggctaaactagcctctgcctgtggaggcatcatatattttctaagctatgtgccctacatgtatgtggcaatcagagaggaagtggcccatgacaagatcaccgccttcgagaaatgtatcgcctcactcatgagtaccacagcctttggtcttggctccaagtatttcgctctgtatgaagtcgccggagtcggtatccagtggcacaccttcagccagtcacccgtggagggtgacgatttcaatctgctcctcgccgttaccatgctcatggtggatgcggtggtatatggtatcctaacttggtatatcgaagcagtccatccaggtatgtatggcctgccccgtccgtggtatttcccccttcagaagagctactggctcggatccggacgcacagaggcctgggaatggtcatggccttgggctcgcaccccacggctttctgtgatggaagaggaccaggcctgcgctatggagagtcgccgattcgaggaaacccgtgggatggaggaagagcctactcacctaccgttggtcgtgtgtgtagacaaactgaccaaagtttacaaagacgataaaaaacttgccctaaataaattaagtcttaacctgtatgaaaaccaggtggtgtccttcctgggccataacggtgctgggaaaactacgactatgagtatcctgaccggcctatttccccctacgtctggtagtgccacaatctatggacatgacattcgcaccgagatggatgagatcagaaagaaccttggaatgtgtcctcagcacaacgtgctgtttgatcgcctgaccgtggaggaacacctctggttttacagcagactgaagtcaatggctcaggaggaaattcgcagagagatggacaaaatgattgaagacctggaactatcaaataagcgccacagcctggtgcagacactctctggaggaatgaaacggaaactatcagtcgctatagcttttgtggggggttcacgcgctatcatcctagacgaaccaacagctggtgtagatccttacgcacgcagggcaatttgggaccttatcttgaagtataagccaggtcggacaatactgctcagtactcatcatatggacgaggcagacctcctcggtgatcggatagccatcattagccacggcaaactcaagtgttgtggatctcctctgtttctgaagggcacatacggtgacggctatcgccttacactggtaaagagacccgcagagcctgggggaccgcaagagccagggcttgcaagctctccgccaggacgggcacccttatcctcttgttccgagctccaagtgtcccagtttatacgtaagcacgttgcatcctgcctgttggtgtccgacacgtctaccgaactcagctatattttacctagcgaggcagcgaagaagggtgctttcgagcgcctgttccagcacttggagcgctcgctggacgccttgcacttatcaagtttcgggctaatggataccaccctcgaggaagtgttccttaaggtctccgaggaggaccaatccctcgaaaacagcgaggctgacgtcaaagaatcacggaaggacgtgcttcccggagccgaaggtccagccagtggtgaaggtcacgcgggaaacctcgcacggtgtagtgagctaacccagtctcaggcgtcattgcaaagtgctagtagcgtgggaagtgcgcgtggcgatgagggggcagggtatacagacgtctatggcgactatcggccactgttcgacaatccacaggatcccgacaacgtatcgctgcaggaggttgaggcggaggctctctcccgcgttggccagggttccagaaaattagacggagggtggctaaaggttaggcaattccatgggctcctagtgaagaggttccattgcgctcgcagaaactcaaaagccctgttttctcagatcctgctacctgcgttctttgtgtgcgtggctatgacagtggcacttagtgtgccagagattggtgacttgccccctctcgtactctccccttctcagtatcacaattacactcagccacgaggcaacttcataccttatgccaacgaggagcgtcgcgaatataggttgaggttgtcacccgatgctagcccccagcagttggtctctactttccggttgccttctggggtgggagcgacgtgcgttctgaaaagtcctgcaaacggcagcctagggcctaccctgaatctgagctctggagaatccaggcttctggccgcaagattttttgatagcatgtgtcttgagtcattcactcaagggttgcctctgtctaatttcgtcccccctcccccatctcccgcaccatcagacagccccgcttctcctgatgaggatctgcaagcttggaatgtgtctttgcccccaacagctggcccagagatgtggacttctgcccctagcctgcccagattggtgcgtgaacccgttagatgtacatgctctgcacagggcacagggtttagttgcccctcctcagtgggcggacacccgcctcagatgcgggttgtgaccggggacatactcacagatattaccggacataacgtgagcgaatatctcctttttacttccgataggttccgtttacatcgttacggggcaattactttcggcaacgtccttaagtctatcccagccagtttcgggacgcgcgcacctcctatggtgcgcaagatcgccgttaggagagccgcacaagtgttctacaacaataaaggctatcacagcatgcccacctatctgaatagtctaaacaacgccatcctgagggcaaatctgcctaagagcaagggtaaccccgcagcttatggtatcaccgtgacaaaccaccccatgaacaaaacatctgcaagtctcagcctcgactatctgctgcagggcaccgacgtcgtcatcgcaatttttattattgtcgccatgagctttgtgcccgcatctttcgtcgtttttctggtggccgagaaaagtaccaaagcaaaacaccttcagttcgtctctggctgtaacccgattatctattggctcgcaaattatgtgtgggacatgttgaattatctggtgcctgccacctgctgtgtgatcattctgttcgtctttgacctccctgcgtacaccagtcctaccaattttcccgcagtgctatcgctcttcctcctgtatggctggtctattacccccatcatgtacccagcttctttctggttcgaagttccaagctcagcatatgtttttttaattgttatcaacctgtttatcggtattactgccacggtcgctacatttctgctgcagctgttcgaacatgacaaagacctcaaagtggtgaattcctatctgaagagttgtttcttgatcttcccaaactataacctgggccatggccttatggaaatggcctacaacgaatatattaatgagtattacgcaaaaattggccaattcgacaagatgaagtcccccttcgaatgggatatcgtgacacggggactagtggccatggctgtggaaggggtagtagggttcctgctcactataatgtgtcaatataatttcttgcgacgaccccagcgaatgcctgtatccacgaagcctgtcgaggatgatgtagatgtggcctccgagcgccaacgtgtgctgaggggagacgcagataatgacatggtgaaaatcgaaaacctgacaaaggtgtataagagcaggaaaatcggacgaatcctcgcggtggatagactgtgtttaggcgtgcgacccggagagtgttttggactgctcggggtgaatggcgctggtaagacctctacatttaagatgttaactggtgatgagtcgacgacaggaggagaggccttcgtgaatggacatagcgtgctgaaggaactgctgcaggtgcagcagtccttaggctattgtccacaatgtgacgcattgtttgacgagcttacagcacgggagcatctgcagctgtatactcgcctgcgcggaatttcctggaaggacgaggcccgtgtggtgaagtgggccttggagaaacttgagctgaccaagtacgccgataagcctgccggaacatacagcgggggaaataagcgtaaactgagtacggccatcgccctcattgggtatcctgcttttatcttcctggatgagcccactacaggcatggacccaaaagccagaagattcttatggaacctgattctggacttgatcaaaaccggcagaagcgtggtcctgacttcacatagcatggaggagtgcgaagctctttgtaccaggctggcaattatggtgaatggtcggcttcgatgcttaggctcaatccagcacctgaagaatcggttcggcgatggctatatgattactgtgcggaccaaaagcagccagtcggttaaggatgtagtgcggttctttaacagaaattttcccgaggcgatgctgaaagaaaggcaccataccaaggtacagtaccagttaaagtcggaacatatatcactggcccaggtcttctctaagatggagcaggtatccggcgtgctgggaattgaagactacagtgtgtcccagactaccttggacaacgtgtttgtgaattttgcgaaaaaacagagcgacaatcttgaacagcaagagaccgagccacccagtgctctccagtccccacttgggtgcctgctgtctttactacgacccagaagcgcacctaccgagttgagagccctggtcgccgacgaacccgaagacctggacactgaggacgaggggctaatcagcttcgaggaggagcgggctcaactcagctttaacacggacaccctgtgcta

SEQ ID NO: 215349 - DNA, 7400 bp, Artificial Sequence
  Description of Artificial Sequence: Synthetic coding sequence
atgggtaggaaaacttccagagtgcagcagggtccgcctagatcccccgcatgttccgcccatggtgagaggtcatgggggctggaatttcctccattccgttggttactgggcatcgccggacgaacacacctggccgcactcccaccatttcagtgggttcttgcatttgagatctttattccgctggttctattcttcatcctgcttggactgagacagaagaaacccactatctccgtgaaggaagtggctttttataccgcagcaccccttacatcggccggtattctgcccgtcatgcagtccctttgccctgacgggcagagagatgagttcggtttcctgcagtacgccaacagcactgtgacacagctcctggagcgcctggatcgcgttgtcgaagagggaaatctcttcgatcccgctaggccctcgcttgggagcgagctcgaagcgttacgacagcacctcgaggccctttccgccggacccggtaccagtggtagtcacctagataggtccactgtctccagtttttccttagacagtgttgccagaaacccacaagagttatggaggtttttgacacaaaaccttagccttcccaactccacagctcaggcactcctggcagctagagtggatccacctgaggtatatcatctcttatttgggccttcttcagctctcgatagtcagtctggcctgcacaagggacaggaaccgtggagtcggctgggcggaaatcccctgtttcggatggaggagctactgctggccccagccctgttagaacagctaacgtgcacgccaggaagcggagaacttggacggattctgaccgtgccagaaagccagaaaggtgcccttcaggggtaccgggatgcggtttgttctggacaggcagctgcaagggcccgtcgcttctccggattgtctgccgaactgagaaaccagctcgacgtggcaaaagtgagtcagcagctgggcttggatgctcctaatggatctgacagttctccacaggcaccaccgccacggcgacttcaggcactgctaggagacctcctggatgctcagaaggtactgcaggacgtggatgtgctctcagctcttgctctgcttttgccacagggtgcctgcactggacgaacacctgggccaccagccagcggagctggcggtgcagccaatggcactggcgcaggcgctgtgatgggtcctaatgccactgccgaggagggcgctccatcagctgcagctttagctactccagatacattgcaggggcagtgttccgccttcgttcaactttgggccggtctgcagccaatcttgtgtggcaacaaccgtacaattgagcctgaggctctccgtcggggaaacatgagctcccttggattcacgagcaaggagcagcgtaacctgggactactcgtgcacctgatgacgtccaatccaaaaattctgtacgcgccagcgggatccgaagtggaccgggtaattttgaaggctaatgaaaccttcgcttttgtgggaaatgttacgcattacgcacaggtgtggctcaacattagtgctgagatcaggtcctttttggagcagggcaggttacagcagcacctaaggtggctccaacagtacgttgctgagttgaggctgcacccagaggcactaaatctcagtctagatgaattgcccccagccttgcggcaagacaatttctctctgccatctgggatggctcttcttcagcagctggatacaatagacaacgccgcttgcggttggattcaattcatgtccaaagtctctgtcgacatcttcaaagggtttcacgatgaggaatccatagtgaactacacactgaatcaggcctaccaggataatgtgactgtctttgccagcgtcatatttcaaactcggaaggatggcagtctgccccctcatgttcactataaaatcaggcagaactcttccttcactgagaaaacaaacgaaattcgtagagcttattggcgccctgggcctaataccggaggtagattttatttcctgtacggttttgtttggattcaggatatgatggaaagggctatcattgacacgttcgtgggccatgacgttgtggaaccaggatcctacgtgcagatgttcccttacccatgttatacaagggacgatttcctctttgtcatcgagcatatgatgccgctttgtatggtaatttcctgggtgtacagtgtcgctatgaccattcagcacattgttgccgaaaaggagcatcggcttaaggaggtaatgaagacgatgggccttaacaatgcagtgcactgggtcgcatggtttattaccggcttcgtgcagctctcaatttccgtgacggcccttaccgctattctcaaatatgggcaagtcctgatgcattctcacgtggtgatcatttggctctttcttgctgtgtatgctgtggcaactatcatgttctgctttttggtgtccgtgctgtactccaaggctaagcttgcatccgcttgcggaggaattatttattttctgagttacgttccgtatatgtatgtagccattagagaagaggtcgcccatgataaaattactgctttcgagaagtgcatagcctcacttatgtccacaaccgcttttggattggggagcaaatatttcgccttgtatgaggttgcaggcgtgggcatccagtggcatacattctcacaaagtcccgttgagggagacgacttcaatctgctgctggcggtgaccatgctgatggtggatgcggtggtgtacgggatcctgacttggtacatcgaagccgtacaccctggtatgtatggtctgcccagaccatggtacttcccgctgcagaagagctactggctgggctcaggaaggactgaggcctgggaatggagctggccatgggctaggacccctagactgtccgtaatggaggaggaccaggcctgcgctatggagtcaagacggtttgaagaaacacgaggaatggaggaggagcccacacatctgccactcgtagtctgtgtggataaactcaccaaggtatataaggacgataaaaagctcgcgctcaacaaattgagtctgaatctgtacgagaaccaggttgtgtcattcctgggacacaacggtgctggcaaaaccaccaccatgtccatcctcaccggtctgttccccccaacttcaggttccgcaaccatttatggacatgacattagaaccgagatggatgagattcgtaagaacttagggatgtgtccgcaacacaatgtcctcttcgataggttgaccgtggaggagcacttgtggttttattcccgcttgaaaagcatggcccaggaagaaattcgcagggaaatggacaaaatgatcgaggacttggaacttagtaataaaagacactcactggtgcagaccctgagtggcggtatgaaaagaaagctctctgtagctatcgccttcgttggcggatcgagggcgataatcctggacgagccgacagctggcgtcgacccctacgcaagaagagctatttgggacttgatactgaagtataaaccaggcagaactatactgttgagcacacaccacatggatgaggctgacctgctgggcgacagaatcgctatcatcagccacgggaaactgaaatgctgtgggtcccctttgttcttaaagggaacgtacggcgatggataccggcttactctagtgaagcggccagcagaaccaggtggtcctcaagagcccggtttagcctccagtccccctggaagggcacctctgtcatcctgtagtgagctgcaagtgtcccagtttatccgcaagcacgtcgccagctgtttactggtgagtgatacttcaaccgaactctcatatattctccctagcgaagctgcaaaaaaaggggcattcgaacggctgtttcaacatttagagcgatcactggacgcgttgcacctgagctcgtttggactcatggacacaaccttggaggaggtgttcctgaaagtaagtgaggaagaccaatcactcgaaaattcagaagccgacgtaaaggagtcaagaaaagacgtgctgccgggagcagagggaccggctagcggggaagggcacgctgggaatctcgccagatgtagcgaactgacccagtctcaagcctctcttcagtcagcgtcaagcgtgggtagtgccaggggcgacgaaggagccggatacacagacgtctacggggattaccggcctctctttgataacccacaggaccctgataatgtgagcctgcaagaggtggaagcagaagctctgtcacgggttggccagggcagcaggaaactggatggcggttggcttaaagttaggcagttccacggacttctcgttaagcggttccattgtgcacggcgaaacagcaaagctctgttttcgcagattctgctgcctgcatttttcgtgtgtgtggccatgaccgtggccctctccgttccggagatcggggatctgccacctctggtcctctctccttcgcagtaccacaactacacgcagccacgaggaaatttcattccatacgccaacgaggagcggagggaatatagactgcgactatcccctgacgcaagtccccagcagctggtcagtacatttcgtctgccatccggcgtgggcgctacgtgtgtgctcaaaagtcctgctaatgggtccttaggacctactctcaacctgtcttctggcgagtccagattgctggcggctcgctttttcgacagcatgtgtctggagtcattcacacagggcttgcccctttctaactttgtgcctccccctccttctccagctccgagtgatagtccagccagtccagatgaagatcttcaggcctggaacgtcagccttccgccaacagccggacctgagatgtggacatcagccccttcactcccaaggcttgtcagggaacctgtgcgatgtacctgttctgcccagggcaccgggttctcatgtccatcaagcgtaggcggtcacccgcctcaaatgcgcgtggtaactggggatatattgacagacatcactggccacaacgtgtctgaatatttgctcttcacttcggatcgctttcgcctccatcgatacggagctatcacgtttggtaatgtgctgaagtccattccagcctcttttggaacgcgcgcaccacccatggtacggaagatagctgtcaggcgagccgctcaggtgttttacaataacaaaggctatcacagcatgcccacctacttgaattccctgaacaatgccatcctccgagccaatttgccaaagtccaagggcaatcctgctgcgtacggcatcacagttaccaaccacccaatgaataaaacctccgcttccctgagtctcgattaccttctacagggcaccgatgtcgtgatcgcaatttttattatcgtcgctatgtcattcgtgccggcatcattcgttgtcttcttggttgcagaaaagagcacaaaagcaaagcatctccagttcgtgtccggttgcaatcccattatctactggctagcaaattacgtgtgggatatgctgaactacctagttccagctacgtgttgcgtgataatacttttcgtgttcgatctacctgcctatacctctcccacgaactttccagctgtgcttagtctgtttcttctctatggatggtctattacacccatcatgtatcccgctagcttctggtttgaggtaccctcaagcgcctacgtgtttctaattgttataaacctgtttataggcatcacagccaccgtggctaccttccttctgcagctgttcgagcatgacaaggatctcaaggtggtgaattcatatctgaagtcttgttttttgatattcccgaattacaacctcggacatgggttgatggaaatggcttacaacgaatacattaatgaatattacgcaaagatcgggcaattcgataaaatgaaatccccattcgagtgggatatcgtcacccggggtttagttgctatggcagtggagggcgttgtggggttcctgctgacaattatgtgtcagtacaactttctgagaagaccccagaggatgccagtaagcacaaagcccgtggaggacgacgttgatgtggcgtcagaaaggcagcgagtgcttcgaggcgatgcggacaacgacatggtcaaaatcgagaaccttaccaaggtatacaaatccaggaaaatcgggagaatccttgcggtcgatcggctttgtttaggagttcggccaggtgagtgttttggcctgctgggtgttaatggcgctggaaagaccagcacatttaaaatgcttactggggacgagagcaccaccggcggtgaagcctttgtgaatggccatagcgtcctgaaggaactgcttcaagtgcagcaatccctcggctattgtcctcagtgtgatgccttatttgacgaactcacggctcgcgaacacttgcaactgtacactagattgcgtggcataagttggaaagacgaagcccgagtcgtgaagtgggctttagaaaagctggaactcaccaaatacgcggataaacccgctggtacctattctggagggaacaagaggaaactgagcaccgccatcgctcttattggataccctgccttcatctttctggatgagcccacaaccggaatggatccgaaagccaggcggtttctgtggaacctgatcctcgacttgattaaaaccggccgatcggttgtcctcaccagccatagcatggaagaatgcgaagcactttgtacccgcctggcgattatggtgaatggtaggttgcgctgtctcgggtcaattcagcatctgaagaatcggtttggggacggttacatgatcactgttcggaccaagtccagtcagtctgtgaaggatgttgttaggttctttaacagaaacttcccagaagcgatgctcaaggagcgacatcatactaaggtgcagtaccaattaaagtcagagcacatatcgcttgcccaggtgtttagtaaaatggaacaggtatctggtgtgctgggaatcgaggattactcagtttctcagactacattggacaacgtatttgtgaacttcgccaaaaaacagagtgacaacctcgaacaacaggaaactgagccccctagcgctctccagtccccgctgggctgcctgttatccctgctgcggccacgatctgccccaaccgagcttcgtgccctcgtagccgatgagccagaggatctcgacaccgaggatgagggattaatcagcttcgaggaggaaagagctcagttgagctttaacacagatacgttgtgtta

SEQ ID NO: 215350 - DNA, 7307 bp, Artificial Sequence
  Description of Artificial Sequence: Synthetic coding sequence
atgggcttcttacatcagctgcaactcctcctttggaaaaacgtgacactgaaaaggcggagcccctgggtgcttgctttcgaaatcttcataccacttgttctgttctttatcttgctgggactgagacagaaaaagcctacaattagtgtgaaagaagcgttttatacagcagctcccttgacctcggccggtatacttccagtcatgcaaagcttgtgccccgacggccagagggacgagttcgggttccttcaatatgctaactcaactgtaacgcagctcctggaacggctggacagagtcgtcgaggaggggaacttgttcgatccggctcgaccttccctcggcagcgaactggaagcgttacgccagcacctcgaggccttgtctgcaggtcccggaacgtccgggtctcatctggatcggagcactgtgagcagtttctctcttgattcagttgcgaggaatccgcaggaactgtggaggtttttgacccagaacttatctctgccaaatagcacagcgcaagctctcctggctgcacgcgttgaccccccagaagtgtaccatttattgttcggtcctagttccgccctggactcacagtcagggctccacaaaggacaggagccgtggtccagattaggagggaaccccttgttccgtatggaggagttgcttttagccccagctcttctggaacagcttacttgcacaccaggatccggtgagctggggaggattttaacagtccccgaatctcagaaaggggcactgcaaggatacagggacgcagtgtgttccggacaggctgctgccagggcacgacgctttagcggtctgagtgccgagctacgcaatcagctagatgtagcaaaggtgagtcaacaactcggtctagatgctccaaacggctctgactcttcaccccaggcgccacctccacggaggctccaggcactgctcggagatttactcgacgcccagaaggttttgcaggatgtggatgttttaagtgccttggcactacttctgccccaaggggcatgcaccggcagaacccccggacctcccgcttcaggagccggaggcgctgctaacggcaccggtgccggagctgttatgggacctaatgccaccgctgaagagggggctccctcagccgcagccctcgctacacctgacaccctgcaaggacagtgctcagcatttgtccagttatgggcgggtttgcaaccaattctgtgtggtaacaaccgaaccatcgagccagaagcattgcggagaggcaatatgtccagtcttggctttacctccaaggagcagcggaatcttggcctgctggtgcacctgatgactagcaaccctaagatcttatacgcaccagccggatcagaggtggatcgcgtgatcctcaaggcgaacgagaccttcgccttcgttggaaacgtaacacactatgctcaagtgtggctgaacatcagtgcggagatccgctcattcctcgagcaggggcgtctgcagcagcacctgcggtggctccaacagtacgtggccgagcttaggctccaccctgaggcccttaatctgtctctggatgaactccctcccgctctgcgacaggacaacttcagccttccttccgggatggccctactccaacagctggatacaatcgataatgcggcatgcggctggatccagtttatgagcaaggtgtcagtggatatcttcaaaggcttccatgacgaagagtccatcgtcaattacaccctcaaccaagcgtatcaggataatgttaccgtgtttgcatccgtgatctttcaaaccaggaaggacggaagcctcccacctcacgtccattataagattcgccaaaattcctcttttaccgagaaaactaacgagatacggagggcatattggcgcccaggacctaacaccgggggacgtttctacttcctgtacggcttcgtctggattcaagacatgatggagcgggcaatcattgacacctttgttggccacgacgtggtcgaaccgggatcatatgtccagatgttcccctatccttgctacacgcgcgatgacttcctcttcgtgatcgagcatatgatgcccctatgtatggtgatatcttgggtatattccgtggctatgactattcaacatatcgttgccgaaaaagagcatcgccttaaggaagtaatgaaaaccatgggacttaacaacgccgtgcattgggtggcatggttcatcaccggctttgtccagctgagcatctcagtcacagccctgaccgccatattgaagtacggacaggtgctgatgcacagccatgtcgtgatcatttggctttttttagcagtatatgcagtcgcaacaatcatgttctgctttctggtgtcagtgctgtattctaaagccaagctggccagtgcttgcgggggtatcatttactttctgtcttatgtgccctacatgtatgtcgcgattcgtgaagaggtggcacatgataagataactgcttttgagaaatgcattgctagtctgatgtctaccaccgctttcggcctaggaagcaaatatttcgccctgtacgaagtggccggagtgggtatacaatggcacaccttctcacagagccctgtagaaggcgatgactttaatctgttattggccgtaacaatgctgatggtagacgcagtggtctatgggattttaacatggtatattgaggccgttcacccaggtatgtacggcctccccagaccttggtacttcccactgcagaagtcttactggctaggatcgggtcgaaccgaagcttgggaatggagttggccgtgggctagaacgccgcgattgagcgtgatggaggaggatcaggcatgcgccatggaaagccgtcggttcgaggagacccgcggtatggaggaagaaccgactcatctgcccctggtcgtttgcgtggataaactcacaaaggtctacaaggacgataaaaaactggccctgaataagttgtctctgaacctctacgaaaaccaagttgtctctttcctcggtcacaatggagccggaaagactacaaccatgtccattctcaccgggcttttcccccctaccagcgggtccgctaccatatacggccatgacatcagaactgaaatggacgagatcagaaagaatttaggtatgtgccctcagcacaacgtgctgtttgatcggctcacggtggaggagcatctttggttttattcccgattaaagtctatggcccaggaggagattagaagggagatggataaaatgattgaagacctggaactatccaacaaacgacatagccttgtgcaaactctcagcgggggtatgaagagaaaactgtccgtcgccatcgcgtttgtggggggatctagggcaattatcttagatgagcctaccgccggtgttgacccctacgccagaagagcgatttgggaccttattctgaagtacaaacccggtcggaccatcttgctgtctactcaccacatggatgaagctgatctgcttggagaccgtatcgctatcattagtcacggtaaactcaagtgctgtggctcccctctgtttttgaaaggtacctacggtgatggctatcgactcaccctcgtgaagagacccgctgagcctggaggcccacaagagcccggtctggcctcgagccctcctgggcgtgccccactgtcaagctgttcagagctgcaggttagccagttcatacgcaaacatgtggccagttgtctgctggtctctgacacaagtactgagttgagctacattcttccctctgaggctgccaaaaaaggtgcttttgaacgcctgtttcaacacctggaaaggtcactggacgctttacatcttagctcctttggtctgatggacactactctggaagaggttttcctcaaggtgagcgaagaagaccagtctttagagaactctgaagccgacgttaaggagagccggaaagacgtgctgcctggcgctgagggacccgcttccggggagggacatgcgggtaatctcgccagatgttccgagttgacccagtcccaggcaagtctgcaaagcgcatcctcagtcggcagcgctcgcggtgacgagggcgctggttacacagacgtgtatggagactatcggcctctttttgataaccctcaagatccagataatgtgtctctccaggaggtggaagccgaggccctgagtcgtgttggacaaggttcacggaaactggatggaggctggctgaaggtgaggcagttccacgggctcctggtgaaaagatttcactgtgccagaagaaattccaaagctctcttttcccagatccttctgccagccttctttgtctgtgtggccatgacagtggctttgtctgtgcctgaaattggtgacctacctcctttagtattaagcccgagccagtaccacaattacacccagccaagaggcaactttatcccttacgccaacgaagagcgccgtgaatatagactccggctctcacctgatgcgtccccccaacaacttgtgagcacctttagactgccttccggtgtcggtgctacctgtgtactgaagtccccagccaatggcagcctgggtcccaccctgaacctgtccagtggggagtccagattgttggcggctcggttttttgactctatgtgtcttgagagcttcacacaagggctcccactctcaaacttcgtgcctccacctccttccccagccccaagcgactcccccgcaagcccagacgaggatctgcaagcttggaacgtgtccctcccccctacagctggcccagagatgtggacttccgctcctagcctgcctagactcgtaagggagccagtgagatgcacgtgctctgcacagggcaccggattttcgtgcccgtcttccgtcggcggtcacccccctcaaatgagagtcgtgacaggtgatattttaaccgacatcacaggtcataatgtttccgaatacttgctattcacgtcagatcgcttccgattgcacagatatggcgctattacctttggaaatgtcctgaagtctattcccgctagtttcgggaccagggccccacccatggtacgcaagattgccgtgcgacgggctgcccaggtattctacaacaataaaggctaccattccatgccaacttacttgaatagtcttaataacgccatcctgcgagcaaatttgccaaagtctaagggtaaccccgcagcgtacggcatcacagtgaccaaccaccctatgaacaaaacatctgcctccttgtccctggactatctcctccagggaacagatgtggtcattgctatttttattatcgtggcaatgagcttcgtgccggctagttttgtagtgtttctagtggccgagaagagtaccaaagctaaacatctgcagttcgtgagtggctgtaatccaataatttattggctggctaactacgtgtgggacatgctaaactatctcgtgccagccacatgttgcgtgatcattctttttgtatttgacttaccggcttacacctctcctacaaacttccctgctgtcctgagtctgtttctattatacggctggagcatcacacccatcatgtatcccgcaagcttctggtttgaggtgccaagcagtgcttatgtcttcttgatcgtcatcaatctgtttataggcattaccgccaccgtcgctaccttccttctgcagctcttcgaacacgacaaagacctcaaagtggtaaactcatatctgaagtcctgttttctaatctttcccaactacaatctaggccatggtctgatggaaatggcatacaatgagtacattaacgagtattatgccaagataggccagtttgacaaaatgaagtccccatttgaatgggacattgtgacccgtggcctggtggcgatggcggtggagggcgtggtgggctttctgttgacgatcatgtgtcagtacaatttcctgaggaggccccagagaatgcccgtctcaaccaagccggtagaagacgacgtggacgtagcctccgaacggcagagagtcctgcgcggagatgccgacaacgacatggtgaagatcgagaatctcacaaaggtttataagagccgtaaaatcggtcgcattcttgcagtcgaccgtctgtgtctgggggtacgacccggtgaatgttttgggcttctgggggttaatggcgcaggaaagacatcgacattcaagatgctcactggagatgaatccactactggaggggaagccttcgttaacggtcattctgtcttgaaggaactgctccaggtgcagcaaagccttggttactgtccgcagtgtgacgccctgttcgatgagttaaccgctcgggaacatctccagctttacacacggttgcgcggaattagttggaaggatgaagcacgcgttgttaaatgggcgttagagaaactggaattgactaagtacgcagacaagccagcaggtacttactccggaggcaataagcgcaaactctccaccgctatcgctctgattggctaccccgcattcatcttcttggatgaacccacaacaggcatggatcctaaggctcggagattcctgtggaatctgatcctggacttaattaagaccggacgatctgtagtgctgacttcccattccatggaagaatgtgaagccctgtgtaccagacttgctatcatggttaatggcaggttaaggtgtcttggatcaatccagcatcttaagaatcgcttcggagatggctatatgattaccgtacgcacaaagagctcacaaagtgtgaaagacgtggtccgcttttttaaccgcaatttccctgaggccatgcttaaggaaagacaccatacaaaggtacagtaccagctcaaatccgaacatatctctctcgctcaggttttttctaaaatggaacaggtttctggcgttctgggcattgaggactacagcgtgtctcagactacattggataacgtcttcgtgaattttgcgaagaaacagtctgacaacctcgaacagcaagaaacggagcctccatccgcactgcagtctcctctgggctgtcttctgagcttgctccgcccacgaagtgcgcctacagagctccgagcgcttgtggcagatgagccagaggaccttgacacagaagacgaagggttgatttcattcgaagaagagcgagcccagctctcttttaacactgataccctttgcta

SEQ ID NO: 215351 - DNA, 591 bp, Artificial Sequence
  Description of Artificial Sequence: Synthetic coding sequence
atgctgacaggcgacgaaagtactactggcggtgaggcttttgtcaacgggcattccgtgctgaaggagctgctccaggtccagcagtccctgggctattgtcctcagtgcgatgcactgtttgacgagttaaccgcccgtgagcatcttcagctgtatacaagattacgcggtatttcctggaaggacgaagcgagagtggtgaagtgggccctggaaaagctggaattgacgaaatacgcagacaagcccgctggtacgtattctggcggaaataagcgcaaactgtctaccgcaattgcgcttataggatatcccgctttcatatttctcgacgaacccaccaccggtatggatcccaaagcacggaggttcttatggaatctcatcctggatctgatcaaaaccggccgaagcgtggtactgacctcacatagcatggaggagtgtgaggccctgtgcactagactagccattatggagaggtccccagctgtgcccggacagcatcctgcccctgaagagcctgtctggcggtggctgcacgatcatggagctgatcaggaacagccagaatgcgagggacgttag

SEQ ID NO: 215352 - DNA, 5114 bp, Artificial Sequence
  Description of Artificial Sequence: Synthetic coding sequence
atggcagtcttacgacagctcgctctgctcctctggaaaaactatacactgcagaagaggaaggtgctggtgacagtgctcgagctgtttctgcccctgctgttctccggcatattgatttggttgcgcttgaagatacaatccgagaacgtacctaatgccacaatttaccccggtcagagcatccaggagctccctctcttctttacttttcctcctcccggtgacacatgggaacttgcttatatcccgagccattccgatgccgcaaaaacagtgaccgagaccgtccggagggccctcgtgatcaatatgcgcgtacgaggctttcccagcgagaaagacttcgaagattatatcaggtacgacaactgttcctctagtgttttagccgctgtggttttcgagcatccgtttaatcacagcaaggagccacttcctctggccgtgaagtaccatctacgcttttcatatactcgaagaaactatatgtggacccagacaggctctttcttcctgaaagaaactgagggttggcataccaccagtctgtttccactctttcctaaccccggtcctagagagccgacttccccagacggcggtgagcctgggtacattagggagggatttctggcggttcagcatgctgtggatcgggctatcatggagtatcatgccgacgccgctacacggcagctctttcaacggctgaccgtcaccatcaaaaggttcccgtaccccccattcatcgcagacccttttctcgtggctattcagtatcagctcccactgctgctactgcttagctttacatacaccgccctgactattgcgcgagctgtggttcaagaaaaagagcgaaggctgaaagaatatatgcggatgatgggcctttcttcctggttgcactggtctgcatggtttctgttattctttctcttccttttaattgcagcctcgttcatgacgttactgttctgtgtgaaggtcaaaccaaatgtggccgttttgtcccggtccgatccgtcgttggttctggccttcctgttgtgcttcgccatatcgacaattagcttttctttcatggtgtccacttttttcagcaaggcaaacatggcggcagcattcgggggattcctgtatttcttcacatacatcccctatttcttcgttgcgccacgatacaattggatgacactgtcccagaaattgtgcagctgtctgctgagtaacgttgccatggccatgggcgcacagctgatcggaaagtttgaggcaaaaggcatgggcatccagtggcgtgacctacttagtcccgtgaatgtggacgatgacttctgtttcggccaggtcctgggtatgcttctgctcgattccgtcctctatggcttggtgacctggtacatggaagccgtgttccctggacaattcggtgtaccacagccatggtacttttttattatgccatcatactggtgcgggaaaccgagagcggtcgcaggcaaagaagaagaggatagcgaccctgaaaaggctttgaggaacgagtattttgaagctgaaccggaggacttagttgcgggaattaagattaagcatctctcgaaggtgtttcgggtgggaaacaaggaccgcgctgcagtgcgggacttgaatctgaatctttatgaggggcaaattaccgtgcttctgggccacaatggagctggcaaaactaccaccttgtccatgcttacagggctgtttccaccgacatctggcagagcttacatttctggctatgaaatatcacaggatatggtgcaaatccgaaaaagcctgggcctttgtcctcagcatgatattctatttgataacctgacagttgcggaacacttatatttctacgcccaactaaagggactatcgaggcagaaatgtcccgaagaagttaagcagatgctgcatattataggcctggaggacaaatggaattccaggtctaggttcctctctggtgggatgaggagaaaactatcaatcgggattgctctcattgcaggatctaaagtcctcattctggacgaaccgaccagtggcatggacgccatcagccggcgagcgatctgggacctgcttcagcgccagaagagcgaccggacgattgtgcttactacgcactttatggatgaggcagatctcctgggggaccggatcgcaatcatggcgaagggagagctacagtgttgtggatcaagtctgtttctcaaacagaagtatggcgcaggctaccatatgaccctagttaaggaaccccactgcaatcccgaggacatttcacagctcgtgcaccatcatgtgccaaacgccactttggagtcttccgcaggagcagagttatcatttatcctgcccagagagagcacccacagattcgagggactgtttgcaaagcttgagaagaagcagaaggaactcggcatcgcaagtttcggagcgtctattactaccatggaagaagtcttcctgcgtgtgggaaagcttgtggatagtagcatggatatccaggctatacagctacctgcgctccagtaccaacatgagcggagggcctccgattgggcagtcgatagtaatctgtgcggcgcaatggatccaagtgatggtattggagcgttaatcgaggaagaacgaaccgcggtcaaactcaatacgggtctggctctccactgccagcagttctgggcaatgttcctgaagaaggcagcttactcttggcgggagtggaaaatggtcgccgctcaggtcctggtcccgctgacctgcgtcaccttggctttacttgccattaattattccagtgagctgtttgatgaccccatgctgagacttacgctcggcgaatatggtcgcactgtcgtacccttttcagtaccaggtacgtctcaattgggccagcaactgtccgaacacctcaaggatgctctgcaggcggaggggcaggaaccccgtgaggtgttaggcgacctggaggagttcttgatcttcagggccagcgttgagggaggaggatttaacgaaagatgcctggtcgctgcttccttcagagacgtgggtgaaaggactgtggtaaacgcactgttcaataatcaggcctaccattcacccgcaactgctttggccgtggtcgataacctcctatttaaactgttgtgcggtcctcacgcatctattgtcgtcagtaactttccacagcctaggagtgctctgcaggccgcaaaagaccagttcaacgagggcaggaagggttttgacatcgctctgaacttgctgtttgcaatggccttcctcgcaagcacgttcagtatactggcggtgtctgagcgcgcagttcaggctaaacacgtgcagttcgtcagcggtgtgcatgtggcctccttctggctgtctgcactcctatgggatttgatctcatttctcatcccgtccctgttattattggtcgtctttaaggccttcgacgtgagagcatttacaagagacggacacatggctgacacccttctgcttctcctactgtacgggtgggccatcattcctctcatgtacttgatgaattttttttttctgggtgctgcaactgcatatacaagactcaccatcttcaacatcctcagtggcatcgcaaccttcttgatggtcaccataatgagaattccggctgtaaagctggaggagctctccaaaactctggaccacgtttttttggtcctgcccaaccattgcttaggcatggccgtgagctcattttatgagaactacgagacacgtaggtattgtaccagctccgaagtagctgctcactactgcaagaagtataacatccagtaccaggaaaacttttatgcgtggtctgcccctggcgttgggagatttgtggcctctatggctgcctcaggctgtgcttatctgatcttgctctttctcattgagactaatttgttgcagaggctccgaggcattttgtgtgcgctgagacgcagacgaacactcaccgagctgtatactaggatgccagtcttaccagaggatcaggacgtcgctgacgagaggactcggattctcgccccatccccagattctttgttgcatacacccctgatcattaaggagctttccaaggtgtatgaacagcgagttccacttcttgctgtcgataggttgagtctggcagtgcagaaaggggaatgtttcggcctgctgggcttcaacggagcgggaaaaaccactacgtttaaaatgttgacaggcgaggaatcactaacctctggagatgctttcgtgggagggcaccggatctcgtccgatgtgggaaaggtgcgccagaggattggatactgccctcagttcgatgccctcctggaccacatgactgggagggagatgctggtgatgtatgctagactgcgaggaattccagagcgccatattggagcctgtgtggagaataccctacggggactcctgttagaacctcacgcaaataagcttgtgagaacttacagtggtggaaacaagcgcaagctttctacaggcattgcactgatcggtgagcccgctgtgattttcttggatgagcccagtacaggaatggaccctgtggcccgaaggctcctttgggataccgttgcgcgagccagagagagcggtaaggctattataattacttctcacagcatggaagaatgcgaggccctctgtacacggctggctattatggttcaggggcagtttaagtgcctgggtagccctcagcacctcaaatccaagtttgggtccggttactccttgagagccaaggtgcagtcggagggccaacaggaggcactcgaagagttcaaagcctttgttgatcttacctttcctggttcagtgctggaggatgaacatcagggtatggtgcattatcacctgccagggagagatctctcttgggctaaggtgttcgggatcctcgaaaaggctaaagaaaagtatggagtggacgattacagtgtgtcccagataagcttagaacaggtctttcttagtttcgctcacctccaacccccaacagcggaggaaggccgtta

SEQ ID NO: 215353 - DNA, 5126 bp, Artificial Sequence
  Description of Artificial Sequence: Synthetic coding sequence
actgcccctcctcctagcccttcactccccctacaagatcgcgctgccacgagtgcccacctggctctctttacactttctttccagtcgacgtttctgttattccccgcagggtgtagcgcttatctgaacttgctgagacctcctaccagtttggctgctttgggtgtaccattttcaaagacaatggctgtgctacgccaactcgcgctgctcttgtggaagaattacactcttcagaaaaggaaggtccttgtgacagtacttgaactgttcttgcccctcctcttcagcggcatcctaatctggcttaggctaaaaattcagtccgagaacgtacctaatgccaccatttatcctgggcagtctatacaggagttacccttattttttactttcccacccccaggcgacacatgggaactcgcctacataccctctcatagtgatgccgctaagaccgtaactgaaacagtacgacgcgcactcgttatcaacatgcgggtgcgaggcttccctagtgagaaagacttcgaggactacatccggtacgataattgttcctcaagcgtgctagcagccgtcgtatttgagcacccctttaaccattctaaagaacccttgcctctggcggtgaaataccacctccggttttcttatacacgtcgaaactacatgtggacgcaaacaggttcattcttcctaaaggagacggaaggctggcacactacgtcattatttccattattccccaacccgggtccacgagagccaacttcacccgatggcggtgaacccggatatataagggagggattcctggccgtacaacatgcagtggaccgcgcaatcatggagtaccacgctgacgctgcaactagacaactgtttcagagactcactgtcacaataaagagattcccttaccctcctttcatcgccgatccgttcctggttgccattcagtaccagttgcccctccttctcctgctatcatttacgtacactgctttgacgatagctcgcgcagtggtgcaggaaaaggaaaggcggctcaaggagtatatgaggatgatgggcctctccagctggctccactggagcgcttggttcttgctattctttttgttcctactgattgccgctagctttatgacactgctattctgtgtgaaggttaaaccaaacgtagccgtgctaagccgatccgacccctccctggtgctcgctttcctgttgtgtttcgccattagtaccatctcatttagtttcatggtgtctacatttttctcaaaggggatgggtatccagtggcgggacctcttgtctcctgttaacgtggacgatgacttttgtttcggccaggtactgggcatgctgctcttggatagcgtgctgtacggcctcgtgacctggtacatggaggccgtgtttcccggacaattcggggtccctcaaccctggtatttcttcattatgccctcctactggtgcggcaaaccgagagcagtggccggaaaggaggaggaggattccgatcctgaaaaggccttacgcaacgaatacttcgaagcagagcccgaggatctcgtcgccggaattaagatcaagcatctgtccaaagtgttcagagtggggaacaaggacagagctgcagtgagggacctgaatctgaatctctatgagggccagatcacagtcctgttaggtcacaacggcgctgggaagaccacaacattaagtatgctcactgggctcttcccccctacttcaggcagggcatacatctcaggctatgaaatttcccaggatatggttcagatccgtaaatccctggggctctgcccacagcacgacatcttgttcgataacctgaccgtggctgagcacctgtatttttacgcacagctgaaaggcctgagcaggcagaagtgcccggaagaggtgaagcagatgctgcacataatcggactggaagacaagtggaactcccgcagccggttcttgtctgggggaatgcgacggaagctatctatcggcatcgccctcattgccggatcaaaggttctgatcttggacgaaccaacttcagggatggacgccatcagccgaagagctatctgggatctcctgcagaggcagaaaagtgataggacaatagtattgaccacacacttcatggatgaagctgacctgctgggagacagaattgcgattatggcaaagggggaattgcagtgttgcggaagtagcttatttctgaaacaaaagtacggcgcagggtaccacatgaccctggtcaaggagcctcattgcaacccagaggatatatctcaacttgtgcatcatcatgtccctaacgccacccttgaatcttcggcaggagccgagctcagcttcatcttaccacgagaaagcactcataggttcgagggcctgttcgctaagcttgagaagaagcagaaggagttgggaatcgccagtttcggagcaagcatcacgactatggaggaggtctttctgagagtggggaaactcgtggatagctcgatggacatccaggccatccagctcccagccctccagtaccaacacgagagaagggcttcggactgggctgttgacagtaacttgtgcggcgctatggacccatctgatggaataggcgcattgatcgaggaggaaagaactgcagttaagctaaatacaggtctcgcactccattgtcagcaattttgggctatgttcctgaagaaagccgcttattcttggcgggaatggaagatggttgccgcacaggtactagtgcctctcacttgtgtgaccctggcactgctggcaattaactacagtagcgaactattcgatgacccgatgctgcgcctcaccttaggcgaatatggaagaacagtggtgccattctccgtgcccggaacaagccagctgggtcaacagctcagcgagcatcttaaagatgctcttcaagctgaaggtcaagaaccgagggaagtgttgggtgacctggaagagtttctgatttttagggcctccgtagagggcggaggcttcaatgagagatgcctcgtggccgcatcatttcgggacgtcggcgagcgtacggtggtgaacgccctcttcaacaaccaagcatatcactccccagcgacagctttagccgtggtagataatctcctgttcaaactgctgtgtggaccccatgcatctatagtcgtgtcgaactttccccagccgaggagcgctttacaagctgcaaaagatcagtttaacgaggggaggaaaggctttgatatagcccttaacctcttatttgccatggcatttttggcatcaacctttagcatactcgctgtttctgagagggctgtccaagctaagcatgtccaatttgtgtccggcgtgcatgttgcttcattttggctttctgcgctgttgtgggatttgatctcgttcctgattccctccttactgctactggtggtttttaaagccttcgacgtgcgagcttttacaagagacggccacatggccgatacactactgctcctacttctgtatggctgggcaatcatcccgctgatgtacttgatgaactttttttttctgggtgccgcaacagcctacaccaggctgactattttcaacattctgtctggcatcgcgacgttcctaatggtgactatcatgagaatccctgcggtaaagctggaggaactgtctaaaactctggaccacgttttcctcgtgttgcccaaccactgcttgggtatggcagtgagctcattctacgagaattatgagacccggcgatattgcacatcatccgaggtggctgcccattactgcaaaaagtacaatatccagtatcaggagaatttctacgcctggtcggccccaggggtagggagattcgttgctagtatggccgcttctggatgcgcttacctgatcctgttgttcttgatcgaaaccaatctactccagcggcttaggggaattctgtgcgcactgcgtcggcgaagaacactcaccgagttatacacccgcatgccagtactgcccgaggatcaggacgtggcagatgagagaaccaggatcctcgccccatcaccagacagcctcctgcatactccactgatcattaaagaactttctaaggtgtacgaacagagggtccctttgctggcagtcgaccggctgtccctcgctgttcagaagggggagtgtttcggactgcttggtttcaatggtgctggaaagaccactacttttaagatgctgaccggggaagagtctctgaccagtggcgatgcgttcgtcggagggcataggatcagctctgacgtggggaaagtgagacagcgcatcgggtactgtccacagtttgatgcgctgctggatcacatgacaggccgtgagatgttagtcatgtatgctagactgcgcggtatccctgagagacatatcggagcatgtgtcgagaacaccctgaggggactcctgctggagcctcacgccaacaagctcgttagaacttactcagggggtaataaacgaaaactgagcaccgggattgccctgattggagagcctgccgtcatttttttggatgaaccctccaccgggatggaccccgtggcacggaggctcctctgggataccgtggcacgggcacgcgaatcaggcaaggctataatcattacctctcatagtatggaagaatgtgaggccttgtgtaccagactggctattatggtccaggggcagtttaagtgtctgggcagccctcagcacctgaagtctaaatttggcagcgggtatagtctgagagcaaaagtccagagcgaggggcaacaggaggctctcgaggagtttaaagcgtttgtggacttgactttccccggaagtgtgcttgaggatgagcatcagggcatggtccactaccatctgccaggccgagatctgtcttgggcgaaggtgttcgggatcttggagaaagccaaagagaaatacggggtcgatgactactctgtgagccagatctctctagagcaggtcttcctcagcttcgcccatctgcagcctccaaccgcagaggagggaaggta

SEQ ID NO: 215354 - DNA, 6821 bp, Artificial Sequence
  Description of Artificial Sequence: Synthetic coding sequence
atggggttcgttagacaaatacagctgctcttatggaaaaactggacattgagaaaaagacaaaagatccggtttgtcgtggagttggtttggccgctgtccctgtttctggtgctaatctggttgaggaatgctaaccctctttattcccaccacgaatgccacttccccaacaaagccatgccttccgccggaatgctcccatggctgcagggaattttctgcaacgtgaacaatccatgtttccaaagcccaaccccaggagagtccccgggaattgtcagcaactataataacagcatcctggctcgtgtctatagggattttcaagagctcttgatgaatgccccagagtcccaacacctcggacggatttggactgaactccacattctatcacagttcatggacactctgaggacccacccagagagaatcgccggtcgaggtattaggatacgggatatcctcaaagatgaggagacgctgactctctttctcattaaaaatatcggcctatctgatagtgtggtctacctgcttattaactcccaggtgcggcctgagcagtttgcccacggcgtgcctgatctggccttgaaggacatcgcttgttctgaggcattactcgagcggtttatcatcttttctcaaaggcggggtgcaaagaccgttcgttacgctctttgctctctgtcacagggaactctgcagtggatcgaggacacactctatgcgaatgtggatttctttaaactgttccgcgtcctgcccaccctcctggactcccgctcacagggaatcaatctgcggtcttgggggggtattctctccgacatgtctcctcgcatccaggagtttatccacagaccaagcatgcaggacctcctgtgggtaaccagacccctgatgcagaacggcggacctgaaacttttactaagttgatgggcatcctgtccgacttgctctgtggataccccgagggtgggggatccagagtgttgtcctttaactggtatgaggacaacaattataaggccttcttgggcatagacagcacccgtaaagaccccatctactcgtacgatcggcgaacgaccagtttctgtaatgctctcattcagagtcttgagagcaatcccctgaccaagattgcctggagagccgcaaaaccgcttctgatgggcaaaatactttataccccagactcccccgcagccagacggatactgaagaacgccaactcaacatttgaagagctggaacacgttcgcaagctggtcaaggcctgggaggaggtcggccctcaaatttggtacttctttgacaattcaacccagatgaacatgatccgggatactctgggcaacccaaccgtgaaagacttcctgaaccgacaacttggcgaggaagggattactgccgaggctatactgaatttcctgtacaagggccctcgggagagccaggccgacgacatggccaactttgactggagagatatctttaatattaccgacagaacgttgcgtttggtaaaccagtatcttgagtgtctggtgctggataagttcgagtcttataatgatgaaactcaactgacacagagggctctgagtcttctggaggagaatatgttctgggcaggagtcgtcttccccgacatgtacccatggacgagttctctccctccacacgtcaagtacaagattagaatggacatcgatgttgtggagaagactaacaaaatcaaagaccgctactgggactcggggcctcgggctgatcccgtcgaggacttccgctatatctggggcggtttcgcctacctgcaagatatggtggagcagggtattactcggtcccaggtgcaggcggaggcaccggttggtatttatttacagcagatgccgtatccctgttttgtggatgacagctttatgatcatcctcaataggtgctttcccatctttatggtcctggcctggatatacagcgtctccatgaccgtgaaaagtatcgttcttgaaaaggaattgcgactcaaggagactttaaagaaccagggtgtgtcaaacgcagtgatctggtgtacatggttcctcgatagcttcagcatcatgagcatgagtatctttctgctcacaatcttcatcatgcatggtcgcattctccactattccgatccatttatattatttttgttcctgcttgcattctccaccgccacgataatgctgtgtttcctactgtcaacttttttctcaaaggctagcctggctgctgcctgttccggcgttatctatttcactctgtacctgccccacatcttgtgcttcgcttggcaggataggatgaccgcagagctgaagaaagccgtatccctcttgtcgccggttgcattcggatttgggactgagtacttggtcaggtttgaggagcaaggtctcgggctacagtggtcaaacataggtaattctccaacagagggggacgagtttagtttcttgctgtccatgcaaatgatgttgctggatgcagctgtgtacggattacttgcctggtatctggatcaggtcttcccgggagactatggcacgccattgccgtggtacttcctgctccaagagagttattggctcgggggtgagggttgttccaccagggaggaacgcgctctggagaagactgagcccctgacagaggagactgaagacccggagcaccctgaaggcatacatgatagcttcttcgagagagagcaccctggctgggtccctggcgtatgcgtcaagaacctggtaaaaatttttgagccctgtggtcggccagccgtggaccgcctgaacattacgttctatgaaaaccagattaccgcatttctgggacataacggagcagggaaaactacgacactgagcattttaacaggtctcctgcccccaactagcggcactgtcctggtgggcggacgagacatagagacttccctcgacgcagttcgccagtccctcgggatgtgccctcaacacaatatcctgttccaccacttgactgtggcagaacatatgctgttctacgctcaactgaaaggaaagtcgcaggaggaagctcaattggagatggaggccatgctcgaggacaccgggcttcatcacaaaaggaatgaggaagcccaagatctctcggggggaatgcagcgaaaactttccgtagctatagcctttgttggagatgccaaggttgtcatattagacgagcccacttctggagtagacccttactcgagaaggagcatttgggacctcttgctcaaataccggtccggcagaacaattataatgagcacacatcacatggacgaggctgaccttctgggggacagaatcgctattattgcccaaggtcgactgtactgttccgggacgccgctttttttaaagaattgctttggaactggattgtatctaaccctcgtgaggaagatgaagaatatacagtcccagagaaagggctcggaagggacatgctcgtgctcttccaagggctttagtacaacgtgccctgcacatgtcgatgacttgactcctgaacaggtgctcgacggggatgtaaatgagttaatggacgtggtcctccaccacgtgccggaggccaagttagtcgagtgtattggacaggagctgattttcctgctccctaataagaactttaagcacagagcttatgcttctttgtttcgcgagctagaggagacattggccgatctcgggttgtccagcttcgggattagtgacacgccattggaagagatctttttgaaagttactgaggatagtgatagcgggccacttttcgccggtggtgcgcagcagaagcgcgagaacgtgaaccctcggcatccctgcttaggaccgcgtgagaaagcgggacagacaccccaagattcaaatgtctgttcgccgggagccccagcagcccatcctgaaggccagcccccacctgaaccagaatgtcccggtccccagctaaacactggtacccagctggtcctgcagcatgtgcaggcactgctggtcaagagattccagcataccatcaggtctcacaaagactttctggcacagatcgtcttacctgcgacttttgtatttctggccttgatgttgtccattgttatcccaccctttggagaatatccagccctgactctgcacccctggatctatggacagcagtataccttcttctccatggacgagcccggatccgaacagttcaccgtgctggcagatgtgctcctgaacaaaccgggattcggtaatagatgtctcaaggagggctggctgcccgaatacccatgcggcaatagtactccttggaagactccctccgtctctcctaacataacccagctcttccagaagcagaaatggacccaggtcaatcccagcccatcctgccgatgttcaactcgggagaaactgactatgttgccagagtgccccgaaggtgctggaggcctccctccaccacaaagaacacagagatcgactgaaattctgcaagacctgaccgatcgtaacatcagtgatttcctggtgaagacttaccccgctctcattagatccagcctgaaatccaagttctgggtgaacgagcagcgctacggcggaataagcatcggcggtaagttacctgtggtccctattaccggggaggcactcgtcggctttttgagcgacctggggaggatcatgaatgtgtccgggggtcccatcaccagggaggcgtcaaaagagattcccgatttcctaaagcacctggaaaccgaagataatatcaaggtgtggtttaacaacaagggctggcacgcattggtgagttttcttaatgtggcacacaacgccattttgcgggcttctctgcctaaggacagaagccctgaagaatacgggatcaccgtgatatcccagcctcttaatctcaccaaggagcagctctccgaaatcaccgtgttaaccaccagcgtggacgctgtcgtggcaatctgtgtcatcttctcaatgtccttcgtccccgcaagttttgtgctatacctgatccaggagagagtgaataagtctaagcacttacagttcatcagcggggtctcccccacaacctattgggtgactaactttctgtgggacatcatgaattatagcgtgtcagccggtctggtggtcggtatcttcatcggatttcagaagaaggcctatacatccccagagaatctccccgcactggtggctctcctactgctttacggctgggccgttatccccatgatgtatcctgctagttttttgtttgacgttccttctacagcatatgtggccctgagctgcgctaatttgtttataggcataaattcatcagccatcaccttcatcctggagctgttcgaaaacaataggaccctgctgcgctttaacgctgtgcttcgcaaactgttaatcgtatttccgcatttttgcctgggtcgaggcctgatagatctggctctgagtcaggccgtcaccgatgtctacgcacggttcggggaggagcactcagccaatcctttccactgggacttaataggaaagaatctcttcgcgatggtggtggaaggggtcgtgtactttctgctgaccctcctggttcaacgtcactttttcctgtcccagtggattgccgagcccaccaaggagccgattgtggacgaggatgatgatgtggccgaggagcggcagagaatcatcaccgggggaaataagactgatatactgagacttcacgagctcaccaaaatttatcccggtacctctagccccgcagttgaccggttgtgcgttggcgtgagacccggagagtgtttcggcttactgggtgtgaatggtgctggcaaaaccacaacctttaaaatgctgacaggcgacactactgtaaccagtggcgacgccaccgtggccggtaagagcatccttacaaacatcagcgaagtgcaccaaaatatgggctattgcccccagtttgacgcaatcgacgaacttctaacgggtagagaacacctgtatctgtatgccagactgagaggcgtacctgcggaagagattgagaaagtcgctaactggagcataaaatctctggggctgaccgtttatgcagattgcctagcgggaacctatagcgggggaaacaagagaaaactgtccacggctattgcactcattggctgtccgcctctcgtcctcctggatgaacccaccacgggaatggatcctcaggcgagaaggatgctctggaacgttatagtgtccattattagagaggggcgagctgtggtcctgaccagtcacagcatggaagaatgcgaggctctgtgtaccaggctcgccataatggtgaaaggggcatttaggtgtatgggcacgattcagcatctgaagtcaaaatttggcgatggatatatagtgaccatgaaaatcaaatccccaaaggacgacctgttacccgacttaaatccagtggagcagttctttcagggcaactttcctggatctgtccaaagggagcgccattataacatgctgcagtttcaggtctccagttcttcccttgccaggatattccagctgcttctgagccataaagatagcctgctcatcgaggaatactctgtcactcaaacgaccctggaccaggtttttgttaactttgccaaacaacaaacagagagccacgacttaccactgcacccacgtgccgctggtgctagccgacaggctcaggatta

SEQ ID NO: 215355 - DNA, 2940 bp, Artificial Sequence
  Description of Artificial Sequence: Synthetic coding sequence
atgggctttgtgcgccaaattcagctgctcctctggaaaaattggaccctcagaaagaggcaaaaaataaggtttgttgtggaactagtgtggcctctgtctctgttccttgtcttaatttggctgaggaatgctaatcctctttacagtcatcatgaatgccacttcccaaacaaggcaatgccaagtgctggcatgctgccttggctgcagggcattttttgtaacgtaaataacccctgcttccagtctcctacacctggggaatctcctggtattgtgtccaattacaacaacagcattctcgccagggtttacagagacttccaagagctgcttatgaacgccccagaatcacagcatctgggcaggatctggacagagcttcacatcctctcgcagtttatggatacactccgcacccatcctgagcggatcgctggaaggggcatcagaattcgggatatcctaaaggacgaagagactctaacgctgtttctgataaaaaatataggcctaagcgacagcgtcgtatacctgctaatcaacagtcaggtgcgtcccgagcagttcgctcacggtgtgccagacctggcactcaaggacattgcctgctccgaggctctcttggaaagatttatcatcttctcccaacgcaggggcgcaaaaactgtccgatatgctctctgtagcttatcccagggtactctgcaatggatcgaggacacattgtacgctaatgtggacttcttcaaactctttagggtgcttcctactctcctcgactctagatctcaggggattaatctccgtagttggggtggaatcctctccgacatgtcgcctcgtattcaagaattcatacacagaccgagcatgcaggacctcctttgggtgacacgccctttaatgcaaaacggtggcccagaaacattcacgaaacttatgggaattctctccgacctcctttgcggctatcctgaggggggtgggagtagagtgttgtccttcaattggtatgaagataacaattacaaagcgttcctgggaatcgactctacccgtaaagaccctatttactcttacgatagacgcactaccagcttctgcaacgccctgatccagtccctcgagagcaatccccttaccaaaatagcatggcgggctgccaagccactgcttatgggaaaaatcctgtacacgcccgattcccccgcagctcggaggattctgaagaatgccaatagtacgtttgaggagctggagcacgtccgcaaactcgtcaaggcttgggaagaggtgggtccccagatctggtattttttcgacaacagtactcagatgaacatgattcgcgacaccctgggaaaccctacagttaaggattttctgaaccggcaacttggagaagagggtataacagccgaggcaatcctgaacttcctctataaaggacctcgcgaatcccaggctgatgatatggcaaatttcgactggcgggacatattcaacattaccgatcggaccttgaggttggtcaatcagtatttggagtgcctggtacttgataagttcgagtcgtataacgacgagacacagctcactcagagagctctaagtctcctggaagagaacatgttttgggctggcgtggtatttccagacatgtatccttggacgtcctcccttcccccacatgtgaaatataaaattcggatggacatcgatgttgtggagaagaccaataagatcaaggacaggtattgggactctgggccaagagcggatcccgttgaggattttaggtacatctggggcggtttcgcttacctgcaggatatggtggagcaaggtataacacgtagccaggtccaggctgaagccccagtgggaatctatctgcaacaaatgccttacccttgctttgttgatgacagtttcatgattatcctgaaccgctgttttccaattttcatggttttagcttggatctatagcgtgtcaatgacggtgaaatccattgtgctggaaaaagaactgagactgaaagagactctgaagaaccagggcgtgagtaatgcagttatttggtgtacctggtttctggattccttcagtattatgagcatgtcaattttcctgctcacaatcttcataatgtccttactgtctcctgtggcctttggcttcggtaccgaatatctggtgagattcgaggaacagggcctcgggctccagtggagtaacatcgggaactcccctactgagggcgacgagttctcattcttgttatccatgcagatgatgcttcttgacgctgccgtctacggtttgcttgcgtggtaccttgaccaggtttttcctggcgattacggcactccgctgccatggtatttcctcctccaagagagctactggctcggaggagagggctgctctacccgagaagaacgggctctggagaaaaccgaacctctaactgaggaaaccgaggacccggagcatcccgagggcatccacgattcttttttcgaacgcgagcatccagggtgggtgcccggagtctgcgtgaaaaatcttgtgaagatcttcgagccatgcggacgtcctgccgtcgaccgcctgaatattactttctacgaaaaccagatcactgccttcctcggacacaacggcgctggtaagaccaccacctttagtgctggcgctcctctcagcagcaaggggcctgagcggcacttgctgagaggagaacacggccctccctggtttcccaaagaacagcagacccgcacatcgcaaggcgcagccaatcccagggacacagtatttaagtcatttggagaaccccaggaggggactactgcctgcaccccctgcgacggtatgttttcaagagccgttcagtgcgaatggaatgttggacctgtgcccttctag

SEQ ID NO: 215356 - DNA, 1179 bp, Artificial Sequence
  Description of Artificial Sequence: Synthetic coding sequence
atggtggtggagggtgtggtgtactttcttctgactctgttggtccagagacacttctttttgagtcagtggattgccgaacctaccaaggagccaattgtcgatgaagatgacgacgtcgctgaagaacgacagaggatcataacaggagggaataagacggatattctcagattgcacgagttgacgaaaatttatccaggaacctcttcccctgccgttgataggctgtgcgtcggggttaggccaggtgaatgctttgggctgctgggggtcaacggggcaggcaaaactactacctttaaaatgctgacgggcgacactactgtaacctcgggggacgccaccgttgcaggaaagagcatcctgaccaacatcagcgaggttcatcaaaacatggggtattgcccccagtttgatgcaatcgatgagttactgactggacgggaacatttatatctgtacgcgcgtctgagaggcgtgccggctgaggaaattgaaaaggttgcaaactggagcataaaaagtctgggactgacagtctacgctgactgcctggccggtacttatagtggaggcaataagcgcaaactgagcactgccattgccctgatcggctgccctcctcttgtgctgctcgacgaacctaccaccgggatggacccacaggctcggcgaatgctatggaacgtaattgtttccattatcagggagggacgggcagtggtccttacctcgcacagtatggaggagtgtgaagcattgtgtactaggcttgccattatggtgaaaggggcatttagatgcatgggtaccatccagcatctgaagtctaagttcggagacggatatattgttacgatgaagattaagtctcctaaggatgaccttctcccagatctgaatccagtggagcagttttttcaaggcaacttcccaggcagtgtgcaacgtgaacggcattacaacatgctgcagttccaagtctcctcatcgagtttggccaggatttttcagttgctgctttcacacaaagattctttattgatagaggaatacagcgtgacacagacaactctggaccaggtgttcgttaattttgccaaacagcagacagagagccatgacctgccgcttcatcccagggccgcaggcgctagtcgacaggctcaggattag

SEQ ID NO: 215357 - DNA, 1632 bp, Artificial Sequence
  Description of Artificial Sequence: Synthetic coding sequence
atgatgatgaactatagcgtgtctgccggattggtggtgggtatcttcattggcttccagaagaaagcatatacgagtcccgaaaatcttccagccctggtcgcgctgcttctcctgtacggctgggcagtgatcccaatgatgtacccagcgagcttcttatttgatgtaccctctaccgcctatgtcgcactgtcatgcgccaatttattcattggtattaactcatcagccattacattcatcctggaactatttgagaacaatcgcactctgctacggtttaatgcagttctccggaaactgctgattgtgttcccccacttttgcttgggcagaggactcatcgatctcgcacttagtcaggccgtgacagatgtgtatgccagattcggagaagaacactccgcaaatcccttccactgggaccttatcggcaagaatctgttcgcaatggtggtcgagggggtggtttacttcctcctgacccttctcgtgcagcgccactttttcctctcacaatggatcgctgaaccaacaaaagagcctatcgtggatgaagatgacgatgtcgcagaagagcgacagcggatcatcacaggtggtaataagacagacattttgcgactgcacgagctgacgaagatttacccaggtacctcgtcaccggcagtggaccggctgtgtgtgggtgtgagacctggggaatgtttcgggctgctgggggtcaacggtgctggcaaaactaccactttcaagatgttaaccggcgataccacggtcacgagtggggatgccactgtggctggcaaatccatactcaccaatatttccgaggtgcatcagaacatgggatattgccctcagttcgatgctatcgatgaactcctgaccggcagggagcatctgtacctgtatgcccgtttgcgaggcgttcctgcggaggaaattgaaaaggtagccaactggtctattaagtccctcggtctgactgtctacgcagactgccttgcaggaacttactctggaggaaacaagagaaaactgtcaacggccatcgctctgattggctgccctccactggtgctcctggacgaaccaacgaccggcatggatccccaagcgagaaggatgctgtggaacgtaatcgtctctattattcgggaggggagggccgtggtactgacctcacatagcatggaagaatgcgaggccctctgcaccaggctggcgatcatggtgaagggcgcttttagatgtatgggcactattcagcacttgaaatctaagtttggagacggatacatcgttactatgaagattaaatccccaaaggacgaccttctccctgacctcaatcctgttgaacagttctttcagggtaatttccccggtagcgtccagcgcgagcgtcactataatatgcttcagtttcaagttagtagttcatcactcgctagaatattccaactgctgctgtcccacaaggacagtctcctcatcgaggaatattctgtgactcagaccaccctggatcaggtttttgttaacttcgccaaacagcagacagaatcccatgaccttccgctgcacccaagagctgcaggcgcaagccggcaggctcaggactag

SEQ ID NO: 215358 - DNA, 3198 bp, Artificial Sequence
  Description of Artificial Sequence: Synthetic coding sequence
atggatgtggtcctgcaccatgtgcctgaggccaaactggtcgagtgtattgggcaagagctgatattcttgttaccaaacaagaactttaagcaccgagcctacgccagtctcttccgggagctggaggagactttggcagacctgggactgagttcattcggcattagcgatactcccctggaggagattttccttaaagttaccgaagacagcgactccgggccactgttcgctggcggtgcgcagcagaagcgcgagaacgtcaacccccgtcatccctgtctgggacccagagagaaggccggacagacgccccaggatagtaacgtctgttctccaggagccccagccgcacaccctgagggccagccccctccggagcccgaatgtccgggaccgcaattaaacactggcacacagttggtgcttcagcacgttcaggcccttcttgtaaagcggttccagcatacgattcgtagccacaaggacttcttagctcaaatagtgttgcccgcaacgttcgtctttctggctttgatgctgagtatcgttatcccaccatttggggaataccccgctcttaccttgcatccatggatttacggacagcagtatacctttttttccatggatgaacctgggtccgaacagtttaccgttcttgcagacgtgctcctcaataagcccggtttcggcaatcggtgcctgaaggaggggtggctacccgagtatccctgcggtaattctactccgtggaagacaccgtctgtgtcgcccaatatcacacagctgtttcaaaaacagaagtggactcaggtgaacccatcccccagctgccgctgcagtacccgcgagaaacttactatgttgcctgagtgccctgagggggctggcggactgcctccccctcagcgaacgcaaagaagcaccgagatcttgcaggatctgacagatagaaatataagtgactttctggtgaagacctatcctgcattaataagatctagcttaaagagcaaattttgggtgaacgaacaacgctacgggggaatttctatcggcggtaaacttcccgtggttccaataacgggtgaggcgctcgttggatttttgagcgatctgggcaggattatgaatgtctcaggtggccctatcaccagagaggcaagcaaggagattcctgacttcctgaagcacctggaaaccgaggacaacatcaaggtttggtttaacaacaagggatggcatgcgctggtgtcatttcttaacgtagcccataacgccattttgcgcgcatctctgcctaaggacagatcccctgaggagtatgggatcaccgtgatcagccagcctttgaacctaacgaaggagcaactctctgagattaccgtgctcacgaccagcgtggacgccgtggtggccatttgcgttattttcagtatgtctttcgtgccggcatctttcgtgctatatctaatccaggaaagggttaacaaatcgaagcacttacagtttatttcaggggtcagcccgacaacctactgggtgactaattttctgtgggatattatgaactatagtgtttcagcaggcctggtggtggggatctttatagggttccaaaagaaggcttatacctcgcctgagaacctccctgccctcgtggctttactcttgctctatggctgggccgtaattccaatgatgtaccctgcgtccttcctttttgacgtcccatcaacagcatacgttgccctttcatgcgctaatcttttcatcggaatcaactcctctgccatcacttttatcctcgaattgtttgaaaacaacagaacactgctgaggttcaacgccgtgctgcggaaactccttatcgtgttcccgcacttctgccttggtaggggtctaatagacttagccctgagccaggccgtgactgatgtatacgctcggtttggcgaggagcattcagccaatccatttcactgggacctgatagggaaaaaccttttcgcgatggtggtggaaggggtggtgtatttcctgcttactctccttgtgcagcggcactttttcctttctcaatggattgctgagcccacaaaagaacccattgtggatgaggacgacgatgttgccgaggagaggcagaggatcattaccggcggtaataaaaccgatattctgcgcctgcacgaactgacgaagatttaccccggaacctcctcaccagccgtggaccgactctgtgtgggggttcggccaggagaatgttttgggctgctgggcgtgaacggggcaggaaagacgaccacattcaagatgctgaccggtgacaccacggtgacttctggggatgcaaccgttgcaggcaagagcattctgactaacatctccgaagtgcaccagaacatgggttactgtcctcagtttgacgccattgatgagctgctgaccggacgagagcacctttatctctatgcacgtttgaggggtgttcctgcagaggagattgaaaaagtagccaattggagcataaaaagcttaggcttaactgtttacgctgattgccttgcgggtacctattccgggggaaataagcggaaactgagtactgcaattgccttgattggctgtccgcctttagtcttactcgacgagcctacgaccgggatggatccccaggcacgtcggatgttgtggaatgtcattgtatctataatccgggagggcagagccgtggttttgactagccacagcatggaggaatgtgaagcgctgtgcactcgactggccataatggtgaagggtgcatttagatgcatggggaccattcagcatcttaagagcaaatttggagacggatatatcgttaccatgaagattaagtcccccaaagacgatcttttaccagaccttaaccctgtggagcagttcttccagggcaatttcccaggatctgtgcaacgggagcggcactacaatatgttacagttccaggtttcctctagtagcctcgccaggatctttcagcttctgctaagccacaaggattctctgcttatagaagagtactctgtgacacagaccacgctggatcaggtcttcgtgaacttcgctaagcaacagactgaatctcacgatttaccacttcatccacgagcagccggagcatccagacaagcacaggattag

SEQ ID NO: 215359 - DNA, 4928 bp, Artificial Sequence
  Description of Artificial Sequence: Synthetic coding sequence
atgtctactgcgatccgtgaggttggtgtctggcggcagacgaggacattgcttttgaagaactacctcataaagtgccggactaagaagtcctcggtgcaggaaattctgtttccgcttttctttctgttctggctcatacttatatcaatgatgcatccaaataagaagtacgaagaagtccccaacatcgagctgaaccccatggataagttcaccctgtccaatttgattttgggctacacgcctgtcactaatattacaagttctatcatgcagaaagtctctaccgaccatctccccgacgtgataatcaccgaagagtataccaatgaaaaagagatgttgacttcaagtttatcaaagccctcgaatttcgtaggggtggtcttcaaagattctatgtcctacgagttgaggttctttcccgacatgatccccgtgtcatccatatacatggactcccgggctggctgcagcaaatcttgcgaggccgcacagtattggtcttctggatttaccgtgttgcaagcatccatcgacgctgctattattcagctcaagaccaatgtttcactgtggaaggagctggagagtacaaaagctgtgatcatgggagaaacagctgtggtggagatcgatactttcccgcgaggggtgatccttatttatctggtcatcgctttttcgccctttgggtattttctggctattcatatagtggctgagaaggaaaagaaaataaaagaatttctgaaaatcatggggctgcatgacacagctttctggcttagttgggtgttactctatacgagcctgatttttttaatgtcactccttatggccgttatcgcaactgcgtcactgctgttccctcaatcatcctcaatagttatctttctgctctttttcctttatggactgagcagcgttttcttcgctctgatgctcactccgctctttaagaaatcaaagcacgtgggtattgttgaattctttgtgactgtcgcctttgggttcatcggactcatgatcatccttatcgaatctttcccaaagtctctggtgtggctgttctctccgttctgccactgcaccttcgtcatagggatcgcccaggtgatgcacctcgaggattttaacgaaggggcatccttcagcaaccttacagccggtccgtatcccttgataattaccattatcatgctgacattaaatagtattttttacgtattactggctgtctatctggaccaagttatccccggagaattcggcctgcggcgttcttcactctactttcttaaaccttcatactggtctaaaagtaaacgcaattacgaagaactttccgagggaaatgttaatggtaacatatcgttcagtgagattatcgagccagtgtcaagtgagtttgtcggtaaggaagccattcggatctccggtatccagaagacgtatcggaagaagggagaaaacgtcgaggcactgcgcaatctgtcttttgacatttacgaagggcagattacagcattattaggtcatagcggcactggaaagagcacacttatgaatatcctgtgcggcctgtgtccaccatcagacgggttcgcatccatctacggacaccgtgtctcagaaatcgatgagatgttcgaggcgaggaaaatgatcggtatttgtccgcaactggacatccactttgatgtgcttacggttgaggagaatttatctattctggctagtattaaaggtatcccggcaaacaatattattcaggaggtccagaaggtcctgttagatctggatatgcagaccatcaaagacaaccaggccaagaagctgtcgggaggacaaaaacgcaaactctccctggggatcgccgtactgggcaatccgaagattctcctgttggacgaacctactgccggtatggatccgtgcagccgtcacatcgtctggaatctgctcaagtaccgcaaggcgaacagagtgactgtgttcagtactcactttatggatgaggccgacattctcgccgataggaaagcagtcatttcccaaggcatgctgaaatgcgtaggaagcagcatgttcctcaagagcaagtggggaattgggtatcggttatctatgtacatcgacaaatattgcgccacagagagcctgtctagcctggtgaaacaacacattcctggggctacactgctccaacagaatgaccagcaacttgtgtacagcctcccattcaaggacatggacaagttcagcgggctattctcagctctagactctcattccaatcttggagttatatcatatggagtgagtatgaccacactggaggacgtcttcctaaagctggaggttgaggccgaaatagatcaggccgattattccgtgtttacacagcagcccctggaagaggagatggactcgaaaagcttcgatgagatggagcagtcactgctcattctgtctgaaacgaaagcggctttggtgtccaccatgtctctttggaagcaacagatgtacacaatcgccaagttccattttttcacactcaaacgcgaatccaagtctgtccgcagtgtcctacttcttctgctgatctttttcactgtgcaaattttcatgttccttgtgcatcacagctttaaaaatgctgtggtccctattaagcttgtgccagacttgtatttcttaaagcccggagacaaacctcacaagtacaagactagcctgcttcttcaaaacagcgccgacagcgacatctcggacctcatcagctttttcacgagtcaaaacatcatggtgaccatgataaacgacagtgactacgtgtctgttgcacctcactcagctgccctgaacgtcatgcattccgaaaaggactacgtgttcgctgcggtgtttaacagcactatggtttattctttgccgatactggtgaacataatttctaactactacttgtaccatctgaacgtgacagaaacaatacaaatttggagcacgcctttttttcaggagattaccgacattgtttttaaaatagaactgtacttccaggccgctctgctcggaatcattgtaaccgccatgcccccatacttcgctatggaaaatgctgagaaccacaagatcaaggcctacacccagctcaaactctccggccttctcccctctgcctattggattgggcaggccgtggtagacattccgctattcttcatcattcttatactgatgttgggttcacttctcgcctttcattatggactctacttctacactgtgaagtttttggcagtcgtcttttgcctcataggttatgtgccgtccgtgatcctttttacttatattgcgagctttacgttcaaaaagattttgaacacaaaggagttctggtcttttatatatagtgtggcggctttagcttgtattgcaataactgagatcacattttttatggggtacacaatcgcgaccatccttcattacgcattttgtataatcatccccatttatccgttgctcggctgtctgatctcgtttattaagatctcctggaagaacgtgcggaagaatgtagacacctataatccgtgggaccgtctatctgttgccgttatcagtccctacctacaatgtgtcctgtggatctttttgctccagtactatgaaaagaagtatgggggtcggtccattcggaaggatccgttcttcaggaatctgtccacaaaatctaaaaaccggaagcttcccgaaccccctgacaacgaggacgaggatgaggatgtgaaggcagagcgcttgaaggttaaagagttgatggggtgtcagtgctgtgaagaaaaacccagcataatggtcagcaacctccacaaagaatacgatgataagaaagactttctgctctcgcgcaaggtcaagaaagtcgccaccaagtatatcagcttctgtgttaagaaaggcgaaatactgggactcctcggtcccaatggagccggaaagagcaccatcattaatatcctcgttggtgacatcgaacccacctctggccaggtgttcctcggcgattatagttcagagaccagtgaggacgacgattctctgaagtgcatgggttattgcccacagattaaccctttatggcctgataccaccctccaagaacacttcgagatttacggagctgttaaagggatgtctgcgagcgatatgaaagaagtcatatctcgtattactcatgctctcgacctgaaggagcacctgcaaaagactgtgaaaaaactgcccgcaggcattaagcggaaactctgcttcgcgctgtccatgctggggaaccctcagatcaccctcctggacgagcccagtactggcatggaccctaaggctaaacagcatatgtggcgcgctattcgcacagccttcaagaaccgcaaacgcgctgcgattttaacaacacactatatggaggaggccgaagcggtctgcgaccgcgtggccatcatggtctccggccagctccgatgcattgggaccgttcagcacctgaagagcaagttcgggaagggatactttctcgaaatcaagttgaaggattggattgagaatctggaggttgaccggttgcagcgagaaatccagtacatcttcccaaacgcaagtcgtcaggaatcctttagttccatcctcgcctacaaaattcctaaagaggacgtgcagtctctgtcccagtccttcttcaagctagaggaagcgaagcacgcatttgcgatcgaagagtattctttctcgcaagccacactggaacaagttttcgtggagctgactaaggaacaggaagaggaggacaacagttgcgggacactaaacagtacactgtggtgggaaagaacacaggaggatcgagtcgtattcta

SEQ ID NO: 215360 - DNA, 4931 bp, Artificial Sequence
  Description of Artificial Sequence: Synthetic coding sequence
atgagtacagcgatccgagaggtgggggtttggcggcagaccagaactctcttactaaaaaactacctgattaaatgtcgcactaagaagtcgtccgtccaagagatcctcttccccctcttcttcctgttttggctcatcctcattagtatgatgcacccgaacaagaaatatgaggaggtcccaaacatcgaactgaaccccatggacaagtttaccctttcaaacctaattctggggtatacccctgttacgaacatcactagcagcatcatgcagaaggtgagcacggaccacttgcccgacgtcatcataacggaggagtacaccaacgagaaggagatgttgacgagctccttatccaaaccatctaactttgttggagtggtgtttaaagactccatgagttacgagctccggttctttccagacatgattcctgtctcaagtatttatatggatagccgggcaggatgttcaaagtcttgcgaggccgcacagtattggtcctctgggtttacggtcttacaggccagcatagacgcagccatcatacagttgaagactaatgtgtcgctgtggaaagagctagagtccaccaaagccgtaataatgggggagacggccgtggttgaaattgacacatttccacgtggcgtgattctgatctatctcgtcatcgccttttccccctttggttatttcctggccatccatattgtcgctgaaaaagaaaagaagatcaaggaattcctgaaaataatggggctgcatgatacagcgttctggctgtcatgggtgctgttgtacaccagccttatcttcctgatgagcctcctgatggccgtgattgccaccgcctcactcctgtttccgcagagcagctccattgtaatctttctcttgtttttcctttacggcctgtccagtgtgtttttcgcactcatgctgactcctctttttaagaagtccaagcacgtgggcatagtggagttcttcgtcacagttgcctttgggtttatcgggcttatgataatacttatcgaaagcttccccaagtctttggtttggctgttctctcccttttgtcactgcacattcgtaattggcatcgcccaggtcatgcacttggaggattttaacgaaggcgcttcctttagtaatctgaccgcagggccttaccctttaatcatcacaatcatcatgttgaccctgaacagtattttctacgtgctcctggcagtgtatctagatcaggtgatcccaggcgagttcggcttgaggagaagttctctgtatttcttgaaaccttcttattggagcaaaagcaaaagaaactacgaggagttgtctgaaggaaacgtcaacggtaatatctcattttccgaaattattgagcccgtgtcatccgagttcgtcgggaaggaggccatcagaatctcaggcattcagaagacatacagaaaaaagggggagaatgtcgaggctcttaggaacttatcctttgatatttacgagggacaaatcactgccctgctgggtcacagcggtacgggtaaatccacgctgatgaatatactgtgcggtctgtgtcccccttctgacgggttcgcatcaatttacggtcatcgtgtatccgaaatagacgagatgttcgaggctcgcaagatgattggcatctgtccacaacttgatatacactttgatgtgctgaccgtggaggagaacctatccatactggcttctataaagggcattccagccaacaacattatacaagaagtccaaaaggtgctcctagacctggatatgcagaccatcaaggacaatcaggcaaagaagctgagcgggggacagaaacgtaagctgagccttgggattgctgtgttgggtaatcctaagatccttctgttggacgaacccactgccggaatggacccgtgcagcagacatatcgtttggaatctgttgaaatatagaaaggccaacagggtcaccgtcttctcaacccattttatggacgaagcggatattttggctgaccgaaaggcagtgattagccagggcatgctaaaatgcgtcggtagctcaatgttcttgaaatcaaaatggggaattgggtaccggctgtccatgtatatcgacaagtactgtgctactgagagcctttcatctctggtgaagcagcatatcccaggagcaaccctactgcagcagaacgaccagcagctggtctatagcctcccttttaaggacatggacaagttcagcggcttgttcagcgcccttgatagtcactcgaatctaggcgtcatctcttacggggtgagcatgacaacgctcgaagatgtattcctcaaacttgaggtcgaagcggagattgaccaggcggactacagtgtgttcacccaacagccgctagaggaggagatggactctaagtccttcgatgagatggaacagagcctccttattcttagtgagacaaaagctgccctggtgagcactatgagcctgtggaagcagcaaatgtacaccatcgccaaattccacttcttcacattgaaaagagagtctaaaagcgttcgctccgtgctgctgctcctgttgatcttttttaccgtacaaatatttatgttcttagtgcatcatagctttaagaacgccgtggtacccatcaagctggtgcctgacctctacttcctaaagccaggcgataaaccccataaatacaaaacctcactgttgcttcagaacagcgccgctgacagtgatattagtgacctcatttctttcttcacctctcaaaacataatggtgaccatgattaacgacagcgactacgtgtctgtagccccacatagcgctgcactcaacgtcatgcacagcgagaaagactacgttttcgcagcggtgttcaattcaactatggtgtactccctgccaattctggtaaatattatctccaactactacctgtatcatctgaatgtgacggagacaatccagatctggtccactccattctttcaagaaattaccgatatcgtgtttaagattgaactgtatttccaagctgctctcttgggcataattgttactgctatgcccccttacttcgccatggagaacgctgagaatcataagattaaagcatacacgcagttgaaactgtccggattgctgcccagcgcttactggatcggccaggccgttgtggacattcctctctttttcataatacttatccttatgctgggatcccttttagcctttcattacggtctttatttttacaccgtgaaattcctggcggtggtgttttgtttgattggctacgtgcctagcgtcatcctctttacttacatcgcatcgttcacgttcaaaaagattctcaacacgaaagagttctggagtttcatctatagcgtggccgcacttgcatgcattgccatcaccgagataaccttcttcatgggctatacaattgccacaatccttcattacgctttttgtattataatccctatctacccgctgctcgggtgcctcatttcatttattaaaattagctggaagaatgtgagaaaaaacgtagacacctataacccatgggacaggctaagtgttgccgttatttctccatacctgcagtgcgtactttggatctttcttctacagtattatgagaagaaatacggtggacgcagtatccgcaaagatccatttttccgcaacctgtccactaagagtaagaaccggaagcttcctgagccccctgacaacgaagacgaagatgaggatgtcaaagccgagcggctgaaagtgaaagagctgatgggatgccaatgctgcgaagagaagccgtcaatcatggtgagcaacctacacaaagaatatgatgacaagaaggacttcctcctgagtagaaaagttaagaaagttgccaccaagtatatctctttttgtgttaagaagggagagattctgggactgttgggccctaacggcgcaggaaagtccactatcattaatatccttgtcggagatattgagcctacttccggccaagtctttttaggcgactacagcagcgagacttcagaggatgacgactctctgaaatgtatgggctattgccctcagattaaccctttgtggcccgacaccactctgcaggagcatttcgagatatacggcgctgtgaaggggatgtcggcttccgacatgaaagaggtgatatccagaattacccacgccttagacctgaaagagcacctccagaaaaccgtgaaaaagcttccggcagggatcaaacgtaagctgtgcttcgcactcagtatgctcgggaacccacagataactctcctggacgagcctagcactggtatggaccccaaggctaaacagcacatgtggagagctatcaggaccgccttcaagaataggaaaagggctgcaatcctcacgacccactatatggaagaggccgaagcagtgtgcgatcgagtagccatcatggtttcaggacagctgcgctgcataggcaccgttcaacatctaaaatcgaaatttggcaaaggttatttcctagaaatcaagctcaaggactggattgagaatctcgaggtagataggctgcagcgggagatccaatacatttttccgaacgcaagcagacaggagagcttctcatctatactggcctataagattccaaaggaggacgttcagtcgttgtcccagagctttttcaaactggaggaagcgaagcacgcgtttgccatcgaggaatacagcttctcgcaggccacgctggagcaagttttcgtagagctcaccaaagagcaggaggaggaggacaattcatgcggaactctgaattcaacactgtggtgggaacgcacacaagaggatagggttgtattcta

SEQ ID NO: 215361 - DNA, 4854 bp, Artificial Sequence
  Description of Artificial Sequence: Synthetic coding sequence
atgaacatgaagcagaaaagtgtgtatcagcagactaaagccctcctgtgcaaaaattttctgaagaaatggcggatgaaacgggaatctctgctggaatgggggctatcaattctgctgggactctgtattgccctcttttcatcatctatgcgcaacgtgcagttccccggaatggctcctcagaacttaggccgagttgataaatttaatagctccagtcttatggtggtctacacccccatatctaaccttacccagcagatcatgaataagaccgctcttgccccattactgaagggcacctccgtgataggtgcgccaaataaaacacatatggatgaaattttgctggagaacttaccctacgccatgggaatcatcttcaacgagacattctcatacaaactgatattttttcagggttacaatagcccactgtggaaagaggacttttccgcccattgttgggacggatacggcgagtttagctgtaccctgaccaaatattggaatagaggtttcgtcgcactccaaaccgccatcaatactgcaatcatagaaatcacaactaaccaccctgtaatggaagaactgatgagcgtgacagccatcactatgaaaacattgccgtttatcactaaaaatctactgcataacgagatgttcatcctcttttttttgctgcacttttcgcctctggtctactttatttctttgaacgtcacgaaggaacgcaaaaagtctaagaatctaatgaaaatgatgggtttgcaagacagcgccttctggctgtcgtggggtctcatttatgcaggctttattttcattatctccatttttgtgactatcatcatcaccttcacacagatcatcgttatgaccggcttcatggtgatttttatccttttctttctgtatggcttgtcactcgttgccctggtgttcctgatgagtgtcttgctcaaaaaggctgtgttaacgaatctcgtcgtgttcttattgacactgttctggggctgtctggggtttaccgtcttctacgagcagttgcccagtagcttggagtggatcctcaacatttgctccccgtttgcttttacgaccggtatgatccagatcatcaaactggactacaacttaaatggggtgatatttcccgatccaagcggtgactcttacactatgatcgctaccttcagtatgttactgctggatggcctgatttatctgctgctggcgctatattttgacaagatactgccttatggcgacgaaaggcactactctcccctcttttttctgaacagctcctcatgtttccagcatcagcggactaacgctaaggtgatcgagaaggagattgacgccgagcacccctccgacgattacttcgagccggtggcacctgagtttcaggggaaggaagcaattcggattagaaatgttaagaaagagtataagggaaagtcagggaaggtcgaggcgttaaaaggtcttcttttcgatatatacgaaggtcagattaccgcgattctggggcactctggcgctggaaagtcttcccttctgaacatactgaacggcctgtcagtgccgaccgaaggaagcgttacaatctataataagaacctcagcgagatgcaagatctggaagaaatcaggaagattacaggagtatgcccccagttcaacgttcagttcgatatcctgacagtgaaagagaacctgagcctgtttgccaaaataaaagggatccatcttaaagaggtcgaacaggaggttcagcgcatcttactggagttggacatgcagaacattcaggacaaccttgcgaaacacctgtcagagggacagaagaggaagctcaccttcgggataactatccttggcgacccgcagatattgctgctcgacgaacctaccactggcctggaccctttcagtcgcgaccaagtgtggagcctcttaagagagagacgcgcagaccatgtgatcctcttctccacgcagagcatggacgaggctgatatcctcgccgaccggaaggtcatcatgtccaatggtaggctcaaatgcgctggttcgagtatgtttctgaagcggcgttggggactaggttaccatctatccctccaccgaaacgaaatctgcaatcctgagcagatcaccagctttatcacccatcacattcccgacgcaaagctgaaaacagaaaataaggaaaagctcgtctataccttgccgctggagcgcacaaatacctttccagaccttttcagcgatctggacaagtgttcagatcagggtgtgaccggatacgatatctcaatgtcaacgctgaacgaagtcttcatgaaactggaaggccaatctacaattgaacaggactttgagcaagtcgaaatgataagggattccgagtcattgaacgaaatggagctggcacatagctccttttctgagatgcagacggccgtgagtgacatggggctgtggagaatgcaggtgtttgctatggctcggctaaggtttctgaaactcaagcgccagaccaaggtcctgttaacactgctactcgtcttcggaattgctatatttcccctgatcgtggagaacatcatgtacgcaatgctgaacgagaagattgattgggagtttaagaatgaattgtactttctgagccccggacaattaccccaggagcctcggacttctctgctgatcattaacaatacggaatctaacatcgaggattttattaaaagtctcaaacatcagaacattcttctggaagtagatgactttgagaataggaatgggactgacgggctgtcttacaacggcgctatcattgtctctggaaaacagaaagattacaggttctcagttgtgtgtaacactaaacgattgcactgtttccctattctaatgaacattattagtaacggcctgcttcaaatgttcaatcacacacagcacatcaggattgaaagctccccctttcccctgtcacacattggtctttggaccggtcttcctgatggatctttctttctgtttctggttttgtgctccatctccccttacattaccatgggcagtataagcgactataaaaagaatgccaaaagccagctgtggatctccgggctctacactagtgcttactggtgcgggcaagcattggtggacgtctccttttttattctcattctactcttgatgtatctgatcttttacatcgaaaatatgcagtatctcctcataacctctcagattgtcttcgccctcgtgattgtgactcctgggtatgcagcatcacttgtctttttcatttacatgatatccttcatctttcgcaagcggaggaaaaacagcggcctgtggagcttctacttctttttcgcctccactattatgttctcaatcaccctcatcaatcatttcgatttgagcattctgattacaactatggtgcttgtgccctcttatacactgctggggtttaaaacatttctggaagtcagagatcaggagcactacagggagttccctgaggccaacttcgagctctcagctacagatttcctggtgtgttttattccctactttcaaacactcctgttcgtgttcgtgctccgctgtatggaactgaagtgcggaaaaaaacgcatgcgaaaggaccctgtgttccgtatctccccccaatcaagggacgcaaagcccaatcctgaagagcctatcgacgaagacgaggatattcaaacagagcgaatccgtacagcgaccgctctgaccacatcaatcttggacgagaagcccgttattattgctagctgcctccataaggaatatgcagggcagaaaaagagttgcttcagcaagaggaaaaagaaaatcgctgcccgaaatattagcttctgcgtgcaggagggcgaaatcttaggactgctaggaccgaatggtgcaggcaagagttctagtattaggatgatcagcggaatcacaaagcctacagccggagaggtggagttgaaagggtgtagttccgtgctggggcacttaggctactgcccgcaggagaacgttctatggcctatgctgaccttgcgagaacatctggaggtatacgctgcggtgaagggactgcgaaaagccgacgcaaggctcgccatcgcccgactagtgagcgccttcaaactgcatgagcagcttaacgtgccagttcaaaaactgacagccggtataacaagaaaactttgtttcgtgttatctctgctcggcaatagccccgtccttttgctggacgaaccatccaccggcatcgaccctacggggcagcagcaaatgtggcaagccatccaggcggttgtcaaaaacaccgaacgaggggtcctcctcactacccacaacctggccgaagccgaggcactctgtgatcgagtcgcaatcatggtatccggtcggctccgctgtatcggttctatccagcatctgaaaaacaagctaggcaaggactacatcttggaactcaaagttaaggagacatcccaggtaactctggtgcacacggagatcttaaagctttttcctcaggccgcaggacaggaacggtactcctcgctcctgacatataagttacccgtagcggatgtgtacccattgagccagaccttccacaaactggaggctgtaaaacacaacttcaacttagaggaatacagtctcagccagtgtactctagagaaggtatttctggaactcagcaaggagcaggaggtgggcaactttgatgaggagatcgacacaaccatgaggtggaaactcctcccacattctgatgaaccttag

SEQ ID NO: 215362 - DNA, 1434 bp, Artificial Sequence
  Description of Artificial Sequence: Synthetic coding sequence
atgttcagtatcaccctgatcaatcacttcgatctgtccattctgattaccactatggtgctagtgccttcatacactctgctgggatttaagaccttcctggaggttcgggatcaggagcattatagggagtttccagaagccaattttgaactttccgcgactgatttcctggtgtgtttcatcccctatttccagaccctgttgtttgtgttcgtgctgaggtgcatggaactgaagtgcggtaagaaacgaatgagaaaggaccccgtgtttaggatcagcccccaatcccgggacgccaagcccaaccctgaggagccaattgatgaagacgaggacatacaaactgagcgcatcagaactgccacggccctgactaccagcatactcgacgagaagcctgtgataattgctagttgtctccataaggagtacgccggacagaaaaaaagctgtttttccaaaaggaaaaaaaaaatcgctgcaaggaatatcagcttctgcgtacaggagggcgagattttgggactgttaggccctaatggagccggaaagtcaagctccatcagaatgatctctggcatcaccaaaccaaccgcgggtgaggtggaactgaaaggctgcagctccgttttgggacatcttggatactgtccccaggagaacgtgctgtggcccatgctcaccctgcgcgagcatctggaggtgtatgccgcagtcaaaggcctaagaaaggccgatgccagactggctatcgccaggctggtgagcgcctttaagttgcacgagcagctgaacgtgccggtgcagaagctaaccgccggaattacaagaaaattatgttttgtactgtcactactcgggaactctcctgtgcttcttttggatgagccctctactggcattgacccaactggacagcaacaaatgtggcaggccatacaggcagtggtaaaaaataccgagaggggcgtgttactgactactcacaacctggctgaagccgaagcgttatgtgaccgggtggctatcatggtctcagggcgactgaggtgcatcggatcgatccagcacttgaaaaacaagctcggcaaagactacattctggaactcaaggtgaaagaaacttctcaggtcaccctcgtacataccgagatccttaagctgttcccacaagctgccggacaagaacgctattcaagtctcctaacctacaaactccctgtggcagacgtgtatcctctcagccagacattccataaattggaggctgtaaagcataattttaacctcgaggaatatagtctgtcacagtgtactctggaaaaggtgtttctcgagttgagtaaggagcaagaggttggaaatttcgatgaggagatagacacgaccatgcgatggaagctcctgcctcatagtgatgagccttag

SEQ ID NO: 215363 - DNA, 6441 bp, Artificial Sequence
  Description of Artificial Sequence: Synthetic coding sequence
atggctttttggacacagctcatgctgttgctgtggaagaactttatgtatcgcagacgacagccagtccagctcttggttgaactgctgtggcctctgtttttgttcttcattctcgtcgccgtacgccacagccaccctcccctggaacatcacgagtgtcatttccccaacaaacctctcccatctgctggcacagtaccctggctccagggccttatatgcaacgtgaataatacgtgcttcccacagctcacccctggagaagagcccggtcgcctgtctaacttcaacgactctctagtatccagactcctggctgatgcaagaacggtgctgggcggagcttctgctcaccggacccttgctggcctggggaagctgattgccacactgagagcagccaggtctaccgcccagcctcagccaaccaagcagagcccccttgaaccgcctatgttggacgtagctgaactgttgacttcactacttagaactgaatctctgggccttgccctgggccaggctcaagagcctctgcactctctgctggaagctgcagaggatttagcccaggagctgctggcactgcggtctctggtggagttgcgggcattgctgcaaagacccagagggacaagtggcccactagagttattgtccgaggctctctgtagcgtcagggggcctagttccaccgtcgggcctagcctcaattggtatgaggctagcgacctcatggagctggttggccaggagccggagtctgctctgccagacagctccctgtcccccgcatgctccgagctgattggggctctggacagccatcccctgtccaggctgctttggcgacggcttaaaccccttatcctggggaagttgctgtttgcacccgatacaccatttacacggaaactgatggcacaggtgaacagaacgtttgaagagctgaccctcctccgcgacgtgcgagaggtgtgggagatgctgggcccacgcatttttacgtttatgaatgattcctctaacgttgcgatgctccagcgtttactgcaaatgcaggacgaagggcgacgtcagcctaggccgggtggtagggatcatatggaggcgctgaggtcattcctggatcctggatccggcggttatagctggcaggacgctcatgctgacgtgggacacctagtaggcactctcggtcgcgtgaccgagtgtctgagcttagacaagttggaagcagccccatccgaggcagcgcttgtgtccagagcattgcagctgctggccgaacaccggttttgggccggagttgtgttcttgggaccagaggatagcagcgatccaactgaacatcccacccctgacctgggccctggacatgtgaggattaaaatacggatggatatcgacgtagtgacacgtactaataagattcgcgatcgattttgggaccccggtccagctgccgaccctctgaccgacctgagatatgtttggggtggatttgtttatctgcaggaccttgtcgagcgcgctgcggtgcgcgtgctgagcggcgctaacccacgcgcaggactatacttgcagcagatgccatacccatgctatgtggatgacgtgtttctccgcgtgttgagccgcagcctgccgctattcttgacgctcgcttggatctattccgtcaccctgaccgtgaaggctgtggtgagggaaaaagagacaagacttcgggatactatgagagccatgggactgagccgggctgttttgtggctgggatggttcttgtcatgtctggggccttttctcctatcagccgctttgctcgtcctcgtcctgaaactcggtgacatccttccctacagccatcccggtgtcgtgttcctgttcctcgccgctttcgctgttgctaccgttactcaatcctttctcctgagcgccttcttttcccgggcaaatctggccgctgcttgtggaggcctggcctacttctccctgtacctgccttacgtcctgtgcgttgcttggagagaccgtctccccgctgggggtcgagtagccgcttccctcctaagccccgtggcctttgggtttggatgtgaaagcctcgccttactggaggagcaaggggagggggctcagtggcataatgtggggacgcgcccaacggcagatgtgtttagtctagctcaggtatcagggctcctgctgctggatgccgctctctacgggctggccacctggtatttagaagccgtctgtcctggccagtatgggatacctgagccatggaatttcccttttcgtaggtcgtactggtgcggacccagacccccaaaatcaccagcaccttgccctacccccctagatccgaaagtgctcgtcgaggaagctccgccaggcctctcaccaggagtgtccgtaaggagccttgaaaagcgtttccccggaagtccacagcccgctctgagaggactgtcactggacttttaccaaggacacattactgccttcctcggccataacggtgccggaaaaactacgactctaagtattctcagtggtctgttccccccatccgggggttccgcattcattctgggccatgatgtgcgctcatctatggccgcaatccgcccacacctgggagtatgtccacagtacaacgtcctgttcgacatgctgacagtggacgagcacgtatggttttacggccgacttaaggggctttcagccgcagtggttggacctgaacaagatagactgcttcaggatgttggattagtgagtaagcagtctgtgcagacccgtcacctctctggcggtatgcagaggaaattgtccgtcgcaattgcgttcgttggagggagccaagttgtcatacttgatgaaccgacggcgggtgtggatcccgcttctcgaagggggatctgggaattactcctgaagtatcgggaaggaagaacacttatcttgtctacacaccatctggacgaagcagagctgcttggcgatcgggtggcagtggtggctgggggaagactctgttgctgtggaagccccttattcttacgccgacacctggggagcggatattatttaaccttggtcaaggccaggctacccctgacaacaaacgagaaagcagatacagatatggaagggtcggtggacacaagacaggaaaagaagaacggatctcaggggtcaagagttggcaccccacagctccttgccctagttcagcactgggttcctggcgcacggcttgtggaggagcttccacacgagctggtcctggtgcttccttacactggagcacatgatggcagcttcgccacactatttcgagaattagacacccgactggcagagctgagactcaccggctacggcattagcgacacaagtctggaggagatcttcttgaaagtagtggaggaatgcgctgcagatactgatatggaagatggcagttgcggccaacatctgtgtaccggcatcgctgggttagatgttaccttgcggctgaaaatgcctcctcaggaaaccgctctggagaatggagagcccgcaggatccgctccagaaacagatcaggggtcaggcccagacgctgttggcagagttcagggctgggcccttaccagacagcagcttcaagccctgttgctcaaacggttcctgctagcgcgtcgaagcagaaggggactgtttgctcaaattgtactgcctgcactcttcgtggggctggccctcgttttcagcctgatcgtgccccctttcggccactaccctgcgctgagactgtcacccaccatgtatggggctcaagtctcattcttttcagaggacgccccaggtgatccgggtagagctcgtctgctggaggccttgctgcaggaagctggtctggaagagccccctgttcagcatagtagccatagattttccgcgcctgaagtccctgcagaagtggccaaagtgcttgcatcgggcaactggacgccagagagtccttctcccgcttgtcagtgtagtaggcctggagcccgtaggcttctccccgattgccccgctgcagcagggggacctcccccaccacaggctgtgactggcagcggcgaggtcgtccaaaatctcacgggccgtaacctgtccgatttcctggtaaaaacataccctcgactggttagacagggactcaagacaaaaaaatgggtgaatgaggttagatacggcggattttcactcgggggtcgcgaccccggacttccatccggccaagaacttggtcgctccgtagaggaactttgggccctactgtcccctctgcccggaggtgcactcgacagggttctcaagaatcttaccgcctgggcccatagtctggatgcacaggacagtctgaagatctggtttaacaacaaaggatggcactccatggtcgccttcgtaaatcgcgcaagcaatgccattcttagggctcacttgccacctggtcccgcaaggcatgcccacagcataacgactctcaaccatcccctgaatctgacgaaggagcagctcagtgaaggagctcttatggctagcagtgtcgacgtactggtgtctatctgcgttgtattcgccatgtctttcgtgccagcgtcctttacactggtgctcatcgaagaaagggtgacccgagccaagcatttgcagcttatgggcggactgtctcccacattgtattggttgggaaacttcctctgggatatgtgcaattacctcgtgccagcctgcatcgttgtgcttatctttctcgccttccagcagcgagcctatgtagctccagcaaaccttcctgcgcttctgttgttactcctgctctacgggtggagtatcactccactgatgtaccctgccagctttttcttctccgttccttctaccgcatacgtcgtgttaacctgcatcaatttgttcattggaatcaatgggtctatggccacgtttgtgctagaactgttttccgatcagaaactgcaagaagtatctcgaattctcaaacaagtgtttcttatatttccacacttttgcttaggaagaggactaattgatatggtccgcaatcaagccatggcagacgcgttcgagcggctgggagaccgccaatttcagtctcccctgagatgggaagtggtcgggaagaatctgctggccatggtgattcagggcccactgtttctgctcttcacactgttgctgcagcatcgctcacaattgctgccccagccgagagtgcgtagccttcccctccttggggaggaagacgaagatgttgcccgtgagagggagagggttgtacagggcgctactcaaggagatgtccttgtgcttaggaatctgaccaaggtttataggggtcaacgcatgcccgctgtggatagactttgtctgggaattcctccaggcgagtgtttcggtctgctaggggtgaacggagcaggcaaaacatctactttccgtatggtaacaggagatacgcttgcctcccggggagaagcggtgctggccggtcactctgtcgccagggagcctagcgccgctcacctgtccatgggctattgcccacaatccgacgctatctttgaactgcttacagggagggaacacctcgagctgttagctaggctgagaggcgtgccggaggctcaggtcgctcagaccgcaggctccggcctggccaggcttggactatcatggtatgccgacagaccagcaggcacatacagcggcggaaacaagaggaagcttgccacagccctggcactggtgggcgatcccgctgttgtctttttagacgaacccacaacgggaatggatccaagtgccaggcggttcctctggaactctcttctggcagttgtcagagagggcaggtccgtaatgctgacgtcccattccatggaggagtgcgaggctctctgctcacgactggctatcatggtgaatggccgttttaggtgcctcggtagtccacaacatttgaaggggaggttcgccgctgggcacacgctgactctgcgggtgcctgcggcaagaagccagcctgctgcggcattcgtggccgctgaattcccaggtgcggagctgcgtgaagcccatggtggacggctgcgatttcaactgcccccaggaggtcgttgtgctctggcccgagtttttggcgagttagcagtccacggggcagagcatggagtcgaagatttttcagtatctcaaaccatgctagaggaggtctttttatatttctctaaggatcaggggaaggacgaagatacggaggaacaaaaggaagctggtgtgggggtggatccagctcctgggctacaacatcctaagcgagtttctcagttcctggatgatccatcaacagcagagacagtactgtat

SEQ ID NO: 215364 - DNA, 6440 bp, Artificial Sequence
  Description of Artificial Sequence: Synthetic coding sequence
atggcattctggacccagctgatgctgctgctgtggaaaaactttatgtataggcgcagacaacccgtgcaactcttggtggagttgttatggcccttgtttctgttctttatactggttgccgtccgtcattcccaccccccactcgaacaccacgaatgccacttccctaacaagcctttgccttcagctgggactgtcccctggctccagggtctcatatgtaatgtgaacaatacatgttttccccagcttacgcccggagaggagccagggagactctctaatttcaacgacagcttggtcagtagactcttagcagatgccaggactgtcttggggggagcgtctgcacaccgaaccctggctggcttggggaaactcattgcaacactacgcgctgctagaagcaccgctcagcctcagcccaccaaacaaagccctttagagccacctatgctcgatgtggccgagctgctgacatctctgctgcggaccgaaagcctggggttggccttaggacaggcacaggaacctcttcactctctccttgaggccgctgaggatctcgcccaggaactgctggcactcagaagcctggtggaactgagggcccttctgcagagacccaggggcacaagtggacccttggaactgctgagcgaggccctctgttctgttcggggacccagcagcaccgttggaccaagcttgaactggtatgaagcttctgaccttatggaacttgtgggacaggagccggagtcagctttgcccgatagctcgctgtcccctgcatgctccgaattgatcggagcacttgactcccaccctctatcgagactcctatggagacgtttaaagccgttgattctgggtaagcttctttttgcacctgacacgcctttcactaggaaattgatggcgcaggtcaatcgtaccttcgaggaactgacacttctgagggatgtcagggaggtttgggaaatgctcggtcccagaatctttacatttatgaacgattcctccaatgtggcaatgcttcagcggctgctacagatgcaggacgaaggcaggcgtcagccacgtcctggcggaagggatcacatggaggccctgaggtcttttctcgacccaggctcagggggatattcctggcaggatgcccacgctgacgtggggcatctcgtgggcacgctcggcagagtgaccgagtgcctgtctctggacaagctggaagccgctccgtcagaagcggctctagtctcgcgcgcactgcagctgctagccgaacaccgattctgggctggcgtggtgtttctagggccagaggacagcagtgacccaacagagcatccaaccccagatctgggtcccggacacgtacggatcaaaattcgtatggacatcgacgtggtgacccgcaccaacaaaattagagaccgattctgggatccgggtcctgcggcagacccattaaccgatctgaggtacgtatggggcggatttgtgtacctgcaagacctggtagagcgcgctgctgtgagagtgttatcaggcgcaaatccccgagctggcctctacctccagcagatgccttatccctgctacgttgatgacgtgttcctgagggtgctgtccagatcccttccattgtttctgacgctggcctggatttactccgtgaccctgacagtgaaagccgtggtgcgtgagaaggagactcggctccgggacactatgcgagcgatgggcttgtccagggctgtcttatggctgggctggttcttgtcatgtcttggaccatttcttctttcagcggctttgctggtcctggtgctgaagctgggcgacatactgccctacagccaccctggggtagtctttctattcttggccgcttttgcagtggcaactgtgacacagagtttcttgcttagtgcctttttttcccgcgctaacctcgccgcagcgtgtggcggactcgcctacttctcactctacctgccgtatgtcctttgcgttgcctggcgagacaggcttccagctggcggacgggtcgccgcttccctactgagccccgtggcttttggcttcggctgtgagagcctggctctgctggaggagcagggggagggcgctcagtggcataacgttggtactagaccaaccgctgatgtatttagtttggcccaggtgagtggcctgttactgctggacgcagcactgtacggactggccacctggtacctggaggcggtgtgcccgggacagtatggcatccccgagccctggaacttccctttccggcgatcgtattggtgcggcccaaggcccccaaaatccccggcaccctgcccgaccccactagacccaaaagtgttagttgaagaggccccaccgggactctcccctggcgtttccgtgcgcagcttagagaaacgatttcccggatctcctcaaccagccctcagggggttatcactagatttttatcaaggacacatcactgcctttctcgggcacaacggagctggcaagaccactacactgtctatactctctggtttgtttcctccctcagggggatcagcctttattttaggccatgatgtgaggtcgtccatggcagcaattagaccccacctaggggtatgccctcagtataacgtcctgtttgacatgctgacagtggatgagcatgtctggttctatggcaggctgaaaggattgagcgcagccgtggtcggcccagaacaagaccggctgttgcaggacgtagggcttgtatctaaacaatcagttcagaccagacacctgtctggtggtatgcagagaaaactgtcagtcgccattgcattcgtggggggttctcaagtcgttattctcgacgagcccaccgcgggagtggatccagccagcaggaggggcatttgggagttgctgttaaagtatcgtgaagggagaacacttatcctgagcactcatcacctcgatgaagctgagctccttggcgaccgggtggctgtggtggccggtggtcgtctatgttgctgcggttctccgctgtttctgcgcaggcatcttgggagtggctactatctcaccctggtaaaagctaggcttcctctgacaactaatgagaaagctgataccgacatggaggggtctgttgacacccggcaggaaaagaagaatggctcccagggctccagggtgggtacgcctcagttactggcactagtccaacactgggtgcccggagcacgcctcgtggaggaacttccacatgaactggtactcgtgcttccatatactggagcgcatgatggatcttttgccacactgttccgggaactggacactcgcctggcggagctccgcctgactggatacggcatcagcgacacttccctggaggaaatattcctcaaagtggtggaagaatgcgcagccgacaccgacatggaagacggctcatgtgggcagcacctctgcaccggaattgcgggtctggatgtgaccctgcggttgaaaatgccccctcaggaaacagctcttgaaaacggagaaccagccggttccgcgcctgagaccgatcagggttcagggccagatgcagtgggtagagtgcaggggtgggcactcacgcgacaacagctgcaggctcttctcctaaagcgctttctgctcgccagacgcagtcgtagaggtctgtttgcccagatcgttcttcctgcactctttgtgggtctcgctttggtcttcagcttaattgtgcctccattcgggcattaccctgcgttacgcttgtcccctacaatgtatggggctcaggtgtcgttcttttccgaggacgccccaggtgatccgggtagagccaggctcctggaagccttgctccaggaggccggtcttgaggaaccaccggtgcaacacagctcccataggttttctgcacctgaagtgccagccgaggtggccaaagttctggcatctggaaattggacccccgagtcgccttccccagcttgccagtgttctagaccaggggctcggagactcctccccgattgtcccgcagctgccggagggcctccacctccccaggccgtgaccggttcgggagaggtagtccagaacttaactgggagaaacttgtcagactttttggtgaaaacataccctagactggtgagacaagggctcaagacaaaaaagtgggtgaacgaggtgagatacgggggattcagcctggggggtcgggatcccggtctgccttcgggacaggaactggggaggagcgtagaagagttgtgggctcttcttagccccttacctggtggggctctggaccgggtgctcaaaaaccttactgcttgggcgcactccctggacgcacaggacagcctgaagatttggtttaacaataaaggatggcacagcatggttgcattcgtgaatcgcgcatccaacgcaatcctccgggctcacctccctcctggcccagctcggcacgcccactcaattaccacactgaaccaccccctgaacctgactaaagaacagctgagcgagggcgctttgatggcctcttccgtggatgtccttgtatcgatctgcgtggtcttcgcaatgagtttcgttcctgcctcctttaccctggtattgatagaagagagagtcacaagagcgaaacacttgcaactgatgggcggactttccccaacattgtactggttgggaaactttctgtgggatatgtgcaactacctggtgcccgcttgtatagtcgttttgatttttctggctttccagcagagggcctatgtagcgccagccaatttacctgctctcctgctgttactgttgctgtacggctggagcatcacgccactgatgtaccctgccagcttcttcttcagcgttccgtccaccgcctatgtagtactgacatgtatcaacttattcatcgggataaacggtagcatggctaccttcgtgttggaacttttctcagatcagaaattacaggaggtatcccgtatcctgaagcaggtctttcttatcttcccccacttttgtctgggtcgcggtttgattgatatggtgaggaatcaggctatggccgacgcctttgagaggcttggcgacagacagttccagtccccattaaggtgggaagtggtaggtaagaatctgctggccatggttattcagggcccactattcctcctctttactctgctgttacaacaccgatcccagctcctcccccagccacgagtgcgaagtctgccactgctaggagaggaagatgaagacgttgcgagggagagagagagggtcgtgcagggggcaacccagggcgacgtcctggtgctgcggaaccttacaaaagtgtaccgagggcagagaatgcccgctgttgatcggctgtgccttggcattcctcccggtgaatgtttcgggcttctaggagtcaacggagcaggcaagacgagtaccttccgaatggtgacaggcgatacgctggccagcaggggagaggctgtcctcgcagggcattccgttgccagagagcctagcgccgctcatctttcaatgggttactgtccccagtctgacgccatatttgagctgctcactggaagggaacacttagaactgttagcaagactgaggggcgttccagaggcccaggtcgcccagacagcaggcagcggcctggccaggcttggcctcagctggtacgccgaccgcccagccggtacatactcaggcggtaacaaacgaaagctggccacagcactggcattagtcggggacccggcagtcgtctttctggacgagcccaccacagggatggatccgtcagccaggagatttctctggaactcactgcttgcggtggttagagagggcaggtccgtcatgttaacgtctcacagcatggaagaatgcgaggccctatgctcccggctggccataatggtcaacggtcgctttagatgcctaggctccccacagcatctgaagggcaggttcgccgcaggtcacacattgacacttcgcgtccctgccgctcggagtcagcctgcagcagcatttgtcgcagcagagttcccaggagctgaactgcgtgaagcacacgggggacgccttcggtttcagttgccccctggcggacggtgcgccctagccagggttttcggagagctcgctgtgcatggtgcggagcacggggtggaggacttttccgtgagccaaacaatgctggaagaagtttttctctatttcagtaaggaccagggaaaggacgaggacacagaagaacaaaaggaggctggggtgggggttgatcccgctcctggcctccaacaccctaaaagggtatcccagttcttggacgacccctcaactgcagagaccgtgttata

SEQ ID NO: 215365 - DNA, 495 bp, Artificial Sequence
  Description of Artificial Sequence: Synthetic coding sequence
atggcattctggacccagttaatgttgctcctctggaagaactttatgtaccgcagacgtcaacctgtgcaactcctcgtcgaactcctgtggcctctcttcctgttttttatcttggttgcagttcgccattcccacccccctctagaacaccatgagtgccacttcccgaacaaacctcttcccagcgccggaactgtgccttggctccagggactcatctgtaacgtgaacaacacatgcttcccccagctcacccctggtgaagaacccggacgcctatccaacttcaacgatagcttggtcagccgtcttctggccgatgccagaacagtgctgggcggtgcctcagctcatcgaaccctcgctgggttgggaaagcttattgcaactttgagggcagccaggtccactgcccaaccccagcccaccaaacaatcaccgctcgagccacccatgctggacgtggcggagcttctgactagtctgctatag

SEQ ID NO: 215366 - DNA, 4746 bp, Artificial Sequence
  Description of Artificial Sequence: Synthetic coding sequence
atgaggaaacgaaaaatcagtgtgtgccagcagacatgggccctcttatgcaagaactttctaaagaaatggcgcatgaaacgtgagtccctgatggagtggctgaatagcttacttctgttattgtgcctgtacatctatccccatagtcaccaagtgaacgacttctcatctttattgacaatggatctgggacgggtggacacttttaacgaatctcgattctcagtagtgtatacccccgttactaacacgactcagcagatcatgaataaggtcgcctcaacaccatttctagccggtaaggaagtactgggccttcccgatgaagaaagcattaaggagtttacagctaactaccctgaagaaatagtgcgggtcacttttaccaatacttatagctaccatttgaaatttctgctcgggcacggtatgcctgcgaaaaaggaacataaggatcataccgcccattgctatgagaccaatgaggatgtgtattgcgaggtgtcagttttttggaaagaggggttcgtggcactgcaagccgctatcaacgccgcaattatcgagatcactacgaaccattccgtaatggaagaactgatgagtgtgacaggcaagaacatgaagatgcactcatttattggccaatcgggagtgatcacagacctctatctctttagttgtataatcagcttctcgagcttcatttactatgccagcgttaatgtgacgcgggagcgcaaacgaatgaaagcacttatgacaatgatggggctaagggatagcgccttttggctgtcttggggtcttctgtacgccggatttatcttcattatggctctgttcttggctctggttattcgaagtactcagtttataatattatcagggtttatggtcgtgttcagcctgtttctgctgtacggcctcagtcttgtcgctttggccttcctcatgtccatcttggtgaaaaagagcttcctgaccggacttgtggtgttccttttaaccgtcttctggggctgtttgggttttaccagtctgtaccgccatctgccggcatccctggaatggattctgtccctcctctcgccattcgccttcatgctcgggatggctcagctcctccacctggattacgacctgaattcaaatgcttttccacacccttccgatggcagtaacctgatagtggctaccaatttcatgctcgcctttgacacttgcctgtacctggctctagccatctattttgagaagatccttccgaatgaatacggacaccgccgaccgcctctgttctttcttaagagctcgttctggtctcagacacagaagaccgatcatgttgccctggaggatgaaatggacgctgaccccagcttccacgattcatttgaacaagctccccctgagtttcagggcaaggaagccatcaggatacggaacgtgacaaaagagtacaaaggaaagcccgacaagattgaggccttgaaggatttagtattcgatatatatgaaggccaaattactgcaatcctcgggcacagcggggctggaaagagtactctcctgaacattctttctggcctgagtgtgcccacaaagggttctgtgaccatatacaataacaaactgtccgaaatggcggacctagagaatctttctaaattaacgggcgtgtgcccgcagtctaacgttcaattcgactttcttaccgtccgcgagaaccttcggctcttcgccaaaattaagggcatccttcctcaagaggttgataaggaaattttcttgctggacgagcccactgctggcctcgatcccttctccagacaccaggtctggaatctcctgaaggaaagaaaaaccgacagggttatcctctttagcacgcagttcatggatgaggccgacatcctggcagatcgcaaagtctttctgtcgcaaggtaagctgaaatgcgccggatcatccctcttcctgaaaaaaaagtggggaattggctaccacctcagcctccagctgaacgaaatttgtgtggaagagaacatcacatccctggtgaagcaacacatcccagatgctaagctcagtgcaaagtcagagggcaagttgatctatactttgcctctggagagaaccaataagtttcctgagctctacaaagatctggatagctatcctgacttaggaatagaaaattacggagtcagtatgacaaccttgaatgaggttttcttgaagctggagggaaagtctaccattaatgagtcagatatcgctatcctaggcgaagtacaggcagaaaaggccgatgacaccgagcgactagtggagatggagcaggttttgtccagtcttaataagatgcgcaagaccatcggcggtgtggccctgtggagacagcaaatttgtgctatcgcccgagtgaggctgttaaagctaaagcacgagcgcaaagccctacttgcgttattgcttatcctgatggcgggattctgccccctcttggtggaatatactatggtaaagatataccaaaatagctatacctgggagttgtccccccatctgtatttcttggctcccggtcagcagccccacgaccccctcactcagctgctgattattaacaagaccggcgctagcatcgatgattttattcaaagcgttgagcaccaaaacatcgctttagaggtagacgcgttcgggactaggaacggaaccgacgatccttcttataacggtgctatcaccgtttgctgtaatgagaagaactattcattctccctagcatgcaacgccaagaggttaaattgcttcccggtcctgatggacatcgtgagtaatggactgctcggcatggtgaagccgtctgtacatatccgcaccgaacgaagtacatttctcgaaaacggtcaggataaccctataggattcttggcatacataatgttctggttagttttgacgagcagttgtcctccttacatcgccatgtcctccatcgacgattacaagaatcgggctcgctcgcaactgcgtatctctggcttgtccccctcggcctattggtttggtcaagccttagtcgatgtatctctctacttcctggtgtttgtgttcatttaccttatgagttacatttccaattttgaggacatgctgctcaccattattcacatcatccagatcccttgcgcagtcggatactccttctcgctcatattcatgacttatgtaatatcatttatcttccggaagggccgaaagaactccggcatatggagcttctgcttttacgttgttactgtcttctcggtggcagggtttgcttttagtatctttgaatccgatatcccttttatcttcactttcttgatcccgcctgccacaatgatagggtgcctatttctgtcttctcacctgctcttctcctctctattttctgaagagcggatggacgttcagcccttcttagtgtttctgatccccttcctccacttcattatcttcttgtttactttgcgatgcctggagtggaagtttggcaaaaaaagtatgagaaaggaccctttttttcgaatctcccccaggtccagtgacgtgtgtcagaaccccgaagaacccgaaggtgaggacgaggatgtgcaaatggagcgggtgcgcactgccaatgccttgaactcgacaaactttgacgagaagcccgtaatcattgcgtcttgccttcggaaggagtatgctggaaaacggaagggatgtttctcaaaaaggaagaataagatcgcaacccgcaacgtgtcattttgcgtgcgcaaaggagaggtattgggactgctcggccataatggcgctgggaaatcgaccagcatcaaagtgataactggggacacaaaacccactgccggacaggtacttcttaaaggtagcggcggtggagacgcactagagttcctcgggtattgtcctcaggagaacgccttgtggcctaatttaacagtgcggcagcacctcgaagtttatgcagccgttaagggactacgtaaaggcgatgccgaagtggccataacgcgcctggtggatgccctgaagttgcaggatcagctcaagtccccagtgaagacgttgtctgaaggtatcaaacgcaaactttgttttgttctcagtattctgggcaatccatcagtcgtgttattggacgaaccttccactgggatggatccagagggccagcagcagatgtggcaagctattagagccacattccggaataccgaaagaggggctcttctcacaactcactacatggctgaagctgaggctgtgtgcgacagggtcgctatcatggtaagtggcaggctacgctgcatcggcagcatacagcacttaaagtccaagttcggcaaggattaccttttagagatgaaggttaaaaatctggctcaggtcgagccattgcatgctgaaatactgcggctgtttccccaggccgctcgacaggagagatactcctcactcatggtatataagttaccggtggaggacgtgcagccgttagcccaagccttctttaagctggagaaggtcaagcaatccttcgacctggaggaatactccttgagccagagcacccttgagcaggtgtttctggaactgtccaaagaacaagagttgggcgacttcgaggaagatttcgatccttcagtcaagtggaagttgctgccccaagaggagccgtag

SEQ ID NO: 215367 - DNA, 801 bp, Artificial Sequence
  Description of Artificial Sequence: Synthetic coding sequence
atgcgtaagcggaaaattagcgtgtgtcaacaaacgtgggcactgctctgtaaaaacttcctcaaaaagtggagaatgaagcgagaaagtttgatggaatggcttaattccctcttactgctgctttgtctttacatctatccgcatagccatcaggtgaatgactttagctccttactaaccatggaccttggccgagtggacacctttaacgagagcaggttttcagttgtgtacacaccagtgactaataccacccagcagatcatgaacaaagtggcttcaacaccttttttagccggaaaggaggtgctggggctgcctgacgaggagtctatcaaagagttcaccgccaattatcctgaagaaatcgtgagagtgacctttactaatacttactcatatcatctaaagtttctgttggggcacggcatgccagccaaaaaggagcataaggatcacactgcacattgttacgagaccaacgaggacgtgtattgcgaagttagcgtcttctggaaggagggctttgtcgcacttcaggccgctattaatgccgctattatagagatcactactaaccactctgtcatggaagaactgatgtccgtgacgggtaagaacatgaagatgcattcatttatcggtcaatccggcgtcattacagatttgtatctcttcagctgcattatatctttttccagtttcatctactacgcatcagttaacgttacccgggagcggaaaaggatgaaggccctgatgactatgatgggtttgagggatagcgcattttggtag

SEQ ID NO: 215368 - DNA, 4866 bp, Artificial Sequence
  Description of Artificial Sequence: Synthetic coding sequence
atgagaaaaaggaaaatctccgtgtgccagcaaacatgggcgcttttatgtaagaacttcctgaaaaaatggaggatgaagcgggagtcactcatggagtggctgaactctttactcttgctgctgtgtttgtatatttatcctcatagtcaccaggtgaatgacttctcctccttgcttaccatggacctgggcagggtagacaccttcaacgagagcagatttagcgtcgtatacaccccagtgaccaacacgacccagcaaatcatgaacaaagtggcgtcaactccctttttagctggaaaggaggttcttgggctacctgatgaagagtcaattaaggagtttacggcgaattatccagaggaaatagtgcgagtgacatttacaaatacctattcataccatttgaagtttcttttaggacatggtatgcctgcaaagaaggagcataaagaccacacagcgcattgctacgaaacaaacgaggatgtttactgcgaagtgtccgtgttttggaaggaagggtttgtggcgttgcaggccgcaatcaatgctgccatcatcgagatcaccacgaatcactccgtgatggaagagttgatgtccgtaactggcaagaacatgaagatgcactctttcatcggccaaagcggggtcataaccgatttgtatctcttcagctgtatcatcagtttcagcagtttcatttactacgcctccgtgaacgtcacccgtgaacggaagcgaatgaaagctctgatgacgatgatgggcctgagggatagtgcattctggctttcttggggtcttctgtatgcaggtttcatcttcatcatggccctgttcctggcactggtaattcggtctactcagttcattattctaagcggctttatggtggtgttcagcctgtttctgctctatggtctctcccttgtggcgctggcctttcttatgtctatcttggtcaagaaaagcttcctgacgggcctcgtcgtgtttcttttgaccgttttctggggatgccttggctttacgtccctataccgtcatctaccagcaagcttagagtggatcctgtctttgttgtcccccttcgccttcatgctgggaatggctcaattgctccatctcgactatgacctcaattctaatgcctttccccatccttccgatggctcgaatttgattgtcgccaccaatttcatgctagcgttcgacacctgtttatatttggccctggctatatacttcgagaagattctccccaacgaatacggtcaccggaggccgcctttgttcttcctgaagagctcattctggtctcaaacacagaaaaccgatcatgtggcactcgaggatgagatggatgccgacccttcatttcatgatagttttgaacaggcacctcctgaatttcagggtaaagaagccattcgaattaggaacgtaactaaggagtacaaaggcaagcccgataaaatcgaagctctgaaagacttggtgttcgacatctacgagggccagatcactgcaatcctcggtcactcgggcgcaggaaagagtactctcttgaatatcctatccgggctgagcgtgccgacgaagggttcagtcaccatatataacaataagctgtctgagatggccgacctcgaaaatctatctaaactgaccggggtgtgcccccagagcaatgtgcagtttgacttcctaaccgtccgcgagaacctccgacttttcgcgaagataaaaggaattctaccgcaagaggtggacaaagagatccaacgtgtcctcctggaactagagatgaaaaatattcaagatgtgctggcacaaaacctgtcaggcggtcaaaagcggaagcttacatttggaattgcaattctcggagatcctcagatttttctcctcgacgagccaacagcaggactggaccctttcagtaggcaccaggtatggaaccttcttaaagagaggaagacagatcgggtgatcctcttctccactcagtttatggacgaagcagacattctagccgacaggaaagttttcctttcacagggcaaattaaaatgtgctggatctagtctttttctaaagaaaaagtgggggatcgggtaccatttatccctacagctcaacgagatttgcgtggaagagaatattacctccctggttaagcagcatatcccggacgccaaattgtctgccaaaagtgaaggaaagctgatatacaccctgcccctggaaaggacgaacaagttcccagagttgtacaaggacctggactcataccccgatctcgggatcgaaaactacggtgtgtctatgaccaccctgaatgaggtctttcttaaactcgagggcaaatctactatcaacgaatccgatattgccatccttggcgaggtgcaggccgaaaaagccgatgatacagagcggttagtggaaatggagcaggtcctgtccagtctcaataagatgcggaagacaatcgggggagtagccttgtggcgccagcaaatttgtgcgatagccagggtgcgactgctcaaacttaagcacgaacgcaaggcactcctggccctgcttcttatcctcatggcgggattttgcccattgctggtggagtacactatggtgaagatctatcagaacagctatacttgggaattgagcccacacctctatttcttggcacccggtcagcagcctcacgatcctctgacgcagctgctgatcattaacaagaccggagctagtatagatgattttatccagtctgtggaacaccagaatattgctctggaggtcgacgctttcgggacccgaaatggcacagacgacccatcatacaatggagcaatcaccgtatgctgcaatgaaaaaaattatagtttttccttggcttgcaatgccaagcggctcaactgcttccctgtcctgatggacatcgtttcaaatgggcttctgggcatggtgaaaccaagcgtgcatatacgtacagagcggagcactttcctggagaacggacaggataatccaattggttttttggcttacattatgttttggctggttctgacatcttcttgccccccttatatagctatgtcctctatagatgactacaagaacagagctaggagccaattaagaatctccggactcagtccttccgcttactggtttggtcaagctctcgtcgacgtgagcctgtactttttggttttcgtattcatttatcttatgagctacatctccaacttcgaggatatgctgttaaccattatacacattattcagatcccatgcgccgttggatatagtttttcactcattttcatgacatacgtgatctcttttatctttagaaaaggccgaaaaaattctggcatctggagtttctgcttttacgtggttaccgtcttcagcgtcgcgggattcgcttttagcatattcgaatctgatatacctttcatcttcacatttctgatccccccagctacaatgatcggctgtctctttctgtccagtcacctactgttctccagccttttctctgaagaacgcatggacgttcaaccattcctggtcttcctgattcccttcctgcatttcataatcttcctgttcactctaaggtgcctggaatggaagttcggaaaaaagagcatgcgtaaagatccgttcttccgcatcagcccgagatcgtcggatgtgtgtcaaaatcccgaggaaccggagggagaggatgaggatgtccagatggaacgggtcagaactgccaacgccctgaattcgactaacttcgacgaaaagccggtcatcatcgcgagctgccttcgcaaggaatacgcaggtaaacgcaagggctgctttagtaaacggaaaaacaaaatcgcgacccgaaacgtctctttttgtgtgaggaagggcgaagtgttgggtctgctgggacataacggcgcaggaaagtcgacctctattaaggtcattaccggggatactaagcctaccgccggacaggtgctacttaagggcagcggtgggggagatgctctcgagttcctggggtattgcccacaggaaaacgcgctgtggcccaatctgaccgtgcgacaacatctggaggtgtatgctgctgtcaagggtctaagaaagggtgacgcggaggtcgccattactcgcttggtggatgcgctgaagctacaggaccagctcaaatctccagttaagacactcagtgagggcatcaaaagaaaactgtgttttgtcttgtccatcctgggcaatcctagcgtggtgttgttggacgaaccctctaccggtatggacccagaagggcagcagcagatgtggcaggccatacgagccactttcagaaacactgaacgcggagctctgctgactacacattacatggcagaagctgaggccgtgtgtgacagggtagccataatggtgtctggtcgattgcgctgtatcggtagcatccagcacctgaagagtaagttcggaaaggactacctgctggaaatgaaagtgaaaaacctggcgcaggtcgagcccctgcatgctgagatcttgcgcctcttcccccaagccgcaagacaagagagatatagttccttaatggtttacaagctaccggtggaagacgtccagcctctggcgcaggccttctttaagcttgaaaaggtgaagcaatcatttgatcttgaagagtacagcctgagccaatccacacttgagcaggtctttctggaactgtcaaaggagcaagaactgggggactttgaggaggattttgacccctcagtaaagtggaaactgctcccgcaggaagagccgtag

SEQ ID NO: 215369 - DNA, 3312 bp, Artificial Sequence
  Description of Artificial Sequence: Synthetic coding sequence
atggaccttggtagagtcgacacctttaacgagagtcgcttcagcgttgtctacaccccagtaacaaacactactcagcagattatgaataaggttgcctctactccatttcttgctggaaaagaggtgctcggattgccagacgaagaatcaattaaagagtttacagctaattacccggaagaaatcgtaagagttacattcactaacacctactcctatcatctgaagtttcttctgggccacggcatgcctgccaagaaagagcacaaggatcatacagcccactgttatgaaaccaacgaagatgtatattgcgaagtgtcagtcttttggaaagagggcttcgttgcattacaagcagcaattaacgccgctatcatagaaattaccacgaaccactccgtcatggaggagctgatgagtgtgactgggaagaatatgaaaatgcactcttttatcggccagagcggcgttatcaccgatttgtacctcttctcttgcatcattagtttcagctcctttatctattacgcctctgtgaacgtaacaagggaacggaagcgcatgaaggctctcatgactatgatgggcctcagagactctgctttctggctgagctggggccttctctacgcgggtttcatctttatcatggcattatttttggccctcgtcatccgtagcacacaattcatcatcctgagcgggtttatggtggtctttagtctgtttctcctgtacggcctctcactagtggctctagctttccttatgtcaatactggtcaagaagagctttctcaccggcctggtagtgttcttgctgacagtgttctggggatgcctgggattcacaagtctttatcgccacctccctgcctccctcgagtggatcttgtcactactgtccccctttgcattcatgcttggaatggcgcagctcctccatctggactacgacctcaactctaacgctttcccccatccttcagatggatcaaacctgatagtggctactaactttatgttggcctttgacacatgtttatacctcgccctggccatctactttgaaaaaatcttgcccaacgagtacggtcaccggagacctccactgttcttcctcaaaagttcattctggtcccaaactcagaagacagatcacgtggccctcgaagatgaaatggacgcagacccttcttttcatgatagctttgaacaggccccaccggagtttcagggaaaagaggcaatcagaattcgaaacgtcacaaaagagtacaagggcaagcccgacaaaatcgaagctctcaaggatctggtatttgatatctatgaagggcagataactgccattcttggacactcaggtgccggaaaaagcacactgctgaatatcctctctgggctgtcagttcccacaaagggatcagttacaatctacaacaataagttgtcagaaatggccgacctggaaaatctgagcaaattaaccggcgtctgtccacaatctaacgtgcagttcgatttcctcacagtgcgggagaatctgcgtctttttgcaaaaatcaaaggaatccttccacaggaggtggacaaggaaattcaaagagtcctattggagctcgagatgaaaaacattcaagacgtgctggcgcaaaatctaagcgggggacaaaagaggaagctgacctttggaattgcaatcctcggcgacccacagatatttctgcttgatgaaccaactgcaggactggatcccttttcgcggcatcaggtctggaatctcctaaaagaacggaaaaccgatagagtaatcctattctctacccagtttatggacgaagctgatatattagccgacagaaaggtgttccttagccagggtaagttgaagtgtgcgggtagtagtctttttcttaagaagaaatggggcattggctaccatctgtccttgcagttgaacgagatctgtgtcgaagagaacatcaccagcctggtgaaacagcacattcccgacgctaaactgagcgccaagagcgagggaaagctcatttatacactgccactggagcgcaccaacaaattccccgagctgtataaggacctagatagctatccagatcttggaatagaaaactacggcgtctccatgaccacactcaacgaagtattcctgaaattggagggtaagagcacaatcaacgagtccgacattgccatcctgggagaggtgcaggcagaaaaggcggacgataccgaacggttagtggagatggaacaggttctgagttctttaaacaagatgaggaaaaccattggcggtgtcgcactctggcggcaacaaatctgcgccatcgcccgagtgcggctcctcaagttgaaacatgaaagaaaggccctactggcgctgctgctgatactgatggccggtttctgccccctgctggtggaatataccatggtgaagatttaccagaactcctacacatgggagctgagcccccacctttactttctggcaccgggacagcaaccacacgaccccctgactcagctgctaataatcaacaaaaccggagcatctattgatgactttatccagtccgtggaacaccagaacattgcattagaggtggatgcctttgggacccggaacggcactgacgacccctcttacaacggtgcaataaccgtttgttgcaatgaaaagaattattccttttctctggcttgtaacgctaagcgcctcaattgtttccccgtgttgatggacattgtgtccaacgggctgttgggtatggttaaacctagcgtacatattcggaccgaacggtccacgttcctcgaaaatggtcaggataatccgataggcttcttagcctacataatgttctggctggtactcacaagcagttgcccaccttacatcgctatgagctccattgacgattacaagaaccgggctagatcacaactgcgaatttctgggctgtccccatctgcctactggtttggccaagctttggtagatgtgagcctatatttcttggtatttgtgttcatttatctcatgtcctatatctctaatttcgaggacatgctgctcactatcatacatattatccaaatcccttgcgcggttgggtattccttttcacttatatttatgacttacgtgataagcttcatcttccggaaaggacggaaaaactcgggtatatggtctttctgtttctacgttgtcagtatttttctggtcgacgtctattgcatctatctgatttacaattcggaattgatcctttag

SEQ ID NO: 215370 - DNA, 471 bp, Artificial Sequence
  Description of Artificial Sequence: Synthetic coding sequence
atgctaggaatggcacaactgcttcatcttgattacgacttgaactctaatgcttttcctcaccctagtgatggctccaacctgatcgtggccactaactttatgctggcctttgatacgtgcttatatcttgctctcgccatatacttcgaaaagattctccccaatgagtatggccacaggaggcccccactgttcttcctgaaaagtagtttctggtcccaaacccagaagactgatcacgtagccctggaggacgagatggacgcagaccctagcttccatgacagctttgagcaggcacctccggagtttcaagggaaggaggcaattcgaatccgcaatgtcaccaaagagtataaaggtaagccggacaagatcgaggctctcaaagacttagtgtttgatatttacgagggtcagattacggccatccttgtcacagtggagttagaatcccagcattgttag

SEQ ID NO: 215371 - DNA, 4875 bp, Artificial Sequence
  Description of Artificial Sequence: Synthetic coding sequence
atgtccaaacggagaatgtccgtgggtcaacagacctgggctcttttgtgcaaaaattgtctgaagaagtggagaatgaagagacagacactgctcgaatggctgttctcatttctgctggtgttattcctgtacctgtttttcagcaacctccaccaggtccatgacacaccccagatgagttccatggatctcggcagagtggactcttttaacgacactaactacgtgatcgccttcgcgcctgaatcaaagactacccaagagattatgaataaagtggcctctgctcctttcctcaagggccgaacgattatgggatggcctgatgaaaaatccatggatgagctggatttgaactattcaatcgacgcagttagggtgatttttaccgatacattttcataccacctcaaattctcttgggggcatcgcattcccatgatgaaggagcatcgcgatcactccgcccactgccaggcggtcaatgagaagatgaaatgtgaagggagtgaattttgggagaaggggttcgtggccttccaggcggctattaatgccgctataattgagattgcgactaatcactctgtgatggagcagcttatgtccgttactggcgtgcacatgaaaatcctgccttttgtggcccaagggggtgtcgccacagactttttcatatttttttgtatcatttctttttctacctttatctattatgtgagtgtcaacgtgacacaggagcgacagtatatcaccagtctgatgactatgatggggctgcgggagtctgcattctggctatcatggggcctcatgtacgccggttttattctgattatggcaaccctgatggccctgattgtaaagtccgcacaaattgttgttctgacaggcttcgtaatggtctttacattattcctcctgtacggcttatccctcatcactttagccttcctgatgtccgtgctgatcaagaagccctttctcactggactcgtcgtgttcctcctgatcgtgttttggggaatcctgggctttcccgcactctacacccgcctgcccgcttttcttgaatggactctttgtttgctgtctcctttcgctttcaccgtgggtatggctcaactcattcacttggactacgatgtgaattcaaacgcccacctggattctagccaaaatccctatctgatcatcgctacgctttttatgttagtctttgacactcttctttatctcgttcttaccttgtactttgacaagatactgcccgctgaatatggtcaccgttgtagtcccttattttttctcaagtcatgcttttggtttcaacatggcagagcaaatcacgtagtgcttgaaaacgagacagactctgatcctacaccgaacgactgtttcgaacccgtgtcccctgaattctgtgggaaggaggccatccgcatcaagaacctgaagaaagagtatgccggaaagtgcgaacgagtggaggccctcaaaggcgttgtgtttgatatttacgagggccaaataacagccttactgggccattcgggcgcagggaagacgacactgctgaacatactttcgggccttagcgtgccaactagcgggtccgtcaccgtgtataaccataccttgtcccgcatggccgacattgaaaacattagtaagttcaccggattttgcccccagtctaatgtacagttcggtttcctgacagtaaaggagaaccttcgactttttgcaaagatcaagggcatcctgccgcatgaggttgagaaggaggtgcaacgtgtagtgcaggagttggagatggaaaatattcaggatatcttagctcagaatctcagcggaggtcagaacagaaaactgaccttcggtatcgccattctcggagacccccaagtgctgctgctcgatgaacctaccgctggactggaccctttaagtcgacacagaatatggaacttgctgaaggagggaaaaagtgatagggtgatcctgttttcaacacagtttattgacgaagcagacatcctcgcagacagaaaagtatttatcagcaacggtaagttaaaatgtgctgggtctagtctgtttctgaaaaaaaaatggggcatcggatatcacctgtcattacatctgaatgaaagatgtgaccctgagtcaatcacctctctcgtaaagcaacacatttccgacgccaagctcacagctcagtcagaggagaagcttgtttatatattacccctcgagagaaccaacaagtttcccgagctgtatcgggatctggaccgctgctctaatcaggggatagaggactacggggtgtcaattactactctaaatgaggtcttcctcaagttagaaggaaaaagcaccatagacgagagcgacattgggatctgggggcagttacagaccgacggcgcaaaggatataggctcacttgtcgagctggaacaggtactgtcatccttccacgagactcggaagaccatcagcggagtggccctctggcgacaacaggtctgtgccatcgctaaagtaagattccttaagctcaaaaaagaaagaaagtcactgtggaccatactgctcctctttggtatctcctttattccccagcttctggaacatttgttttatgagagctaccaaaaatcttacccttgggagctttcccccaatacatactttctcagccctggacagcagccccaggatccccttactcacctgctcgtcattaacaagaccggcagcacgatcgacaacttcctgcatagcctccgcaggcagaatatcgctatcgaagtcgatgcatttggcaccaggaatggcaccgatgatccttcttacaatggggctatcattgtttctggcgatgaaaaggaccatcggttcagcatagcttgcaatacgaaacgactgaactgctttcccgtgctgttggacgttattagtaacggtctactggggatcttcaacagcagtgaacatatccaaacagacaggagtactttctttgaagagcacatggattatgagtacggatatcggagcaacacctttttttggatcccaatggccgcttcatttacaccttacatagccatgagtagcattggggactataaaaagaaggcccacagccagctgcgcatcagtggactctaccctagtgcatattggtttggccaggcgctggtggacgttagtttatatttcctgattctactgctgatgcagataatggactatatctttagcccagaggagattatctttatcattcaaaaccttctaatccagatcctctgtagtattggctacgtgagctccctggtcttccttacttacgtgatctccttcatcttcaggaacggccgtaaaaacagcggaatttggagcttcttctttttgattgttgtcatattcagcatcgttgccacagacttaaacgaatatggttttctaggtctgttttttggcaccatgttaatcccaccatttactcttattggatcactgttcatttttagcgaaatcagccctgacagcatggattacctgggagcctcagagtctgagatagtgtacctggcccttctcataccatacctgcattttctaatttttctgttcatcctgcgctgccttgagatgaactgccggaaaaagctgatgaggaaggaccctgtgttccgcattagcccgagatctaacgccatttttccaaatccagaggaaccagaaggcgaggaagaagatattcagatggaacgcatgcgcaccgtcaatgcgatggctgtgcgtgatttcgatgagacaccagtaatcatagctagttgcttgcggaaggagtacgccggtaagaagaagaattgcttctccaaacgcaaaaaaaagattgcaacaagaaacgtatcattctgcgtaaagaagggcgaggtcataggtctgctcggccataacggggcagggaagagtaccaccatcaagatgattaccggtgacacaaagccaactgctggacaggtgattttgaaggggtcaggaggaggagaaccactcgggttcctgggctattgtccacaggaaaatgctctgtggccaaatctgacagtcaggcaacatctggaggtttatgcagcagtgaaaggtctgcggaagggagacgccatgattgccattactcggctggtggatgccctgaagttgcaggaccagttaaaggccccagtcaaaaccctcagtgaaggaattaagcggaagttatgttttgtgttatctatactgggaaacccgtcggttgtgctgctggacgagcccagcaccgggatggacccggaaggtcagcaacaaatgtggcaagtgatacgggctacatttaggaacactgaaagaggggcactgctgactacccattacatggcggaagccgaggccgtgtgtgaccgcgtcgcgataatggtgtctggcagactgaggtgtattggctctattcaacacctgaagagtaaatttggcaaagattatctgcttgagatgaaattgaagaaccttgctcaaatggaacccctgcacgcggagatcctcaggctgtttccccaggccgcacagcaggagcggtttagtagtcttatggtgtacaaactcccagttgaagatgttcggccactgagtcaggcttttttcaagctcgagattgtaaagcagtcttttgatttagaggaatactccctgtcgcagagtacgctggagcaagtgtttttggaattgtcaaaagagcaagaattaggagatctggaggaggatttcgaccctagcgttaagtggaaactgctgcttcaggaagagccttag

SEQ ID NO: 215372 - DNA, 4308 bp, Artificial Sequence
  Description of Artificial Sequence: Synthetic coding sequence
atgtctaaaagacgtatgtcagtgggccagcagacgtgggccttgttgtgtaagaattgccttaagaagtggcgcatgaagagacagaccttgctcgagtggctgtttagcttcctccttgtgctttttctgtatctttttttttcaaatttacaccaagttcacgacacaccccaaatgtcatcgatggatctcgggagagtggacagttttaatgacaccaattatgtgatcgcatttgctcccgagagcaagactactcaggagataatgaacaaggtggcctccgccccatttttaaaaggtaggactatcatgggatggcctgacgagaagtccatggacgagcttgatctcaattacagcatcgatgcagtgagagtaattttcactgacaccttttcttaccacttgaagttctcctggggccatcgcatccctatgatgaaagaacaccgggatcattccgctcattgccaagccgtcaacgaaaaaatgaaatgcgaaggatctgagttctgggaaaagggatttgttgcattccaggctgcaatcaatgcagccattatcgaaatcgctactaatcatagcgtcatggagcagttgatgagcgtgaccggggttcatatgaaaatcctacctttcgtggcccaaggtggagttgccaccgatttttttatttttttctgtatcatctctttctctacattcatctattatgtgtcagtgaacgtcactcaagagagacagtacatcaccagcctgatgaccatgatgggcctgagagagtcagctttctggctatcctggggcctgatgtacgctggattcattctgattatggccacgcttatggcacttattgtgaaaagtgcacaaattgttgtcctaactgggtttgttatggtcttcaccctgttcctactttacggtctgagcctgatcaccctcgcttttcttatgtcagtgctaattaagaagccatttttaacaggcctcgtggtctttcttctaattgtattctggggaatcctgggcttccctgcgctatacactcgattgcctgcatttctggaatggaccctgtgcctcctttctcccttcgcgtttaccgtggggatggctcagctaattcacctggattacgatgtgaattccaacgcccatctcgatagtagtcagaacccgtacttgattatagcaactctcttcatgctagttttcgacacgctgttgtatctggtcttgacgttgtatttcgacaaaattctgccggctgagtatggccaccggtgtagccctctattctttctgaaaagttgcttctggtttcagcacggccgtgctaatcatgtggtcctggaaaacgagactgacagtgaccccactcccaacgattgctttgaacccgtttctccagaattctgtggaaaagaggccatcaggataaaaaacctcaagaaagagtacgcgggaaagtgcgaacgggttgaagctctgaaaggagttgtctttgatatttacgaaggccaaattactgcgctactagggcactctggcgctggcaaaaccaccttattgaacatcctttcaggcctgtcagtaccaacaagcggatccgttacggtgtacaaccacaccctgtcacgcatggctgacatcgaaaacatttcgaaattcaccggcttttgtcctcaaagcaatgtgcagttcggctttttgactgtcaaagagaacttgcgcctgtttgcaaaaatcaaaggcatccttccccacgaggttgagaaagaggtacaaagagttgtgcaggagctcgaaatggaaaatatccaagatatcctggcccagaatttaagtggaggtcaaaacaggaaactgacattcggcattgccattcttggagatccacaggtgctccttctggacgagcccacagcgggactcgaccccttatcccgccacagaatctggaaccttctcaaggaggggaagtctgatcgggtgattctcttttcgacccaattcattgatgaggcagatatccttgccgatagaaaagtgttcatcagcaacgggaaactgaaatgtgctggatcatcactgtttctgaaaaaaaagtggggcatcggttaccaccttagccttcacctcaacgaaaggtgtgatcctgaaagcattacctctttggtgaaacaacatatcagcgacgccaaacttacggcccaatcagaagagaagttggtgtatatcctgccattggaaaggaccaacaagtttcctgaactgtatcgcgatcttgatcggtgtagcaatcagggcattgaagattacggcgtctctattactactctgaacgaggtctttttgaagctcgaagggaagtccacgattgacgagtcagacatcggcatctgggggcagcttcagacagatggtgcaaaggacatcggctcccttgtcgagctggagcaggtgctgtcatcctttcatgaaacacggaaaacgattagcggtgtggccctctggaggcagcaggtttgcgccattgctaaagttcggtttctcaaactgaagaaggaaagaaagtcactgtggacaatcttattgctgttcggcatttccttcattccccagctgctggagcatctgttctacgagtcataccaaaaatcctacccctgggagctctccccgaatacatattttctcagtcccggacagcagccccaagacccccttactcatctcctggtcattaataagaccggctccacaattgacaatttcctccactctctgcgacgtcagaatatagccatagaggtggacgcatttggaactaggaatggaacagatgatccctcctacaatggtgctataatagtttccggagacgagaaggatcatagattctcaatcgcgtgcaacacaaagcgcctgaattgcttccctgtcctgctggacgtgatatcgaatggattgttgggtatattcaactctagtgagcatatacagacagacagatcaacctttttcgaagagcacatggattatgaatacggatatcggagtaacacattcttttggatcccaatggccgcaagcttcacaccctacattgccatgtcttctattggtgactataaaaagaaggcccactcccaactaaggatcagcgggctatacccctcggcttactggtttggacaggcactcgtggatgttagcctgtatttccttatccttttactgatgcagatcatggactatatattttcacctgaggaaattatttttatcatccagaatctgttaatccagattttatgtagcatcggttacgtatcatctctggtgttcctgacctacgttatctcatttattttcagaaacggaagaaagaactctggcatttggtcatttttctttctcatagtggtgatcttttccatagttgcaactgatctcaatgagtatgggtttttaggcctgttctttggcactatgctaatccctccctttaccctaattggttctctctttattttctctgaaatctccccagatagcatggattatctgggggcatctgagagtgagatcgtttatttggctctactgataccatatctccatttcctgatatttttgtttatcctgagatgccttgaaatgaactgtaggaaaaagctcatgcgcaaggatcccgtgtttcggatatctcctcggtcaaacgccatttttccaaacccagaggaaccggagggagaggaagaagatattcagatggaaagaatgagaacagtgaacgcgatggccgttcgagactttgatgaaacccccgttattatcgcttcctgcctgcggaaagaatatgcaggcaaaaaaaaaaattgcttcagcaaacgcaagaaaaaaattgctacacggaacgtgtccttttgtgtgaaaaagggcgaggtaatcggactcctcggccacaacggggcaggcaaaagcaccactatcaaaatgataaccggagacacaaagccgacagctggccaggtgatccttaagggctccggcggaggagagcctcttggcttcctcggatactgtcctcaagagaatgctttgtggcctaacctcacagtgcggcagcatctagaggtgtacgctgccgtgaagggcctgcgcaagggcgacgccatgatagcaattacccgccttgtggatgccttgaagttgcaagaccagctgaaggctcctgtaaagacactttccgaaggaatcaaacggaaggctggggacagtggacacctatag

SEQ ID NO: 215373 - DNA, 3423 bp, Artificial Sequence
  Description of Artificial Sequence: Synthetic coding sequence
atgagtgtgggacagcagacctgggcactgctctgcaagaactgtctgaagaagtggcgcatgaaacgacaaaccctgctggaatggctgttttcttttttactggtgcttttcctgtatctattctttagcaacctccaccaggttcacgataccccacagatgagctctatggaccttggacgtgtcgactcatttaacgatacgaattatgtaatcgctttcgcccctgagtctaaaaccacgcaggagattatgaataaagtagccagcgccccatttctcaaagggagaacgataatgggatggcccgacgaaaaatcaatggacgagttggatctcaattactccatcgatgcggtgcgagtaatctttacagacaccttctcctatcacctcaagtttagctggggccaccgaatcccaatgatgaaggagcaccgcgaccattctgctcattgtcaggccgtcaacgagaagatgaaatgcgagggaagcgagttttgggaaaaggggttcgtcgcgttccaggcagcaattaacgcagcaataatcgaaatcgccacaaaccactccgtgatggaacagctgatgtctgtgaccggcgtacacatgaaaattttgccttttgtggctcagggtggggttgcgactgacttcttcatcttcttctgcattattagcttttccaccttcatctactacgtcagcgttaatgtgacccaggagcgtcagtatattacctctctgatgaccatgatggggctaagagaatccgccttttggctgtcctgggggctcatgtatgccggattcatcctcataatggccactttgatggccctgattgtaaaaagtgcccaaattgtggtgctgacaggttttgtgatggtgttcacactgtttctgctgtacggtctgagcctcatcaccttagcatttctgatgagtgtgttaatcaaaaaacccttcctgacaggtctggtagtgttcctactcattgtgttctggggcatcctcggctttccagccctgtacactcgactgccggcttttctagagtggaccctttgcctgttgtcaccgttcgcgttcaccgtgggcatggcacagctcattcacctcgattacgatgttaattcaaatgcccacctagactcaagccagaacccctacctgatcatagcgactttgtttatgttggttttcgatactttgctgtacctggttctaaccctctatttcgataaaattcttccggctgagtacgggcaccgctgcagtcctttgttttttctgaagagctgtttctggttccagcacgggagggccaatcacgtagtcttagaaaacgaaacggacagtgatccgacacctaatgactgcttcgagcccgtgagtccagagttttgcggcaaggaggccattcgcattaagaacctcaagaaggagtacgctggtaagtgtgaacgggtggaggctctgaagggcgtggtcttcgacatctatgaagggcaaatcactgccctgctcggccatagcggcgctggtaagaccaccctgctgaacatcctgtccggactttcagtaccaactagcggttccgtcactgtgtataaccatactctgtccagaatggccgatatagagaatatatctaaattcacggggttttgcccccaaagtaacgtccaatttggctttctaacagttaaggaaaatttaagattatttgccaaaatcaaggggatccttcctcacgaggtggaaaaagaggtgcagcgtgttgtacaggaactggaaatggagaacatccaggatatcctggcccagaacctgtccggaggccagaatcggaagctaacctttgggattgctatcctgggagatccccaggtgctgcttttggatgaacctaccgctggcctagacccactttcacgccatcgtatatggaatctgttgaaggaaggaaagagtgatcgcgtaattctgttcagtacacagttcattgacgaggccgacatactagcagacagaaaggtgtttattagtaacgggaagttgaagtgtgccggttcatctttgtttttaaagaagaaatggggcatcggctaccatctttcccttcacctgaacgaacgctgcgatcccgagtctatcacgtcactcgttaaacagcacattagcgatgctaagctgacagcgcagagcgaggaaaagctggtttatatcctgcctctggagcggaccaataagttccctgaactctaccgcgatctagaccgctgttccaatcagggaattgaagattatggagtctctattaccacccttaatgaggtattcctgaagctggagggcaagagcacaattgacgagtctgacatagggatctggggccagttgcagacagatggtgccaaagatattggtagccttgtcgagctcgagcaagtgttaagctccttccatgaaacccggaagaccattagtggagtggcactgtggcggcaacaggtgtgcgccatcgccaaagtgcgtttccttaaactgaaaaaagaacgtaaatctctttggactatcttgttactcttcgggataagtttcatcccacaacttcttgagcatctgttttacgagtcgtatcagaaatcctatccttgggagctgagccccaatacgtactttctatcacccggtcagcagccacaagatcctttgactcatctgctcgttatcaacaagaccggatctaccatcgacaacttcctccacagcctgcggcgacagaatattgccattgaggtagacgctttcggcactcgcaatggaacagacgatccgtcatataatggagccattatcgtctcaggcgacgagaaggatcacagattttctatcgcttgtaatactaagagactgaactgcttccccgtcctccttgacgttatctctaacgggttattaggcatatttaacagttcggagcacatccagacagacaggagcaccttcttcgaggaacatatggattacgagtacgggtacaggagtaacaccttcttttggatccccatggcagcctcctttacaccctatattgcgatgtcatctatcggcgattataagaagaaggctcactctcagctgcgtatttccgggttgtacccgagtgcttattggttcggtcaagccttagttgatgttagtctgtacttcctgatcctgcttttgatgcagatcatggattacatcttttctcctgaggagatcatcttcatcattcaaaacctcctcattcaggtggtcatcttctctatagtagctactgacctgaatgaatacgggttcctcgggctcttctggcaccacgtgaatacctctctgcatattgactggttgagcatccattttttctag

SEQ ID NO: 215374 - DNA, 2217 bp, Artificial Sequence
  Description of Artificial Sequence: Synthetic coding sequence
atgcgcggtccccctgcttggcctctacggttgctcgagcctccaagccccgctgagcctggcagactactgcccgtcgcctgcgtgtgggctgcagccagtcgcgttccaggttccctcagtcctttcacgggccttcgcccagctcgcctttggggggctggtcccgctctgctctggggtgttggagccgcaaggcgctggaggagcggctgccgaggtggtgggccaggggcatcgaggggcgtgctggggcttgctaggcttctcgggctctgggcgagaggccctggttcatgtagatgtggtgcgttcgccggaccgggagctccacggctgcctagagcacgattcccagggggacctgcagccgcagcatgggctggcgacgaggcctggcgacggggaccagccgcaccccctggcgacaaagggagactgaggccagccgcagctggccttcccgaggctcgcaaactactcggccttgcataccccgagcgcaggcgtctcgccgcagcagtgggcttcctgaccatgagtagtgttatctctatgtctgctcctttctttctgggtaagatcatcgacgtcatttatactaatcccacggtggattattccgacaacctcacccgtttgtgcctggggctttccgctgtattcttatgcggggcagccgcaaacgcaatccgggtgtacctgatgcagacctccggtcaaagaatcgtaaacaggttacgaactagtttattcagcagcatcctaaggcaggaggtggcctttttcgataagactcggacaggcgagttaatcaaccgcctctccagcgacactgccctgctgggcaggtccgtaaccgagaacttgtctgatggactgagagcaggtgcccaggccagcgtgggaattagtatgatgtttttcgtctctccaaacctggctacatttgtcctttctgttgtccctccagtttctattatcgctgtcatctacgggagataccttcggaagctcactaaagttactcaagatagcctggcgcaggccactcagttagcagaggagcgcatcggtaatgttaggactgtgagggcatttggtaaggagatgactgaaattgaaaagtacgccagtaaagtggaccacgtgatgcagttagctaggaaggaggcctttgcacgggcaggatttttcggcgctaccgggcttagcggaaatctgatcgtgttgagcgtgttgtacaagggtggactgttaatgggctccgcccacatgacagtgggagaactgtctagcttccttatgtacgctttttgggtgggcatttcaattggaggcctatcctcattttatagcgagcttatgaaggggctgggagctggaggcagactgtgggaacttctggagagagaacccaagttaccttttaacgagggtgtgatactcaacgagaaatcttttcagggagcactcgaatttaaaaacgtgcattttgcttacccggctagacccgaagtgccaatcttccaggatttcagcctcagcatcccttccgggtcggtgacagcacttgtaggaccctcaggctccggcaaaagcacggtcctgtctttgctcctaaggctttatgatcccgctagtggaaccatttccttggacggtcatgacattcggcaattgaatccggtctggttgcggagcaaaattggcaccgtgagccaagagcctatccttttcagttgtagcatcgcagaaaatatcgcttacggcgcagacgatccaagcagcgtcaccgccgaggagattcagagagttgctgaagtggccaatgccgtggctttcattcgcaatttcccacaggggttcaacaccgttgttggggagaagggggttttgctctcaggtggacaaaagcaaaggatcgccatcgctagggctttgttgaagaacccaaagatactattgctcgacgaagctacatcggccctcgacgcagaaaatgaatatctggtgcaggaggccctggaccggttgatggacgggaggaccgtcctagtgattgcacacaggctatctaccatcaaaaatgccaacatggtggcagttctggaccaaggaaaaattacagaatacggaaaacacgaggaattactctccaaaccaaacggtatctaccggaaactcatgaacaagcaaagcttcatctccgcttag

SEQ ID NO: 215375 - DNA, 2529 bp, Artificial Sequence
  Description of Artificial Sequence: Synthetic coding sequence
atggtgaccgtggggaattactgcgaagccgagggcccagtagggccagcatggatgcaggatggactgagcccctgttttttcttcactttggtcccatcaactaggatggccttaggcaccctggcgctcgtgctggctttgccttgcagacggagagagagaccggcaggcgctgattctctgtcatggggagcaggaccccgaattagtccttatgtattgcaactgcttctcgcaacgttacaggccgctcttccattagcagggctggccggacgcgtggggactgcacggggagctccactgccaagttacctcttactggcaagtgtcctagaatccctcgctggagcctgcgggctgtggctgttggtcgtggagagatctcaggcccgacaacgtctcgccatgggcatctggatcaagtttaggcactcaccgggactgcttctgctatggaccgtagctttcgcagctgaaaacttggcactagtatcgtggaattccccgcagtggtggtgggcgagagcagacttgggccagcaagtgcaatttagcctctgggtcttgaggtatgttgttagcgggggactcttcgtactaggcctgtgggcccctgggctgcgcccacagagctacacattgcaggtgcacgaagaggatcaggatgtcgagcgaagccaagtcagatcagctgcgcagcagtctacttggagagacttcggccgaaagctgcgtttgctgagcggatacctatggcctaggggatccccggcactgcagctggtggtgctgatctgcctgggattgatggggttggagcgtgcactaaacgtgctggtccccatcttttataggaacatagtgaacctgctgaccgagaaggctccgtggaactccctcgcctggactgtgaccagctatgtctttctgaagttcctgcagggaggagggaccggttctaccggttttgtttccaacttgaggacattcttgtggatccgtgtgcagcagttcaccagccggagggtggagctgctgatcttcagccacctgcatgagctttctctgcgctggcacctgggcaggcggaccggcgaagtgctaagaattgctgaccgagggaccagctccgtcaccgggctgctgtcttatctagttttcaatgtcatacctaccttagccgacatcatcattggaataatatatttctctatgttctttaatgcttggttcgggctcatcgtcttcttgtgcatgtctctttatctcaccctgactatcgtggtgacggagtggaggaccaagttcaggcgagcaatgaacacccaggaaaacgccactagagcacgcgctgtggacagcctactgaacttcgagaccgtgaaatattacaatgctgagtcttatgaagtcgaaagatacagagaagccataattaagtatcagggcttagaatggaaaagctcagccagtctggttctgctgaatcagacacagaatctagtcattgggctcggccttctggctggatccctgctctgcgcctatttcgtcacggaacagaaactgcaggtgggcgattacgtactgttcggaacctatatcattcagctatacatgccactgaactggtttgggacatactaccgtatgattcagacaaatttcatcgatatggagaacatgtttgatttgctgaaggaagaaacggaggttaaggatctgcctggagctgggccactgaggtttcaaaaaggtagaatcgaattcgaaaacgtccacttttcttacgctgacggcagagaaactctgcaggatgtctccttcaccgtgatgccgggtcaaaccctggcactggtggggccaagcggagccggtaagagtaccatactgcgcctgctatttcggttctatgacatctcaagtgggtgcattcggatcgacggacaggacatctctcaggtgacccaggccagcctgagatcgcacattggtgtggtgcctcaagataccgttttgtttaatgatactattgccgataatatccggtatggcagagttaccgccggtaatgacgaagtcgaagctgccgctcaagccgctggcattcatgatgccatcatggcattccccgaaggttatcgcacccaggtgggtgaacgcggtctgaagctgagtggcggtgaaaaacaaagagttgccattgccaggacgatcctcaaagcacctggaatcattctgcttgacgaagcgacaagtgccttagatactagcaatgaaagagcaattcaggcaagtctggccaaggtgtgcgctaatcggacgacaattgtagtagcccacagactgagcactgtggttaatgccgaccagatcctggttatcaaggatggatgtatagtagagcggggacgccacgaggccctgctgagccgtgggggagtctacgccgacatgtggcaactccagcagggccaggaggaaacgtcagaggacacgaaaccacagactatggaacgctag

SEQ ID NO: 215376 - DNA, 636 bp, Artificial Sequence
  Description of Artificial Sequence: Synthetic coding sequence
atggtcactgtgggcaactactgtgaggctgaaggaccggtagggccagcatggatgcaagatggcctgagcccatgcttcttttttacacttgtcccctcaactaggatggcactcggaaccttagccttggtcctagctctgccgtgtcgaaggagggaacgcccagcaggtgccgactccttgtcctggggggctggccctagaatttctccttatgcattaccaggaggccctcactgccaggcaatctatttttggcccccatgttggcgggtgtggccggcaccggtagcctgcggctgtctttcatggtcaggcgctagacacggttccgtgtggcagtgggcgagcggttctagttctggcaccgccttggttagctgcagtagcggcctctggcgattacagctgcgcacgtggccgtggtgcctaggtacggcccactcggggggaggtcaggggcagacatgggcgtcaaggttctcgctggcgtgcgggtgctgcggcatgtggtctctcgaagggtgcctgtcctgggtgtccgggccactagactttgtcccttctccgattcattgcaggttcatgaagagaacgaagatgtggaagggtgcttcagaattagcggactag

SEQ ID NO: 215377 - DNA, 2391 bp, Artificial Sequence
  Description of Artificial Sequence: Synthetic coding sequence
atggtcacagtggggaactactgtgaagctgaagggccagtgggaccagcttggatgcaggacgggctcagcccctgcttcttcttcaccctggttccttccaccagaatggcccttggcaccctggcactagtcttggctttgccttgccgcaggagagagcggccagctggcgctgacagcctctcctggggcgctggcccacggattagcccatacgttcttcagctcctcctggccaccctgcaggccgctctgcccctggccggattagccggacgagtcgggacggccaggggcgctcctctcccttcttatcttctccttgcatccgtgctggagagcctggctggggcatgcggattatggctgctagtggtcgagaggtctcaggcaaggcagcggctggccatgggcatctggataaaatttaggcatagccccggactcctactgctgtggactgtggccttcgcagccgaaaacctggccctggtgtcctggaactctccacagtggtggtgggccagggccgatctggggcaacaggtgagaagtgctgcacagcaaagtacatggcgagatttcggcagaaaactgaggctgttgtctggttatttatggcctcgtgggtctcccgcacttcaactggttgtgctcatctgcctaggactaatgggcctggaaagggcattgaacgtgcttgttccaattttttatcgcaacatcgttaatctactcaccgagaaggccccatggaattcactcgcctggaccgtgacatcctacgtgttcttgaagttcttacagggcggtggaaccggcagcaccggcttcgtgagcaacctgcggacattcctctggattcgcgtccaacaatttacctcccgcagagtggagctgcttatttttagtcacttgcacgagctgtctctcaggtggcacttaggacgcaggaccggcgaagtcctgagaatagctgaccgcggaacttcaagtgtaactgggcttctgtcgtacttagtcttcaacgtcatccccacactcgcggacatcattattgggattatttattttagcatgttcttcaacgcctggttcggtctgatagttttcctctgcatgagcctgtacttaaccctgactatagtggtaacggaatggcgcacaaagtttcgcagggccatgaatacgcaggagaacgctacccgcgcacgcgctgtggactccctcttaaattttgagaccgtgaaatactacaatgctgagtcctatgaagtcgagagatatagggaagctatcattaagtaccagggactggagtggaaatcttctgcatcactggtgctgctgaatcagacacagaatctcgtcataggactgggcctcttagctggcagtctgttgtgcgcctacttcgtcactgagcaaaaactgcaggtgggtgactacgtcttgttcggtacctacataatccagctgtatatgccgttgaattggttcggaacctactaccggatgattcagaccaattttattgatatggagaatatgtttgacctgctgaaagaagagacagaggtgaaagacttgcctggggctggtcctttgcgcttccaaaaggggagaatagagtttgaaaacgttcacttctcttacgcagacggcagagagactctacaggacgtgtccttcacagtgatgcctggccagactctcgcattggtcggcccatccggcgcaggcaagtccacgatcctgcgactgctctttaggttctacgatatttccagcggatgcatccgcattgatggccaggatattagccaagtgacccaggcgtctttgcgctcacacattggtgtggtaccacaggataccgtactatttaacgacacaatcgcagataacattagatacggcagagtgaccgcaggcaatgacgaggttgaggcagcagcacaggcggctggaatccatgatgctattatggccttccctgaaggatacagaacacaggtgggagaaaggggcctcaagctctcagggggagagaagcagcgcgtcgcaattgccagaacgattctgaaagccccaggtatcatcctgctggatgaagctacaagcgcactggatacatctaatgaacgtgccatccaggcttccctcgcaaaagtgtgcgcgaaccggaccacaatcgtcgtggcccacaggctgagtactgtcgtgaacgccgaccaaattttggtgattaaagacggctgcattgttgagcgcggaaggcatgaagctctcctaagccggggaggggtttatgcagatatgtggcagttacagcagggccaggaggaaacaagcgaagacaccaaacctcagacaatggagcggtag

SEQ ID NO: 215378 - DNA, 2262 bp, Artificial Sequence
  Description of Artificial Sequence: Synthetic coding sequence
atggcactgctcgccatgcacagttggaggtgggccgctgcagccgcagcatttgagaaaagaaggcattctgcaatcctgatacggcctctagtgtccgtgtctgggtcagggccacagtggcggcctcaccaactgggtgctttagggacggcccgtgcatatcagcagattccagaatcccttaagtctattacctggcagaggctgggcaaagggaactcgggacaattcttggatgccgctaaggccctacaggtttggcccctgattgagaagagaacatgctggcacggtcatgccggaggagggcttcacacagatcccaaagagggcctcaaagatgtcgacactcgtaagattattaaggcaatgctcagttatgtgtggcctaaagaccggcctgatcttagagctcgagttgccataagcctcggcttcctggggggagccaaggctatgaacattgttgtgccgtttatgttcaagtacgccgttgacagcttgaatcaaatgtctggtaatatgctgaacttgtctgacgctccgaatactgtcgccacgatggctaccgccgtcctcattgggtacggcgtctccagagccggagcagcgtttttcaatgaggttcgaaacgcagtatttggtaaggtagctcagaactcaatccgacggatcgccaagaacgtttttctgcatctgcataacctggatctgggctttcacctctcccggcaaaccggcgcactgtctaaggcaattgatcgagggactaggggcatctcctttgttctgtcagcactggtgttcaatcttcttcctattatgtttgaggtcatgctagtgtccggggtgctgtattataagtgcggagctcagttcgcactggttaccctcggtacccttggaacttatactgcctttacagtcgcagtaactcggtggagaactagattcagaatcgagatgaacaaggccgacaacgatgcgggaaacgccgcaatagacagcctcctcaactacgagacggtgaaatatttcaacaacgagcgctacgaggcgcagcgatacgatggtttcttaaagacctatgagacggcatccttgaagtcaactagcactctggccatgttgaacttcggacagtccgcgattttcagtgtgggcttgacggccatcatggtgctcgcctcacaaggtatcgtggccggaactctcactgtcggcgacctggtgatggtgaacgggctcctcttccagctaagtctgcccttaaattttctaggaacggtgtacagggaaacccggcaggccctgattgatatgaacaccctcttcacgctccttaaggtggacacccaaatcaaggacaaggtgatggccagcccattacagatcactccgcagaccgcaaccgtcgctttcgataacgtccatttcgagtatattgagggccaaaaggtcctatccggaatctcgttcgaggttcctgcaggaaaaaaagttgccatcgtagggggaagcggcagtggcaagagtaccatagtgcggctactgttccggttctatgagccccagaagggttcaatttatctggccggtcagaacatccaggacgtcagccttgagagcttacggagggccgttggggtcgtaccacaggacgcggttctttttcacaacaccatctattataacctcctgtatggtaatatcagcgccagccctgaagaagtgtacgctgttgccaaactggctgggttgcatgacgccattcttaggatgccccacggttatgatactcaggttggtgagaggggattgaagctctccggtggggaaaagcagcgcgtggctattgcacgggctatccttaaggacccacctgtaatcctctacgatgaggctactagtagcctagatagcatcaccgaagaaacaatcctgggagcaatgaaagacgttgtaaaacatcgaacttcaatcttcatcgcgcaccgtctgtccacagtcgtggacgccgacgagatcattgtgctggatcaggggaaagtggccgagaggggcacccatcacgggctcctggccaatccccatagcatttattccgagatgtggcacacccagtcctctcgtgttcagaatcatgacaatccaaagtgggaggctaagaaggagaatatttcgaaagaggaagaaagaaagaagcttcaggaagaaattgtaaacagcgtcaagggctgcggaaactgttcttgttag

SEQ ID NO: 215379 - DNA, 2259 bp, Artificial Sequence
  Description of Artificial Sequence: Synthetic coding sequence
atggctctgttagcaatgcactcctggcgctgggccgcagccgcagcagcgttcgaaaagcgtagacattccgccattttaatcaggccattggtgtcagtaagcggctcagggcctcagtggcggccacatcagctcggggctttagggactgctcgggcttatcagatccctgagagcctgaagtccattacttggcaacgccttggcaaaggaaattccggccagtttctggatgctgcaaaagcgctacaagtatggccactgatagagaaacgtacttgctggcacggccacgccggaggcggtcttcacaccgatccaaaagaaggtttaaaagatgtcgacaccagaaaaatcattaaagccatgctaagttatgtgtggcctaaggaccgcccagatctcagggccagggtggctatctcactggggttcttgggtggagcaaaggccatgaatatcgttgtcccctttatgttcaagtatgctgtggactcattgaaccagatgagcgggaatatgctgaacctatccgacgcgccaaacactgtggcaacgatggccaccgccgttctgatcggctatggcgtgtcaagggcaggcgctgccttctttaatgaggttcggaatgccgtgtttggcaaggttgcccaaaactccatcaggcgcattgctaaaaatgtgttcctccatctacacaacctagacttaggttttcatttatcgaggcagactggggctttgagcaaggctatcgaccgcggaacacgcggaatttccttcgtgctgagcgcactcgtgttcaatctgttgcccatcatgttcgaagtcatgctcgttagtggcgtgctctattacaagtgtggcgctcaatttgcgttggtgacgctgggcaccttgggaacctacacagcgttcacagtggctgttactcggtggcggacccgattcaggattgagatgaacaaggctgataatgacgcgggtaacgctgctatagattcgttgttgaattacgagacagttaagtactttaataatgagcggtatgaggcccagcgatatgacgggttcctgaagacctacgaaaccgctagcctgaaaagtacttccacgctcgctatgctgaacttcggccaatcagctatttttagtgttggcctgacagccattatggtgctggcttctcagggcattgtggccggtaccctcaccgttggggatcttgttatggtcaacggcctgctgtttcagctcagcctccccctgaatttcctcggcacagtgtatcgggaaacgagacaggccctaattgacatgaatactctgttcacgctactgaaggtagatacacagataaaagataaagtgatggcctccccactacagatcaccccacagaccgccactgttgcgtttgataacgtccactttgaatacatcgagggtcagaaagtgcttagtggcatttcgttcgaagtccctgccggaaagaaggtcgctatcgtggggggatctggtagcggaaagtctactattgtacgattgctgttcagattttatgagccccagaaggggtctatctaccttgctggacagaatattcaggacgtgagcctagagagcttgagaagagctgtaggggtagtgccccaagacgctgtcctttttcataatacaatctattacaatctgctgtatgggaacatatcagccagtccggaggaggtctacgccgtcgcaaaactcgccggacttcatgatgccatcttgcgcatgccacatggttatgatacgcaagtcggggagcggggtttaaagttatccggaggcgagaagcagcgtgtcgccatagctcgggcaatcttgaaagatccaccagtgatcttgtatgatgaggccacgtccagcctggattccatcacagaagaaaccatactgggcgctatgaaagatgtggttaaacacagaacaagcatcttcatcgctcacaggctgtcaacagtcgtcgatgctgatgaaattattgtgctggatcaaggcaaagtagccgagcgtggaacccaccatgggctgctggccaacccacactcgatctacagcgagatgtggcacacccaatccagcagagttcagaatcatgataatccgaaatgggaggcaaaaaaggaaaatattagcaaggaggaggaacggaaaaaattgcaagaggagattgtgaatagcgtaaagggctgcggcaattgttcatgttag

SEQ ID NO: 215380 - DNA, 2109 bp, Artificial Sequence
  Description of Artificial Sequence: Synthetic coding sequence
atggccctattggctatgcacagctggcggtgggcggctgcggcagctgccttcgagaagagacggcattcagcaatcctaatccgccctctcgtttcggtctctggttcaggcccacagtggcgacctcaccagctcggcgcattgggcaccgccagagcctatcaggccctgcaggtctggccactcattgagaaaagaacatgctggcacggtcacgcagggggaggtttgcacactgaccccaaggaaggacttaaggatgtggatacgcggaagatcatcaaagccatgctgagctacgtatggccaaaggaccgaccggacctgagggcaagggtcgccatttcgctcgggttcctggggggtgctaaggccatgaacattgtcgtccccttcatgttcaaatatgcagtggatagtctgaatcagatgtccggcaacatgctgaatctttctgatgcgcctaacactgtggctactatggcaaccgcagtgctcatcggttacggagtcagccgagcaggcgctgcgttcttcaatgaagtgaggaacgctgtgttcgggaaagttgcccagaacagtatcaggaggattgctaagaatgtgttcctccacctgcacaatctagacctgggcttccatctcagtcgacagactggcgcactatctaaggccattgatcgcggaaccagaggaatctcctttgtgcttagcgctctggtgtttaatctgctgccgattatgttcgaggtcatgctggtgtccggcgtgctatactataagtgtggtgcccagtttgccctagtgacactaggaacccttggaacttacaccgccttcactgttgcagtgacaagatggcggaccagattcagaattgagatgaacaaagctgacaatgacgctggcaatgccgctatagactcgctactgaattacgaaacagtgaaatactttaacaacgaacgctacgaggctcagcggtatgatggattccttaagacatacgagaccgcaagtctgaagtccaccagtaccctcgcaatgttaaacttcggccagagcgccatcttctcagtgggcctgaccgcgatcatggtcctggcctcccagggcattgtggccggaacgctcaccgtgggggatctggtcatggtaaacggactgctttttcaactgtcacttccactgaactttcttggcactgtttaccgcgagacgcggcaggcattgatcgatatgaataccctcttcactttgctcaaagtggatacccagattaaggataaagtgatggcgagtcctctccaaattacacctcaaacagcaaccgtcgctttcgataatgtgcacttcgaatatatcgagggacagaaggtgctgtcaggcatttcattcgaggtacccgctggcaagaaggtggctatcgtcggcggttccgggagtgggaagagtacaatcgtgcggctgctctttagattttatgagcctcagaaaggatcaatctacctggctgggcagaatatacaagacgtctccctcgagtcgctgcgacgggctgtcggcgtggtccctcaggacgccgtgttgttccacaacaccatttattataatctgttgtatggcaacataagcgcatcgcccgaggaggtgtacgctgtcgccaaattggccggacttcacgacgctattctgcgaatgccccatggatatgacactcaggtgggagaaagagggctaaaactttcaggcggagaaaagcagagggtggctatcgccagggccatcctgaaagatcctccagtgatcctctacgacgaggcaacctcctcgctcgacagtataactgaggaaacaattctaggagccatgaaagacgtggtgaagcacaggacgagcatcttcattgcacatcgactttccacggtggttgacgctgacgagattatagtgcttgaccagggaaaggtcgctgaacggggtacacaccacgggctgctagcaaaccctcactctatctacagtgagatgtggcacactcaatcgtcaagagtgcagaatcacgataatcctaaatgggaggcaaagaaggagaatatctcttag

SEQ ID NO: 215381 - DNA, 2181 bp, Artificial Sequence
  Description of Artificial Sequence: Synthetic coding sequence
atggcactgctcgctatgcatagctggaggtgggcggctgccgctgccgctttcgagaaaaggcgccactctgccatcttgatcaggcccctcgtctcagtgtctggcagcggaccccagtggcgccctcatcagttaggtgccctgggcactgctcgcgcatatcaagcactccaggtctggcctcttatcgagaaacgcacatgctggcatggtcacgcgggagggggactacacactgatcccaaagagggcctgaaggatgtcgatacgaggaagatcataaaggctatgctgtcatacgtgtggccaaaagataggccagacttgcgcgctagggttgccatcagcctggggttcctcggcggagctaaggcaatgaatatcgtggtacccttcatgttcaagtacgccgtggactcattgaatcagatgagcggtaacatgctcaatctgtccgacgcgcctaatacagttgccacaatggccaccgcagttctgattggttacggggtgtctcgagcaggagccgcattctttaatgaggtcaggaacgctgtcttcgggaaggtggcccagaacagtatacgcaggatagcaaagaacgtgttcctgcacctgcacaatctggatcttggctttcacctgtcaaggcaaacaggagccttgtccaaagctattgaccgagggacacgaggtatatcttttgttctatcagctttggtgttcaatcttctgccgattatgtttgaagtgatgctggtctctggcgttttgtactacaaatgcggggcacagtttgctctcgtaaccctcggcaccttaggcacgtacaccgctttcaccgtagctgtgaccaggtggagaacacggttccgtattgagatgaataaggctgacaatgacgccggtaacgctgcaatcgacagtttactgaactacgaaaccgtcaagtactttaataacgagcgatacgaggcacagcgttatgacggctttttgaagacttatgaaaccgccagtctgaaaagcacctccaccttggctatgctcaatttcggccagtctgctattttctcagtgggcctgacagccattatggtgctggcaagtcagggtattgtcgctggcaccttgacggtaggcgacctggtaatggttaatggactgctcttccaactctccttacccttaaactttctggggacggtgtacagggagacccggcaagccctcattgacatgaacactctgtttactttgctgaaagtggatacccagattaaagataaggttatggcctcaccactgcagatcactccacagactgcgaccgtggcctttgataatgttcatttcgagtatatcgaggggcaaaaggtcctgtccggcatctctttcgaagtgccagcagggaaaaaggttgcaatcgtcggcggttcagggtcggggaagagcactatcgtgcgattactctttagattttacgagccgcaaaaaggcagtatttatctcgcaggtcagaatatccaggacgttagcttagaatccttacgccgagctgtgggcgtggttcctcaggatgccgtgctgttccataatactatctattacaatctgctctacggcaacatcagtgcgagcccagaagaggtctacgcagtagctaagttagctggcctgcacgatgccattctgcgcatgccacatggctacgacactcaggtgggagagagagggctcaaactgtctggaggcgaaaaacagagagtggcaatcgccagagcaatcctgaaggacccgccagtcattctgtatgatgaagccacatcaagcctggactccattactgaggagaccatcctgggagctatgaaagacgtggtgaaacaccggacctccattttcattgcccatcgtctttctaccgttgtcgatgcagatgaaataattgtcctggaccagggcaaggtagctgagagggggactcaccacggactcctggcaaatccacactcgatatacagcgaaatgtggcacacccaaagtagtagagtgcagaaccatgataacccaaaatgggaggccaagaaggagaatatatctaaggaagaggagagaaaaaaactgcaggaggagatcgttaactcggtgaaaggatgcggcaactgctcttgctag

SEQ ID NO: 215382 - DNA, 2208 bp, Artificial Sequence
  Description of Artificial Sequence: Synthetic coding sequence
atgctggtccatctctttagagtcgggattagaggagggccttttccaggaagactgctgccccctttgcggtttcagacattctcagccgtgagaaacacctggcggaatggaaagaccggtcagcttcataaggccgaaggcgagtatagcgacggatatagatctagcagtctactgcgggcagtcgcccatcttcgcagccagctgtgggcacacctgccgcgtgccccattggcacctcgatggtccccaagcgcctggtgttgggtgggcggtgccctgttagggcctatggtgctgagcaagcatccccatctgtgcctcgtggccctatgcgaggccgaagaggcgccaccagccagttcaaccccacacgttgtaggctcccggttcaactggaaactcttctggcagtttctccatccccaccttctggtgctgggcgtggctgtcgtactcgctcttggagccgctctggtgaacgtgcagattcctctgctcctcgggcaattggtcgaagtcgttgctaagtacaccagggaccacgtcggatcatttatgactgaaagtcagaatctgtctacacatcttctaattctttacggcgtgcagggcctgctgacattcggctacctggtcttgctgtcccacgttggcgaacgtatggctgtcgatatgaggcgagcactcttttccagcctgctgcgccaggatattaccttctttgacgccaacaagactgggcagttagtcagcaggctgaccacagacgtgcaggaatttaagagctcctttaagttggttattagccagggactacgaagctgtactcaggttgctggatgcttggtcagtctgtcaatgctgagcacacgacttacattacttctcatggtggccacacccgcactcatgggggtgggcaccctgatgggaagtggattgcgaaaactcagtaggcaatgtcaggagcagatagcccgagcaatgggcgtcgccgatgaggccctgggtaatgttcgtacagtccgggcatttgccatggaacagagagaagaggaaaggtacggagctgaactggaagcctgcaggtgccgggctgaagagcttggaagaggcattgctctctttcaggggctctcaaatattgctttcaactgcatggtcttagggacactgtttattggaggttcactggttgcaggtcaacagttaaccggcggagatctgatgtccttcttggtggcttctcagacagtgcaaagaagtatggcaaacttgtcagttttgttcgggcaggtggttcggggactcagcgccggagccagggtattcgaatacatggctctcaacccttgcatacccctttcaggaggatgttgtgtgcctaaagaacaactgcgagggagcgtgacattccagaacgtatgtttcagctacccctgtcgccctggtttcgaggtgctgaaagatttcacactgaccctcccgccaggtaaaatcgtggcacttgtaggccagtccggagggggaaagaccacagtagcaagcctgctcgaacggttttatgatccaacggcgggtgtggtgatgcttgatggacgggacctccgtaccttggacccttcttggctgaggggccaggtggtcggcttcatcagtcaggaaccggtcttattcggaaccactattatggaaaacatccgctttggaaagctggaggccagcgatgaggaagtgtataccgccgcacgcgaagctaacgcccacgagtttataacatcctttccagaagggtataacaccgtcgtgggagagcggggaaccacactgagcggtggccaaaaacaacggctcgctattgctcgggctctcatcaagcagccaacagtgttaattttagacgaggctacttccgccctggatgccgagtcagagagagttgtccaggaagccctggaccgggctagtgccggaagaacggtattggtcattgcccaccggctatccaccgtgcggggagcgcactgtatcgtggtcatggcagacggacgggtttgggaagcaggcacacatgaagagttactgaaaaaaggcggtctgtacgctgaactcatacggaggcaggcgctggacgctcccaggaccgccgctccaccgcctaagaagcctgaaggcccaaggtctcaccagcacaaatcttag

SEQ ID NO: 215383 - DNA, 1404 bp, Artificial Sequence
  Description of Artificial Sequence: Synthetic coding sequence
atgctcgtgcacctgttccgcgtgggcattagaggcggaccctttcctggtaggctgctccctccactgcggtttcagacattcagcgccgtgaggcgactcttgaggctgcagcccagagtgagccagaaggaaggcactctgggggtgtcagatcatgcacagtccgccctccctaccggcggaccactgagctggccctggcgctactcggatggctacaggagttcttcactcttgcgagcagtggcacatttgcggtcgcagctctgggcacacctaccgagagcgcctttggcaccccgttggtctccatccgcatggtgttgggtgggcggagctttgttgggccctatggtcctcagcaagcacccccatttatgcctagtcgcgctttgtgaagccgaagaggccccaccggctagctctactccgcatgtggtgggcagccgcttcaactggaaactgttctggcagttcctgcacccacacctgttggtgctcggggtcgctgtggtgttggctctaggtgccgctctggtgaatgttcagatccccctcttgctgggacaactggtggaggtagtggccaagtatacgcgcgaccacgtgggcagcttcatgacagagtctcagaacctttccacacacctcttgatactgtacggcgtccaggggctgctgacgttcggatacttggtcttgctgtctcatgttggggaacgaatggcagtggacatgcgccgtgccctgttttcatccctgctcagacaagacattaccttttttgatgctaataagacagggcagctcgtctcccgactgactactgacgttcaggaatttaagtcctccttcaagttagtgatttcacagggactccgttcctgcactcaggttgccggatgtctggtgtcactctcaatgctctctacgagactgacgctcctgctgatggtagccacgccggctcttatgggagtcggcaccttgatggggtctgggttgagaaaactgtctcgccagtgtcaagagcaaattgcaagagcaatgggagtggcagatgaagctttggggaacgttcgtacagtccgcgcattcgcaatggagcagcgggaagaagaaagatatggagcagaactggaggcctgtaggtgcagggccgaggaactggggaggggcatcgcactgttccagggcctctctaatattgcatttaattgcatggtccttggcaccctcttcatcggaggttcgctagttgccggacagcagcttacagggggagatcttatgtctttcctcgtggcaagccaaacagtgcagaggcaggtgcacggtcagcctttatgtccagtttgggcagggggaccaggggcagaatgtagatgtccgggattatag

SEQ ID NO: 215384 - DNA, 2157 bp, Artificial Sequence
  Description of Artificial Sequence: Synthetic coding sequence
atgttggtgcatctgttcagggtgggaatcaggggtggtcctttccccggacggctcctgcctcctctgcgattccaaaccttttccgccgttcgctatagcgacggttacagaagctcctctcttcttagggcagtggctcatctccgtagtcagctgtgggcccatctccctagagcccctctagcccctaggtggtcaccctccgcctggtgctgggtggggggtgcgctactggggccaatggttttgtccaaacacccccatttgtgcctggttgctctatgcgaggctgaggaggcccctcctgctagctctacgcctcacgtagtggggagccggtttaattggaagcttttctggcagtttcttcatccccacctgctagtgctgggagtggcagtcgttttggcactgggggcagcactggttaacgtccagattccactgctgctgggacagctggtcgaagtggtggccaaatacactagggaccatgtgggctcttttatgacggagtctcagaacctcagtactcacctgttgattctatacggcgtacagggtctgctcacattcggctatctagtccttctctcacatgtgggcgagcgcatggctgtggacatgcgtagagccctcttctcgagtctgttgcggcaggacatcacctttttcgatgcaaataagacgggacagcttgtgtccagactgaccaccgatgtccaagagtttaagtcaagcttcaagctggttatcagccaagggttgcggagctgcacccaggtagccggatgtctggtgtctttgtcaatgctgagtacaaggctgacattgctgcttatggttgccacacctgctctgatgggcgtgggaacactgatgggatcaggcctccggaaactcagtaggcaatgccaggagcagatcgcacgggctatgggagtggctgatgaggccttggggaacgttcgtacggtgcgggcttttgctatggaacaacgagaggaagagaggtacggggcagaattggaagcttgccgttgccgcgcagaggaactgggaagaggtatcgctctgtttcaggggttgtctaacatagctttcaattgcatggtgctcgggactctcttcattggtggctcattagtggccggtcagcagctcacaggtggtgatctcatgtcattcttggtggcgagtcaaactgttcagcgcagcatggcaaacctctctgtgctctttggccaggttgtgcgagggctgtccgccggtgccagagtatttgagtacatggccttgaatccttgcattcccctcagtgggggatgttgtgtgcccaaagaacagttgagaggatccgtgaccttccagaatgtttgtttttcctacccttgccgaccaggtttcgaggtccttaaggattttaccctgaccttacctcctggcaagatcgtggccctcgttggtcagtcagggggaggaaaaactacagtcgcaagtctccttgaacgattttacgacccaaccgcaggagtggtgatgctggacggccgagacttgcggacactggacccatcttggctgaggggacaggttgtcggattcattagtcaggaacctgtgcttttcggcacaaccattatggagaatatccgatttgggaaactggaagccagcgatgaggaggtgtacactgccgctcgtgaagccaatgctcatgagttcattacttcttttccagagggctacaacactgtcgtgggggagcgaggcaccacactgtctgggggacaaaagcagcgtttagcgatcgcaagagctctaattaagcagccaactgtcctcatcctcgatgaggccactagcgctctggacgccgagtcggaaagagtcgtgcaggaagccctggacagagccagcgccggtcggaccgtgctggtgatcgcacacaggctatccacagtgcgcggtgcacactgcattgttgttatggcagatggcagagtctgggaagcaggcacacacgaggagcttctcaagaagggcggtctatatgcagaactaataagacgacaagctctcgacgcacccagaaccgcagccccacctccaaaaaagcctgaggggcctaggagccaccagcacaaatcctag

SEQ ID NO: 215385 - DNA, 2106 bp, Artificial Sequence
  Description of Artificial Sequence: Synthetic coding sequence
atgcttgtccatttgttccgcgtggggatccgaggcggaccgtttcctgggaggctgttgccgccattgcgattccagacattcagtgcggtgcgctattccgacgggtatcggagtagctctctattgagagcggttgcgcacctgcggtctcagctctgggcacatctgcctcgggcactgctcgggcctatggtgctgagcaagcatccccatctctgcctagtcgccctgtgcgaagccgaagaggctcctcccgcttcatcaactccccatgtagttgggtctcgcttcaactggaagctcttttggcagtttctgcacccccatctcctagttctcggagttgctgtggttctagccctgggtgctgccttggtgaacgtacagattccgctgttactgggccagctagtggaagttgtcgcgaaatatacccgagaccacgtaggtagctttatgacggagtctcaaaacctgtcaacccatctgcttattctgtacggggtccaaggattgcttacattcggatacctagttctgctatcccacgtgggcgagagaatggcagtggatatgcgtcgcgctttgttctcgagtctcttaagacaggatattacattcttcgacgccaataagaccggacagctagtgtccagactgactacagatgtgcaggagttcaaaagcagcttcaagttggtgataagtcagggcctgcggtcatgtacacaagtagccggatgcttggtgagtctcagcatgctgtcgacccggctgaccctacttcttatggtcgctacgccagctctgatgggcgtcggtacacttatgggttctggtctccggaagctctctcgccagtgccaggaacagatcgcacgggctatgggcgtggctgatgaggcgctaggaaacgttagaaccgtgcgggcatttgccatggagcaacgggaggaggagcggtacggggctgagttggaggcgtgccgatgcagagcagaagaacttggtcggggtatcgctctgttccagggcctttcaaacatagcctttaactgtatggtgctaggtacgctctttatcggcggatcacttgtcgcaggccaacagctgacaggcggagaccttatgtccttccttgtggcctcacaaacagtccagagatctatggcaaacctgagcgtcctgtttggccaggtggtgcgtggcttgagtgcaggagccagagtgttcgagtacatggccctcaacccgtgtattcctttgagtggcggatgttgtgtgcctaaggaacagctgcgaggtagcgtgacctttcagaacgtttgtttctcatatccatgccggccagggtttgaggtattaaaggacttcacacttactctgcctcctgggaagatcgtggcactggtagggcagtccgggggagggaagaccacagttgctagccttttggagcgattctatgacccaactgcaggcgtggtgatgctcgatgggcgtgacttgcggactctcgatccgagctggcttcggggacaagttgtggggtttataagtcaggaaccagtgctctttggtaccaccattatggagaacattagatttggaaaactggaggcatccgatgaagaagtgtacactgcagctagggaggctaacgctcacgagttcattacctcttttcctgagggctataatactgtggtgggcgaacggggaaccaccctgtccggaggccaaaagcagcggcttgcaattgctcgggctttgataaaacagcccaccgtcctgatactggacgaggccacatctgccctagacgctgagtctgaacgtgtggtccaggaagccttggacagggcgtcagctggtcgaactgttctggtgatcgcccatagactcagcacagtaaggggagcacattgcatcgttgtgatggctgacgggagggtatgggaagccggaacgcatgaggagctcctgaagaagggcggactttatgctgagctcatccgcaggcaggccctagatgcccctcggacggccgctccaccacccaagaagcccgaaggcccaaggagccatcagcacaagtcctag

SEQ ID NO: 215386 - DNA, 1296 bp, Artificial Sequence
  Description of Artificial Sequence: Synthetic coding sequence
atgctcgttcatttattcagggtggggattcgcggagggccattccccggacgactgctcccccctctccgctttcagactttttccgctgtgcggtacagcgacggctataggagcagcagtcttctgagagctgtcgcccacctgcggtcacaactttgggcccacctgcccagagcgcctcttgctcctagatggtcccccagcgcttggtgttgggtcggcggagccctgctgggacccatggtgttgagtaaacacccacacctatgtcttgtcgctctgtgcgaagcagaagaagcccctcctgcaagtagcacgccccacgttgtgggatcacggttcaattggaagctcttctggcagtttctccacccacaccttctggtcctaggcgtggccgtggtcctcgctcttggagccgcactggtgaacgtacaaatacctctcttgctgggacagttggtggaggtcgtcgcgaagtataccagggatcacgtcggctcgttcatgacggagtcccagaacctatcaacccacctgctgatactgtacggagtgcagggactgctgacattcggttatttagtgttactatcccacgtgggcgaacgaatggccgtagacatgaggcgcgctctcttctcatcactgctcaggcaggacattacatttttcgacgccaataaaacgggccaactggtttcacggctgactaccgacgtgcaggagttcaaaagtagcttcaaattggtgatcagccagggccttcgctcatgtactcaggtcgccggatgtctcgtttccttatccatgcttagcactcggctgaccctgttgctgatggtggcaactcccgcactgatgggggtgggaactctgatgggttccggcctgcggaagcttagcaggcagtgccaagaacagattgctcgggcaatgggggtggctgatgaagcgttgggcaacgtgagaaccgtgcgcgctttcgccatggaacagcgggaggaggagagatacggtgccgaactggaggcttgccgatgtagagcagaggagttggggcgaggcatcgccctctttcaggggctcagcaacattgctttcaattgtatggtcctgggcacgctttttattgggggatccctcgtcgccggtcagcagctcaccgggggagacctcatgtctttcctagtggctagccagacagtgcagtcattcctgcgggtcgccccatgcccgaactctctcccattgcaggccgtgacctttcacgcatggaaagatcacccttag

SEQ ID NO: 215387 - DNA, 2082 bp, Artificial Sequence
  Description of Artificial Sequence: Synthetic coding sequence
atgctggtgcatttattccgcgtggggatccgcggaggccctttccccggtaggctgcttccacctttgcggttccagacattttcggctgtgcgatattccgatggctataggtccagctccctgctacgggctgttgcccacttgcggtcacagctatgggcccaccttcctcgggcacccctggcacctcggtggtccccgagtgcgtggtgttgggtgggaggggctctgctgggccctatggtcctctccaagcacccacatttgtgtctggtagctctctgtgaggcggaggaggcccctccggcatcgtccaccccgcacgtggtgggttcaagatttaattggaagctgttctggcaattccttcatccccatctgcttgtgcttggcgtcgccgtggtcctcgctttaggggctgccctggtcaatgtgcagattccactgctgctcggccagttagtggaggttgtggctaagtatactagagatcatgtgggcagcttcatgaccgagtcgcagaatttgagcacgcacctgctgattttatacggcgtgcagggtctcctcacattcggctaccttgtcctgctgtcacacgtgggagagaggatggccgttgatatgagacgtgcactcttctcttccctgctgagacaggacatcactttcttcgatgccaacaagaccggccagctcgtgtctcgcctgacgacggatgtgcaggaatttaaatcaagcttcaagctagtcatttcccagggcctgcgttcttgtacccaagtcgctggttgcttggtgagcctaagtatgctgagcacacgcctcacgctgctgctgatggtggctactcctgccctgatgggtgttggaactctaatggggtctgggcttcggaagctgtcaaggcagtgccaagagcagatcgcacgggctatgggggttgcagacgaagccctaggcaatgtccgaaccgtaagagccttcgctatggagcagcgggaagaagaaaggtatggtgctgagctggaagcctgtaggtgtagggcagaagagttgggccgaggcatagcattatttcagggactcagcaacatcgccttcaattgcatggtgctcggcacactctttatcggcggaagcttggtggctggtcaacagctcacagggggagacttgatgtccttcctcgtagcatctcaaaccgttcagagaagcatggccaacttaagtgttctgtttggacaggttgtaagggggctgagcgccggtgcgagggtgttcgaatacatggccctaaacccgtgcattcccctctctggtggctgttgtgttccgaaagagcaactccgtggcagcgtgacattccaaaacgtgtgtttcagctacccttgccggccaggcttcgaggtactgaaagatttcacattgaccttgccccctgggaagatagtagcactcgtgggccagtctggcggagggaagacaactgttgcctcgttgttggaacgcttttacgaccctacagcaggggtggtcatgttggacggaagggacctgcggacgctcgatcctagctggctgcgaggacaggtggtggggtttatcagccaggagcccgtgctcttcgggacaacaataatggaaaacatccgtttcggcaagctcgaggcctccgatgaggaggtctatacagccgcaagagaggccaacgcccatgagttcataacaagtttcccagaaggatacaacactgtcgtcggagaaaggggcaccactctgagtggaggtcagaaacaaaggctggcaattgcaagggccctaatcaaacagccaaccgtcctgattctggacgaagccacgtccgccctcgatgccgagagtgagagagtagttcaggaggccctggacagagcctctgctggaaggactgtgctggctggcacccatgaagagctccttaaaaagggaggactctatgctgagcttatccgtagacaggccctcgacgctccaagaactgctgccccacctcccaagaagcctgaaggcccaaggagccaccaacacaagtcatag

SEQ ID NO: 215388 - DNA, 1893 bp, Artificial Sequence
  Description of Artificial Sequence: Synthetic coding sequence
atgcgcgtgaagcttctgctgcctgccgctcctgttctgcccagacaacacgccggtgccttcatttctggacgcgatagtggctggccgattcccaggcaggccgctacggcgcctccgctccccgatatcctgagttgtcaattagccctcggagcagcactggtcaatgttcagatccctctgctgctgggacaactcgtggaagtcgtggccaaatacacccgcgatcatgttgggtccttcatgacagagtcccagaatctcagcacacacctccttattctgtacggagtacaggggttgttgactttcgggtatctggtactgttaagccatgtgggcgaaagaatggccgtggacatgcggagggccctgttcagttctctactgcgtcaagacataaccttctttgacgctaacaaaactggacagctagtctccagactgacaactgatgtccaagaattcaaaagtagcttcaagctcgtcatcagtcaaggactgcggagctgcacacaggtagcaggatgtttggtgtccttgtcgatgctttccacacgcctgaccctgctgctaatggtagccacacccgcactaatgggggtcggaaccttgatgggctcgggcctgcgaaaactttcgcgccagtgccaggaacagatcgctagggctatgggagttgccgatgaggccctcgggaacgtccgcaccgtgcgtgcatttgctatggaacagcgggaggaggagcgctacggcgcagaactagaagcgtgccgatgtagagctgaggaattgggtagagggattgccctttttcagggtttatctaacattgctttcaactgtatggtgctgggcaccctgttcattgggggaagtttggtggcgggtcagcagttgactgggggagacctcatgagttttttggtcgctagtcagacagtgcagcggagcatggcgaatctttcagtgttgtttgggcaagtggttaggggactttcagctggtgctcgagttttcgagtatatggccctgaacccctgcattccactgtctggtggttgttgtgtgccgaaggaacaactgcggggttccgtgacgtttcagaatgtatgtttctcttatccatgccggcctggcttcgaagtgctgaaggactttacactaacactcccacccggtaaaatcgtggctctggtggggcagagtgggggaggtaaaaccacagtggcctcattactcgagaggttttatgaccccacagctggcgtcgtgatgttagacgggcgagacttgcgaacccttgatccatcctggctccggggacaggtggtagggttcattagccaagagcccgtcttgttcgggacaacaatcatggaaaatattcgcttcggcaaattggaagcatccgatgaagaggtttatacagctgctcgggaggccaatgcacatgagttcattaccagcttccccgaagggtataacacagtggtgggagagaggggaaccactctgtcaggtggacagaagcagcgactggccatcgcccgtgccctgattaagcagccaaccgtgctcattctggatgaggccacttcagcgctggacgccgaaagcgagcgtgtggttcaagaggcgctggatcgtgctagcgctggcaggaccgtccttgtgattgctcacagattgagcactgtgcggggagcccattgtattgtggtgatggccgatggccgtgtctgggaggccggaacgcacgaggagctgctcaaaaaggggggattgtatgccgaactcatccggagacaggctctggatgctccccgtaccgcagcccctcccccaaagaaacccgaggggcctaggtcccaccagcacaagagttag

SEQ ID NO: 215389 - DNA, 2301 bp, Artificial Sequence
  Description of Artificial Sequence: Synthetic coding sequence
atgcgcctctggaaagcagttgtggtaactctcgcctttatgagcgtggacatctgcgtaacaacagccatctacgttttctcacatcttgaccggagtctgctcgaggacatccgccatttcaatatcttcgatagcgttctcgacctctgggcagcttgtctgtatcgtagctgcctattattgggtgcgactattggggttgctaaaaacagtgctttaggccctcgccgtctgagagccagctggctggtgataaccctggtctgcctgtttgtgggaatctatgccatggtgaagttgctgctatttagtgaagttagacgacctatccgggatccgtggttttgggcactgtttgtgtggacttacatttccttaggggctagctttctcctatggtggctgctgagcacagtccgaccaggtacccaggctctggaacctggggctgcaacagaggccgaagggttccccggatcaggcagacctcccccagaacaagccagtggcgcaacactgcagaaactattatcttacactaagccagatgtggccttccttgtagcagcctccttttttctgattgttgccgctctgggcgaaaccttcttgccttactacaccggcagggcgatcgacgggatcgtcatccagaaatctatggatcagttttccactgccgtcgtgattgtgtgtctgctcgccatcggttcttcatttgccgcaggtattagagggggtatttttactttgatcttcgccagattaaacattagactacggaactgcttgttcaggtcgctggtgtcccaagaaacttcattttttgacgagaacaggacaggcgatctgatcagccggctgacttccgatacaacaatggtcagcgacctggtgtcacagaatatcaatgtcttcttacgcaacactgtgaaagtgactggtgtcgtggtgtttatgttctctctgagctggcagctgagcctggtaacatttatgggctttcctatcatcatgatggtctctaacatttatgggaaatactataaacgattatctaaggaagtgcagaatgccctcgcgagagctagcaatacggccgaggagacaatttccgcgatgaaaaccgtacgcagcttcgccaacgaggaagaagaggcggaggtctatttacgaaagctccagcaggtatataaattgaacaggaaggaggccgcagcctatatgtactacgtttgggggtctggcctcacgttacttgtggtgcaggtgtctatcttgtactatgggggacatctggtaatttctgggcagatgacttcaggcaatctgatagcctttatcatctacgagtttgtcctgggcgattgcatggagagcgttggctctgtctactccgggctcatgcagggggtcggtgccgctgagaaagtattcgagttcatcgatcggcagccaactatggtgcacgatggcagcttggcccctgaccaccttgaggggagagttgattttgaaaatgtcaccttcacttaccgcacacggcctcacacgcaggttttgcagaatgtatcattcagcctttccccaggaaaagtgacggcactggtgggacccagtggctcaggcaaatctagttgcgtgaatatcctggaaaatttttaccccctcgagggcggtagagttctgctggacgggaagccaatatctgcatatgatcataagtacctccacagagtgatctctttggtcagtcaggagcctgttttattcgctcgaagcatcacagacaacatcagttacggactgcccacagtgccctttgagatggttgtagaagcagcccagaaggctaatgcacatggtttcattatggaactacaggacgggtatagtactgagacaggagaaaaaggcgcacagttgtctggaggccagaaacaacgcgttgccatggcacgcgcattggtgcggaatcccccagttctgatactcgatgaggccacatccgcattggacgccgaatctgagtatctgattcaacaggccatacacggcaatctacagaaacatactgtacttatcattgcacatcgcttatcaacggtggagcatgcacatctgatcgtcgttcttgacaagggaagagttgtccagcaaggcacccatcagcagttacttgctcaaggcggtctctacgctaagctggtgcagaggcagatgcttggactgcagccagccgctgatttcactgcagggcacaatgaaccagtcgcaaatggctcccataaggcatag

SEQ ID NO: 215390 - DNA, 2172 bp, Artificial Sequence
  Description of Artificial Sequence: Synthetic coding sequence
atgcgcttatggaaagccgtggttgtcacgctggcttttatgagtgttgatatctgcgtgaccacggctatttacgttttttctcacctcgatcgcagcctgctggaggatatacgacattttaatatttttgactccgtgctggatctctgggctgcctgcctgtatcggtcctgtcttctgcttggcgctacaattggcgtcgccaaaaactccgctttgggaccccgtcgccttcgtgcatcctggctggtgattaccctggtgtgtctgttcgtaggcatttatgctatggtgaagctcctgttgtttagcgaggttcgcaggccaattagagatccatggttctgggccttgttcgtgtggacatatattagcctcggggcttccttccttctgtggtggttgttatctaccgtcaggcccggaacccaagcactcgaacccggagccgctactgaggcggagggcttccctggaagtgggcgacctccccctgaacaggcctctggggcaaccctacaaaagttattaagctacaccaaacctgatgtagctttcctggtggctgcctcattttttttaatcgtggccgctctcggcgagactttcctgccctactacaccggaagggctattgatgggatcgtaattcagaagagcatggaccaattctcaaccgcagtggtgatcgtgtgccttctggctatcggctcatccttcgccgctggcattcggggaggcattttcaccctaatatttgctaggcttaacatacggcttcgtaattgtctatttagatctctggtttctcaagaaacatcatttttcgacgaaaatcggaccggcgacttaatcagtaggttgacctcagacacaacaatggtgagtgatttggtctcgcagaacatcaacgtgttcctccggaacacagtcaaagtcaccggggtggtggtgtttatgttctccctgtcctggcaacttagcctggtgacatttatgggcttccccatcatcatgatggtgtctaacatttatggcaagtactacaagcgcctatccaaggaagtgcaaaatgctttggccagagcttccaacacggccgaggaaactatttccgccatgaagactgtgcgcagttttgctaacgaggaggaggaggctgaggtgtatcttcggaaactccagcaggtctataagctcaaccggaaggaggctgcggcttacatgtactacgtatgggggtctggctctgttggtagcgtatatagcggacttatgcagggggtcggcgcagccgagaaggttttcgagtttatcgaccgacaaccaaccatggtacacgacggatccttggcgcctgatcatctagaaggaagggtggacttcgagaatgtgacttttacttatcggacacgaccccatacacaagtgttgcaaaatgtatcattcagcctgagtcctggcaaggtgacagccttggtgggaccaagtggcagcggcaagagttcttgcgtaaatatcctcgagaacttttaccctctagaaggaggtcgtgttctcttggatggtaagcctatttccgcatacgaccacaagtacctccatagggtgatctcactggtcagtcaggagcctgtgcttttcgctaggtcaatcaccgataacatttcatatgggctcccgaccgtgccgtttgagatggtggtcgaggcggcacaaaaagctaacgctcatggttttatcatggagctccaggacggttattccactgaaacaggcgaaaaaggggctcagctgtccgggggacagaagcaacgagtggctatggcacgtgcattggtgagaaatccacccgttttgatcttggatgaagccacttctgcgctagatgcagaaagtgagtacttgatacagcaagcaattcacggcaatttacagaagcatacagtattgattatcgcgcataggctgtctactgttgagcacgcccatctgatcgttgttctggataagggccgagtggtacagcaaggtacccatcagcagttactggcccaaggtggtctgtatgccaagcttgttcaacgtcagatgctgggcttgcagcccgctgccgacttcactgcaggtcacaacgaacccgtcgctaacgggagccacaaggcctag

SEQ ID NO: 215391 - DNA, 2301 bp, Artificial Sequence
  Description of Artificial Sequence: Synthetic coding sequence
atgagactctggaaagctgtcgtcgtcacactggcttttatgagcgttgatatctgtgttactaccgctatctacgtgttctctcacctggaccggtcactgctggaggatattagacatttcaacatctttgacagcgtgctggacctctgggccgcttgtctgtatcgttcctgcctcctccttggagcgaccatcggagtagcgaagaatagtgctctcgggccaaggcggctgcgtgcctcctggctagtgatcactttggtgtgtctgttcgtggggatctacgcgatggtcaagcttctgctattcagtgaggtcaggaggcccatcagagacccatggttctgggcacttttcgtatggacctatatcagcctgggcgctagcttcctcctgtggtggctgctgtctaccgtgcggcctggcacccaggccttagagcccggagcagcaaccgaagctgagggctttcctggcagcgggagacctcccccagagcaggcctcgggagcaaccttacagaaactgctgtcgtacacaaagcctgatgtcgctttcctcgtggctgcgagcttctttctaatcgtggcggcactgggcgaaacctttctgccctactacaccggccgagccatcgatgggatcgtcatacagaaatccatggatcaattttctaccgctgtggtgattgtgtgtctgctggcaatcgggagctcatttgcagccggtatacggggagggatctttaccctgattttcgctagactcaatatccggcttaggaattgcctgttccgcagtctcgtgtcccaggagacatcgttttttgacgagaaccgaaccggcgacctgatttcccgactaactagtgacaccacaatggttagcgatctagtcagtcagaacattaatgtgttcttgagaaacactgtgaaggttacaggtgtggttgtatttatgttttccttgtcatggcaattaagccttgtgaccttcatgggattccctattatcatgatggtttccaacatctatggcaagtactacaagcggctctcaaaggaagtgcaaaacgccctggcgagagcctctaataccgcggaagagactataagcgcaatgaagactgttcggtcatttgccaatgaggaagaggaggccgaggtgtacctgaggaagctgcagcaggtttacaagttgaaccgcaaagaagctgcagcttatatgtactacgtctggggctccggactgacactcctcgttgtccaggtctcgatcctgtattacggagggcatctagtgatttccgggcagatgacttccggaaatcttattgccttcattatttacgagtttgtcctgggggattgcatggagtctgtcggcagcgtgtattctgggcttatgcagggcgtaggtgccgcagaaaaagtgttcgagtttattgacagacagcccacaatggtccatgacgggtccctagcccctgaccacctagaaggcagggtcgatttcgagaatgtgacattcacttatcggactcggccacacacccaggtcctgcagaacgtgtccttcagtctatcccccggtaaggtcaccgccctggtcggcccaagcggttctggcaaatcatcatgtgtgaatattctggagaatttttatcctctggaaggtggcagagtccttttggatggcaagcccatatctgcctacgatcataagtacctccacagggttattagtcttgtgtctcaggaacccgtactgtttgcacggtcgatcaccgataacatttcttacggacttccaactgtgcctttcgaaatggtggtagaggccgcacagaaagcaaacgctcacggtttcattatggagctacaggatgggtactccacggaaaccggcgagaaaggcgctcaattgtctggtggccagaaacagagggtggcgatggcgagagctctggtgagaaatcctcccgtcctgattctcgacgaggcgacaagtgctctggatgccgagagtgaatatctcatccagcaagctattcatggtaacctgcaaaaacatacagttcttattatagcccataggctgtccacagtggaacatgcgcacctcatcgtagtacttgataaaggacgcgtcgtgcagcaggggacgcatcagcaattgctcgcacaaggtggcctttacgctaaattagtgcagcgccaaatgctcgggctgcagcctgctgcagatttcacagcaggccacaacgagccagtggccaatgggagccacaaggcatag

SEQ ID NO: 215392 - DNA, 2310 bp, Artificial Sequence
  Description of Artificial Sequence: Synthetic coding sequence
atgcggctgtggaaggcggtggttgtcacgttagcattcatgagtgtcgatatctgtgtgaccacagccatatacgtgttctcacacctagatcgtagcttgctagaggatatccgacattttaatatatttgattcggtccttgatctgtgggcagcctgtctgtacaggtcttgtcttctgctgggggctaccatcggcgtcgccaagaactcagccctgggcccaagacgcctgcgcgctagctggctcgtcataactctcgtctgcttgtttgtgggcatctacgccatggttaagctcttactcttctctgaggtgcggagacccattagagacccctggttttgggctctgtttgtgtggacgtatatttctctcggcgctagctttctcctctggtggcttttgtcaaccgttcgaccgggaacgcaggctctggagccgggtgccgctacagaggcagagggttttcccggaagcggcaggcctcccccagagcaagcatccggggcaacgctgcagaagctactgagttatacgaagcccgatgttgcgtttttagtagccgcttcattttttctcatcgtggcagcccttggagaaactttcctaccatattataccggtcgagccatcgacggcattgtaatccagaaaagcatggatcagtttagcaccgcagtcgtgatcgtgtgcctcctggccattggctccagttttgccgctggtatcagagggggaatctttacacttatttttgcacgccttaatatccgcctgagaaactgcctttttcgaagcctggtctctcaggaaactagtttctttgacgagaacagaacgggggatctcattagccggctgacctcagacaccaccatggtgtcagatcttgtgtcccaaaacatcaatgtgtttcttcgcaacactgtgaaagtcaccggggtggtcgtcttcatgttctcgttgtcatggcagctgtctttagtcacattcatgggctttcccatcataatgatggtgtcaaatatatatggtaagtattacaaaaggctgagcaaagaggtgcagaacgcactcgctcgtgccagcaacaccgccgaagaaacgatttcagcaatgaaaacggttcgtagcttcgctaatgaagaggaggaagcggaagtttacctgcggaaactgcagcaggtgtataaactgaatagaaaagaagcagcagcatacatgtactacgtctggggtagcgggctgacgttgctagtcgtgcaggtctctatcctgtactatggagggcatctggtcatcagcgggcagatgaccagtgggaatctaattgcttttatcatctacgagtttgtgctcggcgactgcatggagtcggtgggctcggtatacagcggactgatgcaaggcgtcggagctgctgagaaagtgtttgaatttatcgatcggcagcccacaatggtgcacgacgggtccttagcccctgaccacctcgaaggacgcgtagattttgaaaatgtgacttttacctatagaacaagaccgcatacccaagtgctccagaatgtgagttttagcctcagccctgggaaagtcacagcactagtgggtccatcagggtcagggaagagctcatgcgttaatatcttggaaaatttttacccactagagggcggtcgtgtgctcctggacgggaagcctatctccgcctatgaccacaaatacctgcatcgggttatctccctggtaagccaagagccagtcctctttgcccgtagcatcactgataatatctcctatggcctgcctaccgttccattcgagatggtggtcgaggctgcccagaaagctaatgcccatggcttcattatggagctgcaggacggttattctaccgagaccggtgagaagggagcccagctgagcggaggccagaagcagcgggtcgcaatggcgagggccctggtgcgtaaccccccagttctcatactcgacgaagccacatcggccttggacgctgagtcagaatacctgagtccacagatccagcaggcaattcacgggaatttgcagaaacacaccgtgttgattattgctcataggctctctaccgtggaacatgcacacctgatcgtggtcctagataaaggtcgggtcgtgcagcaaggaacacatcagcaactattagcccagggcggtctctacgctaagctcgtacagagacagatgctgggcttgcagcccgcagctgactttacagccggacataatgagccagtggcaaacggaagtcataaggcatag

SEQ ID NO: 215393 - DNA, 2112 bp, Artificial Sequence
  Description of Artificial Sequence: Synthetic coding sequence
atgcgactgtggaaggctgtggtagtcaccctggccttcatgagtgtggacatctgtgtgacaactgccatttacgtctttagtcaccttgatagatcgcttttggaagatatcagacactttaacatcttcgactcagtgctcgacctgtgggctgcgtgcctctatcgatcttgtctgcttctcggagccactattggagtggccaagaatagtgcgctgggccctaggcggctgagagcctcctggctggtgattacacttgtctgtctgtttgtaggcatatatgccatggttaagctcctgttgttttcagaagtacggagaccgattcgagacccatggttctgggcgctgttcgtttggacatacatctctctaggggcatcgttcttactatggtggttgctgtccactgttcggccaggaactcaggccctagagcccggagctgccactgaggcggagggttttcctggctccggcagacctccaccagagcaggcttctggggctacacttcagaagctactgtcctatacgaagcccgacgtggccttcttggtcgctgcttctttcttccttatagtggccgctctaggcgagacctttctcccttactacacggggagggcgatcgatgggatcgtcattcagaagagtatggaccaatttagcacagcggtggtgatcgtttgcctcctggccatcgggagctcctttgctgctggtatccgcggaggtatctttacacttatttttgcacgtcttaacattagactgaggaattgtctgttcagaagccttgtgagtcaagagacctctttttttgacgagaacagaaccggtgatctgataagccgacttactagtgataccacgatggtgagcgatcttgtaagtcagaacattaatgtcttcctacgaaatacagtcaaggtcacaggagtagtcgtgtttatgttttctctgtcctggcaactatcactcgtgacattcatgggctttccgatcataatgatggtgagcaatatttatggaaagtattacaagagactctccaaggaagtccaaaacgccctggcccgagccagtaataccgcagaagagaccatctctgccatgaaaaccgtgcgatcgttcgccaacgaggaggaggaagctgaggtatacctgagaaagctgcagcaggtctataagctaaataggaaggaggcggctgcctatatgtattacgtatggggttctggtctcactcttctagtagtccaggtaagcattctgtactacggaggccacctggtgattagtggacagatgacaagcgggaatctgattgcctttattatctatgagtttgtcctcggcgattgcatggaaaacgtatccttttccctgtccccaggcaaagtgactgccctggtagggccttcaggcagcggcaagtctagctgtgttaacattcttgagaatttctacccactggagggcggtagggtgttactcgatggcaaacctattagtgcttatgatcataaatacctccatcgtgtgatctcgctggtttcccaggaacccgtgctcttcgctcggtccataacagacaatatctcttatggcctgcctacagtcccgtttgagatggtggttgaggccgcacagaaggcaaatgctcacggcttcattatggagttgcaagatggatacagcaccgaaactggcgagaaaggggctcagctctcagggggtcagaagcagcgggtggcaatggcgagggccctggtccgcaacccacccgtattaatcctggacgaggccacatcggccctggacgccgaaagcgagtaccttattcagcaggccatccacggaaacctgcaaaaacacaccgtgctgattattgcccatcgattgtccacagttgagcatgcccatctcatcgtggtgcttgacaaggggagagttgtgcagcaaggaactcaccagcaactgcttgcacagggaggactgtacgccaaactggtgcagcgacagatgctcggcctgcagcccgcagccgattttacagcaggccacaatgaacccgtcgcaaacggtagccataaggcttag

SEQ ID NO: 215394 - DNA, 2301 bp, Artificial Sequence
  Description of Artificial Sequence: Synthetic coding sequence
atgcggctgtggaaagccgtcgttgtcaccctggcctttatgtccgtggacatctgtgttacgaccgcaatttacgtgttctcacaccttgatcgctctctgctggaggacattcggcacttcaatatatttgatagcgtgctcgatctgtgggccgcttgtttatacagaagctgtttgttgttaggagccaccatcggggtcgcaaagaatagcgcgcttggcccaagacgtctgcgagctagctggcttgtgattacattggtatgccttttcgtcggaatttacgccatggtgaaactcctcctattctccgaggtgagaagacccatccgcgacccttggttttgggccctgttcgtgtggacctatatcagcctgggagccagttttctgctttggtggttactgtccactgtgcgcccaggaacccaggcattggaaccaggcgcagcaaccgaagctgaaggctttcctggcagtggcagaccgccacctgagcaggcctctggcgcaacacttcagaagctgttgagttacactaaacccgacgtggcctttttggtggccgcatcttttttccttattgtggccgcattaggcgaaaccttcttaccttattacaccggaagagctatcgatggaatagtgatccagaaatcaatggaccagttttcgacagctgtcgtgattgtctgtctgctcgcaataggctcgtccttcgccgctggtattagaggcggtatattcacgctgattttcgcaagactcaatatcaggctgcgcaactgcctgtttagatcgctggtgtcacaggaaacgtctttcttcgatgagaatagaaccggtgatctaattagtagactgactagtgatacgacgatggtaagtgatcttgtttcacagaacattaatgtcttcctgcgtaataccgtaaaggtcaccggggtggtggtgtttatgttttccctttcctggcaactctcactggttacctttatgggattcccgataataatgatggtcagcaacatctacggcaagtattataagcgcctctctaaagaagtacagaatgcgctggcaagggcctccaacacggcagaggagaccataagtgcgatgaagacagtaagatctttcgccaacgaagaagaagaagcagaggtttatcttcgaaaactacaacaggtttacaaacttaatagaaaggaggcggcagcttatatgtactatgtttggggcagcggattaacattgctagtggtccaggtgagtatactgtattatggcggacatctggtgatcagcggacagatgacgagcgggaacctgattgccttcattatttatgagtttgtgttgggtgactgcatggagagtgttggtagtgtttattccgggctgatgcaaggtgtaggcgctgcggagaaggtgtttgagttcatcgatcggcagccaactatggtgcacgatggttctttggcccctgatcacttggagggacgagtcgacttcgagaacgtgacctttacctaccggactcgccctcatactcaggtgctgcaaaatgtgtccttctcgctgagtcctggaaaggtgaccgccctggtgggtcccagcggttccggtaaaagcagctgcgtcaacattctggaaaacttctacccgctggaggggggaagagtactgctagacggcaagcccatatctgcatacgatcacaagtatctgcacagagtcatctccctggtcagccaggagcctgtccttttcgcgaggtctataacagacaatatttcatacggactgccgacagtgccttttgagatggtggtggaggctgcccagaaggccaacgcacacggattcattatggaactgcaagatggatactcaactgaaaccggcgagaagggagcccagctgtctggcggacagaagcagcgtgttgccatggcaagggccctggttaggaatccgcctgtactcattctggacgaagccacttcagccctggacgccgagtcagaatatctcatacagcaggccatccacggcaacctgcagaagcatacagtgctgatcatagcgcaccgactgtcgaccgtggagcacgcccatcttatcgttgttctggataaggggagggtcgtgcagcaaggaactcaccagcaactcctcgctcagggaggcctttacgccaagttagtccagcgacagatgctgggcctacagcctgctgcggatttcactgctggtcacaatgagccagtcgccaatggcagccataaggcttag

SEQ ID NO: 215395 - DNA, 4395 bp, Artificial Sequence
  Description of Artificial Sequence: Synthetic coding sequence
atgtgccttctggtcttccctcttgtaccgaggagccccgactatatcttgccttgctcccccggatggcgcctgagactggccgctagctttttgctctctgttttccctcttctggatctactgcccgtagccttgcccccaggggctggtcctggtcctattggcttggaggtgcttgcagggtgcgtggctgccgtggcttggattagtcactcactggctttgtgggtgttggcacatagcccacacggccatagccgcggacctctggctctagcccttgtggcactcctgcccgctcctgccctggtcctgacagttctttggcactgtcagcggggaaccctgttgccccctcttctccctggtccaatggcaaggctgtgcctgttaatccttcagctggcagcgttgctcgcttacgctctgggatgggctgcacccggaggaccacgtgagccctgggctcaggagcctcttttgcccgaggaccaggaacccgaagtagctgaggacggcgaatcatggctgtcccggtttagctatgcttggttagcccctctactggccaggggggcatgtggtgaacttcggcaaccacaggacatctgtcgcctgccacataggttacagcctacctatcttgcaagagtgtttcaagctcactggcaggaaggtgccaggctctggagggccctctacggggcttttggccgttgctatctggctcttgggctgctgaagctagttggaacaatgcttggcttcagcggacccctgctgctcagcctcctggtcggcttcctggaggaaggacaggagcccctgagtcacgggctcttgtacgcactaggtctggccggaggggctgttctgggcgcagtgcttcaaaatcagtatggctacgaggtgtacaaagttacccttcaagccagaggagctgtactcaacattctgtattgcaaggcactgcagctcggcccatcgagaccacccacaggggaagctcttaatttgctaggtacagattccgagcgcttgctgaatttcgctggttcttttcatgaggcctggggtctcccacttcaactcgcgatcaccttgtatctgctgtaccagcaggtgggggtggcattcgtcgggggactcatcctggcgctgctgctggtgcccgtcaataaggtgattgcaacgaggattatggcttccaaccaggaaatgttacagcataaagatgctcgcgtaaagctcgtgacagagctgctaagcggcatccgggtcataaaattctgtggatgggagcaggccctgggcgctcgtgtcgaggcgtgtagggccagggagctcggccgactccgagtgatcaagtaccttgacgcagcgtgtgtgtatttgtgggcagctctcccagtggtgatttctatagtcatctttattacttacgttcttatgggacaccagctcacagctaccaaagttttcaccgcactggcactggtaagaatgctgatactgcccctaaataacttcccatgggttatcaacggcctgctggaagccaaggtgagcctcgatcgtatccagctcttcctggacctgccaaaccacaaccctcaggcttactatagccctgactgtggccgtctgggagcccaaatcaagtggctcctctgttccgatcctccggcagagccatccacagtcctggaactgcatggcgctctgttctcttgggaccccgtggggaccagcttggagacgttcatcagtcaccttgaggttaaaaaaggcatgctggttggcattgtgggcaaggtcgggtgcgggaaaagttctttgctggcggcaatcgcgggtgaattgcacagactcagaggccatgtggccgttcggggattgtcaaaagggttcggactggcaacacaggagccttggatacagttcgccaccatacgggataatatcctctttggaaaaacatttgatgcccagctgtacaaagaggttctggaggcatgtgcgctgaatgatgatctgtcgatcctccctgctggtgatcagacagaggtcggtgaaaaaggagtgacacttagtgggggtcagcgtgcaagaatcgcactcgctagggcagtgtaccaggaaaaggagctgtatctgttggacgacccactggctgccgtcgatgcagatgtagcaaatcacctgctgcacagatgcatcctgggaatgctcagttacacgacaaggcttctgtgcacccataggacagaatacctagaacgagccgacgccgtccttttaatggaagcaggcaggctgattcgggcaggccctccgtcagaaattctcccattagtgcaggcggtgcctaaggcatgggccgagaacgggcaggagtcagactcggcaaccgcacagagtgtccagaaccctgaaaaaaccaaagaggggctggaagaagagcagagtactagtggacgcttactacaagaagagagcaagaaggagggcgcagtggcattacacgtctaccaggcctattggaaagccgtcggccagggcctcgccctggcaatcctcttcagcctattgttgatgcaggctacaaggaatgccgcagactggtggctgagccattggattagccagttgaaggcggagaattctagccaggaggcgcagccaagtacctctccagcatccatggggctattcagcccgcagttgttactattctcccctgggaatttgtatatccctgtgttccccctgccgaaggccgcacccaatggatcttctgacattcgcttttacctgaccgtctacgctacaatcgcgggtgtgaactcactatgtaccctactcagggccgtgctgtttgccgctggaaccttgcaggccgctgcaaccttacatcgtcgcctgctgcaccgtgtcttgatggcccctgtgaccttttttaacgctacaccaacaggcaggattctgaacagattttctagtgatgtggcctgcgctgacgactctctgccatttatccttaatatactgctggccaacgcggcagggctgctggggctcctggctgtgctgggatcgggcctcccctggctgctgctgctgcttccccctctgagtattatgtattaccatgtccagaggcattatagggcctcttctcgggaattacgtcgactggggagtctgactctgagcccactctactcccacctggccgacaccctggcgggactgtctgtgttacgggcaacaggagcgacctatcggtttgaggaggaaaatttacgactcttggaactgaatcaacggtgtcagttcgccaccagcgctaccatgcagtggcttgacattcgcctgcagttgatgggagcagctgtagtcagtgctatagcgggaatcgccctagttcagcatcaacagggtttagctaaccccggtctggttggactctcgcttagttacgcgctgtccctcactggtctcctgtccgggctggtttctagtttcacccaaactgaagctatgctcgtgagtgtggagagactcgaggagtacacatgtgatctcccgcaggagcctcagggccagccacttcaactgggcacagggtggctcacacagggtggggtggagtttcaggatgtggtcctggcctatcgccctggtcttcccaacgccttggacggcgtgaccttttgtgtgcaaccgggtgagaaattgggcatcgtcgggagaacaggatctggcaagagttccctcctcttggtcctgtttcggctcctggagccttcctccggacgcgtactgctcgacggcgtggacacaagccagctggagctggcacagctgagaagccaactggcaatcatccctcaagagcccttcctatttagtggaaccgtccgcgagaacttggacccacaaggcctacacaaagatcgggcactttggcaggctctgaaacaatgccatctatcagaagtgattacaagtatggggggtctcgacggagagctcggtgaaggcggtcggagtctctcactgggacagcggcagctcctttgcctggcccgagcgctgctgacggatgctaagattctctgtattgacgaggccactgcctctgtagatcagaaaaccgaccaattactgcaacagaccatctgcaagcgctttgccaataaaaccgtccttactatagcccacaggcttaacaccatcctgaactcagaccgggtgctggtgctgcaggcagggagagtcgtggagttggatagcccagctaccctacggaaccagcctcatagcctgtttcagcagctgctccagagctcgcagcaaggcgtccccgcatcccttggcggtccctag

SEQ ID NO: 215396 - DNA, 4479 bp, Artificial Sequence
  Description of Artificial Sequence: Synthetic coding sequence
atggagcgactgctcgctcagctgtgtggctccagcgccgcttggcccctccctctgtgggaaggggacacgacgggccattgctttacccagcttgtcttaagcgccttgccgcatgctttactggccgtcctttctgcttgttacctggggacccccaggtcacccgattacattctgccctgcagcccaggatggcggctgagacttgctgccagctttttactgagcgtgtttccactccttgatttgctgcccgtggcactgcctcctggcgctggacctgggcctattggactagaggtgctggcagggtgtgtggctgccgtcgcctggatctcacatagcctggcactgtgggttctagcccatagcccccacggtcacagtaggggccctttagctcttgctcttgtggcactactgccagcacctgccctggttctcacagtattgtggcactgtcagagaggaacactgttaccccctctccttcctgggcctatggccagactgtgcttgctgatactccagctagctgcgctgcttgcttacgctctcgggtgggctgcaccaggagggccacgggagccatgggctcaggaaccgctgttgcctgaagatcaggagcccgaagtggccgaagacggcgaatcgtggctgtccagattctcctacgcgtggctagccccattgctggcacgcggagcatgcggagaattgaggcagccacaggacatatgcagactgccccaccggttgcagcctacatacctggcaagggtgttccaagcccactggcaggagggagctcgtctttggagagcactgtatggggctttcggcaggtgttacctagccctgggcctgctcaagctcgtcggtacaatgctgggcttcagtggaccgctgcttctctccctgctggttgggtttctcgaggagggacaagaaccgctttctcacggcctgttatatgctctgggcctggcaggaggcgcagtgcttggggctgtccttcagaaccagtatggatatgaggtctacaaagtgacccttcaggccaggggagccgtacttaacattctgtattgtaaggccttacagctaggaccaagtcggccacctactggagaagctctgaatctcttaggcacagactccgagcgattactgaatttcgctggatcatttcacgaggcatggggacttcctctacagctggccattactctgtacctgttgtaccagcaggtgggggtggcatttgtcggaggactcatactcgcgctactgttggtgccagtgaacaaggtgatcgcgaccagaattatggcttccaatcaagagatgctccagcacaaagacgctagggtgaagctggtcacagaattactctccggcattcgagttataaagttctgcgggtgggagcaggctcttggtgctcgggtggaggcctgcagggcgagggaattaggcaggctgcgggtgattaagtacttagacgccgcatgcgtgtacttgtgggccgctcttccagtggtgatctccatcgtgatcttcatcacctacgtcctgatgggacatcagctcacggctaccaaggtgttcacagcactagcactcgtccgcatgctcatactacccctcaacaattttccgtgggtcattaatggtcttctggaagccaaggtgagtctagatcggatacaactgttcttggatctgccaaaccataatccacaggcttactatagccccgatcctcctgcagaacccagcacagtgttggagttgcacggagcgctgttctcttgggatcccgtggggacttccctcgaaacattcatcagccatttggaggtgaagaaaggcatgctggtgggcattgtagggaaggttggttgtggcaagagtagcctccttgccgctattgctggcgagttgcacaggctgcgagggcatgtggcggttcgaggccttagcaaaggctttggcttggcgacccaggaaccttggatacaattcgcgacaatcagggacaacattctgtttgggaaaacctttgacgcccagctgtacaaggaagtgctggaggcctgtgcacttaatgatgacttgtcaatcctgcccgcaggtgatcaaacggaggttggcgaaaagggcgttacactctcaggcggacaaagagcaagaattgctctggcaagggctgtctatcaggaaaaggaactgtacctgctggatgatccactggcagctgtggacgctgacgtcgcgaatcacctgcttcatcggtgcatccttggcatgctgtcctacaccacccgcttgctctgtacacaccggactgagtacctggagcgcgctgacgccgtgctgctgatggaggccggaaggctcattcgggctggaccaccgtccgaaatactcccattagtgcaggccgttcccaaagcttgggccgagaatgggcaggaatccgatagtgccaccgcacagagcgtccaaaatcctgagaagaccaaggagggcctggaggaggaacagagcacttcgggacggctactgcaagaggagtctaaaaaagagggtgcagtagcgctacacgtgtatcaggcttactggaaagcagtggggcaaggtctggccctcgccatcctcttctccctgcttctcatgcaggctacaagaaatgctgccgattggtggctgtcacactggatcagccagcttaaggccgaaaacagtagccaggaggcacaaccctctacctcgcccgctagcatgggtttatttagcccccagctgcttctttttagtccaggtaatctgtacattcccgtattcccactgccaaaggccgctcccaatgggagtagcgacatcagattttaccttacggtttacgcgactatcgcaggcgtcaattccttgtgtacactgcttagggcggtccttttcgcagccggaactctgcaagcagccgctacgctgcatcggaggctgcttcatagggtgctgatggcccctgttacattttttaacgccactcccacaggcaggattttaaatcggttcagtagcgatgtggcctgcgctgacgattccctgccattcatcctgaatatcctgctcgctaatgcggctgggcttcttggtttactcgcagtgctgggtagtgggctgccatggcttttgttgctgctaccaccactctccatcatgtactaccatgttcagcgccactatcgggcttcctcacgggagctgaggcgcctcggtagtctgactctgagccccctgtattctcatctggccgacactttagcgggactgtctgtgcttagagccaccggcgcaacctaccgtttcgaagaagagaatctaagattgttagaactgaatcagcgctgtcaatttgcaacgtccgccacaatgcagtggttggacatcagactgcaactgatgggcgcagctgtggtcagcgctattgccggtattgctctcgtccaacatcaacagggacttgccaacccaggactagttggactgtctttgagctacgcattgtctcttactggtctgctctctggactcgtgtccagttttacacaaacggaggcgatgctagtgagtgtggagcgcctggaggagtacacctgcgatctgcctcaggagccgcaggggcaacccctccagctaggaacaggatggctgacgcagggtggtgtagaattccaggacgtggttctagcgtacagacccggattgcccaatgccttggatggagtgacgttttgcgtgcaacctggcgagaaactggggatcgtggggagaactgggtctggtaaaagctctctcctcttggtgctgttccgcctgctggagccctcctccggcagagtactgctggacggagtagatacttcgcaactggaactggctcagctgcgatcgcagcttgcaataatccctcaggagcctttcctgttctctgggactgtgagagaaaaccttgatccccaggggttgcacaaggaccgcgcactatggcaggctctcaagcagtgccacctgagcgaggtcatcacctccatgggaggtctcgatggagagctgggtgagggcggaagatctctaagtttgggacagcgccaactgctctgtctggccagagctctgctcacagatgccaagattctgtgtatcgacgaggcaaccgcatccgtcgaccagaagactgatcagctcctccaacagacaatttgtaaacgattcgccaataagaccgtgctgactatagcacaccggttaaataccatcttaaacagcgacagggtcctggtgctgcaggcaggcagggtcgttgagttggactcacccgctaccctcagaaaccagcctcactccttgttccagcaactcctccagagctcccaacaaggcgtgcctgctagcctcggtggaccatag

SEQ ID NO: 215397 - DNA, 4035 bp, Artificial Sequence
  Description of Artificial Sequence: Synthetic coding sequence
atgaccaggaagagaacatactgggtgccaaatagttcgggtggactggtaaatagggggatagacatcggggatgatatggtctcagggcttatctacaagacttatacgctccaggatggcccttggtctcaacaggagagaaacccagaggcacctggaagagctgctgtgcctccttggggaaagtacgacgctgccctgcgcacgatgataccttttagaccaaagccgaggttcccagcccctcagccccttgataatgcaggcctgttcagctatctcaccgtctcctggcttaccccgctaatgattcaaagtttgcgctcaaggctggatgaaaatactataccccctctttccgtgcacgacgcaagcgacaagaacgtgcagaggttgcacaggctgtgggaggaggaggtgtcacgacgcggtatcgagaaggcttccgttctgctagtcatgctgaggttccaacgaacacggttgatcttcgatgctctcctgggtatttgtttttgtattgcgagcgtactgggcccaatcctcattataccaaagatcctcgaatactccgaggagcagctcggaaatgtggtccacggcgtgggactatgcttcgcattgtttcttagcgagtgtgtcaaaagcctttccttcagttcaagttggatcattaaccaacggaccgcaattagatttagagcagcggtgagcagttttgcatttgagaaacttattcaattcaagtcggtgatccatattacctcaggcgaggccatcagcttcttcacaggcgacgtgaattatttgttcgagggcgtttgttatggtccactcgtgcttattacatgtgcttcactcgtaatctgcagcatttcttcttacttcattattggctacacagctttcatcgccattttatgctacctgcttgtttttccactcgctgtgttcatgaccagaatggctgtgaaggcccagcaccacacatctgaggtctcagatcagcggattagggtgactagtgaggtgttaacatgtattaagctgatcaaaatgtacacctgggaaaagccatttgctaagatcatcgaagacctcaggcggaaagaaaggaaactgttagaaaaatgtggactcgtgcagagtctgacctctattacattgtttataattcccaccgtggcgacagctgtgtgggttttgatccatacttccctgaaactgaagctgactgcctcgatggcattttctatgctcgcgagcttaaatctgctacgcctgtcagtgttcttcgttcccatagccgtgaaggggctcacaaattccaagagcgccgtcatgagattcaagaagtttttcctccaggaatcgcccgtgttctatgtgcagaccctccaggatccatccaaggcgttagtgttcgaggaggcaactttgagctggcaacagacctgtccaggcatcgtcaatggagccctggagcttgagcgaaacggacatgcttccgagggcatgacaaggccacgagacgcactgggcccagaggaagaaggcaactcccttggtccggagttgcacaaaatcaacttggtggtcagtaagggcatgatgttaggggtgtgcgggaataccggctcagggaaatcatcgcttttaagcgctatactggaggaaatgcatctccttgagggttccgtgggagtgcagggaagcctggcatacgttcctcaacaggcatggatcgtcagtggcaatataagggaaaacatccttatggggggtgcttatgataaagctaggtatctccaggtcttacattgctgtagccttaacagagacctcgaattgctgccttttggcgatatgacagagatcggagagcggggtctcaatctctctggcggtcaaaagcaaaggatctctctagcgagggccgtctacagtgatcgacagatttatctacttgatgatcccctttccgctgttgacgctcacgtcggcaaacatatctttgaagaatgcatcaaaaagacattacgaggcaagacagtggtgctggtcacgcaccagctgcagtatctggaattttgtgggcagatcatcctgctggaaaacggtaagatctgtgagaacggcacacactcagaactcatgcagaagaaaggcaagtacgcacaactcatccagaaaatgcataaggaggccacaagtgatatgttacaagatacggcaaaaatcgccgagaagcctaaggtagagagccaggccttagccacgtcccttgaagaaagccttaacggcaatgctgttcctgaacatcagctgacccaggaggaggagatggaggaaggttctttaagctggcgtgtctatcaccattacatccaggcagccggaggctacatggtgtcctgcatcatcttctttttcgtggtgctcatagttttccttactatcttctctttctggtggctttcctactggctggagcaagggtctggaacgaattctagtcgtgagtccaatggaacaatggctgatttggggaacattgccgataacccacagctcagcttttatcagctcgtgtacgggctcaacgcgttactcttgatttgtgtcggagtctgttcttccgggatattcacaaaggtgactagaaaagcttcgaccgcactgcataataagttgtttaataaggtattccgttgtcctatgtctttcttcgacactatcccaatcggtcggttgctgaattgcttcgcgggagacctcgagcagttagaccagctgcttcctatctttagtgaacagttcctggttctgagtctgatggtcattgcagttctgctcatagtatccgtgctctcaccttatatactgttaatgggagccataatcatggtcatttgcttcatttactacatgatgttcaagaaagccattggggtgttcaaaagactggagaactactcacgctccccgctctttagccacatcctcaactcactccaaggcctcagctcaattcatgtatatgggaagactgaggacttcataagccaatttaaaaggctgactgacgcacagaacaattatctcctgctgtttctttcctcaaccaggtggatggccctccgcctggagataatgaccaacctcgtgacactggcagtagcattattcgttgccttcggtatcagctccaccccctatagctttaaagtgatggcagtaaacattgttctccaactggcatcctcatttcaggccaccgctaggatcggactggaaacggaagctcagtttacggctgtagagcggatactgcaatatatgaaaatgtgtgtgagcgaggcccctttacatatggaaggcacatcttgtccccagggctggccgcaacatggggagataattttccaggactaccatatgaagtatcgcgacaacactccaaccgtcttgcacggaatcaatctaaccattcgcggtcatgaggtcgtggggatcgtcggaagaacaggctctggaaaatcaagtttagggatggccttgtttcgcctggtagagcccatggctggaagaatcttgatcgatggggtggatatctgtagtatcggcctggaggatctcagatcaaagttgtcagttatacctcaggatcctgtgttgttgagtggcaccatcagattcaatcttgacccattcgacagacacacagaccagcagatttgggatgccctggagcgcacctttctgaccaaggccattattctcattgacgaagcaaccgcctctatagatatggagaccgacacccttatccaacgaactatcagagaggcgttccagggctgtaccgtgctggttatcgctcatagggtcaccactgtgttaaactgtgatcacattctagtgatgggtaacggcaaagttgtggaatttgataggcccgaagttctgcggaagaagcccggttctctgttcgcagccttgatggccacggccaccagctctctccggtag

SEQ ID NO: 215398 - DNA, 4149 bp, Artificial Sequence
  Description of Artificial Sequence: Synthetic coding sequence
atgacccgcaagaggacttactgggtgcccaattcatccggcggattagtgaacagaggtatcgacatcggagatgatatggtctctgggctgatctataaaacatatactctacaggacgggccttggtcacaacaagagcgcaaccctgaggcccctggtcgagcggctgtgcctccctggggcaagtacgacgctgcactcaggaccatgatcccctttcgcccaaagcccaggttccccgcaccccaacccctcgacaacgctggactttttagctacctgactgtgtcgtggctgaccccactaatgatccagtcactgcgctcccgactggacgaaaacacaattccaccactcagtgtgcacgacgcatccgataaaaatgtgcagagattgcacagactatgggaggaggaagtctccaggcgtggcattgagaaagcgagcgtgttactggttatgcttcggtttcagcggacaagactcatcttcgacgctttgctcgggatctgtttctgcatagcaagtgtcctgggacccatattgatcattcctaaaatattggagtacagtgaagagcagctcgggaacgtcgtgcatggcgttgggttatgcttcgcactatttctcagtgagtgtgtgaaatccttgtcgttttccagttcatggattattaatcaacggaccgcaatcagattccgggctgccgtaagttcttttgccttcgagaaactcatacagtttaagagcgtcatccacattacttcaggcgaggccatttcgtttttcaccggagacgtgaattacttattcgaaggagtatgctatggacctctggtcctgatcacctgcgcctcgttggtcatttgtagtatatcctcctatttcataataggatacacagccttcattgcaattctctgttacctgttagtgtttcctctagccgttttcatgacccgtatggccgttaaggctcagcaccatactagcgaggtatcagatcagagaattagagtcacaagtgaggtgctgacctgtatcaagctgatcaaaatgtacacctgggagaagcctttcgcaaagataatagaggacctgcggcgaaaggagcgcaaactgctagagaagtgcggccttgtgcagtccttgacttctatcactctgtttattatcccaacagttgccactgccgtgtgggtgctgattcacacctcgttgaagctgaagctcactgcctccatggcgttctccatgctagcatcactgaacctgcttcgactcagcgtattttttgtgccgattgcggtgaaaggcctcaccaattctaaatccgccgttatgcgcttcaagaagttcttcctccaggagagtccagtcttttatgtgcagactcttcaagacccgagtaaggcgctcgtgtttgaggaagctactctgtcctggcagcagacatgcccaggcatcgtcaatggtgctctcgaactggaaaggaacggccacgcctcagaaggaatgactcggcctcgggacgcgctgggtcccgaagaggaagggaatagtttggggcctgagttgcacaagataaacctagtcgtgtctaaagggatgatgctgggcgtatgtggcaacaccgggagcggaaagagcagcctacttagtgcaatcctcgaggagatgcatttgctggaaggatccgtaggagtccaaggctcacttgcctatgtgccccagcaggcctggatcgtctcaggaaatattagagagaatatccttatgggaggagcttatgacaaggcacgctatctccaggtgctccactgctgttcgttaaatcgagatcttgagcttctgcctttcggggatatgacagagattggcgagaggggcctcaacctgtccggcggacagaagcagagaataagcctcgcacgtgcagtctactctgatcgtcagatctacttactggacgatccgctctccgcagtggatgcacacgtggggaaacacatttttgaggaatgcattaaaaaaactcttagaggcaagaccgttgtgctggtgacacaccagctgcagtacctcgagttttgcggccaaattatattactcgaaaatggcaagatttgtgagaacggcacacattctgaactgatgcagaagaaaggaaagtatgcccagctcatacagaaaatgcataaggaggccacgagtgacatgcttcaagataccgctaagatcgcagagaaacctaaggtcgagtcacaggctcttgctacttctctggaagagagtcttaacgggaatgctgtgcccgagcaccagttgactcaggaagaggaaatggaggaaggcagcctatcttggcgcgtgtaccaccattacatccaagccgctggcggatatatggtcagctgtattatattttttttcgtggtcctgattgtgttcctgaccattttcagtttctggtggttgagctactggctggagcaaggctccgggacaaactcttctcgagagtccaatggcacaatggccgacctggggaatatcgccgacaatcctcagctcagcttttatcaacttgtgtatgggctcaacgctctgctcttgatttgtgtgggggtgtgctcgtccggtattttcaccaaggtaacccgtaaagcttccacagccctgcacaataagctatttaataaagtgtttagatgcccgatgtcgttcttcgataccatccctatcgggagactgctgaattgttttgccggagaccttgagcaactagatcagttactgcccatcttttcggaacagttcctggtgttatcacttatggttatcgccgtccttttaattgtgtctgttctctcaccttatatcctgcttatgggagccatcatcatggttatttgcttcatttactacatgatgtttaaaaaggcaataggtgtttttaaacggttggagaactattcccgatcaccactgttttcgcacatactgaattccttacaaggactcagtagcattcatgtatatggcaaaaccgaggatttcatttcacagttcaaacgcctgacagacgctcagaacaattatctgctactcttcctatcatccacaaggtggatggctcttcgtctagagatcatgacaaacctggtgaccttggccgtagccctcttcgtggcattcggcatcagctcaacaccatactcttttaaggtcatggccgtgaacatcgtactccaactcgcatcgtcattccaggccacagctaggattggcctggaaaccgaggcccagtttacagccgtcgagaggatcctccagtatatgaagatgtgtgtcagtgaggccccactacatatggaggggacatcatgtcctcaaggatggccccagcacggtgaaatcatcttccaagattaccacatgaaatatcgggataatacccctactgtgctgcatggtattaacttaacaattcggggacacgaagttgttgggattgtggggcgtaccggtagtggtaagtccagcctgggaatggctctgttcaggctcgttgagccaatggccggacgaatcttgatcgacggcgtcgacatttgttcaataggcctggaggatcttcgctctaaactgtcagttatcccacaggatcctgttctgctgagcgggaccatacgcttcaatcttgatccttttgacagacacacagatcagcagatatgggacgcgctggagcgaacctttcttacaaaggcaatttctaagttccccaagaagttgcataccgatgtcgtggaaaacggcggaaactttagtgtcggcgagagacaattactatgcatcgctagagccgtcttgagaaactcgaagattatcttgatcgacgaggcaactgcttccattgatatggagaccgacactctgatccaacgcacaattagggaagcgtttcagggctgtaccgtgctggtgatagcccaccgtgtcacaactgtcctcaattgtgaccacatcctggtgatgggtaacggtaaggtcgtcgaattcgataggccagaggttcttcgcaagaagccaggaagcctgttcgccgctctgatggccacagccacctcctccctcagatag

SEQ ID NO: 215399 - DNA, 4149 bp, Artificial Sequence
  Description of Artificial Sequence: Synthetic coding sequence
atgaccagaaagcgcacttactgggttccaaactctagcggtggcctcgttaatagaggaatcgacattggtgatgacatggtttccgggttaatatacaaaacctatacattacaggatgggccttggagtcaacaggagagaaatcctgaagcccctgggagagcagccgttccaccatggggaaaatatgacgcagctcttcgcaccatgattccatttaggccaaagcctaggtttcctgccccacagccgctggacaatgctggcctcttttcatacctgaccgtcagctggctgactcccctcatgatccagtccctgaggtcccgcttagatgagaacacgataccacctctctcggtgcacgacgcgtctgataagaatgttcagcggctgcacagactctgggaggaagaggtctcacgccgtgggattgagaaggccagcgtgctgttagtgatgttgcggttccagcggacccgtctgatttttgacgccctgctgggtatttgcttttgcatcgcctcagtgctcggacctatcctaataatccccaaaatccttgaatattcggaagaacagctaggcaacgtagtgcacggcgtggggctatgtttcgccctctttctgtcagagtgtgtcaagagtcttagtttctcttcctcctggataataaaccagagaaccgccatacgatttagggccgctgttagctcttttgcttttgagaagctgatacaattcaagagcgttattcatatcacatcgggagaagcaatttcattcttcaccggcgacgtcaattacctgtttgaaggagtctgttacgggcctctagtgctaatcacgtgcgcaagccttgtgatctgctctattagctcctactttatcatcgggtacacagcctttattgctattttatgctacttgctcgtcttcccactggcagttttcatgactaggatggctgtgaaggctcagcatcacacttccgaggtgtctgaccagcgaatccgagttactagtgaagtgctgacatgtatcaaactgatcaagatgtacacctgggaaaagccttttgccaagataatcgaggatcttcgacggaaggagagaaaattgctggagaaatgcggcctggtacagtccctgactagcattaccctcttcatcatccctaccgttgctactgcagtttgggttctgattcacaccagcctcaagctaaagctgacggcttcaatggcatttagtatgctggcttcattaaatcttctgcgcttgtccgtcttctttgtgccgattgcagtgaaggggttgacaaatagtaagagtgccgtgatgaggttcaagaaattttttctccaggagagcccggtcttctatgttcaaaccctgcaggaccctagcaaggctctggtgtttgaggaggccacgctgagttggcaacagacctgtcctggaatcgttaacggagccctggagctcgagagaaacggccacgcctccgaagggatgacacgccctcgggatgcgctcggtccggaggaagagggaaattccctgggcccagagctacacaaaatcaacctcgtagtttctaagggcatgatgctaggcgtctgcgggaatactggatcagggaagagctcacttctgagcgcaatactcgaggaaatgcatttgttagagggttccgtcggggtgcagggttccctcgcttacgtgccacaacaggcctggattgtttctgggaatattcgcgaaaatattctgatgggcggagcttatgacaaagcacgatatctccaggtcctgcattgttgctccctgaaccgcgatcttgagttgctgccctttggtgacatgactgagatcggagaaaggggtttgaatctctccggcggacaaaagcagcgaatcagcctagccagggccgtatactcagatcgccaaatctacctcctggatgaccccctgtccgcagtagatgcccacgttggcaagcatatctttgaagaatgcattaagaagactctgcgcggtaagaccgtggttctggtgacacatcagctgcagtaccttgagttctgtggccaaatcatcctcttggaaaatggtaagatttgcgagaacggaacacattcagaactgatgcagaagaagggcaaatacgctcagttaatccagaaaatgcacaaggaggcaactagtgacatgctacaggataccgccaaaatcgcggagaagccaaaagtggagtctcaagccttggccacctctctggaagagagtttaaatgggaatgctgttcccgagcatcagctgacacaggaggaagagatggaggaaggctcgctgtcatggcgcgtgtaccatcattatattcaggccgctggaggatatatggtctcatgtattatttttttcttcgtagttctgatcgttttcctgaccattttttcattctggtggctgagctattggctcgagcagggctctggaacaaactcttccagggaatctaacggaactatggccgatctgggaaacattgctgacaatccccaacttagcttctatcagctggtttacggcctcaacgcccttctgctcatctgtgtgggagtctgtagctctggaatcttcaccaaggtaaccaggaaagcttcgaccgccctgcataataaactgtttaacaaggttttcagatgccccatgagcttctttgacaccatcccaattggccgattactgaattgctttgccggagacttggaacagctagaccaactgctaccaatttttagcgaacagtttctcgtccttagcctaatggtcatcgctgtgctgttgatcgtgtcggtgctctctccctatatactacttatgggagcgatcattatggtcatctgtttcatttactatatgatgttcaaaaaagctataggggtgtttaagcgcctggagaattacagccgctcaccccttttcagtcacattctgaatagcctgcagggactgagcagcattcacgtctacggaaaaaccgaagattttatttcccagtttaagcgtcttaccgatgcgcagaacaactatcttttactatttctcagcagcacccgctggatggcactgagattggagataatgacaaacctcgtgactcttgccgtggccctgttcgtagccttcggtatctcttctaccccttatagctttaaagtcatggcagtgaatattgttctccagcttgcatccagcttccaggcaactgcgaggatcggccttgaaacagaggcacagtttactgctgtcgaacgcatactgcaatatatgaaaatgtgcgtatccgaggcccctctacatatggaggggacatcatgccctcaagggtggccccagcacggcgagataatcttccaggactaccacatgaaataccgcgacaacacccctaccgtgctgcacggcattaatctgaccatcaggggtcacgaggtggttgggattgttggccgaacaggaagcggaaaatcaagtctaggaatggcgttgttccgcttagtcgaacctatggcgggacgaattctgatagacggcgtggacatttgttctatcgggctcgaggacctgaggtccaagctgtctgtgatcccacaagacccagtacttctttcaggcaccatccgcttcaatctcgacccatttgaccgacacactgatcagcagatttgggacgcactagagagaaccttcctgactaaggctatctctaaattccctaagaaactgcacaccgatgtcgtggagaacgggggaaacttttccgttggtgaaaggcaactgctgtgtatcgctcgagcggtactccgaaacagcaaaattattctcattgacgaagccacagccagcatcgacatggagactgacaccctgattcagaggacaatccgagaggcttttcagggatgcacagttcttgtgattgcccatcgcgtgactaccgtgctaaactgtgatcatatacttgtgatgggcaatggaaaggtggttgagtttgatcgcccagaagtcctgaggaagaaaccgggaagtctctttgctgctctgatggccaccgccacgtcctctttacgttag

SEQ ID NO: 215400 - DNA, 4149 bp, Artificial Sequence
  Description of Artificial Sequence: Synthetic coding sequence
atgacgaggaaaaggacctattgggtgcctaattcttcaggaggcctcgtgaaccgcggaatcgatattggagacgacatggtcagcggactgatctacaagacctatacactccaggacggcccttggagccagcaggagcggaacccagaagccccaggcagggctgctgtccccccttgggggaagtatgacgccgcactaagaacaatgatcccattcagacccaaaccaagattccctgccccacagcctctggataacgcaggactgttctcttatttgaccgtttcttggctaacgcccctgatgattcaaagcctgaggtccaggctggatgagaacaccatcccaccactttccgtgcacgacgctagcgataaaaatgtccaaaggttgcatagactgtgggaggaagaagtaagccggagaggtattgaaaaagctagtgtcctgctggtgatgctgaggtttcagcggactagactcatatttgacgccttgcttggtatttgcttttgtatcgccagtgtgctaggcccaatcctgatcataccaaagatccttgagtacagcgaggagcaactcggtaacgtggtgcacggagtgggcctctgtttcgctctgttcttgagcgagtgcgtgaaatcgttgagtttctcatcctcatggatcataaaccagaggaccgctatacggtttagggccgctgtgtcaagtttcgcattcgaaaagctgattcaattcaagtcagtaatacatatcacaagcggagaagctatctcttttttcacaggggatgtcaactatctttttgagggtgtatgctacggcccactggttctgataacctgcgccagcctcgtcatatgcagtatatccagctactttatcattggctatacagcgttcatagccatattatgttatctgctggtcttccctcttgcggtatttatgacgcgcatggcagtgaaggctcagcatcacaccagcgaagtgtcggatcagcgcatccgagtcacttccgaggttttgacatgcatcaagttgattaaaatgtacacctgggagaaaccgtttgcaaagattatagaggacttacggagaaaagagagaaagctcctggagaagtgcgggctcgttcagtccctcacctccatcacccttttcattattccaacagtggccacagcagtatgggtactgattcacactagccttaagctaaaactgactgcatcaatggcatttagcatgctggcctctctgaacttgctgaggctgtcggtgtttttcgtgcccattgctgttaagggcctcaccaattcaaagtctgcagttatgagattcaagaagtttttcctgcaagaaagtcccgtgttctatgtgcagacccttcaagacccgtctaaggcactcgtttttgaggaggccacattgtcctggcaacaaacgtgtccaggcatagtaaatggtgctctggaactggaaagaaatggacatgcctccgagggaatgacgcgccctagagatgccctggggcctgaggaggaagggaattccctcggcccagagctccataaaatcaacctggtagtctctaaagggatgatgttgggcgtatgcggaaacacaggctcaggcaagtccagcctcctttccgcaattctggaggaaatgcacctcctggagggaagtgtgggggtccagggcagtctcgcttatgtgccccagcaagcgtggattgtgtctggaaacatccgtgaaaacatcctaatggggggagcgtatgataaggccaggtacctgcaggtgctccactgctgttctctcaaccgagacctggagctcttgccctttggggatatgacagaaatcggtgagaggggcctgaatctgtctggagggcagaaacagaggatctccctcgcaagagcagtgtactcagacagacagatctacttactagacgacccactgtctgccgttgatgcgcatgttggaaaacatatctttgaggagtgcatcaaaaaaaccctgcgtggaaagaccgtagtcctcgtgacacaccagctgcagtatctggagttctgtggacagatcatattattggagaatggcaagatctgcgagaacggtacacatagtgagctcatgcaaaagaaaggaaaatacgctcaactgatccaaaagatgcacaaagaggctaccagcgacatgctccaggacacggcaaagatcgccgagaagcctaaagttgaatcacaagccctagcaacctctttggaggaaagtttgaacggaaacgcagttcctgaacaccagctcacccaggaggaggaaatggaggaaggctctctgtcctggagagtgtaccaccactatatccaagccgcaggtgggtacatggtatcttgtatcatcttttttttcgtcgtgctgattgtctttctgacaatcttcagcttctggtggttgtcatactggctagaacagggatctgggaccaatagttctcgcgagtccaacggaacgatggctgacctcggaaacattgcagacaatccccaactttctttttaccagttagtgtatggacttaatgctctgctgctgatctgtgtcggcgtgtgctccagcggaatttttacgaaagtgacccgcaaagcatccaccgccctccacaacaagctgttcaataaggtctttcgctgcccaatgtcttttttcgacactatccctatcggacggttgcttaactgtttcgcaggcgacttggagcagttagaccaactcctgcccatatttagtgaacaatttctggtgctgtccttaatggtgattgcagtgcttttgatcgtgtctgtcctgagcccctacatcctcctcatgggcgctataattatggtgatatgcttcatttattatatgatgtttaaaaaggcaatcggagtatttaaacgcctggagaactattctagatcaccactcttttctcacatccttaattctctccagggcctttccagcatccatgtgtatgggaagactgaggacttcatctctcagttcaagaggctgactgacgcccagaataactacctccttctttttctatcgtccactcgctggatggctctgcggctggagattatgactaacctcgtgaccttagccgtggccctattcgttgccttcggtatcagctcaactccctacagttttaaggttatggctgtcaacatagtgcttcagctcgcatccagtttccaagctacggcaagaatcggcttggagacagaggcacagtttaccgcggtagagcgcattttacagtatatgaagatgtgcgtgagcgaagcccctctacacatggagggtactagttgtcctcagggatggccacaacacggcgagatcatcttccaggattatcacatgaagtacagggataacacaccaaccgtgctgcatggcattaaccttacaattcgcggacacgaagtggtgggcatcgtgggtcggaccggctctggtaaatcttcactgggtatggctctttttaggttggtcgagcccatggccggtaggatcctgatcgatggcgtcgatatctgcagtatcgggttggaagacctgagaagcaaactctcggtgataccccaggatcctgtgttactctcggggactatcaggttcaatctggatcccttcgatagacacacagaccagcaaatctgggatgccctggaacgcactttcctcacaaaggccatttccaagttcccaaagaaactgcatactgacgtagtggaaaacggcggaaatttttctgtaggcgagcgacagttattatgcatcgctcgggcagtcctgagaaattctaaaataatcctgatcgacgaggcaaccgccagcattgacatggaaactgacacgctgattcagaggactattcgcgaggcttttcaaggctgcacggtgctggtgatagcacaccgcgtgacgactgtcttaaactgcgaccatattctcgtgatgggcaacggaaaggtggtggaatttgacagacccgaagtcctgagaaagaaacctggatcccttttcgctgccctgatggcgacagccaccagcagcttgagatag

SEQ ID NO: 215401 - DNA, 2268 bp, Artificial Sequence
  Description of Artificial Sequence: Synthetic coding sequence
atgacaaggaaacggacatactgggtcccgaactccagcggcggattagtgaatcgcggaattgacataggagatgacatggtgtcaggcctgatatacaagacgtataccctgcaggacgggccatggagtcagcaggagagaaatcctgaagccccaggaagggccgctgtgccaccatggggaaagtacgatgctgctttacgaacaatgatccccttcagacccaagccacgcttccctgccccacagccgctagataatgcaggcttgttttcctacctgactgtgtcatggctcacccctctcatgatccaatctttgcgatcccgactggacgaaaacaccattccgccactcagtgtgcacgatgcctctgacaagaatgtgcaaaggctgcaccggctgtgggaagaagaagtgtctcggagaggaatcgagaaggccagtgtgctcctggtgatgttgagatttcagcgaacacggctcattttcgatgcgctgttaggcatatgtttttgtatcgcatccgtacttgggcctattctcatcatccctaagatcctggagtatagcgaagaacagctcggaaacgtcgtgcacggagtcggcttgtgcttcgccttgttcttgagtgaatgtgtgaaatctctgagttttagctcctcgtggataatcaatcaacgaacagctatacgatttcgtgcagcggttagcagctttgcgttcgagaaacttattcagtttaaaagtgtgatccatatcacatccggggaagctatatctttcttcactggagacgtgaattatttattcgagggtgtttgctacggacccctggtattgatcacgtgcgcttccctcgtcatctgctcaatctccagctatttcatcataggctacacagcctttatcgccatactttgctatctgctggttttcccactggccgtgttcatgacacggatggccgtgaaggcgcagcaccatacttccgaggtctctgaccagcggattcgggtgacctcagaagttctcacctgcatcaagttgatcaagatgtacacctgggagaaaccttttgccaagatcattgaggaccttcggagaaaggaacgcaaactgctggaaaagtgcggccttgtccaatctctgacgtctatcaccctgttcatcatccctactgtggctactgcagtctgggtgctcatccacactagcctgaaactcaagctgacagcttccatggcattctccatgctggcttccctaaatctgctgaggctttctgtgttctttgtcccgatagctgtcaaaggcctgactaactctaaatctgctgttatgcgatttaagaaatttttcctccaggagtcacccgtattttatgtgcagacactgcaggaccccagtaaagctttggtgttcgaagaagccacgttatcttggcagcagacttgccctggcattgtgaatggtgccctggagttggaacgcaatgggcatgcttccgaaggaatgactaggccaagggatgcactgggtccagaagaggagggaaactccctgggtcccgaacttcataaaatcaacctcgtagtatctaaggggatgatgttgggggtctgcgggaatacaggttctggaaagagctctctgttgtccgctatacttgaggagatgcacttgctggaagggtctgttggtgtgcaagggagtctggcgtacgtccctcagcaggcctggattgtgtccggcaacatccgggaaaacattctgatggggggtgcctacgacaaggcacgatatctccaggtgctgcattgctgtagtttgaaccgggatttagagctgctcccatttggcgacatgaccgaaatcggcgagcgtggccttaatctgtccggtggtcagaagcagcgaatcagcttggcacgggctgtttattctgatcgacaaatatatcttctggacgaccctctgtcggcagttgacgctcatgttggaaagcatattttcgaagaatgtatcaaaaagacccttcgcggaaagaccgtggttctcgtgacccaccagcttcagtacctggagttctgtgggcagatcattttgttggagaacgggaaaatatgtgaaaatgggacccattccgagctcatgcaaaaaaaaggtaaatacgcccagctgattcagaaaatgcataaggaagctaccagctgccgatctatttccagccatcgtaggaggcggtggaagaaggccccatag

SEQ ID NO: 215402 - DNA, 4080 bp, Artificial Sequence
  Description of Artificial Sequence: Synthetic coding sequence
atggttggtgaaggaccctaccttatttcagatctcgatcagagagggcgaagaaggagcttcgcagaacgttatgatccgtcgttaaagaccatgatccccgtgaggccatgtgctaggctagcccctaaccccgtcgacgacgccggattgctctcttttgccacattttcctggctaacacctgttatggtcaagggttacagacagcgcttaaccgtagatacactgccaccactgagcacttatgactcctcagacactaatgccaagaggtttcgggtgctctgggacgaggaagtggcgagagtgggtccagagaaggcatccctgtctcatgtagtgtggaaatttcaaaggactcgcgtgcttatggatatagtggccaacatactgtgcattataatggccgctatcggcccagttatattaatccatcagattttacaacagacagaaaggacatctggaaaggtgtgggtaggaatcggcctttgtattgctctgtttgcgactgagtttaccaaggtctttttctgggccctggcctgggcaattaactacagaaccgcaatccgactgaaggtggcattgtctacacttgtgttcgagaacctggtcagtttcaagacactcacccacattagcgtgggggaggtgctgaacatcttaagcagtgactcatattcgctatttgaggcagccctcttctgccctctgccagctacaattcccatacttatggtattttgcgccgcatatgcctttttcattctcggacctactgccttgattggcatcagcgtatacgttatttttataccagtgcaaatgtttatggcgaagctaaacagcgccttcagacggagcgcaatcctggtgacagacaagcgggtacagacaatgaatgaattcctcacctgcatccgactgattaaaatgtatgcctgggaaaaaagcttcaccaacacaatccaggacattagaagaagagagagaaagctccttgagaaggccggattcgttcagtctggtaactccgcactggctccgatcgtttcaacaatagctatagtccttactttgtcatgccatatcctccttcgcaggaagcttacagcaccagtggccttttctgtcattgccatgtttaacgtaatgaagttttccatagcgatcctgccattctctattaaagcgatggcggaggccaacgtgagcctgcggaggatgaaaaagatcttgattgataaatcaccaccttcgtacattacccaaccggaggatccggataccgttctgctgctcgccaatgcaaccttgacgtgggagcacgaggcatcccggaaaagtacacccaaaaaactccaaaaccaaaagcggcacctctgcaaaaaacagagaagtgaagcttattcagagcgaagccctccagccaagggagccactggcccagaggagcaatccgattcactgaagagtgtgcttcacagcatctctttcgtggttaggaaaggaaagatcctgggaatttgtgggaatgttggctctggaaagagctccttgctggccgctcttttaggccagatgcagcttcagaagggagtggtggctgtgaacggcacactggcatatgttagtcagcaggcttggatattccacgggaatgtgagggaaaacattctgtttggcgagaaatatgatcaccagcggtaccagcacacggtccgggtatgcggtcttcagaaagaccttagcaacctcccatacggtgatctgacggagatcggtgaacgcggactaaacctgagtgggggtcagaggcagaggattagcctagcaagagctgtttacagcgatagacagttgtacctgctggatgatcccctgagtgccgtagacgcacacgtgggcaagcatgtctttgaagagtgcataaagaagaccttgagggggaagaccgtggtactggtaactcatcagttgcagttcttagaatcatgtgacgaggtgatactcctggaggacggtgagatatgtgagaaaggcactcataaggaactgatggaggagcgaggacggtacgcgaagttgatccataacctgcggggactgcagtttaaggatcccgaacacctgtataatgccgcaatggtcgaagcattcaaagagagccctgctgagcgcgaggaagacgctggaatcattgtgttggctcccggaaacgaaaaagacgagggtaaggaatctgaaactgggagtgagtttgtcgacacgaaagtccctgagcaccagctgatacagaccgaaagcccccaggagggcacagtcacctggaaaacttaccatacgtacatcaaagctagtggaggctatctgctctcattgttcaccgtgttcttgtttttactcatgatcggaagcgctgcattctcaaattggtggctgggcctgtggctggacaaaggaagccggatgacatgcggacctcaaggcaatcgtaccatgtgtgaagtgggtgccgtgttggcagacattggccagcatgtctaccagtgggtctacactgcatctatggtgttcatgctcgtctttggggtcacaaaagggtttgtatttacaaaaaccaccctgatggctagcagcagccttcatgatacggtcttcgataaaatactgaagagtccgatgtcattcttcgacactacccctaccggtcgactcatgaaccggttcagtaaagatatggatgagctcgatgtaagattgccctttcatgcggagaacttcctgcagcagttttttatggtggtgttcattctggtaatccttgctgctgtgttcccggctgttctgttagtggtggcatcgcttgctgtaggcttcttcatcctgttgcgaatctttcataggggtgttcaggagttaaagaaggtggaaaacgtgtccagatccccgtggttcacgcatattacttccagtatgcaggggctgggaattattcacgcctacggtaaaaaggagtcctgtattacatatcacctgctctattttaactgcgccctgcgctggttcgcactgcgaatggacgttctcatgaatatcctgaccttcaccgtggctttactggttacactgtcattcagcagcatttccacaagctccaagggattatcactgagttatatcattcagctgtccggcctcctgcaggtatgtgtcagaaccggcacagaaactcaagctaagtttacgagtgtggaactgttgagagagtacatttctacatgtgtaccagagtgtactcaccccctcaaagttggaacatgccccaaagattggccgagtcgtggtgaaataacatttcgggactaccaaatgagatacagggataatacccccctcgttctggattctctgaacctgaacattcaatccgggcagacagttgggattgtaggtaggactgggagcggcaagagcagcctcggcatggcactgtttcgactcgttgaaccagctagcggcaccatctttattgacgaggtcgatatctgcatactcagtctagaggatctgcgcaccaaactgacagtgattccgcaggaccccgtgttgtttgtgggcacggtccgttataacttggacccattcgagtcccacacggatgaaatgctctggcaagtcttagaacgcacattcatgcgcgacacgatcatgaagctcccagaaaaattgcaggcggaggttacggagaacggtgagaattttagcgtgggtgagagacagttgctctgtgtggctagggcactgctgcgcaactccaagataatactactggacgaggctacagcgtccatggacagcaagacggatacactcgtgcaaaacacaatcaaggacgcattcaaagggtgcaccgtgctgactattgcccatagactaaacacagtgcttaattgcgatcatgtcctggttatggaaaatgggaaagttatcgagtttgataagccagaagttttggctgagaaaccagacagcgctttcgccatgctcctcgccgctgaagtgcggctttag

SEQ ID NO: 215403 - DNA, 1902 bp, Artificial Sequence
  Description of Artificial Sequence: Synthetic coding sequence
atggtgggtgaggggccttatctgatttccgatctcgaccagaggggtcgcaggaggtcctttgccgaacggtacgaccccagcctgaagactatgatccctgttagaccctgcgccaggctggccccaaatccggtggatgacgccggactgctatcctttgccaccttctcatggctgaccccggtcatggtcaaaggataccggcagagattgacggtggacaccctgccgcctcttagtacctacgacagctccgacacgaacgctaagcgatttagagtactttgggatgaagaggttgccagagtgggacccgaaaaagcctcactgtcacacgtggtctggaagttccagagaacccgcgtactgatggatattgtggccaatattctgtgtatcatcatggccgctataggccctaccgtgctgatccatcagattctacagcagacagaacggacgtctggaaaggtgtgggtgggtattgggctctgtatagctctatttgcaacagagttcaccaaggttttcttttgggccctcgcatgggcgattaactaccgaacagcaattcgattaaaggttgccctatctacactcgtgtttgagaaccttgtatctttcaagactctgacacacatcagtgtcggagaagtcttaaatattttaagctcagattcctattcactttttgaggctgcactgttctgcccattgccagcgacaattccaatactgatggtgttttgcgcagcctacgctttctttatcctgggtccgactgccctaatcgggatctccgtgtacgtcatctttatcccagtgcagatgtttatggccaaactgaatagcgcgtttcggcgatcagctatactggtgactgataaaagggtccagactatgaacgagttcctgacttgtattcggctgatcaaaatgtatgcatgggagaaaagctttactaacaccatccaagatataagacggagagaaaggaagctgctggagaaggccggattcgttcagagtggaaacagcgctctcgcccctatcgttagcactatagccatcgtgctgaccctgtcctgccacattctactcagacgcaaactgacagcccctgtggctttcagcgtgatagcaatgttcaacgtgatgaaattttctatcgcaattctaccattcagcattaaagccatggcagaggccaacgttagtctccgtcgcatgaagaaaatcctgatcgacaaaagccctccatcttacatcactcagccggaagacccagatactgtcctgctcctagctaacgcaaccttgacctgggaacacgaagcatcacggaaatcaacaccgaaaaaactgcagaatcaaaagaggcacctctgcaagaagcagcggagcgaggcatatagcgagcgatcccctccggctaagggagcaacaggcccagaagaacagtctgatagcctgaagagcgtgctgcactctatctcttttgtggtgagaaaaggaaaaatcttggggatatgtggaaatgtaggaagtgggaagtcatctcttctagccgctctgctcggccagatgcagctccaaaaaggcgtggtcgctgtcaacggcacactggcctatgtgagccaacaggcatggatcttccatggcaacgtgcgagaaaatatcctctttggagaaaaatacgatcaccagcggctgggctcaggcgcttctacgtccctcggcggaaggggtcggggactggcgtggcccgcactatctacccccactgtttcgtcaacgtgttggactaccccatgtagaccttggactccaacttggggctccacaagcctccgctccgcgttaaggaggagaagtggagagcggcagagcagctggtag

SEQ ID NO: 215404 - DNA, 2808 bp, Artificial Sequence
  Description of Artificial Sequence: Synthetic coding sequence
atggtcggcgaggggccttatcttatctctgatttagaccaacggggtcggagacgcagctttgccgaacgctatgaccccagcctgaaaaccatgataccagtgaggccttgcgctcgcttggccccaaaccctgtagatgatgccggtttgctgtcatttgctacattctcctggttaacgccggtgatggtaaagggctaccgtcagaggctgaccgttgacacgctgccccctctatccacatacgactcttcagatacaaatgctaaaagattccgagttttgtgggatgaagaggtggcaagagtcgggccagagaaagcctccctgtcccacgtcgtttggaagtttcagcggacaagggttcttatggacatagtcgccaatatcctctgcatcatcatggctgcaattggaccaaccgtattgatccaccaaatactccaacaaaccgagagaaccagcggaaaggtgtgggtaggaatcggcctgtgcatagccctatttgccaccgagttcaccaaggtgtttttttgggcactggcctgggcaattaattacaggaccgcaattcggcttaaggtggccttatctacactcgtcttcgagaacctggtcagcttcaagaccctgactcatatctccgtgggcgaggtgctgaacatcctgagttccgactcttacagtctcttcgaagccgctctgttttgccctttgccggctacaataccaattctcatggtgttctgcgccgcttatgcgtttttcatccttggacctacggcacttatcggtatttctgtctacgtgattttcatccccgttcagatgttcatggctaagctcaacagcgctttcaggcggtcagccattcttgtgactgacaaaagagttcagactatgaacgagttcttgacctgtattcgactcatcaaaatgtacgcgtgggagaagagcttcacgaatactatccaggacatccggagacgtgagcgcaagctgcttgaaaaagctggatttgtgcagtccggtaactcagcgctcgcccctattgtgtctaccatcgccatcgtccttaccctctcatgtcatatactacttcgaaggaagttgaccgccccagttgcattctccgtcatagcaatgtttaatgtaatgaaattctccattgccattctacccttctctattaaagccatggccgaggctaacgtgtctctgcgtcgaatgaagaagatcctgattgacaaaagcccccctagctacatcactcagccagaggatcctgatacagtcctgttgctggccaatgcaaccctgacatgggagcacgaggccagccggaagtctacccccaagaagcttcagaatcagaagcgacatctgtgtaagaagcagcgatccgaggcctactctgaacggagccctcctgctaagggagcgactggcccagaagaacaatccgattctcttaagagcgtcctgcatagcatctcgtttgtggtcagaaaaggcaaaatcctgggcatctgtggcaacgttggcagtggcaaaagctcgttgctcgccgctctcctggggcagatgcagttgcaaaagggcgtcgtagctgtgaatggtaccctggcatatgtgtcccagcaagcttggatattccatggaaatgtacgagaaaacattctgttcggggaaaagtatgatcaccagcgctatcagcacacagtgagagtttgcggtctgcagaaggacctgagcaatcttccatacggcgatctcactgagattggcgaacgcggactcaatctgagtggaggacaacgccaacgcatcagtctggccagggctgtgtattccgatcgtcagctatatcttttagatgacccacttagcgcagttgatgcacatgtcggaaaacacgtgtttgaagagtgcattaagaaaaccctgcgaggaaaaaccgtggtgctggtgacacatcaattgcaattcttggaaagttgtgatgaagtgatactactcgaagatggtgaaatctgtgaaaagggaacccacaaggagttaatggaggaaagagggagatatgccaagctcattcataatctgcggggacttcagttcaaggatcccgagcacttgtacaacgcagctatggttgaggcttttaaagaatcaccggctgaaagggaggaggacgctgtactggcccctggaaacgagaaggatgaagggaaggaatctgaaacaggctccgaattcgttgacactaaggtccctgaacaccagttaatccagacggagagtcctcaagagggaaccgtcacctggaaaacttaccacacatacattaaagccagcggtggatacctcctgtccttgttcacagtgttcctatttctcctgatgataggtagcgcagccttctccaattggtggctgggactctggctggataaagggtcacgcatgacctgcggtcctcaggggaatcggactatgtgcgaagtgggcgcagtgcttgccgatattggacagcacgtgtaccagtgggtgtatactgcatccatggtattcatgcttgtgttcggcgtgacaaaggggttcgtgtttacaaagaccaccctgatggcatcctcctcgttgcatgatactgtctttgacaaacactttccacagaggagtcctggcgcacaggaaggaggagagtgtcagcctgtaactctggtgcatcctcaccacctgctgcacgccggaccgggacatcactccaggctatggcaggagggggaactgcatcacctcgtatag

SEQ ID NO: 215405 - DNA, 2793 bp, Artificial Sequence
  Description of Artificial Sequence: Synthetic coding sequence
atggtgggcgaaggcccatatctgatcagcgacctggaccagcgcggacggagacgctcctttgctgagcgctatgatcccagcctgaagacgatgattcccgtcaggccatgtgccaggttggcaccaaaccctgtggatgacgctggactgctctcctttgccaccttctcctggctgacccctgtaatggtcaagggatacagacagcgcctcactgtggataccctgccaccactcagcacatatgattcgagcgataccaacgccaagaggttccgagtcctatgggatgaagaggtcgctagggtgggacctgagaaggcttccctgagccatgtggtgtggaagtttcagcgtacacgagtcctgatggacatcgtggccaatatactgtgcataatcatggcggctatcggacccaccgttctgattcaccaaatcctgcagcagacagagaggactagcggcaaggtatgggtcgggattgggctatgcatcgccctgttcgcaaccgagtttactaaagtcttcttctgggcccttgcgtgggctattaactatcgaactgcaattagattgaaagttgcactcagtacactggtttttgagaacttggtgtcattcaagacactcactcacatttctgtgggagaaatgttcatggccaaactcaacagcgcttttcgaagatccgcgatcctcgtgacagataagcgcgttcaaacaatgaatgagtttctcacttgcatcaggctgattaaaatgtacgcctgggaaaagagctttacaaacaccatccaggatattcgcaggagagaaagaaagttgttagagaaggccggatttgttcagagtggcaattctgcactggctcctattgtgtccactatcgctatcgtgctgacactcagttgccacattctactgcggcgtaaactgaccgctccagtcgctttcagcgtcatcgcaatgtttaacgtcatgaaattttccatcgctattctccccttctcaatcaaggccatggctgaggccaatgtctctctccgcaggatgaagaagatactgatagataaaagcccaccttcgtacatcactcagccagaggatcctgacaccgttctgctgctggccaacgccacacttacatgggagcatgaagcaagtaggaaaagcaccccgaaaaagctgcagaaccagaagaggcacctctgtaaaaaacagcgttcagaagcatacagcgaaaggtcccccccagcaaaaggagctactgggcctgaggaacagagcgactcactgaagagcgtcctgcacagcatctcattcgtggtaaggaagggtaaaatactggggatttgcggaaatgtcggaagcggcaagagcagcctgctggccgctcttttgggccagatgcaactacaaaaaggagtcgtagcagttaacggtacactcgcttatgtctcacagcaggcctggatctttcacggcaacgttcgcgaaaatatcctctttggcgaaaagtacgatcaccagagataccagcacacagttcgagtgtgtgggttgcagaaggacctttccaacctgccctatggcgaccttacggaaatcggagaaaggggcctgaacttgtcaggtgggcaaagacagcgaatatcgctggctcgcgctgtctactcagatagacagctttatctgctggacgatccattaagcgcagtagatgctcacgttggcaaacacgtatttgaggaatgtatcaagaagaccctgcggggaaagacggtagtactggttacacaccagttacagtttctcgagtcatgcgacgaggtgatcttattggaagatggcgaaatctgcgaaaagggaacccacaaggagctaatggaggagcgaggcaggtacgctaagctgattcataacctcagggggctacagttcaaagatcccgaacacctgtacaatgctgccatggttgaagctttcaaagaatcaccggctgagcgcgaagaagacgctgggatcattgtgccagagcatcagctcattcagacggagtccccccaagaggggaccgtgacttggaaaacctaccacacctatatcaaagcgagtggcggatatctgctgtccctgtttacggtgttcctgttccttctgatgattgggtccgccgcattttctaactggtggttggggctctggctcgacaaggggtccaggatgacctgcggcccacaaggcaatcgaactatgtgtgaagtgggagctgtacttgccgatattggacaacatgtttaccaatgggtgtacacggcttcgatggtgttcatgttagtctttggagtgactaaaggcttcgtttttaccaaaaccacgttaatggcgtcctcttcactgcatgacaccgttttcgacaagatcctgaagtccccaatgagcttctttgataccaccccaacgggcagactgatgaatagattctctaaagacatggacgagttggatgtgcgcttaccattccacgccgaaaactttctgcagcagttcttcatggtggtttttatcctggtgattctggcagcggtcttccctgctgtgttactggtggtcgccagtctcgctgtggggttctttatacttctgaggatttttcaccgtggagtgcaggagcttaaaaaagtcgaaaatgtcagccgatctccctggtttacccacatcacttcaagcatgcagggccttggtattatacacgcctatggtaaaaaggagtcttgcatcacctag

SEQ ID NO: 215406 - DNA, 321 bp, Artificial Sequence
  Description of Artificial Sequence: Synthetic coding sequence
atggtgggggaggggccttacctcatcagcgacttagaccagaggggcagaagacgatcgtttgccgagagatatgatccgagcctgaagactatgatcccagtgaggccatgcgcacgcttggcccctaatcccgtggacgatgcagggttacttagctttgccaccttttcttggctgactcccgtcatggtcaaaggatataggcaaaggctcaccgtggataccttaccgccactctctacatatgactcttccgatacgaacgccaagaggttcagagtgctttgggatgaggaggtggcacgggtgggtccctag

SEQ ID NO: 215407 - DNA, 858 bp, Artificial Sequence
  Description of Artificial Sequence: Synthetic coding sequence
atggtgggggagggaccttacctcatttcagacctggatcagagaggaagaaggagaagttttgcagagcgctacgatccatcattgaaaaccatgattcccgttcgcccatgtgctcgtctggcccctaatcccgtcgacgatgctggtctgctgagtttcgccacatttagctggcttaccccagtgatggtcaaggggtaccgacagagactgaccgtggataccttaccacccctttcgacatatgattcctcagacacaaatgccaaaagatttcgggttctctgggatgaagaggtcgcccgagtcgggcctgagaaggcttcactttctcacgtggtctggaaattccagaggactagagtgttgatggatatcgtggccaacattctttgtatcattatggctgcgatcgggcctactgttttaatccaccagatcctacaacaaaccgaaagaacatcaggcaaggtttgggtgggaatcggcctctgcatagctttatttgcaaccgagttcacaaaggtcttcttctgggctttggcctgggctatcaactacagaaccgccatccgcctcaaggtagctctgtctaccttagtgttcgagaatctcgtctccttcaaaactctcacccatatctctgtgggtgaagtgttgaatatactgtcgtcagattcttattctctcttcgaggcagccctgttctgcccgctgccggctacgatccccatactgatggtcttctgtgccgcatacgccttcttcattcttggacctaccgctctgattgggatcagtgtgtgtttgtggccaagcagcatacagttaagtgaggggcagcagttttggtag

SEQ ID NO: 215408 - DNA, 882 bp, Artificial Sequence
  Description of Artificial Sequence: Synthetic coding sequence
atgctggagaagttttgcaatagtaccttttggaacagctcatttttagattcccctgaggctgatctgcccttgtgcttcgaacagactgtgctggtgtggattcccctgggatacttatggctgctcgctccctggcagctgctgcatgtgtacaaatcccgaaccaaaaggtctagtaccaccaaactataccttgctaagcaggtgtttgtgggattcctactgattctggcagccattgagctggctctggtcctgacagaggacagcggtcaggccacggtccctgcagtcagatatacaaatccttccctctatcttgggacctggctgttggtacttctgatccaatattcaaggcagtggtgtgtgcagaaaaacagctggtttctgtcattattctggatcctgagcattctgtgtgggacattccagtttcagacgctgattcgcacattgctccagggtgataactccaatctggcgtactcctgtctgtttttcatctcctatggcttccaaatcttgattctgatattttccgccttcagtgagaataatgagagtagcaataacccctcctctatcgcctcttttctgtcctcaattacctatagctggtacgattctattatcctgaagggatataaacgtccgcttacacttgaggatgtctgggaggtggatgaggagatgaagaccaaaactctggtttcaaagttcgagacgcatatgaaaagagagttgcaaaaggcaaggcgtgccctgcagagaaggcaggaaaaatcatctcagcagaatagcggagctcgcttaccaggactgaacaaaaatcagtcccaatctcaggacgcgctagtgctggtgaccttcccgtag

SEQ ID NO: 215409 - DNA, 4638 bp, Artificial Sequence
  Description of Artificial Sequence: Synthetic coding sequence
atgttggagaaattttgcaactcaactttttggaattcctctttccttgacagtccagaagctgacttaccactctgctttgagcagaccgtcctggtctggattcctctcggttacctctggctgctcgcaccatggcagctcctccatgtgtataaatcacgcactaagcgctccagtactaccaagctatacttagcaaaacaggtctttgtggggtttctgctgatcctggcagcaattgagctggctctggtgcttactgaggactccggtcaagcaaccgtgcccgcagttcgttacaccaatccctcattgtatctcgggacatggctccttgtgctgctcattcagtacagccgccagtggtgcgtccaaaagaacagctggttcctcagtctgttttggatcctgtccatcctgtgtggtacatttcagttccagaccctgatccgcacactgctacagggtgataactctaacctggcatactcttgcctcttttttatttcctacggattccagatcttaattttgatcttctccgccttctctgaaaacaacgagtcctcgaacaacccctcttccattgctagttttctgagttctattacctacagctggtatgactccatcatccttaagggatacaaacgacctcttactttggaagatgtgtgggaggtggacgaagagatgaagacaaaaacattagtctccaagttcgagactcacatgaagagagagctccagaaggccaggcgcgcactccagcgaaggcaggaaaagagctctcagcagaattcaggagccagactgccaggccttaacaagaatcaaagccagagccaggacgccctggtcctggaagatgtggaaaagaagaaaaagaaaagtggcaccaaaaaagacgttcctaaatcttggctgatgaaggcattgttcaaaacattttatatggtacttctgaaatcatttttgcttaaattagtaaacgacatattcactttcgtgtcccctcagttgctgaaactcctgattagtttcgcgtccgaccgggacacatacctttggatcggctacctatgcgcaatcctgttattcaccgctgctctcatacagtccttttgtttgcaatgttatttccaactttgtttcaagctcggcgttaaggtgagaacagccattatggcctccgtatacaaaaaagcattgaccctttccaacctggccagaaaggaatacacagtaggggaaactgtgaatctgatgagtgttgatgcccagaagctaatggatgttaccaacttcatgcatatgttatggtctagcgttttacagatagtactgagtattttttttctctggagggagctcggtccctcagtgttagcaggtgtcggtgtgatggttttggttatccctattaacgcaatactgagcaccaagtcgaagaccattcaggtgaagaatatgaaaaacaaggataagaggctgaagatcatgaatgaaatactgagtgggattaagatcttgaagtatttcgcatgggaaccatcatttcgagatcaagtccagaacctacgcaagaaagaactaaaaaacctcctggctttctcacaactacagtgtgtggtaatatttgtgttccaactaactcccgtgcttgttagcgtagttacattctctgtctatgtcttggtggactccaacaacatccttgatgcccagaaagcattcacctctattacattgttcaatatcctcagattcccgttgtccatgttacctatgatgatttcttcaatgctgcaggccagcgtttctaccgaaaggctggaaaagtatctggggggagatgatcttgatactagtgccattagacatgattgcaactttgacaaggctatgcaattctccgaggcgagcttcacctgggaacatgactctgaagccacagtcagagatgttaacttggacattatggccggtcagctggttgctgttatcggcccagttggatccgggaagtcatcactgatcagcgctatgctgggcgaaatggagaacgttcacgggcacatcacaattaaggggacaaccgcctacgttccccagcagtcatggatccagaacggtaccattaaggataacattttatttggtacggagttcaatgaaaagcgatatcagcaggtgctggaagcgtgtgctctgctgccggacctagagatgcttccaggcggagatctggctgagatcggtgagaaaggcatcaacctgagtggcggtcaaaagcagaggattagcctcgctcgcgctacataccaaaacctagacatttatctactggacgacccgctgtctgccgttgacgcccatgtcggaaagcacatcttcaataaggtcctcggccctaacgggctgcttaagggcaaaactaggctgctggttactcactctatgcactttttgccacaggtggatgaaatcgtggtgcttggcaacggcacaatcgtcgaaaaagggtcttattccgcacttcttgcaaagaagggagaatttgcgaaaaatctgaaaacgttcctgcgacacactggccctgaggaagaagctactgtccatgacggatcagaagaggaggatgatgattacgggctgatcagctcagtggaagaaatcccagaagatgcggctagtattacaatgcggagagaaaattctttcagacggacattgtctcgctcctcccgcagcaatggcagacacctcaaatccttacggaatagccttaagacgcgcaacgtgaatagtctaaaggaagatgaggaactcgtaaaggggcaaaagctaataaagaaagaatttatcgagacagggaaagtgaaattttctatctacctggagtaccttcaggccataggactgttctcaattttcttcatcattttagccttcgtgatgaattctgtggcgtttattggctctaatctgtggttaagcgcctggacttctgacagtaaaatattcaatagcaccgactaccccgcatcacaaagagatatgagagttggagtttatggagccctaggcctcgctcagggaatattcgtcttcatcgcccacttctggtcagccttcgggtttgtccacgcctccaatattctccacaagcagctgctgaataatatcctgagagcgcctatgcgattttttgataccacaccaacaggacggattgtcaacaggtttgcaggagacatatcaacggtagatgacacgctgccacagtcgcttagatcttggattacatgcttccttggcattataagcacactggtgatgatatgcatggccacccctgtgtttacaattattgttattccgttgggcatcatctacgtgtcagtacagatgttctacgtctcaaccagccgtcagttgagacgacttgattctgtcaccagatcacctatatacagccacttctctgagacagtgtcaggcctgccagtgattagagccttcgagcatcagcaacggttcctaaaacataatgaggtccggatagacactaatcagaaatgtgtgttttcatggattacctcaaacagatggctggccatccggctggaactggttggcaatctgaccgtgttctttagcgcactgatgatggtgatttaccgggacacccttagtggggacacagtgggtttcgttttatctaacgcgctgaatataacacaaacactcaattggctggttagaatgacatcggaaatcgagaccaatattgtggctgtggagagaattacagaatacacaaaagttgagaacgaggctccttgggtaacagacaaaaggccccctcccgattggcccagtaagggcaaaatccagtttaataactatcaggtgaggtataggcccgaactagacttggttctgaggggcatcacatgcgatattgggtccatggagaagatcggcgtcgttggcaggaccggtgccggtaaatctagccttaccaactgcctatttcgcatacttgaagcggctgggggtcagattatcatcgacggagtcgacatcgccagtattgggctacacgacctgcgagaaaagctgaccatcatcccacaggacccaattttgttcagcgggtccctgcgcatgaatttggacccgtttaacaactactcagacgaagagatctggaaggcgctagagctcgctcacttaaagagctttgtcgcctcacttcaattgggactctcccatgaggtaacggaggcgggtggaaacttgtctatcggacagaggcagttgctgtgcctagggagggcacttctgaggaagtctaagattctcgtgcttgacgaggctacagccgctgtggacctggagaccgataacctcatccagaccactatccagaatgagttcgcccattgcacagtgataactatcgctcataggttgcacaccatcatggattccgacaaggtgatggtgctggacaacggaaagattatagagtgcggtagtccagaagaactgctgcagatccctggccctttctactttatggccaaagaggcgggtattgagaatgtgaactccacaaagttctag

SEQ ID NO: 215410 - DNA, 4584 bp, Artificial Sequence
  Description of Artificial Sequence: Synthetic coding sequence
atggatgctctttgtggttctggggagctcgggtccaagttctgggattccaacctctccgtgcatacggagaatccagacttgaccccttgttttcagaactcgttactggcgtgggtcccatgcatttacctctgggtcgcgctcccctgctatctcctgtacttaaggcaccactgtcggggttacattattctctctcacctcagtaaactaaaaatggtccttggagtattgttgtggtgcgtaagttgggctgatttattctacagtttccacggactggttcacggcagagcacccgctcccgtgttctttgttactcccctggtggtcggcgtcaccatgttactggccaccctccttatccaatatgagcggcttcagggtgtgcagtcatcaggcgtgcttataatcttctggttcttgtgcgtcgtctgtgctatcgtgcctttcagaagcaagatcctgttagccaaggccgagggggagattagcgacccattcagattcactacattttacatccatttcgcgctcgttctctcagcgctgattctggcctgtttccgcgaaaagccacccttcttcagtgctaagaacgtcgatcccaatccttacccagaaacttcagcaggattcttgtcgcggctttttttctggtggtttacgaagatggccatctatggctatcggcatccgcttgaggaaaaggatctgtggtcccttaaggaagaagacaggtcgcaaatggtcgtccaacagctcttagaggcttggcgcaagcaggaaaagcaaaccgcacgccacaaagctagcgccgctccaggaaaaaacgctagtggagaggatgaagtgctgcttggcgcacgcccacgaccccgaaagccaagtttcctgaaggctctacttgcaacgttcggaagctccttcctcatatctgcctgctttaaattaatccaggaccttttatcgtttattaatcctcagctgttaagcatactgatcagatttatcagcaatcccatggcgccttcgtggtggggattcctggtggcgggactgatgttcctgtgttcaatgatgcaatctcttatcctccagcactactatcattacatatttgtgactggcgtgaaatttcggacaggtattatgggtgttatctatcggaaggcactggtgataactaacagcgtgaaacgtgccagcaccgttggggagattgtcaacctgatgtccgtggatgcccagcggtttatggacctggcaccctttctgaacctgctatggagcgcaccactacagatcattctagcaatctactttctgtggcagaatctgggaccatctgtcctcgctggggtggcatttatggtgttgctgattccactcaacggggcagtggcggtcaagatgagagcatttcaggttaagcagatgaaactgaaggatagccgcattaagctcatgtccgaaatccttaacggcatcaaagtcctgaaactatacgcatgggagccctcctttctgaaacaagtagagggaatccggcagggagagctccagctgctgagaacagctgcctacctgcataccacaaccacgtttacatggatgtgtagccctttcttagtcacccttataactttatgggtgtacgtctatgtggatcccaacaatgtcttggatgctgaaaaagcatttgtgtcggtgtctttgtttaacatcttgcgactccccctgaatatgctgcctcagctgataagtaaccttactcaagcctccgtcagcctcaaacggatacaacagttcctgagccaagaagagctggacccacaaagtgtggaacgcaaaaccatcagtcctggatatgccatcaccatccactctgggaccttcacatgggctcaggacctcccaccaacactgcatagcctcgatatccaggtgccaaaaggcgcacttgttgcagtagtcgggccagtggggtgcgggaaatcaagtctggtgtcagctcttctgggggagatggagaaactcgagggcaaggtgcacatgaaaggttctgtagcctatgtgccccagcaggcatggatacagaattgtacattgcaggagaatgtgctttttggcaaggccctcaacccaaagcgataccagcagactcttgaggcctgtgcactgctggccgatctcgaaatgctgccaggcggagatcagactgagattggtgagaaaggtattaatttatctggcggtcagagacagagagtcagtctcgcgagagccgtgtattcagacgctgatatatttctccttgatgatccgttatcggcagtggattcccacgtcgccaaacatatctttgaccacgttatcggaccggaaggcgtgctggccggaaaaacccgagtcttggtaacgcatggaatctcctttcttccacagactgacttcatcattgtcctcgcagatggacaggtttccgaaatggggccatatccggctctgctgcagagaaatggatccttcgctaacttcctgtgtaactatgcacctgatgaggatcagggccatctagaggatagctggactgctttagagggcgcagaggacaaagaagcactgttgatcgaagatacccttagtaaccatacagacctcactgataacgatcctgtgacatatgtcgttcaaaaacagtttatgcgtcagctcagcgcactgtcatccgacggcgaaggccaaggcagaccagtccccagaaggcatctgggccctagcgagaaagttcaggtgactgaggcaaaggccgacggagctctgacccaggaagagaaagctgctatcggtactgtggagctttcagtgttttgggactacgccaaggcagtggggctttgcacaaccctggccatctgtttgctgtacgtcggacagtctgcagcagccatcggcgcaaatgtgtggctaagtgcctggactaatgacgccatggccgatagccgacagaacaatacaagcctgaggctgggcgtgtacgctgctctaggcattctgcaaggatttcttgtgatgctcgctgccatggccatggccgcaggaggtattcaggcagcccgtgtgctacatcaggccctgctgcataataagattcgttctccccagtcatttttcgataccactccatcagggaggattctaaattgtttctctaaggatatatatgtggttgacgaagtcctcgcgcctgtgattctgatgctgctaaatagcttttttaatgctatctcaaccctggtcgtgattatggcctcaacccctctgtttacggttgtaattctgcccttagcggtcctgtatacccttgtccaaagattttatgcagcaaccagtaggcaattaaagcgcctggagtccgtcagtcgctcccccatatattcccacttctctgagactgtgacaggggcaagcgtgatcagggcttataaccggagtcgggactttgagatcatctccgacacaaaggtggacgctaatcaacgctcctgctacccctatattatcagcaatcgatggcttagtatcggcgtggaattcgtcgggaactgtgtggtgctctttgcagccttgttcgctgtgataggaaggtcctcccttaatccaggcctggttggactgagcgtcagctattccctgcaggtgactttcgccctaaattggatgataagaatgatgagcgatctcgagagtaacattgttgctgtcgagagagtcaaagaatattccaaaactgaaacggaggccccttgggtagtggagggctccaggcctcctgagggctggcctccccgtggggaagtagagtttagaaattattccgtcagataccgccctggactggacctcgtgctacgcgatttatctctgcatgtgcacgggggagaaaaggttggaatagttggtagaactggggctggaaagtccagcatgacactgtgtctgtttcgaatattggaggccgctaagggggaaattcggatagatggactgaatgtcgcagacatcggccttcacgacctgaggtcccaactgactattatcccccaagatcccatactcttttctggcacgttgagaatgaatctcgacccatttgggtcgtactccgaggaggacatctggtgggccctggagttatcacacctgcatacatttgtctcaagtcaacctgcaggattggatttccaatgcagcgaagggggagaaaatctgagtgtcggacagaggcagctggtttgcctggctcgcgcactgttgcgaaagtcccgtattttggtgctggacgaggctaccgcagcgattgatctggagactgacaatttaattcaggctacaattagaacccagttcgacacatgtaccgtcctaaccatcgcccaccgcctcaatacaatcatggattatacaagagttcttgtcctggataagggagttgtggcagagtttgacagccccgcaaaccttatcgccgcaaggggtattttctatggaatggctcgagacgcgggactggcatag

SEQ ID NO: 215411 - DNA, 1719 bp, Artificial Sequence
  Description of Artificial Sequence: Synthetic coding sequence
atggacgcactttgtgggagtggcgaattaggctcaaagttctgggatagcaatctttcagtccatactgagaacccagatctcacaccctgtttccaaaattctctccttgcctgggttccttgtatatacctttgggtggctctgccatgctatttgctttaccttcgtcatcactgtcggggttacatcatcctcagtcacctgagcaagcttaagatggtgctgggcgtgctgctctggtgcgtgagctgggctgatctgttttactccttccatgggttggttcacggtagggcccctgcgcctgtcttctttgtgaccccactagtcgtgggagtgacaatgcttctcgccaccctgctgattcagtatgagcgtctgcagggtgtgcagagcagtggagtcttgatcattttctggttcctgtgtgtggtttgtgcaatcgtaccattccggagcaagatcctgttagctaaagctgaaggagaaatttcagatcctttccgctttactaccttctatatacatttcgcactcgtactcagtgctctgattttagcatgctttagggagaagcccccattcttttctgcaaagaacgtcgaccctaacccataccctgaaacaagtgcaggatttctctctcgcttgtttttctggtggttcacaaaaatggcaatctatggatacaggcatccactggaagagaaagacctgtggtcgctgaaagaagaggacaggagccagatggtggtacagcaactgttggaagcatggcggaagcaagagaagcagaccgcccgacacaaggcttccgcagccccagggaagaacgcaagcggagaggacgaagtcctcctgggggctaggccacggcctcgcaagccttccttccttaaggccctgctggcaacctttggcagctccttcctaatctcagcatgcttcaagctcattcaggatctcctgagtttcataaacccccagcttttaagcatattgatccggttcatttcgaatcccatggccccttcctggtggggttttcttgtcgcaggactcatgtttctttgctcaatgatgcagagcctgatcctccagcactactaccactatatttttgtcactggggtgaagttccgcacgggcattatgggtgttatttaccgcaaggccctggtcatcaccaactctgtgaaaagggccagcaccgtcggagagatcgtcaaccttatgtcagtcgacgcccaacgcttcatggacttagccccattcttaaacctattatggagtgctcccttacagatcatactggcaatatacttcctgtggcagaatctagggcctagcgtcctggccggagtcgcattcatggtgttgctgattccattgaatggagctgttgcagtgaaaatgcgggcatttcaggtcaaacagatgaaactgaaagacagtcggatcaaactgatgtcagaaatcctgaacgggatcaaggttctcaaactgtacgcatgggagccgagcttcctgaagcaggtagagggcattcggcagggtgagctgcagcttctgagaaccgccgcttacctccacaccaccactaccttcacttggatgtgttcacccttcctcgttcgattggggacgggactcggtccatgcttgcagggatccggctgtcccggtatggcgagggcccattggaccctgccatag

SEQ ID NO: 215412 - DNA, 3717 bp, Artificial Sequence
  Description of Artificial Sequence: Synthetic coding sequence
atggacgcactctgcggatctggagagctcggctccaagttctgggactctaacctttctgttcataccgaaaatcccgatctgactccgtgctttcaaaacagcctgctggcctgggtgccatgtatctatctctgggtcgcactaccctgttatttgctgtacctacgacaccattgccgaggctacattattctgtctcatctgagcaaacttaaaatggtgttgggtgtactcctgtggtgtgtgagttgggccgacctgttctactcttttcatgggcttgtgcacgggcgagcaccagcacccgtattttttgttacccctctggtcgtcggtgtgacaatgctcttagcgaccctgttaattcagtatgagagactacagggcgtgcaatcttcgggcgtgcttattatcttttggtttctctgcgtcgtgtgtgcaatagtcccgtttcgctcaaaaattctcctcgccaaggcagagggggagatttcggacccctttcggttcacaacattttacatccattttgcactggtgctcagtgctctcatactggcgtgttttcgggagaagccaccttttttttcggccaaaaacgtggacccaaatccctatcctgagactagtgcaggcttcctgtctcggctgtttttttggtggtttaccaaaatggcgatatacggctatcggcaccctctggaagagaaggatttgtggagtctgaaagaagaggatcggtcccaaatggtcgtacagcagctccttgaagcatggaggaaacaggaaaaacagacggccaggcataaggcctcagctgccccagggaaaaacgcttctggagaggatgaagtccttctgggagcaagaccaagacccagaaagccctccttcctcaaggctctccttgcaacttttgggagctctttcttaatatccgcctgcttcaaactaatccaggatttgctgtcctttatcaacccacaactgttgtccattttgatcagatttatcagcaaccctatggctccttcttggtggggcttcctggtggccggtctgatgttcctctgttccatgatgcaaagcctgatcctgcagcattattatcattatattttcgttacaggggttaaattccgaacaggcataatgggggttatctataggaaagcgctcgtgatcacaaatagcgtgaagcgggcatcaaccgtgggcgaaatcgttaatttaatgagcgtggatgcccagcggtttatggacctggcccctttcctgaatctgctgtggagcgcacccctccagataatcctcgccatctacttcctgtggcagaacctggggccatccgtgctagccggtgtcgcttttatggttttgctgattccactgaacggtgctgtggctgttaagatgcgtgcttttcaagtaaaacaaatgaagttgaaggatagccgaattaaactgatgtccgagattctcaatggcataaaggtcttgaagctatatgcatgggagccctcattcctgaagcaggtcgagggcattcgccaaggggagctgcagctcctgagaactgcagcctacctgcacacaactaccaccttcacctggatgtgtagcccctttctggtaacattaattacgctatgggtgtacgtgtacgtggatcctaataacgtcctggacgcggagaaagcattcgtcagcgtgtccctgttcaacatcctccggctgcctctgaatatgctgccccagttgatttcaaatctcacccaggcgtccgtgagccttaagcggatccaacaattcctgagccaagaggagctcgacccccagtcagttgagcggaagacaatcagccccggttacgcaataactattcattccggcacatttacttgggcgcaggatctcccccctactctgcacagcctggatatccaggtgccaaaaggggctttggtcgctgtcgttggccctgtgggctgtgggaaatcctctttggtctctgcactcttgggcgaaatggaaaagcttgagggaaaggtccatatgaaagggtctgtagcatatgtccctcagcaggcctggatccaaaattgcaccctccaggaaaacgtcctgttcgggaaggctttgaatccaaagcgatatcagcagacactagaagcttgtgctctgttggcagacctggagatgctgcccggaggagaccagactgagattggcgaaaagggaataaacctgagtggaggacagcggcagcgtgtctccttggctcgcgctgtttacagcgacgccgatatcttcctcctggatgatccattgtctgccgtcgactcccatgttgccaaacatatctttgaccacgtcataggccctgagggtgtactggccggaaaaacacgcgtcttagttacacacggcattagcttcctgcctcagactgacttcatcatagtcctagccgatggacaggtaagcgaaatgggtccttatcccgctcttttgcagagaaatgggagcttcgccaatttcctctgtaactacgctcccgatgaagaccaaggccacctggaagactcttggacggcactcgagggtgcagaggataaggaagcactcttgatcgaagataccttaagcaatcacacagatctcacagacaacgacccggtgacatacgtcgtgcagaagcagtttatgaggcagttgtccgctctttctagcgacggggagggtcagggcaggccagtgcctcgcagacacctgggcccaagtgagaaggtgcaggtgacagaagctaaagcggatggggctctgacccaggaagagaaggcagctatcggaactgtggaactgagcgttttctgggactacgcaaaggctgtagggctgtgcactaccctcgcaatctgtctgctctatgttggccagtccgcagcagccatcggggctaacgtgtggctcagtgcttggacgaacgacgcaatggctgacagccgacaaaataatactagcctaagattgggagtatatgccgcactggggattctgcagggattcctggtcatgctggctgctatggctatggccgcaggcggtatccaggctgccagggttctgcaccaggccctcctgcacaataagatcaggagcccgcagagcttttttgatactactccctcgggacgcatattaaactgtttcagtaaagacatatacgttgttgacgaggtgcttgcacctgtaatcttgatgttactcaacagtttttttaatgccatctccaccctcgtcgtcatcatggctagcactcctttgtttactgtggttattctgcctttggctgttctttatacactcgttcagaggttttatgcagctacatctaggcaactgaagcggctggaaagtgtgagccgttcccccatttatagtcacttttccgaaaccgtcaccggcgcttccgtgatccgagcttacaatcgttcccgggatttcgagataatctcagataccaaggtggatgccaaccagcgctcatgctatccttatattattagcaatcggagcgaagctgccagtctcgccccttgtagttcccgaaactcccaacaggccctctggtgttctggctcactatcattactgagtcccaagcagaaaacaggacccgctctgcccctccctcacttccttctgatctag

SEQ ID NO: 215413 - DNA, 3978 bp, Artificial Sequence
  Description of Artificial Sequence: Synthetic coding sequence
atgcttcccgtgtatcaggaagtcaagccaaaccccttacaggacgccaatctgtgtagcagggtcttcttttggtggcttaatcctctgtttaaaataggtcacaagagaagactcgaggaggatgatatgtactcggtcctcccggaggatcgtagtcaacatctcggggaggaactccaggggttttgggataaggaggtgctgagagctgagaatgacgcgcagaagccttccctgacccgagcaattatcaaatgctactggaagagctacctcgtgctgggcatcttcaccctgattgaggaatctgctaaggtgatccaacctatcttcctgggaaaaatcattaactattttgagaattacgacccaatggactctgtggccttgaacactgcgtacgcctatgctaccgtcctgactttctgtactttgattctagccattctccaccacctctacttttaccacgtgcagtgtgctggcatgcgacttcgggtggcaatgtgccacatgatctaccgcaaagctctacgcctgtcaaacatggctatggggaagacaactactgggcagatagtgaacctgctgagcaatgacgttaacaaatttgaccaggttacagtgttcctccatttcctatgggcaggcccacttcaggcaattgcagtgacagcattgctctggatggagattggtatctcttgcctggctggaatggcagtgctaatcatcttgcttcccctacagtcatgttttggcaagctcttctcatctctgaggtcaaagactgctacttttaccgacgcacgaatacgcaccatgaacgaggtcattacgggcatccgcatcattaaaatgtatgcatgggaaaagtccttctctaacttaatcaccaacctccggaaaaaagagatcagcaaaatcctgagatcctcctgtcttcgcggtatgaaccttgcatcctttttcagcgcaagcaagataattgtgttcgtcacttttacaacttacgtactcctaggttcagtgatcacagcgtccagagtgttcgtcgctgtgaccctgtatggggcagtgcgcctgacagtaaccttattcttccctagtgccattgagcgagtttccgaggctatcgtgtcaatacggcgaatacagacattccttctgctagacgagatcagtcagcgcaatcgccaactaccgagtgatggtaagaaaatggtgcacgtgcaggatttcactgcgttttgggataaagcttccgagacaccaactttgcaaggactgagctttacggtcagaccaggagaactactagccgtggtcggacctgtaggggctggaaagtccagtctactgagcgccgtgctcggcgagctggccccaagtcacgggttggtatcagttcatggccgaattgcttacgtcagccagcagccttgggttttttccgggacattgcgttcaaatattctttttggcaaaaaatacgagaaagagaggtacgagaaagtaataaaagcatgtgccctgaagaaggacctgcaactgctggaagacggagacttgacggtgatcggcgaccgcggtactacgctctcaggcggacagaaagcacgggttaacctggctcgtgctgtttaccaggacgctgacatctatctgttggatgaccccttgtccgctgtcgatgcggaggtgtccagacacctgttcgagttgtgcatctgccagatattgcacgaaaaaattacgatcctggtaacacaccagttgcaatacttaaaggcagcttcgcagatcctaatcctaaaagacggaaagatggtgcagaagggaacatacactgagttccttaaaagtgggatcgatttcggctctcttctgaaaaaagataacgaggagtctgagcagccgccagtgcccggtacgcccaccctgcgcaatcggacattcagcgagagtagtgtgtggtcccagcagtcttctagacccagcctcaaagatggcgctctcgaatcgcaggacaccgaaaacgttccggtgacactgtccgaagaaaataggtccgagggcaaggttggatttcaggcttacaagaattattttagagcaggagctcactggattgttttcatattcctgatcttgctaaacactgcggctcaggtggcctatgtgcttcaggactggtggctatcctactgggccaacaagcagtctatgttgaatgtgaccgtgaacggaggcggaaacgtaaccgagaagctggatctgaattggtacctggggatatattccggacttactgtagcaacagtgctcttcggtatcgcacgcagcttgctggtgttttatgtgctagtgaattcctcccaaactctccataacaagatgttcgagtccatcctgaaagctcctgtcttgtttttcgaccgtaaccctatcggcaggatcctgaaccgtttttccaaagacattggccacttggatgacctgttacccctgacatttctagacttcatccagaccctgcttcaagtggtgggggttgtgtcagtcgctgtagccgttatcccttggatagccatacccctggtgcctcttgggattatttttattttcctgagaaggtacttcctcgaaacttcgcgcgacgtgaaacgtttggagtctactacccggagtccggtcttcagtcacctgagcagtagcctccagggcctgtggaccattagagcatacaaggccgaggaacgatgtcaggaactcttcgatgcccaccaggaccttcactctgaggcgtggttcctcttcctgaccacttctcgatggtttgctgtgaggttggatgccatttgcgcaatgttcgtgatcattgtcgcattcggctccctgattctggcaaagaccctcgatgcaggccaagtcggactcgctttgagctacgccctcacccttatgggtatgtttcagtggtgtgtgaggcagagcgcagaggtagaaaatatgatgatttctgtggagagggtcattgagtacaccgatctggaaaaggaggctccttgggagtaccagaaacgcccacccccagcgtggccccatgagggggtgattatctttgacaatgtcaattttatgtattcgccaggtgggcctctggtgcttaagcatctcacagctttgattaagagtcaggagaaagtcggtattgtggggcgaaccggcgcaggtaagtccagtcttatttccgccctgttcaggctgtcagagccggaggggaaaatctggattgataagattctgacaaccgagataggtctgcacgatttgcggaaaaaaatgagcattattccccaagagcctgtgctcttcactggcactatgaggaagaatctggaccctttcaacgagcatacagacgaagagctgtggaatgcgctccaagaggtgcagcttaaggaaactatagaggatctgccaggtaaaatggataccgagttagcagagagcgggtctaacttcagcgtgggacagagacagctggtttgcctggccagggccatcctccgtaaaaatcagatcctgatcattgacgaggccacagcgaatgtagatccacgcaccgacgagttgatacagaaaaagattcgagagaaattcgcccattgcactgtgctgacaatcgcccaccggctgaatacaatcatcgattcagataaaatcatggtcctggattctgggagactgaaagagtatgatgaaccatacgtgcttttgcagaataaagaaagcctcttctataaaatggtccaacagctaggcaaagccgaggctgcagccttaaccgagaccgcaaagcaggtgtacttcaagcgcaattatccccacataggccacaccgatcacatggttaccaatacatccaatgggcaaccctcaactctcacaatttttgagacagctctatag

SEQ ID NO: 215414 - DNA, 3837 bp, Artificial Sequence
  Description of Artificial Sequence: Synthetic coding sequence
atgctgcctgtgtaccaggaggttaagccaaatcccctgcaagacgctaacctgtgcagtagggtattcttctggtggcttaatccccttttcaagattggccacaaaagaagactcgaggaggatgatatgtattccgtgcttcctgaagacaggtcccagcacctgggagaagaactgcagggattctgggataaggaagtgttacgtgcggaaaatgacgctcagaagcccagtctcactcgtgcaattattaagtgctattggaagtcttacttagtcctcggaatctttaccctgatcgaggagtctgcaaaagtcattcagcccatcttcctgggtaagatcattaactattttgaaaactacgatccaatggacagtgtcgcactgaacactgcatacgcatacgcaacggtattgactttttgtacgctgatcctagccattcttcatcatctgtatttttaccacgtgcaatgcgcaggcatgaggctcagagttgctatgtgtcacatgatctaccgcaaggccttaaggctttcgaatatggctatgggcaaaacaactacgggccagatcgtgaacctcctctcgaacgacgtcaacaagtttgaccaggttacagtgtttctgcacttcctgtgggccggtcctcttcaagcaatcgccgtcaccgccttgctgtggatggagataggtatcagctgcttagccggtatggcagtgctgatcatactgctacctctccagagctgtttcgggaagctgttctcgtctttgaggagtaagactgccacttttacagatgcgcgaatacgcaccatgaacgaagtgatcacggggattagaattattaagatgtacgcatgggaaaaaagctttagcaacctgatcaccaatctgagaaagaaggagatttccaaaatcctgcgctcaagctgcctgcggggaatgaacctggcctcgtttttttccgcttcgaaaatcatcgtattcgtgacattcacaacctacgtcctcctcgggtcggtaatcacggcctccagagtgtttgtggctgtcacgctttacggtgctgtcagacttacggtgactttgttcttcccatctgccatcgaacgagtgagcgaagccatcgtgagcattagaaggatacagacatttctcttgttggacgagatatctcagcggaaccggcagctgccttcagacgggaagaagatggtacatgtgcaagattttaccgctttttgggataaagccagcgaaactcctactctacaaggcttgtcttttaccgtgaggccaggagagttattagccgttgttggacccgtcggggctggtaagtcttcgctcctgtcagcggtgctgggagaactcgcccctagccacggccttgttagcgtgcacgggagaattgcctacgtcagtcagcagccctgggttttctctgggactctgagaagcaacatactgtttggtaagaagtacgaaaaagaaagatatgagaaggtaataaaggcttgtgccctgaagaaagatcttcagctcctagaggacggagacctgaccgtgattggagatcgaggaactacactaagcgggggtcagaaagctagggtgaatttggctcgtgcggtatatcaggacgctgacatttatctattggacgaccccctgtctgctgtagatgccgaggtctcccggcatctctttgagctgtgcatatgccagatcctccatgagaagatcaccatcttggtgacccaccaactccaatatttgaaagccgcaagtcaaatcttgatactgaaggacgggaagatggttcagaagggcacctacaccgagttcttaaagtctgggatagacttcggcagcttgttaaaaaaagacaacgaagagtccgagcagccccctgttccaggtacccccacactccggaaccggacattctccgagtccagtgtgtggagtcagcagtcaagtcgcccaagccttaaagacggagcccttgagtctcaggatgtggcctacgtgctgcaagactggtggctgtcatattgggcgaacaagcaatcaatgttgaacgtcactgtcaatggcggaggcaatgtaacggaaaagttagatctgaattggtatctgggtatttattctggacttactgtcgccacggtgttgtttggaatcgcgaggtctctcctcgttttctacgtgctggtgaactcctcccaaacacttcataataaaatgttcgaaagtatcctgaaagctccagttctgttctttgacagaaacccaattggcaggattcttaacaggttttcaaaagatatcggacacctggacgacctgttaccgcttacttttcttgattttatacagaccctccttcaggtggtcggcgtggtgagcgtcgcagtggctgtgatcccttggatcgctatccccttggttccattaggcataattttcatctttctccggcgatattttctggaaaccagtagagacgtcaagaggctggaatctaccacgcgttcccccgtgttcagccacctgtctagttccttgcagggactgtggacgataagggcctataaagcagaagagcgctgtcaggagctgttcgacgcccaccaggacctgcactccgaggcatggttcctcttcttaaccacctcgaggtggtttgcagtgagactggatgctatatgtgccatgtttgtgatcattgtggcctttggatccttgattctggccaaaactctggatgccggacaggttggactcgccctatcttacgcccttacccttatggggatgttccagtggtgtgtgcggcaatctgcggaggtcgaaaatatgatgatctctgtggagagagttattgagtacacagaccttgaaaaagaggccccttgggagtaccagaagagaccacctcctgcctggccccatgaaggtgttataattttcgataacgtcaacttcatgtacagccctggcggtcctctggtcctgaagcaccttactgcacttattaagtcccaggagaaagttgggatcgtcggtcggaccggggcagggaaatcctcattgataagtgctcttttcaggctgtctgagccagagggtaaaatctggatagacaagatcttgactacggagattggcctgcatgacctgagaaagaagatgtctattatcccccaggagcccgtactattcactgggacaatgagaaaaaatctagatcccttcaatgagcatacagatgaggaactgtggaatgccttacaggaggtccagttgaaagagaccatcgaagacctacctggcaaaatggatactgagctggctgagtccgggtccaactttagcgttggacagaggcaacttgtgtgtctggccagagccatactgaggaagaaccagatcctcattattgatgaagccaccgcaaacgtagatcccagaacggacgagttaattcagaagaaaatacgtgaaaaatttgcgcactgcacggtcctcaccattgctcacagactgaacaccataatcgacagcgacaaaattatggtgctcgatagcggaaggctcaaggaatatgacgaaccatacgtgctgctgcagaacaaggagtcattattttataagatggtgcagcaactgggtaaggccgaggctgccgcactgaccgaaacggccaagcaagtgtacttcaaacgtaactacccacacattggccacactgaccatatggtaaccaatacaagtaacggacagcccagtacgctgacaatcttcgagacagccctctag

SEQ ID NO: 215415 - DNA, 2580 bp, Artificial Sequence
  Description of Artificial Sequence: Synthetic coding sequence
atgctgcccgtgtaccaggaagtcaagcccaaccctctgcaagacgctaatttgtgctcccgggtattcttttggtggctaaatccactctttaagatcgggcacaagagacgcctcgaagaagacgatatgtactcagttctgccagaggaccggagccaacatttgggcgaggaactccaaggattctgggataaggaagtgctgcgcgcagaaaatgacgctcagaaaccaagtctgaccagagctataattaagtgttactggaaatcatacctggtgctcggaatttttaccctgatagaggagtccgctaaggttatccaacctatttttctgggcaagattatcaactattttgaaaactatgatccaatggattcagtggctctgaatacggcttacgcgtatgccaccgtcctcactttctgcaccctgattctcgccatcctgcaccacctctacttttatcacgttcagtgcgcaggtatgcgtttacgcgtcgcaatgtgccacatgatctatcgcaaggcactgaggctgtcaaatatggccatgggtaagacaaccaccggtcaaatcgtcaacttactgagcaacgacgtgaacaagttcgatcaggtgaccgtgtttctccactttctgtgggccggaccattgcaagccatcgccgtgacagcactgctgtggatggagatcgggatcagttgccttgccggaatggctgtgctgatcatcctactgcccctgcagtcctgctttggtaagctattttcctcacttagatcaaaaactgcaacctttaccgacgcgagaattcggacaatgaacgaagtgatcacgggcatccggatcattaagatgtacgcctgggagaagtcattctcaaaccttatcaccaacctgcggaaaaaggagattagtaaaatcctcaggtcctcttgcctgcgagggatgaacttagcttcctttttttcagccagtaaaatcatcgtttttgtgactttcaccacatatgtgctgctgggtagcgtcatcactgcaagtagagtattcgtggccgtgaccctctacggagcggtgcgattaacagtgactcttttctttccctcagcaatagaaagggtgagcgaggccattgtgagcatccgacgcatccagactttcctgctgcttgacgaaatctcccagcgcaaccggcagttgccttcagacggtaaaaagatggtgcatgttcaggacttcacagctttctgggataaggcaagcgagacgccaactctgcagggactcagttttaccgtgaggccgggtgagctcttagcagtggtaggcccagtgggggctggaaaatcctctctgctgtcagctgtgctgggggagttggccccttcccatggattggttagtgtacacggccgaattgcctatgtatctcagcagccttgggtcttttctgggacgctcagatccaacattctgtttggaaagaagtatgagaaggaacggtacgagaaggtgattaaagcttgtgcattaaaaaaagatctacagctgttggaggacggggatttgacagtgatcggggatcgcggtaccactttgagtggcggacaaaaggcccgtgtaaatctggctagggccgtgtatcaggacgccgatatatatctcttggatgacccccttagcgccgtcgatgcagaggtgtccagacatctgtttgagctgtgcatctgccagattctgcatgagaagatcactatccttgtaacccatcagctacaatatttgaaggccgcttcacagatcctgatcctgaaggacggaaaaatggtacagaagggcacctacactgagttccttaaaagcggtattgactttggaagtcttctgaaaaaggataatgaggagagcgagcagccccctgtccccggaactcccacactgcggaataggaccttcagcgagagcagcgtttggtcacagcagtcctcacgcccaagcttaaaagatggggctctggaatctcaggacaccgaaaacgttccagtgactctgtcagaggaaaacaggtcagaaggtaaagttggattccaggcttacaagaattactttcgggctggggctcactggattgtcttcattttcctcatactcctcaataccgcagcccaggtcgcctacgtgctccaagactggtggctctcctattgggccaataagcagagtatgctcaacgtgacagtgaacggaggaggcaatgtcacagaaaaactcgacctgaactggtatttgggaatctacagtggactgacagtggccacagttctattcgggatagctcggtctttactcgtcttttacgtactcgtaaatagcagccagacactgcacaataagatgtttgagtctattttaaaagcccctgtgcttttcttcgaccgcaatccgattggtcgtatacttaatcggtttagcaaagatataggtcacctggacgatctcctgcctttaacctttctggatttcatccagcgatgggacttagctgtgctctcttggttggtgtctaactcttag

SEQ ID NO: 215416 - DNA, 2355 bp, Artificial Sequence
  Description of Artificial Sequence: Synthetic coding sequence
atgctgccggtgtatcaggaggtgaaaccaaaccctttgcaggatgccaacctctgttcccgtgttttcttctggtggctaaaccctctgttcaagatcggtcacaagcgtcgactcgaggaggacgacatgtacagcgtgttgccagaagatagaagccagcatctgggcgaggagcttcagggcttctgggacaaagaagtgcttcgggctgaaaacgacgcacagaagcccagcttaaccagggccatcatcaaatgttactggaagtcatatctggtgcttggaattttcaccctgatcgaggcactacgattgtcgaatatggctatgggaaaaacaaccactggtcagatcgttaacctgctaagcaacgacgtcaacaagttcgaccaggtcaccgtttttttgcatttcctatgggccggacccctgcaagcaatcgcagtcactgcacttctgtggatggagattggtatatcgtgccttgcgggaatggccgtgctaataatccttctacccttgcagtcatgtttcgggaagcttttcagttctctccgctccaagaccgcgacttttaccgatgctcggattcgcaccatgaatgaagtcatcaccggaatccgcattatcaaaatgtatgcctgggaaaaatctttctctaatctgatcactaacctccggaagaaggagatcagcaaaattcttaggagttcctgtttaagagggatgaatcttgccagctttttcagcgcttctaaaattatagtgttcgtgacttttactacttacgtacttctcgggtctgtgatcaccgcttcccgagtctttgtagccgtaacactgtacggggcagtcaggctcacggttacactgttcttcccttcagccatagaacgtgtatctgaagcgattgtgtccattcgcagaatccagacctttctgttgctggatgagattagtcagcgtaaccggcagctccccagtgacggaaaaaagatggtacacgtccaggacttcactgccttttgggataaagcctccgaaactccaacactgcagggcctgtctttcaccgtgaggcccggtgagctgttagctgtggtagggcctgtgggcgcaggtaaatcaagcctcctttcggccgtcctgggtgaactggccccatcacacggcctagtgagcgtccacgggcgaatcgcctatgtgtctcagcaaccttgggtcttctcaggcactttacgaagtaacatcctgtttggcaagaagtacgaaaaggaacgttatgaaaaagtgatcaaagcttgcgctctgaagaaggaccttcagctcctggaggatggtgatttgactgttataggtgaccgtggcaccaccctgagcggaggacagaaggcaagggtgaatctagccagagctgtgtaccaggatgctgatatttatctgctggacgaccccctatctgccgttgatgccgaagtgtcccgacacctatttgagctatgcatatgccaaatcctccacgagaagattactatactggtaacccatcagctacagtacctcaaagctgcctcccaaatactgatcctgaaagatgggaaaatggttcaaaagggcacctacaccgaattcctgaagtccgggatcgactttggctcgttgctgaagaaagacaacgaagagtccgagcagcctcccgtccccggaactccaacgctaagaaatagaaccttctctgaatcctcggtgtggagccaacagagcagccgcccttccctcaaggatggcgcactagagtctcaggataccgaaaatgtgcccgtgacattgtctgaagagaaccggagcgaaggaaaggtgggctttcaggcatacaagaattactttagggcgggagcacattggatcgtttttattttcctgattctactgaacacagccgctcaagtggcctacgtgctgcaggactggtggctatcttactgggctaataagcagagcatgctaaacgtgacggttaacggtggcggaaacgtgactgaaaaattagatttaaattggtacctcggtatctatagcggtctgaccgtagcgactgtgcttttcgggatagcacggagcctcctggtgttctatgtgctagttaactcgagtcaaaccctccataataaaatgtttgagtccatactcaaggcccctgttctcttcttcgaccgcaacccaatcggcaggattttaaatcgtttttcgaaggatatcggtcatttggacgatctgctgccattaaccttcctggacttcatccaacgatgggatctggccgtgctctcatggctggtgagtaactcatag

SEQ ID NO: 215417 - DNA, 75 bp, Artificial Sequence
  Description of Artificial Sequence: Synthetic coding sequence
atgcttccagtctatcaggaagtaaaaccaaatcccctgcaagatgctaacttgtgttcgagagtattcttctag

SEQ ID NO: 215418 - DNA, 4185 bp, Artificial Sequence
  Description of Artificial Sequence: Synthetic coding sequence
atgaaggacattgatatagggaaggaatatatcattccatctcctggttatcggagtgtcagggagcgtacttctacgtcagggacccatagagaccgggaagatagtaagtttcggagaacccgcccactggagtgccaggatgcgttggaaaccgcggctagagctgagggacttagcctagacgcgtccatgcattcacagcttaggatcctggacgaagaacatcccaaaggtaagtaccaccatggactgagtgcactgaagcccatccgaaccactagtaagcaccagcatccggtagataatgcaggcctcttctcatgtatgacattttcctggctgtcatccttggccagagtggcccataagaaaggcgagctgagtatggaggacgtctggagtctgagcaagcatgagagctccgatgtaaattgtaggcgcctggaacgcctctggcaagaagagttgaatgaagtaggtccagatgctgccagcttaaggcgtgttgtctggatcttttgtaggactcgcctcatcctcagtattgtctgccttatgattacacagctagcaggctttagcggaccagcatttatggtgaagcatctgttagagtatactcaggcaacagaatccaatctacagtattcattgctgttggtcctgggtcttctcctgactgaaatcgttagatcttggagtttggccttaacttgggctcttaactatcggaccggtgttaggttacggggtgccatcctgactatggcgtttaagaaaatcttgaaacttaaaaatatcaaggagaagagcctcggcgagctcatcaacatctgctcaaatgatggccaacgcatgttcgaagccgcagctgttggctctctcttggcgggtggcccagtggtagccatactagggatgatatacaacgtcatcattcttggcccaactggcttcttgggatccgccgtctttattttattttaccccgctatgatgttcgcgagcaggttaacagcatactttcggcgaaagtgtgtcgcagccacagatgaacgggtacagaagatgaatgaggtgctaacttatattaaattcatcaagatgtacgcctgggtcaaggcattcagccaatctgtgcagaaaatccgagaggaagaaaggcgcatcctggagaaggctggctattttcagtccatcactgtaggcgtggccccaattgttgtggtgatcgccagcgtggtgacattctccgtacacatgacactgggcttcgacctaactgcggctcaggcctttacggtcgtgacggtgtttaatagtatgacattcgctttgaaggttacccccttcagtgtcaaatctttatccgaagccagcgtcgcggtggacagatttaagtccctctttctgatggaggaagttcacatgatcaaaaataaacctgctagtcctcacatcaaaattgagatgaaaaatgccaccctggcctgggacagtagccattctagtatccaaaactcccctaagttaacgccaaaaatgaagaaagacaaaagagccagtcggggaaagaaggagaaggtcaggcagctacagcgcactgagcatcaggccgtgctggctgagcaaaagggacatctcctcctggattccgatgagaggccttctcccgaagaagaagagggtaagcacatacatctcggccacctgagactccaaaggaccctgcacagtatcgatctggaaattcaggagggcaagctagtgggtatttgtggcagcgtgggtagtggcaaaacctctctcatcagcgcaatactgggccaaatgacgctgctcgagggtagcatcgctatttccggcacgtttgcttacgtggctcaacaagcatggatcttgaacgcaactctacgggacaacatcctcttcggaaaggaatatgatgaagagaggtataactctgttctgaacagctgctgtctccgacctgacctggctattctgccatcatctgatttgactgaaattggagagaggggagcgaacttgagcggaggccagcggcagcgtatttccttagccagagccctgtattccgatagatccatttacatacttgatgaccccctttctgccctagacgctcatgtgggtaaccatatcttcaattccgccatccgcaagcacttgaagtcaaaaactgtgttgttcgttactcaccaattacagtacctcgtggactgcgatgaggtaattttcatgaaggaaggctgtatcacagagagaggcactcatgaggaactaatgaatctcaacggagactatgccacaattttcaataaccttctgcttggagagaccccgccagtagagataaattccaagaaggaaacttccggcagtcagaaaaaatcccaggataagggcccaaaaacgggaagcgtcaagaaagagaaggctgttaaaccagaggagggccagctggtgcagcttgaagagaaaggccaaggttccgtgccatggtccgtatacggcgtgtacatacaggcggcaggaggacccttggccttcctcgttataatggccctgtttatgttaaatgttggctccaccgctttttcgacttggtggctgagttattggatcaagcagggatcaggaaatactaccgtaacccggggaaacgaaacatctgtttctgacagtatgaaggacaacccgcacatgcagtattacgcgagtatctatgcactcagcatggctgtgatgctgattttgaaagccataaggggcgtcgtcttcgtcaaaggcacccttcgggcttcttcccgactgcacgatgagctcttcagacgaatactgcggagcccaatgaagttcttcgacactactccgaccggacgtatactgaacaggttctcaaaagatatggacgaagtcgatgtgaggcttcccttccaggccgagatgttcatccagaacgtgatcttggtcttcttctgtgttggtatgatagccggtgtgtttccctggtttttagtggcggtagggccacttgtgattcttttctcagtcctgcacatcgtgagcagatatcaggaactgcttgacgataaccaggcccctttcttcctgtttacctgcgcaatgcgctggttggccgtgagactcgatcttatttcgattgcactcattacaacgacaggcctgatgattgtactcatgcacgggcaaatccctcccgcttatgcaggcctggccatctcttatgcagtgcagctcactggtctctttcaattcactgtccggctcgcatcggaaacagaggcaagatttacaagtgtagaaaggattaaccactatattaaaaccctgagcctcgaagcccctgcacgtataaagaacaaggccccatctcccgactggcctcaggagggcgaagttactttcgaaaatgccgagatgagataccgggagaatcttccgctggtcctgaagaaggtcagcttcacaattaaaccaaaggaaaagattggcatcgtggggagaacaggatcagggaagtcctctttgggaatggcactttttagattggtagaactgagcggtggatgtattaagatagatggcgtgaggatctctgatatcggactggctgacctcaggtcaaaactgtcaatcatcccccaggaaccagtcctctttagcggtactgttagatctaatctcgaccctttcaaccaatacaccgaagatcagatctgggacgccctggaacgcactcacatgaaggagtgcattgcacagttgccccttaagttagagagcgaggtgatggaaaacggagacaacttcagtgtcggcgagcgtcaactcctctgtatcgctcgcgcattactacgccactgtaagatcttaatcctggacgaagcaaccgccgctatggatactgagaccgatcttctaattcaggaaacaattcgggaggcctttgccgactgtacaatgttgaccattgcccatcggttgcacaccgtgctaggctcagatcgtatcatggttctcgcccagggacaagtggtggagttcgatacaccaagcgtgttgctttccaatgatagctcgcgattttacgcaatgttcgcagctgcagagaacaaggtggctgtcaagggttag

SEQ ID NO: 215419 - DNA, 4314 bp, Artificial Sequence
  Description of Artificial Sequence: Synthetic coding sequence
atgaaggatatcgacatcggaaaagagtatatcataccttcgccgggataccggtccgtgagagaaagaacatcaacaagtgggacacatcgagatcgggaggattccaagttcaggcgtaccagaccgctcgagtgccaggatgccttagagacagcagcaagagctgaaggtctatcacttgatgcctcaatgcatagccagctgcggatactggatgaggaacaccctaaggggaaataccatcatgggctctcggccctcaaacctatccggaccaccagcaagcaccagcatcccgtggataacgccggactcttctcctgcatgactttcagctggctcagctccctggcacgcgtcgcacacaagaagggagaactgtccatggaggacgtgtggtcacttagcaagcacgagtcgagcgacgttaactgcaggcggctcgagcgcttgtggcaggaagagttgaatgaagttggacctgatgctgcctccctgaggcgtgtggtgtggattttctgccgcacccgactgattctgagtattgtatgcctgatgatcacccagctggcaggatttagcggccctgccttcatggtcaagcacctgcttgagtacacccaggccaccgaatctaacctccagtacagcctgctccttgttctggggctgttgttgaccgaaattgtgaggagttggagcctggccctgacatgggcccttaattataggaccggcgtgcggctccgaggtgcaattctgactatggcatttaagaagatcctgaagcttaagaatatcaaggagaaatctctgggcgaattgatcaacatatgtagcaacgatggtcagcggatgttcgaggcagctgccgtgggttcactgctagctggagggccagtagtggccatacttggcatgatctacaatgtgatcattctagggccaaccggctttctcggaagcgctgtgttcattttgttttacccggctatgatgtttgcttcccggctgactgcgtatttcagaaggaaatgtgtcgccgcaacggacgaacgtgtgcagaagatgaacgaggtgttaacctatatcaagttcatcaaaatgtacgcatgggtgaaggctttctcccagagcgtgcaaaagattcgggaagaggagcgacgtattcttgagaaggcagggtacttccagagcataacagtgggggtagcacccatcgtggttgtcatcgctagcgtagtaactttttccgtccacatgaccctgggattcgacctcaccgccgcacaggccttcaccgtggtgactgtatttaatagcatgacctttgcccttaaggtgacacccttcagcgtgaaaagcctgagtgaagcatctgtcgccgtggatagatttaagtccctattccttatggaggaggtacacatgatcaaaaacaagcccgcaagcccgcacatcaaaattgagatgaagaatgcaacattggcctgggatagcagtcacagttccatacagaatagcccaaagctcactcctaagatgaagaaggataaacgtgcctcacggggtaagaaagagaaggtccgtcaactccaacggaccgagcatcaagcagtcttggcggagcagaagggccatctcctgctcgattccgacgaacggccaagtccagaggaggaggagggcaagcacattcatctcggacaccttagactgcagcggacactgcattctattgacctcgaaatccaggaggggaagcttgtcggtatctgtggatccgttgggtcagggaaaacaagcctgatttccgctattctgggacaaatgacgctactggagggctcaatcgctatttctggaactttcgcctacgtcgctcagcaggcctggattctgaatgcaacacttcgggataatatactgtttggaaaggaatacgacgaagagcggtacaacagtgtattgaactcctgctgcctaagacccgatctcgcgattctccccagttcagacctcacagaaatcggagagaggggggcaaacttgtccgggggtcagaggcagcgcatttctcttgctcgcgcactttactcagacaggagtatctatatattggacgatccgctatcagctttggacgcgcatgtggggaaccacatctttaattccgccatcagaaagcacctgaagtcaaagacagtccttttcgtgactcaccagctgcagtacctagtggactgcgacgaggtgatctttatgaaggaggggtgtatcacggaaagaggaacacacgaagagctcatgaatctcaacggggattacgcaaccatcttcaacaatctgctactcggggagacacccccagttgagatcaattcaaagaaggagacaagcggatcacagaaaaagtcccaggacaaggggcctaagacgggatctgtcaagaaggagaaggctgtgaagcccgaggagggacagctcgttcagctggaagagaagggacagggaagcgtgccttggtcagtatatggcgtgtacattcaggccgcaggtggacctctcgcttttctggtgatcatggcgctgttcatgcttaacgtcggctctacggcctttagcacctggtggctgtcctattggatcaaacaggggtcagggaataccaccgtaaccaggggcaacgagacatccgttagcgacagtatgaaggacaacccccacatgcagtactatgcttcaatatacgcgctgagtatggctgttatgctgattctcaaagccatcagaggcgtggttttcgtgaagggcacattacgcgcatcgtcaaggctccacgacgaactgttcagacgaatcctgaggtcgcccatgaaattctttgacacaacgcccactgggagaatcctgaaccggttctcaaaggatatggatgaagtcgacgtgcgactcccattccaggcagaaatgttcattcagaacgttatcttggtattcttctgcgtgggcatgatcgcaggagtgtttccatggttcttagtagccgtgggcccattggtgattctcttttccgttctgcacattgtctcacgcgtgttgattcgcgagctgaaaaggctcgacaacattactcagagcccctttctgtctcacataacctcgtcaatccaagggctagccaccatccatgcatacaacaaaggacaagaattcctgcatagataccaggagctcttggacgacaatcaggcgccattttttctcttcacctgtgcgatgcggtggctcgctgtgcggctggatctgatctcaatagcactcattactacaacgggcttgatgatcgtgctcatgcacggtcagatacctccagcctatgcgggattggctatctcctacgccgtgcagctgaccggactgtttcagttcacagtgcggctcgcctctgagaccgaagcaaggtttacatccgttgagcgcataaaccattacatcaagaccttgtcactcgaggcgcctgcccgaattaagaacaaggcaccctcccctgattggccccaggaaggcgaagtgacattcgagaacgccgaaatgcgctatcgggagaatttgcccctcgtccttaaaaaagtgagcttcaccatcaaaccaaaagagaaaatcggcatagttggccgaaccggatccggtaagagttccctgggcatggccttgttccggcttgtggagctgtccggcggatgtattaaaatcgacggcgtgcgcatctccgacatcggtctggctgacctcaggtcgaagctcagtatcattccacaagaaccagttctattctccggcacagttaggagcaatctggaccccttcaatcaatacaccgaggatcaaatctgggatgccctcgaacgtacccacatgaaggaatgtatcgcacaattacctctaaagctcgaatctgaggttatggaaaacggcgacaatttttctgtcggcgagcgacagctcctttgtattgcccgagccttgcttaggcattgtaaaattttaattctggatgaggcaaccgcggcaatggacacagagaccgacctgctcatccaagaaacgatccgcgaagctttcgccgactgtacaatgttgacaatcgctcatagactacatactgtgctagggtcagatcgtattatggtcctcgcccagggccaagtggtggagtttgataccccatctgtgctgctctcaaacgatagtagcaggttctacgctatgtttgccgcagccgagaataaagtcgcggtcaagggctag

SEQ ID NO: 215420 - DNA, 627 bp, Artificial Sequence
  Description of Artificial Sequence: Synthetic coding sequence
atgaaggatatagatatagggaaggaatacattatcccctcccccggttacagaagcgtgcgcgagcgtaccagcacatctggcactcacagggatcgggaagactctaaattccgcaggactcggcctctggaatgccaagatgcgctggagacagccgctagggcggaggggctgtccctggatgccagtatgcattcccaactgcgcattctggacgaagaacaccctaaagggaagtatcaccacggtttgagtgcccttaagcccatcagaacgacaagcaagcatcaacatcctgtggacaacgctggactcttttcctgcatgacattcagttggctgagcagtttggccagagtggcacacaagaagggcgaactcagtatggaggacgtttggtcattatctaaacacgagagcagtgacgtgaactgcagaagacttgagcgcctttggcaggaggagctcaacgaagtgggacccgacgcagcatcactccgccgagtggtatggatattctgcagaactcggttaatcctttccatcgtgtgcttgatgatcacacaactggcaggcttttcaggacccaactttcaggacggatgcatactgcgaagcgagtag

SEQ ID NO: 215421 - DNA, 2511 bp, Artificial Sequence
  Description of Artificial Sequence: Synthetic coding sequence
atgcacagccagctgagaatacttgacgaggaacatcctaaaggcaaatatcatcacggattatctgccctgaaacccatccgcaccacaagtaaacaccagcaccccgtggataatgctggactcttcagctgcatgacctttagctggctgagctcactggcccgagtggcacacaagaaaggagagttgagtatggaggatgtatggtcccttagcaaacacgagagtagtgatgtcaactgtaggaggctcgagcgactgtggcaggaagagttgaacgaggtcggacccgatgcagctagtctgcgaagggtggtctggatcttttgtagaactcgactcattctgagtattgtgtgtttaatgattacccaactggcgggattttccggacctgcttttatggtgaagcatctcctggaatatacccaggccactgagtcgaacctgcagtattcccttctcctcgttcttgggctgttactcacagagatcgtcaggtcctggagtctagccctgacatgggctcttaattatcggaccggcgttagactgcgcggagccattctaaccatggctttcaaaaagatcctcaagctcaagaatattaaggagaaatcactcggagagctgatcaacatttgtagtaacgatggccaacgcatgttcgaagcagctgcagtgggcagccttctggccggaggacccgtggtcgcaattctggggatgatctacaatgtcatcatcctgggtcctaccggctttctcggctcagcagtgttcatcctattttatcccgcaatgatgtttgctagcagactgacagcctacttcaggcggaagtgcgttgccgctacagatgagcgggtgcagaagatgaacgaggttctgacatatatcaagttcattaaaatgtacgcctgggtcaaagctttttcgcagtccgtacagaaaatccgcgaggaagagagaaggatcctggaaaaagcagggtacttccaatccattacagtcggcgtagcacccatcgtagtcgtgatcgcctccgtcgtgacttttagtgtacatatgacgttgggttttgatttaacagcggctcaggctttcactgtggtgacggtattcaattcaatgaccttcgcattaaaggttaccccgttttcagtgaaatctttatccgaggcctcagtggcggtggacagatttaagtccttgttcctaatggaggaggtgcacatgattaaaaacaagccggcaagccctcacattaaaatagagatgaagaacgctaccttggcctgggacagcagtcactctagcatccagaatagtcctaagctgacgccaaagatgaagaaggacaaacgggcttcccgcggtaaaaaggagaaggttagacagctgcaaaggacagagcatcaagccgtgttggctgagcagaaaggacatctgttgttagattccgacgagcgcccaagccctgaagaagaagaggggaagcatattcatctgggccaccttaggttgcagagaaccctccactcaattgacttggaaatccaggaaggaaaactggtggggatttgcggaagcgttggttctggcaagacatctttgatcagtgcaatcctgggacagatgaccctcctggagggaagtatcgccatttcagggacttttgcttacgtcgcccagcaggcgtggattctcaatgctacacttagagacaatatcttgtttggaaaagagtatgacgaggagcgctataactctgttctgaacagttgttgcctgcgccctgacttagcaatactgccttccagtgacctgaccgaaataggcgagaggggggcaaatctgtccggcggacaacggcagcgcatatctctggcacgggctctgtattcagatcgatccatctatattctggatgaccctctgtctgcactggatgcccatgtgggtaaccatatttttaatagtgccatcaggaagcacttgaagtcaaagacagtgttattcgtgactcaccagttgcagtacctggtggactgcgacgaggtaatctttatgaaggaagggtgcattaccgagagaggtactcacgaagaactcatgaacctgaatggggattatgcaaccattttcaacaatctgttgcttggcgaaactcctccagtagagataaacagcaagaaggagacaagtgggtcacaaaaaaagagtcaagacaagggcccaaaaactggctccgtaaagaaagagaaggctgtaaagcctgaagaaggccagttggtccagctggaggaaaaggggcagggttcagtaccatggtccgtatacggccatcccggttgctggggaccgctcggaatccctggatactacgggcctttccacgccgagtgccgacagcaccgactccagcatctggtggtggagcttctggaccaagcacgcaaacgcgagcatcattgcgattctagggaacgcgatctgggtgagtag

SEQ ID NO: 215422 - DNA, 678 bp, Artificial Sequence
  Description of Artificial Sequence: Synthetic coding sequence
atgaaagatatcgacatcggaaaggaatacataatccctagcccaggctatcggtccgtgagggaaagaacaagtacttctggcacccaccgcgatcgagaagactccaagtttcgcaggacacggcctctggaatgtcaggacgcccttgaaacggcagctcgggcagaagggctgagcctcgacgcctcaatgcattcccagctgcgcatactcgacgaggaacatccaaaggggaaatatcaccacggtctgtctgcactcaaaccaataaggactacatcaaaacaccagcatcccgtggataatgccggattattttcatgtatgacctttagctggctgtctagccttgcccgtgttgcgcacaaaaagggagaactgagcatggaggacgtctggtccctgtccaagcatgagtcctcggatgtcaattgtcgcaggcttgaacgtctgtggcaagaggagctgaacgaggttggtccagatgccgcttccttacgcagggtggtgtggattttttgtaggactcggctcattctttccattgtgtgcctgatgattacccagctggctgggttcagtggcccacccagtttcggggactgtagcatctctgccgaagtgtgcggaaatcgcctccactgcaccgccatcctgttgtcctgtttcacctag

SEQ ID NO: 215423 - DNA, 696 bp, Artificial Sequence
  Description of Artificial Sequence: Synthetic coding sequence
atgaaggacatcgacatcggcaaagagtacatcataccatcccctgggtacagaagtgtgcgggagaggaccagtaccagcggcacccaccgggatagggaagactctaagttccgcaggacacgtcctctggagtgccaagatgcactagagactgcggctagagccgaagggctgagcttagacgcttccatgcacagccaattacgcattttagatgaggaacatcctaaaggcaaatatcaccacggtctgtccgctttgaaaccaataagaaccacctccaagcaccagcaccccgttgataacgctggcctgtttagctgtatgacatttagctggctgagctcactcgcaagggtcgctcacaagaagggcgagttatctatggaagatgtttggtctctcagtaagcatgaaagttctgatgtgaattgccgcaggttggagcgcttgtggcaggaggaactgaatgaggtggggcctgatgcagcaagtctgcgcagagtcgtctggatattttgtaggactagactgatcctgtccatcgtgtgcctcatgattacccagctggctggcttctcagggccagtgagtagcaatcaccccttccgtcagtcacctggcgctcgaccccgtccagccttgacactgttgttttgctgcaggggctgcgcccagctatgggccaggtag

SEQ ID NO: 215424 - DNA, 444 bp, Artificial Sequence
  Description of Artificial Sequence: Synthetic coding sequence
atgaaagacatcgacatcgggaaagaatacatcataccttccccaggctacaggtctgtgcgcgagaggaccagcacatctggaactcaccgcgacagagaagactcaaaattcaggcgcacacggccacttgagtgtcaagatgctctcgaaaccgcagcgagggccgagggtttaagcctggacgcaagcatgcattctcaacttcgaattctagatgaggaacatcctaagggcaagtaccaccatggcctctccgccctgaagcctatcaggaccaccagcaagcatcagcacccagttgacaatgctggcctattttcgtgcatgactttttcctggctttcttctctcgccagagtggcccataagaaaggggaattaagtatggaggacgtctggagtctgagtaagcacgagagctctgatgtcaactgccgttag

SEQ ID NO: 215425 - DNA, 639 bp, Artificial Sequence
  Description of Artificial Sequence: Synthetic coding sequence
atgaaagatatcgacatcggtaaggaatatataataccctcccccggatataggtcagtgagggaaagaacgagcacctccggcacccatagagatagggaggatagcaagtttcggaggacacgaccattagaatgtcaagacgctctcgaaacagctgcacgagcggagggtctctctctggatgctagtatgcattcccagctgagaatcttggatgaagaacaccctaagggaaaataccatcacggtctaagcgcactgaaacccattcgaacaacttcaaagcatcagcatcccgtggacaatgctggtcttttttcatgcatgacgttcagctggctatccagcctggctcgtgtggcacacaagaagggagagctgtccatggaggacgtttggagcctatctaagcacgagagctctgacgtgaattgcagacgtttggaacgcctgtggcaggaggagctaaatgaggtgggaccagacgctgcttcactccgccgagtcgtctggatcttctgcagaacaaggctcatcttaagcatagtctgcctaatgatcacgcagctggccggattctctggcccactagcctggtgctgtcaggatttggacctcggcggtgtgtctctgtag

SEQ ID NO: 215426 - DNA, 1530 bp, Artificial Sequence
  Description of Artificial Sequence: Synthetic coding sequence
atgcagtcctggagcagggtgtactgctcgttggccaagaggggccacttcaacagaatttctcatggcctccagggcttgagtgccgtgcctttacggacgtacgccgatcaacccattgatgccgacgtaactgtgattggctccgggcctggtgggtacgtcgctgccatcaaggctgctcagctaggttttaagaccgtgtgcatcgagaagaacgagacccttggcggaacatgcctgaatgttggctgcatcccctctaaagccctgctgaacaactcacactattatcacatggcccatggcaaagattttgccagtcgtggcatcgagatgagtgaggtaagactcaacctggataaaatgatggagcaaaaatctacagccgtgaaggccctgacaggaggaatcgcacacttgttcaaacagaacaaagtggttcatgtgaacggttatggaaaaattacagggaagaatcaggtgactgctaccaaggcggacgggggtacccaagttatagatacaaagaatatcctgatcgccacagggagcgaagtcacaccttttcccggtattacaattgacgaagataccatagtcagctccactggcgcacttagcctgaaaaaagttcctgagaagatggtggtgataggagccggagtgattggcgtggaactggggtctgtttggcaacgcctgggtgccgacgtcaccgccgtggagttcctcggtcatgtcgggggagtgggtatcgacatggaaatctctaagaacttccagaggatcctgcagaagcagggctttaaatttaagctaaacaccaaagttacgggtgcaaccaagaaatctgacggaaaaattgatgtaagtattgaggccgcttctggaggcaaagccgaagttataacctgtgacgtgctactcgtttgcatcggtcgacgcccttttacgaagaatctggggctcgaggagttaggcattgaacttgatcctcggggtcgcattccagtaaacacgaggttccaaacaaagataccgaacatttatgcaataggagatgtggtggctggaccaatgcttgcccacaaggccgaggacgagggcatcatttgtgtcgagggaatggcagggggtgctgtccacatcgactacaactgcgtccctagcgtgatctacacgcacccagaggtcgcttgggttggcaagtctgaagaacaactgaaggaggaaggcattgagtacaaggtcggtaagttcccttttgccgcaaattctcgagccaaaaccaacgctgacactgacgggatggttaaaatcttgggccagaagtcgacagatagggtcctcggcgctcacatcctgggtccaggagccggagagatggtgaatgaggctgctctggctttagaatatggagcatcatgtgaggatatcgccagggtgtgccatgctcacccaacactgagcgaggctttccgggaggcgaatctggctgcatctttcgggaaatccatcaatttctag

SEQ ID NO: 215427 - DNA, 4512 bp, Artificial Sequence
  Description of Artificial Sequence: Synthetic coding sequence
atggccgctcccgctgagccctgcgctggccagggagtctggaaccagacagaaccggaacccgctgccacatccttgctgtctctatgctttctgcgcacagctggcgtgtgggttccaccaatgtacctttgggtactcggcccaatctacctgctgtttattcatcatcatgggcgaggctacctgcgcatgagtcccctgttcaaggccaaaatggttctgggattcgctctgatcgtgctgtgtacctcttcggtggccgtagccctatggaaaattcaacagggaaccccagaggcccctgaattcctcatacaccctacagtgtggctgacaaccatgagctttgcagtttttctgatccatactgaacgtaaaaagggggtacagtccagcggggtgctctttgggtattggctgctgtgttttgtcctgcctgctacaaatgccgcacaacaagcaagtggagcaggattccagtctgatcccgtcagacatctctctacctacctatgcctgagtcttgtcgtagcacagttcgtgctcagttgcctggccgatcagccacctttcttccccgaagacccccaacaaagtaacccatgtccggaaacaggggcagcatttccgtcgaaggccactttctggtgggtgagtgggttggtctggcgcggttacaggcggcctctgagacccaaggacctgtggagtttggggcgagagaatagcagtgaagagctggtgagtcgcctcgagaaagaatggatgcggaatcgcagtgccgctcgcagacacaacaaggccatcgcattcaagcggaaggggggatctgggatgaaagcccctgaaacggaaccttttctgcgacaggaagggagccagtggaggcccctcctaaaggccatctggcaagtgtttcactctacctttcttctcggaactctgagcctcatcatcagcgatgtctttcggttcacggtgcccaaactcctctcactctttctcgaatttatcggcgatcctaaacccccagcatggaagggatacttattggctgtactaatgttcctgtctgcttgcctgcagaccctattcgagcagcagaacatgtatcgactgaaggttctgcagatgcggctccgaagcgccataaccggattggtgtaccgcaaagtcttagccctctcttccggctcacgaaaagcctcagccgtaggagatgtggtcaatctggtcagtgtggacgtgcagaggctgaccgagagcgtgctgtacctgaacggactgtggctgccactggtctggatagtcgtgtgcttcgtgtacttatggcagctgcttgggccatctgcactgacagctatcgccgtgttcctgtccctcctcccgctgaatttctttatcagtaagaagcggaaccaccatcaagaggaacagatgcggcaaaaagactccagagcgcgtcttaccagttctatcctgcgcaatagtaagaccatcaagttccatggctgggagggcgctttcctggatcgggtcttaggcatcagaggacaggagctgggagcgctgcgcacctcaggtctgctcttttctgtcagtctggtaagcttccaggtgagcacattccttgtggccctggtcgtgttcgcggttcacaccttagtggctgaaaatgccatgaatgccgagaaggctttcgtgacgctgaccgtgctcaatatattgaacaaggcccaagcctttcttcctttctctattcactctcttgttcaggccagagtgtcattcgataggctggttacattcctctgcttggaggaagtcgatccaggtgtggtggattcatcctcaagtggcagtgctgccggaaaggattgcattaccatccacagcgccaccttcgcgtggtctcaggagtctcccccttgcctgcacagaataaacttaactgttccgcagggctgcctgctggctgtggtggggcctgtgggagcagggaagagttccctgctatctgccctgctcggcgagctgtccaaagtcgaaggcttcgttagcatagaaggggcagtggcttacgtgccacaggaagcctgggtgcagaacaccagtgtggtggagaacgtttgttttggtcaggagctggatcccccatggcttgagcgcgtgcttgaggcatgcgctctccagccagacgtggattccttccctgagggaattcacacttcgatcggtgagcaggggatgaatctgagcggcggtcaaaagcaaagattgtccctggctcgggcagtgtacagaaaggctgcggtgtacctactcgacgaccccctggcagctcttgacgctcacgttggtcaacatgtttttaaccaggttattggacccggtgggctgctgcaaggcacgacgcggattctggtcacacatgcattgcatatcttaccccaggccgactggattatcgtcctggccaacggagcgattgctgagatggggtcctaccaggaattactccaacgaaagggagcgctaatgtgcctgctggaccaggcccgtcaacctggggatcggggagaaggcgaaaccgaaccaggcactagtacaaaagatccccgaggcacatctgcaggcagaaggcctgagctgcgaagagagagatcaatcaaatcggtgcccgagaaggaccggacaacgtcagaggctcagaccgaggtgccattagacgaccctgatagggccggttggcctgctggaaaggactcaatccagtacggaagggtgaaagcaacagtgcatcttgcttatcttcgcgcagtggggacgccattatgtctttatgccctcttcctatttttatgtcagcaagtggcgtctttctgcagaggctactggctctctttatgggctgatgatccagcagtgggtggccagcagacccaggcagccttgagggggggaatatttgggctcttgggctgtctgcaggcaattggcttatttgcctcgatggctgctgtgctcctgggcggagccagggcttctcggttattgtttcagcgattgctttgggacgtggttcgctcccctataagttttttcgagaggaccccaattggccacttactgaatagattctcgaaggaaacagacacagttgacgttgatatccccgataaactgagatcccttctgatgtatgcctttggactgcttgaggtctcactcgtggtagctgtcgctacgccactggccaccgtcgcaattcttccactgtttctcctatatgctggcttccagtccctctatgtagtgtcgagctgtcagcttcgcagactggagtcagccagctatagctccgtctgcagccacatggcggaaaccttccaggggagcacagtcgttagggctttccgaacccaggccccatttgtggcccagaacaacgccagggtagatgaatctcagcggatatctttcccccgactggtggcggatcgctggctcgccgcaaatgttgaacttttgggaaacggattggtgtttgccgcagctacctgtgcagtgctaagcaaggcgcacctgagtgcaggactcgtcgggttctctgttagtgccgctctccaggtgactcagacccttcagtgggtggtgaggaattggacagaccttgaaaactccatcgtgtcagtagaacgaatgcaagactacgcttggaccccaaaggaggctccctggcgcctgccgacgtgcgcagcacagcctccctggccccagggaggccaaatagagttccgggactttgggttgagatatcgcccagagctgccgctggctgtgcagggggtgtctttcaagatccacgctggggagaaagttggcatcgtcgggagaacaggtgcaggtaagagctctcttgccagtggactgctacgattacaggaggctgccgaggggggtatttggattgacggggtgccaattgcacacgtgggccttcacactctcaggagccggatttcaataattccacaggaccctatcctcttccctggctcacttagaatgaacctcgatctgctacaggagcacagcgatgaggccatttgggctgctttggaaacagtgcagctgaaagcgctggttgcgtctctgcctgggcagctgcagtataaatgtgccgataggggagaagacttgagcgtaggccagaaacagctgctgtgcctggcaagggccctgttaaggaagacacagatcttaattctggacgaagccactgctgctgtagatccgggaactgaactccagatgcaggccatgttggggagctggtttgcccagtgcacggtcctgttgattgcacacagactcagaagtgtaatggattgtgccagggtgctggtaatggacaaggggcaggtcgccgaatctggaagtccagcacagcttctcgcacagaagggactattttatcgattggcacaagaatctggcctggtctag

SEQ ID NO: 215428 - DNA, 2616 bp, Artificial Sequence
  Description of Artificial Sequence: Synthetic coding sequence
atggctgcccctgcagaaccttgcgctggacagggggtgtggaaccagactgagccagagcctgctgcaacctccctactgtctctgtgtttcctgaggaccgctggcgtttgggtgccgccaatgtatctatgggtcctggggcctatatatttactgtttatccatcatcacgggcgtgggtatctccgcatgagcccactcttcaaggcaaaaatggtactggggttcgcgctgatagtgctgtgtacaagcagcgtcgccgtggccctgtggaagattcagcagggaacccccgaggcccctgagtttttaatccatcctaccgtatggctgaccacgatgtcctttgcggtctttctaatccacaccgagaggaagaagggggtccagtcctcaggggtgctgtttgggtactggctgctgtgcttcgtgctcccggcaaccaatgctgcccagcaggcctccggagctggtttccagtccgacccagtgagacacctctccacctacctctgtctatccttagtagttgctcagttcgtccttagctgcctggctgaccagcccccattctttcctgaagaccctcaacagtcgaatccctgccccgaaactggcgctgcttttccttcaaaagccaccttttggtgggtgagcgggctggtatggcgagggtatcgccgtccgctgcgcccaaaagatttgtggtcactgggaagagagaattcctcagaggaactggtctcaagacttgagaaagagtggatgcgaaacaggagtgccgcacgccgtcacaataaggctatagcctttaaaaggaaggggggttccggaatgaaagccccagagacagagccctttttacggcaggagggaagtcagtggcgtccactcctgaaggccatctggcaggtcttccattccacattccttctgggtactctaagtctcatcatttctgacgtgtttagattcactgtacccaagttgctctctctcttcctggagtttatcggagatcccaaaccccctgcatggaaggggtacctgctggccgtgctcatgttcttgtccgcttgcttacagacattgtttgaacagcagaacatgtatcggctgaaggtgctacagatgagacttaggtccgccatcacaggcctggtttaccgcaaggtgctcgcactgagcagcggaagcagaaaggcttcggccgtcggagatgttgtgaacctggtctccgtggacgtccaaagattgactgagtccgtcctctatctgaatggcctctggctcccactcgtgtggatcgtcgtgtgttttgtctacctctggcagttattaggcccatctgcattgaccgcaatagcggtttttctctcactgcttccactgaatttcttcatatcaaagaagcggaatcaccaccaggaggagcaaatgcggcagaaggacagtcgcgctagactcacaagttcaattctcaggaattcaaaaacaataaagttccacgggtgggaaggcgcattccttgatcgtgtgctggggattcgcggacaagagcttggcgctttaaggacatccggtctgctcttttccgtttcacttgtcagcttccaagtctcgacttttctcgtggctcttgtggtcttcgctgttcacacgctggtagcagagaacgccatgaacgccgagaaggcattcgtgactctcactgtgctcaatatcttaaataaagcacaggcttttttgccgttctctattcacagtctcgtacaggctcgcgtgagcttcgatcgcctagtcaccttcctctgcctcgaagaggtggatccgggtgtagtggattcttctagcagtggctctgccgctggtaaggactgcataaccattcacagtgccacctttgcctggagtcaggagtcacccccttgtcttcacagaatcaatctgaccgtgccccagggttgtttgttagccgtggtcggccctgtgggcgctgggaagtcgtctctcctttccgcactgcttggggagctctcaaaggttgagggctttgtctcgattgagggggctgtggcttacgtgccccaggaagcatgggtccaaaacacgtctgtggtggaaaatgtgtgcttcggacaggagcttgacccaccctggctcgaacgggtgctcgaggcgtgcgctctgcagcccgacgtggatagctttcctgagggtatccacacctccattggcgaacagggcatgaatctgtcagggggtcagaagcaacggctgtccctggccagagcagtctatcgaaaagcggcagtgtatctcctcgacgatccccttgccgcacttgatgcccatgtgggacagcacgtgttcaatcaagtgataggccctggcggactgttgcagggcacaaagcagaacctgggccctgctccacggactcccgaggcaccactgcaggccggagggccttcattggacgcacgcggaccgtcttctcaatcacttagacggaccgtccccttgcagaaacccaggcaacggtttctgtggatgacgctcaccgggcaggacgggcagcaggagcgaacggcttcaaataccgccggatag

SEQ ID NO: 215429 - DNA, 2019 bp, Artificial Sequence
  Description of Artificial Sequence: Synthetic coding sequence
atggctgccccagcagaaccatgtgcagggcagggggtatggaaccagacggaacctgagcctgccgctacctctctgttatcactctgtttcctccggacagccggtgtctgggtcccacccatgtacctgtgggtactggggcctatctacttgctgttcatccatcatcatggacgcggatacctgcgaatgtctccgctctttaaggccaagatggtcgcggcaattccaggaagcctcgagcccggaaacgttttaggatttgccctgatagtgttgtgcacctcgtcagtggccgtggccctctggaagatccagcaaggaaccccagaggctcccgagtttctgatccacccgactgtttggctgactacaatgagtttcgcagtcttcctcattcatacagagcgcaagaaaggagttcagtcctccggggtgctctttgggtactggctgttgtgtttcgtgcttccagcaacaaatgccgcacagcaggccagcggagcaggtttccagtccgatccagttagacatttgtctacgtatctctgcctatcattggtggtagcccaattcgtgctgagctgcctggccgaccagccccctttcttcccggaggacccacagcagtctaacccctgccccgaaaccggagccgctttccccagtaaggcgaccttttggtgggtgtccggactggtttggagggggtataggagacccctccggcctaaagacttatggtccctcggtcgggaaaactcatccgaagagcttgtgagtagacttgagaaagagtggatgcgcaatcggagtgctgctcgccgacacaacaaggccattgcatttaaacgcaagggagggagcggaatgaaagcccctgagacagaaccattcctgcgccaagaggggagccagtggcgaccactgttgaaggcgatttggcaagtgttccactcaacctttctgttgggcactctctcccttatcatctcagatgtgtttcgcttcacagtgcccaagctcttgtctttgtttttggaatttatcggcgaccctaagccccctgcttggaagggttacctgctggctgtgttgatgttcttaagtgcctgtctccagacgctgtttgagcagcagaatatgtaccgacttaaagtgttgcaaatgcggttaaggagtgccatcaccgggttggtgtatcgaaaagtgctggctctgtccagtggctctaggaaggcttccgccgtgggggatgtagtgaatctcgtgtccgtggatgtgcagcgattaactgagagcgttctgtatcttaatggtctctggttgcctctggtgtggattgtggtttgctttgtgtatctgtggcagctgttaggacctagcgcgctgacggctatagctgtcttcctctcactgctgccactgaatttttttatctctaaaaagcggaaccaccatcaggaggagcagatgcgccagaaggattccagggccagactcacatcctccatactccgtaactctaaaaccattaaatttcacggatgggagggcgcatttctggaccgtgtgttagggatccggggacaagaactgggagcactgaggacctcgggcctgctgttttcagtaagtctcgtttcatttcaggtgagcactttcttagttgcgctggttgtcttcgccgtgcatactctggttgcagagaacgccatgaatgccgaaaaagcatttgttactcttaccgtgctgaacatcctcaataaggctcaggcatttttgcctttttccatccacagtctggttcaggccagggtatcttttgataggctggttaccttcctgtgtttagaagaagtcgatcctggggtagtcgactcttccagctctggaagtgccgcaggcaaggactgtataactattcactcagctacttttgcttggagtcaagagtcccccccatgcctgcacagagtgctcttgtaccacgcaggctggagtgccatggcctag

SEQ ID NO: 215430 - DNA, 4650 bp, Artificial Sequence
  Description of Artificial Sequence: Synthetic coding sequence
atgtcgctgagtttttgcggcaataacatctcctcttacaacattaatgatggtgtgttacagaactcatgcttcgtcgacgcgttgaacctagttcctcacgtcttcctattatttattacatttcccattctgttcatcggatggggttcccaatctagtaaagttcagattcaccataacacatggctgcattttcccggacataacctccgctggattctcactttcgcccttcttttcgtccatgtgtgtgagatagctgagggcatcgtctctgattccaggcgggagtctcgccacctccacctgttcatgcccgctgtaatggggttcgtcgccactactacctcgatcgtttattaccacaatattgagacatctaacttcccgaagctgctccttgcgttgtttctttattgggtcatggctttcataactaaaaccatcaagctggtgaagtattgtcagagcggattggatatcagtaatctccgcttttgtatcaccgggatgatggtgattttaaatggtcttctgatggcagtcgagattaatgtgattcgcgtgcggaggtacgtgttttttatgaacccacagaaagttaagccacctgaagaccttcaggatttaggcgtgcggtttctgcaacccttcgttaacttgctgagtaaggccacctactggtggatgaacacactcatcatctccgcccacaagaagccgatcgacctgaaagcaataggcaagctgcctatagcgatgagggcagtgactaattacgtgtgtcttaaggacgcatatgaggagcagaaaaagaaggttgccgaccacccaaaccgcactccttcaatctggctggcaatgtacagggccttcggtcgccctatactgctttcgagcacgtttcggtacctggcagacttattaggattcgccggtccactttgcattagtgggatagtgcagagggtgaatgagacccagaatggtacaaataacaccacaggtatcagcgagacgctatcttcaaaagaattccttgaaaatgcatacgtcctcgctgtcctgctattcctcgcactgattctgcagcgaacatttctgcaggcatcttactacgtgacaattgaaacaggcatcaatcttcgtggcgcacttttggccatgatttataacaagatactccgcctcagtacatctaacctcagcatgggagagatgacactcggacagatcaacaacctggtggctatagaaaccaaccaactgatgtggttcttattcctatgcccaaacctctgggcaatgccagtgcagattatcatgggtgtcatcctgttatataatttgctgggtagcagcgccctggtgggggcagctgtcattgtgcttttggctccaattcagtacttcatcgccaccaagctcgccgaggcgcagaaatcaactctggattacagcacagagcgactcaaaaagacaaacgaaattttaaagggtataaagttgctgaaactctatgcctgggagcacatcttctgcaagtccgtcgaagagacaaggatgaaagagctgtcctctctcaagaccttcgcactctatacttccctgtccatcttcatgaatgccgctatcccaatcgcagctgtgctcgccacttttgtgacgcacgcgtacgcctccggaaataacctgaagcccgcagaggcctttgcctcattgagcctgtttcacattctcgtaacccctctgtttctcctgagtacagtggttagatttgctgtcaaagctattatttccgtacagaagttaaacgagttcctgctctccgatgagatcggcgacgacagttggagaactggagaaagctcactgcctttcgagtcctgcaagaaacacacaggcgtgcagccgaagaccattaatagaaagcaacctggccgttatcacttggatagctacgagcagtctactcgccgtttgcgcccagccgagacagaagacattgctatcaaggtgactaatggctatttctcatggggcagcggacttgcaactctgagcaacatcgatatacggatacccacaggtcagctgaccatgattgtcggtcaggtgggttgcggaaaatcgtctctgttattagcgatcctcggcgaaatgcaaaccctggaggggaaggtgcactggagcaacgtcaacgagtcagaaccttcattcgaagccacccgctccagaaatcgatacagtgttgcttatgcagcccagaaaccttggctcttaaacgctaccgtggaggagaatatcacatttgggtccccatttaataagcaaaggtataaagccgttacagatgcatgtagtttgcagcctgacatcgatttgcttccatttggcgatcagaccgaaattggggagcggggaataaatctgtcgggagggcagcgacaacgcatctgtgtagccagagcgttgtaccaaaacactaacattgtatttttagatgatccttttagtgccttggacattcatctgagtgaccatttgatgcaggagggaatactaaagtttctccaggatgataagcgcacgctggtgctggtgacccacaagcttcaatacctgacacatgccgactggataatcgcgatgaaggatggcagcgtgctccgggaaggcacactgaaggacattcaaaccaaagatgttgaactgtacgaacattggaagactctgatgaacagacaagatcaggaactggaaaaagatatggaggcagaccaaaccaccctcgaacggaagaccctgcggagggccatgtattcccgggaagccaaggctcagatggaagatgaagacgaagaagaggaggaggaggaggatgaggatgataatatgtccactgtgatgcgtttacgcaccaagatgccgtggaaaacttgctggcgttacctgacgagtggcggttttttccttctgatactaatgatcttttctaagttgctcaagcattccgtcatagttgcgattgattattggctggctacctggacatcggaatatagtataaataatactggcaaggctgaccagacttactacgtggccggattttctatcttgtgcggcgcaggcattttcctgtgcctcgtgacctccctgacagtggagtggatgggactgacggctgccaagaatctgcatcacaacctgctaaataagataatcctaggtccgattaggtttttcgacaccacgcccctcggacttatcctcaacaggttcagtgcggacacaaatatcatcgaccaacatataccccctactttggagtctttgactaggagcacgcttctttgtctgagtgcgatcggcatgattagctatgctacccctgtattcctcgttgctctcctcccgttaggtgttgcattctacttcatccagaaatactttagagtagctagtaaagatctgcaggaactggacgatagtacacagctgcctctcttgtgccacttcagcgagactgctgaaggactgacaacaatccgagcctttagacacgagacaaggttcaaacaacggatgctggaactgaccgatacaaacaatattgcttacctctttctttcagccgctaaccggtggttggaagtgagaacagactatctgggggcatgcatagtgctcaccgcttctatcgcctctatttccggctccagcaacagcggtctggtgggactgggtctactgtacgctctgactatcacaaattacttgaattgggtggttcgcaatttggcagacttggaggtccagatgggtgcggtgaagaaagtgaacagttttttaaccatggagtcagagaattacgaaggcacaatggatccatctcaagtccccgaacactggccacaggagggtgagattaagatacatgacctgtgcgtgcgttacgaaaacaatctgaagcccgtcctgaaacacgtaaaggcatatatcaaacccggacagaaggtcggtatctgcggtaggaccgggtccggcaaaagtagcctttcgttggccttttttcgtatggtcgatatttttgatggaaagatagtcattgatggaatcgatatcagtaagctgccattgcacactctgcgctcgagattaagtattatactgcaggacccgatcctgttctctgggtcaataagattcaatctggatcccgagtgcaagtgcaccgatgatcgtctgtgggaggccctcgagatcgcccagctaaaaaatatggtgaagagcctgcctggcggactggacgcagtggttacagagggaggtgagaatttctctgtcgggcagaggcaattgttttgcttggcccgtgcttttgtgcggaaatcaagcatactgatcatggacgaggccacagcatcaatcgatatggctaccgaaaatatactgcaaaaggtagtgatgaccgcttttgcggatcgcacagtggttactattgctcaccgggtgcataccatcctgacagctgacttagtcattgtgatgaagcgcggtaatatccttgagtatgatacaccggagtcattgttggctcaggagaacggagtgttcgcaagtttcgttagagcggatatgtag

SEQ ID NO: 215431 - DNA, 4650 bp, Artificial Sequence
  Description of Artificial Sequence: Synthetic coding sequence
atgagcctctccttttgcggtaataacatatcttcctataacatcaacgacggggtgctccagaactcttgcttcgtcgatgctttgaacctggttccacacgtgtttctcctgttcataacctttcccatactgtttattgggtggggatcccagagttccaaggtgcaaatccaccacaatacctggcttcactttcctggacataatctgaggtggatcctcacatttgcactgctgtttgtgcacgtttgcgagattgccgagggaattgtatccgatagccgccgagagtcaaggcacctgcatctcttcatgcctgctgtgatgggtttcgtcgctacgacgacatccatcgtgtattatcacaatatcgaaacgtccaacttccctaagctgctgctggctctctttctgtattgggtcatggcctttatcacaaagacgatcaagctagttaaatactgtcagtcggggttggacatatcaaacctgcgcttctgcatcactggcatgatggtgattctgaatggattgttgatggccgtcgagatcaacgttatccgggttcgccgatatgtgtttttcatgaatcctcaaaaggtaaaaccgccagaggatcttcaggatctcggggttagatttctgcagccttttgtaaatctcctatctaaagccacttattggtggatgaacaccctaatcattagtgctcacaagaagcccattgatctgaaagccatagggaagcttcccatagctatgcgagctgtgaccaactacgtttgcctcaaggatgcctatgaagagcagaaaaagaaagttgcagatcacccaaaccggaccccctcaatctggctggctatgtatagggcatttggccgtccgatcttgttaagtagtaccttccgttatttagcagatctgcttggtttcgccggtcccctctgcattagcggcatcgtccagcgcgtgaatgagacccagaatggcactaataatacgactggcatttcagaaactctatcttctaaggaattcctggaaaacgcttacgtactggccgtgcttctcttcttggccttaatcttgcagcgcacgtttctgcaagctagttattacgtgacgatcgagaccggcatcaacttgcgcggagccctgctagcaatgatctataataaaatactgagactgtccacctctaacttgtcgatgggagagatgaccctgggacagattaataacctggtggctatcgaaacaaatcaactgatgtggtttctgtttctctgtccaaatctgtgggccatgcccgttcagatcatcatgggagtgatattactgtacaacctcctcgggtccagcgccctggtcggtgcggctgttattgtgctcctcgcccctatacagtactttatcgccacaaaattagcagaggcacagaagtcaacacttgactacagtaccgagcggcttaaaaaaaccaatgagatcttgaaaggaattaagctgttaaagctctacgcatgggaacatatattttgcaagtccgtggaagaaacccgaatgaaagagttaagttccctgaagacctttgctttatatacctccctcagcatcttcatgaacgccgctattccgatcgccgcagtcctggccacctttgtaactcacgcctatgctagtggcaataaccttaaaccagccgaggccttcgctagtctgtccctgttccacattcttgttaccccgctctttctcctatcaactgttgtgcgcttcgccgtgaaggccattatttccgttcaaaagttgaacgagttcctattgagtgatgagattggagatgatagttggcgcactggggaaagcagccttccgttcgagagctgtaagaaacacaccggcgtgcaaccaaagacgattaaccgcaaacagcctggacggtatcatctcgacagttacgagcaaagcacaaggcgcctccggccagctgagacagaggacattgccattaaggtgacaaatggctattttagttggggctccggcctcgccaccctttctaatatagatattagaatccccactggtcagctgacgatgatcgtaggacaggtggggtgtggaaagtcctccttacttctcgcaatacttggcgagatgcaaaccttagaagggaaggtacattggagcaatgttaatgagtccgagccaagctttgaagcaacacggagcaggaatagatactcagtggcatacgcggctcagaaaccgtggcttctcaatgcaacggtggaggagaatattacctttggctccccatttaataagcagagatataaggccgtaacggatgcttgctccttacaaccagacatcgacttgcttccattcggggaccagacggagattggagagcgcggtattaaccttagtgggggacagagacagagaatctgtgtggcaagagccctttatcagaatacaaatattgtgtttctggacgaccctttttcagctctcgacatccatctctctgaccatctgatgcaggagggaatccttaagtttctccaggatgataagagaacactggttcttgtaacacataagttacaatacctcacccacgcagactggatcattgccatgaaagacgggtccgtgctgcgagaaggtactctgaaagacattcaaaccaaagacgtggaattgtacgagcattggaagacgctgatgaataggcaggaccaagagctggagaaggacatggaagccgaccagactacactagagaggaaaacacttaggcgggctatgtattcccgggaggctaaggctcaaatggaggatgaagacgaggaggaggaagaggaagaggatgaggatgataatatgtcaactgtgatgaggctgagaacaaaaatgccttggaagacttgttggcgataccttaccagtggcggttttttcctcctgattctgatgattttttccaaactgctgaagcatagtgtgatcgtggccatagattattggctggccacctggacaagtgagtactcgattaacaacactgggaaggccgaccagacgtattatgtggctggattctcaattctttgcggtgcaggtatcttcttgtgcctggtcacaagccttacagtggaatggatgggactcaccgccgctaaaaatctgcatcacaatctcttgaacaagatcattctgggccctatcaggttttttgacactactcctctcggacttatcttaaaccgcttctcagccgatacgaacatcatcgatcagcacatcccccctacactggaatcactgacgagaagcactcttctctgtctctcagctatcggaatgatttcttatgcaactcccgtgtttctcgtagccttactacctttaggcgtggccttttactttatccagaagtatttccgggtagcttcaaaggacctccaggagcttgacgactctacccagctccctctgctgtgccacttcagcgagacagccgagggactgacgaccattagagcattcaggcacgaaactcgctttaagcagcggatgctcgagctgacagatacgaacaacattgcttacttgtttctcagcgcagccaacagatggctcgaagtgcggaccgattatttaggcgcatgcatagtattgacggcctcaatcgcgagtatctctgggagttcaaattcaggtctcgtgggcttggggttactctacgccttaacgattaccaattacctgaattgggtcgtgaggaacctggccgacttggaggttcagatgggggctgtgaaaaaggtgaacagttttctcacaatggagagcgaaaattacgaggggaccatggatccaagccaggttcccgaacactggccacaggaaggagagatcaaaatacacgacttatgtgtccgatatgaaaataacctcaagccagtgctgaagcacgttaaggcctatataaaaccaggccagaaggttggaatttgtggtcggactgggagcggcaagtcctcgctgagcttggcctttttcagaatggtagacatctttgacgggaaaattgtgatcgatgggatcgatatttcaaaactgccactacatacactacggtcacgattgtctattatacttcaggatccaattttgttctcaggctcaataaggttcaacctcgatcccgaatgcaaatgcaccgacgacagactgtgggaggctctggagatcgctcagctgaagaacatggtaaagtcattgccagggggtttggacgcagttgttactgaagggggagagaatttctcggtcgggcaaagacagctcttttgtttggcgcgagcctttgttcgaaagtcctcaattttaatcatggatgaagccacggcatcaatcgacatggcgacagagaacattctgcagaaagtggtcatgaccgcgtttgccgacagaaccgtcgtcaccatcgcgcacagggtcagcagcatcatggacgccggtttagttctggtgttctcagaagggatcctcgttgagtgcgacacggtgcccaacctccttgcccataaaaacggactgttttctaccctcgttatgacgaacaagtag

SEQ ID NO: 215432 - DNA, 450 bp, Artificial Sequence
  Description of Artificial Sequence: Synthetic coding sequence
atgagcttgtctttttgtgggaataatatttcaagttacaacatcaatgacggggtgttgcagaactcttgcttcgtcgatgccctcaatctcgtgccccacgtctttcttctctttatcacttttcctatcctatttattgggtggggctctcaaagctctaaggtgcaaatccatcacaacacttggctgcatttccccggacacaacctgcgttggattttaacgttcgctctgcttttcgtccacgtctgcgaaatcgccgaaggtatcgtgtccgacagccgacgcgagagtagacatcttcatttgttcatgccagccgtgatgggttttgtcgctacaaccacttccattgtgtattatcataatatcgagacctcaaatttccccaagctcttattgggattcagccatcacgagtcaaagtcttgctatcagcatagttag

SEQ ID NO: 215433 - DNA, 4542 bp, Artificial Sequence
  Description of Artificial Sequence: Synthetic coding sequence
atgtccctgtcattctgcggcaataacataagttcttataatatcaacgatggagtgcttcagaactcctgcttcgttgacgctttaaatttggtgcctcatgtgtttttgttattcattaccttcccgattctttttattgggtgggggtcccagagctctaaagtgcagatccaccacaatacgtggctccacttccccggacacaatctcaggtggatactgacttttgccctactatttgtccacgtgtgcgaaatagctgaggggatcgtgtccgattctaggagggagtcgcgacatttacatcttttcatgccagcggtaatgggatttgtagcaactaccacctcaatcgtgtactaccataacattgaaacttctaattttcctaagctccttttggccttgttcctgtactgggtcatggcatttatcacgaagacgatcaaactcgtgaagtactgccagtccggacttgatatctctaaccttcgtttctgcataaccggcatgatggtgatcttgaacgggctgcttatggcagtggagatcaatgtcatccgtgtgcggaggtacgtcttcttcatgaacccccagaaggttaaacccccagaggacctgcaggacctcggggttcggtttttgcaaccgttcgtgaacctgctctctaaggcaacgtattggtggatgaatacactgataatttccgcacataaaaagcccatagatctgaaggcaatcggcaaactgccaatagctatgcgggctgttacgaattatgtttgccttaaggatgcctacgaagaacagaaaaagaaagttgctgatcatcctaaccggacccctagtatctggctggctatgtatcgagcctttgggaggcctatcctcttgagctccacctttagatatcttgctgatctcctgggattcgctggccctttgtgcatcagcgggatcgtacagcgggtgaatgaaacacaaaacgggaccaacaatactaccgggatcagtgaaacccttagtagcaaggagttccttgagaatgcttatgtgctggctgtactcctctttctggcattgatccttcagcggacatttctgcaggcaagttactacgtgactattgagacgggcatcaacctcagaggtgcattactggcgatgatttacaataaaatcttacgactgtctacatccaacctgagtatgggggaaatgacacttggccagatcaataatctggttgctatcgaaacgaaccagcttatgtggtttcttttcttgtgccctaacctgtgggccatgccagtgcagattatcatgggcgtaatcctcctttacaatctgctggggtcctccgctctggtgggagccgctgtgatcgtgctgctggcccctatccagtactttattgcaaccaagttggcagaagcccaaaaaagcaccctggattactccaccgaacgcctaaagaaaactaatgagatcctgaaaggaatcaagctccttaagctgtacgcttgggaacatatcttctgcaagtccgttgaggaaacacggatgaaagagctgagttccctgaaaacttttgcgctgtatacatcactcagcattttcatgaatgcggcaattcctatagccgcagtcctggctaccttcgtgacacacgcctatgcatccggcaacaatcttaagcccgcagaggccttcgcttcgctgtctttgtttcacatccttgtcactcccctgttcctcctcagtaccgtggtgcgttttgctgttaaggcgatcatatccgtgcaaaagctgaacgagtttctcttgtctgacgagatcggggacgactcctggcgaaccggagaaagcagtctcccttttgaatcctgcaaaaagcatactggtgtagtcaccaatggttacttttcttggggttcaggtctggccaccctttccaacatcgatatcaggattcccactggccagttaactatgattgtgggacaggtcggatgtggaaaaagctctctgcttcttgccatactcggggagatgcagacactggagggtaaggttcactggtccaatgtgaatgaatctgagcccagctttgaggcaacgagatctcgcaacagatatagcgtagcttacgccgctcagaagccatggcttctcaatgcgaccgtagaggaaaacattactttcggttcccccttcaataaacagcgctataaggcagtgactgatgcctgtagccttcaacctgacattgatctgttgcccttcggagaccagaccgagatcggcgaaagaggaataaatctttccggtggacaacggcagaggatctgcgtggcaagagccctctaccagaatacaaacatcgtgtttctggacgacccgttcagcgccctggatatacacttaagcgaccacctcatgcaggaggggattctgaaattccttcaggacgacaagcggaccctggtgctggtgacccacaagctgcaatacctcacccatgccgattggatcatagcaatgaaggacgggagtgtgctgcgtgaaggcaccctgaaggacatccagaccaaggacgtggaactgtatgagcattggaaaacacttatgaacaggcaggatcaggaacttgaaaaggatatggaagcagaccagacgacgctggagagaaaaacactgcggcgagctatgtactctagggaggccaaggcacagatggaggatgaggatgaggaagaggaagaagaggaggatgaagatgataacatgtcgaccgtgatgcggcttagaactaaaatgccctggaaaacctgctggcggtatctgactagtggaggattctttctgctgattttaatgattttttcgaagctgctaaagcattccgtgatcgtggctattgactactggttagcgacctggacctctgagtattcaataaacaatacaggcaaggccgaccagacctattacgtggcaggcttttctatactctgcggcgcagggatcttcctttgtctcgtcacatctctgaccgtcgagtggatgggtctgactgcagcaaaaaaccttcatcataacctgcttaataagatcatcttgggtccaattcggttttttgacacaaccccgctcgggttaattttgaatcgattttccgccgataccaatatcatcgatcagcacattcccccaaccctggagtcattaacccgatccacattgttatgtctttcagccatcggcatgatatcttatgccacgcctgtctttttggtcgcactgttgccactgggtgttgccttctacttcatccaaaagtacttccgggtcgcatctaaggacttacaagagctggacgactcgacgcagctgccacttctgtgccacttctctgaaaccgctgaagggctgacgactatccgcgcttttcggcacgagacacggtttaagcagagaatgcttgagctgacggacaccaacaacatcgcgtatttattcctgtccgccgctaataggtggctcgaagtgcgaaccgattacctgggcgcatgtatcgtactgaccgcgagcattgcatcaattagcggatcttccaattcaggtttagtcggattggggctgctgtatgcgctaaccattaccaactacctcaactgggtggtgcggaatctggccgacctggaggtacagatgggggcagtgaaaaaggttaactctttcctcacaatggagtcagaaaattacgagggaactatggacccttctcaggtgcctgagcactggccacaagagggggagatcaaaattcatgacctgtgcgtgcggtatgaaaataacctcaagcccgtcctaaaacatgtgaaagcctatatcaagccaggacagaaggtgggcatctgtgggagaaccggaagtggcaagtcttcactgagcctggcctttttcagaatggtggatatattcgatggtaagatagtgattgatggcatcgatatttccaaactgcccctgcatactttgcgctcccgattatccattatcctccaggatccgattctgttctctggatccatccggtttaatcttgacccggagtgcaagtgcaccgatgaccgcctgtgggaggctttggaaatagcacagcttaaaaacatggtgaaatccctgccaggtggcctggacgccgtggttacggagggtggggagaatttctctgtgggacagcgccaactgttttgcttggcacgcgcttttgtgcggaagagcagtatcctgattatggacgaggctaccgcctctatcgacatggccaccgagaacatcctacagaaagtggtcatgactgcattcgccgacagaaccgtcgtgacaatcgcccacagagtgtcctccatcatggacgctggcctcgttctggtcttctctgaagggatcctggttgagtgcgatactgtgcccaacctgcttgcacacaaaaacggcctcttcagtactctggtcatgaccaataaatag

SEQ ID NO: 215434 - DNA, 1386 bp, Artificial Sequence
  Description of Artificial Sequence: Synthetic coding sequence
atgcagagggttaatatgatcatggctgagagtcccggactaattacgatctgtttattggggtatttattgtcagcagagtgtacggttttcctggatcatgaaaatgctaacaaaattctaaatagaccgaagcggtataattctggtaaactggaggagtttgtgcagggaaatctggagcgggaatgcatggaagagaagtgcagctttgaggaagctcgggaggtgtttgaaaatacagaacggactacggagttctggaaacagtatgtagacggggatcagtgcgaatctaatccgtgccttaatgggggttcctgtaaggatgatatcaattcatatgagtgttggtgccctttcgggttcgagggcaagaattgtgagctcgacgtaacttgcaacattaaaaatggtcgctgtgagcaattttgcaagaatagcgccgataataaagtcgtctgtagctgtacagagggatacagactggctgagaatcagaagagctgcgaacccgcagtgccgttcccctgtgggagggtgtctgtttcccaaacatctaagctaacccgcgctgagacagtgttcccagacgtcgattatgtcaatagcacggaagccgaaactatcctcgataacataacacagtccacacagagtttcaatgactttactcgtgttgttgggggagaggacgccaaacccggacagtttccctggcaggttgtcctgaatggaaaagtagacgccttctgcggcggatctatagtcaacgaaaagtggatcgttaccgctgcacattgtgtggagacgggggtcaaaataactgttgtggccggagaacacaacatcgaggaaaccgaacacacagagcagaagcgaaatgtgatcaggataatcccgcatcacaactacaacgctgcaattaataagtacaaccatgacatagccctgttagagctagatgaaccactcgttctgaactcctacgttaccccaatctgcattgctgataaagagtatacaaacatattcctaaagtttgggtccgggtacgtatcaggttgggggagagtgttccacaaggggagatctgctctggtgctccagtacttaagagttccactggtggaccgggcaacctgtctgcgaagcaccaagttcacaatctacaacaacatgttttgtgcagggttccacgaagggggtcgagactcatgccagggcgactctggcggacctcatgtgacagaggtggagggcacatccttcctgaccggaattatttcatggggcgaggaatgcgctatgaaggggaagtacggaatatacacgaaagtgtcccgttatgtaaattggataaaggaaaagaccaaactgacttag

SEQ ID NO: 215435 - DNA, 684 bp, Artificial Sequence
  Description of Artificial Sequence: Synthetic coding sequence
atggatggcaggctgcgtaatcctgaccaaagcctgacggaggacgtcgtggccttcgccgcatctgtcgcgcacctgtactccaaccttacaaagcccttgcttgatgtggccgttaccagctacacactactgagggcggctcgaagccgtggagccggtacagcctggccaagtgccatcgccggattagtggtctttcttaccgccaatgtgctcagagctttttcaccaaagttcggggagttggttgccgaagaagcgaggagaaagggtgaactcaggtatatgcatagtagagtcgtcgcaaattcggaagagatagcattttatggaggccatgaagtagagcttgctctgttgcagcggagctatcaggacctggctagtcagattaatctcattctgttagaacgactgtggtatgtgatgctggaacaattcctgatgaaatatgtatggtcagcgtcaggactgctcatggtggcagtgccgatcattaccgccaccggttatagcgagagcggtgaaactcaggggtccaagcgcattcaggccagaggactgtctcccattcccctcggagccgaattaacacgtgcacagctctcacagccggcagcgcacttctgttgtcgcggtcaccgtggccctgccgcaagcctagatgcgtttaggggctag

SEQ ID NO: 215436 - DNA, 672 bp, Artificial Sequence
  Description of Artificial Sequence: Synthetic coding sequence
taactgttctccaccgtcgctgcccctttttatctgcctgcttccagcgtgggagggttccacctcttcatcgtggcatctaccgatgctgaggctgtgaaaaaggccgcactagaaaagaaagaggaggaactggtctccgagagaaccgaggcattcaccattgctagaaacctcttgactgctgcagccgatgctatcgaaagaatcatgtcttcttacaaagaggtgaccgagctggcaggttacacggcgagagtgcacgaaatgttccaggtgtttgaggacgtgcagcgctgtcacttcaaacgaccccgagaacttgaggacgctcaggcaggttcagggacgatagggcgatccggcgtacgcgtcgagggcccattgaagattcgaggccaggttgtcgacgtggaacaggggatcatctgtgagaatatccccatcgttacaccgtcaggagaggtggtcgtcgctagcctgaatattcgggtcgaggagggaatgcacctattgataaccgggcctaatgggtgtggcaaaagttcacttttccggattcttggtggtctttggcctacatacggaggggttctctacaagccaccgcctcagagaatgttttacatccctcaacgaccttatatgtcagtggggagtctaagggattag

SEQ ID NO: 215437 - DNA, 2223 bp, Artificial Sequence
  Description of Artificial Sequence: Synthetic coding sequence
atgacccacatgctgaacgccgctgcagaccgtgtcaaatggacacgcagttctgctgctaagcgggcagcttgcctagtcgcggcagcctatgcgctgaaaacactctaccccatcattggcaagcggctgaaacagtccggtcacgggaaaaagaaggctgccgcttatccggctgctgagaatactgagattctccattgtacagaaacaatctgcgagaaaccctcccccggtgttaacgctgacttttttaaacaactcctcgagctgcgcaaaattctgttccctaagttggtgaccacggaaacagggtggctgtgtctgcacagcgtggctttgatatcgcgtaccttcctgtcaatctatgtcgccggacttgacggaaaaattgtgaagtcaatcgtggaaaagaagccaagaaccttcatcattaaactgatcaagtggcttatgatcgcgataccagctaccttcgtgaacagcgcaatcagatatctggagtgcaagttggcactggcttttcgaactcgcctcgttgatcacgcctacgagacctattttaccaaccagacctattataaggtcataaatatggacgggagactggcgaatcctgatcagagtctgaccgaggatattatgatgtttagccaatcagtggcccatctttatagtaatctcaccaaacctatactggatgtcatgctgacctcatataccctgatacaaacggccacctcgaggggggcttcccccattgggccaaccctgcttgcaggcttagtggtatatgctacggcaaaggtcctgaaggcctgttctcccaagttcggcaagctggttgccgaggaagcacatcgcaaaggctatctgcggtacgtacactccaggataatcgccaacgtggaggagatagctttctatagaggtcacaaagtagaaatgaagcagcttcagaagtcatataaagcactagctgaccagatgaacctgatcctctccaagcgtttgtggtacatcatgatcgaacagtttcttatgaaatacgtttggtcctcaagtggactcatcatggtggcaattcctataataacggctaccgggttcgccgatggtgaggatggacagaaacaggtgatggtctctgaacgtacggaagcatttactactgcaaggaatctgttggccagcggcgcagacgccatagagcgaattatgagctcctataaggaagtcacagaacttgcgggatacactgctcgagtttataatatgttctgggtcttcgatgaagtgaagcggggaatctacaaaaggacagcagtcatccaggagtccgagtcacactccaagaacggggctaaagtggaattgccattgagtgataccctcgcaatcaagggcaaggtgatcgatgtggatcacggtataatctgtgagaatgtcccaattataactccagctggggaggtcgtggcttcccgcttgaattttaaggtcgaggaggggatgcatctgctcataactggccctaatgggtgtggcaagtcctccctcttcaggatcctttccgggctttggcctgtgtacgagggcgttctgtataagccacctcctcagcatatgttttacatccctcaacgtccctatatgagtctcgggtctctcagagaccaggtgatctatcccgatagcgtcgacgatatgcacgacaaagggtatacagaccaggacttagaacgtatactacataacgtccatctgtaccatatcgtccagagggaggggggttgggatgctgtcatggattggaaagacgtcctgtctggcggtgagaagcagcgcatgggcatggcacgcatgttctaccataagcctaagtacgccctacttgacgagtgtactagcgcagtctccatcgatgtagaaggtaaaatttttcaagctgcaaaaggagccggtatctcccttctaagcattacgcaccgaccgtccctttggaagtaccacacccacctcttacagtttgacggcgagggcggttggcggtttgagcagcttgacacagccattcgactgaccttgtccgaggaaaagcagaagttagaaagtcagctcgccggaattcctaaaatgcaacagcggctcaatgaactgtgcaagatactgggcgaagactccgtattgaagacaataaagaacgaggatgagacaagttag

SEQ ID NO: 215438 - DNA, 711 bp, Artificial Sequence
  Description of Artificial Sequence: Synthetic coding sequence
atggcagcatttagcaaatacctcactgctaggaatagttctttagccggagccgcattcctgttgttatgtctgctgcataaaagacggagggccctgggtctgcatggaaaaaagtccgggaagcctccacttcagaataacgaaaaagaaggaaagaaagaaagagccgtggtggataaagtcttcttctccaggctcattcagatattaaaaataatggtccccaggacattctgtaaggagactggttaccttgtgctgatcgcagttatgctggttagtcgaacctattgcgatgtctggatgattcaaaatgggacactcatcgaaagcggaatcatcgggaggtcaaggaaggattttaagagatacctgttgaatttcatcgccgcaatgccgctgatttcgctcgtgaacaattttctcaaatacggcttaaatgagctcaaactgtgtttcagagtccgattgactaagtatttgtacgaggaatatctccaggcctttacctattataaaatgggtaatctcgacaatcgcatcgcaaatcctgatcagttactgacacaggacgttgaaaagttctgcaacagcgtggtggacctatactccaacctgtccaagcctttccttgatatagtgctgtatatttttaagttaaccagcgccatcggggcacaggtactcgggaaaatcctctggcattag

SEQ ID NO: 215439 - DNA, 1980 bp, Artificial Sequence
  Description of Artificial Sequence: Synthetic coding sequence
atggcggcattttccaaatacctaaccgctaggaatagcagcctcgctggtgcagcctttctcctactctgtctgctccataaaaggagaagagcgctcggtctccacggtaagaaatctggcaagcccccactgcagaataatgagaaggagggcaagaaggaaagagccgttgtagacaaggtattcttcagccggctaattcaaattctgaagatcatggtccccagaaccttttgcaaggagactggctacttggtcttgattgccgtcatgctggtatccagaacatactgtgacgtttggatgatccaaaatggaactctcatcgaatctggcattatcggaaggtcccggaaggattttaagcggtacttactgaacttcatcgctgctatgcctctgatcagtcttgtcaataacttccttaagtacggcttgaacgagctcaagttgtgctttcgggtgcgtctgacgaagtatttgtatgaggaataccttcaggcctttacttattacaaaatgggcaacctggacaaccggatcgcgaatcccgaccagctgttaacccaagatgtggagaaattttgtaactcagtggtggacctctacagcaacctgagtaaaccatttttggacatcgtcctgtacattttcaagctaacttcagctataggagcacagggccctgcttcaatgatggcttatctcgtcgtctctggactcttcctaaccaggctgagacgacccataggaaaaatgacaatcacggagcagaagtacgaaggagagtacaggtacgtgaattctcgcctcataaccaatagcgaagagatcgcgttctacaatggaaacaagagagaaaagcaaacggtgcactctgttttccgcaagctggtggaacatctgcacaattttattctgttcagattttctatgggcttcattgactccattatcgctaagtacctggcaacggtagtgggctatctggtcgtctctagaccctttctagacttgtctcacccaagacacctcaagagcactcattcagagctgttggaagactactatcaatcaggacgaatgcttttgcggatgtctcaggctctaggccgaatcgtgcttgcaggcagggaaatgacccgcttggctggatttaccgccaggatcactgagctaatgcaggtgctcaaggatctgaatcatggaaagtatgaaaggaccatggtttcccaacaggagaaagggatcgagggggttcaagtgataccccttatccctggggcaggggagataatcatcgccgataatatcattaagttcgaccacgtacccctggctacgcctaatggcgatgtacttatacgagatctgaatttcgaggtccgctctggcgctaatgtactcatctgtgggcctaatgggtgcggtaagtcctcgctgttcagggtgctgggcgaactgtggccactctttggcggacgcttaaccaagccggagcggggaaaactgttctatgttccccagcgcccttacatgaccctcggcactctgcgagatcaggtcatctacccagatggacgggaggatcagaagagaaaaggcatctctgacttggtcttgaaggaatacctcgataatgtacagttgggacatattcttgagcgggagggaggttgggactctgttcaggactggatggatgtgctcagtggaggcgaaaagcagcggatggcaatggccaggcttttctaccataagccccagtttgctattctcgacgaatgtacctcagccgtgagtgtagacgtcgagggttacatatactcccactgccgaaaagtcggcattacactatttactgtctcacatcgtaaaagtctgtggaagcatcacgagtactacctccacatggacggcaggggcaattatgaattcaagcagatcaccgaggacacggttgaattcggttcttag

SEQ ID NO: 215440 - DNA, 1650 bp, Artificial Sequence
  Description of Artificial Sequence: Synthetic coding sequence
atggccgcattttccaaatatctgaccgcccgtaatagctctttagccggagctgccttcctgctactctgtcttctccacaaacggaggcgggctttgggactccatggaaaaaagagcggaaagcctcctctgcagaacaatgagaaggagggtaaaaaggagcgggcagtggtcgacaaagtgttcttttctcgcttgatccagatcctgaagataatggttccgagaacattttgtaaagagacggggtacctggttcttattgctgtgatgctcgtgagtcggacatattgtgatgtgtggatgattcagaacgggacattgattgaaagcggcatcattggacgcagcagaaaggactttaagcgctatctgctgaatttcattgccgcaatgcccctgatctctctggtgaacaattttctcaagtacggacttaatgagcttaaattatgtttcagagtgagactaactaagtatctgtatgaggagtaccttcaggcattcacttactataagatgggtaatctcgataacagaatcgccaaccctgaccagttgctcacccaagacgtggaaaaattctgtaattctgtggttgatttgtactccaacctgtctaagccgttcctcgatatcgtactctacattttcaaactgacctccgccattggagctcaaggccctgcgtcaatgatggcttatctggtcgtgtcaggcctcttcctgacgagactcaggagacccatcggcaagatgactattacggaacagaaatacgagggcgagtaccgatatgtaaatagtaggcttattaccaactcctttactgcacggattacagaattgatgcaggtactgaaagacctgaatcacgggaaatatgaaaggaccatggtctctcagcaggaaaaggggattgaaggagtccaagttattcccctaatcccaggcgctggggagataattattgccgataacatcataaagtttgatcatgtgccgttggctactcctaacggagatgtgctcattagagacctgaacttcgaggtcagaagtggggctaacgtgctcatttgcgggcctaacggatgcggaaagtcaagtctgttcagggtactcggggaactctggccgctgttcggcggtcgattaacgaaaccagagagaggcaaactcttttacgtaccccagcgaccatacatgacactgggaaccctcagagaccaggtgatataccccgacggacgcgaagaccaaaagaggaaaggaattagcgatctcgtgctcaaggaatacttggataatgtacagcttggccacatactggagcgcgaagggggatgggacagcgttcaagattggatggacgtgctgagcgggggagagaagcagagaatggccatggcacgtcttttttaccacaaaccacagtttgctatactcgacgagtgcacttctgctgtgtccgtagatgtagagggctacatatatagtcactgtaggaaagtggggattaccttatttactgtgtcacaccggaagtccctgtggaagcaccacgagtactacctgcacatggacggcagaggcaattatgaatttaagcaaatcacggaagacaccgtcgagtttgggtcctag

SEQ ID NO: 215441 - DNA, 2052 bp, Artificial Sequence
  Description of Artificial Sequence: Synthetic coding sequence
atggcagccttcagcaaatatctcactgcaagaaattcttcactggctggagccgcttttcttctgctgtgtctcctacacaagaggcgaagagcgctgggattgcacgggtattttatggaaacctggagagaaaaatctgatgaggtgatgggcgagttaaccgaccacgttactcactgtaagaagagcggtaagccccctctgcaaaacaatgaaaaggaaggaaagaaggagcgggctgttgtcgacaaggttttcttttctcgacttatacagattctcaaaattatggtccctaggacgttttgtaaagaaacggggtacctggtgctaattgctgtaatgttggtctcccgcacatattgtgacgtctggatgattcaaaacggtaccctaattgaatcagggatcattggtaggtctagaaaggattttaaaaggtacctgctgaatttcattgcagctatgcctctgatctccctggttaataatttcctgaaatacgggctgaacgagctcaaactatgctttcgagtgagactgacgaagtacttgtatgaagaatacctgcaggcgttcacctattataaaatgggcaacctagacaaccggatcgctaacccggatcaattgctaacccaggacgtggaaaagttttgtaattcagtagttgatttgtacagtaacttatctaagccatttctggatattgtgctgtatatcttcaagctgacttccgccataggggctcagggacccgctagtatgatggcctacttggtggtgagcggtctgtttctcactagattacgcagaccgatcggaaaaatgactatcacagaacaaaagtatgagggagagtaccgctacgttaatagcagactgataacaaattcagaagagatcgctttttataacggaaacaaaagggagaagcaaacagtgcactcggttttccgcaagctcgtcgagcacctccacaattttattctttttaggttcagcatgggattcatcgatagcatcattgcgaaatatctggccaccgtagtggggtacctggtggtgagccgaccatttctggatctctcacatccccgacatctgaaaagcactcatagtgaattgctggaggactactaccagtccggaagaatgttgctaagaatgagccaggctctgggaaggatcgtcctggctggcagagagatgacccgattagccggtttcacagcccgtatcacagagctgatgcaggttctgaaagatctgaatcacgggaaatacgagagaaccatggtgagccagcaggagaaaggaatcgagggagtgcaggtcattccacttatccccggagcgggagagataataattgccgacaatatcatcaagttcgaccatgtgccgttagctactcctaacggagacgtgcttattagagatttgaacttcgaggtacgtagcggagcaaatgtgctcatttgtggtccaaacgggtgtggtaaaagctcactgtttagagtgctgggcgagctgtggcccctgtttgggggaagactgactaaacccgagcgcggaaagttgttttatgtcccacagcgcccatacatgaccttgggcacgttgcgggaccaggttatctatcccgatggcagggaggatcaaaagcgtaagggcatctcagacctggtcctgaaagaatatttggacaatgtgcagctcggccacattttggaaagagaagggggttgggactcagtgcaggactggatggatgtactatcaggaggcgagaagcagagaatggcaatggccaggctcttctaccacaagccccaattcgcaattctggatgaatgcacctcagcggtttccgtggatgtcgaggggtacatctatagtcactgccggaaggtgggaattacgctttttacagtctcgcatcgtaaaagcttgtggaaacaccacgagtattacctccacatggatggtcggggaaattacgagtttaaacaaattaccgaagacacagtcgaattcggcagctag

SEQ ID NO: 215442 - DNA, 1761 bp, Artificial Sequence
  Description of Artificial Sequence: Synthetic coding sequence
atggtgcctcggaccttttgcaaagagacagggtaccttgtgttgatcgccgttatgctggtcagccgcacgtactgcgacgtgtggatgatccagaatggcaccctgattgaatccggaattatcgggaggagccgcaaggacttcaaaaggtatcttctgaatttcattgccgcaatgcccctcatctccttggtgaacaacttcctcaaatatggcctaaacgagcttaaattatgtttcagagtgagactgactaagtatctgtatgaagaatacctccaggcatttacctactataagatgggcaaccttgacaacagaattgctaacccggatcagctcctgactcaagatgtagagaagttttgtaatagcgttgtcgatctctatagcaatcttagcaagccgttcttggacattgtgttatacatattcaagctgactagtgccataggcgcacaggggcctgcaagcatgatggcttacctcgttgtttccggactcttcctaactcgcttacggcgacccattggcaagatgactataaccgagcagaaatatgagggcgaataccgatacgttaacagccgtctgattacaaactcagaagagatcgcattctataacggcaataaacgtgaaaagcaaaccgtacacagtgtgtttaggaagctcgtggagcatctgcacaatttcattctgtttaggttctctatggggtttattgattcaatcatcgcgaaatatctggctacagtcgtaggatacctcgtggtgagcagaccttttctcgacctgtcccacccgcgtcacttaaaatccacccatagcgaacttctcgaagattactaccagtcggggagaatgctgcttcggatgtctcaggccctgggccgaattgtgctcgccggtcgcgagatgacccgattagcaggtttcacagccagaatcaccgaactcatgcaggttctgaaggacctgaaccatggtaagtacgagcgcactatggtttctcagcaagagaagggcattgagggtgtgcaggtgattcctttaatacccggagcgggagagatcattattgcggacaacattattaaatttgaccatgtaccactggccacaccgaacggggatgtcctgatccgagatttaaacttcgaagtgagaagtggggcaaacgtgctgatttgcggcccaaacggctgtggcaaatcatccttatttcgcgtgctgggggaactctggcccctgtttggcggaagacttacgaaacctgagagaggtaaactgttctacgtgcctcagagaccatacatgacattggggactttgagagatcaggtgatctatccagacggtagggaagaccaaaagcgcaaaggaattagtgatcttgtcctgaaggaatacctggacaacgtccaacttggccatattctcgaacgcgaagggggatgggactccgtccaggactggatggatgtgctcagcggaggagaaaaacagcggatggctatggccagacttttttaccacaagccccaatttgctatcctcgatgaatgtaccagcgccgtctctgtcgatgtggaggggtatatctatagccattgtaggaaggtagggattacactcttcacagtcagccatagaaagagtctttggaagcatcatgagtactacctccacatggatggtcggggaaactatgagtttaaacaaatcactgaagacacagtggaatttgggtcatag

SEQ ID NO: 215443 - DNA, 1467 bp, Artificial Sequence
  Description of Artificial Sequence: Synthetic coding sequence
atgctgatcgtcttgaactctactctgaagtcttttgaccagtttacctgtaatctgctgtacgtatcttggaggaaggatttaactgagcatcttcaccgcctgtacttccgcggacgtgcgtactacaccctgaacgtgcttagagatgacattgacaaccccgatcagcgcatctcccaagacgtggaacgcttctgcagacagttgtcatcaatggcctccaagctgattatttcgccctttacactcgtttattatacataccagtgtttccagagcaccggctggctgggacctgtgtctatctttgggtactttatactcgggactgtagtgaacaagaccctgatgggcccaatcgtaatgaaacttgtgcatcaggagaagctcgagggagattttcgagccggtcatgttgaacacatgcggaccgatcggagactccagcggcttctgcagactcagcgtgaacttatgtcaaaggagctgtggctgtacattggaataaatactttcgactacctgggtagtattctttcttatgtggtgatcgccataccaatcttttccggcgtgtatggggacctgagccccgcagaattgtccacccttgtcagcaaaaacgcctttgtctgcatctaccttattagctgctttacacagctaattgatctctctaccacactgtctgatgtggcagggtacacacacagaatcgggcagctccgggagaccctactggacatgagcctgaagtctcaagactgcgagatcctgggagaatcagagtggggtcttgacacccctcccggatggcccgcagcagagccagctgacactgccttcctcctagagcgggtaagcataagcgccccttctagtgataagcccctgatcaaggacctaagcctgaagatatcagagggacaatctctgttgatcaccggtaacacaggcacaggcaagacttctttgctgcgtgttttgggcggactctggacctcgaccaggggtagcgtccagatgctgaccgacttcggcccacatggagtgttatttttgccccagaaaccctttttcactgatggaacacttcgcgaacaggtcatctatcctctcaaggaggtgtaccctgatagcggaagcgctgatgatgagaggattctgcgatttctggagcttgctggcttatcaaatttagtggctcggacagaagggttggatcaacaggtggactggaattggtacgatgtgttgtctccaggagagatgcagagactgagctttgcaaggctgttctatctgcagccaaagtatgctgttctcgatgaagctacctccgccctgactgaagaagtagagtctgaactttatcggatcggccaacagttgggcatgacattcatttcagtcggacataggcagtctctggagaaggtgcccgtgctgacaaggatggcctag

SEQ ID NO: 215444 - DNA, 1821 bp, Artificial Sequence
  Description of Artificial Sequence: Synthetic coding sequence
atggcagtcgcaggaccagccccaggggctggggctaggccaaggctggacttgcagttcctgcagaggttcctccagatcctgaaggttttgtttccatcgtggagctcccagaatgccttaatgttcttaacacttctgtgtctgacactgttggagcagtttgttatataccaggtgggacttattccgtcccagtattacggggttctcgggaacaaagacctagagggatttaagacgttaacattcctggccgtcatgctgattgtgcttaatagtactctgaagagctttgaccagttcacatgcaacctgctgtacgtgagctggcgaaaagatcttaccgaacacttgcaccgactctatttcagaggcagggcgtattataccctgaatgtgttgagagatgacatcgataaccctgatcagcgcatctcacaggatgtggagagattttgccgccagctatcctccatggcttccaaacttatcatatctcccttcaccctggtttactatacttatcagtgcttccagagtaccggttggctcgggcctgtgagcattttcggatattttattctcggcacagtcgtgaacaaaaccttaatggggccaatcgtgatgaaactcgtgcaccaggagaagttggaaggcgatttcagattcaagcatatgcaaattcgagtgaacgcggagcccgctgcattttaccgcgctggccatgttgagcatatgcggacagatcgcagactgcagaggcttctgcagacacaacgcgaactcatgtccaaggaactgtggctctacatcggtatcaacaccttcgactatctgggatccatcctctcttatgtggtcatcgccattcctatctttagcggcgtctatggcgacctgagcccagccgagttgtctacgctagtgtctaagaatgcctttgtctgtatttatctcatctcctgctttactcagctgatcgatctttcaaccacccttagcgatgtcgccggttatactcatcgtattggccagcttagagaaacgttgctcgacatgtccctaaagtcccaggattgcgaaattctgggagaatcagaatggggccttgacaccccacccggttggccagccgctgaaccagccgacacagcattcctcctcgaaagagtatcaatttcagccccatcctccgacaagccactgatcaaagatctctcccttaaaatctcagagggtcagagtctgctgattactggcaacactggcactggtaagaccagcctgctgagggtgttgggaggcctctggacatccactcgagggtccgtgcagatgttgaccgattttgggccacacggtgtgctattcctgccacagaaacctttcttcaccgacggtactctgcgcgaacaggtgatctaccctctgaaggaggtataccctgacagcgggtctgcagacgacgaaaggatcttgaggtttctagaacttgccggtttgtccaatttagtggcacggaccgagggactggatcagcaagtcgactggaactggtacgatgtgcttagtcccggagagatgcagagactgtcatttgccagactgttttatctgcagccaaaatacgctgttctggatgaggccacctctgcgttaactgaggaagtcgaatctgagctttatagaataggacagcagttgggaatgaccttcatatccgtaggtcaccggcaatctctggagaaatttcatagcttggtcctgaagctctgcggaggcggtagatgggagctcatgcgtatcaaggtggaatag

SEQ ID NO: 215445 - DNA, 297 bp, Artificial Sequence
  Description of Artificial Sequence: Synthetic coding sequence
atgcgctctttgctcctcagtactgtgggcatcaacactttcgattacctgggttccatcctctcatacgttgtgatcgcgatcccaatcttttctggcgtttatggtgacctcagccctgcggaactttccaccctggttagtaagaacgcgttcgtctgcatttatttgatcagttgctttacccaactgattgatctgtcaactacgctgagcgacgtggccggttacacacatagaatcggacagctgagggagactctcctcgatatgagtctgaaaagccaggattgctag

SEQ ID NO: 215446 - DNA, 1800 bp, Artificial Sequence
  Description of Artificial Sequence: Synthetic coding sequence
atggccgataaactaactcgcattgccattgtaaaccacgacaagtgtaaacctaagaaatgccggcaggagtgcaagaagagttgccctgttgtgcgtatgggaaagttgtgcatcgaagtgactccccagtctaaaatcgcttggatcagcgagaccctctgcatcggatgtgggatttgcattaaaaaatgcccattcggtgctctgtcgattgtgaatctgccttcaaatctggaaaaggagaccacacaccgctattgcgcgaatgcatttaaactgcaccgactccctatcccgaggccgggagaagtgttggggctcgtcggcacgaatggtatcggcaagagcaccgccctcaagattttagcagggaaacagaaaccaaatctgggtaagtacgacgatccacctgactggcaagaaattcttacttactttcgcggttctgaactccagaattattttacgaagattctcgaggacgatttgaaagctatcattaaacctcagtacgtcgaccaaatccctaaggccgctaaggggacagtggggtccatcctggatcgaaaggacgaaaccaagacacaagccattgtatgccaacagctggatctgacgcatctgaaagaacgcaacgttgaggacctgtctggaggagaactacagcggtttgcatgcgcagtcgtgtgtatccagaaggccgacatctttatgtttgatgagccctccagttatttagacgtaaaacagcggctgaaggctgctatcacaattcgttcactgatcaaccctgatcgctacatcatcgtggtggaacacgacctgtcagttctcgattatctgagtgattttatctgttgcctgtatggcgtgccttcggcttacggcgtggtcacaatgcccttttctgtgagggaaggcattaatatattcctggatggctatgtgccaacagagaatctgcgatttcgtgacgccagcttagtgtttaaagtcgctgagacagcaaacgaggaggaggtgaagaagatgtgtatgtacaagtatcccggtatgaagaaaaagatgggcgagtttgagctcgctatcgtcgctggggagtttactgactccgaaatcatggtcatgctgggtgagaatggcactggaaaaacaacattcataagaatgctggcaggccgtctgaagcccgatgaggggggagaggtgccagtgctgaatgtctcctataagccccagaagatctctccgaaatctacgggatctgtccgccagctgttgcacgagaaaatacgagacgcttacacccatcctcagttcgtgacagacgtgatgaagccgttgcaaattgaaaacattattgatcaggaggtgcagacattaagcggtggagaactccaaagagtggcattagccctttgtctgggcaagccggctgacgtttacctcatcgacgagcccagtgcctacctggacagcgaacagaggctcatggcagccagagtagtgaaacgtttcattctgcacgctaagaagacagcatttgtggtagagcacgacttcataatggcaacctatctcgctgacagggttatcgtttttgatggggtcccttctaagaacacagtggcgaactccccacagacactgctcgcaggaatgaataagtttctaagtcagctcgaaatcactttcaggagggaccctaacaactatagacccagaattaacaaactgaactccattaaagatgtcgagcagaaaaagagcggtaattacttctttctggacgattag

SEQ ID NO: 215447 - DNA, 633 bp, Artificial Sequence
  Description of Artificial Sequence: Synthetic coding sequence
atggctgataaactaacccggattgcaatcgtaaaccacgacaaatgcaaaccaaagaagtgcagacaagaatgcaagaaatcctgcccagtggtccggatgggaaaactgtgtatcgaggtaacgcctcagagcaagatcgcctggataagcgaaacgctctgcataggatgtggcatatgcattaaaaaatgcccgtttggggctctgtcaattgtgaatctaccgtcaaatctcgagaaagaaaccactcaccggtattgcgctaacgcttttaaactgcatcgtctgcctatcccacgacctggagaagtcctcggcctggtcgggaccaacggaattggtaaatcaacagccctgaaaatcctcgctggcaagcagaagccaaatctgggcaagtatgatgatccccctgattggcaggagatactgacttatttccgaggcagtgaattgcagaattatttcaccaagatacttgaagatgacctgaaggctattatcaaaccgcaatacgtcgaccaaattcctaaagctgctaaaggcaccgttggatccatcctcgataggaaagatgagaccaagactcaggccattgtgtgccagcagctggacctcacccatctaaagtag

SEQ ID NO: 215448 - DNA, 2538 bp, Artificial Sequence
  Description of Artificial Sequence: Synthetic coding sequence
atgcccaaagcgcctaagcagcagccacctgaacccgaatggattggtgatggagagtccaccagccctagtgataaagttgtaaaaaagggtaagaaagacaaaaagattaagaagactttctttgaagagctggccgttgaagataaacaggcaggcgaagaagaaaaagtgttgaaggagaaagagcagcagcagcagcagcagcagcagcagcagaagaagaaaagagacactcgcaaaggtcggagaaagaaagacgtggatgacgatggggaggagaaggaattaatggagcgcctcaaaaagttgagtgttcccactagcgatgaggaagatgaagtgccagcgccaaaacccaggggaggcaaaaaaaccaaaggaggaaacgttttcgctgctcttatccaggatcagagtgaggaagaagaagaggaggaaaagcaccctccaaaacctgctaagcctgagaaaaaccgcattaacaaggcagtctccgaagagcagcaaccagcgctcaaaggcaaaaaaggcaaggaggaaaagagcaagggcaaagccaagccacaaaacaaattcgccgcactcgataatgaggaggaagataaggaagaggaaattatcaaagaaaaagaacctcccaagcaggggaaagaaaaggccaagaaggccgagcaggggtccgaggaagagggtgaaggcgaggaagaggaagaggaagggggtgagagtaaggctgacgacccatacgcccatctctcaaaaaaggagaaaaaaaagctgaaaaaacagatggagtacgagcgacaggtcgcatctctaaaggctgcaaacgcagctgaaaatgacttctccgtcagtcaagccgagatgagcagtcgacaagctatgctggagaatgcatccgacattaaactcgagaagttcagcatcagtgcccatggcaaggagctattcgttaacgccgacctgtacatcgtcgcagggagacgttacgggctggtgggacctaacggaaaaggcaaaaccacacttctgaaacatatcgcgaacagagcgctgtccataccacctaacatagatgttctactgtgcgagcaggaggtggttgcagatgagactccagctgttcaggctgtgttaagggccgacaccaagaggctgaagttgctagaagaggaacggagactgcaaggccagttagagcaaggagacgacaccgctgctgagaggttggaaaaggtgtacgaggaactgcgcgcaaccggggcagccgctgcagaggctaaagcgaggaggatactggctggtctgggttttgatccagagatgcaaaatagacctacccagaaattttctggtggttggcggatgagggtgagtctcgccagggccctattcatggagccaaccctcctcatgctggacgagcctactaaccatctggaccttaacgcagtaatttggctgaacaattatctgcagggctggcgtaagaccctcctaatcgtcagccatgatcaaggttttctagacgacgtctgtacggatattatacacctcgatgcacagcgcctgcactattacagagggaattacatgacttttaagaagatgtatcaacagaaacaaaaggagcttctcaaacagtacgagaagcaggagaagaaactgaaagagctgaaggcagggggaaaaagcaccaagcaggccgagaaacagactaaggaggcccttaccaggaaacagcagaagtgccggcgaaagaaccaggacgaggaaagtcaggaagcccctgagctcttaaagagacccaaggagtacacggttcgcttcactttccctgatccaccacccctaagcccccctgtcctcgggctgcatggagtgacctttggctaccagggacaaaagccactattcaaaaaccttgattttggcatcgatatggactcacggatttgcattgttggcccaaatggcgttggaaaaagcactctgctcctcctgctgactggaaaactcacccctacccacggggagatgcgtaagaaccaccggcttaaaataggcttcttcaaccaacagtacgctgagcagcttagaatggaagagacgcccacagaatacctgcagaggggctttaatctgccatatcaggatgctaggaagtgcctgggacgattcggcctggagtcacacgcacataccatccaaatctgcaaactgagtggcggacagaaagctagggtggtgttcgctgagttggcctgtcgcgaacccgatgttctgattctggatgagccaactaacaacctcgacattgagagcatcgacgcgctgggcgaagccataaatgagtacaagggagcggttatcgtggtgagtcacgatgctcggctgataacagagaccaactgccagctgtgggtggtggaggagcagagcgtctcacagatagatggggactttgaagactataaaagagaggtgttggaggcgctgggcgaggttatggtgtctaggcccagagagtag

SEQ ID NO: 215449 - DNA, 2424 bp, Artificial Sequence
  Description of Artificial Sequence: Synthetic coding sequence
atgcccaaggctcctaagcaacagcctcccgagcccgagtggatcggagacggcgaaagtactagcccatcggataaagtggtaaagaaaggaaagaaggataagaaaatcaaaaaaactttcttcgaagaactggccgtagaggacaagcaagcgggagaagaagagaaagtcttgaaggagaaggagcagcaacaacaacagcaacaacagcaacagaagaaaaagcgggatacccgtaaaggcaggcgtaaaaaggacgtcgatgatgacggagaggaaaaggagctgatggagcgcctcaaaaagcttagcgtcccaacctcggacgaagaggatgaggtgccagctcccaagcccagaggcggaaaaaaaaccaagggtggtaatgtgttcgcggcactgattcaggaccagtctgaggaggaggaggaggaggaaaagcacccccctaaaccagccaaacccgaaaagaataggattaacaaggctgtcagtgaagaacagcagcccgctctgaaggggaaaaaagggaaagaggaaaaatctaagggaaaggcgaagccccagaataaatttgcagcgctcgataatgaggaggaagataaagaggaggagatcatcaaggagaaagaaccaccgaaacagggtaaggagaaagccaaaaaggccgaacagatggagtatgaaaggcaggtggcctcccttaaagctgctaatgctgctgaaaacgatttctctgtttctcaggcagaaatgtcctcccgtcaggcgatgttggagaacgccagcgacataaagcttgagaagttcagcatcagcgcacacggcaaggagctgtttgtgaatgccgacctttatatagtagccggaaggcggtacggcttagtgggtccgaatggcaaaggcaaaacgacattgctgaaacacatcgctaatcgggcactatctattcctccgaatatcgacgtgctactgtgcgaacaggaggtcgtagccgatgaaactccagccgttcaggccgtcttgcgggcagataccaaacgccttaagctacttgaggaggaacgtaggctgcaaggtcagctagaacagggagacgacactgcggctgagcgcctggagaaagtgtatgaagagctccgcgcaaccggagcggctgccgctgaggcaaaggctcggcgtattcttgcgggactcggctttgatcctgaaatgcagaaccgccctactcagaagttcagcggcggttggcgcatgcgcgtgtccctggcacgagcgctgttcatggaaccaacactgctaatgctggatgaaccaactaatcatttggaccttaacgctgtgatctggcttaataattatctgcaagggtggcgcaagactcttctgattgtgagtcacgaccagggcttcctggacgacgtttgtaccgacatcatacatctagacgcccagcggctgcattactataggggaaattatatgactttcaaaaagatgtaccagcagaaacagaaggagctgctcaagcagtatgagaagcaggagaaaaagctgaaagagctaaaggctggcggaaagagcacaaagcaagccgaaaaacaaacaaaggaggccctcacccgcaagcagcagaaatgtcgtagaaaaaaccaagatgaggaatcgcaggaggcgcctgaactcctcaagcgcccaaaagaatacactgttcgattcacattcccggacccaccacctctgtctccacctgtgctaggtctgcacggagtgacattcgggtatcaagggcagaagccactgtttaaaaatctggacttcggaattgatatggatagccgtatatgtatagtgggccctaacggtgtgggcaagtcaacactgttgctgctcctgacaggcaagctgacccctactcatggagagatgcgtaagaatcataggctaaagattggcttttttaaccaacagtatgccgaacaactgagaatggaagagacgcccactgagtacctacaacggggtttcaacctgccctatcaggatgcccgtaagtgcctgggtagattcggcctggagagccatgctcatactattcagatttgcaagctttccggtgggcagaaagcccgagtggtctttgccgagcttgcttgtcgagaacctgatgtactaattctggacgaaccaactaataacctggatatcgaatctatagacgctctcggcgaggccatcaacgagtacaaaggtgccgtgatcgtggtgtctcatgacgcccgactgatcaccgagactaactgtcagttgtgggtggtcgaggagcagagcgtatcgcagatcgacggagatttcgaggactataaaagagaggtgttggaagcactgggcgaggtcatggtgagtagacctagggagtag

SEQ ID NO: 215450 - DNA, 2424 bp, Artificial Sequence
  Description of Artificial Sequence: Synthetic coding sequence
atgcccaaagccccaaagcagcagcctccggaaccagagtggattggggatggagagtccacctccccttccgataaagtagttaagaagggcaaaaaagataaaaagatcaagaagactttctttgaggaactcgctgtcgaagataaacaggccggagaggaagaaaaggtcctgaaagagaaggaacagcagcagcagcaacagcagcagcagcagaagaaaaagagagatacgcgaaagggacgcagaaagaaagacgtagacgatgatggagaggagaaggaactcatggagcggcttaaaaaactcagcgtgccaacatcggacgaggaagatgaggtgcccgctcccaagcccagaggaggcaaaaagaccaaagggggaaacgtctttgctgctcttatacaggaccagagcgaagaagaagaggaagaggagaagcacccccctaaaccagccaagcccgagaagaacagaattaacaaagccgtgtctgaggaacaacaacccgcactcaagggaaaaaaaggtaaagaagagaagtccaagggtaaggcaaagccccagaataagttcgctgccttggataacgaggaagaggataaagaggaagaaattattaaggagaaggaacctcctaaacagggtaaagaaaaggccaaaaaagccgagcaaatggaatacgagagacaggtggcatctttaaaggcagctaacgccgcagagaacgatttttccgttagccaggccgagatgagctctagacaagctatgctcgagaatgcatccgacatcaaactggaaaagttctctatctctgcccatgggaaggaacttttcgttaatgcagacctgtacattgtggcaggacgacggtatggcttggtaggccctaatggtaagggtaaaactacattgctgaagcacatcgcgaatagagctctctccattccacccaacattgatgtattgctttgtgaacaggaagtggtggcagacgaaacgcctgcggtgcaggccgttcttcgggcagacactaagcggctgaaacttctggaggaagagagaagactgcagggccaactcgagcagggcgacgatacagctgccgagagactagagaaagtgtatgaagagctaagggctaccggtgctgctgccgcagaagcaaaggccaggcgaattctggctggactcgggttcgatcccgaaatgcagaatcgacccacccaaaaatttagcggcggatggagaatgagggtcagcctggcacgggctctctttatggaacccactcttttaatgcttgacgagcccacaaatcacctcgatctcaacgccgtgatctggttgaataattatctgcagggttggagaaagaccctgctcattgtttcacatgatcagggatttttagatgacgtatgtactgacatcattcacttggacgctcagaggctgcactactatcgtggaaattatatgactttcaaaaaaatgtaccagcaaaaacagaaagagttgttaaagcagtatgagaagcaggagaagaaactcaaggagttgaaggccggagggaaatcaacaaagcaggccgagaagcagacaaaggaagcattgacccggaagcagcagaaatgtagacgaaagaaccaagatgaagagtcccaggaagccccagagctgctcaagcgtcccaaagaatacactgtgcggtttaccttccccgacccgcctcccctgagccccccagtgttgggtcttcatggcgtcactttcggctatcaggggcagaaacccctgttcaagaacctcgacttcggaatcgatatggattctcggatttgcatcgtcggcccaaacggggttggcaaatctaccctcctactccttttgactggtaaattgactcccactcatggagagatgagaaagaatcatcgtctgaagattggattttttaatcagcagtatgcagaacagcttcggatggaggagacaccaactgagtatctgcaacgaggattcaatctgccatatcaggacgctcggaagtgcttagggcgatttggactagaatctcatgcccacactatacaaatatgcaagctctcaggaggccagaaagctcgggttgttttcgctgaactagcctgtagagagcccgacgtgctgattctagacgaaccgaccaacaacctggatatcgagtcaatcgatgcactcggggaggcaataaacgagtacaaaggagcagtgatcgttgtcagccacgacgcgcgactgattaccgagactaattgccaactgtgggtggtcgaagaacagtcagtttcccagatcgacggtgacttcgaggactacaaaagggaggttttagaagcactgggcgaggtgatggtgagccgtcctagggaatag

SEQ ID NO: 215451 - DNA, 2538 bp, Artificial Sequence
  Description of Artificial Sequence: Synthetic coding sequence
atgccaaaggccccaaagcagcaaccacctgagccggaatggatcggggatggcgaatccacatctccaagcgataaagtcgtgaaaaaaggcaagaaggacaaaaagattaaaaagacttttttcgaggagcttgctgtcgaagacaagcaggctggagaggaagaaaaggttcttaaggagaaagaacagcagcagcagcagcaacagcagcaacagaaaaagaagcgggataccaggaaagggaggcgcaaaaaagatgtggacgatgacggggaagaaaaagagctgatggaaaggctgaaaaagttaagcgttcctacaagcgatgaagaggacgaggtgccagctccaaagcccagaggcggtaaaaaaactaaagggggtaacgtgtttgcagcattgatacaggatcagagcgaagaggaagaagaggaagagaaacatccaccgaaaccggctaagccagagaaaaatagaatcaataaggcagtgagtgaggagcagcagccggcactcaaggggaagaaggggaaggaggagaagagtaaaggaaaagccaagcctcagaataaattcgccgctctcgacaatgaggaggaagacaaggaggaagagatcatcaaggagaaggagcctccgaagcaggggaaagaaaaggcgaaaaaggctgaacagggttccgaggaggagggggagggcgaggaagaggaggaggaaggcggagagagtaaagccgacgacccttacgctcacctatccaagaaagaaaaaaaaaagctgaaaaagcagatggaatatgagcgccaggtcgcatctctgaaggccgcaaacgctgccgagaatgattttagtgtgagtcaggccgagatgtcctcacgacaggctatgctggaaaacgcttccgacattaagctggagaagttctcgatctctgcccatggaaaagagctctttgtcaatgcagacctgtacattgtggccggaaggcggtacgggctcgtagggccaaacggaaaagggaagacgactctgttaaaacatatcgccaatagagccctgtctattcctccaaatattgatgttctgttatgcgagcaggaagtagttgcagacgagacacccgctgttcaggccgtgctgagggccgacaccaaacgcctaaagctgttggaggaagaaagacgtctgcaagggcagcttgagcagggggacgacactgcagcagaacggcttgaaaaagtgtatgaagagctaagggccacgggggctgctgcggctgaagctaaagcacggcgtatactcgctggcctgggtttcgatccagagatgcagaaccgtcccacccagaaattcagcggtggttggcggatgagggtgagcctcgccagagcgctgtttatggaacctacattgctcatgctggatgagcccacaaaccatttggacctaaatgcagtgatctggctgaacaattacctgcagggatggcgcaaaaccctgttgatcgtgagtcacgatcagggatttctcgatgacgtttgcaccgacatcatccacttggacgcacaacggctgcattactatcgtgggaactatatgactttcaagaagatgtaccagcagaaacagaaggagcttttaaaacagtacgagaagcaggagaagaagctgaaggaactgaaagcgggaggaaagtcaacaaaacaggccgagaagcaaactaaagaggccctaacgaggaagcagcaaaagtgtaggaggaagaaccaagacgaggaatctcaggaggcccctgagctgcttaagagacccaaggaatacactgttagatttaccttccctgaccctcccccactgtcgccccctgtgctcggtctgcacggcgtcaccttcggctaccagggtcagaagcctttgttcaaaaaccttgactttgggattgacatggacagcagaatttgcattgtcgggccaaacggggtcggaaaatcaacactcttgcttctgctcactggtaaactgactccaactcatggggaaatgagaaagaaccatcggctgaaaatcgggttttttaaccaacagtacgccgaacagctgcgaatggaggagaccccgactgaatatcttcagagggggtttaacctgccctatcaagacgcaagaaaatgcttgggccgattcggcctggaaagccacgcacacacaatccaaatctgtaaactctctggcggtcaaaaggctagggtcgtcttcgctgaactcgcttgtcgggagccagacgtgctgatactcgatgagcccactaacaatcttgacattgagagtatcgacgccctgggagaggcaatcaatgagtacaagggtgccgtaatcgtcgtgtcacacgacgccaggctcattactgagacgaattgccagctgtgggtggtcgaagagcaaagcgtaagccagatcgatggcgactttgaagactataagcgggaagtgctggaggctctgggcgaagtaatggtgtctcgccctcgggagtag

SEQ ID NO: 215452 - DNA, 717 bp, Artificial Sequence
  Description of Artificial Sequence: Synthetic coding sequence
atgcctaaggctcccaaacagcagcctcctgagcctgaatggatcggggacggcgagagcacttcaccgtccgacaaggtggtaaagaaaggtaaaaaggacaaaaagattaagaaaacctttttcgaggagctagccgtcgaagataagcaggcaggggaggaggagaaagtgttgaaggagaaagagcagcagcagcagcaacagcagcaacagcagaagaagaaacgggacacgaggaagggtcggaggaaaaaggatgtggacgatgatggcgaggagaaagaactcatggagcgtctcaagaagctgagtcggggatttaatctgccctaccaggatgcaagaaagtgtctcggacgctttggcctggaatctcatgcccacacgatccagatttgcaagcttagtggcggacagaaggcccgtgtggtctttgcagagctggcctgtcgtgagcctgacgtgctcatcttggatgagccaactaataacctcgatattgaatctattgatgcgctaggggaggccattaatgagtacaagggtgcagtcatcgtcgtaagccacgacgccaggctgattactgaaacgaactgccagttgtgggtggtggaggaacagagtgtgtcacagattgatggtgatttcgaggactacaagcgcgaagttcttgaggcactgggagaagtgatggtgagccgacctagggaatag

SEQ ID NO: 215453 - DNA, 2424 bp, Artificial Sequence
  Description of Artificial Sequence: Synthetic coding sequence
atgccaaaagcaccgaaacagcagcctcctgagccagagtggatcggtgacggagagtccacatctccaagcgacaaggtggtcaagaaaggcaaaaaggataaaaagattaagaagaccttcttcgaggaactggccgtggaagacaaacaggctggagaagaggaaaaagtgttaaaagaaaaagagcagcaacagcagcagcaacagcagcagcaaaagaagaaaagggacacacgtaaaggccgacgtaagaaagatgtggacgacgacggggaggaaaaggagctcatggagaggctgaaaaagctcagcgtccctaccagcgacgaagaggatgaggtgccggcacccaaacctagaggtggcaaaaagactaaggggggaaatgtgttcgctgcgctgatccaagatcaatcggaggaggaggaagaggaagagaaacacccgccaaaacccgctaagcccgagaagaaccgtatcaataaagccgtgtctgaggaacagcagccagccttgaaaggtaaaaaaggtaaggaagaaaaatccaaagggaaggccaagcctcaaaataaattcgcagctttagacaacgaggaggaagacaaagaggaggagatcatcaaggaaaaagagcccccaaaacagggtaaggagaaagctaagaaagcggagcagatggagtacgagcggcaggtcgcgagtctgaaggcagcaaacgccgcagaaaatgatttttcagtttcacaagctgagatgtcctctcgccaggccatgttggaaaatgcttcagatatcaagctagagaaattctcaattagcgcccacggaaaggaactgtttgtcaacgcggatttgtacatcgtggctggaaggcggtacggcctagtgggtccaaatggcaagggcaagaccacgctgttgaagcacatagcaaatcgggcactcagtattccacctaatatcgatgtgctgttatgtgaacaggaggttgtcgccgatgagacccccgctgttcaggctgttcttagggccgacacgaaaaggctgaagttgctggaggaggaaaggaggctgcaaggacagctggaacagggcgacgacacggccgctgagcgcctcgagaaagtctatgaagaactgcgtgcaaccggtgccgcagcagccgaggcgaaagcaaggagaattttagcgggtttaggctttgacccggagatgcagaaccgcccaacccagaaattcagcgggggttggaggatgcgagtttcactagccagggccctgttcatggagccgacactgttgatgctggacgagccgactaatcatctcgacctgaacgcagtaatttggctcaataactacctgcaagggtggcgaaagaccctgcttatagtttcccacgaccaggggtttctggacgatgtgtgtacagatattattcatctagacgcacagagactgcattactacagagggaattatatgacatttaaaaagatgtatcagcagaagcagaaggaactcctgaaacaatacgagaaacaggaaaagaaactgaaggaactcaaagcaggcggaaaatcgaccaaacaggccgaaaagcagacaaaggaggccctgacgagaaagcagcagaagtgccgccgtaaaaaccaagatgaggaaagccaagaagcccctgaactgctgaagaggccgaaggaatataccgttcggttcaccttccccgatccccctcctctgagtccccctgtgctcggtctacacggagtgaccttcggctaccagggacaaaaaccgctgttcaaaaatctagacttcggaatcgacatggactcgcggatctgcattgtagggccaaatggcgttggaaaaagtacactgctgctgttacttactgggaagctaactcccacacacggtgaaatgcgcaaaaaccacagattaaaaatcggcttcttcaatcaacagtatgctgagcaacttagaatggaggagactcctacagagtacctgcagagaggcttcaatctcccatatcaagacgccaggaagtgtttggggagattcggattggagagccacgctcatacaatccagatctgtaagctctctggaggtcagaaagctagggtcgttttcgccgagctggcctgtagagagcccgacgtcctgatcctagacgagccaacgaacaacttagatattgagagtatcgacgccctgggagaagccattaatgagtacaagggcgctgttatagtggtgagtcatgacgcgcgactaataacggagactaattgccagctttgggtggtagaggaacagtctgtttcccagatagacggagattttgaagattacaaacgcgaggtcctcgaagctctgggcgaggtgatggtaagtaggcctcgagagtag

SEQ ID NO: 215454 - DNA, 717 bp, Artificial Sequence
  Description of Artificial Sequence: Synthetic coding sequence
atgccaaaagcccctaagcaacagcctccagaacctgaatggatcggagacggggaatcgacaagcccatctgataaggttgtgaagaagggtaagaaggataaaaagattaagaagacattcttcgaggaactcgccgttgaagacaaacaggcgggagaggaggaaaaagtgttgaaggagaaggaacaacagcaacagcagcagcaacagcagcaaaaaaagaagagagacacacgcaaaggcaggcggaagaaagatgtggacgacgacggggaagaaaaagaactgatggagaggctgaaaaagctttctagaggcttcaacctgccgtatcaggacgcccgtaagtgtctcggaaggtttggtttagagagtcacgcacacacgatccagatatgcaaattatctggtggccaaaaagcgagggttgtgtttgcagagctagcttgtcgggaacccgacgtcttgattctcgacgagcctactaacaacctggatattgaatcaattgatgcactgggggaagcaattaacgagtataaaggggctgttatcgttgtgtctcatgatgcacgcctcatcactgagacaaattgccaactctgggtggttgaggagcagtccgtctcccagatagatggagatttcgaggattataagcgggaggtgttagaggcccttggggaggtgatggtgagccgcccacgcgagtag

SEQ ID NO: 215455 - DNA, 1023 bp, Artificial Sequence
  Description of Artificial Sequence: Synthetic coding sequence
atgcccaaggcccctaagcaacagccccctgaacctgagtggattggggatggcgaatcaacgagccccagtgacaaggtggttaagaaggggaagaaggataaaaagatcaagaagaccttctttgaagaattagcggtggaggacaagcaggcaggcgaggaggagaaagtgctcaaggagaaagaacagcagcagcaacaacagcagcagcagcagcagaaaaaaaagcgagacaccaggaaaggcagacgtaaaaaggacgtggatgacgatggcgaagagaaggagctgatggaaaggctgaaaaaactctcagtaccgacctcagacgaggaggatgaggtgcccgcacccaagcccagaggcggaaagaagaccaaggggggaaatgttttcgctgctctgatccaggatcagtcggaagaggaggaggaggaggagaagcacccgccaaaaccagcaaagcccgagaaaaataggatcaacaaggctgtatctgaggagcaacagcctgccctgaaggggaaaaaaggcaaggaagaaaaatccaaggggaaggcgaaaccacaaaataaattcgccgcacttgataacgaggaggaggacaaagaagaagagattatcaaagaaaaagaacccccaaagcagggtaaggaaaaagcaaagaaagcagagcaaggctcagaggaagagggggaaggcgaggaggaggaagaggaaggcggagagtcaaaagccgacgacccatatgcccacttgagcaagaaggagaagaagaaacttaagaagcaaatggagtatgagcggcaggtggcgtcgctgaaagcagccaacgccgcagaaaacgatttttctgtttctcaggccgaaatgagctctcggcaggccatgctggagaacgcgagtgatattaagctggagaagttctccataagtgctcacggcaaggaactctttgtcaacgccgatctgtatatcgtggccggtaggcgttacggcctggttggccctaacggatag

SEQ ID NO: 215456 - DNA, 2538 bp, Artificial Sequence
  Description of Artificial Sequence: Synthetic coding sequence
atgcccaaggcgcctaaacaacagccgcctgagccagagtggattggagacggcgaaagtacctcaccctcggacaaggtggtgaaaaaaggaaagaaggacaagaagattaaaaagacttttttcgaagaactggctgttgaagataagcaggccggtgaagaagagaaggtacttaaggaaaaagaacagcagcagcagcaacagcagcagcaacaaaagaagaaacgcgatacccgtaagggtcgcagaaaaaaggatgtcgacgacgacggtgaagaaaaagagttaatggaacgacttaagaagctcagtgtaccaacctcagacgaagaggatgaagtgcctgcccctaagccaagaggcggtaaaaaaaccaagggcggtaacgtcttcgccgcattgatccaagaccagtctgaggaggaagaggaggaagagaagcacccccctaaaccagctaagcctgaaaagaacaggataaataaggccgtgtcagaagaacaacagcccgcactaaagggcaagaagggcaaggaagagaaatctaaaggaaaggccaagccccagaataaatttgcagcccttgacaacgaggaggaggacaaagaggaggaaatcatcaaagagaaggaacccccaaagcagggcaaggagaaagctaaaaaagcagaacaaggttccgaggaagaaggggagggcgaggaggaggaagaggagggcggtgagagcaaggccgacgacccatatgctcacctctcgaagaaggagaagaagaagcttaagaagcaaatggaatatgagagacaggttgctagcctcaaggctgccaacgcagccgaaaacgacttttctgtcagtcaagctgagatgagtagccgacaagctatgctcgagaatgcttcagatataaagttggaaaagttctctattagcgcccacgggaaagagctttttgtcaacgcagatctgtacatcgtggctggacggcgttacgggctagtcggtcctaacgggaagggcaaaaccactcttctaaagcacattgccaatagggccctgtcgattcctcccaatatcgacgtgctgctctgcgagcaggaggttgtcgctgacgagactccagcagtgcaggccgtcctgcgtgctgacacaaagcggttgaagctcctggaggaagagaggcgcctgcaagggcagctggaacagggcgacgatacggctgctgagagactcgagaaggtatatgaagagctgcgcgctaccggcgctgctgcggcagaggcaaaagcacggaggatcctggccggtctgggtttcgatcctgagatgcaaaaccgtcccacgcagaaattctctggaggctggagaatgagggtgtccctggccagagccttgttcatggaacctactctccttatgctggatgagccaacgaatcacctggatttaaacgctgttatttggttaaacaattacttacaagggtggaggaagaccctgttaattgtgtcacatgatcagggctttttagatgatgtgtgcaccgacatcatccaccttgatgcccagagattgcactattataggggcaactacatgacctttaaaaagatgtaccagcagaagcagaaagagctcctgaaacagtacgagaagcaggagaaaaaactgaaggagttaaaagccggaggaaagagcacaaagcaagcggaaaaacagacaaaggaggcactcactcggaaacagcagaagtgcagacggaaaaaccaggacgaggaatcccaagaagcccctgaactcctgaaacgccctaaggagtacactgtgagattcactttccctgatcctcccccactatctccccctgtgctcgggctccacggcgtgacattcggctaccagggccagaaacctttgtttaaaaatctggactttggaatcgacatggactcccgaatttgcatcgttggaccaaatggtgtcgggaagtctactctgttactgttgctcacagggaaattaacacccacgcacggcgagatgcgcaagaaccatcgactcaaaataggattctttaaccaacaatacgcagaacagcttaggatggaggaaactcccacggagtacctccagcgcggattcaacctgccctaccaggatgctcggaaatgtctcggacggttcggcctcgaatcccatgctcatacaattcagatatgtaaactcagcggcggtcagaaagctcgtgtggtctttgctgagcttgcgtgcagggaacccgacgtgttaatattggatgaaccgacaaacaatctggacattgaatccatcgacgccctgggagaagcaatcaatgaatataagggggctgtgattgtggtcagccatgatgctaggctgatcaccgaaaccaattgtcagctctgggtagtcgaagaacagagcgtgagccaaattgacggagatttcgaagactataagagggaagtgctcgaagccctcggcgaagtcatggtatctcggcctcgtgagtag

SEQ ID NO: 215457 - DNA, 2424 bp, Artificial Sequence
  Description of Artificial Sequence: Synthetic coding sequence
atgcctaaggccccaaaacagcagccccctgagccagaatggatcggggacggagagtctacctccccatcagataaggtggtgaagaagggcaagaaagataagaagattaaaaagaccttcttcgaagaactcgccgtggaagataagcaggcaggcgaggaggagaaggtgcttaaggagaaggaacaacagcagcagcagcaacagcagcagcaaaaaaaaaaacgcgatacaagaaaaggtcggcgaaaaaaagatgtggatgacgacggagaagagaaggagctgatggagcgactgaagaaactgagtgtgccaacgtccgacgaagaagatgaggtccctgctcccaagccaagagggggtaagaaaaccaagggagggaatgtgtttgcggctcttatccaggaccagagtgaagaggaggaggaggaagagaagcacccgcctaagcctgcaaagccagaaaagaaccgaattaacaaggctgtttccgaagaacaacagccagccctgaagggaaaaaaagggaaggaagagaaatcaaaagggaaagcaaaaccccagaacaagtttgcagccctggacaatgaagaggaggataaagaagaagaaataatcaaagagaaggagccccctaagcagggtaaggagaaagcgaagaaggccgaacaaatggaatacgaacgacaggtggccagtctgaaggccgcaaatgctgcagagaatgatttttcagtctcccaagcggaaatgagctctcgtcaagcaatgctagagaatgcttcagatattaagctcgaaaagttttccatctcagcacacggcaaggaactgttcgtcaacgccgacctgtacatcgtggccggtagacgttacggcctcgtgggccctaacggaaaaggcaagaccaccctcctgaaacatattgcgaacagagccctgtccattccaccaaatattgatgtgctgctgtgcgaacaggaggttgtggccgacgagacccctgccgtgcaagccgttctgcgcgctgatacgaagcgtctgaagctccttgaggaggaacggaggcttcaggggcagcttgaacagggtgatgataccgcagcggaacgattggagaaggtgtacgaggagctgagagcaactggggctgccgctgccgaggccaaagccaggaggattcttgccggtcttggatttgacccagaaatgcagaatagacccacacaaaagttttccggcggatggcgcatgcgagtgtcactggcacgtgctcttttcatggaaccaacactcttgatgttagatgagcctaccaaccatctcgatcttaatgctgtgatctggctgaataactatctgcagggatggcggaaaactctgctgattgtctcacacgaccaaggtttcttggatgacgtctgtacggacataatccacctggacgcacagcggcttcactactaccgcggaaactacatgacttttaagaagatgtaccagcagaagcaaaaagaactgctcaagcagtacgaaaaacaggaaaagaagctcaaggagttgaaggcaggcggaaagtccaccaagcaggccgaaaaacagacgaaggaagcattgacccggaaacagcagaaatgccggaggaagaaccaggacgaagaatctcaggaagcacccgaactcttgaagcgccctaaggagtacactgtccgattcacattcccagacccccctcccctgagtccacctgtccttggcctgcacggagtgacttttggataccaaggccagaagccactcttcaagaatcttgactttggtattgatatggatagcaggatctgcattgtaggcccaaacggtgttggaaagtccaccctgctgctgttgctgacaggaaagctaacgccaactcacggtgagatgcggaagaatcatcgcttgaagataggcttcttcaaccaacaatacgccgagcagttacgtatggaggagacacccacagagtatctgcagcgcggatttaatctgccgtatcaagatgctcggaaatgtctggggagatttgggctggaatcgcatgcccatactatacaaatctgcaagttaagtggcggacagaaagccagggtagtcttcgcagagctcgcctgccgggagcccgacgtgctcattctcgatgagccgaccaataacctcgacattgaatcaatagacgcgctcggggaggccattaacgagtacaaaggagccgtgattgtggtgtcccacgatgcaagactcattaccgagacaaattgccagctttgggttgtggaggaacagtcagtctcccaaatagacggggattttgaggactacaagcgtgaggttttggaagcactcggagaagtcatggttagtcggccaagagaatag

SEQ ID NO: 215458 - DNA, 2424 bp, Artificial Sequence
  Description of Artificial Sequence: Synthetic coding sequence
atgcctaaggccccaaaacaacaaccgccagaacccgagtggataggggacggtgaatctacctctccaagcgataaggtcgttaagaaggggaaaaaagacaaaaagatcaaaaaaacgttcttcgaggagctggccgtggaggacaaacaggctggagaagaagagaaggtgctgaaggagaaagagcaacagcagcaacaacaacaacagcaacagaagaaaaagagggacacacggaagggcagacggaagaaggatgtggacgacgatggagaggaaaaggaactgatggaaagactaaagaagctctctgtccccactagcgacgaagaggatgaagtaccggctcctaaacccagaggcggaaagaagactaaggggggaaacgtgtttgccgctttgatacaggatcagtctgaggaggaggaggaagaggagaagcacccccctaagcccgcaaagccagaaaagaatagaattaacaaggccgtgtccgaggagcaacaaccagctctgaagggcaaaaaaggcaaagaagaaaagtccaaaggtaaagcaaaaccacagaacaagtttgcagccctcgataatgaggaggaagataaggaagaggagattatcaaggaaaaagagccccctaagcaggggaaagaaaaagctaaaaaagcggagcagatggagtacgagcgtcaggtggcatcacttaaggcagctaacgcagcagagaatgacttcagtgtgtcccaggctgaaatgtccagcaggcaagctatgctcgagaatgcatccgacattaagttggaaaaattcagtataagtgcccatggtaaggagctctttgtgaatgccgatctctacatagtcgccggacgcagatatggtcttgtggggccaaatgggaaggggaaaaccaccctgctcaagcacatcgcgaatagggccttgtcgattccccctaatatcgatgtgcttctgtgcgaacaggaagttgtggcagatgaaacacccgcagtgcaggcagtcctccgcgctgacaccaagcgcctcaaactcctagaagaagagaggaggttgcaggggcaactggaacagggcgacgatactgctgctgagcggctggagaaggtgtacgaggagctgagagcaacaggagcggctgccgctgaggcaaaggcccgacggatactggccggattaggattcgacccagaaatgcagaatcgtccaacacaaaaattttctggtggttggagaatgagagtcagcctggcacgtgccctgtttatggaaccgacacttctgatgctcgatgagcccaccaaccatctggacctcaatgccgtcatctggctcaataattacctgcaggggtggagaaagacactcctgatagttagtcatgatcagggtttcctcgacgatgtgtgcacagatataatccatttggacgcccagaggctccactactaccgaggaaactacatgacgtttaaaaaaatgtaccagcagaaacaaaaggagttgcttaaacagtatgagaagcaggagaagaagttgaaagagctgaaagcgggtggaaagtctaccaagcaggcagagaaacagacgaaggaggccttaactcgtaagcagcaaaaatgtaggcggaaaaatcaagacgaagagtcccaagaggctccggagctgttgaagcgccctaaagaatataccgttagatttacattccccgatccacctcctctttcccctccagtgctcggcctgcatggggtgaccttcggataccaggggcagaaaccccttttcaagaatctggatttcggcatagacatggacagccgcatttgcatagtcggacctaatggagtgggcaagtcaacactgctgctgctcctgactggtaaactaacaccaacccatggagaaatgaggaagaaccacaggctgaagattggtttctttaatcagcaatacgcggagcagctgaggatggaggaaactcccactgagtacctgcagcggggattcaatttgccgtatcaagatgccagaaagtgcctgggaagattcggtctcgaaagccacgcccatactatacagatctgtaaactgagtggtggacagaaggcccgtgttgtgttcgctgaattagcctgtcgcgagccagatgtcttgattctggatgagcccacaaacaatctcgacatcgaatctattgacgctctgggcgaagccattaatgaatataagggcgctgtgattgttgtgagccacgacgccagactgattaccgagacgaattgccagttatgggtagttgaagagcagtccgtctcccagatagacggcgatttcgaggattacaagcgagaggtgctcgaagcactgggggaagtgatggtcagcagacctcgggaatag

SEQ ID NO: 215459 - DNA, 717 bp, Artificial Sequence
  Description of Artificial Sequence: Synthetic coding sequence
atgcccaaggctcctaaacagcagccacccgagccggagtggatcggggacggtgagagcacatcaccctcagataaggtcgtcaaaaagggcaagaaggacaaaaagattaaaaagacattcttcgaggaactcgcagtcgaggacaagcaggccggagaagaagaaaaggtattgaaggaaaaggagcagcaacagcagcagcagcagcagcagcagaaaaagaagcgagataccaggaaagggaggaggaagaaggacgtggacgacgatggggaagaaaaagagctgatggaacgcctcaagaagctttcccgagggtttaatctgccctatcaggatgcccgaaaatgtcttggccgtttcgggctggagtcacacgcgcataccatacagatttgcaaactcagcggaggccagaaggctcgagtggtgttcgccgaactggcctgtagggagccagacgtgctgattcttgacgagcctaccaataatctcgacatcgagtccattgacgctctgggagaggccattaacgagtataaaggcgctgtaatcgtagttagccacgacgcaaggctcattacggagactaattgtcagttgtgggtggtggaagagcagagcgtgtcacagatagatggtgattttgaggattacaagcgagaggtgctcgaggcgctgggggaagtgatggtgagtcggcctcgggaatag

SEQ ID NO: 215460 - DNA, 1023 bp, Artificial Sequence
  Description of Artificial Sequence: Synthetic coding sequence
atgcccaaggccccaaagcagcaaccgccagagcccgagtggatcggggatggggaatccacaagcccatccgataaagtcgtgaagaagggaaaaaaagacaaaaaaattaagaagacattttttgaggagctggctgtagaggacaagcaggcgggagaagaagagaaggtgctcaaggaaaaggaacaacagcagcagcagcaacagcaacaacagcagaagaaaaaaagggatactcgcaaaggacggaggaaaaaggacgtggacgacgacggtgaggaaaaggagttaatggagaggctgaagaaattatctgtccctacctccgacgaagaagatgaggtgcccgcaccaaaacctaggggtgggaagaaaaccaaaggcggaaacgtattcgccgctctgattcaggatcagagcgaggaagaagaagaagaagaaaagcaccctcccaagccggctaaacctgagaaaaatcgaatcaacaaggccgtaagtgaagagcagcagcccgcactcaaagggaagaaggggaaggaagagaagagcaagggcaaggccaaaccccagaataagtttgctgcgctcgataacgaagaggaagataaggaggaggagatcattaaggaaaaagaacccccaaaacaggggaaggaaaaggctaagaaggctgaacagggaagcgaagaggagggtgagggcgaagaggaggaggaggaggggggagaatctaaagccgacgatccatacgcccatctctccaagaaggagaagaagaaacttaagaaacagatggagtacgaaaggcaagtcgctagcctgaaggccgctaatgccgctgaaaacgacttttcagtaagtcaggccgagatgagctcgcgtcaggccatgcttgagaatgcgagcgacatcaagttggaaaaatttagtattagtgcgcacgggaaagaactatttgtgaatgctgatctctatatcgtcgccggtcgacgatatggattggttggcccaaatgggtag

SEQ ID NO: 215461 - DNA, 2538 bp, Artificial Sequence
  Description of Artificial Sequence: Synthetic coding sequence
atgcctaaggcaccgaagcaacagcccccagagcctgagtggatcggcgatggagagtcgactagtccctcagacaaagttgtgaagaagggcaagaaggacaaaaaaatcaaaaaaaccttttttgaagagctcgcggtggaagataagcaggcaggagaggaggagaaagtgctgaaagagaaggagcagcagcaacagcagcagcaacagcagcagaagaaaaaaagagacacccgtaaggggaggcgtaaaaaggacgtcgacgacgacggcgaagagaaagagctaatggagaggttgaaaaagctgagtgtaccgacctcagacgaggaggatgaagtgccggcaccgaaacccagagggggaaagaaaactaaggggggtaacgtttttgccgctctgattcaagaccaaagcgaagaggaggaggaagaagaaaagcatcctccgaaacccgctaagcctgaaaagaacaggataaataaggccgtctccgaggagcagcagccagcgctgaagggcaaaaaagggaaagaggagaaaagcaaagggaaggcaaagcctcagaacaagttcgcagcactcgataatgaagaagaagataaggaggaggagatcatcaaggaaaaggaaccccctaagcaagggaaggagaaagccaaaaaggccgagcaggggtccgaggaggaaggggagggcgaagaggaggaggaggagggtggcgaaagcaaggctgacgatccttacgcacacctgagtaagaaggaaaagaagaagctcaagaagcagatggagtacgaaaggcaggttgcctctttgaaggcagccaatgccgctgagaatgacttctccgtgtcacaggccgagatgtcatcgaggcaggccatgcttgaaaatgccagcgatatcaagcttgagaaattctccattagcgcgcatggaaaggagttatttgtaaatgccgatctgtacattgtcgctggaagacgatatggcctggtgggacctaatggcaaggggaaaaccactttgctgaagcatattgccaatcgcgcactctcaatcccaccaaacatagatgtactgttatgcgagcaagaagtagtggctgacgagactcccgcagtgcaggccgttctgagagcggacacaaaaagactcaaactgttggaggaggagcggcgacttcaggggcaactggagcagggtgatgacacggctgctgaacgactggaaaaagtctatgaggagcttcgggctactggggcagctgccgcagaggccaaagcaagacgcatcctcgctgggctgggattcgacccggaaatgcagaataggcccacccaaaaattctctggcggttggcgaatgcgcgtctcgctcgcgagggccttatttatggaaccgaccctcttaatgcttgacgagcccactaatcaccttgacctcaacgctgtcatttggttgaataactacctgcagggctggcgcaagactctgttaatcgtcagccatgatcaggggtttctggatgacgtctgcacagacataattcacctggacgcacaaagactgcactattatcggggaaattatatgacgttcaagaaaatgtaccaacagaaacagaaggagctactaaagcagtacgaaaaacaggagaaaaagctcaaggaacttaaagctggaggcaagtctacaaagcaagctgaaaagcagacaaaggaagcactgacccgaaagcagcaaaaatgccgcaggaaaaaccaggatgaggaaagtcaggaggccccagagcttctgaagcgcccaaaggaatatacagtgcgcttcactttcccggaccccccacccctgtcaccaccagtccttgggctccacggtgtgacctttggctatcaggggcagaagcccctgttcaaaaaccttgattttgggatagacatggattcaagaatatgtatcgtgggcccaaatggggtgggtaaatcgacactactattgctcctgactggaaaactgaccccgacacatggtgaaatgcggaaaaatcacagattgaagatcggtttcttcaatcagcagtacgcagagcagctccggatggaggaaacacccacggagtatctgcaaagagggttcaatctcccttatcaggacgccaggaagtgcttaggtcgcttcggactggaaagtcatgcacacactattcagatctgtaaactttctgggggacagaaggctcgcgttgtgttcgccgaactcgcttgccgagagcccgacgtgctgatccttgacgagccaactaataacctggacattgaaagtattgacgctttgggagaagctatcaacgaatacaagggagctgtgatcgtggtgagtcacgatgctagactgatcaccgaaaccaactgccagctgtgggtggtcgaggaacaatccgtgtcccaaattgacggcgatttcgaggactataagagagaagtgctggaggcgctcggagaggttatggtgtcaaggccgagagaatag

SEQ ID NO: 215462 - DNA, 1023 bp, Artificial Sequence
  Description of Artificial Sequence: Synthetic coding sequence
atgcctaaggctcctaagcagcagccgccagaaccagaatggatcggagacggggagtccacttcaccatctgataaggtggttaagaagggtaagaaggacaagaagattaaaaaaacgttttttgaggagttggctgtggaagataaacaggctggcgaagaggaaaaggtactcaaggaaaaagaacagcagcagcagcagcagcaacagcagcaacagaaaaagaaacgggacaccaggaagggtcgacgcaaaaaagatgttgacgacgatggggaggaaaaagaattgatggagcgattgaaaaaactgagtgttccaacgtcagatgaagaagacgaggtacctgccccaaagcctcgcggaggcaaaaaaactaaaggagggaatgtctttgcagcccttatccaagatcagagcgaggaggaagaggaggaggagaaacaccctccaaaaccagcaaagcccgagaagaatagaatcaacaaagctgtctcggaggaacagcaaccggctctgaaggggaaaaagggaaaagaggagaaatctaagggcaaggcaaaaccacagaacaaattcgcggcactcgacaacgaggaggaagataaggaggaagagatcatcaaggagaaagaacccccaaaacagggcaaggagaaggcaaaaaaggcggagcagggtagcgaggaggagggcgagggcgaagaagaggaagaagaaggcggtgaaagtaaggctgacgatccttacgcacatctgtcaaaaaaggaaaagaagaagctgaagaaacaaatggaatatgagcgccaggtggctagcttgaaagctgccaacgcagctgagaacgacttctccgtttcccaagccgaaatgtcaagcaggcaggccatgctggagaacgcctccgatatcaagcttgaaaagttttccatttccgcgcacggtaaagagctattcgttaacgctgacctgtacattgtggctggtcgtagatacggcctggtgggtcccaatggatag

SEQ ID NO: 215463 - DNA, 2538 bp, Artificial Sequence
  Description of Artificial Sequence: Synthetic coding sequence
atgccgaaggcgccaaaacaacaaccccctgaaccagagtggatcggtgatggcgagtctactagcccaagcgacaaagttgtgaagaagggtaaaaaagataagaagattaaaaaaacattttttgaggaactagccgtggaggataaacaagcaggcgaggaagagaaagttttaaaagaaaaggagcagcagcagcagcaacagcagcaacaacagaagaagaagagagacacccgcaaagggagacgcaaaaaggatgtggatgacgacggtgaggagaaagagctgatggagaggctcaagaagctgtccgttccaacctctgatgaggaggacgaagtgcctgcgccaaagccccgtggcggaaaaaaaacaaaaggaggaaatgttttcgcagccctgatccaggatcagtccgaagaagaggaggaggaggaaaagcatccaccaaagccagccaaacctgagaagaacaggatcaacaaagccgtgtcagaggagcagcaaccggctcttaaaggaaaaaaaggtaaagaagagaaaagcaagggcaaagccaagccccaaaataaattcgccgctcttgataatgaagaggaggataaggaagaggaaattattaaagaaaaagaaccgccaaagcagggaaaagaaaaggccaaaaaagccgagcaaggctctgaagaagagggcgagggtgaggaggaggaagaagagggaggagagtccaaagcggatgatccctatgcccatctttctaagaaggaaaagaagaagctgaagaagcagatggagtatgagaggcaggtggcttctttaaaggctgcaaatgctgcggagaacgacttcagcgtgtcacaggctgagatgagtagtcgacaagctatgttagaaaacgcaagtgacattaagctggagaagttctctatctccgcacacggcaaagaacttttcgtgaacgctgatctttatatcgtggccggtcggaggtacggcctggtcggcccaaacggaaaagggaaaacgacgctcctcaagcacatcgcaaatagagcactgtcaattcctcctaatatcgacgtactgctgtgtgagcaagaggtagtggcagacgaaacgcctgccgtgcaggccgtgttgcgggctgataccaagcggttaaagctgctagaagaagaacgaaggctgcagggacaattggagcagggggacgacaccgccgctgaacggttagagaaggtgtatgaggaactgcgggcaaccggagctgccgcagccgaagccaaagcgaggcgaatcctggcgggactaggttttgatcccgaaatgcagaaccggcctacacaaaagttttctggagggtggaggatgagggtgtctttagctcgggctcttttcatggaacccaccctgttgatgctggacgaacctaccaatcatctcgacttgaatgctgtcatatggctaaacaactatttgcagggctggcggaagacgctgcttatagtgtcgcatgaccagggatttttagatgacgtctgtacagatattattcacctcgacgctcaacgtctgcactactatagaggcaactatatgacgtttaaaaaaatgtatcagcaaaagcagaaggaattgctgaagcagtacgagaaacaggagaaaaaactcaaagagctgaaagctggcggtaaatctacaaagcaggctgaaaagcagaccaaagaggccctgacccgaaagcagcaaaagtgtcgcaggaagaatcaggatgaagagagccaggaggcacccgagttgctgaaacgccctaaggaatacacagtgcgttttacttttcccgatccccctccattaagtccccctgtgttggggctgcacggtgtgacattcggctaccagggtcaaaagcctctattcaagaatttggattttggaattgacatggactccagaatctgcattgtcggtccgaatggcgtggggaaatcgactctcctgctcctgctgactggaaagcttactccaacccatggtgagatgaggaagaaccaccgcctgaagatcgggttttttaaccagcaatacgcggaacaactccgaatggaggaaactcctaccgaatatttacagcgagggtttaacctgccgtaccaggacgcccgaaagtgtctgggcaggttcgggctggagtcccatgctcacaccatccaaatctgcaagctctccggtggacaaaaagctcgagtcgtgtttgctgaacttgcatgccgcgagccggatgtgctgatcttggacgagccaactaataatctggacatagaaagtattgatgctttgggggaagccattaacgagtataaaggggctgttatagttgtgtcccatgacgccagactcatcaccgagacaaactgccagttgtgggtcgtggaagaacagtctgtgtctcagattgatggtgactttgaagattataagagggaggtcctggaggctctgggggaggtaatggtgtctagacctcgagaatag

SEQ ID NO: 215464 - DNA, 1023 bp, Artificial Sequence
  Description of Artificial Sequence: Synthetic coding sequence
atgcctaaggccccaaaacagcagcctcccgagcctgaatggataggtgatggagaatctacttctcccagtgacaaggttgtcaagaagggcaaaaaggataagaagatcaaaaagacatttttcgaagagctggcggtcgaggataaacaggccggagaggaagaaaaggtgctgaaggagaaagaacagcaacagcagcagcaacagcagcaacaacagaagaaaaagcgcgacacacgtaagggcaggagaaagaaagacgtcgatgatgatggagaagagaaagagctgatggagcgcctgaaaaaattgtccgtgcctacaagcgatgaggaggacgaagtaccagcccctaaaccacgcggaggtaagaaaacgaagggcggaaatgtgtttgcggctctcatccaggatcagagtgaagaggaggaagaggaagagaaacacccccctaagccggctaagccagagaagaacagaatcaataaagcggtgagcgaagagcagcagcccgctcttaagggcaagaaaggcaaagaagagaagtccaaaggaaaagctaagccccagaacaaattcgccgctctggataacgaagaagaagacaaggaagaggaaattatcaaggaaaaggagccgccaaagcagggaaaagaaaaggctaagaaagccgagcaggggtctgaggaggagggggagggtgaggaggaggaggaagaagggggagaatccaaagcagacgacccctacgctcatttatccaaaaaggaaaaaaagaagctgaaaaagcagatggaatatgaaagacaggtcgcgtctctcaaggcagccaacgctgcagaaaatgacttctccgtgagccaagccgaaatgtccagccgtcaggctatgctggaaaacgccagcgacattaagctcgagaagtttagtatctctgctcacggaaaagaactattcgtcaatgcggacctctatattgtcgctggacggagatacggactcgttggccctaacggctag

SEQ ID NO: 215465 - DNA, 1023 bp, Artificial Sequence
  Description of Artificial Sequence: Synthetic coding sequence
atgcctaaagctccaaaacaacagccacctgaacccgagtggattggggatggtgagagcacctcaccatccgacaaggtcgtgaaaaagggcaaaaaagataaaaagattaaaaagacgttttttgaggagttggccgttgaggacaaacaggctggagaggaagaaaaggtccttaaagagaaggagcagcagcagcagcagcagcaacagcaacagcagaagaagaagcgcgacacacggaagggtagacgaaagaaggacgtagatgacgatggggaggaaaaggaactcatggagaggttgaaaaagctgtcagtgcctaccagcgacgaggaggacgaggtcccagccccaaagcccagggggggaaaaaagaccaagggcggtaatgtatttgcggcattgatccaggaccagtctgaggaggaggaagaagaagagaaacaccccccaaagccagcaaagcctgagaagaaccggataaacaaagccgtaagcgaagaacagcagccagccttgaagggaaaaaagggcaaggaagagaaatcaaaaggtaaagcgaagccccaaaataagtttgcagcccttgacaacgaggaggaagataaggaagaggagataattaaggagaaggaaccacccaagcagggaaaggagaaagccaagaaggctgagcaaggttccgaggaggagggtgagggcgaggaggaggaggaggaaggaggcgagagcaaagctgatgatccgtatgcacacctgagcaaaaaggaaaagaagaaactgaagaagcaaatggagtatgagagacaggtcgcctcactgaaagccgcaaacgccgctgagaacgatttcagtgttagccaggccgaaatgtctagtagacaggctatgctggagaacgcatctgacattaaactcgaaaagttttcaatctctgcccacggtaaagagctattcgtgaatgccgatctttacatcgtggctggccgaagatacggactggtagggccaaatggatag

SEQ ID NO: 215466 - DNA, 1023 bp, Artificial Sequence
  Description of Artificial Sequence: Synthetic coding sequence
atgccaaaggcccctaaacagcagccccctgagccggaatggattggcgacggcgagtcgacttcccctagcgacaaagtcgtgaaaaaaggcaagaaagacaaaaagattaaaaagacctttttcgaagaactggcagtggaggataagcaggcaggcgaagaagagaaggtactgaaagagaaagaacagcagcagcagcagcagcaacaacagcagcagaagaagaaaagagatacgagaaaagggaggcgcaaaaaggacgtagatgatgacggggaggagaaagaattgatggagcgactgaagaaactgtcagtaccgacctccgacgaggaagacgaagtaccagcccctaagccgagaggaggaaagaaaacgaaaggcggtaacgttttcgctgccttgattcaggatcaatccgaagaggaggaggaggaggaaaagcaccccccaaaacctgctaagcccgaaaagaaccggattaacaaggccgtgtctgaggagcagcagcccgcattgaaaggtaaaaagggaaaagaggagaagagtaaaggaaaggccaagcctcagaacaagttcgccgcactggacaacgaggaggaagataaagaagaagagatcattaaggagaaggagccacctaagcagggcaaagaaaaggcgaagaaggcagagcaggggtccgaggaagagggtgaaggagaggaagaggaggaggagggcggagaatcaaaggctgatgacccctacgcacacttgtcaaagaaggaaaagaagaagctgaaaaagcagatggaatacgaacggcaggtggccagtctcaaggctgccaatgcagccgaaaacgactttagtgtgagccaagccgaaatgagtagtaggcaggcgatgctggagaatgcctcagatattaagctcgagaagttcagcataagcgcccatggaaaggagttattcgtgaatgccgacctctatattgtcgctggaagacgttacggtctggtcgggcctaatggctag

SEQ ID NO: 215467 - DNA, 1023 bp, Artificial Sequence
  Description of Artificial Sequence: Synthetic coding sequence
atgccgaaagctcctaaacagcagccgccagagcccgagtggataggggacggggaatccacatctccaagtgataaggtggtaaagaaggggaagaaagacaaaaagatcaaaaagacctttttcgaagagctggctgtcgaggacaaacaggcgggtgaggaagagaaagttctgaaggagaaggaacagcagcagcagcagcagcagcaacagcaacagaaaaagaagcgggacacaagaaaaggccgtagaaaaaaagacgtggatgacgacggcgaggaaaaagagttaatggagagacttaagaaactgtctgtgcctacaagtgacgaggaggacgaggttcccgcacccaagcctcggggtggcaagaaaactaagggagggaatgtgttcgccgcattgatccaagatcagtccgaggaagaagaagaagaggaaaagcatccacctaagcctgctaaacctgaaaagaatagaattaacaaggcagtgtctgaagagcaacaacctgccttaaaggggaagaagggaaaggaggaaaagagtaagggaaaggctaagcctcagaacaaattcgcagctctcgataatgaggaggaggataaggaggaagaaatcattaaggagaaggaacccccaaaacagggaaaggagaaagctaagaaggccgagcagggcagcgaggaggaaggggaaggcgaagaagaggaagaggagggcggagagtctaaagcagatgacccctacgcccaccttagcaagaaggaaaaaaaaaagctcaaaaagcaaatggagtacgaaagacaggtggcctcgctgaaggctgctaatgcagcggaaaatgacttctccgtctcccaggccgagatgagctcacggcaggcaatgctggagaatgcaagtgatatcaagctagagaaattcagcatctcagctcatggaaaggagctgttcgtgaatgcagatctgtacatcgtcgctggaaggcgctatgggctcgttggacccaacggttag

SEQ ID NO: 215468 - DNA, 2424 bp, Artificial Sequence
  Description of Artificial Sequence: Synthetic coding sequence
atgcctaaagctccaaagcaacaacctcctgaacctgaatggatcggagatggtgaatctacatctccctccgataaggttgtgaagaaaggaaaaaaagacaaaaaaatcaaaaaaacattttttgaggagctcgcagtggaagacaaacaagctggcgaagaggaaaaagtactgaaggaaaaagaacagcagcagcagcaacagcagcagcagcagaagaagaaacgggacacccggaaaggcaggagaaaaaaagacgtggacgacgacggagaagaaaaagaattaatggaaaggttaaaaaagctgtcagtgcctaccagcgatgaggaagatgaggtgcccgctccaaagccgcgtgggggaaagaagactaagggcggtaatgtattcgccgcactgatccaggaccagagcgaagaggaggaagaagaagagaagcatcccccaaagccagcaaagcctgaaaagaaccggatcaataaggctgtgtctgaggaacagcagccagcactgaagggcaaaaagggtaaagaagagaagagcaagggcaaggccaagccacagaacaaatttgccgctttggataatgaggaagaggacaaagaagaagaaatcattaaggagaaagaacctccgaagcagggaaaagaaaaagccaagaaagccgaacagatggaatatgagcggcaggttgcctcccttaaagccgctaacgccgctgagaatgacttcagcgtctcccaggccgaaatgagctccagacaagctatgctggagaacgctagcgacattaaactggaaaagttctcaattagcgcacacggcaaggaactgtttgtgaatgccgacctctacatagttgctggccgaagatacgggcttgtaggacctaacggcaaaggaaagacgacactcctcaagcacattgccaatagagcgctgagtatcccccctaatattgatgtactcctgtgcgaacaggaggttgttgcggatgagacccctgccgttcaggctgtccttcgagctgacactaaacgcttaaagctgctcgaggaggagaggcggttgcaggggcaattagaacaaggcgatgataccgccgctgagcggctggagaaggtatatgaggagttaagagctaccggagctgccgctgcggaagccaaggccaggagaatcctggccggacttggctttgacccggaaatgcagaaccgaccaacacagaaattcagtggcggttggaggatgcgcgtgagcctcgcccgagccttgttcatggagccgactcttctaatgcttgatgaacccaccaaccatttagatcttaacgcagtgatctggctgaacaattatttgcaaggttggcggaagaccctccttattgtttcgcacgatcagggctttctggacgacgtatgcactgatatcatccatctggacgctcagaggttacattactacagagggaactacatgacattcaagaaaatgtaccaacaaaagcagaaagagctgctcaagcagtatgagaaacaggagaaaaaattgaaggaactgaaggcaggagggaagagcacaaaacaggcggagaaacagacaaaagaggcactgacccgcaaacagcagaagtgtcgtcggaaaaaccaggacgaggagagtcaggaggcgccagagttactcaagcgccctaaggaatacaccgttcgattcacatttccagatcccccaccgctgagcccaccggttctgggcttacacggcgtcacatttgggtaccagggccagaagcccctgttcaagaatcttgacttcgggatcgatatggactcacgtatctgcattgtcggaccaaacggggtgggtaagagcaccctgttgttgctattgaccggaaagctgacccccacacatggagagatgaggaagaatcataggctgaagataggtttcttcaaccagcagtatgccgaacagctccgaatggaagaaacaccgactgagtatcttcagcgcggttttaacctcccctatcaggatgccaggaagtgtctgggcagattcggattggagtcccacgctcatactatacagatttgtaagctctcaggtggccagaaagctagagtcgtttttgcagagctggcttgccgggagccggacgttctgattctggacgagccgacgaataatctggatatcgaatccattgacgcattgggcgaggccatcaatgaatataaaggggcagttatagtagtgtcacatgatgcccgactgatcaccgagactaactgtcagttatgggtggtcgaagagcagtctgtcagccagattgatggcgatttcgaagattacaaacgggaagtgctcgaagccctcggggaagtaatggtgagtcggcctagggaatag

SEQ ID NO: 215469 - DNA, 2424 bp, Artificial Sequence
  Description of Artificial Sequence: Synthetic coding sequence
atgcctaaagccccaaaacaacagcctcccgagcccgaatggatcggagatggagagtccacctccccatccgacaaagtcgtgaagaagggaaagaaggacaagaaaattaaaaaaactttctttgaagaactcgctgtggaggacaaacaggcaggggaggaagagaaagtcttgaaggagaaggagcagcaacagcagcaacagcaacagcaacaaaagaagaaacgtgacacgcgaaagggacggcgaaaaaaggatgtagacgacgatggagaagaaaaggagctgatggaacggcttaaaaagctgagcgttccaaccagcgatgaggaagatgaggttccagcacccaaacctaggggagggaagaagacaaaaggcggaaatgtgttcgcagcactcatccaggaccaatcagaggaagaagaagaggaagaaaagcaccctcctaagcctgcgaagcccgaaaaaaaccgcataaacaaagccgtgagcgaggagcagcagcctgctctgaaaggtaagaagggcaaggaggaaaaaagtaaaggcaaagccaagccccagaataaattcgcggctcttgacaacgaagaagaggacaaagaggaggaaatcatcaaggagaaggaaccacccaagcagggtaaagaaaaagccaaaaaggcagaacagatggagtacgaacggcaagtggctagtctgaaagccgcaaacgccgcagaaaacgatttctctgtctcccaggccgagatgtcatcacggcaggctatgctggagaatgcgtccgatataaagctcgaaaagtttagcatttccgcgcatgggaaggaactctttgtcaacgcagacttgtatatcgttgccggaaggaggtatggcctggtcggcccaaacggaaaagggaagaccaccctgttgaagcatatcgctaatagggctctgtcaatacccccaaatattgacgtgctcttatgcgaacaggaggtcgtggcggatgagactcccgcagtgcaggcagtgctgcgggcagacacaaagcgattgaagctgttggaggaagagagaaggttgcagggccagttagaacagggggacgacactgccgctgagaggctcgagaaagtctatgaggagcttcgggctacgggggcagcagccgcagaggcaaaggctagaagaatcctagcagggctgggctttgatcctgagatgcagaacaggccaactcagaaattctctggaggctggcgtatgcgcgtgtctctcgccagggcactgtttatggaacctaccctgttgatgctggatgagcccactaaccatcttgacctgaacgcagtcatctggctgaataattatctgcagggctggaggaagaccttactgatcgtgtcacatgaccagggattcctggacgacgtctgcacagatatcatacaccttgatgctcaacgattgcactactaccgaggaaactatatgactttcaaaaaaatgtatcagcagaaacaaaaggaactgctcaagcagtacgagaagcaagaaaagaaattgaaagagctcaaagcaggaggcaagtcgactaagcaggctgaaaaacagactaaagaagccctcactaggaagcaacaaaaatgtagacgcaagaatcaggacgaagagtcacaggaggcccctgaactcctgaagcgaccgaaggaatatacggtccggttcacctttcctgacccaccccctttgtcccctcctgtcttgggactccatggtgtcacattcggctatcagggccagaagccactgttcaagaatctggattttggcatcgacatggacagtcgaatttgcatagttgggcctaatggggtgggaaaaagcacgctgctgctgctgctcaccgggaaactgacccccactcacggagagatgcggaagaatcatcgtctgaaaattggatttttcaatcaacagtatgctgaacagctgcgcatggaagagacacccacagagtacttgcagaggggcttcaatctcccataccaggatgcgcgtaaatgcctaggtagattcgggcttgaaagccacgctcataccattcagatctgtaagttgagcgggggacagaaggctcgcgtcgttttcgcagaattagcttgccgggaacctgatgtgctcatcttggacgagccaactaataacttagacatcgagtccatagacgcactcggtgaagccataaacgagtataaaggtgccgtaatagtcgtatcacatgatgcaaggctgattacagaaactaattgccaactttgggtagtggaggaacagagcgtctcacagatcgacggcgatttcgaagactacaaacgtgaagtgctggaggccctaggcgaggttatggtttcaagaccaagagaatag

SEQ ID NO: 215470 - DNA, 717 bp, Artificial Sequence
  Description of Artificial Sequence: Synthetic coding sequence
atgcccaaagccccaaagcagcaaccgccagaacccgagtggataggagacggggaatccaccagtccttctgataaggtcgtgaagaagggcaaaaaggacaaaaaaatcaaaaaaacattctttgaagagctcgcagtcgaggataaacaggctggagaggaggaaaaggtcctgaaggagaaggagcagcaacaacagcagcaacaacaacagcagaaaaagaagcgagatacacgcaaaggaaggcgcaagaaagacgtcgacgatgacggcgaggaaaaagaactgatggagcgtctgaaaaaactgagtagaggcttcaaccttccctatcaggacgccagaaaatgcctgggtcggtttggattggagtctcatgcccacacaattcagatatgcaaactatccggcggtcagaaagctagagtagtgttcgctgaactcgcatgtagggaacccgacgtgttgatattggacgagcccaccaacaatctggatatcgagtccatcgacgccctgggcgaggccatcaacgaatacaagggagccgtgatcgttgtttcgcacgatgcgaggctgatcactgagacgaactgccagctgtgggtcgtggaggaacagtctgtatctcagattgacggtgattttgaggactacaagcgcgaagtcttggaggccctcggggaagtcatggtcagccgccctagggagtag

SEQ ID NO: 215471 - DNA, 1602 bp, Artificial Sequence
  Description of Artificial Sequence: Synthetic coding sequence
atgcccaaagcacccaaacagcagccacccgagcctgagtggattggggacggagagtccaccagtccctccgataaggtcgtgaaaaagggcaagaaggacaaaaagatcaagaaaaccttctttgaagaattggccgtggaggataaacaggccggagaagaggagaaagtgctcaaagaaaaggagcaacagcagcagcagcagcaacaacaacaacagaaaaagaaacgcgatactcgcaaggggaggcgaaagaaggatgttgacgatgatggggaggaaaaagagcttatggagcgtctgaaaaaactgtccgtgccaactagtgacgaggaggacgaggtccctgcgcctaaacccagaggaggtaaaaagacgaaagggggtaacgtgtttgccgctctgattcaggatcagagtgaagaagaagaggaggaggagaagcacccccctaagcccgctaaaccggagaagaaccgaatcaacaaggcggtcagcgaagaacagcagccagctctgaagggcaagaaggggaaagaggaaaagtcaaaaggaaaagctaaaccacagaacaagttcgccgcactcgataacgaggaggaggataaagaggaagaaatcatcaaggagaaagagcccccaaagcaggggaaagaaaaggccaaaaaagctgagcaaggcagcgaagaagaaggcgaaggcgaggaggaagaagaagagggcggagaatctaaggccgatgatccctacgcccacctgtccaagaaagagaaaaaaaagttaaagaaacaaatggagtacgagaggcaggtggccagcttaaaggccgcaaatgctgccgagaatgacttctctgtgagtcaggcagagatgtcttctagacaggccatgcttgagaatgcgagcgacataaaactggaaaaattctctattagtgctcatgggaaagaactctttgtaaatgcagacctctacatagttgccggacgaagatatgggctcgtaggccctaacggcaagggcaaaaccactttgctgaaacacatcgcaaacagagcacttagcatccccccaaatatcgacgttctcctctgcgaacaagaagttgtagctgatgagacccccgctgttcaagccgtcctgagggacgacaccgccgcagagaggcttgaaaaagtctatgaggagctgcgggcaactggcgctgctgcagctgaggcgaaggctaggagaatcttggcaggactaggtttcgacccagagatgcagaatagacctacacagaagttctcagggggttggcgtatgcgggtgagtctggctagggccctgttcatggagccaactttgctgatgctggatgagcccacgaacaatttagacatcgagtctatcgatgctctgggcgaggccatcaacgagtacaagggggctgtgatcgttgtctcacatgacgccagacttatcaccgagactaattgccagctgtgggtggtagaggaacagagtgtgtcacagatcgacggggacttcgaagattacaagagagaggtattagaggccctaggagaagtgatggtcagccggcctagggagtag

SEQ ID NO: 215472 - DNA, 717 bp, Artificial Sequence
  Description of Artificial Sequence: Synthetic coding sequence
atgccaaaggctcccaagcaacagccgcctgagccagaatggataggagatggtgaaagtaccagtccctcagacaaggtggtgaagaaggggaaaaaggacaaaaagatcaagaagaccttctttgaagagctcgccgtggaggataagcaagccggagaggaagagaaggtgttaaaagagaaagagcagcagcagcagcagcagcagcaacagcagaagaaaaagagagatacgagaaaaggcagacggaagaaggatgtggacgatgacggagaggaaaaggagttaatggagaggttaaaaaaactgtctagggggttcaatctcccatatcaagatgccagaaagtgtctggggcgattcgggctggaaagtcacgctcataccatccaaatctgcaagctgagcgggggacagaaggcacgggtcgtgttcgcggagctagcttgccgtgaaccagatgtgctcatccttgacgagcctaccaacaacttggatatcgagtcgattgatgcgctgggagaggccatcaatgagtacaaaggtgctgtgattgttgtgagtcatgacgctaggctgataacggaaacaaactgtcagctttgggtcgtggaggagcaaagtgtgtcccaaattgatggagactttgaagattacaaacgtgaggtcctggaagctctgggtgaagttatggtcagtaggcctcgcgagtag

SEQ ID NO: 215473 - DNA, 2538 bp, Artificial Sequence
  Description of Artificial Sequence: Synthetic coding sequence
atgccaaaagcgccaaaacagcaaccgcctgagcccgagtggatcggagacggagagagcacctctcccagcgataaagtggtgaaaaaaggcaagaaggacaagaaaatcaagaagacatttttcgaggagctggcagtcgaagacaagcaggctggcgaggaagaaaaggtattaaaagagaaagagcagcagcagcaacagcagcagcagcagcagaagaagaaaagggatacacggaagggccgacgtaagaaggacgtggatgacgatggcgaagaaaaggaactgatggagcggctcaagaagctgtctgtgccaacctcggacgaggaagatgaggttcctgctccaaagccccgtggtggcaagaagacaaaggggggaaatgtttttgcagctctgatccaggaccagtccgaggaggaagaggaggaggaaaaacatccaccgaaaccagctaagccagaaaagaaccgcatcaataaggccgtttccgaggagcagcagccagcccttaaaggtaagaaaggtaaggaagaaaagtccaagggcaaggcgaaaccccagaacaaattcgctgcactggacaatgaagaagaggacaaggaggaggaaatcataaaggagaaggagccgccaaagcagggaaaagaaaaggctaagaaggccgagcaggggagtgaagaggaaggcgagggcgaggaggaagaagaggaagggggagaaagcaaggcagacgacccctatgcccacttgtccaaaaaggaaaaaaaaaagctcaagaaacagatggagtatgaaaggcaggtagccagcctgaaggccgcaaacgctgccgagaacgacttcagcgtaagtcaggctgagatgagcagccgtcaggccatgctcgagaatgctagcgatatcaagctcgaaaagttttccatatccgcacacgggaaggagctttttgtaaatgcagatttatacatcgtagctgggaggaggtacggtctggtaggcccaaatgggaagggaaagaccacactgctaaagcatatcgccaacagggcactcagcattcctccaaacatcgacgtactcctttgcgagcaagaggtggtcgcggatgagactccagctgtgcaggccgtgctgagagctgacacgaagcgccttaagttgctcgaagaagagcggagactgcagggtcagctcgagcagggtgatgacaccgcagccgaaaggctggagaaggtgtacgaggaattgcgggctactggcgcagcagcagctgaggctaaggccagaagaatattggccggtctcggctttgaccccgagatgcagaaccggcctactcaaaagttcagcggaggatggcgaatgagagttagcctggcccgtgcattatttatggagccgaccctactgatgctggacgaacctaccaaccacctggaccttaacgctgttatttggcttaataattatctgcagggctggagaaagacattgctgatagtgagccacgaccagggattcctggatgatgtgtgtactgatatcatccatctcgatgctcagcggttgcattactatagggggaactacatgaccttcaagaaaatgtatcagcagaaacagaaagagctgttgaagcagtatgagaaacaagaaaagaaattgaaggagctgaaggccggaggaaagtctaccaagcaagctgagaaacagaccaaagaagccttgacacggaaacagcaaaaatgccgcaggaagaatcaggatgaagaatctcaagaggccccagagctgctgaagcgtccaaaagagtacaccgtgagattcacatttcccgacccccctcccctctctcctccagtgctgggcctgcacggtgtaacattcggataccaaggacagaagccactgtttaagaacctggactttggcattgatatggatagtagaatatgcatagtgggtcctaacggcgtgggcaaaagcacattgttgctgcttcttaccggaaagttaacacctacgcacggcgaaatgaggaaaaatcacagattaaagatcggatttttcaaccagcaatacgccgagcaactgcggatggaagaaacaccgacggaatacctccagcggggattcaacctcccctatcaggacgcgcgtaaatgtttgggtagatttggcctggagagccatgcacataccatccagatttgtaagttaagcggaggtcagaaggccagggtcgtgttcgccgagctggcgtgccgtgaaccagacgtcctgatcctcgatgagcctactaacaacctggatattgaaagcattgatgctctgggggaggcgatcaacgaatataagggggcagttatcgtagtgagtcacgacgctaggcttatcacagaaactaattgccagctatgggtggtcgaagagcagtccgtgtcacaaatcgacggcgacttcgaggactataagcgcgaggtcctggaggccctaggggaggttatggtttctcgcccaagagagtag

SEQ ID NO: 215474 - DNA, 2538 bp, Artificial Sequence
  Description of Artificial Sequence: Synthetic coding sequence
atgccaaaggcccctaagcagcagcctcctgaaccagagtggataggtgatggcgagagcacctccccttctgacaaagtggttaagaagggcaaaaaagataagaaaattaagaagaccttttttgaagaactggccgtggaggacaaacaggcaggcgaagaggaaaaggtcctaaaggagaaagagcaacagcaacaacaacagcaacagcagcaaaagaagaagagagacactcggaaaggcaggagaaagaaagacgtagacgatgacggagaagaaaaggaacttatggagcggcttaaaaaacttagtgtgccaacgagtgacgaggaggatgaagttccagctccaaaacctaggggcggtaaaaaaaccaaaggcggtaatgtattcgctgccctgattcaggaccagtcagaagaagaagaagaagaagagaagcaccctcccaagcctgccaagcccgagaaaaaccggattaacaaggccgtgagcgaagaacaacaacctgcacttaagggaaagaagggcaaagaagaaaagtcgaaaggcaaggcgaagccccagaacaaattcgccgctctcgacaatgaggaggaggacaaagaggaggagatcatcaaagagaaagagcccccaaagcaggggaaggagaaagcaaagaaagctgagcaaggctccgaggaggagggtgaaggagaagaagaggaagaggagggaggcgagtccaaggctgacgatccttacgcccatctttcaaagaaagagaagaagaaactgaagaaacagatggaatacgagaggcaggtggcatctttgaaagcggctaacgccgctgaaaacgacttttctgtatcgcaggccgagatgagtagccggcaggcaatgctggagaatgcgtccgatataaaactggagaagttctctatctccgcccacggcaaggagttattcgttaacgccgatttgtatatcgtcgctggcaggcggtatgggctcgtgggtcctaatggaaaaggaaagactacgctgcttaaacacatcgctaatagggcgctgagcattccaccaaatatcgatgtgttgctgtgcgaacaggaggtcgtggccgacgagacacccgcagtccaagccgtgctccgagctgacaccaagagactgaagctcctggaggaagagaggagactacaaggacagctggaacaaggtgatgataccgccgctgaacgcttagaaaaggtatacgaagagcttagagccaccggcgctgcggcagctgaggctaaagctagacggattctggctgggctggggttcgatccggaaatgcagaaccgcccaactcagaagttcagcggcggatggcgaatgcgggtgagtttagccagagctctcttcatggagccaacactgctgatgctggatgaacctaccaaccatctggacctcaatgctgtgatttggcttaataattaccttcaaggatggcgaaagaccttgttaatcgtgtcacacgaccagggcttcctagacgacgtctgtactgatattatacatctggacgcccaacggctccactattatcgcggtaattacatgacctttaagaagatgtatcagcaaaagcagaaagagttactcaaacagtacgaaaaacaggaaaagaaactgaaggaactcaaggccggtggcaagagtactaagcaggctgaaaagcaaactaaagaggccttgactaggaaacagcaaaagtgccgccgtaaaaaccaagacgaagaatctcaggaagcgcctgaactgctgaaacgacctaaagagtacaccgttcgatttacctttcccgatcctcctcctctgagcccacccgtgctgggactgcacggggtgactttcggataccaaggacaaaagcctctctttaaaaacctggactttggaattgatatggactctagaatctgtatcgtgggcccaaacggggtcggcaagagcacattgctgttactgctcacaggaaagctgactccgacccatggtgagatgcgcaagaaccatagattgaagattggattcttcaatcaacagtacgcagagcagctgagaatggaagaaactcctaccgagtaccttcagaggggtttcaacttgccttaccaggatgcacgtaaatgtctaggacgcttcggactcgagtcacatgcccacacaatacagatctgcaaactctcagggggtcagaaagcgagggtcgtttttgcggaactggcatgtcgggagcctgatgtgctcattctggacgagcccaccaataatctcgacatcgagtcaattgacgctctgggagaggcaattaacgagtacaagggagctgtgatcgtcgtgagtcatgatgccaggctgattactgagactaattgccaactctgggtggtggaggagcagtccgtcagccagattgatggagacttcgaagactataagcgcgaggttctggaagcattaggcgaagtcatggtgtcaagaccgagggagtag

SEQ ID NO: 215475 - DNA, 717 bp, Artificial Sequence
  Description of Artificial Sequence: Synthetic coding sequence
atgccgaaggcaccgaagcagcagcctccagaacctgagtggataggagatggtgaaagcactagccccagcgataaagtggtgaagaaggggaagaaagataaaaaaataaaaaaaaccttttttgaggagctcgcagtggaagacaagcaggccggtgaggaggagaaggtgctgaaggaaaaagagcagcagcaacagcagcaacagcagcagcagaagaaaaaaagggatacaagaaagggcaggagaaagaaagatgttgacgatgatggcgaagaaaaggaactgatggaacgcttaaaaaagctctccagagggtttaacctaccctatcaggacgccaggaagtgtttaggaagatttggtcttgagagccacgcccacactatccagatctgcaagctctcaggcggacagaaggcgagggttgtgtttgctgagctggcatgtcgcgagcccgacgtgctgattttggacgaaccaactaacaatctggatatcgagtccatcgacgctctcggggaggctattaacgaatacaaaggagctgtaattgtcgtgtctcacgatgccaggctcataacagaaaccaactgtcagctatgggtcgtcgaggaacagtcagtgtctcaaatagatggggacttcgaagattacaaaagagaggtgctcgaggcactcggcgaagttatggtcagcaggcctagagagtag

SEQ ID NO: 215476 - DNA, 1602 bp, Artificial Sequence
  Description of Artificial Sequence: Synthetic coding sequence
atgcccaaagctcctaaacaacagccccctgaacctgaatggatcggggacggcgaatccacttcgccttctgataaggttgttaagaaaggtaagaaggacaagaaaattaaaaagacttttttcgaggaactggccgtagaggataagcaagccggagaggaagaaaaagtcctcaaagagaaagagcagcagcagcagcagcagcagcagcagcagcagaaaaaaaagcgcgatactcggaagggacgccgaaagaaggatgtagatgacgatggggaggagaaggagctgatggaacggctaaaaaagttatccgtcccaacctccgacgaggaggacgaggttccggctcctaaaccgagaggcggtaagaaaactaaaggtggaaatgtgttcgccgctcttattcaggaccagtctgaagaggaggaagaggaagaaaaacatccaccgaagccagccaagccggaaaagaacagaatcaacaaggcggtatccgaagagcagcaaccagcattgaagggcaagaagggcaaggaggagaaatcaaaggggaaagccaaaccccaaaacaagtttgccgctctcgacaacgaagaagaggataaagaggaggaaattatcaaggaaaaagagccgccaaagcaaggaaaagagaaggccaaaaaagctgagcagggctctgaagaggaaggtgaaggcgaagaagaagaggaagagggcggagagagtaaggctgacgacccctacgctcatttatctaagaaggaaaagaagaaacttaagaaacagatggaatacgaacgccaagtggcttcattgaaggccgctaacgctgccgagaacgacttctcagtatcccaggcagagatgagcagtagacaggcaatgctggagaacgcttctgacattaaactggagaagttttctatctccgcccacggtaaagagctgttcgtcaatgcagatttgtacatagttgcgggacgacgatacggtcttgtgggtcctaacgggaagggcaaaactaccctgcttaagcatattgcgaatcgtgccctcagtatccctcctaatatcgacgtcttgctgtgcgaacaggaggtggtggctgatgaaacccccgcagtccaggccgtgttgcgcgatgatacagctgccgagagactggaaaaggtttatgaggagcttcgagctaccggcgcagcggctgcggaggccaaagcccgtaggatactggctggccttggcttcgatccggagatgcagaatagacctactcaaaagttttcagggggatggcggatgagagtgtccctggctagagccctatttatggaacctaccttactcatgctggacgagcccactaacaatctcgatatcgaatccatcgacgcgctcggagaggcaataaacgagtacaagggcgctgtcatagtggtgtctcatgatgccagactgatcaccgaaactaactgccagttatgggtggttgaggagcagtcggtgtcacagattgatggcgattttgaagactacaaaagggaggtactagaagccctgggggaagtgatggtctcacgtccacgggaatag

SEQ ID NO: 215477 - DNA, 1599 bp, Artificial Sequence
  Description of Artificial Sequence: Synthetic coding sequence
atgcccaaagcaccaaagcagcagcctccagagcccgaatggattggtgacggtgaaagcacttccccgtctgacaaggtggtgaagaaaggaaagaaagataagaagataaagaagaccttttttgaggaacttgccgtggaggacaaacaagccggtgaagaggagaaggtgttgaaagaaaaggagcaacaacagcagcagcagcagcagcaacagaaaaagaagagagacacacggaagggcaggcgtaaaaaggacgtggatgacgatggagaagagaaagaactcatggaacgccttaagaagctttccgtgccgacgtctgatgaagaggatgaggtgccggcaccaaagcccagaggcggaaaaaagaccaagggtgggaacgtcttcgctgctctaatacaggaccagtcagaggaggaggaggaagaagaaaagcatcctccaaaacccgctaagccagagaaaaatcgcattaacaaagcagtctcagaggaacaacagcctgcacttaaagggaaaaaagggaaggaggagaaaagcaagggcaaagctaagcctcagaacaagttcgccgcactggacaacgaggaagaggacaaggaagaggaaatcatcaaagaaaaagagccgccaaagcagggcaaagagaaggccaagaaggccgagcaagggagtgaagaggagggagaaggcgaagaagaggaggaggaaggcggagagagcaaggcagatgacccatacgcccatctctcaaagaaagaaaaaaaaaagctcaagaagcagatggagtacgagcgccaggtagctagcctgaaagcagcgaacgcagctgagaatgactttagtgtgtctcaggctgaaatgtcctctcggcaagctatgctggagaatgccagcgatattaagttggagaagttcagcatttccgcgcatggaaaggagctgtttgtaaacgcagacctatacatagtggccggacgtagatatggccttgttggtccaaacggcaagggtaagaccacactcctcaaacacattgcaaacagagccctgtcgattcctcccaatatcgatgtgctcctctgcgaacaagaagttgtcgccgatgagacaccggctgtgcaggccgtgctaagagacgataccgcagcagagcgccttgagaaagtctatgaagagcttagagccaccggggctgccgcagcagaagcaaaggccaggcgaattctcgctgggctgggcttcgatccagagatgcagaatcgacccactcagaagtttagcggcggatggaggatgcgagtgtcgctcgccagggccctttttatggagcccacactcttgatgttggatgaacccacgaacaatttggatattgaatccatcgacgcactcggagaggccatcaacgagtacaaaggcgcagtgatcgtcgtcagtcacgatgcgagactgatcactgagaccaactgtcaactgtgggtagtggaggaacagtccgtctcccagattgacggggattttgaggattataagcgagaggtccttgaggccctgggcgaggtaatggtgagtcggccaagggagtag

SEQ ID NO: 215478 - DNA, 1599 bp, Artificial Sequence
  Description of Artificial Sequence: Synthetic coding sequence
atgcccaaggcacctaagcagcaaccccctgagccagagtggataggagacggtgagtccacctctccaagcgataaggtagtgaagaaggggaagaaggataagaaaattaaaaagacctttttcgaggagctggccgtcgaagataaacaggctggcgaggaggaaaaagtgctgaaggagaaagaacagcagcaacagcaacaacagcagcagcagaaaaaaaagcgcgacaccagaaaagggagacgaaagaaagacgtcgatgacgacggagaggagaaggaattgatggagaggctgaagaaactgagcgtgcctacctctgacgaggaagatgaggtccctgcgcctaagcctcgagggggaaaaaagactaagggcggtaatgtctttgcagcactgatccaagatcagtccgaagaggaagaggaagaagagaagcatcccccaaagcccgctaagcctgagaaaaatcgaatcaacaaagcagttagcgaagagcagcaacccgctctcaagggtaaaaaagggaaggaagagaagagtaaggggaaagctaaaccccagaacaagttcgccgcacttgataacgaggaggaggacaaggaggaagagatcattaaagaaaaggaaccccctaagcagggcaaagagaaggcaaagaaagcggagcagggatccgaggaagaaggagagggagaggaggaagaggaggaaggaggggaaagcaaagcggacgacccgtacgcgcatttaagcaaaaaggagaagaagaaattgaagaaacagatggagtatgaaaggcaggtggcctcccttaaggccgcaaatgctgccgagaacgacttttctgtctctcaggcagaaatgtcatcccgacaggcgatgctggagaacgccagcgatatcaagctggaaaagttcagcatttctgcccacgggaaggaattattcgtgaacgctgacttatatatcgtcgcagggagacgctatggtctcgtaggccctaacgggaaaggtaaaacaaccttgcttaagcatattgctaacagggccctgtctatacccccaaacatagacgttctgctctgtgagcaggaggtggtcgcagatgagactcctgccgtgcaagcagtacttagggatgacacagcggctgagagactcgagaaggtgtatgaagagcttagggccacaggcgcagccgcagctgaagctaaggccaggcggattcttgccggtctggggtttgatcccgagatgcagaaccgtcctactcagaaattttccgggggatggaggatgcgggtttctcttgccagggccctgttcatggagcccacgctattaatgctcgacgaacctaccaataatctcgacattgaatccatcgacgcactgggggaagctatcaatgaatacaagggggcagtcatcgtagtgtctcacgatgctagactcataaccgagaccaattgccagctttgggttgtcgaagagcaaagcgtatctcagatcgacggagacttcgaagattacaagagagaagtactcgaggcccttggcgaagtgatggtaagcagacctagagaatag

SEQ ID NO: 215479 - DNA, 1599 bp, Artificial Sequence
  Description of Artificial Sequence: Synthetic coding sequence
atgcctaaagctccaaagcagcaaccacctgaacccgagtggattggtgacggcgaaagcacctccccatctgacaaggtggtcaagaaagggaagaaggacaaaaagatcaaaaagacctttttcgaggaactggccgttgaggataagcaagcgggtgaggaggaaaaagtcctgaaagaaaaagagcagcagcagcagcaacagcagcagcaacagaaaaagaaacgcgacactcggaaagggaggagaaagaaagatgtggacgatgacggcgaggaaaaggaactgatggagaggttaaagaagttgagcgtacccacgagcgatgaggaggacgaggtgccggcacctaaacctagaggcggaaaaaaaacaaaggggggaaatgtgttcgcagcgttgatccaggatcaaagcgaagaagaggaggaggaggagaaacatcccccaaagccagccaaacctgagaagaatcgcataaacaaagctgtgagcgaggaacagcagccagccctgaagggcaagaagggcaaggaggaaaagtccaaaggaaaggccaaaccccagaataagtttgcagccctggataatgaggaggaggacaaagaggaggagataatcaaagagaaagaaccgccaaagcaaggaaaggaaaaagccaagaaggcagagcaggggtccgaggaggagggagagggagaggaggaggaggaggaaggaggcgaatctaaagccgacgatccgtacgctcacctgagtaagaaggaaaagaagaagctgaaaaaacagatggaatatgaacggcaggtcgcttccttgaaggccgcaaacgccgctgagaatgacttctctgtctcacaggccgagatgtctagcaggcaggcaatgctggaaaatgcatccgacatcaaacttgagaagttttccattagtgcccacggaaaagagctcttcgttaatgctgacctatatatcgtggccggtaggcggtacggcctggtgggacctaacggcaaagggaaaacgacactcctcaagcatatcgcaaaccgggcattgagcatcccccctaatatcgacgttcttctctgtgaacaggaggtggtggcagacgagacccccgctgtccaggccgtactgcgggatgataccgctgcagagcgactcgagaaggtatatgaggaactcagagctacaggcgcagctgctgcagaggctaaggccagacggattttggctggcctgggctttgaccctgagatgcagaacaggcccacacaaaagtttagtggcggatggcgaatgagggtgagcctcgctagggcactgtttatggagcccacccttctcatgctggacgagcctactaataacctggatatcgaatccatcgatgctttgggagaggccattaatgagtataaaggagcagttatcgtggtctcgcacgacgcacgcctcatcactgaaactaactgtcagctttgggtcgtcgaagagcagagcgtaagccagattgatggggacttcgaggactacaagagagaagtgcttgaagcactgggagaagtgatggttagtcggccaagagagtag

SEQ ID NO: 215480 - DNA, 1599 bp, Artificial Sequence
  Description of Artificial Sequence: Synthetic coding sequence
atgcccaaagcccctaagcaacagcccccagagcctgagtggatcggagacggagagagtacaagtccatccgataaggtggttaaaaagggcaaaaaagataagaagataaaaaagacttttttcgaggaactggccgtcgaggataagcaagccggagaagaggagaaggtgcttaaagagaaggaacagcagcaacagcagcaacagcagcagcagaaaaagaaacgcgacacccggaaaggcaggagaaaaaaggacgtagacgatgacggtgaagaaaaggagctaatggaaaggctgaagaagctcagtgtgcctacctcagacgaagaggacgaggtgcccgctcccaagccacgaggcggaaaaaagaccaaagggggaaacgtgttcgcagcattaatacaagatcagtcagaggaggaggaggaagaggaaaaacatccacccaagcccgctaaacctgagaagaaccggataaataaggccgtttctgaagagcaacagccagcgctgaaggggaaaaaaggtaaggaagaaaaatcgaaaggtaaggccaaaccccagaacaagtttgccgctctggacaacgaggaggaagataaagaggaagagatcattaaggaaaaggagcctccaaaacaggggaaagagaaggccaaaaaagccgaacaaggcagtgaggaggagggtgaaggtgaagaagaagaggaggaaggaggggaaagtaaagccgacgatccttatgcccatctgagtaagaaggaaaaaaaaaaactgaaaaagcagatggaatacgaacggcaggtggcctcgctgaaggcggctaatgccgcagagaacgatttctccgtgagccaggccgagatgtcaagtaggcaggccatgttggaaaacgctagtgacatcaaactcgaaaagttctccatttccgcgcatggtaaggagttgtttgtgaatgcagacctatacatcgtcgccggtcggcgatacggactggtgggaccaaacggaaaagggaagaccactctgctgaagcacatcgctaacagggccctgagtattccacccaacattgatgtgctgctgtgcgaacaggaggtagtagctgacgaaacacccgctgttcaggccgtactgagagatgatacagctgctgaacggctagaaaaagtctatgaggagctacgagccaccggagccgctgcagccgaggcaaaggcgagaaggattctagcaggattagggttcgatccagagatgcagaatagaccaacccagaagttttccggcggatggaggatgcgagtaagccttgctagggccctgttcatggaacccaccctgctgatgctggatgagcctacaaacaatctcgacattgagagtattgacgccctgggggaagccatcaacgaatacaaaggcgctgtcatcgtcgttagccacgacgccagactcattaccgagaccaactgccagctgtgggtggtagaggaacaatccgtgtcacagatagacggggatttcgaggactataagagggaggttttggaagcactgggagaagttatggtgagcagaccgagagaatag

SEQ ID NO: 215481 - DNA, 1602 bp, Artificial Sequence
  Description of Artificial Sequence: Synthetic coding sequence
atgcccaaggccccaaagcaacaacctcctgagccagagtggatcggggatggagagtctaccagtccatctgataaggttgtgaagaaggggaaaaaggataaaaagataaagaaaaccttcttcgaagaactggccgtggaggataagcaagcgggagaagaggaaaaagtgcttaaggaaaaagagcagcagcagcagcaacaacagcagcaacagcagaagaagaagagggatactcggaaaggaaggaggaagaaagatgtggatgatgacggagaagagaaagaactaatggaaagactgaagaaattgtccgttcccacgtctgacgaagaagacgaggtgcccgctccgaagccgaggggaggcaagaagacaaagggcggaaatgtcttcgctgctcttattcaggaccagtcagaagaagaagaagaggaagagaagcacccacctaaaccagctaaaccagaaaaaaacagaatcaacaaggcggtctcagaggaacagcagcccgcattgaagggaaagaagggcaaggaggagaagagtaaaggaaaagccaagccacagaataagtttgccgcactcgataacgaagaggaggataaggaggaagagattataaaggagaaagagcctccgaaacagggcaaagagaaggcaaagaaggccgaacagggctcggaagaggaaggcgaaggtgaggaagaggaggaagagggcggagaatctaaggccgacgatccttacgcccacctgagtaagaaggaaaagaagaaacttaagaagcagatggagtacgaaaggcaagtcgcatctctgaaagccgctaacgctgccgagaatgacttttccgtgtcacaagccgaaatgtcctcgcggcaggccatgcttgagaacgcctcagatattaagctggagaaatttagcatctccgcccatggcaaggaactgtttgtgaacgcggacctttacatcgtagccggaaggaggtacgggctggtcggtcccaacgggaagggcaagactactctcctgaaacacatcgcgaatcgtgccctgagcataccacccaatattgatgtgctgctatgcgaacaagaagtggttgccgacgaaactcctgccgttcaggcagtccttcgcgatgataccgccgcagaaaggctggagaaagtgtacgaggaactacgcgctaccggtgctgctgccgcagaagcaaaagccaggcggatcctggctggcctgggatttgaccccgaaatgcagaatagacccactcagaaattcagtggaggatggcgtatgcgggtgtctctggccagagctttgttcatggagcctacgttactaatgttggatgaaccaaccaataaccttgacatagagtccatcgacgccttgggagaagccatcaatgaatacaagggcgcagtgatcgtagtatcccacgacgccaggctaatcacagaaactaattgccagctgtgggtggtcgaggagcagtctgtctcccagatagacggggactttgaggattacaagcgcgaggttcttgaagctctaggtgaagtgatggtgtcccgccctcgagagtag

SEQ ID NO: 215482 - DNA, 1515 bp, Artificial Sequence
  Description of Artificial Sequence: Synthetic coding sequence
atggacctgatcccgaattttgctatggagacatgggttctggtagcgacctccctcgtgctcctctacatctacggaacacactctcacaaactgttcaagaagcttggtataccgggtcctacacccctgccgtttctagggaccatcctgttttacctccgcggattatggaattttgatagagagtgtaatgaaaaatatggcgaaatgtggggactctatgaggggcagcagcccatgctcgtgattatggaccctgatatgataaagaccgtcctagtaaaagagtgctattccgtttttacaaatcaaatgcccctgggtcctatgggcttcttgaagtcagctttatccttcgccgaggatgaggagtggaagcggattaggacactgttgagtcctgcctttacatctgtgaaattcaaggagatggtaccaataatttctcagtgcggagacatgctagtgaggtcactcagacaggaagcagagaacagcaagagcattaatttgaaggactttttcggggcatacactatggacgtgatcacaggcaccctcttcggcgtaaatttagacagtctgaataatcctcaggacccttttctgaaaaacatgaagaagctgcttaagctcgactttttggatccgtttcttctgctcatctccctgtttccatttctcacgccggtgttcgaagctctgaatattggtctgtttccaaaggacgtgacacacttcttaaagaatagcatagaaagaatgaaagagagccgcttaaaggacaagcagaaacaccgggtcgacttttttcaacagatgattgacagtcagaacagcaaggaaaccaagagccataaggccctgagcgacctagagctggttgcgcagtctataatcattatcttcgccgcttacgacactacatccacaactttacctttcattatgtacgagttagcaactcatcccgatgtccagcagaagctgcaagaagaaattgacgccgtgctacctaacaaggcaccagtgacttacgacgctctggtgcagatggagtacctcgatatggtagtgaatgagacattacggctgttcccggtcgtgtctagagtcacacgtgtctgtaagaaggacatagaaataaatggcgtttttattcctaaggggctggccgtgatggttcccatctacgcgctccaccatgaccctaaatactggacagagccagaaaaattctgcccagaaagtcgtttctctaaaaagaataaagactctatagatctctacaggtacatccccttcggagccggtcctagaaattgtatcgggatgcgcttcgccctgaccaacatcaaacttgcggtcatcagggctctccaaaatttctcgtttaaaccctgtaaagagacacaaattcccctcaaattggacaatctccctatattgcagccggagaagcctattgtcctgaaggtccatctccgggatggaattacgagcgggccatag

SEQ ID NO: 215483 - DNA, 1872 bp, Artificial Sequence
  Description of Artificial Sequence: Synthetic coding sequence
atgccttcagatttagcgaagaagaaggccgcaaaaaagaaagaggccgcaaaagcccgtcaaaggccccgaaagggtcatgaagagaacggagacgtggtgacggaacctcaagtcgcagaaaagaacgaagcaaacggaagggaaacaacagaggtggatctgctaaccaaggaacttgaagatttcgagatgaaaaaagcagcggctagggcggtgaccggcgtcctcgcaagccatccgaactccacagatgtacacattatcaacttgtctctgacttttcacgggcaggaactgttatctgacaccaagcttgagctgaattctggtagacggtacggcctcatcgggcttaacggcatagggaaatccatgctgctgagcgccatcggaaagcgcgaagtcccaatacccgagcacatagatatctaccatctaacgagagagatgcctccctccgacaaaacaccactccattgtgtgatggaggtggatactgagcgggcaatgctcgaaaaggaggccgagcggctggcccacgaggatgccgagtgtgaaaagctcatggaattgtatgagaggctagaggaactcgacgctgataaggccgaaatgcgcgctagtcgtatcctccatggcttgggcttcacccccgctatgcagcggaagaaacttaaggacttttccgggggttggcggatgagggttgcattagctcgagccctgttcatccggcctttcatgttgctgctggatgagccaacaaaccatctggacctggacgcctgcgtgtggttagaggaggagttgaaaactttcaaacgtatcctagtactggtgtctcatagtcaagattttctcaatggagtctgcactaatatcatacacatgcataacaaaaaactaaaatactacacaggcaactacgaccagtacgtgaaaacacgactggagttggaggagaaccaaatgaagaggtttcactgggagcaggaccaaatagcccatatgaagaactatatcgccaggttcggccacggcagcgccaaactcgcaagacaggcccagtccaaagaaaaaactctgcagaaaatgatggcctccggactgacggagagggttgtatccgataaaaccctctccttttatttccccccatgcggaaagatccctcctccggttatcatggtccaaaacgtatccttcaagtacaccaaagacggcccttgcatctacaacaacctcgagttcggcatcgacctcgacacacgggtggcactggtcggtccaaatggagccggaaaatccaccctcctcaaactgctaacaggtgaattattacctaccgacgggatgatccgcaagcactcacatgtaaaaattggacgctaccatcagcatctccaggagcaattggacctggacctaagccccctggagtatatgatgaaatgttatcctgaaatcaaagagaaggaggagatgaggaagatcattggcagatatggcctgacggggaagcaacaggtttctccgattaggaatctgtcggacgggcagaaatgtcgcgtctgcctggcatggctggcctggcagaacccacatatgctattcctggatgaacccactaaccatctggacatcgaaaccattgatgcgctggctgacgccattaatgagttcgaaggtgggatgatgctcgtgagtcacgatttccgcttgattcaacaagtggcacaggaaatttgggtatgtgagaaacagaccattaccaaatggcctggcgacattctagcctacaaggaacatcttaagagcaagctagttgacgaagagccccagcttacaaaaaggacccataacgtatag

SEQ ID NO: 215484 - DNA, 723 bp, Artificial Sequence
  Description of Artificial Sequence: Synthetic coding sequence
atgccctctgatctggcaaagaagaaagctgccaaaaagaaggaagctgcaaaagcgcgacagagacctcgcaaaggccacgaggaaaacggggatgtggtgaccgaaccccaggtggccgaaaagaatgaggcaaatggccgagaaactactgaagtcgacctgttgacaaaggagttggaagattttgaaatgaagaaggctgcggcacgcgctgtgaccggtgtgttggcttctcacccgaattctacagacgtccacatcataaacctgtcattaacttttcatggccaggaactgctcagcgataccaagctcgagctgaactccgggaggcggtatggtttaattgggctgaacggaatcgggaaaagcatgctgctctccgctatcgggaaaagagaggtacccattccagaacacatcgacatctatcacttgacgcgggaaatgccgccatcagataagacgcccctccactgcgttatggaagtggatacagagagagctatgctagaaaaagaagccgagagattggcacatgaggatgctgagtgtgagaagctgatggagctctatgaaaggttggaagagctggacgctgacaaggcggaaatgcgcgcttctcgcattctgcatggcctgggattcacaccagcaatgcagagaaagaagctcaaagatttcagcggagggtggagaatgagagttgccttggcttag

SEQ ID NO: 215485 - DNA, 867 bp, Artificial Sequence
  Description of Artificial Sequence: Synthetic coding sequence
atgccaagcgatctggcaaagaaaaaggcagccaagaagaaggaggcagcaaaggccagacagcgccctcggaagggccatgaagaaaacggtgacgtcgttacagagccccaggtggcggagaagaacgaagcaaatgggagagagactaccgaggttgatttattgaccaaagagttagaggactttgaaatgaagaaagctgccgcacgcgctgttaccggagtccttgcaagccatcctaactccactgatgtacacataataaacctctctctgaccttccatgggcaagagctcctgtctgatacaaaattggagctgaattcaggacgtcgctacggcctgatcgggttgaacggtattggaaagtcgatgttactttccgctattggaaaacgcgaagtgccaattcctgaacatatcgacatctatcatttgactcgcgaaatgccaccttccgacaagacacctttgcactgtgtgatggaggtcgacaccgaacgggcaatgctagagaaggaggcggagcggctggcccatgaggacgccgagtgtgaaaaattaatggagctgtatgagcggcttgaggagctggatgcagacaaggccgagatgcgcgcatcgagaatcctgcatggactcggattcactccggcaatgcagcggaaaaagctgaaggacttttctggcggatggcgaatgcgcgttgcactggccagggccttgttcatacgaccattcatgctgctgctggacgagccaaccaatcatctggacctggacgcctgcgtctggttagaggaggagcttaagacatttaaacggatactggtcctggtgtctcactcccaggactttttatag

SEQ ID NO: 215486 - DNA, 2361 bp, Artificial Sequence
  Description of Artificial Sequence: Synthetic coding sequence
atggtcaggagaggatggtcagtgtgtacagcgattctacttgcccgtctctggtgccttgtgccgactcacacattcctgtccgagtacccagaggcagcagagtaccctcacccagggtgggtctattggctacagatggcggtcgcgccaggacacctgcgagcatgggttatgcgaaataatgtgaccactaatatcccttccgcattcagtgggaccctcacacacgaggagaaagctgtgctgaccgtgttcactggcacagccactgctgtgcacgtacaagtggcagcgctggcaagtgccaagctcgagtcctccgtgtttgtgaccgattgtgtgtcatgtaaaattgagaacgtgtgcgactctgcactgcaggggaagagggtgcctatgagcggtttacagggcagcagcattgtaatcatgcccccttctaaccgaccccttaaagcctccgcagcgtcttgcacctggtcagtgcaggtgcagggtgggccacatcatctaggggtggttgctatcagtggtaaagtcctgtccgcagcacacggcgcaggtcgtgcctacgggtggggattcccgggtgatccgatggaggaaggctacaaaaccctccttaaggggatctccggcaaatttaatagcggtgagctagttgccatcatgggaccaagcggcgcaggcaagtcaactctgatgaacattttggccggttatcgcgagaccgggatgaagggagcagtgctgatcaacggactgccgagggacttaaggtgcttccgcaaggtttcttgttacatcatgcaggacgacatgctcctccctcacctcaccgtgcaggaagcgatgatggttagtgctcacctcaagctgcaggaaaaagacgaaggcagacgggagatggtcaaggaaattctgactgcacttggcctgctgagttgcgctaacacaagaaccggatccctcagcggcggtcagagaaagagattggccattgcgctagaactcgtgaacaatccacctgtgatgtttttcgacgaaccaacctcagggctcgactctgcatcatgcttccaggtagtgtctctgatgaaaggccttgcccagggagggaggtctattatatgcaccatccatcagccttcagccaagctttttgagctgtttgaccagctgtatgtgctttctcaaggacagtgcgtgtacagaggaaaggtgtgtaacctcgtcccttacctgcgcgacctggggctcaattgccctacttaccacaacccagctgacttcgttatggaagtcgcttctggggaatatggagatcagaattcccgccttgtcagagccgtaagagaaggaatgtgcgactccgaccataagagagatctgggaggtgacgccgaagtcaacccatttctatggcatagaccttccgaggaagtgaagcagactaaaaggctaaaaggactgcggaaagattcatcttctatggaggggtgtcatagtttctcggcaagttgtctgacccagttctgtatcctcttcaagaggaccttcttgagcataatgagggacagcgttctaacacaccttcgcatcacatcccacatagggataggcctgctgattgggctattgtacctgggtatagggaatgaggcgaaaaaagttctgtctaacagtggttttctatttttcagtatgttgttcctcatgttcgcagctctgatgcctaccgtactcacattcccactggagatgggcgtatttctccgcgaacatctgaactattggtactcactgaaggcctactatttggcaaagacaatggccgacgtccccttccagatcatgttccctgtcgcctattgctccattgtttattggatgacaagtcagcccagcgacgcagttcgctttgtgctgttcgcggcacttgggacaatgacatcgttggtggcacagtctttgggtctgctcataggagccgcatccacgtctcttcaggtggccacttttgtgggacccgttacagctatacctgtgctgttgttttccggatttttcgtgtccttcgacaccatacctacatatctacagtggatgagctacatatcctatgtgcgctatggttttgaaggagtgatcctgtcaatatacggtctggatcgagaagacttacattgtgatattgacgaaacttgtcattttcaaaaatccgaagctattctccgcgagctggatgtggaaaacgctaagttatatctggattttatcgtgctggggatttttttcatcagccttaggctgatagcttactttgtgctgcgatacaagattcgtgctgaacggtag

SEQ ID NO: 215487 - DNA, 2034 bp, Artificial Sequence
  Description of Artificial Sequence: Synthetic coding sequence
atgaggatttctttgcccagagcccctgaacgcgatgggggagtatccgctagttctctgctagacactgtcactaacgcctcttcctacagcgctgagatgaccgagcccaaaagtgtatgcgtatcggtggacgaggtggtgtcatccaacatggaggcaacggagaccgacctcctgaatggccacctgaagaaggtggataataatctcaccgaggcccaacgcttttcttcactgccaagacgcgcagctgtaaacattgaatttagggacctcagttattctgtcccagaaggaccttggtggagaaagaaggggtataaaaccctgttaaagggaattagcggaaaatttaatagcggagagctggttgccattatgggtcctagcggggcaggcaaatctactctgatgaacatactcgcgggataccgagagacgggcatgaagggcgctgtgctgattaacgggctgccgagggacctgcggtgcttccggaaggtttcatgctacataatgcaagacgatatgcttctccctcatctgacagtgcaagaggcaatgatggtgtcagcgcacttgaagcttcaagagaaagatgagggtcgcagagagatggttaaagagatactcacagctcttgggctgctgtcttgcgccaacaccagaacgggatcattgtccgggggtcaacgcaagaggctggccatagccctagagctggtgaacaacccacctgttatgtttttcgacgagcccacatctggcttggatagtgcttcctgtttccaagtggtgagcctcatgaaaggactcgcccaagggggtcgatctattatttgcaccatacaccagccctcggccaagctgtttgaactgttcgatcagctgtacgtgttgtctcagggacagtgcgtctaccgcggaaaagtgtgtaatctggtgccatatttgcgggacctgggtctgaactgccctacgtaccataatcccgcagattttgtcatggaagtggcaagcggtgagtacggagatcaaaactctcggctggtaagagcggtccgagagggcatgtgtgactctgaccataaacgcgatctgggaggggatgcagaggtcaatccctttctatggcacagaccatccgaggaagatagctcttctatggagggatgtcacagtttcagtgcaagttgtctaacacagttttgcattctgtttaagaggacattcctatcgatcatgagagactccgtgctgacgcacctacgcataaccagtcatattggaatcggcttgctcatagggcttctgtacctgggaattggcaacgaagcaaaaaaagttctgagcaattccggttttctatttttttccatgctttttctgatgtttgccgcactgatgccgacggttctaacatttccactcgaaatgggagttttcctgcgcgaacacctgaactactggtattcattgaaggcttactatctcgctaagacaatggctgacgtgccctttcaaatcatgttccctgtggcgtactgttccatcgtttactggatgacctcacaaccctccgacgcggtcagattcgtcctctttgctgctctaggtactatgacatcattggtcgcccagagccttggtctgctcattggcgctgccagcacctctcttcaagtggctaccttcgtggggcctgtgaccgccatcccagtgctcctattttctggttttttcgtctcttttgacacaattccaacttacctgcagtggatgtcttatatttcatacgtgcgctatggcttcgagggcgtcatactgagtatatacggtttggatcgggaagacctgcactgtgatatcgatgagacctgtcattttcaaaagtccgaagctatcctcagagaactggacgtcgaaaacgccaaactttatctggactttattgtgctcggaatattcttcatcagcttgcgactgattgcatattttgtcttgagatacaagatcagggccgagaggtag

SEQ ID NO: 215488 - DNA, 1992 bp, Artificial Sequence
  Description of Artificial Sequence: Synthetic coding sequence
atgataatgagactgccacagccacacggcaccaacgcttcttcttatagcgcagaaatgactgaaccaaagagcgtgtgcgtgtctgtggatgaggtcgtgtcatcaaatatggaggcaacagagacggatctgttaaatgggcacctaaagaaggttgataacaatctgaccgaagcccagagattcagttcccttcccagacgtgctgcggttaatattgagttccgggatttatcgtattctgtgcccgaaggtccttggtggagaaagaaagggtataagaccctgctgaagggaatcagtggaaaatttaattccggtgagctcgtcgctatcatgggcccttccggtgctggcaagtccaccctgatgaacatcttggctggatatcgtgagactggaatgaagggcgcagtgctcataaacgggcttcctagagatttacggtgcttccggaaggtgagttgctacatcatgcaggacgacatgctcctgccccaccttaccgtccaggaagccatgatggtgagcgctcacctgaaattgcaggagaaggacgaggggagacgcgagatggtcaaagagattctcactgccctcggtcttctgtcttgtgctaatactcgcaccgggagcttaagcggaggtcagcgtaaaaggctcgctatcgctttagaactggtgaataacccccctgttatgttttttgatgagccaacttccggattggattccgcttcatgttttcaggtggttagcctgatgaagggccttgcacagggaggacgatctatcatctgcacaatccaccagcccagtgccaagttgttcgaacttttcgaccagctttacgtgctatctcaggggcagtgtgtgtatcggggtaaggtgtgcaatctggtcccttacctccgggacctgggcctgaattgccctacctatcataaccccgctgactttgtgatggaggtggcttcaggcgaatacggagaccagaatagcagactcgtgcgcgcagtcagggagggtatgtgtgactctgatcacaaacgggatctgggaggggacgctgaggtcaaccccttcttgtggcaccgcccttcagaagaggacagctcaagcatggagggttgccattcatttagtgcttcatgtcttacccagttttgtatcctcttcaagaggacatttctgagcattatgagggacagcgtgctgacacatctacggatcacaagccacatcggtataggattgctgatcggattgctgtatctgggcatcggaaacgaggcaaaaaaagttctatctaattccggtttcttattcttcagtatgctgtttctcatgttcgctgctctgatgcctactgtcttaaccttcccactggaaatgggggtgtttctgcgtgaacacctgaactattggtattctcttaaggcctattatcttgccaaaactatggcggatgttccattccagatcatgtttccagtagcttactgttctatcgtgtattggatgacatcccagccttcagacgcggtgcgatttgtgcttttcgcagccctcgggacaatgacctcactggtggcccagtccttgggactgctgatcggtgccgcttccacaagtttgcaggtggctacctttgtgggacccgtaacagcaatcccagtgttactcttctccggatttttcgtaagcttcgatacgatccccacctatttgcagtggatgtcatacatcagttacgtgagatacggcttcgaaggggtcattctgtccatctacggtctcgacagggaggacctccactgcgatatagatgagacctgtcacttccaaaagtcagaagccatacttagggaactagacgttgaaaacgcaaaattatatcttgattttatcgtgctaggcatttttttcataagtcttagacttatcgcctactttgttctcagatataagatacgagcagaaagatag

SEQ ID NO: 215489 - DNA, 2037 bp, Artificial Sequence
  Description of Artificial Sequence: Synthetic coding sequence
atggcatgtctgatggctgctttcagcgtggggaccgcaatgaacgcatcctcatacagcgcagagatgaccgagccaaaatctgtttgcgtgagcgtggacgaagtcgtctcctcaaatatggaggccactgaaaccgatcttctgaacggacacctgaaaaaagtggacaacaacctcaccgaagcccaaagattctcttcactgccgaggcgagcggcagtgaatatagagttccgggatctgagttatagcgtgcccgagggaccatggtggcgaaaaaaggggtacaagacactactgaaaggtatttctggcaaattcaattccggcgagctcgtcgccattatggggcctagcggagcaggtaagagtacacttatgaacattctcgccggatacagggagactggcatgaagggagccgttcttattaacggcctgccacgtgacctgcgctgttttaggaaggtctcctgttacataatgcaggacgacatgctattgccacacctcacagtacaagaggcaatgatggtgtctgcccatttgaaattacaggaaaaagatgaaggcaggcgtgagatggtgaaggaaatactgaccgccttgggactactcagctgtgccaatacccgaacgggcagccttagcggcggacagagaaaacgtttggccattgcattggaactggttaataacccaccagtgatgtttttcgatgaacccacctccggcctggacagcgcttcctgcttccaggtggtgagtctgatgaaagggttggcccagggcggaaggtccatcatctgtacaattcaccagcccagcgccaagctctttgaactattcgaccagctgtacgtgctctcccaaggacagtgcgtgtatcgaggcaaagtctgcaacttggttccctacttgcgagatctggggctcaactgcccaacttaccataaccctgccgactttgtcatggaagttgcttcaggcgaatacggcgaccaaaacagtcgcttggtgcgtgctgtgagagaaggcatgtgcgattctgaccacaagagggacttaggtggtgatgcagaggtcaatccctttctttggcacaggccaagcgaagaagtcaagcagacaaaaagactgaagggccttcgcaaggattcttctagcatggagggttgtcactccttctccgcctcctgtttgactcaattctgcatacttttcaaacggacattcctatcaattatgcgagatagtgtcttaactcatcttcgcatcacaagccacattggtatcggactcttgattggcctgctttatttagggatcgggaatgaggccaaaaaggtcctgagcaatagtggctttctgttcttctctatgctcttcttgatgttcgctgcccttatgcctacagtgttgacatttccactggaaatgggggtgttcttgcgcgagcatttgaattattggtacagtcttaaggcctactatttagcaaagaccatggcagacgtccccttccagataatgttccctgtcgcctattgttcaattgtatattggatgacaagccagccctccgatgccgttcgcttcgtcctatttgctgcgcttggcactatgacatccttagttgctcaatctctggggttattgatcggggcagcatccacatctcttcaggtcgccactttcgtcggtcccgtgaccgccatcccggttcttctgtttagcggcttcttcgtctcctttgacactattccaacctatctgcagtggatgagttacatctcttacgtgcgctacggcttcgaaggagtgatcctgtccatctatgggctggacagagaggacctacactgcgacatcgatgagacctgccattttcaaaaatcagaagctatcctgcgggaactcgatgtggaaaatgcgaaactctacttggactttattgttctggggatatttttcatctcactcaggttgattgcctactttgttttgcgttataagatcagggcagagagatag

SEQ ID NO: 215490 - DNA, 2475 bp, Artificial Sequence
  Description of Artificial Sequence: Synthetic coding sequence
atgttggccgttcaacagacagagcatctcccagcatgccctcctgcacggcgttggtctagcaatttctgcccggaatcaactgaaggcggaccctcactgctcggactgcgtgacatggtgagacgcggatggtccgtctgtacagcgattttattagctcgcttatggtgtttagtgccgacccataccttcctgtccgagtatccagaagccgcagaatatccccacccaggatgggtctactggctgcagatggccgtcgcgccaggacacctgcgcgcttgggtgatgcggaataacgtgacaacaaatatcccttcagcgttttccgggacactgacccacgaggagaaagcagttctgacagtgtttaccggcacagccacagctgtccatgtccaggtcgcagctctcgccagtgctaagctagagagctccgtgtttgtcactgactgtgtatcatgtaagatcgaaaatgtatgcgattctgcacttcagggcaaacgagtgccaatgtccgggttgcagggcagttccattgttattatgccccctagcaataggccactcgcttcagccgcatcctgcacctggagcgtgcaggttcagggaggcccacatcatcttggagttgtggctatttccggcaaggtgctctctgccgcacacggggctggcagagcatacgggtgggggtttcccggagatccaatggaggagggctataaaaccttgctcaagggaatcagtggcaagttcaactcaggagaactggtagcaatcatgggccctagcggggcaggcaagagtacactgatgaatatccttgccggttatcgggaaaccggcatgaaaggcgcagttctgattaacggactaccaagagacctacgttgctttcggaaggtcagctgctatataatgcaggatgatatgctgctgccccacttgaccgtccaggaggcaatgatggtgtcagctcatctgaagctgcaggaaaaggacgaaggtcgtcgagagatggttaaagagattctgacagccctgggtcttctgtcttgtgccaacacgagaacggggagcctgagtgggggacagagaaagcgcttggccatcgccctggagctcgtgaataatcctccagtgatgttcttcgatgagccaacctccgggttggacagcgcctcctgctttcaggtggtgtcacttatgaagggactggcacaggggggacgatcaatcatctgtaccatacatcagccctccgctaagctttttgagctgttcgaccaactttacgtactgtcacaggggcaatgcgtatataggggtaaagtctgtaatctagtgccctatcttagagacttgggcctaaactgcccaacctaccacaacccggctgacttcgtgatggaggtcgccagcggggaatatggtgatcagaattcacgcctcgtgcgagctgtacgggagggcatgtgcgactctgatcacaaacgtgatctcggcggtgacgccgaagtcaatcccttcctctggcacaggccatcagaggaagtgaagcagaccaaacgcttgaaggggctgaggaaggactcatcttctatggagggatgccactcattctcagcgagctgcttaactcagttctgtatcctgttcaaacggactttcctgtccattatgcgggacagcgtcctgacacacctgagaataaccagccacatcggcataggattgctgattggtcttctctacctgggtatcggtaatgaagcaaaaaaggtcctgagcaactccgggttcctcttcttttccatgcttttcctgatgttcgcagccctaatgcccactgttcttacttttccgctggaaatgggagtcttcctccgcgagcatttaaattattggtacagtctgaaggcctattacctggccaagacaatggctgacgtccccttccaaatcatgtttcctgtcgcctattgctcaatcgtgtactggatgacttcccagccaagcgatgccgtcaggttcgtgttgtttgccgctctgggcaccatgacttccctggtggcccaatcactcggtctgcttattggggcagcgagcactagcctgcaggtggcaactttcgtgggccctgtgactgctattcccgtgttgttgtttagcggattctttgtgagctttgataccatacccacttatctgcagtggatgagctatatttcctacgtgcgttatggctttgagggtgtgatcctgtccatttacggcctcgatagagaagacctacattgcgacattgatgaaacttgccattttcagaagagcgaggctatacttagagagcttgacgttgaaaatgctaaactgtaccttgactttattgtgctgggaattttcttcatatcactgaggttgatcgcctatttcgtactgcggtataagatccgggctgagcgatag

SEQ ID NO: 215491 - DNA, 2001 bp, Artificial Sequence
  Description of Artificial Sequence: Synthetic coding sequence
atggcatgcctgatggcggcattcagcgtcggaactgctatgaacgccagctcatattcagccgaaatgaccgaacccaagtctgtatgtgtgtcagtggacgaggtagtctcgtcaaatatggaagcaaccgaaacagatctcctgaatggtcaccttaaaaaagtggataataacctgacagaggcgcagagattctcttctctgcctcgccgtgctgctgttaacatcgagtttagggatttgagctactctgtgcctgagggaccatggtggaggaagaagggttacaagacactgcttaagggcatttctggaaaattcaactccggcgaactggtggctatcatggggccaagcggcgcaggtaagagcactttgatgaacatcctggcaggttatcgggaaacaggaatgaaaggcgcagtgctgatcaatgggctgccgagggatctccgctgcttccggaaggtttcctgttacattatgcaggatgacatgctgttgccacatctaaccgtgcaggaggccatgatggtgtctgcacaccttaagctccaagagaaggatgagggaaggcgtgaaatggtgaaggagatcctgaccgcactgggcttactttcctgcgcaaacacacgcaccggatccttatccgggggacagcggaaaaggctggctattgctttggagctggtgaacaaccccccagtcatgttttttgacgaaccaacttctgggctggacagtgccagttgcttccaggttgtatcgctcatgaaaggactggcccagggtggtagatctatcatatgcaccatccaccagccctccgcaaagctcttcgagctcttcgatcagctctacgtactgagtcagggacagtgcgtgtacagaggtaaggtatgtaatctggtaccatatttgagagacctcgggctgaactgtcccacctaccataatccagcagacttcgttatggaagtggcctctggcgagtacggcgatcagaattcgaggcttgtgcgagccgttcgcgaggggatgtgcgattctgatcacaaacgcgaccttggcggagacgcggaagtaaatccctttctctggcaccggccttccgaagaagacagcagttccatggaggggtgccatagcttctccgcttcgtgcctcacgcagttttgcatcttgttcaagcgaacctttctgtcgataatgcgcgactctgtgttgacacaccttcgcattacaagccacattggtatcggcctactgatcggactattgtatctcggaatcggaaacgaagccaaaaaggtgctgtccaacagcgggtttttgttcttcagtatgctcttcctcatgtttgcagctctgatgcccaccgtgttgactttcccactggagatgggtgtcttcctgagggaacacctgaactactggtattcgctgaaagcttattatctggctaaaaccatggccgatgtgcccttccagatcatgttcccggtggcctactgctcaatcgtatactggatgacgagtcagcccagtgacgcagttcgctttgtgctttttgctgccttgggcactatgacatcccttgttgcccagagcctgggcctcctgatcggcgcagccagcacttcactccaagtcgctactttcgttggaccagtaacagcgatacccgtcttacttttttctgggttcttcgtctcattcgacactatccctacctatttgcagtggatgtcttatatcagctatgtgcgctatggattcgaaggcgtcatcctcagcatctacggattggatagggaagatctccactgcgatattgacgagacttgtcattttcagaaatcagaagctattctgcgcgaactggatgtggaaaacgctaagctctacttagacttcatcgtgctgggcatctttttcatttctctccggctgatcgcctattttgtgctgaggtataaaattcgcgcagaacggtag

SEQ ID NO: 215492 - DNA, 2007 bp, Artificial Sequence
  Description of Artificial Sequence: Synthetic coding sequence
atgctgggaactcaggggtggactaagcagcgcaaaccttgcccccaaaacgcgagcagttacagcgcagaaatgaccgaacccaaatcagtatgcgtgagtgtagacgaggtggtatcgagtaatatggaggccacagaaaccgatctcctcaatggacacctgaagaaagtcgacaacaatctgactgaggctcaacgcttctcttcactgcccaggcgggcagccgtgaacatcgaatttcgggatctttcctactcagtgcccgaaggtccttggtggcggaagaagggctacaagactctgctgaaaggcataagtggcaaattcaactccggtgagcttgtcgctattatgggaccctccggcgctgggaaatcaacgctgatgaacatattggccggataccgggaaaccggaatgaagggcgcagtgcttatcaacggcttacctcgagatcttaggtgttttcgcaaagtgagttgctacataatgcaggacgatatgcttttgccccacctgaccgtgcaggaggccatgatggtgtccgctcatctgaagctgcaggaaaaagacgaaggaagacgggaaatggtaaaagagatactgactgcactgggtttgctctcatgcgccaataccaggactggatcattgtccggcggacaaaggaagaggctggccatagcgcttgaactggtgaataatcccccagtaatgttcttcgatgaaccgaccagcggccttgactccgcctcatgttttcaggtggtttctctcatgaagggcctggcccaggggggtcggtctattatttgtactatccaccagccttccgcaaagctgttcgaacttttcgaccagttgtacgtactctcacagggtcagtgtgtctaccgaggcaaggtatgcaatttggtcccatacctgagggacctcgggctgaactgccccacctaccacaaccctgccgatttcgtgatggaagtggcctcaggcgaatacggtgatcagaacagcaggcttgtgagagccgtgcgagaaggtatgtgcgactctgatcataaacgagatttaggtggcgacgccgaagtgaacccttttttgtggcatcgacccagtgaagaagactctagtagtatggaagggtgtcactctttcagcgccagctgcctaactcagttttgtattttgtttaagagaaccttcctgtctatcatgcgggacagtgtgcttacccacctgagaattactagccacatagggattggattactgataggcctcctgtacctgggcatcggaaacgaggctaagaaagtgctgtctaactctggttttctgttcttcagcatgctttttctgatgttcgccgcattaatgccaacagttcttacctttcctctagagatgggagtgtttctgcgtgagcatttgaattattggtactctttaaaggcctactacttagccaaaacgatggccgacgtgccttttcagattatgttccccgttgcatactgctcaattgtgtattggatgacatctcagccctcagatgccgtgaggttcgtcttatttgccgctctcggaactatgacgagtctggtggctcaatcactgggcctgctcataggagccgcaagtaccagcctgcaagttgccacatttgtaggacccgtgaccgccattccggtgttgctgttctcaggattctttgtaagctttgacacgatcccaacgtatctccagtggatgtcttacatcagttatgtccgctatgggtttgaaggtgtgatcctgtcaatttatggactggatcgggaggatctccactgcgatatcgacgagacttgccattttcaaaagtccgaagccattcttcgcgaactggatgtggagaacgctaaattgtatctggatttcatcgttcttggtattttctttatctccctccgcctgatagcttacttcgtcctaagatacaaaatcagggctgagcgttag

SEQ ID NO: 215493 - DNA, 1941 bp, Artificial Sequence
  Description of Artificial Sequence: Synthetic coding sequence
atggccgagaaggccctagaggctgtcgggtgtggtctgggcccaggggctgtagctatggctgtgacgttggaagatggagccgaacctcctgtactgacgacacacttaaaaaaggtcgagaaccacatcaccgaggcccagagattcagtcatcttcccaagaggtctgccgtggatatagagttcgtggagcttagctacagcgtgagagagggcccttgttggcgaaaaaggggttacaaaacgctgctgaaatgtttaagcgggaaattctgtagacgagagctcatcggaattatggggcctagcggagccggaaaaagcacatttatgaacattctcgctggctaccgcgaatctggcatgaaagggcagatcctcgtgaatggaagaccaagagagctgaggaccttcagaaagatgtcatgctatattatgcaggacgacatgctcctcccccacctgacagtgttggaggccatgatggtgtctgccaatcttaagctgtccgagaagcaggaagtgaagaaggaactcgttacagagatcctgactgccttggggctcatgagctgcagtcatacgagaactgccctactgtcagggggtcagaggaagcggttggccatcgctttagaactggtgaataatccccctgttatgttcttcgatgagcctacatcaggcttggactccgcttcttgcttccaagtggtcagtctaatgaaatctctggctcagggaggtagaaccatcatctgcaccatccatcagccgtctgctaagctgtttgagatgtttgacaagctgtacattctttcccaaggacagtgtattttcaaaggagttgtgactaacctgattccttatttgaaagggttgggcctgcactgcccaacttatcacaacccagccgacttcatcatcgaggtagcctcaggagagtatggagacctaaaccccatgctgtttagggccgttcaaaacggtctgtgcgccatggcagaaaagaagtccagccccgagaaaaacgaagtgccagctccctgtcctccgtgtcccccagaagtcgatcccatcgagtctcatacatttgccacaagcaccctgacacagttctgtatcctgtttaagaggacctttctgagtatattgagagataccgttcttacacacttaagattcatgtcccacgttgtaattggggtgctcattggtctactgtatctgcatattggagatgacgcgagtaaggtgtttaataataccggctgtctcttcttttccatgctgtttttaatgtttgctgcactgatgccaacagttttgacatttccgttagagatggctgtctttatgagagagcacttaaattattggtatagtttgaaagcatactatctggctaagaccatggctgatgtgccttttcaggtggtgtgccccgttgtgtactgctctatagtgtattggatgactgggcagcctgctgaaactagtaggtttctgctcttctcagcactcgctaccgctactgcacttgtggcccagtccctgggactcctgattggcgctgcttctaattccttacaggtcgctaccttcgtaggacctgtcaccgctatccctgtcctgttattctccggttttttcgtcagcttcaagaccataccaacttatctccaatggagtagttatctgtcttatgtccgctacggctttgagggcgtcattctcacaatctatgggatggaacgtggggacctgacttgcctggaagagaggtgtcctttcagggaaccccagagcattctgagggccctcgacgtggaagatgcgaagctctatatggatttcctggtgctgggcattttctttttagccctgaggttgttggcttatctcgtgctgagatatcgtgtgaaatcagaacgctag

SEQ ID NO: 215494 - DNA, 1941 bp, Artificial Sequence
  Description of Artificial Sequence: Synthetic coding sequence
atggccgaaaaggccctggaagctgtggggtgcggactagggcctggcgcagttgcaatggcagtcaccctcgaggatggcgctgagcctccagtactgacaactcatctgaagaaggtggaaaaccacatcactgaagctcagagattttcacacttgcccaaacgaagcgctgtagacatcgagtttgttgaattaagctattcggtcagagaaggcccttgctggagaaaaagaggatacaagaccctattgaagtgtctgagtggcaagttttgcaggcgggaacttattggaataatgggcccttcgggtgcaggaaagagtacctttatgaacatattagctggataccgggaaagcgggatgaagggccagatcctcgtaaatgggcgaccccgtgagctgagaacctttagaaaaatgtcctgctacatcatgcaagacgatatgcttctgccacatctgactgtgctcgaagccatgatggtatctgccaatctgaagctcagcgagaagcaggaggtgaagaaagaactggttacagagatccttaccgctctaggcctcatgagctgttctcacacaagaaccgccctgctctccggaggtcagagaaaacgcctcgctatcgccctcgaattagtgaataatcctcctgtcatgttctttgacgaacctacctcaggcctggacagcgcctcctgcttccaggttgtctcactcatgaaatccctggcccaggggggacggaccatcatctgtacgatccaccagccatcagcaaaactgttcgagatgtttgacaaactgtacattctcagtcaggggcagtgtatcttcaaaggggtcgttacaaatctgattccgtatcttaaagggctcggcctccattgtcctacttatcacaatccagctgattttatcatagaagtcgctagcggagagtacggagatctcaatcccatgctgttcagagccgtccaaaacggcctatgcgccatggccgaaaagaagagcagtccggagaaaaatgaagtgcccgctccttgccccccatgccctcctgaggtcgatcctatagagtcgcatacttttgctacctccacactcacccagttttgtatcctgttcaagcggacctttctgagcatattgcgggacacagtactcacccatctgcgatttatgtcccacgtcgttattggagtcttaattggacttctgtacctgcacataggcgatgacgcaagcaaggtttttaataacaccgggtgcctgttcttctccatgctgttcctcatgttcgcagctctgatgcccaccgtgctgacctttcctctggaaatggcagtctttatgcgagagcacctgaactactggtattctttaaaggcctattacttagccaagaccatggcagacgtgccttttcaagtggtctgtccagtggtctattgttcaatcgtgtattggatgaccggacaacctgccgagacaagcaggtttctgctgtttagcgctctcgcaaccgctactgctctcgtggctcaaagcttgggcctgcttatcggggctgccagcaacagtctgcaagtagcaaccttcgttggtcccgtaacagccattccagtcctcctttttagcggtttcttcgttagtttcaaaacgatccctacttatttacagtggagcagctacctgtcatatgtgaggtatgggttcgagggggttatcctcacgatttacggtatggagcgtggtgacttgacatgtcttgaagagcgttgtcccttccgtgaaccacaaagcatactgcgcgcacttgacgtggaagacgccaagctctatatggacttccttgtgctgggcatattttttctcgcactgagattgctcgcttacctggtgctccgttatcgcgtgaagtccgaaagatag

SEQ ID NO: 215495 - DNA, 1941 bp, Artificial Sequence
  Description of Artificial Sequence: Synthetic coding sequence
atggccgagaaagccctcgaggctgtggggtgcggcttagggcctggagctgtggccatggccgtcaccctagaggacggagcggagcccccagtgctgacaacccacctaaagaaggtcgagaatcacataacagaggcccagcggttctctcatctgccaaagcggagtgctgtggacattgagtttgtggagctgagctactctgtacgggagggaccgtgttggaggaaacggggttataaaacactgctgaagtgtttgagtggaaaattttgccgcagagagctgattggaattatgggcccttctggggcaggaaagtccaccttcatgaatatattggcgggatatagagaatccggcatgaaagggcaaatcctagtcaacggcagaccgagagagcttcgtacctttaggaagatgtcatgttatattatgcaggacgatatgctcctgccacatctgacagtattggaggccatgatggtgtccgctaatctgaagctatcagagaaacaagaggtcaaaaaggagcttgtaactgagatcttgaccgcgctcggtctgatgagctgttctcatactcgaactgccttactttccggtggtcagagaaaaagactagcgatcgccttggagctggtcaacaaccctcctgtgatgttcttcgatgaaccaaccagcggcctggacagtgcgtcttgctttcaggttgtctctctgatgaagtctttagcccaggggggacgcactatcatatgtaccatacaccagccaagcgccaagctgttcgaaatgtttgataagctgtacatcctcagccaaggccagtgcatctttaagggcgtggtaacaaacctcattccatacttgaagggactgggtttacactgtccaacttatcacaatcctgccgacttcatcattgaggtcgcctccggcgagtatggagacctgaaccccatgctctttcgagccgtacagaacggcctctgtgctatggcagaaaagaagagttcccctgagaaaaacgaagtccccgctccttgccctccttgccctccagaggttgatcctattgagtcccacacgttcgccacctcgaccctgacacagttctgtatcctgtttaaaagaacctttttaagcatcctgagagacaccgtgctgacccatctgcggtttatgtctcacgtagtgatcggagtcctaattggacttttgtatctacacatcggagatgacgcttctaaggttttcaataacactggatgccttttcttttcaatgctttttctgatgttcgcggctttaatgccaaccgtcctcaccttccccctggagatggcggtttttatgcgcgagcacctgaattactggtatagcctaaaggcttactacctggctaaaaccatggcagacgtcccgttccaagtggtctgcccagtggtttactgcagtatcgtgtactggatgaccggccaacccgcagagacctctaggttcttactgttcagcgcccttgccactgctacagccttagtggcgcagagcctcggactgcttattggggcagctagtaacagtttacaggtagccacctttgtggggccagtgaccgccatccccgttttgcttttctctggattctttgtctcatttaaaacaatacccacatacttacagtggtcctcctaccttagctatgtccgatacggttttgagggtgtaatactgacaatatatgggatggagcgcggagacctaacgtgcctggaagaacgctgcccatttcgggagccacaatcaatcctgagggccctcgacgtcgaggacgccaagctctacatggatttcctcgtgctgggaatcttttttcttgcattgcgactgctggcatatcttgtgctgagatatagggtaaagagtgagaggtag

SEQ ID NO: 215496 - DNA, 1956 bp, Artificial Sequence
  Description of Artificial Sequence: Synthetic coding sequence
atgggcgatctgagttccttgaccccaggaggcagtatgggtctgcaagtcaatcgagggagccaaagttccttggagggggcacctgccaccgcccctgagccacattcactgggaattctgcacgcctcatacagtgtctcacacagagtccgcccttggtgggacatcacctcatgtcggcaacagtggactcggcagattcttaaggacgtcagcctgtatgtcgagagtggtcagattatgtgcattctggggagctccggaagcggaaagaccacactacttgacgctatgtcaggcagactcggcagagccggaacatttcttggggaagtctatgtcaatggaagagccctcaggcgcgagcagttccaggattgtttcagttacgtgctgcagtcggacaccctgctgtctagcctgaccgtgagagagaccctgcattataccgccctgttggccatccggagaggaaacccaggcagttttcagaaaaaagttgaggctgtaatggccgagctcagcctctctcacgtagcagataggctcatcggcaattactcactgggcggtatctcaactggggagaggcgtcgcgtgtcaatcgccgctcagctgctgcaagacccaaaggtcatgctgttcgacgagccgactaccggattggactgcatgactgccaaccagatcgtggttctactggttgagctagcgagaaggaatagaatagtggtgctaactatccaccagccaagatctgaactcttccagctgtttgacaaaatcgccatcttgtctttcggagagctgatcttttgcggtacacctgccgagatgctagatttctttaacgactgtggttatccatgtcccgagcattcaaatccattcgatttctacatggatctcacctctgtggacactcagagcaaggagcgcgagattgaaacaagcaagagggtgcagatgatcgagagcgcctataagaagtcagcgatctgccacaaaacactgaaaaatattgaacgcatgaaacatttgaagaccctgcccatggtgccgttcaaaacaaaagattcacccggagtgtttagcaaactgggagtgcttcttcggagggtcactcgcaacctggtgagaaataagttagctgttatcaccaggcttctgcaaaaccttataatgggcctctttctgctgttcttcgtgttacgagtacgctctaacgtactgaagggcgctatccaagatagagtgggcctgctttaccagttcgttggagcgactccctataccggtatgctcaacgcagtgaacctgtttcccgtgcttcgcgctgttagtgatcaggaatcacaggatgggctgtaccaaaagtggcaaatgatgctcgcctacgcattacatgttctgccgttttccgtggtggccaccatgatcttttctagcgtgtgctattggacactcggtctacatccagaggttgctagattcggatacttttccgcggcattactggcccctcacctgattggagagttcctcacccttgtgctcctgggcattgtccaaaaccctaatatcgttaatagtgtcgtggcactgctgagcattgcaggagttttggtgggctcggggttcctgcgcaacatccaggagatgcccatcccatttaaaattatttcttattttacgtttcagaaatactgttccgaaattctggtcgtgaacgaattctatggtctgaacttcacttgtggctcctccaatgtctcagtgactaccaatcctatgtgtgcctttactcagggtatccagtttatcgaaaagacttgccctggcgcaactagccgattcactatgaatttccttatcctgtacagctttattcctgccctggttattcttggaatcgtggttttcaagattagggatcatttgatttcgcgctag

SEQ ID NO: 215497 - DNA, 1443 bp, Artificial Sequence
  Description of Artificial Sequence: Synthetic coding sequence
atgtgtattctgggatccagcggaagcggtaaaaccacactgttggacgccatgagtgggaggctaggtagagcgggaaccttcctgggcgaggtctacgtcaatggccgagccctgcggcgagaacagtttcaggactgcttctcttatgttctccagagtgatactctgttgagcagcctaaccgtgagagagacacttcactacaccgccctcctcgctatccgaagaggcaatccagggagctttcagaagaaagtcgaggccgtgatggccgagctcagcctgtctcacgtggcagatcggctcatcgggaactattctctggggggtatttccaccggagaaaggaggcgcgtgagcatcgcagcacaactgttgcaggatcctatggacctgacctccgttgacacacagtccaaagagcgggagatagagaccagtaagcgcgtccaaatgatcgagagtgcttataagaagtcggccatatgccacaagacattgaagaacatcgaaagaatgaagcacctgaagacactcccgatggtgcctttcaaaacaaaggactcccccggtgtgttctcaaagcttggtgtccttttgcgtcgcgtgacgagaaacctggttcggaataaactggctgtcataaccagactcctccaaaacctcatcatgggcctctttctcctcttttttgttctcagagtcagaagtaacgtgttaaaaggtgcaatccaggatagagtaggccttctgtatcaattcgtgggggcaaccccctacactggcatgcttaacgctgtgaatctcttccctgtccttcgcgctgtgtctgaccaggagagtcaggatgggctgtatcagaaatggcagatgatgctcgcatacgccctgcatgtcttgcctttcagcgtcgtggccaccatgatttttagttccgtctgctattggaccttgggcctgcacccagaagtggcccgatttggctatttttctgcagcactgctcgcaccccatttaataggcgagtttctaacactggtacttcttggtatcgtgcagaatcctaacattgtcaatagcgtcgtggccttgttgtcgatcgctggtgtcctggttggcagtggatttctgagaaacatccaggagatgcccattccattcaagattatcagctacttcactttccagaagtattgctcagaaattcttgtggtgaacgagttttacgggctaaacttcacatgtggaagcagtaatgtgtcggtcactaccaatccaatgtgtgcgtttacccagggtattcaatttatcgagaaaacatgtccaggtgcaacatccagattcaccatgaacttcctcatcctgtactctttcatccccgcattagtcattctcggcatcgtggtattcaaaatccgagaccacctgattagtaggtag

SEQ ID NO: 215498 - DNA, 771 bp, Artificial Sequence
  Description of Artificial Sequence: Synthetic coding sequence
atgggattattcctccttttctttgtgcttagagtccggtccaacgtccttaagggcgctatccaggatcgtgtaggactgctctaccagtttgtaggcgcaacaccctacaccggaatgctgaatgcagtcaacctcttcccggttctgcgtgcagtgagtgatcaggaatcacaggacggcctgtaccaaaagtggcaaatgatgcttgcttatgcactgcatgtgcttccattttctgtagtggcaaccatgatcttctccagcgtgtgctactggactctgggtctccaccccgaggtcgctcgcttcggctattttagcgcggctctgctggcaccccacctgatcggtgagttcctaactctggttctccttggcattgtccagaaccctaacatcgtgaatagtgtggtagcattactctcgatcgcgggagtcctggtgggctccggctttctacggaatatccaagaaatgcctataccctttaagataatttcctattttacctttcaaaaatactgctctgagatccttgtggttaacgagttctacgggctcaatttcacatgtggcagctccaatgtgtctgtaactaccaatcctatgtgtgcgttcacgcaggggattcagttcattgaaaaaacttgtcccggagcaacaagccgcttcaccatgaacttcctgatcctgtactcctttatcccagccctcgtcatcctgggtatcgtcgtgttcaagattcgggatcatcttatctcccgctag

SEQ ID NO: 215499 - DNA, 2022 bp, Artificial Sequence
  Description of Artificial Sequence: Synthetic coding sequence
atggctgggaaggccgctgaagaacggggattacccaagggagccacgcctcaggacaccagtggactccaggatcgtttattctcttccgaatccgacaactccctgtactttacctatagtggtcagccaaatacgctggaggttcgcgacttaaattaccaggtggacttggcttctcaagtgccatggttcgaacagttggcacagttcaaaatgccttggacctcccccagctgccagaattcctgtgaattgggaatccaaaatttgagctttaaggtgcgctccggacagatgttggctattattggctctagtgggtgtgggagggcctctctgctggacgtgataactggacgtggacatggtggaaaaatcaagagtggacagatctggatcaacggccaacccagttccccacagcttgttcgcaaatgcgtggcccacgtacggcaacacaaccaacttcttccaaacttaacggttcgagagacactggcctttatcgcccaaatgcgattgcctagaaccttcagtcaggcacagcgtgacaagcgcgtcgaggatgtgatcgctgagcttcggctgagacagtgcgcagatacaagagtcggaaacatgtatgtaagaggcctgtccggaggggagcggcgaagagtttccattggggtacagcttctgtggaatccgggtatactgatcttggatgagcccacctccggcctcgattcattcacagcccacaatctcgtcaagaccctatcccgcttagcaaaagggaatcgcctggtattgatcagcctccaccagcctaggagcgatatttttcgcctgtttgatttggtcttgttgatgacatcaggtactccgatttacttgggggcagctcagcacatggtccagtacttcaccgcgattggatacccttgtcctcgttattcaaacccagctgacttttatgtggatcttacaagcatcgaccgccgatcgcgcgaacaggagctggccacccgggagaaagcccaatctctcgccgcactcttcttggaaaaggttcgggaccttgatgacttcctctggaaagccgagacaaaagatctggatgaagatacgtgcgttgagtcctcggtgacccccttggatacaaactgtctccccagccctacaaagatgcccggagccgtgcagcaatttaccactcttatccgcagacagattagcaatgattttcgtgatctcccgacattattaatccacggtgcagaggcttgccttatgtcaatgaccattggcttcctctatttcggccatggctccattcaattgtctttcatggatacagcggcactcctgtttatgatcggggcactgatcccctttaatgtgattctcgacgtaatcagcaaatgttacagcgaaagggccatgttatattacgagctggaggacgggctgtacacgacaggaccgtatttcttcgccaaaatcctcggggaattacccgagcactgcgcctatattatcatctacggcatgccaacctactggctcgcaaacttgaggccagggttgcagccctttcttctccactttctactggtgtggttagtcgtattctgctgtagaattatggcactggcagcagcggctctgcttcccaccttccacatggcatccttctttagcaacgcattgtataactccttctacctggcaggaggattcatgatcaacttgagctcactctggactgtgcccgcatggatcagcaaagtgtcattccttcggtggtgctttgagggcctgatgaagattcagtttagcagacggacctacaaaatgccgttgggaaacctgacaatcgcagtctctggtgacaagatcctgtccgtcatggaattagacagctatccactgtacgcaatctacctcatcgtcatcgggttgtcggggggattcatggtcctgtactatgtgtcactgcgatttatcaagcagaagcctagccaggattggtag

SEQ ID NO: 215500 - DNA, 2376 bp, Artificial Sequence
  Description of Artificial Sequence: Synthetic coding sequence
atggcgggtacctctgccccaggcagcaagagaagatcggaaccaccagcgcctagacctgggcctcccccaggtactggccatcctccttctaagcgagctcgaggctttagtgccgctgctgcccctgaccccgacgatccatttggtgctcatggagacttcacagccgacgacctggaagaattagacacccttgcatcacaagctctgtcccaatgcccagcagccgctagggacgtgagctcagatcataaggttcacagactcctcgacggtatgtcgaaaaatccctcaggtaaaaaccgggagactgtgccgattaaggacaactttgaacttgaggtgcttcaagctcagtataaggagttgaaggagaaaatgaaggtaatggaagaggaagtgctgattaagaacggggagatcaaaatccttcgggactctcttcaccagacagaatccgtactggaggagcagaggagaagtcacttcctcttagagcaggagaagacccaagccctgtcggataaggagaaggagttttctaagaaacttcaatctctgcagtccgagctccagtttaaggatgcagaaatgaacgaactgagaacgaaactccagactagcgagcgagcgaataagctcgctgctcccagtgtctctcatgtgtcgcccaggaagaaccccagcgtggtgatcaaaccagaagcttgctcgccccagttcggaaaaacttccttccccactaaagagtctttttcagccaatatgtccctgccgcacccatgccagacggagagtggatataaaccactagtcgggagagaagatagcaagccgcacagcctccggggtgatagcataaagcaagaagaggcccagaagtctttcgtggattcctggcgtcagagatcaaatacccagggctccatcctgattaacctgttgctgaaacagcctctgattcctggctcctccttgtctctctgtcacctgcttagctcatcttctgagagccccgctggcacccctttgcaaccaccgggatttggatctaccctcgccggtatgagcggtttgcgcaccactggatcatatgacgggtccttttccctctccgctctcagggaagcacaaaacctcgccttcactggtctgaatttagtggcgcgtaatgagtgctctcgggacggggaccccgctgagggaggccgaagagccttcccactttgtcaactcccaggggctgtacattttctgccgctggttcagttcttcatcggtctgcactgtcaagcactccaggatctggcagccgctaaacgcagcggtgcaccgggagattctcccacccattcatcttgtgtcagcagcggcgtggagactaatccagaggattctgtttgcatacttgaggggttttctgtgacggctctgtcgattctccagcacctggtgtgccacagcggagctgttgtaagcctgctattgagcggcgtgggcgctgatagtgccgctggtgaaggcaacaggagcttggtgcacaggctttcagatggagacatgacttcagccctcagaggtgtggcggatgaccagggccaacatcctctgttaaaaatgttacttcacctgctggcgttcagctccgctgccaccggccacctgcaggccagcgtgctgacacagtgtcttaaggtcctggtcaagcttgccgagaacactagctgcgacttccttcctaggttccaatgcgtgttccaggtgctgcccaagtgtctcagtcccgagaccccccttccctcagttctgctcgccgttgaactccttagcttactggccgatcatgatcagctggcccctcaactgtgctcacactcagagggctgtctccttttactcctctatatgtacatcaccagcagacctgaccgggtggctttggaaacccagtggctgcaactggagcaggaagtggtctggctgctggccaagcttggtgtgcagagtcctttgccgccagtcaccgggagtaactgccaatgcaacgtggaagtggttcgcgcattgaccgtaatgctacaccggcaatggctaaccgtccggagggcaggtggtcctcctcggactgatcaacaaagacgtacggtccgctgcctccgagataccgtcttactcctgcatggcctgtctcagaaggataaattattcatgatgcattgcgtggaggttctacaccaattcgaccaggtcatgcctggcgttagtatgctaattagaggactgcccgacgtgacagactgcgaggaggctgctcttgatgatctctgtgcagcagaaaccgatgtggaggaccccgaggtcgaatgtggctag

SEQ ID NO: 215501 - DNA, 2295 bp, Artificial Sequence
  Description of Artificial Sequence: Synthetic coding sequence
atggccggtacctctgccccaggttctaaacgtcgctctgagccccctgccccaaggcccggaccccctcctggtaccggacacccgccatctaaaagagcgagggggttttctgctgcggcagccccagatccagatgatcctttcggcgctcatggcgactttacagctgatgacctagaggaactggatactctggcgtcccaggctctgagtcagtgccccgctgctgcaagagacgtgtcatcggaccacaaggtccatcgcttgttagacggaatgagcaagaatccaagtgggaagaatcgagagactgtaccaataaaggacaactttgaacttgaagttttgcaggcccagtataaggagttgaaagaaaaaatgaaagttatggaggaagaggtgctcatcaagaatggggaaatcaagatactgcgcgattccctgcatcagactgagtccgtgctggaagaacaaaggagatctcattttctgctggagcaggaaaagacccaagccctgagcgataaggagaaggagttcagcaagaaactgcagagcctgcaatccgaactccaattcaaagacgctgagatgaacgagttaagaacaaagttgcagacctcagagcgggctaacaaactcgccgcaccctctgtgagtcacgtcagcccgcgaaagaaccctagcgtcgtgatcaagcctgaagcctgctcaccacagtttggtaagacttcattccccacaaaggaatcctttagcgctaatatgtccctgccccacccttgccagacagagagtgggtataagcctttggttggcagggaagactctaagccacattccctgcgcggtgatagcatcaagcaggaggaggcgcaaaaaagtttcgtggatagttggcggcagaggagcaacacgcaaggatctatcctgattaacctgctgctgaagcagccgctgattccaggatcctccctgagcctttgccacttactgtcttcttcaagcgagagcccagccggtaccccactgcagccccctggcttcggctcaaccctggccggaatgagcggtctgagaacaacaggtagctatgacgggtcctttagtctatccgcattgagggaagcgcagaatcttgctttcactggtcttaacctggtagcgagaaacgagtgttcacgcgatggcgatcccgcagagggcggacgccgtgcattccccctatgtcaactcccgggagccgtccattttctccctctggttcagttttttattgggcttcactgtcaagcacttcaggacctcgctgccgctaagaggtctggagccccaggagactcaccaacccactcttcttgcgtgtctagcggagtggaaactaacccggaggactccgtgtgcattctggaagggttctcggttaccgcactgtcaatcctgcaacatctggtttgccactccggagctgtcgtctccctcctgctgtcaggagtgggggcagattctgctgccggagaggggaacaggtcattggtacatcgtttgtctgacggggacatgacatctgctctgcgcggagtagcagacgatcaaggacagcatccactcctgaagatgcttctgcacttgctggctttttctagtgccgcaacaggtcacttgcaggccagcgtgctgacccaatgtctaaaggtgctggtgaaacttgcagaaaacacttcttgcgactttctgcctaggttccagtgcgtgtttcaggtgctcccgaagtgtttgtcacccgagacaccactgccaagtgtgctcctggccgtggagttgctgtctttactggcagatcacgatcaactggcacctcagttgtgttcccactctgaagggtgcctacttctcctgctttatatgtacattacatctcggccagaccgggtggccctggagactcagtggctgcaacttgaacaggaggttgtgcgagcattgactgttatgttacaccggcagtggttaacagtgagacgagcaggcggacccccaagaaccgaccagcaacgcaggacagttcgctgcctgagagatactgtcctactgctgcatggactatcccaaaaggataagttgtttatgatgcactgcgtcgaggtcctccatcagttcgaccaggttatgccaggcgtgtcaatgcttatacgaggcctgcctgacgtgactgactgtgaagaggccgctctggatgacttgtgtgccgcagaaacagatgtcgaagatcccgaagtcgagtgtggctag

SEQ ID NO: 215502 - DNA, 1995 bp, Artificial Sequence
  Description of Artificial Sequence: Synthetic coding sequence
atgaaagtcatggaagaggaagttttgatcaagaatggggaaatcaagattttgcgggacagtctgcaccagactgaaagcgttttggaggagcagcgtagatcccatttcctgttggagcaggagaagacccaggccctgtcagataaagagaaagaattttcgaagaagctacagtctctccagtctgagctacagttcaaggatgcagagatgaatgaactccggaccaagttgcagacctcagaaagggctaataagctggccgcaccaagtgtgtcgcacgtctcaccacgaaagaaccccagcgttgtcattaagccagaagcctgtagcccacagttcggcaaaacgtcgtttcccactaaagaaagctttagcgccaacatgtctttgccacacccttgtcagacagaatcaggatataagcctctcgtgggacgagaagatagcaagccccattccttacgaggcgattcgataaagcaggaggaggcacagaagtccttcgtggattcttggcggcagcgatctaacacccagggatccatcctgatcaacctgctacttaagcagccgctgatccccggatcgagtttgtcgttgtgtcatctgctgagctcgtccagtgagagccccgctggtactcctctgcagcccccaggatttggaagcactcttgctggcatgtccggcctgaggacaaccggatcctatgatggctcattcagcctttctgccctccgcgaggcacaaaacctggcgtttactggcctaaacctagtggccaggaatgagtgttctcgcgacggagatccagcagagggcggacgacgtgcctttcctctgtgtcagctgcccggagctgtgcacttcctcccactcgtgcaattcttcattggactccactgccaggccctgcaagacctggctgccgctaagcgcagtggggcacctggggatagcccaactcactcgagttgtgtgtctagcggcgtcgagacaaatccggaagatagtgtttgtattctcgagggcttcagtgtgaccgcactgtcgatcctgcagcacctggtatgccatagcggcgctgtggtgtctctgcttctgtcaggggtaggcgctgattccgccgctggagagggaaacaggtccctcgtccacagattgtctgacggggatatgacaagtgcacttcgcggagtcgccgacgaccagggacagcaccctctgctcaagatgctcctgcacctgctggcctttagtagcgccgctacaggccatttacaggccagtgtcctgacccagtgtctgaaggtgctggttaagctggccgagaatacttcatgtgattttttacctaggtttcagtgcgtgttccaagtgttacctaaatgtctgtctccagaaaccccacttcctagcgtactgctggccgtagagctcttaagcctccttgccgatcatgaccagttggcccctcagctgtgctctcacagcgagggctgtctgttgctgttgctttatatgtatatcacgagtcgccctgatagagtggcgctagagactcaatggctgcagctcgagcaggaagtggtctggttgttggctaagttgggtgtgcagagccctctccctccagtgaccggcagtaactgccagtgcaatgtcgaggtcgttcgggcactcacggttatgctccataggcaatggctgacagttaggagagcgggtgggcctccaaggacagatcagcagagacggacagttaggtgcttaagagacacagtgctgctgcttcatgggctgagccaaaaggacaagttatttatgatgcactgcgtggaggtgttgcatcagttcgaccaggttatgccaggtgtgtctatgttaatccgagggttgcccgacgtcacagactgtgaggaagccgcattggacgatctgtgcgctgcggaaactgatgttgaggatccagaagtagaatgtggttag

SEQ ID NO: 215503 - DNA, 2097 bp, Artificial Sequence
  Description of Artificial Sequence: Synthetic coding sequence
atgagtaagaatccctctgggaaaaatcgggagaccgttccgatcaaagacaactttgagctggaagtgttgcaggcccagtataaagagctcaaagagaagatgaaggtaatggaggaggaggtgcttatcaaaaacggagagatcaagattttaagagactctttgcaccaaaccgaaagcgtgcttgaagagcagcggagatcacacttcctcctggagcaagagaagactcaagcactatcagataaagaaaaagagttctctaaaaaactccaatcgcttcagagtgaactgcagtttaaggacgccgaaatgaacgagctccgtaccaagttgcaaaccagcgagagggcaaataagcttgctgcaccttccgtgtcacatgtgtcacctagaaagaacccgtccgtagtcatcaagcccgaggcctgcagccctcaatttggcaaaaccagctttcctactaaagaatccttttccgcaaacatgtccctgcctcacccttgccaaactgaatcgggctataaacctctcgtggggcgagaggattcaaaaccccacagtctgcgcggagacagcatcaaacaagaagaagcccagaaaagctttgtggacagctggcgacagagatccaacactcagggctctattctgattaatctcctgctcaagcagccactgatccctgggagcagcctgtcgctgtgtcaccttctgtcttcaagttctgaatccccagcagggaccccgttgcagcctccgggtttcgggtctacgttggccggtatgtctggactgcgtaccactggatcctatgatggttctttctccctgtccgccctgcgtgaagcccagaacctagcattcacaggcctcaatttggtggccaggaacgaatgtagcagggatggcgatcctgccgaagggggtagacgtgccttcccgctgtgccaactgccgggagccgttcactttctcccgctggtccagttcttcatcgggttacactgtcaggccttgcaagacttggcggcagcaaaacggagtggggctcccggagatagtcccacacattcaagttgcgtgagttccggcgtggagactaaccccgaggacagtgtgtgcatcttagaggggtttagcgtcaccgcccttagcatcttgcagcatctcgtctgccacagtggtgcagtcgtgtctcttttgctttccggtgtgggggcagattccgccgcaggtgaaggcaacaggagtctggtgcaccgactgtctgatggtgatatgacctcggctctgcgcggtgtggccgatgatcaagggcagcaccctctgctgaaaatgctactgcacctgttagcctttagcagcgctgctaccggccatctgcaggcttcagttctcacccaatgtttaaaagtgctagttaagctcgcagagaacacttcttgtgactttctgccacggttccagtgcgtcttccaagtgttacccaaatgcctctcccccgagacgccacttccgtcggtcctgttggccgtagaattgctgtcgcttctcgccgatcacgaccagctggctcctcagctgtgttctcacagtgagggctgcctgctgttgttactatacatgtacattaccagccgacctgatcgcgtggccttagagacacagtggctgcagctagagcaagaagtggtctggctcctcgcgaaactgggagtgcagtcccctctgcctcctgtgacgggtagtaactgccaatgcaatgtggaggtcgtgcgagccttgaccgtcatgctgcatagacagtggctcaccgtacgccgagctggcggacctcctcgcaccgaccagcagcgtagaacggttcggtgtctaagggatactgtgctgctgctgcacggtctcagccaaaaggataaattgttcatgatgcattgtgtagaagtcctgcaccagttcgaccaggtgatgcccggagtttccatgttgataagggggctgcctgatgttacagattgtgaggaggccgcacttgacgatctgtgtgcagctgagaccgatgtcgaggaccctgaggtggagtgcggctag

SEQ ID NO: 215504 - DNA, 591 bp, Artificial Sequence
  Description of Artificial Sequence: Synthetic coding sequence
atgtcgaagaacccgtcaggtaagaatagggagactgtgcccatcaaggacaattttgaactcgaagtgttgcaggcccaatacaaagagctcaaggaaaaaatgaaagtgatggaagaagaggtattgatcaagaatggcgagatcaagatcctgcgtgactcactccatcagacagaatctgtcctggaggagcagaggcgctcccactttctgctggagcaggagaaaacacaggctcttagcgacaaagagaaagagttctcaaaaaaactgcagagcctacagtcagaattgcagtttaaggatgccgaaatgaatgagctcagaacaaaattgcaaacctccgaacgggcaaacaagctggccgcaccatctgtgagccatgtgagccccaggaagaacccctcagtagtcataaagcctgaagcatgtagtccccaattcgggaagactagttttcccacaaaggagtccttctctgccaatatgtccctgccccatccatgtcagaccgagagtggatataagcctttggtgggaagagaggactcgaaacctcattctttgaggggcgactcaattaagtag

SEQ ID NO: 215505 - DNA, 141 bp, Artificial Sequence
  Description of Artificial Sequence: Synthetic coding sequence
atgagcaagaatccctccggcaagaatcgcgaaacagtaccgataaaggataacttcgagcttgaggtcctgcaggcccagtacaaggagctgaaagagaaactctgcaagaaggctgatacctcctaccatcacctgtag

SEQ ID NO: 215506 - DNA, 1305 bp, Artificial Sequence
  Description of Artificial Sequence: Synthetic coding sequence
atgagcatagaaaagatctgggcgcgtgaaattctcgacagtcgcggaaatccaacagtcgaagtagatttgtacaccgccaaaggcctgttccgcgcagccgtgccaagtggcgctagcaccgggatttacgaggcactcgaactgcgggatggtgataaacagagatacctgggaaagggtgtgttgaaagccgttgaccacattaactcaaccattgccccagccctcattagttcaggcctcagcgtcgttgagcaagaaaagctagacaatctgatgctcgagcttgatggaactgagaataagagcaagttcggcgcaaacgctatccttggagtgtcactggctgtgtgcaaagccggtgcggctgagagggagctcccactgtaccgccacattgcccagctggccggaaattctgacctgattctcccagttcctgcttttaatgtgatcaacgggggatcccacgccggtaataagctggccatgcaggagtttatgatcctccctgtgggcgcagagtcttttagagatgcaatgagacttggcgcagaggtctaccataccctcaaaggggtgattaaagataagtatgggaaagacgccacaaatgtaggagatgaaggaggatttgcaccgaatatcttggagaatagtgaggccctcgaactagtaaaggaagcaatcgacaaggctggatatacggagaagatcgtgattggtatggatgtcgccgcatccgagttctatcgtgacggaaaatatgatctggattttaagtctcccaccgatcccagcagatatattacaggagaccaactgggcgcactgtaccaggactttgtacgcgattacccggtcgtgtccattgaagacccttttgaccaagacgattgggcagcctggtccaagttcaccgcgaatgttgggattcaaattgtcggggatgacctgacagtcaccaatcccaagcggattgagagggctgtggaggaaaaggcctgtaactgcctgctgttaaaggtgaatcagataggctctgtcaccgaggcgatccaagcctgcaaacttgctcaggagaacggctggggggttatggtttctcaccggtctggcgagacagaagacactttcatcgcagaccttgtcgtgggtctgtgcacagggcagatcaagactggtgccccatgccgcagcgaaaggctggcaaaatacaaccaactgatgcgcatcgaggaggagttgggtgatgaagccaggttcgcgggtcataacttccggaaccctagtgtactgtag

SEQ ID NO: 215507 - DNA, 3573 bp, Artificial Sequence
  Description of Artificial Sequence: Synthetic coding sequence
atgaagacacgtcagaacaaggattccatgtccatgcgatccggacggaaaaaagaagctccagggcctagagaggaacttagaagtcgaggacgggcatcccctggaggtgtgagtacatccagcagtgatggaaaggcagaaaagtctcgacaaacagcaaaaaaagccagggtggaggaggctagcaccccaaaagtgaacaaacagggcaggagcgaggaaatctccgaaagcgaatcggaggaaacaaacgctcccaaaaagacaaaaaccgaacaggagctgccacggccacagtcaccctccgacctagactccctggacgggagatcgctgaatgatgacgggagctcagatccgagggatatagatcaggataaccgctcaacttccccatcaatctattctccaggcagtgtggagaacgattccgactcatccagcgggctgtcccagggccctgcacggccatatcatcccccacctctatttccaccttctccccagcccccagacagcactccccgacagcctgaagcgagttttgaaccacacccaagcgtcactcccaccggctaccatgccccaatggagccacctaccagcagaatgtttcaagcccctcccggagcccctccccctcatcctcagctgtaccccggagggactgggggtgtgttgtcggggcctcccatgggaccaaaagggggtggggctgcctccagtgtaggcggtcccaatggcggaaagcaacatccccctcccacaaccccaatttccgtgtccagctcgggtgcgtcaggcgctccacctactaagccaccgacaaccccggtgggagggggaaatctgcccagtgctccccctccggctaattttccccatgtgacacccaacctgccccctcctcctgccctacgacctcttaataacgcttccgcttcacctccagggttaggggcacagcccctcccgggtcacctacctagcccacacgctatggggcagggaatgggcggtctgccgccaggaccggaaaagggacccacactggcaccttccccacattctctgccccctgcatcaagctctgcgcctgctcccccaatgcgcttcccctactcgtcgtcctctagttccagcgccgctgcttcatcatcctcatcctcctcttctagcagcgcatcccctttccctgccagtcaggctttaccgtcctacccacatagttttccccctcctacttcattatctgtgtctaaccagccacccaagtacacgcagcctagtctgccttctcaagccgtatggtctcagggccctcctcctccccctccctacggtagactgttggctaacagcaacgcacatccaggccctttccccccaagcacaggcgctcagtccaccgctcacccacctgtttccacacatcatcaccatcaccaacagcagcaacagcagcagcagcagcagcaacaacagcaacagcaacaacagcagcatcatggaaattctggacctcctcctcccggagcgtttcctcaccccctcgagggaggatcctctcatcatgcccacccatacgcaatgagtcccagtctgggcagcttacggccttacccaccaggccctgcacatttgcctccccctcactcccaagtctcgtacagccaggcgggacctaatggcccacctgtgtcttccagctctaacagctcctccagtacatctcagggcagctacccatgtagccaccccagcccttcacagggcccacagggtgccccatacccttttccgccagtccctactgtcacaacctcaagcgccaccttgtctactgtgatagccaccgtggcttcatcaccagccggatacaagacggccagccccccaggaccccctccgtacggcaaacgggcaccatccccaggggcttacaagacggccacaccgccaggatacaaacctggatctccacctagcttcaggacaggcacccccccaggttatcgaggtacatctccacccgcagggccaggcacgttcaagcctgggtcaccaacagtgggtcccggaccactgccacctgctggcccatctggcctgcccagcctccctccgccaccagccgctccagcttccggacccccactctctgcgactcagattaagcaggaacccgctgaggagtacgaaacccccgagagccctgtgccacccgctagaagtccctccccccctccaaaggtggttgacgtgcctagccatgccagtcagtcggccaggttcaataagcatcttgatagaggcttcaattcttgcgcccgatccgacctgtactttgttcccttagaaggatcgaagctagccaaaaagcgcgctgatttggttgagaaggtgagacgggaggctgaacagagggccagggaggagaaggagagagaaagagagcgcgagagggaaaaggagcgggaacgggaaaaggagcgagaactagagcgaagcgtgaagcttgcccaggagggacgagcccctgtagaatgcccctccttaggcccagtgcctcataggcccccatttgagccaggaagcgcggtagcgaccgttccaccttatctgggacccgacacacctgccctccggactctttctgagtacgctcggccacatgtaatgagtccgggaaaccggaatcatccattttatgtacctctcggagctgtagaccccggactcttagggtataacgtccctgcactgtactctagcgatcctgctgccagagagagagaacgcgaggccagagagcgtgatctgagggacaggctaaaaccgggattcgaagtgaaaccaagcgaactcgagccactccatggggttcctggccctggcctggaccctttccctcggcacgggggactggctctccaacccggtcctcccggtttacatccctttccctttcacccgagtctgggacccctcgaaagagagcgactcgccctggcggctggtcccgcactcagacctgacatgagctatgccgaaagattagccgcagaacgtcaacacgcggaacgcgttgcagccttggggaatgatcctctggcccgattacagatgctgaatgtgacccctcaccatcaccagcacagtcacatacactcccacttgcacttacaccagcaagacgcaatccacgcagcttccgccagcgttcacccactgatagacccgcttgcctcaggttcacacctgacccggatcccctaccctgccggaacacttcctaacccattactaccgcatcccttgcatgaaaatgaagtgctgcgccatcagttgttcgcagcgccttacagggacttaccagcaagcctgtccgcaccgatgagtgccgctcaccagcttcaggccatgcatgcacagagcgccgagctgcaacgtctagctctggaacagcaacagtggctccacgctcaccaccctttacattctgtccctttgcccgcacaggaggattattattcacacctgaaaaaagagtccgataagccattgtag

SEQ ID NO: 215508 - DNA, 3573 bp, Artificial Sequence
  Description of Artificial Sequence: Synthetic coding sequence
atgaaaaccaggcagaacaaagacagcatgtctatgaggagcggcagaaaaaaagaggctcccggtccacgcgaggagttgaggtcaagagggagagccagtcctggcggagtatctacatcctcatcggatgggaaagctgaaaagtcacgtcaaaccgctaagaaggccagagtagaagaggcgtccaccccgaaagtgaacaaacagggccgttcagaggagatctcagagtctgagtcggaagagacgaatgcccctaaaaaaaccaagaccgagcaggaactgcctagaccccagtcaccctccgacttggactccctggatggcagaagtctcaatgacgacggatccagcgatcccagagacatagaccaagacaaccgctcaacatctccaagcatatactctcctggatcggttgaaaatgactctgactctagttctggactgtctcaaggcccagcccgtccctatcatccaccccctctgtttcctccttctccccaacctcctgacagtaccccacgtcaaccagaagcaagcttcgagccacatcctagtgtaacacccaccgggtatcacgcccctatggagccgcctacatctcgcatgttccaagccccacctggggcaccacctccccacccacagctttatcctggcggtaccggaggcgttcttagcggcccacccatggggcctaagggcggtggggcagcttcctctgtgggcggtcctaatggcggaaaacaacaccctcctcccactacacccattagtgttagtagctccggcgcatcaggagcgccacctacaaaaccacccacgacccctgtgggcggtggaaacctcccctctgctccgcctccagccaattttcctcatgtaacccctaatctccctccacctcctgcgttgcgacctctaaataatgcaagtgcctctccccctgggctaggggctcagcccctgcctgggcatctgccctccccacatgctatggggcagggaatggggggtctgccgcctgggcctgaaaaagggcctaccttggccccatccccgcattccctgcctcccgcatcctccagtgcgccagctcccccaatgaggtttccgtattcatcctcgtcgagctcatcagcggctgctagtagcagcagctccagcagctcgtcaagtgcttccccgttcccggcttctcaagcgctgccatcctatcctcatagtttccccccacccacttcccttagcgtgtcgaaccagcctcccaagtacacccagcccagccttccctcacaagccgtgtggtcgcagggcccaccaccaccccctccttacggccgacttctggcaaactccaacgcacatccaggtccctttcctccctcaacgggggctcaatcaacagctcatcccccagtgtcaacccaccaccaccaccaccagcagcagcagcagcagcaacagcaacagcagcagcagcagcaacaacagcaacaacaccatggtaattccgggccacctccccctggcgcatttccacatcctttagagggcggatcttcccatcacgctcatccttatgcaatgtcgccaagcctgggctcactgcgcccttacccccctggccctgcccacctgccccctccccatagccaggtgtcatactctcaggcaggtccaaacggaccccctgtttcctccagttcaaattcttcgtcctcgaccagccagggtagctatccgtgttctcacccctcccccagccaggggccacagggagccccataccctttcccgcctgtcccaacggtaaccacctcttccgcaactctctccaccgtgatcgccactgtggcttcctcaccagcaggatacaaaacagcgtctccaccaggtccacctccttatggtaagcgcgctccctcccccggagcctataaaaccgctacgccaccaggctacaagccgggttcccccccatctttccggacaggcaccccaccaggataccgtgggacctcacctcctgcaggtcctggcaccttcaaacctggaagccccaccgtagggccagggcctctcccgccagccggtccatctggcctgcctagcttaccgccaccacccgctgcgccagctagtgggccaccgctgtccgcaacacagatcaaacaggagccagccgaggaatacgaaacacctgagtcccccgtacctcctgccaggagtccatcaccacctccaaaggtggtcgatgtcccttcccacgcttcacaaagcgcccgatttaacaaacatttggatcggggatttaactcctgcgcgaggagtgatctctactttgtgccactggaagggtccaaattggctaaaaaacgcgctgacctggtggagaaggtgagacgcgaagcagaacagcgagccagagaggagaaagagcgtgagagagagagagaaagagagaaagaacgcgagcgggagaaagagagagagctcgaaaggtccgtgaaactcgcgcaggagggccgagctcccgttgaatgtccatccctggggccagttccccacaggcccccttttgagcccggatccgccgtggcgacagtcccaccgtatcttggacccgatacacctgcactgcgcacgctgagcgaatacgccaggcctcacgtcatgagcccaggaaacagaaaccatcccttttacgtccccttgggagccgtggacccaggtctgctgggatacaatgtgccggctctttacagctcagaccccgcagccagagagagggaacgggaagctagagagagggaccttcgggatcgcctgaagcccggattcgaggtcaagccttccgagctggagcctctgcatggtgtcccaggaccaggcctggacccctttccccgtcatggcggtctggcccttcagcctggcccaccaggattgcatccatttccattccaccctagtctgggccctctcgaaagagaacgtctcgcccttgctgccggacccgcattacgccctgacatgtcatacgccgagcggctggcggctgagaggcaacatgcagagcgtgttgccgctctggggaacgatccactggccaggctacaaatgcttaatgtgactccacaccatcaccaacactcgcatatccattctcacctccacctccatcaacaggacgccattcacgccgcatctgcatctgtccatccattaatagatcccctggccagcggcagccacctcactcgtatcccttatccggcagggacccttcctaaccccttgctccctcaccccttacacgagaacgaagtgctgagacaccagctgttcgcggcaccttacagagacctccccgcaagcctgtccgctccaatgtcggctgctcatcagttacaggccatgcatgcccagtctgccgagcttcagcgcctggctctcgagcagcagcaatggctccacgcacatcaccccctgcactctgtacccttgcccgcacaggaagactactatagtcacctgaagaaggaatccgataaacctctgtag

SEQ ID NO: 215509 - DNA, 3573 bp, Artificial Sequence
  Description of Artificial Sequence: Synthetic coding sequence
atgaaaacccggcagaacaaggactctatgagcatgaggagtggccgaaagaaggaggctcccggtcctagagaggagctccgttcaagaggtcgtgcctccccaggaggagtctcgacatcaagtagtgacgggaaagccgaaaagtctcgccagactgcgaagaaggccagagtggaagaggcttccactcccaaggttaacaaacaaggcaggagcgaggagatcagtgaatctgaatccgaggaaaccaacgccccaaaaaagaccaagaccgaacaggaactgcccagaccacagtcgccaagcgacctggactcgttagatgggaggtcactaaatgacgacggctcttcagaccccagagatattgatcaggacaaccgttcgactagtcccagtatttacagccccggatctgtagaaaacgactctgacagttccagcggtctgtcccaagggcctgcacgaccatatcacccccctcctctcttcccaccctccccccaacccccagactccacccccaggcagcccgaggcatcttttgagccacacccctccgttactcccacgggctaccacgcccctatggaacccccaacatcccgcatgttccaagctcctccaggagcccctcctccacacccccaactgtatccaggcggaactggaggtgtgctgagtggtcccccaatgggccctaagggcggaggtgcagcgtcctctgtgggcggacccaacggcggaaaacagcaccctcccccaaccacccccatcagcgttagctcgagcggagctagcggcgctccaccaaccaaacctcccacaactcccgttggaggtggaaacctaccctccgcgcctccccctgcaaacttccctcacgtgactccgaacttgccaccccctcctgctctgagaccactgaacaatgctagtgcatcacctcctgggctgggcgctcagccactgccagggcacctgccttcaccacacgccatgggtcagggtatgggcggtctgcccccaggacccgagaagggtccgacactggctcccagtccccactcattgccacctgcctcatcctctgctcctgcacccccaatgcgcttcccttattcttcttcctcatccagcagcgcagccgcatcctcgagcagctcatccagttcctcaagcgcaagccctttccccgcaagtcaggccctgccctcctacccccattctttccctcctcccacaagcctctctgtctcaaaccagcccccaaaatacacccagcctagcctcccctctcaggccgtgtggtctcagggcccacctccgcctcccccatatgggaggctgttagctaattcgaacgcacaccccggacctttccctcccagtactggcgcacagagtaccgcccacccacccgtctcaacacatcaccatcaccaccaacagcagcaacagcagcaacagcaacaacagcagcaacagcagcagcaacaacagcatcatggcaacagcggacccccacctccgggagccttccctcaccccctggagggaggtagcagccaccatgcgcatccatacgcgatgtccccgagtctagggagtctgaggccataccctccaggacctgcccatctacctccaccccactctcaggtctcttacagccaggccggaccaaacgggcctccggtgtccagcagcagcaattcctcgtcttccacgtcccagggctcctatccatgcagtcatccaagtccctcccagggtccgcagggagcaccttaccccttccctccagtccctaccgtcactacatcctccgccacactctcaactgtgatagctacagttgcttcctctcccgcaggctacaaaacggcgtctccaccaggtccacccccttacggaaagcgtgctccttcacctggagcgtacaaaaccgctacccctcctggatacaagccaggatccccaccatccttccggaccggtaccccccctggatatcgtggcacaagccccccagcgggacctgggacgttcaaacctgggtcaccgaccgtaggccctgggcctcttccacccgcaggaccgagcggtttaccatccctccctcccccaccggcagccccagcttctggaccaccactatctgccactcagattaagcaggaacctgccgaggagtatgaaacgccagagtcccccgtccctccagcacgaagtccctcccccccaccgaaggtcgtggatgttccctcccacgcgtcccagtccgcccgattcaacaagcatctggataggggtttcaatagttgcgccaggtctgatctgtattttgtgccattagaagggtctaaattggctaagaaacgggctgacttagtggaaaaagtgcgtcgagaggctgagcaacgagccagagaggagaaggaaagagagagagagcgcgaacgggaaaaggagagggagagggaaaaggaaagggaactggaacggtccgtaaagcttgcccaagagggccgagcccctgtggaatgtcccagccttgggcctgtaccccaccgaccaccattcgaacccggaagtgccgtggctactgtccccccatatctgggtccagacactccagctcttagaaccctgagcgagtacgccaggcctcacgtcatgtcacccggtaaccgcaaccacccattctatgtaccactcggagccgttgatccagggctgctcggttataacgtccctgcactgtattccagtgacccggctgctcgcgaaagggaaagagaagcccgtgaacgggatcttagggacagattaaagcctgggttcgaagttaaaccatccgagctggagccccttcatggagttccgggtcctggacttgacccctttccgagacatgggggtctcgccctccagcctggaccccctggcctgcaccccttcccgttccatccctcccttgggcctctagaaagagaaaggctagccttagcagcgggacctgcactacggccagacatgagctatgccgagaggctcgcagccgaaaggcaacacgccgagcgggtggcggcattaggaaacgacccgcttgctaggctacagatgctcaacgtgacaccacatcaccatcaacattcacacatccactcacacctgcaccttcaccagcaggacgctatccacgcagcttcggcttccgtgcatcccctgatcgatccactcgcctcaggaagtcacctgacacgtatcccgtatcctgcgggaaccctaccaaacccgctgcttccacatccactgcatgaaaatgaagtgttgcgccatcagctattcgccgcaccctacagagacttgccggctagtctcagcgccccaatgtctgccgctcaccaattgcaggcaatgcacgcccagtccgctgagctgcagcggctcgctctggaacagcagcagtggctgcacgctcatcaccccttgcactctgtccctctccccgctcaggaagattactattctcatctgaagaaggagtcagataagcctctgtag

SEQ ID NO: 215510 - DNA, 519 bp, Artificial Sequence
  Description of Artificial Sequence: Synthetic coding sequence
atgctggtgatccacctggaggaacatgtcattatcgccttttctcagcacaatactattatggacctggtccaattctttgttacattcttttcttgcttcctctcactgctgttagtcgcagccgttgtatggaaaatcaaacaaacctgttgggctagcaggaggcgagaacagctgctgcgcgaaaggcagcagatggcatccaggccttttgcctccgtggatgtcgccctggaggtcggagcagaacaaaccgaattcctgaggggaccccttgagggtgctccgaaaccgattgccatcgaaccctgcgccggaaaccgagctgcggtgctgactgtctttctttgccttccacgtggttcatcaggtgcaccaccgccaggtcaatctggtttggccatcgcaagcgcactgatcgatatatctcagcagaaggcgtctgactctaaagataagacgagcggggtccggaacaggaaacacctcagtacaaggcaggggacctgtgtgtag

SEQ ID NO: 215511 - DNA, 4140 bp, Artificial Sequence
  Description of Artificial Sequence: Synthetic coding sequence
atggagacgggaggccgagcccgtaccggcaccccgcaacctgctgccccaggggtctggcgggcaagaccagctggaggaggcggtgggggagctagcagctggttgctcgatggcaatagttggctcctatgttacgggtttctttacctcgctctgtacgcacaggtcagccagagtaagccttgcgagagaactggcagttgcttttctggccgatgtgtcaacagcacgtgtctgtgtgatccgggttgggtgggcgaccaatgccagcactgtcagggcagattcaaactgacggagccttcaggctacttgacagatgggccaattaactacaagtataaaacgaagtgtacctggctgattgagggttacccaaacgctgttctcagactccggtttaaccatttcgctaccgaatgttcctgggaccatatgtacgtgtatgacggcgatagcatttatgcccctctcattgcagtcctatccggtcttatagtgcccgagattaggggcaatgaaacagtgcccgaagtggtcacaacatctggatatgccttgcttcatttcttctccgacgcagcatataatttgacgggattcaatatattttattctatcaattcatgtcctaacaactgttccgggcacggtaaatgcacaaccagtgtttccgtgccctcccaggtttactgcgagtgtgataaatattggaaaggtgaagcgtgtgatatcccctattgcaaggctaattgcgggagccccgaccacggttactgcgatttgacaggggaaaagctgtgcgtgtgcaatgacagctggcagggcccagattgcagtctaaacgtcccgtctaccgagagctactggatcctgcccaatgtgaagccattctctccatcggtgggtagagcctcacataaggcagtcttacacgggaaatttatgtgggtcataggcggatacacttttaactactcttctttccagatggtcttgaattacaatctggagagttccatctggaacgtaggcacacccagcagaggtcctctccagaggtacgggcattcccttgccctgtatcaggagaatattttcatgtatggaggacggattgagacaaatgatggaaacgtgacagatgagctgtgggtcttcaatatccattcccagtcatggtcgacaaagacacccacagttctaggacacggtcagcagtatgcagttgagggacactcggcacatatcatggagctcgactctagggatgtcgtcatgataattatcttcgggtattccgccatttacgggtatacatcatcaattcaggagtaccacatctcaagcaacacttggctcgtgccggaaacgaaaggagcaattgtgcaaggtgggtacggtcatacatctgtgtatgatgaaatcaccaaatccatttacgtgcatggtggctataaggcactgcccggaaacaaatacggcctggtggatgatctatataaatacgaagtaaacaccaaaacttggacaatcttgaaggaaagtgggttcgctaggtatttgcatagtgcagtccttatcaatggagctatgctgatcttcgggggaaacactcataacgatacaagtctcagcaatggagccaaatgtttcagtgcggattttctcgcctacgacattgcatgtgatgagtggaagatcctgcccaagccaaatttacaccgagacgtaaataggttcggtcacagcgccgtggtcatcaacggatctatgtatattttcggcggattctcctcggtgcttttaaatgatattctggtgtataagcctccaaactgcaaggcctttcgggacgaagagttgtgtaaaaacgcaggccctggcattaaatgcgtgtggaataagaaccattgcgaatcttgggagtcaggcaacaccaacaatattctgagggctaagtgtccgcctaaaaccgcggcttccgacgataggtgttaccgctatgcagactgtgccagttgcactgccaacaccaacggctgccaatggtgcgatgacaaaaaatgtatatcagctaactccaattgtagcatgtccgttaagaattatactaagtgtcacgtgcgtaatgagcagatctgcaataaactgacatcttgcaaaagttgcagcctgaacttaaattgtcaatgggatcagaggcagcaggagtgccaagccttgcccgcacatctgtgcggtgaggggtggagccatattggagacgcctgccttagagtcaatagcagcagggagaactacgataatgcaaagctgtattgctacaacctgtccgggaatctcgcatcgctgaccacttctaaagaagtggaattcgtgctggacgagatacagaaatacacgcagcaaaaggtgtcaccctgggtgggcctgcggaagattaacattagctactggggttgggaggacatgtccccctttaccaataccactttgcagtggttacccggagaacctaacgatagcggattttgcgcctatctcgaacgggctgctgtcgccggactaaaggccaacccctgtacgtcgatggccaacggcctggtttgcgagaagccagtcgtgtcgcctaaccagaatgctcgaccgtgtaagaaaccatgctctttacgcactagctgttctaactgcacctctaacggcatggaatgcatgtggtgttcttcaactaagagatgtgtggacagtaacgcttacattatatctttcccctatggacaatgcctggagtggcaaactgctacatgcagcccacaaaactgcagcgggttgcgcacttgcgggcaatgtctagaacagcccggttgcggctggtgtaacgatccttcaaacacagggaggggccactgcattgagggatcctccaggggccctatgaaactgatcggaatgcatcatagcgagatggtgctcgacaccaacctctgtcctaaagagaagaactatgagtggagcttcattcagtgccctgcctgccagtgtaatggacactctacttgtattaataacaacgtttgcgaacagtgtaaaaacttgacaaccggcaagcagtgtcaggactgtatgccaggctactacggtgacccgaccaacggaggtcagtgtacggcttgtacctgctctggtcacgccaacatctgccatcttcacaccggcaagtgtttttgcaccaccaagggcattaagggagaccagtgtcagttgtgtgatagtgagaatcggtacgtgggcaacccactgaggggcacttgctattactctcttctgattgactatcagtttacgttttccctcttgcaggaggatgacagacatcataccgcgatcaattttatagccaatcccgagcaatcgaataaaaatctggacatttcaatcaatgcctccaacaacttcaacttgaatatcacttggagcgtggggagtaccgccggtacaatttcgggggaggagacatcgatcgtgtcaaaaaacaacatcaaggagtatcgcgacagtttttcctatgaaaagttcaacttccggtctaatcccaacatcactttctacgtttacgtgagcaatttttcttggcccatcaaaatacagatagcatttagccagcacaataccatcatggacctggtgcagtttttcgtgacttttttctcctgtttcttgagtctgctactagtggcggcagtcgtgtggaaaatcaagcaaacttgttgggcatccagaaggagggagcagctcctcagggagagacagcaaatggcttctagaccttttgcctcagtcgatgtggcactggaggtgggcgctgagcaaaccgagtttttgagggggcctctggagggggctcctaagcccattgccattgagccctgcgccggtaatcgggcagccgttctcactgtgtttctatgcctccccaggggctcttctggtgcccctcccccaggacagagcggtcttgcgatagcctcagctctgatcgacattagccagcaaaaagccagtgattccaaagataaaacttctggggtgcggaatagaaagcatctaagtacacgacagggcacgtgcgtgtag

SEQ ID NO: 215512 - DNA, 1293 bp, Artificial Sequence
  Description of Artificial Sequence: Synthetic coding sequence
atggagtgtatgtggtgttcctctactaaaagatgcgtggactccaatgcatatataatcagctttccatacggacaatgtctagaatggcagaccgcgacatgcagtccccaaaattgtagcgggctcaggacctgtgggcagtgtctggagcagccaggatgtggctggtgcaacgacccaagtaatacaggcagaggccattgtatcgagggcagcagcagagggcctatgaaattgatcggtatgcaccacagcgaaatggtgctggacacaaatctgtgccctaaggaaaagaattacgagtggagtttcatccagtgccctgcctgcacctgtagtggccacgctaacatttgtcacctgcatacgggtaaatgtttttgtactacaaaaggcataaaaggggaccagtgccagctttgcgacagtgagaatcggtacgtcgggaacccactccggggaacatgttactattccctgttgatagactatcagtttaccttcagcctcttgcaggaagacgacaggcaccatactgctatcaacttcattgcaaaccccgagcagtcaaataaaaatctcgatatctccattaacgccagtaacaacttcaacttaaatataacctggagtgtcggatccactgctggaacgatttccggagaggagacatctatcgtctctaagaataacatcaaggagtatcgtgatagcttcagctatgagaaattcaatttccggagcaaccccaatatcaccttttacgtctacgtttcaaactttagctggcccatcaagattcagatcgctttctctcaacacaacaccattatggatctggttcagttttttgtcactttcttttcttgcttcctgtccctgctcttggtggctgctgtcgtctggaagatcaaacaaacctgctgggcttcacgtaggcgcgagcagttactgagggaacgccaacaaatggcttctagaccttttgcctctgtggacgtggccttagaggtcggggcagagcagacagaatttcttcgaggaccccttgaaggcgctccaaaacctatcgccatagagccttgcgccggaaaccgggcagctgtacttacagtgtttctgtgtctgcctcggggaagctcaggagcgcctcctcccggacaatccggtctggcaatcgcttccgccctgatcgacatctctcagcagaaggccagcgactctaaggacaagacctcaggggtgaggaaccgcaaacatttatccacacggcaggggacctgtgtgtag

SEQ ID NO: 215513 - DNA, 207 bp, Artificial Sequence
  Description of Artificial Sequence: Synthetic coding sequence
atgccgaagcatgagttctccgtcgacatgacctgtgggggatgtgcggaggccgtgtctagagtgttgaataaactgggaggggtgaagtatgatatcgacctccctaacaaaaaggtttgtattgagagcgaacattctatggataccttgctggcaacacttaagaaaaccggaaagaccgtatcatacctgggcctcgaatag

SEQ ID NO: 215514 - DNA, 207 bp, Artificial Sequence
  Description of Artificial Sequence: Synthetic coding sequence
atgcctaaacatgaattctctgtcgacatgacgtgcggcggatgtgcagaggcagtttcaagggtgcttaataaactcgggggagtgaaatatgacatagaccttcccaacaaaaaggtttgtatcgagtctgagcatagtatggacaccctgttggccaccctgaagaagacagggaagacagtaagctatttgggcctggaatag

SEQ ID NO: 215515 - DNA, 207 bp, Artificial Sequence
  Description of Artificial Sequence: Synthetic coding sequence
atgccaaaacacgagtttagcgttgacatgacatgtggcggttgcgcggaggccgtgtctcgggtcttaaataaactgggaggcgtcaaatatgacatcgatcttccgaacaaaaaagtttgcatcgagtcagaacacagtatggacacactgttagctacactgaaaaagactggcaagaccgtatcttatctcgggctcgaatag

SEQ ID NO: 215516 - DNA, 933 bp, Artificial Sequence
  Description of Artificial Sequence: Synthetic coding sequence
atggctgctgctgtcgccgctgccccaggggctttgggatctctgcatgctggaggggcacgtcttgtggctgcgtgtagcgcttggctctgccccggtttacgtttaccaggatcgctagccggacggagggcagggcctgctatttgggcacaggggtgggtgcctgccgctggcggtcccgctccaaaaaggggctacagctctgaaatgaagactgaagacgagttgagagtgcggcatctcgaggaggaaaataggggcatcgtggtgttggggatcaatagagcctacggaaagaacagtcttagcaagaaccttatcaaaatgctgtccaaggcagtggatgccctaaaatcagacaaaaaagtcaggaccatcatcatccggtcagaggtcccgggaatcttctgcgctgctaacctgcctgtcccgaccatcgccgcaatcgacggcctggccctgggaggaggcctggagctcgccctggcttgcgatatcagggtggccgcatcaagtgctaaaatgggcttagtggagacaaagcttgccataattccaggaggcggaggtacacagcgtctcccacgggcaatcgggatgagcctggcgaaagagctgatcttttccgcgagagtattggacggcaaagaggctaaagcggtaggcctgatctcccacgtgctggagcagaatcaggagggcgacgctgcttatcgcaaggcactggatctggccagggaatttcttcctcaggggcctgtagccatgcgggtagctaagcttgccatcaatcagggcatggaagtggatttggtaacaggcctcgcaatagaggaggcatgctacgcccagactatcccaactaaagacagactggagggactacttgctttcaaggagaaacgcccaccgcgatataagggtgaatag

SEQ ID NO: 215517 - DNA, 1020 bp, Artificial Sequence
  Description of Artificial Sequence: Synthetic coding sequence
atggctgccgcagttgctgcggcaccaggcgcacttggatctcttcatgcagggggagccagattggttgccgcttgcagcgcctggttgtgtcctggccttcgattgcctggctctttagctggaagaagagccggaccagccatatgggctcagggctgggtgcccgcagcaggaggcccagcgcctaaacgaggttactcttcggagatgaagacagaagacgagctgagagttcgccaccttgaagaggagaacaggggaatagtggtcctgggcattaacagggcctatggaaagaacagtctctctaagaacctgattaagatgctctcaaaggcagttgacgccctcaaaagcgacaagaaggttagaaccattataattagaagcgaggtgcccggtatattctgcgccggagcagacttgaaggagcgggctaagatgagcagctctgaagtgggcccttttgtgtccaaaatcagagcagttatcaacgatattgcaaacctgcccgtgcccacaattgcagccattgatggtctggccctaggaggcggactggagctagctcttgcctgcgacatccgagtggctgcctcctctgcgaagatgggtctcgttgaaacgaaacttgcgattattccaggaggtggtggtacacagcgattgccgagagcgatcgggatgagtctcgcaaaagaactgatcttctctgcccgtgttctagatggcaaggaggccaaagccgtgggactgatatcccacgtcctggaacaaaatcaggagggtgatgctgcatataggaaagctctcgatttagctagagagtttttgccacaaggccctgttgccatgagagtggctaagcttgccattaatcaggggatggaagtggacctggtgacaggattggccattgaggaagcctgttatgcccagaccatccccacgaaagaccggctggagggcctgctagcttttaaagaaaagcgccctcctcgttataagggtgagtag

SEQ ID NO: 215518 - DNA, 768 bp, Artificial Sequence
  Description of Artificial Sequence: Synthetic coding sequence
atggccgcagccgtggctgcggctcccggtgctctcgggtcactgcacgcaggaggcgcacgcctcgtcgctgcctgttctgcctggctctgccccggactgagacttcctggtagccttgccggtaggcgggcagggcctgcgatctgggctcaggggtgggtgcctgccgctggcggtcctgcaccaaaaagaggatattccagcgagatgaagaccgaagatgagctgcgagtgcggcacttagaagaggaaaacagagggatcgtagtcctcggcatcaatagggcttatgggaagaacagcttaagcaagaatctaatcaagatgctgtccaaggctgttgatgctcttaagtcagacaagaaagtgcggacaattataatccgatcagaggtgccaggaattttctgtgccggagccgacttaaaagagcgtgccaagatgtcttcctccgaggtgggtccttttgtgtctaagattagagcagttataaacgacatcgccaatctccctgttcccacaatcgcagccatcgacggactagccctgggaggcggtctcgagctcgccctggcctgcgacatccgtgtggccgcaagcagcgccaagatgggcctggtggaaaccaaactggcaattatccccggaggggtgacatcaagcacggaggtgctgaacccctctaagagctccatgaaaatagggattattatcttccaaacacccgtgaacatcgacatcctggcttcttcacacgagtcatag

SEQ ID NO: 215519 - DNA, 1932 bp, Artificial Sequence
  Description of Artificial Sequence: Synthetic coding sequence
atgcccctgctttttctggaacggtttccttggccgtctctgcgcacgtataccggtctctctggactggctctgctgggtacaataatttccgcgtaccgtgctttgtcacagcccgaggccggacccggtgaaccagatcagctgaccgcgagtcttcagcccgaacctccagcacctgcccgtccaagtgccggaggaccgagagcccgagacgtagcacaatatctgcttagcgactcactttttgtctgggtcctggtgaacactgcctgctgtgtactgatgcttgtggccaagctgatacagtgtattgtttttgggccactgcgggtgagcgagaggcagcatttgaaagataagttctggaatttcatcttttacaaatttatattcatctttggtgttttgaatgtgcagaccgtcgaggaagtagtgatgtggtgcttatggtttgccggactggtcttcctgcatctgatggttcagttgtgtaaagatcgctttgaatacctctcatttagccctactacacctatgagctctcatgggagagtgctcagcttgctggtggccatgttattgtcttgctgcgggcttgctgccgtgtgttccatcacgggctatactcatggcatgcacacccttgccttcatggcagcagagagtctcctggtgacagtgcggacagctcatgtaatcctgcggtatgtgattcacctgtgggatctaaaccacgaagggacttgggaaggtaagggcacgtatgtctattacacagattttgtcatggaattaacactcctctcgctggatttgatgcaccatatccacatgctgttatttggcaacatttggctctctatggcctcgctggtgatattcatgcagctgagatatctgtttcatgaggtgcagcggcgtatcagaagacataagaattacctgcgggtggtaggtaacatggaagcccgattcgcagtggcaacacctgaagagcttgcggtcaacaatgatgactgtgctatctgttgggacagtatgcaagccgcaagaaagctcccttgcggtcacctcttccacaactcttgcctgcggagctggttggaacaggacacatcgtgtccaacctgcaggatgagcttgaacatcgccgacaacaatcgggtgagagaagaacaccagggggagaacctggatgagaacctcgtgcccgttgctgcggctgaggggcgaccaagactgaaccagcacaatcacttctttcacttcgatggttctcggatcgcaagctggcttccttccttttccgttgaagtgatgcatacaacaaatatactcggtatcacacaggctagcaatagccagttgaatgctatggcccatcaaattcaagaaatgttccctcaggtgccctaccatctcgtccttcaggatctacagctgacacggtctgtcgaaattacaacggacaatatcctggagggaagaattcaggtccccttcccaactcaacggtcagactcaatcagaccggctctcaatagccccgtggagcggccaagctctgatcaggaagagggcgagacatccgcgcagaccgagcgggtgcctctagatctttctccaaggctggaagaaactctggacttcggcgaagtggaggttgaaccctctgaagtggaggacttcgaagcacgaggtagcagattctccaagagcgccgatgaacgtcagcgaatgttggtgcaaagaaaagatgaacttctgcagcaggccagaaaacggtttctgaataagtcttctgaggacgatgctgcgagcgaatcatttcttcccagcgaaggggcttccagcgaccccgtcacattgagaagacgtatgctggccgctgccgctgagaggcggctccagaagcagcagacgtcctag

SEQ ID NO: 215520 - DNA, 954 bp, Artificial Sequence
  Description of Artificial Sequence: Synthetic coding sequence
atgcgcgactcagcctgttggcagcgaaaggacgagctgcttcagcaggcgaggaagagattcttgaacaaatcctctgaagacgacgctgcctccgaatccttccttccctcagaaggcgcttcatcagacccggttaccctgagacgcagaatgctcgcagccaggaatggtggctttcggtcttccaggccaccctcggccccacttccatcttcagcggcttcttgcgcattgtgcccaacggactggcgccgtccggtgcccatcccactccacggtaaggctggtctgacggcgctgcccctgtataaggcttgcgggcttatcgtatttggacagctgatcaacctgatactcctgtgtaacaccttttatgtcaccttcctctttcccctggagacacttcagatcctcaccgttggtatgatttcatccggtgtagattggaccgcttgggggggtggtagatccggcggaagtgaggttgcctgtctacagcaggcagcaagtaccccagcaagctgtgtgcgcccaaccaacgccggagtactgagcacaactccatccggcaagtcggtgggcgaggcgcactccgtcagccctccacctcggaggggcgtgaccagcgtcatcaagctcctgtcactcctgtggaagcacgtcgattgtgccagaaggcccaccgggagttgcacgccccaacagggtatactggagaaggagctcctggtgcgctatcttgaacagagaagaggcaaatcgagggccatcgggtgtgacgaggtgaccccattttgccccacaacttcaggaacagactttccaagtctccaaagcaaagcaggccttataagtgtaaattccggagcgcctgctagccatgaatgtgccccatgggtgccctcccccctgagcatatccctgtctaggctggacctgggaagcgggtag

SEQ ID NO: 215521 - DNA, 1638 bp, Artificial Sequence
  Description of Artificial Sequence: Synthetic coding sequence
atggcaaccgatgccgcattgagacggctcttgcggctgcacaggacagagattgccgtggccgtagactccgcgtttcctctgctccacgctcttgcagaccatgacgtggtacctgaagacaagttccaggagactctccatctaaaggagaaggagggctgccctcaagccttccacgctttactgagttggcttctcactcaagattccaccgctattctggatttctggcgagtcctattcaaggattataacctcgagcgctatggcagactgcaacccatcttagactcctttccaaaggatgtcgacctgagccaaccaaggaagggccgtaaaccgcctgccgtgcccaaggcactggtccccccacctcgtttgccaaccaagagaaaggcaagcgaggaagccagagccgctgccccagcagctctgaccccccgtggcaccgcgagtccaggatctcagctgaaagctaaacctccaaagaagcctgagtctagcgctgagcagcagcgactgccccttgggaacggtatacagacaatgagcgccagtgtgcagcgagcggtagctatgtctagtggtgacgtgccaggggcacgaggcgctgtggaaggtatcctgattcagcaggtcttcgagtcagggggtagcaaaaagtgcatccaagtggggggtgagttctatacacccagcaagttcgaggactccggttccggcaagaacaaagcacgatcttcttcgggaccaaagcccctggtgcgagccaaaggagctcaaggcgctgcaccaggcggtggggaagcaaggctggggcagcagggctccgtcccagcccctctggcactgccatcggaccctcagctccaccagaagaacgaagacgagtgcgcagtgtgccgcgatggaggagagctgatctgttgcgatggctgtccacgggcatttcatctggcctgcctgagccccccattgcgtgaaattcccagcgggacttggcggtgttcctcttgtctgcaggctacggtacaagaggtccagccaagggctgaagagccacggccacaggagccacctgtggaaacccccctcccccctgggctaaggtctgctggtgaagaggttcgcggtcctccgggtgagcccttggctggtatggacaccaccttagtgtataaacacctccctgctcccccaagcgccgcacctcttcctgggctggatagctctgcgctgcacccattgctgtgcgttggccctgaggggcaacagaacctcgctcccggagccagatgtggagtgtgcggggacggtactgacgtgctccggtgcacccactgtgccgcagcctttcattggcgctgccacttcccagctggcacgagcagaccgggaaccggccttaggtgtaggtcttgctctggggatgtcacccctgcccctgtagaaggcgtcctggccccatcccccgctaggctggcacctgggcctgccaaagacgatactgctagtcacgagccagctctgcaccgggacgacttagagagtctgctgtctgaacacacttttgatggcatcctgcagtgggctatccaatccatggccagacccgcagctccattcccatcctag

SEQ ID NO: 215522 - DNA, 735 bp, Artificial Sequence
  Description of Artificial Sequence: Synthetic coding sequence
atgtggttggtatattcttccggtgcccctggcacacagcagcctgctcggaaccgcgtcttttttcctatcggtatggctcccggtggtgtgtgttggcggcctgatggctggggtactggcggtcaaggcagaattagcggtcctgggagcatgggagctggccagcgcctggggtcctctggcacacagcgatgctgctggggcagttgctttggcaaagaggtggccctgagacgggttctgcatccctcacccaagaatgaagacgagtgtgccgtctgcagagatggcggagaattgatctgctgcgacggctgccccagggctttccacttagcttgtctgtctccacccttgcgcgagattccatcaggcacttggcgatgcagttcttgcctgcaagcaaccgtccaggaggtgcagccaagggctgaggaacctcgaccccaggagccacctgtagaaactcccttaccccctggcctaagatctgccggagaggaacccagatgccagggttggactccccgtccatgtactccatactgcgtgtgggtgctgcgcgtatcacggacctggttgctggtaagggttgccggttgtgccgagatggtgcggacttgctgcggagtgttaaccgctcccttgccaagcacgggagcagcgacctcccagccggctccacccggtcctggaagagcttgcgccgctgatcccgctcaggaaacctag

SEQ ID NO: 215523 - DNA, 1047 bp, Artificial Sequence
  Description of Artificial Sequence: Synthetic coding sequence
atgtggctggtatattcttcgggggcaccgggtactcagcagccagccaggaaccgggtgtttttccccatcggtatggccccaggcggagtctgttggagacctgacggctggggcactgggggacagggccgtatctcagggcctggctccatgggagccggacaaaggctcggaagcagcggcacccagcggtgctgttgggggagctgctttgggaaagaggtggccctgcgcagggtactccatcctagcccagtgtgcatgggggtatcttgcctatgtcagaagaatgaagatgagtgtgctgtgtgccgcgacggcggtgagctgatctgctgcgatgggtgcccaagagcatttcatctggcctgtctttctcccccactacgggaaatcccctcaggcacctggcggtgctcctcctgccttcaggcaaccgtgcaggaggtacagccccgagcggaggagccacggccacaggaaccccctgtcgagaccccactccctcctggattacgcagtgcgggagaagaagttaggggacctcccggtgagccgctggcgggaatggatacaactctcgtctacaagcatcttcctgcccctccatctgccgcaccgttgcctggcctggacagttccgccctgcaccctttgctctgcgtgggacccgaggggcagcagaacttagccccaggcgctcgttgtggagtgtgcggggacggtacagatgtgttgaggtgcacacactgtgctgcggcattccattggaggtgccattttcccgctggaacttctcgcccaggcaccgggctgaggtgcaggagctgtagtggcgatgtgactcctgcccctgttgagggtgtgctggccccttcacctgccaggcttgcgccaggcccagcaaaagacgataccgccagccacgaacctgccctccaccgagacgacttagaatcccttctatctgagcacaccttcgacggaattcttcaatgggccatccaaagcatggcacggccagcagccccttttccttcctag

SEQ ID NO: 215524 - DNA, 1017 bp, Artificial Sequence
  Description of Artificial Sequence: Synthetic coding sequence
atgtggctggtttatagcagtggcgctcctggcactcagcagccagcccgtaatcgagtgtttttccctattgggatggcccctggaggggtgtgctggagaccagatggatgggggacaggtgggcagggaaggataagcggaccgggttctatgggcgctggacagcgcctcgggtcttcaggtactcagcggtgctgttgggggagttgcttcggcaaagaggtcgcacttcggagggtactccacccttctccaaagaatgaagacgagtgtgccgtctgccgtgacggcggagaacttatctgctgtgatgggtgtcccagagcttttcatctcgcctgcctgtctcctcctttacgcgaaattccaagcggcacatggcgatgtagcagctgtctgcaggctactgtacaggaggtgcagccaagggccgaagaacctcgaccacaggaacccccagtagaaactccgctcccacctgggttacggtcagctggagaggaagttcgtggccctcctggagagccactggccggaatggataccactttggtttacaaacatctgcccgctcctccaagcgccgctcctctacccggactggatagttccgccctgcaccctctattgtgcgtcggacctgaaggccaacagaaccttgcacccggagccaggtgtggcgtatgcggcgacggaaccgatgttctccgctgcacacattgtgcagccgcttttcactggagatgccacttccctgcaggtacttctcggccaggaacaggactaaggtgccggtcctgttctggagatgtcactcccgctcccgttgaaggcgtgctggcccctagccctgccagacttgcacctggacccgcaaaggacgatacagcatcacacgaacccgcactccacagggacgatcttgaaagtctgctaagcgaacataccttcgatggaattctgcagtgggcaatacaatcaatggcacgacctgcagctcctttcccctcctag

SEQ ID NO: 215525 - DNA, 1047 bp, Artificial Sequence
  Description of Artificial Sequence: Synthetic coding sequence
atgtggctcgtttactcctccggcgcaccgggtacgcagcagccagcaaggaaccgggttttcttccctattggtatggcccctggtggagtgtgctggagacccgatggctggggcacagggggtcaagggcgaatcagcggacctggctccatgggcgctgggcagcgcctgggatcttcggggacacaaagatgttgctgggggtcctgtttcgggaaggaagtggcactcagacgcgtgcttcaccctagtccagtttgtatgggagtttcttgtctgtgtcagaagaacgaggacgagtgtgctgtctgtagagacggaggcgaactgatatgttgtgacggatgccctcgggcatttcatctcgcttgcttaagcccgccacttcgggagatcccctccggcacatggcgctgtagctcctgcctccaggctaccgtgcaagaggtccagcccagagccgaggagccccgtccacaagaaccacccgtggagactccactgccccctgggctgcggtctgccggtgaggaagtgcggggacctccaggagaacctcttgcgggtatggacactaccctggtgtataagcatctgcctgcaccccctagtgctgctccactcccgggtttggactctagcgccctacaccctctcctgtgcgtcgggcctgaggggcagcagaacctcgcaccaggagccaggtgcggtgtttgtggagatggtacagacgtgctgagatgtacacactgcgccgctgcatttcattggagatgccacttcccagccggtacctcccggccaggcacaggcttacggtgtcggtcctgctcgggcgatgtgaccccagctcctgtcgagggcgtgctagcgccatctccagccaggctggcacccggacccgcaaaggacgacaccgcctcacacgagccagccctccatagagacgatctcgagtctctgctcagcgaacatacctttgatggtatccttcagtgggctatccaaagtatggcgaggcccgctgcgccttttccatcctag

SEQ ID NO: 215526 - DNA, 3717 bp, Artificial Sequence
  Description of Artificial Sequence: Synthetic coding sequence
atgaaggtggtgcctgagaagaacgccgttcggatcttgtggggccgtgaaaggggggcacgggcaatgggggcacagcgcctgcttcaggagctcgttgaagacaaaactcgttggatgaagtgggagggaaagagagtcgagttacctgactctccaagatccactttcctgcttgcgttttctcccgacaggacgctgcttgcgtctacccatgtgaaccacaatatctatatcaccgaagttaagaccggcaagtgtgtgcactccttaattggccaccggagaaccccatggtgtgtgaccttccatccaacgatctcaggcctgattgccagcgggtgtctggacggagaggtgcgaatctgggacctccacggtggaagtgaatcttggtttaccgatagcaacaacgccatagctagtttagctttccatcccaccgctcagctcttgctgattgcaaccgcaaatgagattcatttctgggactggagccgaagagagcctttcgccgtcgtaaagacagcgagcgaaatggagcgcgtgcgcctggtgcgtttcgacccactgggtcattatctgctaacagccattgtgaacccctccaatcagcaaggtgacgacgagccagagatccccatcgacggcactgagctgagccactacaggcaacgggctctgctgcagagccagccagtacggaggacaccgctactccataattttctgcatatgctgtcctcacgcagttcaggtatccaggtcggcgagcagtccactgtccaggactcggcaacccccagcccccctcctccgcctcctcagcccagtaccgaaaggcctcgtaccagtgcttatattagacttaggcaacgtgtgtcgtatcctactgcggaatgctgtcagcacctgggtattttatgtctgtgttcccggtgttccggcactcgggttccctctttactaccccaccaggattcggtcccgcctgcctccgcgcgagccacgactccttctttttccttcgtgcagacagaaccctttcacccccctgagcaggcctcgtcgacccagcaggatcagggattgctgaacagaccgtccgccttcagtacagtacagtcatcaacagcgggaaacactctgcgcaaccttagcttgggcccaaccaggagatctctggggggaccactgagcagtcatccttctcggtaccaccgcgaaatcgctccgggtttgacaggatcagagtggactaggacggttttatccctgaacagtagatccgaggcagaaagtatgcctccaccaaggacatccgcatccagcgtctctctgctgagtgttcttaggcagcaagaaggcggttctcaggcgagcgtgtatactagcgcaaccgagggacggggattccccgcaagcggactcgcaaccgagtcagacggcggaaatggatcttcgcagaataactccggcagtatccgtcatgaactccagtgtgaccttagacgctttttccttgagtatgaccgcctgcaggagctcgatcagtcactctcgggagaggcgcctcagacccagcaggcacaggagatgctgaacaataatatcgagagtgaacggccaggaccctcacaccagccaactccccatagctcagagaataatagtaacctgagccggggtcatttaaatcgctgtagggcttgtcataatcttttgacttttaacaatgatactctccgttgggagcgaaccacaccaaattatagcagcggtgaggcctcatcttcctggcaggtccccagcagtttcgaaagcgtgccatcctccggatctcagctcccccctcttgaacggactgagggccaaactccttcatcaagcagattggagctgagtagctcagcctccccccaggaggagaggaccgttggcgtggcctttaatcaggaaaccggccactgggagaggatatacacccaatcgagtcgaagtgggactgtgagtcaagaagccttgcaccaagatatgcccgaggagagcagtgaagaggactcgctccgaaggaggttgttagagagttcactgatctcactgtcaaggtatgacggagcaggtagtcgggagcatcccatttacccggaccctgcacgcgacaatggcgataggtcccgtcatagggctccacgtaacgcgcgaatgtcagctccttcgctgggtcgctttgttcctaggcgctttcttcttcctgaatacctgccttacgccggaatatttcatgaacgaggacagcctggtctcgctacccactcctcagtaaatcgggtgctggccggtgccgtcatcggagacggccagtctgctgtggccagtaacatagctaacaccacctatagactgcagtggtgggacttcacaaaatttgatctgccagaaatcagcaatgccagcgtgaatgtgctggtgcaaaactgcaagatctacaacgatgctagttgtgacatatctgcggatggtcagctcctcgcagcatttattcccagctcccagagaggcttcccggatgagggcatcctggcagtgtactccttggctcctcacaatcttggggaaatgctgtatacaaagcggttcgggccaaacgccattagtgtctcgcttagcccaatggggagatacgttatggttggcctcgcctcgcggcgaatacttctccacccttccacggagcatatggtggctcaggtctttcgcctgcagcaggcgcatgggggagagacctcaatgcgacgggtgtttaacgttttataccctatgccagccgatcagaggagacacgtatcgatcaatagtgcccgttggctgcctgagcctggactaggtctcgcctatggtacaaataagggcgatctggtgatatgtcggccagaggcgctcaactccggcgtagaatactactgggaccagctaaacgagaccgtgttcacggtgcactcgaattctcggtcatctgaaagacccggaacctcgcgggctacgtggcgcaccgatcgggacatgggcctgatgaacgccatcggcctacagcccagaaatccagccacctcggtgaccagtcaggggacccaaactcttgccctgcaactacaaaacgctgaaacccaaactgaaagggaagtgccggagcctggcacggcggctagcggtccgggagagggagaaggatcagagtacggtgcctcaggcgaagacgcactgtcacggatacaacgattgatggctgagggtgggatgaccgctgtggtgcaacgggaacaaagcaccacaatggcttctatgggaggctttggaaacaacatcatcgtctcccaccgcattcaccgaagcagccagactgggacagagccaggagctgcacatacatcaagcccacagccctccacaagccgcggactgcttcccgaagccggacaactggctgaaaggggtctgagcccacgaactgcatcttgggaccagcccggaacgcccggtagagagcctactcagcctaccctcccatcaagctcccccgttcccattcccgtaagtttgccatccgccgaaggaccaactctgcactgtgagcttacaaacaacaaccacctcctggatggtgggtcttcccgcggagatgccgctggacccagaggcgagcccaggaatcgttag

SEQ ID NO: 215527 - DNA, 2169 bp, Artificial Sequence
  Description of Artificial Sequence: Synthetic coding sequence
atgaaggtagtgccagaaaagaatgccgttaggatactgtggggcagagaacgcggtgctagggctatgggggcacagaggctgctacaggaactggttgaggataaaacccggtggatgaaatgggagggaaagcgagtggaacttccagattcacccagaagtaccttcctgttagccttctctcctgaccgcaccctactagccagcacacacgttaaccataatatttacatcaccgaggtaaagacaggtaagtgcgtccacagcttgataggccaccgacgtaccccgtggtgtgtaacctttcacccaactatttccggcctgattgcctcagggtgcctggacggagaggtccgcatttgggatttgcatggagggtctgagagctggttcacagactccaacaatgccattgcttcgctcgccttccaccctactgctcagctcctgctgatcgccactgccaacgagatacatttctgggactggtccagaagggagccttttgccgtagtgaagactgcctcagaaatggagagggtgcgactagtcagatttgatcctcttggccactacctcttaacagcaatcgtcaatccctctaatcagcaaggggatgacgagcctgaaatccccatcgatggtactgagctgtcccattaccggcagcgggctcttcttcagagtcagcccgtacggagaacccccttgctgcacaactttctacacatgttgtcatctcgaagttccggcattcagaccgaacccttccatccaccagagcaggcttcaagtacccagcaagaccaggggctgctaaatcgtccgtcagccttttccacggtgcaaagcagtactgcaggaaacacactccgaaacctgagcctgggacccactcgacgctcccttggcggaccgttgagttcacatccgagccgctaccaccgcgagatagccccagggctcacgggatcagaatggacccggaccgtactcagccttaattctcgctcagaggcggagagcatgccccctccgagaacaagcgcatcttctgtgagtctcttaagcgtgctgcggcagcaggagggaggctcccaggccagcgtttacacatcggccacagaaggaagggggttccctgctagcgggctggcgaccgaaagtgatgggggaaacggttcatcacagaacaattctggtagtattagacacgagcttcagtgtgacttgcggaggttcttcctggaatatgaccgactgcaagaacttgatcagtcactgagtggagaagctcctcaaacccaacaagcgcaggaaatgctgaacaataatattgagtcagaacgcccaggtcctagtcaccagcctaccccccactcctccgagaataacagtaatttgagtcggggacacctcaacaggtgtcgagcctgccacaacctactgacatttaacaacgatacactgcggtgggagcgcacaacacccaactatagcagtggggaagcatccagttcctggcaggttccaagcagcttcgaatctgtgccctcttctgggtctcagttgcctcctttggagagaaccgaaggacagaccccctccagctctcggctcgaactaagctcttcagctagtccgcaggaggagcggacagtgggagtggcctttaatcaagaaaccggtcattgggagcgtatctacacccaaagttcaagaagcggtacggtatcccaagaggccctgcaccaggacatgcccgaggagtcttctgaagaggactctctccggcgacgtagtttagcccttagtcccaggttagagtattcaggagccatcttggcccactgcaaactgcgcctgccaggcagctgccactcaccagcctctgccagccaggtcgcaggcacaaccggagctcatcaccatgctaggctaatatttgcgtttcttgtggagatggaatttcatcacgtgtcccaagcgggactagagttgctgacgagcggagacttgcctaccagtgcctcacagagcgctggaatcactggtgtgagccatcgcgcttggccaaggctattagagtccagcctcattagcttgtctcggtacgacggcgctgggtcccgggagcacccaatttatcctgaccctgcctag

SEQ ID NO: 215528 - DNA, 3627 bp, Artificial Sequence
  Description of Artificial Sequence: Synthetic coding sequence
atgaaggtggtgcccgagaaaaacgcggtacgtatactctggggcagagagaggggggctagggctatgggcgctcaaaggttgcttcaagaactagtggaagataaaacacgctggatgaaatgggaaggcaaaagagtggaactccccgacagccccagaagcactttcctgctggcatttagtccagaccgcaccctgctcgcaagcacgcatgtgaaccacaatatatacatcactgaggtgaaaacagggaagtgcgtccactccctcattgggcatagacggacgccctggtgcgtgacattccaccctacaatcagcggtctcatagcttccggctgtctggatggagaggtgaggatttgggatctccacgggggaagcgaatcatggttcacagattccaacaatgcaatcgccagtctagcatttcaccctactgctcagttattgctcatagcaacagcaaatgaaatccacttttgggactggtcacgccgagagccattcgcggtggttaagaccgcttctgagatggagagggtcaggctcgtgagattcgacccactgggtcactatttactgaccgctatcgtgaacccctctaaccagcagggggacgatgagcctgaaatccctattgatggcactgagctgtcccactatagacagagggccctgcttcaatcccagcccgtacgcaggaccccattactgcacaattttcttcatatgctctcctctcgctccagcggaattcagaccgagccgttccaccccccagagcaagcctcttccacccaacaagaccaaggtctcctgaaccgcccatccgccttctccacagtccagtctagcactgccggtaatacattacgtaatctctctttaggtccaactaggcgctcactgggcggtcctctgtcctcacatccatctcgctatcaccgtgagattgctccaggccttaccggaagcgagtggacacgtacagttctttctttaaacagtcgatctgaagccgagtccatgccaccccctagaactagtgccagctctgtttctttactgagcgtgcttagacaacaggaggggggaagccaggcctccgtctataccagcgccacagagggcagagggttcccagcaagcggcctagctaccgagtcagatggagggaatggcagctcccaaaacaatagtggaagcatcaggcacgaattgcagtgcgatctccgacggtttttccttgagtacgacagactgcaagagctcgaccagtccctgtctggcgaagcaccccagacacagcaagctcaagagatgctgaataataacatagaatcggaaaggcccggacctagccaccaacccactccccactcatccgaaaataactcaaatttgtcacggggacacttgaaccggtgccgcgcttgccataacctgttgacctttaacaacgataccctgaggtgggagcgtactacgccaaactatagctcgggcgaagcatcctcctcttggcaggtacccagtagctttgaaagcgttccgtcatcagggagtcaactgcctccgctcgagcggacagaaggacagacacccagttccagccggctcgaactgagctcttccgcttccccacaggaggagcgcactgtgggagtggcctttaaccaagagaccggtcactgggagcgcatatatacacagagcagccggagcggtacagtgagtcaggaagcgctgcaccaggatatgcctgaagagtcatcagaggaggatagtttacgtagacggctgctggagagttcactgatttctctcagccggtacgacggcgcaggctctcgggagcacccaatctatcccgacccagctaggctctcacccgcagcctattacgcccagagaatgattcaatatttgtcccggagagattccatcagacagagaagcatgcgctaccaacagaatcggttgcgtagtagtacctcgtcaagtagctcagacaatcaagggccatctgtggagggaacggatttagaatttgaagactttgaagataacggtgatcggagccgccaccgcgctcccagaaacgcaagaatgagcgcaccttcactgggaaggtttgtacccaggagatttttgttgcctgaatatctcccatacgctggtatctttcatgaacgaggacagccaggattggccacgcactcctcagtgaatagagtcctcgcaggcgcagtcatcggcgatggtcagagcgccgtggcgtcaaacatagctaataccacataccggcttcaatggtgggactttacaaaatttgacctccctgaaatcagcaacgcctccgtcaacgtgctggttcagaattgtaagatttacaacgatgcaagctgtgacatctctgcagacggacaactcttagccgcttttattccaagctcgcagcggggatttccagacgagggaatccttgctgtgtactcactggcgccacacaatctgggagagatgctttatactaaacggttcggcccaaacgccatctctgtatctctgagccctatgggacgttacgtcatggtcggacttgcgtcccgtcgtattctgctgcacccctccactgagcatatggttgcacaggtatttaggttgcagcaggcccacgggggagagacctctatgagacgcgtgtttaacgtcctctacccgatgccagccgaccagcgtcgtcacgttagcataaactcggcacgctggctgcccgaacctggcttggggctggcctatggcactaataagggcgacctggtcatctgtcggccagaggccctgaatagtggcgttgagtactattgggatcagttgaacgaaacagtttttaccgttcattctaattcacgtagttcagagaggccaggcactagcagggccacctggcgaacagaccgcgacatggggttgatgaatgccataggtcttcagccaaggaaccccgctacctctgtgacgtcccagggcacacaaactcttgcgttacagctgcaaaacgctgagacgcaaacagagcgggaagtgccggaacctggaactgccgcttctggccctggcgagggggaggggtcagaatatggggcaagcggtgaagatgccctctcacgaatccagcgcctaatggctgaaggaggaatgactgcggtggtccagagagaacagagcactacgatggcatccatggggggatttggtaacaatattattgttagccacagaatccaccgctccagccaaactggcactgaaccaggggctgcgcatactagcagtccacagccgtcgacttctaggggccttctgccagaggccggacagctggctgaacgcggattgagtccccgtacggcttcatgggaccagcccggaacgcccggtagagaacccacccagccaacgctgcctagtagcagccctgttcctatacccgtcagtctgcccagcgctgagggccctactctgcattgcgagttaactaataataaccacctattagacggcggatcgtcaaggggcgacgccgctggtccccgaggcgaacccagaaatcgctag

SEQ ID NO: 215529 - DNA, 3810 bp, Artificial Sequence
  Description of Artificial Sequence: Synthetic coding sequence
atgaaggttgtgccagagaagaatgccgtaagaattctttgggggagggagcggggagctcgggctatgggggctcagaggctccttcaagagctggtggaggataaaacaagatggatgaagtgggagggcaagcgtgtagaactcccggacagccctcgctcaacatttttgctggcattctcacccgatcgcacgctgcttgcaagcacccatgtcaatcataacatttacatcaccgaagttaaaacaggtaaatgcgtgcatagcctcataggccatcgacgaacaccttggtgcgtgaccttccatcctactatcagcggcctcattgcatctggttgcttggacggagaggtgcgtatctgggatctgcatggcggttcagagtcttggttcacggattctaataatgcaatcgcaagcctcgccttccaccctacagcccagctgctgctcattgcaacagccaacgagattcacttctgggactggagcagaagagagccctttgccgttgttaagactgcaagcgagatggaaagggtgaggttggttcgtttcgacccccttggccactacttgcttaccgctatcgtcaacccttccaatcagcagggtgacgacgagcctgaaatccccatcgacggtactgagttaagccactatcgtcaacgagctctcctccaatctcagccagtgaggagaacacccttgctgcataactttctgcacatgctcagcagccgcagctctggcatacaagtaggggagcagagcaccgttcaagactccgctacgccatctccccctcctccccctccccaaccgtccacggagcgaccacgaacgtccgcgtacatccggctcaggcaacgggtctcatatcccaccgctgagtgttgccaacacttgggcattctatgcctgtgctcgcggtgtagcggtacgcgggttccctctctgttgccgcatcaggactcggtgcctcctgcctctgcccgagccaccacgccttctttttcttttgtgcagaccgagccattccacccccctgaacaggcctcctctactcaacaggaccagggattacttaataggccatcagcttttagtacagtgcaatcgtccaccgccggtaatacccttcgtaatttaagccttggacccactcggagatctcttggcggaccgctgagctcacacccttcccggtaccaccgggaaatcgcacctggcctgacagggtctgagtggactagaacagtgctgtccctaaattcccgctccgaggccgaaagtatgcctccaccccgtacttccgcttctagcgtgagccttctaagcgttctcagacagcaggaaggagggagtcaggcatctgtgtatacaagtgcaacggagggacgaggatttcccgctagtggtctcgcaactgagtccgatggtggcaacggctccagccagaacaattcaggttccatcagacatgagctacagtgtgatctccggagattcttcctagaatatgataggctgcaggaactggatcagagtctctccggtgaagcaccccagacccagcaggcacaggagatgctgaacaacaacatcgaatctgaacggcctggaccctcacaccagcctactccacattctagcgaaaacaattcgaatctttcaaggggacatctgaatcgctgtagggcttgccataatttattgactttcaataacgataccctgcgctgggagagaaccaccccaaattactcaagtggcgaggcaagctcatcttggcaggtgccttcatctttcgagtcagtgccttcatccggatctcagctgccaccactcgagcgcactgagggtcaaacacctagttcttccagacttgagttgtcctcctccgccagtccccaggaagagcgaacggtgggcgtggccttcaaccaggagacaggacactgggaacggatctacacacagagcagcagatcagggactgtgtctcaggaggccctgcatcaggacatgccagaagagagctccgaggaggactccctgagaagactttcacccgctgcctactatgcacagagaatgatccagtatctgtctcgcagggatagcattcgacagagaagcatgcggtatcagcagaatagactgagatcatcaaccagctcctccagctccgacaaccaaggcccaagcgtcgaggggaccgatctcgagtttgaggacttcgaggacaacggcgatagatctcgccaccgggctccccgaaacgcgcgaatgtcagctccctctctggggcgatttgtccccagaaggttcctgctcccagagtacctgccatacgccggaatcttccacgaacgcggacagcctgggttggccacacactccagcgtcaaccgggtgctcgctggtgccgtgatcggcgatgggcagagcgcagtggcaagcaacatcgcaaataccacttaccgcttacaatggtgggactttaccaaattcgacctgcccgagattagtaatgcttcagtcaatgttctagtgcagaactgtaagatttacaatgatgcctcctgcgacatctccgcggacggccagctcctggccgctttcattccttcttctcagcgcggatttcctgatgaaggcatactggctgtatacagcctggctcctcataaccttggcgagatgctgtatactaagagattcggccctaacgcaatctcagtaagcctgagccccatgggtcgctacgtgatggtgggcttggctagtcgcagaatcctgctgcatccctccaccgaacatatggtcgcgcaggtgtttagactgcagcaggcacatggcggtgaaacctccatgcgtcgcgtctttaatgtcttgtaccctatgcccgcagatcagcgcagacatgtaagcattaactctgcaaggtggcttccagaacccggactgggactagcttacggcaccaacaagggcgacctcgtgatatgtagacccgaggctcttaatagcggcgtggaatattattgggatcagctcaacgagaccgtttttaccgtgcacagtaattctcgtagctccgagagaccagggacaagcagggcaacgtggcgaaccgacagagacatgggacttatgaacgccatcggcctccagcccaggaatccggcaacatcagtgacttcacagggtacacaaactttggcccttcagctacagaatgctgagacccaaaccgagcgcgaggtccccgagccagggactgcggcaagcgggccaggagagggggagggcagcgagtatggcgcttctggggaagatgcactcagtcggattcagaggttaatggctgaggggggtatgacggctgtggtgcagagagagcagtctaccacaatggcctcaatgggaggcttcggtaacaatatcatcgtctcccaccggattcacaggtcatctcaaaccggcaccgagcccggtgccgctcatacctcctctccacagccctcaacctctcgagggctactccctgaggccggacaactggccgagcgcggtctaagtccccgtactgcctcttgggaccaacccggaacccctggacgagagccgactcagccaactctgccttcctccagcccagtacccatccctgtgagcctgccctccgccgagggtcccaccctgcattgtgagttgaccaacaataatcaccttctggacggtggctcaagcagaggggatgccgctgggcctcggggagaaccgagaaatcgatag

SEQ ID NO: 215530 - DNA, 3897 bp, Artificial Sequence
  Description of Artificial Sequence: Synthetic coding sequence
atgaaggtagtgccagaaaagaacgcggtccgcatattgtggggtagagagcggggagcacgtgccatgggagctcagcgtctcttgcaggagctagtagaagataaaacccgatggatgaaatgggaggggaagagggttgagctgcctgacagcccaaggagcacttttttgctggccttcagccccgaccgtacgctgcttgccagcacacatgtgaatcacaatatttatataacagaagtgaagacgggcaagtgcgtgcactcactgattggacataggagaaccccctggtgcgtgaccttccaccctaccatttcaggattgatcgccagcggatgccttgatggtgaggttcgaatatgggacttgcacggtggctccgagtcctggtttactgactctaacaacgctatcgctagtctggcctttcacccaaccgcacagctccttcttatcgccactgcgaacgaaatacacttctgggactggagcaggcgcgaaccatttgccgtggttaaaactgcctcagagatggagagagtgagactggtgcgatttgatccactggggcactatttgctgacagcaatcgttaatcccagtaaccaacagggcgatgacgaacctgaaatccccatcgatggcactgaactctcccactacagacaaagggcacttctacagagtcagccagtgcgccgtactccgctcctgcacaatttcctgcacatgttaagcagtcgctcctccggaatccaggttggagagcagtcaaccgttcaggatagcgccacgccttccccccctccacctcctccacagccctccactgaacgacctaggacgagcgcctacattagactgagacaacgcgtgtcatatccgacggctgagtgctgtcagcatttaggtatattgtgtctgtgtagtcgatgcagcggtacccgggtgcccagcttacttcctcaccaggatagtgtaccccctgcgtcagcaagggctacaactccctcattctcatttgtgcagaccgaaccatttcatccgccagaacaagccagtagcacccagcaggaccaaggcttacttaaccgaccgtccgccttctccacagttcagtccagtaccgcaggcaacaccctgagaaatttatctcttggacccacacgcaggagcctgggagggccattgtcctctcacccttccaggtaccaccgcgagattgcacctggcctaacagggtctgagtggacgcgtaccgtcttgtcattgaatagtcggagtgaagccgagtcaatgcctccacctcgcacatccgcctcctctgtcagcttactttcagtcctacggcagcaggaggggggatcacaggcgtcagtctatacttccgcaacagagggaaggggctttcccgcaagcggcctggccactgagtccgatggcggaaatggaagctcccaaaataatagcggcagcatccgacacgagctgcaatgcgacctgaggagattcttcctcgagtacgaccgcttgcaggaactggatcagagcctgtccggggaggctccacagacccagcaggcccaggagatgttgaataacaacatagagagtgagaggcctgggccttctcaccagcccacaccacacagttctgaaaacaactcaaacctctctcggggtcacctgaacagatgcagggcctgccataacctcctgaccttcaataatgacacactgcgttgggagagaacaacccccaactactcaagcggagaggcatcctcaagctggcaggtgccaagcagtttcgagtcagtaccctcaagtggcagtcagctgccaccgctcgagcgaacagaaggccagaccccctcttcgagccgactagagctgtcctcctcagcctcaccccaggaggagcggaccgtgggggtagcgtttaatcaggaaactggccactgggagcggatctatacccagtcaagtaggagcggcactgtaagtcaggaagccttacaccaagacatgccagaggaaagcagtgaagaagatagcctgcggaggagactactggaaagctctttgattagcctttcgcgctatgatggagctgggtcaagagaacacccaatttatcccgatccggcacgcttaagccccgctgcttattacgcacagcgaatgatccagtatctgtctaggagagactccatacggcagcgcagtatgcggtaccagcagaataggctgaggtcctctacctcttcctcttcatctgataaccaaggcccatctgtggagggaacggatctagagtttgaagactttgaggataacggcgaccgctcccgccacagggcccctcgcaatgcgaggatgagtgctccatccctgggcaggttcgtgcccaggcggttcttgctcccagagtatctcccttacgccggtattttccatgagcggggacagcctggtctggcaacgcatagtagcgtaaacagagtactggcaggcgctgtaataggagatgggcaatcagccgtggcttctaatattgccaacacaacctacaggctgcagtggtgggacttcacgaaattcgatctgcctgagatctcgaacgcaagcgtcaacgtgctggtacaaaactgtaaaatatataacgacgcgtcatgcgatatcagcgcagatggccagctgttagcagcttttatccctagttcacagcggggatttccggatgagggcatcctcgcagtctacagtctggcgccacacaatctcggcgagatgttgtacacaaagcgcttcggacccaatgctattagcgtgagcctcagccctatgggaaggtacgtgatggtggggcttgccagccgacgtatcctcctgcacccaagcacggagcatatggtggcccaggtgtttaggctacaacaggcccacgggggagagacctctatgaggcgcgtgtttaacgtattatatccaatgccagccgatcagcgcagacacgttagcatcaactccgcccgatggctacctgagcccggactcggattggcctatggcaccaataagggggacctcgtcatctgcagaccagaggccttgaactcaggagtggagtattactgggatcaactgaatgagacggtgtttactgtgcactctaactccagaagttctgaaagaccaggaacatcccgagccacctggcggaccgatagagacatgggtctgatgaatgctatcggactccagcctagaaaccctgccacctccgttacaagccagggcacccagacactggcgctccagctccagaacgcggaaacacaaaccgaacgcgaagtgcccgaacctggcacggccgcttcaggtcccggtgaaggtgaaggatctgaatatggagcttcgggggaagacgccctgtcccgaattcagcgactaatggccgaaggcggaatgacagctgtcgtgcagcgagagcagtctaccacaatggctagtatggggggatttgggaataacattatcgtgtctcatcgcatccatagatcatcccaaacaggcactgagccgggagctgcccacacatcatccccacagccctcaacctcccggggtctgcttccagaagccggtcagttggctgagcggggactttctccccgtactgcctcatgggatcagcctgggacccctggcagggaacctacacaacccaccctgccctctagcagccctgtgcccatccccgtatctctgccctccgctgagggcccaacccttcactgtgagctgaccaacaataaccacttgctggacgggggttcatcgcggggagatgccgctggcccacgtggcgagcccagaaatcgttag

SEQ ID NO: 215531 - DNA, 75 bp, Artificial Sequence
  Description of Artificial Sequence: Synthetic coding sequence
atgaaggttgttcctgagaaaaatgccgtccggattctctggggtagggagcgcggtgcaagggccatggggtag

SEQ ID NO: 215532 - DNA, 3810 bp, Artificial Sequence
  Description of Artificial Sequence: Synthetic coding sequence
atgaaggtggtgcccgaaaaaaacgcagtaagaatcttgtggggccgtgagcgaggtgctcgggctatgggagcccagcggctcctccaagagctggttgaagataagactaggtggatgaagtgggaaggcaagcgcgtcgaattacccgattctccaagatctaccttcctgttggccttcagccccgaccgtacgttgttggctagtacccatgtcaaccacaatatctatatcactgaagtcaagacaggcaagtgtgttcactctctgattgggcacaggaggacaccatggtgtgtgacattccatcctactattagtggactgattgccagcggttgtttagacggggaagtgcgcatatgggatctccacggtgggtccgagtcgtggttcaccgattccaacaatgctattgcatccctcgctttccacccaaccgcccaactcttgctgatcgctactgccaacgaaattcatttttgggactggtctaggcgggagccctttgcagtggtaaaaactgcgagcgaaatggaaagagtacgcctggttcggtttgatcctttaggacactatttactaaccgccatagtcaatccctctaatcaacagggtgatgatgaacctgagatccccatcgacggaaccgagctgtcacactaccgtcagagagccctgttgcagtctcagcctgtgcgcagaacacccctccttcacaatttcctgcatatgttatctagccgctcatccggaatccaagtgggggagcagtccacagtccaagacagtgccaccccttctcctcccccaccaccaccgcagccctccacagaacgaccccgaacttccgcatatattaggttgcgacagcgtgtgtcatatcccactgccgagtgctgtcaacacctaggcatcctgtgtctgtgttctcggtgtagcggaaccagggtacccagcctgcttcctcaccaggatagcgttcccccagccagcgccagagccacgaccccttccttttctttcgtgcaaacagagccgttccaccccccagaacaagcgtcttccactcagcaggaccagggactgcttaatcgtccatcagcttttagcacggtacagtccagcacagcaggcaacacactgcgcaacctttctctcggacccactagaagaagtctgggaggccctctgagctctcatccaagccgttaccaccgcgagattgctccgggactgaccgggagcgaatggacccggacggtgttgtcgctgaatagtaggagtgaagccgagtccatgccgcctccacgaacctctgcaagcagcgtgtcactactgtctgtgctgaggcaacaggaaggcggatctcaagcctctgtgtatacttctgccactgagggacgtggtttccccgcaagtggtcttgccactgagtccgacggcggaaacggcagctcccagaacaatagcggatctattcggcacgaactgcagtgtgacttacgcagattcttcctggagtacgaccgactacaggagctcgaccagagtctgagcggcgaagctccacagactcagcaggcacaagaaatgctgaataacaatatcgaatctgagcggcctggcccatcacatcagccgacccctcactccagcgagaataactccaacctgtcaagaggccatctgaaccgctgccgcgcttgccacaacctgttgaccttcaacaacgatacactgcggtgggaaaggaccactcctaattactctagcggagaggcctctagctcctggcaagtgccctcttcatttgagtctgttccaagcagcgggagccagctgcccccactggagcgaacagaaggtcaaactccctcgtcgagcagactggagctctcgtcttcagcctcccctcaggaggaacggacagtcggtgtggccttcaatcaggagaccgggcactgggagcgaatatatactcagtcctcgcgctctgggacggtgtcacaggaggccctccatcaagatatgcctgaggagagcagcgaagaggacagcctaaggaggctgagccctgcagcgtactatgcacagcggatgatccagtatctctctagacgggacagcatacgacaacggtccatgaggtatcagcagaaccggcttcggtcctccacctcatcaagctcaagtgataaccaggggccaagcgtggaggggacagacttggagtttgaagactttgaagacaacggcgataggagccgccaccgggcaccacggaacgcacgcatgagcgccccttcattggggcgttttgtgcccagacgttttttgctgccggagtacctgccatacgccggaatttttcatgagcgcggacaacccggactcgctacacactctagcgtgaatagagtcctggcaggggctgtgattggggatggacagtccgccgttgctagcaacattgccaacaccacatatcggctccagtggtgggacttcactaagttcgacctccccgagatttcgaacgcctcagtgaacgtcctggtgcagaactgcaagatctacaacgacgcctcatgtgacatcagtgcagacggccagcttctggccgctttcatcccgtcgagccagcggggattccccgatgagggaatcctagccgtgtatagcctcgccccacataatctcggggaaatgctctatactaagcgctttgggccaaatgccatcagcgtctctctgagccccatgggcagatatgttatggtcggcctagcctctcgtcgaatcctcctgcacccatctacggagcatatggttgcccaggtctttcgcctgcaacaagcccatggcggagagacctccatgcggagggtcttcaacgtgctgtaccccatgcccgctgatcagcgcaggcacgtgtccattaactctgcgagatggttgccggaacccggactgggcttggcatatggaacaaacaaaggggacctggtaatctgccggcctgaggctctgaactccggcgtcgaatactactgggaccaactgaatgaaacagtgtttacagttcacagtaattcccgctccagtgaacggccagggaccagtagggctacctggagaacagaccgggatatgggactgatgaatgcaatcggtctgcagccacggaatcccgctacctctgtcacatcgcaggggacacagaccctcgcactgcagttacaaaacgcagaaactcagacagaacgcgaagttccagagccaggaaccgctgcaagcggcccaggcgaaggtgagggcagtgagtacggagcatcaggggaagacgccctgtctcggatacaacgtctgatggcggagggtggcatgactgctgtggttcagagggagcaaagtactactatggccagtatgggagggtttggtaataatatcattgtttctcaccggatccataggtcaagccagacaggtacggaacccggagccgcacacacctccagtccacaaccctcaacctctcggggtctactgcccgaggcgggacagcttgcagaacgcggactgtcgcctcggactgctagttgggatcagccaggtacccccggtagggagcctacccagcctacattaccttcttcaagccctgtccccatacccgtgtcacttcctagcgccgagggacctacattgcactgcgagttaacaaataataaccatttgctcgacgggggatcttctcgcggagacgctgccggaccgcgtggagagccaagaaacaggtag

SEQ ID NO: 215533 - DNA, 3717 bp, Artificial Sequence
  Description of Artificial Sequence: Synthetic coding sequence
atgaaggttgtccccgagaagaatgcagtgcgcatcctctggggaagggagcgcggagcacgggcaatgggggctcaaaggctcctacaggaattagtcgaagacaaaacacggtggatgaaatgggaagggaagcgagtggagctgccggatagtccacgctccactttcctgctcgcattttcccctgatcggacactgctcgccagtactcacgtgaaccataacatctatattacggaagtgaaaacgggaaagtgcgttcacagtctaatcggtcaccgtagaaccccctggtgcgtcacattccacccaacgatctctgggctaatcgccagcggctgcttggacggagaggttagaatttgggacctccatggaggcagtgagtcatggttcacagacagcaacaatgcgatagccagtctagctttccatccgaccgcccagttgctgcttatcgctaccgcaaacgagatacatttttgggattggtctcggagggaaccgttcgctgtggtgaagactgcttccgaaatggagcgagtccggctagtgcggttcgaccccttaggtcactatctgcttactgccatagtaaatccaagcaatcagcaaggggacgacgaacctgagataccaatcgacgggaccgagctctcccactatagacagcgagccctgctccagtcacaacccgtacgccgaacgccactactccataactttcttcacatgcttagtagtagatctagcggaatccaggtgggcgagcagtccaccgttcaggatagtgcgactccctcgccgcctccgcctccaccacagcccagcaccgagagaccccgtactagcgcatatataagattgcgtcagcgggtgagctaccccaccgccgaatgctgccaacacctgggcatcctgtgtttatgcagtcggtgcagcggcactcgcgtgcccagtttactcccgcaccaggacagtgttcctccagcatccgccagagcaacaaccccttctttcagtttcgtccagaccgaacccttccatccccctgaacaggctagcagtacacaacaggaccagggacttcttaaccggccaagcgctttctctacagtccagagttccactgctgggaacactcttcgcaatctgtccctcggtcccacccgaagatctctcggtggacccctctcttcccacccatctaggtaccaccgcgaaattgctccaggcctcaccggatctgagtggactcgaaccgtcctctccttaaacagcagatctgaagcagaatctatgcctcccccacgaacctccgcctctagtgtctcactgctttccgtgttgaggcagcaggagggcggtagccaggctagtgtgtatacctctgcaacagagggcagaggatttccagccagtggtctggctacggaatcagatgggggaaatggatcgagccaaaacaactctggcagtatccggcatgagctgcaatgcgacctgcgcaggtttttcctggagtacgataggctccaagaactggaccagtctctctcaggcgaagcacctcagacacagcaggctcaggagatgttgaacaacaacatcgagtctgagcgtcccggacccagtcaccagcctacaccccactcctccgaaaataacagtaacctgtcacgcggacacctgaatcgttgtcgcgcttgccataacctcctaaccttcaacaacgacactctgagatgggagcggaccactccgaactactccagcggagaagcgtccagttcctggcaggtgccctctagctttgaatccgtccctagttccggtagtcagctgccgcctcttgagcgcacggagggtcaaacgccctcctcgagcaggctggaactgtcatctagcgcttccccccaggaggaacgaacagtaggcgtcgcgttcaaccaggagacgggccattgggaaaggatttatacccagagtagtcggtcgggaaccgtgagccaagaggcccttcaccaggatatgcccgaggaaagtagtgaagaagatagccttaggaggaggctgctggagtccagtctcatctccctctcacgctacgacggggctggatctagagaacatccaatttaccccgaccctgccagggacaacggcgatcgctcgagacatcgggcaccgaggaatgcgaggatgtctgccccatcgctgggcaggttcgtgcctcggaggtttctgttacccgagtatctgccgtatgccggtatcttccacgaaagggggcaacccggtttggcaactcacagttccgtcaaccgggtgctggcaggagccgtgatcggggatgggcagtctgccgtggctagcaatattgccaacaccacttatcgactgcaatggtgggattttacaaagtttgatctgcccgaaatcagcaatgcaagtgtgaacgtgcttgtgcagaattgcaagatctataatgatgcatcgtgtgacatctccgccgacggtcagttgcttgccgcttttattccatcctctcagcgcggattcccggacgaaggcatactggccgtttattccttggcacctcataacctgggcgagatgctctacacaaaaaggttcgggcctaatgccatttcggttagcctttcacctatgggacggtacgttatggttggcctggctagcaggcgcatcctcttgcaccctagcactgagcacatggtcgcacaggtcttccgattacagcaggctcatggaggcgagacttccatgagaagagtgtttaacgtgctgtaccctatgccggctgaccagaggagacacgtctccatcaactcagccagatggctgcccgagcccggtctcggcttagcatatggcactaataagggggatcttgtgatttgtcggccagaagctctcaactccggtgtcgagtactattgggatcaactgaacgagactgtttttactgttcactcaaacagccgtagttctgaacgcccaggaacttcccgggcaacctggagaactgacagggatatggggctgatgaacgctattggcttgcagccccgaaaccctgctacgtcggtgacctctcaggggacccagacgctcgctcttcagctgcagaatgcagagactcagaccgagagagaggtgcccgaacccggaactgccgcttcaggacctggtgagggtgaaggctccgaatatggtgccagcggcgaggacgccttgtcccgtatccagcgactgatggctgaggggggaatgactgctgtcgttcagcgtgagcagtctactaccatggcatccatgggcggattcgggaacaatattattgtgtcccataggattcacaggagcagccagactgggactgaacccggagccgcacatacttcctctccccagccttcaacgagccgaggactgctgcccgaggcaggccagctagccgagcggggtctgtcccctagaaccgcctcctgggaccaacccggaactcccggtagagaaccgacacaaccaaccttgccctcatctagtcccgttcccatccccgtttctttacccagcgccgaggggcctaccttgcactgcgaactgaccaataataatcacttgttagatggcggtagcagcaggggcgacgctgctggcccaagaggcgagcctcgtaatcgatag

SEQ ID NO: 215534 - DNA, 3540 bp, Artificial Sequence
  Description of Artificial Sequence: Synthetic coding sequence
atgaaagtcgtaccagaaaagaatgcggtgcgcattctgtggggacgggagagaggagctagggcaatgggcgcacagagacttcttcaggagctcgtggaggacaagacaaggtggatgaagtgggaggggaaacgcgtggaactacctgattcacccaggtccacattccttctggctttttccccggataggactctcctggcaagcacgcacgttaatcacaacatctacattactgaagtaaagacgggcaaatgcgtacactctctcattggacatcgaaggactccttggtgcgtgacctttcatccgacaatttctggactgatcgccagtggatgtctggacggcgaagtgcgcatctgggatctgcacggtggcagtgagtcctggttcactgactcaaataatgcaatagcatccctggcttttcacccgactgctcagttgttgttgatagccaccgctaacgaaattcacttttgggactggtctcgtcgggagccatttgcagtggtcaagacagcctctgaaatggagagagttcgacttgtgagatttgatccactcggacattacctgttgacagcaattgtgaacccatctaaccagcagggtgatgatgagcctgagatcccaatagacggaaccgagctgtctcattataggcagcgtgctttgcttcagtcccagcccgtccgacgtacacctctccttcataacttcttgcatatgctctccagcaggagctccgggattcaaacggagccattccacccgccagagcaggcatccagcacccaacaggatcaggggctcctgaacaggccatctgcattcagtacagttcaaagctcgaccgcgggaaatactctgcgcaacttaagtctggggcctacccggaggagcctcgggggacccctctcttctcatccttcacggtatcatcgggagattgcccctggccttaccgggtccgagtggacaaggacagtcctctctctcaacagtcgttccgaggccgagagcatgccccctcctagaacttcagctagcagtgtttcgctgctatcagttctcaggcagcaggaaggtgggtctcaggcctctgtgtatacatccgcaactgaaggcaggggatttccagctagcggcttagccacagaatcagacggaggcaacggcagcagccagaataactcgggtagcatccggcatgaattgcaatgcgacctcaggagattctttttggagtacgacagactccaggaacttgatcagagtttgagcggagaagctccgcaaacccagcaggcacaggagatgttaaataataacatcgagtcagaaaggccaggaccttcccatcaacctaccccccatagctcggagaacaactcaaatttgtctcggggacacttgaaccggtgcagggcatgccataatctcctcacatttaataatgacacgctgcgctgggaaagaactactcccaactactcctccggagaagcatcatcctcatggcaagtgcccagttctttcgaatcagtaccttcatcgggctcccagctccccccactggagagaacggaagggcaaacaccaagcagttctcgcctggagctgtccagctcggcctctccacaggaggaaaggacggtcggggtggctttcaatcaggagacgggccattgggaacgcatttacacccagagctctcgcagcggcactgtgtcacaagaagcactgcatcaggacatgccggaggaatcgtcagaggaagacagccttagaaggttgtcccccgcagcgtattatgcacaaagaatgattcaatatttatcccgccgtgattccatacggcagcggtcaatgcgctaccaacagaatagattacggtccagcacgtcctcttccagcagcgacaaccagggtccttccgtcgaggggactgaccttgagtttgaagacttcgaagataatggcgatcgaagccgacaccgggcaccccgaaacgctcgaatgtcagccccatcactagggaggtttgtccccaggcgcttcctgcttccagaatatctaccttatgccggaatcttccacgaacgaggccagccaggcctggccacacacagtagcgtgaatagggtgctggctggtgcagtcataggtgatgggcagtcagcagtcgcatcgaatatcgccaacactacatatcggcttcagtggtgggacttcacaaaatttgatctgcccgaaatttcgaacgctagcgtgaacgttttggttcaaaattgtaagatctataatgatgcctcctgtgatatttctgccgatggtcaactgctcgctgcctttattccctctagtcagcggggtttccccgacgaaggaattctcgcagtgtactcacttgcgccacataacctgggtgagatgctgtacactaaaaggttcggcccaaatgcaatttccgtcagcctctctcctatgggacgatatgtgatggtagggctcgcctcgcgccgaattcttctccatccaagcacagagcatatggtcgcgcaagtatttagactgcagcaggcgcacggaggcgagacttccatgcggcgagtctttaatgttctctatcctatgcctgccgaccaacgcagacatgtcagcatcaacagcgccagatggttacctgaaccgggtctcgggttggcctacggaaccaataagggggacctcgtgatttgtcgtccagaggccttaaatagcggggtagagtactactgggatcaactgaacgagacagtctttacagttcatagcaatagccgctcgtccgagcgcccaggaactagtagagccacctggcggacagatcgagatatggggttgatgaacgccattggactgcagccccgaaatccagccacctccgtcacttcgcaaggaacacagacactcgccttgcagttgcagaatgccgagacccagacagagcgtgaggtccccgaacctggcaccgccgcttcaggtccgggtgagggtgaggggagtgaatatggagcttctggagaggacgcactgagcagaatccaaagacttatggcggagggcggtatgacagccgtggtgcagcgtgagcagtccactaccatggcatcaatgggcggtttcggtaacaacatcattgtgagccatcgaatccacaggtcctctcagaccggtactgaacctggtgcggctcacacgtcctccccccagccctctacctcgagggggttactcccagaggccggacagctggcagaaaggggactgtctccaagaaccgcctcttgggatcagcctggaacccccggtcgcgagccaacacagcctactctacccagttcaagcccagtgcctatccccgtatctctgcccagcgccgaaggacctacattacactgtgagctgaccaacaataatcacctcctggacgggggatctagcagaggggatgccgcagggccaagaggagagcccaggaatcgttag

SEQ ID NO: 215535 - DNA, 1947 bp, Artificial Sequence
  Description of Artificial Sequence: Synthetic coding sequence
atggaaaaggcgcgacggggtggagatggtgtcccccgtggacccgtgctgcacatcgtagtggttggtttccatcacaaaaagggttgccaggtggaattctcctaccccccattgatccccggagatggacacgactctcatacgctgcccgaagaatggaaatacctccctttccttgccctccccgacggtgcgcacaactatcaggaggatacagttttttttcatctgccacccagaaatggaaatggggctacagtctttggcatctcctgctacagacagatcgaagcaaaggcactgaaagtaaggcaggcggatattacccgtgagacagtccagaagtccgtgtgtgtgctgtcgaagctccctctgtacgggctgctgcaggcaaaacttcagctgatcacacacgcatactttgaggagaaggatttcagccaaatttcaatcctgaaagaactatatgagcacatgaactctagtcttggaggggcatctctggaagggagccaggtctatctaggcctgagtccgcgagacttggtgctgcacttccgtcacaaggtcttgatcctgtttaaactgatattactagagaagaaagtattattctatatttcccccgtgaataagttggtgggcgcactcatgaccgtactttccctgtttccaggcatgatagagcatggtctatccgattgctcccagtataggcccagaaagagtatgagtgaagacggcggtctgcaagagtctaacccttgtgcagatgactttgtatctgcatcgacagctgacgttagccatacaaatctaggcacaatcaggaaagtgatggcgggaaaccatggcgaggacgccgcaatgaagacagaagaaccactgttccaagtggaggactcctcaaaaggacaggaacctaacgatactaatcagtacctgaagccccctagtcggccatcccccgactcttctgagtccgattgggaaaccctggaccctagtgtgctcgaggaccctaaccttaaggagagggaacaactcggctctgatcagaccaacctgttcccaaaggactccgtgccctctgaatccttgccaatcaccgtgcagcctcaagctaatacagggcaggtggtcctgatccctggcctcatcagcggactcgaggaggaccagtacggcatgcctctggcaatcttcactaagggctacttgtgcctcccctacatggcgctgcagcagcaccacttgctgtctgacgtgaccgtcaggggctttgtcgctggagcaaccaatattctcttccgacaacagaaacacctgagtgacgctatcgtagaagtcgaagaagccctgatacagattcatgaccccgagttgcgtaagttgcttaatcccaccacagcagatttacgatttgccgactacctggtacgccacgtgaccgaaaacagggatgacgtgtttctggacgggactggatgggaggggggtgacgagtggatacgggctcagttcgccgtctacatccacgcattgcttgccgcaacccttcaacttgataatgaaaagatcctgtccgactatggcactaccttcgtcacagcatggaagaacacccataattatcgcgtatggaacagcaacaaacacccagcgctggccgagattaaccccaatcacccatttcagggccaatacagcgtttccgatatgaagctgcgcttcagccatagcgtacaaaacagcgagcgtggtaagaagattggaaatgtgatggtaaccacctcccggaacgtggtgcagacagggaaggctgttggtcaatcagtgggtggtgctttctccagcgcgaaaaccgccatgtccagttggctgtcaaccttcacaacatccacctctcaatccctgaccgaacccccagacgagaaaccctag

SEQ ID NO: 215536 - DNA, 1773 bp, Artificial Sequence
  Description of Artificial Sequence: Synthetic coding sequence
atggagaaggctagacgtggaggcgacggagtgcccaggggacctgtgctgcacatagtagttgtgggatttcaccacaaaaaggggtgccaggtggaattctcatacccacccttaattcccggagatgggcacgattcccatacacttcccgaagaatggaaatatctaccctttcttgcactgccagacggagctcataattaccaggaggacacggtgttctttcatcttcccccaaggaacggcaacggcgcaaccgtgttcgggatttcctgttatcgtcagatcgaggccaaggcgctgaaagtgcgacaggccgatataaccagagagacagtacaaaaatcggtttgtgtcctatctaagcttcctctgtacggattgctgcaggccaagctacagttaattacacacgcatactttgaggagaaggacttctcacagatatccatcttgaaggaactatatgaacacatgaacagctctctagggggtgcctctctcgagggcagtcaggtttacctggggctgtcgcccagggacctggttctgcatttcagacacaaggtcctgatcttatttaaactgatcctgctggagaagaaagtgcttttctatatcagccccgtgaacaagctggttggcgctttgatgacagtcttatccctgtttccagggatgattgagcacggcttatctgactgcagtcagtacaggcccagaaagagcatgtcagaggacggtggacttcaagagtccaatccctgcgctgatgacttcgtgagcgcttcgacagcggatgtgagccatacgaatctgggaaccattaggaaagtgatggccggaaatcacggtgaggacgccgctatgaagactgaggagccgctctttcaagttgaggattcgagtaaaggacaggaacctaacgacaccaaccagtaccttaaacctcctagccggccttctccggacagcagcgagtctgattgggagacgctggacccatccgttctggaagatccaaaccttaaagaacgtgaacagcttggatcagaccagacaaacctgttcccaaaggatagcgtgccctccgaaagtctcccgatcacagtccagccccaggccaatacaggacaggtggtgttgatccccggattgatttcagggcttgaagaggaccagtatggtatgccacttgctatttttaccaaaggttacctgtgcctgccatacatggcccttcaacagcaccatctgctttctgatgtaactgtaaggggattcgtcgcgggagcgactaatattctgttcaggcagcagaagcatttaagcgatgcaatagtggaagtggaagaggccctgattcagatccatgatcctgaactacggaagctcttgaatccgactaccgccgatctacgctttgctgattacctggttagacacgtaactgagaatcgagatgatgtgtttttggacggaactggctgggaaggcggtgacgagtggatccgggcacaattcgcagtttatatccacgcgctgctggcggctacactgcagctcgttttgttcagaatcgttaatgtgaagaaaattggaaacgtcatggtcacaaccagccgaaatgtggtccagactgggaaggccgtgggccagagtgtaggtggagccttctcaagcgccaagaccgcaatgagcagttggctttccacttttacgacctctactagtcagtctctaaccgagcccccagatgaaaaaccctag

SEQ ID NO: 215537 - DNA, 1392 bp, Artificial Sequence
  Description of Artificial Sequence: Synthetic coding sequence
atggaaaaagccaggaggggcggagatggcgttccgagagggccagtgctccatatagttgtggtcggctttcatcataagaaggggtgccaggtggagttctcataccccccactgatccctggggatggccacgattcccacacccttcctgaagagtggaaatatctgcctttcctggcactgcctgatggggcacacaactatcaggaggataccgtgttttttcatttgccgcctcgtaacggcaatggcgcaacagtcttcgggatcagctgttaccgccagatcgaggccaaggccctgaaggtcagacaggccgacatcaccagggagactgttcaaaagagtgtgtgtgtgctgtcaaagttgccactttacggcttgctccaggccaaattgcagcttatcacccacgcctacttcgaggaaaaagattttagccaaatctccattctgaaagaactctatgagcacatgaattcctctttaggcggtgcctctctggaaggcagccaggtgtacctgggcctgtcccctcgcgacctggtgctgcactttcggcacaaagtcctgatcttatttaagctgattttgttagagaaaaaggtgctcttctacatttccccagtgaacaagctggtgggcgcacttatgaccgttctgagcctttttccagggatgatcgagcacgggctctccgactgttcccagtatcgccctaggaagagcatgagcgaagatggaggcttacaggaaagcaacccctgtgccgacgattttgtgagtgccagcactgccgacgtttcacacaccaatctcgggaccatcaggaaggtcatggcaggtaaccacggagaagatgccgctatgaagaccgaggaacctctcttccaggtcgaggattcaagtaaaggacaggaacctaacgacactaaccagtacctgaaacccccaagcaggccatcacctgatagctccgagagcgattgggagactctggacccctcagtgctcgaagacccaaatttgaaagagagggagcaattgggctccgatcaaaccaatctgtttcccaaggacagcgtcccttccgagtccttgccaattaccgtacagcctcaggccaacacaggccaggtagtgcttatcccgggactgatttccggactcgaggaagatcagtacggcatgcccctggcaatcttcacaaagtgcacacaggatgttctgccacaggccaatcattccttcaaattcctcatcacagacagacggatcacgcccagaccactcaggcgacgcctggtcagcgccactctcacaaatatgctgcaggagaagtcgtgttggaagaagcatatcaaatgtcgcagaagagtccagaaatag

SEQ ID NO: 215538 - DNA, 2532 bp, Artificial Sequence
  Description of Artificial Sequence: Synthetic coding sequence
atgagtagtgcgatgttggtgacctgtttacctgacccaagctcctcctttagagaggacgctccaaggcctcccgtgccaggcgaggagggcgaaaccccaccttgccaacctggtgtgggcaaggggcaagttacgaagcctatgcccgtgtctagcaatacgagaagaaatgaagatgggttgggtgaaccggagggcagagccagccccgattcgccactgacacgctggaccaaatcactgcacagcttactcggagatcaagatggtgcttacctgtttagaacctttttggagagggaaaagtgcgtggacactctggatttttggttcgcatgcaacggtttcaggcagatgaacttgaaggacaccaagactctgcgagttgcaaaagctatctacaagaggtacatagaaaataactcgatcgtgtccaagcagctgaagcctgccaccaaaacatatatcagggatggcatcaagaagcaacagatcgattcgattatgtttgaccaggcgcagacagagatacaaagtgttatggaggaaaatgcctaccaaatgtttttgacctcagacatttaccttgagtacgtccgaagcggaggggagaacacagcctacatgagtaacgggggactaggtagcctgaaagtggtgtgtgggtacctgcctacccttaatgaggaagaggagtggacctgcgcagactttaagtgtaagctgtcaccgactgtcgtgggcttgagcagcaaaactcttagggcaaccgcctccgtgcggagtaccgaaaccgtcgactctgggtatcggtcttttaaacgatcagaccccgtgaacccttaccatatcggttccgggtacgtgttcgccccagccacgtccgctaatgattccgaaatctcctctgatgccctgacggatgatagcatgtccatgaccgattcaagcgtcgatgggataccgccatatagagtcggtagcaaaaagcagctgcagcgagaaatgcatcgatctgtgaaggcaaatgggcaagtgtctctcccgcactttccgaggacccacaggcttcctaaggaaatgacacccgtggagcctgcaacgttcgcagctgagttaatctctagattggaaaagcttaagttagagctggaatcgcgtcactccctggaggagcgtttacagcagataagggaagacgaagagcgcgaggggtctgaactgaccttgaattcccgcgaaggtgccccaacacagcatcccttgtccttgcttccctctgggtcatacgaggaggatccccagaccattctcgatgaccatctctctagagtgctgaaaactcctggctgtcagagtccaggcgtcgggcgttattcaccacgatcacggtctcctgatcatcatcatcatcaccacagccagtaccacagtctcctgccacccggtggaaaactgcccccagccgctgcctctcccggtgcctgtcccctcctgggcggaaagggatttgtgacgaaacagaccacgaagcacgtccatcaccattacatacaccaccacgcagtccccaagacgaaagaggaaattgaagccgaagctacacaaagagtccattgtttctgcccaggtggctccgagtattactgttattccaagtgcaagagccatagcaaagccccagaaactatgccaagtgagcagtttggcggatctaggggctcaaccctccccaagaggaatggtaaaggaaccgagcctggcttagcactccccgcaagagagggcggagctcccggaggagccggtgcgctgcaattgccacgggaggagggcgacagatctcaggatgtgtggcagtggatgttggaatcagaacggcagagcaagccaaaacctcattccgcccaatcgaccaagaaggcgtaccccctcgagtcggcacggagtagtcctggagaacgagcatctaggcaccacctctgggggggaaactccggccaccccaggactacgccaagggcccacctcttcacacaggatcctgctatgcccccactcacaccacccaacacactcgcccaactcgaggaggcatgccgcaggctggcagaagtgtctaagccacctaagcagaggtgctgtgtcgcctctcagcaacgcgataggaatcatagcgctaccgtgcagacaggcgctaccccgttctctaacccaagcctggcacctgaagatcacaaagagccaaagaagctagctggcgttcatgccctgcaggctagtgagctggtcgtaacctatttcttttgcggagaggagataccataccggcgaatgctcaaggcgcagtccctcacactggggcactttaaagagcagctgtctaaaaagggaaactaccgttactattttaagaaggccagtgatgaatttgcctgtggggctgtcttcgaggaaatctgggaggatgaaactgtgctgccaatgtacgaaggccgaattctcggcaaggtcgagcgaatcgactag

SEQ ID NO: 215539 - DNA, 2337 bp, Artificial Sequence
  Description of Artificial Sequence: Synthetic coding sequence
atgtcatcagccatgctggtaacctgcctgccagatccttcctcctccttccgcgaggacgcccctagaccacctgtgcccggtgaagagggggagacccccccatgccagccaggcgtgggcaaaggacaggtgacgaagcccatgccagtgagttccaatacaaggagaaatgaagacggactgggcgagcccgaaggcagagcaagtccggactcacccctgacgcgctggaccaagtccttgcattctctgctcggcgatcaggatggcgcttatctgttcaggacttttctggagagggaaaagtgcgtagatacgctcgacttttggtttgcctgcaacggattccggcagatgaacttgaaagatacgaagaccctgagagtcgccaaagcaatctacaagagatatatagagaacaacagcatcgtgtccaaacagttaaagccagcgacaaaaacttatatcagagacgggatcaaaaaacaacagatcgacagtatcatgtttgatcaagcacaaactgagatccaaagtgttatggaggaaaatgcttaccagatgttccttacctctgatatctatcttgagtatgtgaggagtgggggagaaaacactgcctatatgtcgaacggcggactcggctcactgaaagtggtctgcggctatcttcccacactgaatgaggaggaagagtggacctgcgctgattttaagtgtaagctgtcacccactgttgtcggcctttcatcaaagacattgagagctaccgctagcgtaaggtctaccgaaactgtcgacagcggctaccgttcctttaagcgctctgaccccgtgaatccctaccacattggatcaggctacgtgttcgccccagcaacaagtgccaatgatagcgaaatttctagcgacgcgctgactgatgacagtatgtctatgacggatagctctgtagacggcattcctccttaccgggtcggaagtaaaaagcaattgcaacgggaaatgcataggtccgtcaaggctaacgggcaggtgagtctgccacattttccccgaacgcaccgactgcctaaggagatgacacccgtggagccggctacatttgctgctgaactgatcagccgtctggagaagctgaagctggaactagagagcagacactctttagaggaacgattgcagcagattcgggaagacgaggaacgggaaggcagtgagctgacacttaactctagggagggtgcacccacccagcatcccctctcactcttaccctccggaagctatgaggaggacccgcagactatattggatgaccacctgtcgcgcgtactcaaaacgcccggatgccaatctcctggggtgggtcgatactcccctagatctcggtctccagatcaccatcatcaccatcactcccagtatcattctctgttgccacccggtgggaaacttccgcctgctgcggcaagtcccggtgcatgccctctgctcggcggtaaaggtttcgtgactaaacagacaacaaagcatgtgcaccaccactacattcatcatcacgccgtgcctaagacaaaagaggaaattgaagccgaagcaacccagagagtgcactgcttctgtcccggaggatctgagtactactgctacagcaaatgcaagtcacactcaaaagcgccagaaactatgccaagcgagcaatttggcgctcagagtaccaaaaaggcctatcctctggagtcagctagatcatcccctggcgaacgagcttctaggcatcacctgtggggaggaaatagcggacatcccaggactacccctcgggctcatctgttcactcaggacccggctatgccacccctgaccccgccaaatactttagctcagctggaggaggcatgccggaggctggctgaggtgtcaaagcccccaaagcaacgatgctgcgttgcatcccaacaaagggaccggaaccattccgccacagttcagacaggcgctacacccttcagtaaccccagtctggccccagaggaccataaagagcctaagaaactggcaggggtgcatgctctgcaggcctctgagctggttgtgacatacttcttctgcggggaggagattccgtacaggcgtatgttaaaggcacagagcctcacgctgggccactttaaggagcagttgtcaaagaaaggtaattacaggtactacttcaaaaaagcttcagacgagtttgcatgcggagctgtttttgaggagatctgggaggacgaaacggtcctgccaatgtatgaaggacgaatcttgggaaaagtcgagcgaattgactag

SEQ ID NO: 215540 - DNA, 483 bp, Artificial Sequence
  Description of Artificial Sequence: Synthetic coding sequence
atgagctctgccatgctcgttacttgcctcccagacccttcaagctcttttagagaggacgcacccaggcccccagtaccgggagaggagggggagacccccccatgccaaccgggagtggggaaggggcaagtaactaagccaatgccggtgagctcaaatacacgtagaaatgaagacggtttgggcgagccggagggaagggcctcccccgactccccgctaacgcgctggacaaagagcctgcatagcctacttggcgatcaggacggggcatacctgttcagaacgtttctggaacgggagaagtgtgttgataccttggatttctggtttgcttgtaacggttttcgtcagatgaatctgaaggatacaaaaacactcagagttgtgaacgatttctgtcacgacattctcttctacctttattgcaaactgtgtattatcaaatcttctttcaaggaaaactatctggttcagtag

SEQ ID NO: 215541 - DNA, 921 bp, Artificial Sequence
  Description of Artificial Sequence: Synthetic coding sequence
atgtctgaggtgacacggagcctgttgcagcgctggggtgcgtccttccggagaggcgctgatttcgactcatggggccagctcgttgaagctattgacgaataccagatactggctcgacatcttcagaaggaagcccaggcccagcacaacaactcggagtttacagaggagcagaagaaaacaataggaaagattgccacgtgtctggagctgcggagcgccgctctgcaaagcacacaaagtcaggaggagtttaaactggaagaccttaaaaaactggagccaatattgaagaacattctgacctacaataaagaatttccctttgatgtacaacctgtgcccctgagacggattttagctcccggagaggaagagaacctggaattcgaagaggatgaagaggaagggggtgcgggagccggttctcctgattccttcccagccagggtcccgggaaccctcctgcccagattgccttcagagccgggaatgacactgttaactatccgaatagagaaaatcggcctaaaggacgccggacaatgtatcgatccttacatcacagttagtgtgaaggatttgaacggaattgatctcactcctgtgcaggacacccctgttgcaagcagaaaagaagacacttacgttcatttcaatgtggacattgaactgcagaaacacgtggaaaagctgactaaaggagcagccatttttttcgagtttaaacattacaaacctaagaagcgctttaccagcactaaatgcttcgccttcatggaaatggatgaaatcaagcccggaccaattgttatcgagctatacaagaagcctactgactttaaacgtaagaagttgcagctcctgaccaagaaacctttatatttgcatctgcaccagacattacataaggagtag

SEQ ID NO: 215542 - DNA, 675 bp, Artificial Sequence
  Description of Artificial Sequence: Synthetic coding sequence
atgtcggaggtgaccaggagtttactccaacggtggggcgcaagctttcggagaggtgccgattttgacagttggggtcagctggtggaggccatagatgagtaccagatcctggctcgtcacctacagaaagaagcgcaggctcagcacaacaactcagagtttaccgaggagcagaaaaagaccataggcaaaattgccacgtgtctggaactgcggtctgcggcattacagtcaacacagtcacaggaggagttcaagctggaggaccttaagaaacttgagccaatcttgaagaacattctcacctataataaggagttcccattcgacgtacagcccgtgccactgaggcggattttagcccctggcgaagaagagaatctggaattcgaagaagatgaggaagagggaggggcaggggctggaagcccagactcttttcccgcaagggtacctggcgctgccatattcttcgagttcaagcactataaaccaaaaaagcgtttcacttccacaaaatgttttgctttcatggaaatggatgagattaaacccggtccaatagtgatcgagctctacaagaagccaaccgacttcaaaagaaagaaactgcagttgctgactaagaaacccttatatttgcacctgcaccagactctgcacaaggaatag

SEQ ID NO: 215543 - DNA, 849 bp, Artificial Sequence
  Description of Artificial Sequence: Synthetic coding sequence
atgatcgctacagaagctgtagttcgcgcagcccagggcctggcgaggcacctgcagaaggaggcgcaggctcagcacaacaatagcgaattcaccgaagaacaaaagaagacaatcggcaagatcgcaacctgcctggagttgcgaagtgctgcactgcagtccacacaatcacaggaggaattcaaactggaggacctcaaaaaacttgagcccatcttaaagaatattttgacctacaataaagagtttccatttgatgtacaaccagtgcccttgagacggattctggctcccggagaagaggagaaccttgaattcgaagaagacgaggaagagggcggagcaggcgctggcagccccgatagcttccccgcaagagtccctggaaccttgctacctcgcttaccgtctgaacccggtatgactctgctgaccattcgtatcgaaaagatcggactaaaggatgctggccagtgcatcgacccttatatcacagtgtctgtcaaggacctgaatggaattgacttgacccctgtccaggacacccccgtggcctcgcggaaagaagatacatacgtgcactttaacgtggatatcgagctccagaaacacgtggagaaactgacaaagggggcagccatttttttcgagttcaaacactataagcctaaaaagagattcactagtactaaatgctttgcattcatggaaatggacgagatcaaacccggacctatcgtgatcgagctgtacaagaagccaactgatttcaagcggaagaaactgcagttactgacaaagaaacctctgtatctgcatctgcaccaaactctccataaagaatag

SEQ ID NO: 215544 - DNA, 2685 bp, Artificial Sequence
  Description of Artificial Sequence: Synthetic coding sequence
atggcctggcggtgccctcggatgggtcgcgtgccgttggcttggtgcctggccctctgcggatgggcgtgtatggcacctagaggaacacaggcagaagaatccccctttgtggggaacccgggaaatatcactggcgctcgtggtcttacggggaccctgcggtgtcaactgcaggtgcagggtgagcctcccgaggtccattggctgcgggatggccagatcctggagctcgccgacagcacgcagacacaggttccactgggcgaggacgaacaggatgattggatcgtggtgtctcaacttcgaattacttctttacagctgagcgacactggccagtaccagtgcttggtatttctcggacaccagacctttgtatcccagccgggatacgtgggcctcgagggccttccttacttccttgaagagcctgaggatcgcacagtggcagcaaacactcctttcaatctcagctgccaagcccagggccctcctgaaccagtggaccttctgtggctgcaggacgcagttcccctcgctactgcccctgggcacggccctcagcggtctttgcacgtgccaggcttgaataagacctcaagcttctcgtgtgaagctcacaatgccaagggcgtgacaaccagccgtacagccactataactgtattgccacagcagcccagaaatctgcatctggtgtctagacagcccaccgagctcgaagtggcttggaccccaggcctgtccggaatttaccccttgacacactgcacattgcaggccgtattatcaaatgacgggatgggtatccaggccggagaacccgaccccccagaagaacctttgacttcccaagcaagcgttccaccacaccaactgcgcctcggttccttgcatcctcatactccttaccacatcagagtggcttgtacttcttctcaggggccttcgagttggacccactggctgcccgttgaaactcctgagggtgtgccactgggacctcccgaaaacatctccgcaaccaggaacggctctcaggcttttgtgcactggcaggagcccagagcacccctgcagggaacattactgggctacaggctggcttatcaggggcaggacacgcctgaagtgctgatggacattggcttgagacaggaggtcaccctagagctgcaaggagatggcagtgtgtcaaaccttaccgtctgcgttgcggcatatacagccgcaggagatggcccttggagcctccctgtgcccttggaggcttggaggccgggacaggctcagcctgtgcaccagctcgtgaaagagccaagtacacccgcattcagctggccatggtggtacgttctactgggagcagtcgtcgccgcagcctgtgtactgatcttggcattgtttctggtgcacaggcgaaaaaaagaaactcggtatggcgaagtcttcgagccaaccgttgagcgcggtgagctggtcgtgcgctatcgcgttaggaaaagttattcacgcagaacgaccgaagcaacacttaactccctggggatcagcgaggagctaaaagaaaagctgcgtgatgtgatggtagatagacacaaagtcgccttggggaagaccctgggcgaaggggagtttggtgcagtgatggagggccagcttaatcaagacgacagcatcctcaaggttgcggtcaaaacaatgaagattgcgatttgtactagaagcgagttagaggattttctgtccgaggctgtttgtatgaaggaattcgaccaccccaacgttatgcggctcattggggtctgctttcagggctcagaaagggaatcgttcccagcaccagtggtaatcctaccgttcatgaagcacggcgatttacactcatttcttttgtattcacggctcggagatcagcccgtctatctgcccacccaaatgctcgttaagtttatggccgacattgcgtcaggaatggagtatctgagcacaaaacgctttattcaccgggatcttgctgcgaggaattgtatgctgaacgagaacatgtccgtctgtgtggcagacttcgggctgtccaagaaaatctataacggcgactactatcggcaggggcgaatagcaaagatgccagtgaagtggattgccattgagagccttgccgacagggtatatactagcaagagtgacgtctggtctttcggagttactatgtgggagattgcaaccagaggacagactccatatcctggagttgagaattctgaaatatatgactatctccgacaggggaacaggttgaagcagccggcagattgcctcgacggcctgtacgccctgatgtctagatgctgggagctcaatccccaggaccgcccaagtttcaccgaactgcgcgaagaccttgagaacaccctcaaagctcttcccccagcgcaagagccggatgaaatcctgtatgtgaacatggacgaaggaggcggatacccggagccccctggggcagcgggtggtgctgatccaccaacacagccggatccaaaagattcttgttcttgccttactgcagcagaagtacaccctgccggtaggtacgtactgtgcccatcaaccacgcctagccctgctcaaccggcagataggggaagcccagctgcacccggacaagaagatggggcatag

SEQ ID NO: 215545 - DNA, 2658 bp, Artificial Sequence
  Description of Artificial Sequence: Synthetic coding sequence
atggcgtggaggtgcccgcgtatgggtagggtcccgctagcatggtgtttagccctgtgtggttgggcatgtatggctccaagaggcacacaggctgaggagtcgcccttcgtgggtaaccccggaaacatcacgggcgctaggggcttgactggcaccctgcgctgccagcttcaggtgcaaggggagcctccagaagttcattggcttcgggacggacagatacttgagctcgcggactctacgcagacacaagtgccactgggtgaagatgaacaggacgattggatcgttgtgtctcagctgcggatcaccagtcttcaactcagtgatacaggccagtatcagtgtctggtgtttctgggccatcaaacatttgtgagccagccaggttatgtcggactagaaggcctgccctactttctggaagaaccagaggatcgcactgtcgcggcaaacactcctttcaatctcagctgtcaggctcaaggtcccccagagccggtcgatttgttgtggctgcaagatgcagtgcccctcgccacggcgcctggacacggaccccaacggagcttgcacgtgccgggacttaacaagacatcctcattttcctgtgaagcccacaacgccaagggagttactacgagccgtaccgccacaatcacagtccttccgcagcagcccaggaacctgcatctggtctcccgccagcctaccgagctcgaggtcgcttggactcctgggctgagtggtatatatccacttacccattgcactcttcaggccgtgctctctaacgatggtatgggaattcaggccggagaacctgatccacccgaagaacctctgacaagccaagctagcgttcctccacaccaactgcgtttggggtcgctccatcctcataccccgtaccacatacgggtggcttgtacctccagtcaaggcccttcaagctggacacactggctcccagtcgaaacaccagaaggtgttcctcttggtccccctgagaatatttccgcgactcgaaacggctcacaggcctttgttcactggcaagaaccgcgtgcgcctttacagggcacgctgctgggctacagactggcctatcagggacaggacacaccagaagttctgatggacatcggtcttcggcaggaagtgacactcgagctgcagggcgacggctcggtgtctaatcttacggtgtgcgtggcagcatacaccgcagccggagacggcccttggtctctccccgtgccgttggaggcttggcgtccagtcaaggaaccctcaacccccgctttctcctggccctggtggtacgttctgctgggcgctgtggtcgcagcggcttgtgtgctcatccttgccttgtttctggtacaccggcgaaagaaagagactagatatggggaagttttcgaacccacggtcgagcgcggtgaactagtagtgaggtaccgcgtccggaagagttattctcgaaggacgacagaggctacacttaactcactgggcatatctgaggaactcaaagagaaactccgggatgtcatggtggatcggcacaaggttgccttaggcaagactcttggggagggagaattcggtgcggtcatggagggtcagcttaatcaggacgacagcattcttaaggtggccgttaagacaatgaagatcgcaatctgtacccggtctgaactggaagacttcctgtccgaggcagtctgcatgaaagaattcgaccaccccaatgtcatgcgattgatcggtgtgtgctttcagggtagcgaacgcgagtccttccccgctccagtggtgattcttccattcatgaagcatggcgatctgcacagctttctgctgtattcccgtctcggcgaccagcccgtgtacctgcctactcagatgctggtgaagttcatggccgatattgccagcggtatggagtacctgagcacgaaacgcttcattcaccgagatctggctgccaggaactgtatgctgaatgagaatatgagtgtgtgcgtcgcagactttgggctgagcaaaaagatctacaacggcgattattaccggcaagggagaattgctaagatgccagtcaaatggattgccattgagtctctcgcagatcgggtgtatacatccaagtctgatgtctggagcttcggggtgacaatgtgggagatagctacaaggggacagaccccctaccccggagtcgaaaactccgaaatatatgactacctgaggcagggcaataggctgaaacagccggcagattgtcttgacggattatatgctctgatgtctcgatgttgggaactgaacccccaggatcggcctagctttaccgagctgagagaggacctcgaaaacacattgaaggcgcttcctcctgcccaagaacccgacgagattctgtacgtgaatatggacgagggtggcggatatcctgagccgccaggggctgccggtggagcagatcctcctacccaacctgaccctaaagacagctgtagttgtttaaccgccgcagaagtccatcccgctggccgttacgtgttgtgcccaagtacaactccttctcccgctcagcccgctgaccgcggaagcccagccgctccagggcaggaggacggtgcctag

SEQ ID NO: 215546 - DNA, 2439 bp, Artificial Sequence
  Description of Artificial Sequence: Synthetic coding sequence
atggagcctttgggaaattggcggagcttaagggccccacttccgcctatgctgcttctgctgctcctacaggtagctggtcctgtcggtgccctggctgaaacactgctgaacgctcctcgagcaatgggcacttcctcgagccccccttccccagcatcagtggtagccccaggaacgaccctgttcgaagagtcccgactgccagtgttcacactggactatccacacgtacagattccattcgaaatcacactatggatcctgttggctagccttgccaaaatcggctttcacctttaccacaaactacccaccattgttcctgaatcctgtttattgattatggtgggactgctgttggggggtattatcttcggagtagacgagaagagtcctcctgcaatgaaaacagatgttttctttctttacttgctgccacctattgtgttggacgctggctatttcatgccaacgcggccttttttcgaaaacatcgggactattttctggtatgccgttgtgggtacactgtggaactcaattggaatcggggtatcactctttggtatatgtcagatcgaggccttcggtctttcagacataacccttttacagaacctgttgttcgggtcactgatctctgctgtggatcctgtggcggttttggccgtgttcgagaacattcacgtgaatgagcagctgtacatcctggtgtttggcgaatccctcctaaatgatgccgtcaccgtggtgttatacaacctgtttaagtccttttgtcagatgaaaacaatcgaaacaatcgacgtattcgccggaatcgccaactttttcgtggtagggatcgggggtgtacttattggcatctttttaggattcatcgctgcgttcaccacccggtttactcacaacatcagggtcatcgagccgctgttcgtttttctgtattcctacctttcgtatattactgccgagatgttccatctgtcagggatcatggctattacagcctgcgccatgacaatgaataagtatgtggaagaaaatgttagtcagaagagttacaccactataaagtactttatgaaaatgctgtcatccgtaagcgaaacgctgattttcatatttatgggcgtgtcaacagtgggaaagaaccatgaatggaattgggcattcgtttgctttaccctggcattctgcttaatgtggagagccctgggtgtgttcgtgctgacacaggtgatcaataggttcagaactataccactgacttttaaagaccagtttattatcgcctacggaggactgagaggcgcaatctgcttcgccctggtgttcctgcttccagcggctgtatttcctcgcaagaagctgttcatcacagctgcgatcgttgtcattttctttactgtctttatcctcggtattacgatccgccctctggtcgaattcctggacgtgaaacgatctaacaagaagcagcaggccgtatccgaggaaatatactgccgactgttcgatcacgtgaagaccggcatcgaagacgtctgcggtcattggggccacaacttctggcgagataaattcaagaaatttgacgataagtatcttcggaaattgctgatccgcgagaaccagccgaagagcagtattgtgagcctgtataaaaagctcgagattaagcacgcaattgagatggccgagaccgggatgatctccactgtgcctacattcgcaagtctgaatgattgtagagaggaaaagattcgcaaggttacctcttccgagacagacgaaatacgtgaactgctctccagaaacctgtaccagattcggcaaagaacgctgtcttataataggcattccctcaccgctgacacgagtgagcgccaggccaaggagatcctgatccggagacgtcattctttgcgggaatctattcgaaaggactcttcccttaaccgagaacaccgagctagcacatccacctcccggtacctgtctttgcctaagaacactaaacttccggagaagctgcaaaagcgccgtactatatccatcgcagatggtaatagtagcgattcagatgcagatgccggtaccacagttctcaatctgcagccgagagcacgacggtttctgcctgagcagttttcaaaaaagagtcctcagagttacaagatggaatggaaaaacgaagtggatgtggactctggcagggatatgccctcaacgcctcccacacctcactccagggaaaaagggacccaaacttcaggcctactgcagcagccgctgctgtcaaaggaccaatctgggtccgagcgggaggattctcttacggagggaatccctccaaaaccgcctcctagattggtgtggagggcctccgaacccggttcccggaaagcgagatttggctccgagaagccctag

SEQ ID NO: 215547 - DNA, 681 bp, Artificial Sequence
  Description of Artificial Sequence: Synthetic coding sequence
gcagaggggaagtggggcctggctcacggcagggcagaagctcacgtgtggcccggacagggcggatggcggttgggccctccccaagggaggtggaccggctccagccctctgcttgacattgtgggaggaagaaaagctaggccgagacagtttccctttctcgccagcattcagaaccaagggagacatttctgcggtggcgcactcatccacgctcgcttcgtaatgactgctgcatcttgctttcaaagtcagaatccaggggtgtccaccgtggtgctgggtgcctacgacctgagacgtagggagagacagagcagacagacgttttcaatatcttccatgtccgaaaacgggtacgacccacagcagaatctcaatgacctcatgctcctccagctggatcgagaggcaaatctgacaagttcagtcaccatacttcccctacccctgcaaaacgccaccgtcgaagctggcacgaggtgccaggtggctgggtggggctctcaacgttctggtggaaggctgtctcgtttcccaaggttcgtcaacgtgaccgtgacccctgaggaccagtgccgccctaataacgtgtgcacgggcgtgctgacgcggaggggtggcatttgtaacgtgtcagctccatgtgggggaaggcgcggtcccgaacgctactag

SEQ ID NO: 215548 - DNA, 7874 bp, Artificial Sequence
  Description of Artificial Sequence: Synthetic coding sequence
atgtttcgccgagcgaggctgtcagtgaaacctaacgtgagaccaggcgtgggcgctcgcggaagtacggcctccaatcctcaacggggacgggagtcaccaagaccacccgacccagccactgattccgcttccaagccagcagaaccaacggacgtgcctaccgttgactttggcggagcagaaccacaagagaaggcaccacggtctagcacagagaagaccgggggtgataacgatgttgaagagtcaagtcggagcagtagtaccgtttctcaaagacgaaagcgcattagcagcacctcatcactcgttaagtctagtgtcagcgtaccttccgagtcacacccattgtcaacaattaatcaagaggcaccacagcctaccgccacctccacgaaggagaagcagccctgttccgacaggtacagaatatacaaggcacagaaactaagggagatgttgaaggaggagctgaggaaagaaaagaagcagtggaagaataagtacgctattaatgaatcacagcgaccccctgaccggtctaaaatgacgatgcgagattttatctattacctgccggacaataatcccatgacaagctctctggagcaggaaaaaaaaaccgaaaagccatcaacccccgtgcagacccgcgagcaggagggcaagagcacccctaatgccgaggataacgaaatggaggaggagaccgatgacggaccactcctggttccaagagtgaaggtcgcagaggatggatcaatcatccttgacgaggaaagcctgacagtggaggtcttgcgcactaaggggccatgtgtggtggaggagaacgatccgatctttgaacgaggatccactactacttatagttccttccgtaagaactattacagcaaaccctggtccaataaagaaacagatatgttttttttggcaatcagcatggtcggcactgatttctctatgatcggccagctcttcccacacagagctcggattgaaattaagaataaatttaagagggaagagaaaaccaatggttggcgcattgataaagcttttcaggagaagagacctttcgattttgacttctttgctcacctgcttcagaaagtgttggctgaggaagagaagaggaaacaaaagtccgtgaagaaccattccctcaaagaaaagaagagcaccaaacctcggaagaatgtgaaggtgaagaaggtcgcgtgtgagggagtgaataatgacccagacgagagtatgtcttccaggatctcagacaccgaacgaagccagaaagatgcgcagacggttgaggaggagtcattgactttgtcccgcgaagatgccgaacaggtcgccctggaggtggaccttaaccagaagaagcgcaggaggaagaaacaagacggggctaatgagctcggagtcaataatctgttggagaacgcgaccgtccaggctggaccgtctaagggggaaaaacacaaaaacaagtgccaggctatcaggcccgaactcaaggaaggagaatgcagcaaggagcagatgctctcatgtacccagaatattgatgggattgtgggattcgccagcacggaaaaggtggaaaagagaaccgaccccatcctttctctttccaaccagcaggacgcaacatcggttgcaacggaatctagtgaatcgtccaccagtgacctgccttcttttgaggtgggaatccgggctctgtgtgaagtgaacaacgctgagggatcgtgtatcgaggaacgaaacgtcgacctgaaaaataactccctcgaaattgaccagaccgaaaacgtgaagcccatgttgagggggaggtttcagagaccaaagccaaacttaagccgggcagggaaaaaaagcgttctgtcccaggggaaaaccgagtctgaatctaaaaactctcacagcaagacttcggtggagaaaaaccacgtcgaaaaagacaaaatgaataccctcgatatccttcgcatggaaaccaccgaacgggaaaatcctgaggcagagacagtctccgtccttggagagaagaactgtctgcaggaggggagccagttgaaggcactccgccctgtgcaggtaaggggtcgactccaaaaaccaaaacctaatgccggaaaggctgcagagcgaaaagaaatactgatcagccaggaggagattggtgctaatgtcgaaaaaaatgaaaatgagagctgtgccgaccgagataccccccagcacatggaagatcaatcgaggaaagatttcgaggaggaagatgtgatcctgcagccagaaaaaaatgacagctttcaaaacgttcagccagatgagccgaaggtattgaatgaatgtctatccgtgcaagagaataacaaggcaaacaaactcaatcaggtacctatactgcgaacacggtttcagaagccaaagccaaacattggccgaggcactgggaggcgcgaaattagttccaaagaggaggtgcttgagaagatccttgtgagcggagagatggcagccgcactgagagagaccgtccgcttggacacttcacccaaggaaatggtgccggcagaaataaacaccaaagaaatgcagtctgatttgaaagagacaggcaggcgggctatctccccgcgtgagaaaatcttggatgtaatcgacgataccattgaaatggaaacaggcctgaaagccatgggcagagaaatctgcttacgcgaaaaaacccctgaagttattgacgcaaccgaggaaattgacaaagatctagaggaagccggtcggagagagatctccccccagaaaaacggcccagaggaagtgaaacctttgggggaggtggaaactgatctgaaagcaactggaaacgaatcgtcaccgagggagaaaacgcctgaagtgactgatgctactgaggaaatcgataaaaacttggaagaaactggccgtaggaagattagtccacgggagaacgggcctgaggaggtaaagccagtggatgagatggagactgatctgaatgccaccgggagagagagttcacctcgcgagaagacgcccgaagtgattgatgccaccgaagagattgatctggaagaaactgagcgcgaggtctccccccaggagaatgggctcgaggaagtcaagcccctgggcgaaatggagacagacctaaaagctacggggagggattcctttcctaggggaaaaaccccagaggttattgacgccatcgaagaaattgagatcgatcttgaagaaacggagcgggaaatttcccctcaggaaaacggcctggaggaggtaaaaccgttaggtgagatgcagacagatctgaaggctaccggtagagagatctcccctagagagaagacccctgaagtcatcgatgctactgaagagatcgataaggatctagaagagaccggtagaagggaaatttcccccgaggaaaacgggccagaggaggtgaagccagtggatgagatggagacagacctgaagacaacaggtcgggaaggaagctctcgcgaaaaaacaagggaggtgattgatgccgctgaggtgattgagacggatctggaagagacagagagggagattagcccccaggagaacggcccagaggaagtgaaacctgtggggaaaatggagaccgatctcaaggagatcagggaagagatttcccagagagagaaggtcttggcggagtttagtgctatccgagagaaagagattgacctgaaggagactggcaaaagagatatcccgattatggaaaaagtgtcaggcaagatggcagtggttgaagaaatggaagcagatttgaaagagacggggaaagaaaacttcagagagcgcggaagcgaggagatctgtgtcaccgaggagaaggtcgccgagctgaagcagactggaaaaaccgacatatccccgagggaaaatgagttagaggaaaccagcacctcacggcagacagatactcatctcatgcaaagtggctccaacgacttttctgccgtccctagtctggacatccagaacatctcttccgaggtcttgagtatgatgcacacgcccgttgaggagaaaagaaattccgagaaagaggtaagctcacacttttctcacttcaagatatcctcccaaactcacgaaagcgacaagacagaggttcaaggaattcagtctcctgatgtgcctgagcagttctccgatatcaatctctcaaagagcctgccgcaggagcaaaagccactggagattaaaccagccccattcgttagatccagattcaagaggcccaaaccgaacctggctagagcagctctgaaacgcgaaactacagagagtgaaaagtatatctatgagaaaaagtccgaaacgaagaagatggagacaatcgtcatgcaggaaaataacgagcagaccgatacactaccctcccagcacgatgaagcgagcctgatgatctcaagagagaaagatacgctcggacacagaaacgaggaagccgtgattttgccctgcacacaaaccgaacggaacctatctccaagcaacagttgtgagcccaaagaggagtctcagtcagccccagtacaaaagaacgattctgtcgtgtcggtgggaaccaacaacgtgaacaccttccagcaggaaatgaaagagagcgtgattcagacagccagacaggtgcgcggtcgtctgcagcgcccacgccctaatattcggaagaccggacagagacagattgtggacaagggggaggccaaaggtatcattaaagagggaaggacaatactgccgaaagacgagactgaaaagaaggtgctgactgtctcgaattcccagatagaaactgaaattgaagtgccatctagtgccgtgcccgagcataggatgtacgaaaaccaatcccaggttgtgttggtagaaaatttgcatgtgaataagacaaatgaaacaattaggcacgagaataaaccatatgtaccatcgagtgcgcaaatgactagacgaaaattccaaaaggcaaagccaaatctggggagagctcactcaaagaaggaggagcccgtcctggaaaaagtgacaactgaccagtctaaggagggtaagcctgaagatcacctgctccagaaaggcgcttccaatactcagctgcttttgaaggagaaggccgagctattaacaagtttggaggtttcggcccgtaaggattgtgtgggtagtaaggaatcggccctggctaagatcgatgcggagctagaagaagtggggcctagccgccgagtgggtgaggaaactgttggtgacaactctccctctagcgtcgtggaggaacagtatctcaacaagctcacctcttgcccccagccactgaacgagacgagctactctaaaatagccttggacggcaagaccacaatctcaagcacatcagaatacgagcgcaataggggggaacggagatcccacaagaagttcaaaccaaacgtaacccggggacgagggagtaagagagtgagggggaaaacctctaaaaaagagccaagggccagtaaggcaatgctcgtcacccttcgggcttctcaggaggaggacgatgacgctgacgactttgaatccgattacgaggaagaaagctatcatcttgctccagaggaggtaaataaggcccctgtctttgtgcccgtgggcttacggtcaccggagcctgtgagcgcccagattgaggagacgatggaagaactagaaatcactgtaaacgttcctgatgtgggctgcatcgctgttgtggagcatgagctacccaataccgacgtgacaaccgaggaaatgaaacaggaggaaaacctctctgtgccatttgagatgacaactagcgagcacatccaagacgagcccggaacgaatgatggatccacggaggcggcaattacccttctcacaatgggggacctggttctgcagtctgagatcagctctgaacagggagatgtgggcgtgtgcatcatccctcacgtccacagcaaagataaatctcacattccctctagcctggacaacgtgaaccacaagatcgtccatgagtgccaggagctgtcatcacccgtcatcactactagtcctgcaagctttgaggagaataagattgtacttgaggaacagtcttcgcgggaagagataagtctgatggaaaaggtgaaagaaaatgcaactcctactaggaataccatttctaaggtgacaagcaaccttagaattcgttctaggttggcgaaacctaagcctaacctggaaaaaactctcggaacaaataggttggatgactaccaagaggtgtccagcttatgcgtaacaaagggtgcagagatggaaacacaacgtgaaacagaaaagaacgcttcaaaagccactgagctggagaacaaaaatctcggccctgtaaccactgccgaaaacaaagatcagagcaagctggcttgcgtccatgggatcaagggaaccagtatctccagcgaagtgaacttaacagaaaggaacgagaatcaggaagaatctagccaggaggtgcacatgctgagtgtggcccctgtggcttcaagcgagaccgggccatgcactctggggctcgaccggggactgggcgagaactctgttgaggaaccacagatcaaggacagcaaaggtgactccgtccttactctccccgtcccagagtacactcctaccagcattcccgaagtgcagcaggagaacataatcaatcctcaggaccttacggtgaacttagtggccaacgttccccaagacggggaggatgaacaggccttcatcctcactttggtcgaaattcccgctaatgccgtggaggagtttaccgacgccacagcacagttcatgccaaaccccctgttgccggcaccaattcttgtgaaaagtgtgaatacggaggagcgcggtgatatgtccatctgccttccggctacgtcagtgggtcaggacgcgatgggcctgtctatctccggcagggataattctaagaaacccccagacaatttggacctggttagcagaaaacgatttcagtgtagacttgataagaatgatcatatcccgccagccaaaaaacggagcttaaccctgcgcgatgattgccaagagtacaccaccgaagttcattcaaaggaactaacaaatgttttcgaagagacgggagagtcacataaaggccaagatattttcctcacatcagggagtactctcaccacacccgagccccagcggcaacaggtagaagcagccttccagtccagaggatcgcgttcccctgacgcctgtatggataaaaatgtgcctcaacttcctcaggatgaaatgatcgtgagcgataaagaggagaggacagacgccgcacctaagagccagcagatggacagccgaaccagctcgtcaaaagcatcgctctcgagacctggacggcgaccgctgggattcttgtcgctgatatgctctaagaactccctcgagagcgatgaaccaatgcaggtgcattctaagaagaggttaaaacccctgatccctgggttgcggaaaaagctaaagcgcagtaatccatttaacgagtcccaggaaaaaaacagggagagctctgatctgcttcctagcccaagtgttattaccactcagtctgagaacatctccagtagcgctacgcaggttagctgcgatcagccgctgcttaaagaaggatataaatccgcacagaagcgtgctccccaaggcgaagcgacgacggtgagcgagtacttttttaatgatatatttatagaggtggacgaaacggaata

SEQ ID NO: 215549 - DNA, 1392 bp, Artificial Sequence
  Description of Artificial Sequence: Synthetic coding sequence
atgctagttaccttaagggcaagtcaggaggaggacgacgatgctgatgatttcgagtccgactacgaggaggaatcttaccacttggcaccggaagaagtaaacaaagcccctgtgtttgtgccagtcgggttgcgatcaccagagcccgtgtctgctcagattgaggaaacaatggaagagctggaaattacggtcaatgtgcctgatgtggggtgtatcgctgtggtcgaacatgaactccctaacactgatgttacaacggaggagatgaaacaggaggagaacttaagcgttccatttgaaatgactactagcgagcacattcaggacgagcctggtactaatgacggtagtaccgaagccgctattactttgttgacaatgggcgatctggtcctccagtccgaaatttcctccgaacagggagatggagtttgcatcattccacacgtgcatagtaaagataagtctcacatcccttcaagcctggataatgtcaaccacaaaatcgtccacgagtgccaggaactcagctcacccgtgattacgacctcccctgcctcatttgaggagaataaaatagtattagaagaacagtcctctagggaagaaatctcgctcatggaaaaagtgaaagaaaatgccactcccaccaggaacacaatatccaaagttacctcaaacctgaggatacgcagtaggcttgccaaaccgaagcctaatctggagaagaccctcggcaccaaccggctggacgactaccaggaagttagtagcttgtgcgtcacaaagggggctgagatggaaacccaaagagagacagaaaaaaatgcctccaaagcaacggagctcgaaaacaaaaatttgggccctgtcacgactgctgaaaacaaggatcaatccaagcttgcatgtgtgcatggcatcaagggcaccagtattagctcagaagtgaatttgaccgagcgaaacgagaaccaggaggagagtagccaggaggtgcacatgctgagcgtcgccccagtggcctccagcgaaaccggcccatgcactctcggactggaccgcggtctgggcgaaaactctgtagaggaacctcagatcaaggattctaaaggtgactctgtgctcacactcccagtgccagagtatacccctacgtccatcccagaagtgcagcaagagaacatcatcaatcctcaggacctcactgtctttgtttaccaacagctccagctagtaaagatgccatgggtgtatctcttcctcgaggaaattatcctgaagtctaggctcatcatttggatcttgtatctgggcagagactttaatgctggtcttattaagatgaccacctttcttcttcctaaaaacgtccactctttgtag

SEQ ID NO: 215550 - DNA, 2445 bp, Artificial Sequence
  Description of Artificial Sequence: Synthetic coding sequence
atgtttcgtcgagcaagactctccgtgaagccgaacgtcagaccaggtgtgggcgctagaggtagtacagcctcaaatccccagcggggacgcgaaagccctaggccaccagacccggctacggactcagcaagcaaacctgctgagcccaccgacgtccccacagtcgacttcggcggagccgagccacaggagaaggcacctcggtcaagcacggagaaaaccggcggagataacgatgtggaggaaagttctcgaagcagctctacagtaagtcagcggagaaaaaggatctcctctaccagctccctcgttaagtcttcagtgtcggtaccaagcgaatctcacccactcagcactattaatcaagaagctccacagccaaccgccacctccactaaagaaaagcaaccatgctccgacaggtaccggatttacaaggcccaaaagctcagggaaatgctgaaagaagagttgcgcaaggaaaagaagcaatggaaaaacaaatatgcaataaatgagagccagcgcccacctgataggagtaagatgactatgagggattttatctactatctcccagataataatccgatgacatccagcttggagcaagagaagaagaccgagaagccaagtacgcccgttcagacgagggagcaagagggcaagtctactccaaatgccgaagacaacgagatggaggaggaaactgacgacgggcctctcttggtcccgcgagtgaaggtggcggaagacggctccatcattttggatgaggagagcctaactgtcgaggtcctgaggactaagggcccatgcgtggtagaggaaaatgacccaatttttgagcgcggaagcaccactacctattcttcattcagaaaaaactactactccaaaccttggtcaaacaaagaaacagacatgttctttctggcgatatccatggtagggacagacttcagtatgatcgggcagctgtttccgcacagagccagaatcgagattaaaaataagttcaagcgcgaagagaagacaaacggatggcgaatagacaaagcctttcaagagaagagaccctttgacttcgacttcttcgctcatttgctgcaaaaggtactcgccgaagaagagaagagaaagcagaagtccgtcaagaaccattcactcaaggaaaagaagagcacaaagccaagaaagaacgtcaaggtaaagaaagtggcatgtgaaggtgtgaataacgaccccgacgaatccatgtctagtcgaatttccgataccgaacgcagtcagaaggatgctcagacggtcgaagaagagagtctgaccctgtcacgcgaggacgccgagcaggtcgcgctagaggtggacctgaaccagaaaaagagacgacgcaagaaacaggacggcgcaaatgagctgggcgtcaacaatttgcttgaaaacgccactgttcaggcagggccttctaagggagagaaacacaagaacaagtgtcaggccatccgacccgaactcaaagagggggaatgtagcaaggagcagatgttgtcttgtacccagaatattgatggcatcgtcgggtttgccagcaccgagaaggtggagaagaggactgatcccatcctgtctctgtctaatcagcaagacgccacttctgttgcaacagagtcctcagaaagctcaacaagcgatttgccatcgttcgaggttggtattagagccctctgtgaagtgaacaacgctgaaggatcctgtatagaggaaagaaatgtggatcttaaaaacaactctctagaaattgatcagacagagaatgtgaagccaatgctgcggggacgctttcaacgccctaaacccaatctcagcagggccggtaaaaagtctgtgttgtctcagggtaaaacggagagtgagtctaaaaattcgcattctaaaacttcggtcgaaaaaaatcatgtcgagaaagataaaatgaacactctggacatcctccgaatggagactactgagagggagaacccagaagccgaaaccgtctcagttctaggagagaagaattgtttgcaagaaggatcacagcttaaagcactccgccctgtgcaggtgaggggtagactgcagaagccaaagcctaacgcagggaaggccgctgagcgaaaggagatcctgatctcgcaggaggagatcggcgctaacgtagagaaaaatgaaaacgaaagttgtgccgaccgggatacaccacagcatatggaagaccagagccggaaggatttcgaagaggaggacgttattctccagccggaaaagaatgattcatttcagaacgtccagcccgacgagcctaaagtcctgaacgagtgccttagtgtccaggaaaataacaaagctaacaaactgaaccaggtacctatcctcagaacacggttccagaaaccctag

SEQ ID NO: 215551 - DNA, 2541 bp, Artificial Sequence
  Description of Artificial Sequence: Synthetic coding sequence
atgttccggagagccagattgtccgtcaagcctaatgttagaccgggagtgggcgcacgaggaagtactgcttccaatcctcagagaggaagggagagtcccagaccccctgacccagcaaccgattccgctagtaagcccgcagagcctacagacgtgcctactgttgactttggcggagctgagccccaggaaaaggctccacgatcttctacggaaaagactggaggagataacgatgtggaagagtccagccgctcctcaagcacagtatcacagagacgcaaacgcataagctccacttccagcctcgtcaaatcaagtgtttcggtacccagcgaaagtcacccactcagtacgattaaccaagaagcaccgcagccaacagctacctccactaaggaaaagcaaccctgctcggataggtatcgcatctacaaggcacagaagctgcgcgaaatgttgaaggaggagctacgtaaggagaaaaagcagtggaagaataagtatgcgattaacgaatcccaaagaccgcctgacaggagtaagatgactatgagggactttatttactacctgcccgacaataatccaatgacctcttctctggagcaagaaaaaaaaacagaaaagccttccacgccagtccagacccgagaacaggaaggaaagtctacaccgaatgccgaagataatgagatggaagaagagactgatgacggaccgctgctcgttcccagagtcaaggttgctgaagatggatcaattatcctcgacgaagagtctcttaccgttgaagtgctaagaaccaaaggaccctgtgtagtagaagaaaacgacccaatctttgaacgcggatctaccacgacatactcctcttttagaaaaaactactatagcaaaccatggagtaataaggaaactgatatgttctttctcgcaatctctatggtcggaacagatttctctatgataggacagttgttcccccaccgggctcgcattgaaataaaaaacaaatttaagcgagaggagaaaacaaacggctggcgaattgataaggcgtttcaggagaaacgcccatttgacttcgacttctttgcccacctgttacagaaagttctggcggaagaggagaagcgaaaacaaaaatccgttaagaaccatagtcttaaggagaagaaaagtacaaaaccaagaaaaaacgtgaaagtcaaaaaggtggcatgtgagggggtcaacaacgaccctgatgaatctatgtcatcacgcattagcgacaccgaacggtctcagaaggacgctcagaccgtcgaggaagaatcactgaccttgtcacgggaggacgcagagcaggtcgccctggaagtcgacctcaatcagaagaagcggaggagaaaaaagcaggacggcgctaacgagctgggcgttaacaatctcctcgagaacgcaaccgtccaagccggaccgtcaaagggggaaaagcataagaataagtgccaggccatccgccctgaactgaaggaaggagagtgttccaaggagcagatgctgagctgtacccagaatatagacggcatcgtgggatttgccagcaccgagaaagtcgagaagcggacagatcccatccttagcctgtcaaatcagcaggacgccacttccgtcgctactgagtcctcagagtcctctacaagcgacctcccctctttcgaagtcggtataagggctctttgcgaagtgaataacgctgaaggaagttgcatcgaagaaagaaatgttgatctgaagaacaattccctggagattgaccagacagagaatgtgaaacctatgcttcgagggaggtttcaaagaccaaaaccaaacctgagccgcgcaggcaaaaaatccgtactgtcccagggaaagactgaaagcgagagcaagaatagtcatagtaagacaagcgtggagaaaaaccacgtggaaaaagacaagatgaacacacttgacatactgcgcatggagactaccgagagagaaaatcccgaggctgagacagtctcggtgctgggagaaaagaactgcctgcaggagggcagccaattgaaggccctacggccagtccaggttcgaggacgtcttcaaaagcctaagcccaatgccggaaaagcggcagagagaaaagaaatcctgatttctcaggaggagattggagctaacgtggagaagaatgagaatgagagctgtgccgatcgggacacccctcagcatatggaagaccaaagtcgaaaggatttcgaggaggaagacgtgatcctccagcctgagaagaacgattccttccagaatgtccagccagacgaaccgaaagtgctgaatgaatgcctgtctgttcaggaaaacaataaggctaacaagcttaatcaggtgcccatcctccgcacacggtttcagaaacctaagccaaacataggcaggggcacaggccgtagagagatttctagtaaagaagaggtgctggaaaagattctttcactcggcaaatggcgccagcactag

SEQ ID NO: 215552 - DNA, 6398 bp, Artificial Sequence
  Description of Artificial Sequence: Synthetic coding sequence
atgagcagccgtatcagtgacaccgaaagatcacagaaggacgcccagacagtggaggaagagagtctcacactctctcgtgaagacgcggaacaggtggctttggaagtcgacttgaatcagaaaaaaagacggaggaaaaaacaggatggagctaacgagctcggtgtaaataatctactggagaacgcaaccgtccaggctggtcctagtaagggcgaaaaacacaagaacaagtgtcaggcgatcaggcctgagctgaaagaaggagaatgctcgaaagaacagatgctaagctgtacacagaatattgacggcattgtgggattcgcatccacagagaaggtagaaaagaggactgacccaattctgtctctgtcaaatcaacaagacgctacttccgtggcaaccgagtcctccgagtcttccacttctgatttaccctcttttgaggtgggcatcagagccctctgcgaagtgaataacgcagagggatcctgtatagaggagagaaatgttgacctaaagaacaacagtctggagatcgaccaaacggaaaacgttaagccgatgctgcggggtcgattccaacggccaaaaccgaacctgagtcgtgcagggaagaaatctgtgctgtcccagggaaaaaccgagagtgagtctaagaatagccacagcaaaacaagcgtcgaaaaaaatcacgttgaaaaggataagatgaacaccctggacattctccggatggagacgacagaaagggaaaatcccgaagccgagactgtgagcgtgcttggcgagaaaaactgcctgcaggagggcagccaacttaaggctctgcggccagtgcaggtaagaggcagactccagaagccaaagcccaacgccggaaaggcagcagaacgtaaggaaattcttatatcccaggaagagattggtgccaacgtggagaagaacgagaacgaatcctgtgcggaccgggatactccccagcatatggaagatcagtcacgtaaagattttgaagaagaggacgtgattctgcagcccgagaagaatgacagctttcagaatgtacaacctgacgaaccgaaggtcctgaacgaatgcttgagcgtgcaagagaacaataaagcgaataaattaaatcaggtgccgatcctgagaaccaggttccagaaaccaaagcccaatatcgggaggggaacaggacgtcgggaaatctccagtaaagaagaggtcctcgagaagattttagtctctggcgaaatggctgcagctctgagggagacagtgaggctggacacatcccccaaagaaatggtgcccgcagagatcaacaccaaagaaatgcagtctgaccttaaggagacgggcaggagggccatttcccctcgagaaaagattcttgatgtcatagatgacaccatcgagatggagaccggtctgaaggccatgggaagggaaatttgcctgagggaaaaaacacccgaggtgatcgacgcaaccgaggagatcgacaaagatcttgaggaagccggacgaagagagatctcgccccagaagaacggccctgaggaagtcaagccattgggcgaggttgaaacagatctgaaggcgactgggaatgagtcatcgcctcgtgagaaaactccggaggtcacagacgcaaccgaggagattgacaaaaatctggaagagaccggacggagaaagatctctccccgagagaacggccctgaggaagtcaagccagttgatgaaatggagacagatctcaacgccacgggcagagagtcttctccgagggagaaaactccagaagtgattgatgcgacagaagaaatcgacctcgaggaaaccgaacgggaggtgtcccctcaggagaacggtttagaagaagttaagcccctgggggaaatggagaccgacttgaaagccactggtcgggactccttccctcgcggaaagactccagaagttatcgatgccatcgaagagatcgaaattgacctcgaggagacagagcgcgaaattagtccgcaggaaaacggtctcgaagaagttaaacccctgggggagatgcaaactgacctgaaggctaccggcagggaaatcagcccaagagagaagaccccagaagtcatcgacgccactgaagagattgacaaggacctagaagagacgggtaggagagagatcagccctgaggaaaacggcccagaggaagtaaagccagtggacgaaatggagacagacttgaagacgaccgggagggaggggtcaagccgcgagaaaactcgtgaggttatagacgctgctgaagtgatcgagaccgatctggaagaaacagagcgggagatcagtccacaggagaatggaccagaggaggtaaaacccgttgggaagatggaaaccgacttgaaggagattcgggaggagatttcacagcgcgagaaagttctggctgaattttccgccataagagagaaagagatcgacctgaaggagaccggaaaacgtgatattccgatcatggagaaggtgagtggcaagatggccgttgtcgaggagatggaggctgatctgaaagaaactggcaaggaaaactttagagagcgaggcagcgaagagatctgtgttaccgaagaaaaagtggccgaactcaaacagaccggtaagactgatattagtccaagggaaaatgaactggaagaaacttctaccagtaggcagaccgatacccatcttatgcagtcgggttctaatgatttttccgcagtgccctccctcgatatccagaatatcagttctgaagtcctgagcatgatgcacaccccggtggaggagaagcggaattccgaaaaagaggtatcctcacatttcagtcactttaagatctcctcccaaacccatgagagcgataaaacggaggtccaggggatccagtcccctgacgtacctgagcagttttcagacatcaatctgtctaagtcactcccacaggagcaaaagcccctggaaataaagcccgcaccattcgtcagatctagatttaagcgacctaaaccaaatttggctagggcagcactaaagcgtgagactaccgaatcagagaagtacatctatgagaagaagtctgaaactaagaagatggagactattgtaatgcaggagaacaacgaacagactgacacactgccgagtcagcatgatgaggcttcactaatgatcagccgcgaaaaagatactctgggccacaggaatgaggaggcggtgatcctcccttgcacacagaccgaacggaatctgtccccatccaatagctgcgaacccaaggaggagtcccagagtgcgccagtccagaagaacgactctgtggtttctgtgggaacaaacaatgtaaatactttccagcaggaaatgaaagagtcggttattcaaaccgctagacaggtgagaggccgtctccagcgccctaggcctaacataagaaagacgggacaacgccagatcgtagataaaggagaagcgaaaggaatcatcaaagaaggtagaactatcctgcctaaggacgagacagaaaagaaggtgcttactgtgtccaattctcagatcgagaccgaaatcgaggtccctagtagcgccgtgccggaacaccgcatgtatgaaaaccagagtcaggtcgtgctcgtagagaacctgcatgtgaacaagacaaacgagacaatcaggcacgagaacaaaccttacgtgccatcctctgcccagatgacccgaagaaagtttcagaaggcaaagccaaacctggggagagctcatagcaagaaggaggaaccggtcttggaaaaagtcaccacagatcaaagtaaggagggtaagcctgaagaccatctgttgcagaagggcgcatctaatacacagcttctcctgaaggagaaggccgagctgctgaccagcctggaagtgtctgcgagaaaggactgtgtcggctccaaggagtctgcattggccaagattgacgccgagctggaggaggtcggcccttctaggagggtcggtgaagagaccgtgggcgacaacagccctagctccgtggtggaagagcagtacttaaataagctgaccagctgtccccagccccttaacgagacaagttacagtaaaattgcactggacggcaaaacaacgataagctctaccagcgagtatgagcggaaccgtggagaacgtagaagtcataaaaaatttaagcccaacgttaccagaggcagaggctctaagcgggttagaggcaaaacgtccaagaaggagccaagggcatccaaggccatgttagtgaccctgagggccagccaggaagaagacgatgatgctgatgatttcgagtcagattatgaagaagagtcgtatcatctggcacccgaggaagtcaataaagctcctgtcttcgtcccggttggcttgagatccccagagccagtgtctgcacaaatcgaggagacaatggaggagctcgagatcaccgttaatgtacctgacgttggctgtattgcagttgtggagcatgagcttccaaacactgatgtgactaccgaggagatgaagcaggaggagaacttgagcgttccttttgagatgacaacttctgagcatatccaggacgagccgggagtgtgcatcataccccacgttcactccaaggacaagagtcacatcccatccagcctggacaacgtaaaccataaaatcgttcatgagtgccaggagctttccagtcccgtgatcacaacatctcccgctagcttcgaagaaaacaagattgtcttagaggagcagtcttcgcgggaagagatatctctaatggagaaggtcaaggaaaacgcaacccccacccgcaacactatttctaaagtgacgtcaaatctccgcatcagaagtcggttggccaaacctaaacctaacctcgagaagacactcggaactaatcgcttagatgattatcaggaggtaagcagcctttgcgtcacaaaaggcgctgagatggagacccaaagggagactgaaaagaatgcctcaaaggcaacagagctagaaaacaagaacctgggcccagttacaaccgctgagaacaaagaccagtcaaagctggcctgtgtacacgggattaagggcaccagcattagctcagaagtcaacctgaccgaacgcaatgaaaatcaggaagagtcaagtcaggaggtgcacatgcttagtgtggctccagtggctagctctgagaccggcccatgcacacttggcttggatcgcggactgggcgaaaactccgtggaggagccccagatcaaagatagcaagggcgatagcgttcttaccctgcccgtccccgagtatacaccaacctctatacccgaagtccagcaggaaaacattattaaccctcaggacttaactgtgaacctggtggcaaatgtgccccaagacggagaggacgaacaggctttcatcctcactcttgtggagattccagccaatgccgtggaggaattcacagacgccaccgcccagttcatgcctaaccctttgctgcccgctcccattctggtgaagagcgtgaatacagaagaaaggggggacatgtcgatctgccttcctgccacttccgttggtcaggatgctatgggcctgagtatctccggcagggataacagcaagaagccccctgacaacctggacctggttagtcgaaagaggtttcaatgcaggctggataaaaatgaccacattcctcctgccaaaaaaaggtcactcactctgagggacgactgtcaggagtacaccacagaggtacatagtaaagagctgacaaatgttttcgaggaaacaggcgaatcccacaaaggtcaggacattttcctcaccagcggctcgactctgacaaccccagagccccagcgccagcaggttgaggccgctttccagagccgcggttctcgttctccagacgcttgcatggataaaaatgttcctcagctgccacaggacgaaatgatagtatctgataaggaggagcgaaccgatgccgcacctaagagtcagcagatggattctcgtacaagttccagtaaagccagtctgtctagacctggtcgtagacccctggggttcttgtcactgatctgttccaaaaactctctggaaagcgacgaacctatgcaggttcatagtaagaaacgccttaagccacttattccgggtctgagaaagaagctgaagaggtccaacccatttaacgaaagtcaggagaaaaaccgcgagtccagtgacctgctcccatccccttccgtgatcactacccagtccgagaatatcagtagcagtgcaacacaatctccttttta

SEQ ID NO: 215553 - DNA, 1392 bp, Artificial Sequence
  Description of Artificial Sequence: Synthetic coding sequence
atgttggtaacactacgcgcttctcaggaagaggatgatgatgcagacgacttcgaatcagactacgaagaggagtcctaccacctggccccagaagaggttaacaaggcaccagtgtttgtgccagtggggctgcgctcccccgaacccgtgtctgctcagattgaagaaaccatggaagaattagagataaccgtcaatgtgcctgacgtgggatgtatcgccgttgtggaacatgagctcccgaatacggatgtgactactgaggagatgaagcaggaggaaaatttgtctgttcccttcgagatgacaactagtgaacacattcaggatgaacccggaaccaacgacggtagcactgaggctgctattactctgctgaccatgggcgacctagtcctgcagagcgaaatcagctcggaacagggcgacggcgtgtgcattatcccacacgtgcactcgaaagacaaatcccacatcccctcctccctggataatgtgaaccacaagatagtccatgagtgccaagaattatctagcccggtgataacaacaagccccgcttcgtttgaggagaataagatcgtgcttgaggaacagtcctcacgagaggagatctccctaatggaaaaagtgaaggaaaacgccactccaaccaggaataccatctccaaagtgacgagcaatctcaggatccggagcagactggcaaagcccaaaccaaacctcgagaaaacattaggtactaatagactggatgactatcaggaggtgtccagtctttgtgttacaaaaggcgctgagatggagactcagcgggaaacggaaaagaatgcttccaaggctactgagctggaaaataagaacctcggaccagttaccacagccgaaaataaagaccagagtaaattggcatgtgtgcacgggattaaaggaacctctatatccagtgaagtgaatctgaccgagcgcaatgaaaaccaagaggaaagctcccaggaagtccatatgttatctgttgcaccggtcgcgtcgagtgagaccggcccttgcacactgggcctcgaccgcggattgggcgagaacagtgtcgaggagccacagatcaaggacagcaagggagattcagtgctgacgctgccggttcccgaatacacccctacctccatccctgaagtgcagcaggagaacattatcaacccccaggacttaacggtcttcgtctatcagcaactgcagctggtcaaaatgccttgggtctaccttttcctcgaggagatcattctgaagtcgcggctgattatttggatcctctacctgggcagggactttaacgcgggtctgattaaaatgaccacctttttgctgcctaagaacgtacatagtctgtag

SEQ ID NO: 215554 - DNA, 1518 bp, Artificial Sequence
  Description of Artificial Sequence: Synthetic coding sequence
atgggactggtatcctctaagaagcccgacaaagaaaaaccgattaaggaaaaagacaagggacagtggagtccactaaaagtttctgcgcaggacaaggatgctccacctttgcccccattggtcgtattcaatcatctgacccccccacctccagacgagcacctggatgaggacaagcacttcgtggtggctttgtacgactacactgcaatgaatgatagagacctgcagatgctgaagggcgaaaagcttcaagtgcttaagggcactggcgattggtggttggctcgttcactggtgaccggaagggaaggatacgttccaagcaactttgttgcgagagtggaatcactggaaatggaaaggtggttttttaggagtcagggccgtaaggaggcggaaagacagctcctagccccaatcaacaaggccggaagctttcttattcgcgagtcagagaccaataagggcgcattttccctcagtgttaaggacgtgactacacagggagaactgattaagcactacaagattcgatgcctagacgaaggaggatactatatcagtccccgaattaccttcccttccctgcaagccctcgtgcagcactatagcaagaaaggggatggcctgtgccagcggctgaccttgccatgcgtcagacctgcccctcagaacccatgggcccaggatgaatgggaaattcctagacagagcctgcgcctagttcgtaagctcggcagcggtcagttcggcgaggtctggatggggtactataaaaacaacatgaaggtggccataaagacgttgaaggagggcactatgagtccagaggcttttctgggagaggctaacgtcatgaaggcactgcagcacgaaaggcttgtgcgcctttacgctgttgtgaccaaggaaccaatctacatcgtgacagaatatatggcacgcggatgcctgctcgattttcttaaaactgatgagggcagcaggctgtccttgcctcggctcattgacatgtccgctcagatagcggagggcatggcctatattgaaaggatgaattctatccatagggatctgcgggcagccaatattctggtgtcggaagcgctgtgctgcaagatcgcagacttcgggctcgccagaattatcgattctgagtataccgcccaagaaggggcaaaatttcccatcaagtggaccgcacctgaggcgattcacttcggagtgtttactataaaggccgatgtttggtccttcggcgtcctcttgatggaggtggtgacatacggtcgggtcccatacccagggatgtcaaaccccgaggtgattagaaacctggagagagggtatcgcatgccacgaccagacacgtgtcctcccgagctctatcggggtgtgattgctgaatgctggagatcccgcccagaggagcggcctacgttcgagttcctccaaagcgttctcgaagacttctacacagcaacggagcggcagtatgagctacaaccatag

SEQ ID NO: 215555 - DNA, 1773 bp, Artificial Sequence
  Description of Artificial Sequence: Synthetic coding sequence
atgggactggttagcagcaaaaagcctgataaggagaaacccatcaaggagaaggataagggacagtggtctccactaaaagtcagtgctcaggacaaggacgccccaccgttgcccccactcgtggtttttaaccatctgacaccaccccctccagatgaacacctagacgaagacaaacactttgtcgtagccctctacgactatactgccatgaatgaccgggacctgcagatgttgaagggggagaagctgcaggttctaaaaggcacaggggattggtggttggctcgatccctggttactggtagagaagggtacgtgccgtccaatttcgtggcgagagtggagtcacttgaaatggagagatggttttttagaagccagggtaggaaagaggctgaaaggcagctgttagctcctataaataaggccggttctttcctgattagggagagtgagacaaataagggtgcattcagtctatccgtcaaggatgtaactacacaaggtgagctgatcaagcattacaagatcagatgcctagacgaggggggatattacatttcacccaggattacattcccgtctctgcaggctctggttcagcattatagcaagaaaggagacgggttgtgtcagagattaacactcccttgcgtccgcccagctccccagaacccctgggcccaagacgagtgggaaattccaaggcagtctctgcgcctcgtcaggaaactggggagcggacagtttggggaagtctggatgggatactataagaataatatgaaagtggccatcaagaccctgaaggagggtaccatgagccctgaagcttttctgggtgaggccaacgtaatgaaagctttgcagcacgagcgcctggtgcggctgtatgcagtggttacaaaagagccaatctatattgtcacggaatacatggcgcgaggttgcctgctggatttcctcaaaacggatgaaggcagtcgcctaagcttgcccaggctaatcgacatgtcagcccaaatcgctgaagggatggcttacattgaaagaatgaatagcatccacagagatctgcgagccgcaaatatccttgtgtccgaggcgctgtgctgtaaaattgcagactttggactggcgcgtatcattgattctgagtacacagcccaggagggggcaaagttccctatcaaatggaccgcccctgaggccatccacttcggggtgtttactataaaagccgatgtctggtcatttggggtgctcctgatggaagttgttacttatggcagagttccctaccccggtatgtccaatcctgaggtgataaggaatctggagcgcggataccgaatgcctagacccgacacctgcccccctgagctctatcgaggcgttatcgctgaatgctggagaagtcgacccgaagagagacccacctttgactgcacacccggaagagtgacccgacctctctgcgcagcttcatttgttgagggctgcaactccgatttagcccgatcctctggagtgttatctccatcaaaagtgttccgaaccggcaagcggctctctagcagcaaggcccctgtgctcggcacacctcgggcagggagagtccctgcgagtgcgccttgtgttgaccccgctctccccagatacaggtcacagactggaagccgcggacgacaacagggacagccacaacccagactgcggagttcaacagccggactcttttgtaataaggtaaccagcgtgcgatag

SEQ ID NO: 215556 - DNA, 615 bp, Artificial Sequence
  Description of Artificial Sequence: Synthetic coding sequence
atggcaactgcatcacctagtgtgtttcttttaatggttaacgggcaagttgagtcagcccagtttccagaatatgacgatctgtactgtaagtactgcttcgtgtacggtcaggattgggccccaactgccggtctcgaggaaggaatttctcagattacctctaagagtcaggacgtacgacaggccctagtgtggaacttcccgatagacgtgacattcaagtcaactaatccttacggttggccccagattgtcctgtcggtctatgggccagacgtgttcggtaacgacgtggtcagaggttatggcgctgtgcacgtgccttttagcccaggaagacataaacgcaccattcccatgtttgtacccgaaagcacaagcaagctccagaaatttacttcatggttcatggggagaaggcctgagtacactgaccctaaggtggtcgcgcaaggggagggtcgcgaggtcacaagagtccgcagccagggcttcgtcactctgcttttcaacgtagtcacgaaagacatgcgtaagctgggctatgacacgggcccatccgacactcagggtgtcctgggaccctcgccgccacagtcattcccacagtag

SEQ ID NO: 215557 - DNA, 462 bp, Artificial Sequence
  Description of Artificial Sequence: Synthetic coding sequence
atggccacagcctcaccatcggtattcctgctgatggtaaacggtcaggtcgagtccgctcagtttcctgagtacgacgacctgtattgcaaatactgctttgtctatggccaagactgggccccaacggcaggcctggaggaagggattagccagatcacaagcaagtctcaggacgtccggcaggctctagtgtggaatttcccaattgacgtgactttcaagagcaccaacccttatggttggcctcagattgtgctgtccgtgtatggaccagacgtcttcggaaatgacgtggtacgtgggtatggcgctgtgcacgttccgtttagccctggacgacacaagcgcaccatccccatgtttgtccccgagtcaacgagcaagctccagaaattcacttctctctgccttgtagcctcttccgacttacaggccgctcctcccacggaagataagtag

SEQ ID NO: 215558 - DNA, 486 bp, Artificial Sequence
  Description of Artificial Sequence: Synthetic coding sequence
atggctactgccagtccctccgtgttcttactcatggtcaatggacaggttgagagcgcccagtttcccgaatatgatgacctctattgcaagtattgcttcgtgtacggtcaggattgggcccctaccgcagggctggaggagggaattagtcagattacaagcaaatcacaggacgtgcgtcaggccttagtgtggaacttccccattgacgttacctttaaaagcaccaatccgtacggatggccacagatcgtgcttagcgtttatggcccagacgtgttcggaaatgatgtcgtgcgcggatatggcgcagtgcacgtgcctttcagccctgggagacacaaacgcaccattcctatgttcgtccccgagtcaacatcaaagctccagaagttcacgagctggttcatggggaggcggcctgaatacactgatcctaaggtagtcgcccagggggaggggagggaggcccagccaggatag

SEQ ID NO: 215559 - DNA, 564 bp, Artificial Sequence
  Description of Artificial Sequence: Synthetic coding sequence
atggccacagccagccctagtgtttttttactgatggtgaacggacaagtcgagtcggcacaattcccggaatacgatgacctctattgtaaatactgttttgtgtatgggcaggactgggcgcctacagccggactcgaggaaggcattagccagatcaccagcaaatcccaggatgtgcggcaagctctggtatggaacttcccgattgacgttacctttaaatcgaccaatccatacggctggccacagatcgtgctcagcgtgtacgggccagatgtgtttgggaacgacgtcgtgcggggttatggcgctgtgcatgtaccattcagtccagggcgtcacaagagaactattccaatgttcgtcccagaaagcaccagcaaactgcagaagtttactagctggttcatgggtagaagaccggagtacaccgaccctaaagtcgtggctcagggggagggcagggaagacgagaacgcagaggcggaaatccccagatcaacttgggtgtctctgtgtcctagccccgcatggctgatgttgcctttctgccctcaatag

SEQ ID NO: 215560 - DNA, 402 bp, Artificial Sequence
  Description of Artificial Sequence: Synthetic coding sequence
ctcctgatggtcaatggtcaggtggagtctgcgcagttcccagagtacgacgacctttattgcaagtactgcttcgtatacggtcaggactgggctcccactgcgggtctagaggaagggatctctcagattactagcaagagtcaggacgtgcggcaggcgctcgtgtggaattttcccatcgacgtcacttttaaatctacgaatccctacggctggccacagatcgtgctctcagtgtacggcccagatgtgttcggcaacgacgtggtgcgaggctacggagcagtccacgtcccatttagtcctggacgacacaaacgcacaattcctatgttcgtgccagaatccacaagcaagctgcagaagttcactcgttcagcatcatgcagtacacactag

SEQ ID NO: 215561 - DNA, 615 bp, Artificial Sequence
  Description of Artificial Sequence: Synthetic coding sequence
atggctaccgcctcaccatcagtgtttttgctgatggtgaacggtcaggtggaatccgcacaattccccgaatacgatgacctgtactgcaaatactgcttcgtttatgggcaggattgggcacctactgctgggctggaggaagggatctcacagattacgtccaagtcacaggatgtgagacaggctttggtatggaattttcctatcgatgtaacctttaaaagcactaatccctatggatggcctcagatcgttctgagtgtatatggccctgatgtcttcggaaacgatgtagtacgcggatatggcgctgtccatgtgcccttttcccccggaagacataaaaggacaattccgatgtttgttccagaaagcacctctaaactgcagaagttcacatcctggtttatgggacgcagaccggagtatacggacccaaaggttgtcgcgcagggcgaaggaagagaggtgacgcgagtgagatcccagggtttcgtgacgctccttttcaacgtggtcactaaagacatgcgcaagttaggctacgatacaggccctagcgatacgcagggtgtgcttggccctagccctcctcagagctttccccagtag

SEQ ID NO: 215562 - DNA, 444 bp, Artificial Sequence
  Description of Artificial Sequence: Synthetic coding sequence
atgatgacttccaccgcctctacagctctgtgcacggccagaaccggacctccacagcgggtgtggagacggggttcgcaccgatcacacccacgcgctaagatgtgcggcaaacactggtgcggcacttccccactgatgtcccccctgaaagctcccacacccacagcaggccataggtcatgcagcgcctgcatggatcagatgtgctcaggtacaatgtggttcgaagccatgggaccatgtacctgtccgtcacacctggcaggcaccaaggggccaagtccgtgcctaagccagaatctgagactgaactgtaggtccctccaggcgggatcttggggaggaggcccaagcacacagacacctaggtggtggctgcgcgtgaaggccggaaagccaccatcaggactgtctgtaaaggacagcagcgtatcgaggtag

SEQ ID NO: 215563 - DNA, 528 bp, Artificial Sequence
  Description of Artificial Sequence: Synthetic coding sequence
atggcagaagttcacgtaatcgggcaaattattggagctagcggcttcagtgaaagttcactgttctgcaaatgggggatccacaccggggctgcttggaaattactgtccggcgtgagagaaggacagacgcaagtggatactccgcagatcggggacatggcctactggagccatccaattgacctccacttcgccaccaaaggtcttcagggttggcccagattgcattttcaagtctggagccaggattcttttggacgatgccagttggccggatacggtttttgtcacgtcccttcaagccccggtactcatcagctggcgtgtcccacctggcgccctttgggttcctggagggagcagcttgcccgagcctttgtgggaggtgggccacagttgttgcacggcgatacgatctacagcggagccgatcgataccgtctgcacacggcagccggagggaccgtccatcttgagatcggcctgctgttgcgaaactttgaccgatatggagtggaatgttag

SEQ ID NO: 215564 - DNA, 1452 bp, Artificial Sequence
  Description of Artificial Sequence: Synthetic coding sequence
atgactgaagtagagtacacccagctccaacatattctctgcagtcatatggaggcggctgcggacggcgaattggagactcgattgaacagtgcgctgctcgcagccgctggccctggagctggtgccggaggcttcgctgcagggggacagggaggggctgctcctgtgtatcccgttctttgcccctcagcactggccgcagatgccccttgccttggccatatagatttccaggagctccgcatgatgctgctcagcgaagctggcgctgcggagaaaacttctggcggaggggacggtgctcgggctcgcgcagacggggctgctaaagagggagccggagccgcagcagctgctgctggacccgacggtgcacccgaagcaagggctaaacccgctgtgagggtcagattggaggatagattcaattctatacctgccgagcctccccctgccccaagaggccctgagccccctgagcctggcggagcgctgaataatttagtaaccctcattagacatccttctgaacttatgaacgttcccctgcagcagcagaataaatgcaccgctctggttaagaataagaccgcggctacgaccacagccctacagtttacatatccgctatttacgaccaatgcttgcagcacctctgggaactctaatctcagtcagactcagagctcttcaaattcctgctccgtccttgaagcggcaaagcaccaagatataggcttgcccagggccttctctttttgttatcagcaggagatcgaaagcaccaaacagaccctcgggtccagaaataaagtgcttcctgaacaagtttggattaaagtgggggaagcagcgctttgtaaacaagccctgaaacgtaatagaagccgcatgagacagctggacaccaacgtcgagcggcgagcactgggggaaatccagaacgtgggagagggggcaaccgcaacacagggtgcttggcagtctagcgagagcagccaagcaaacctgggcgagcaggcccagagcggccctcagggtggcaggtcccagcgtagggaacggcataaccggatggaacgagataggaggaggaggatacgaatctgttgtgatgaactgaatttgttggttcctttctgtaacgcagagaccgataaggctactacgctacaatggaccaccgctttcctcaaatatatccaagaaaggcacggcgactcgttgaagaaggtattgtcaacaaacagtcggtatgttatgctttggacatgtttcctgaagatgaagtcagccgtggatggaaagaaccctcagcacgcataccgcacagctaatcacaagtggctttgcctgcacgaggccagatctttcgcattcgaggtgagcatctgggctcactttcagctgtttcgggttcgcatccctgaaggatttcttagtatttag

SEQ ID NO: 215565 - DNA, 843 bp, Artificial Sequence
  Description of Artificial Sequence: Synthetic coding sequence
atgggccctaaagacagcgccaagtgccttcatcggggtccccagccctcacactgggctgcaggtgacggcccaactcaggagcgctgtggcccaaggagcctgggtagccccgtgctgggcttagatacttgtagggcctgggatcatgtcgatggacagatcttgggccagttgcggccactaacagaggaggaagaggaagagggcgcaggcgcaacactgtcccgcggtccagccttcccagggatgggctcagaggagttaaggctcgcctcgttttacgactggcccctgaccgcggaggtcccgcctgaactgttggccgctgctggattcttccatactgggcaccaagataaggtgagatgttttttttgttacggtggcttacagtcgtggaagaggggggacgacccctggacagagcatgcaaagtggtttcccagctgtcagtttctgctccgctccaaaggcagagatttcgttcattctgtgcaggagacacattcacagcttttggggtcctgggacccttgggaagagcctgaagatgccgctcccgtggccccttccgtgcctgcctctggttatcccgaactaccaactccacgcagggaggtacagagcgagagcgcacaggagccgggtgcacgtgacgttgaagcccagcttaggcggctgcaggaggagcgtacctgtaaggtgtgcctggaccgggctgtgtccatcgtttttgttccatgtggccaccttgtgtgcgccgagtgcgcgccaggtctgcagctctgtcctatatgccgtgccccagtaagatcccgcgtccgtacattcctgtcttag

SEQ ID NO: 215566 - DNA, 3564 bp, Artificial Sequence
  Description of Artificial Sequence: Synthetic coding sequence
atgcggcctcgtggagcagctttcgctgcaggccctccaggggacctgcatctggggacggccatcggcttcgctggagcgatctggagaagccgctctcccgcaatgagcactctgctcgacattaaatccagtgttctccgacaagtgcaggtgtgtccgagtttccggaggaggaccgagcaggatcctggttcagcctccgctgatcctcaggagcctgccacgggagcgtggaagccaggcgacggtgtggagttctttgcgcatatgcgcctgatgctcaaaaagggagaaggtagacagggactcccatgtctggaagttccactccgatcgggctcacccgcacctccggaaccagtggacccaagtcttgggcttcgtgccctggctccagaagaagtggaaatgctgtacgaggaggctctttacaccgtcctctacagagccggaaccatgggccctgatcaagtggacgatgaagaagctctgttgagctacctccagcaggtctttggaacatccctagaagagcacactgaagccattgagcgggtgagaaaagcgaaggcccctacctatgcattgaaggtctctgtgatgcgggcaaagaacctcttggccaaggaccccaatggcttctccgatccctactgtatgctcggaattctgcccgcttcagatgcgacgagggaaccaagagcacagaaagagcagagattcggttttagaaagggatcaaaaagggggggacccctgccagcaaagtgcatccaggtcactgaagtgaaaagctctaccctcaatccggtttggaaggaacatttcttgttcgagattgaggacgtgtcaacagatcagctgcatttggacatctgggatcatgatgatgatgtgtccctcgtggaggcgtgtagaaagctgaacgaggtgatcgggctgaaaggcatgggtagatacttcaaacagatcgtgaagagtgcaagggcaaacggaaccgctggcccaacagaggatcatactgatgactttctcgggtgcctcaatattccagttcgagaggtgcctgtggcaggagtggacagatggtttaagctggaaccgagatcatctgcctcccgagtgcagggacactgtcacttggtgctcaagcttattacaacccagcgggacaccgccatgtcccaacggggtaggtccgggttcctaagccacctgctcctcctgtctcatctgctaaggctcgaacattctgccgaggaaccaaacagctcttcatggcggggagagctgagtacccccgcagccacgatactttgcctgcatggagcacagtcaaatctcagccccctgcagctggccgtgctacactggcaggtcagttcaagacatcatcagacttgcactctagattattcatatttactgggcctcctggaagacatgcaagcacactgggaagaagctccctccctcccacaagagcaggaagagagccttgccgattccttgtcagccttcagtgagttcggcctccagctcctcaggcagctgcgtgactactttcccgctactaacagtaccgcagtccaccgcttagagctactgcttaaatgcttaggcaaattgcagctcttccagccttcctttgaaatctgtccattcgagagcgaattgaatatggacatagcggctgcgctcaaaagaggaaatcgcgagtggtacgatagaattcttaatgacaaatcacctcgcgagcagcccggaccacaacgactgccgggtctcgtggtattggccgacgcggtgtatgatgacctgcagttctgctattctgtgtacgcaagtttgttccactctattctgaatgtggacgtgtttactctcaccttccgtcaactggaaagacttgtcgcggaggaggcatgggtactgaccgaggaactttcacccaagatgactctcgaagtggcatccggcctctttgaactgtatcttacactggctgatctgcagcgtttctgggactccatcccaggaagggactcgcggtccttggcgctagcaggcatccacgcaccttttttgccagccgttaaactatggttccaggtccttagggatcaggccaagtggcggctacagggagctgtcgatatggatactctcgagcccgtggacgcctccagccggcattcatccagcgccgcaacagcgggactgtgcttgagccatatccaagaactgtgggtcaggctcgcctggcccgaccccgctcaagctcaggggctgggtactcaattgggccaagacgtttgtgaagcaacccttttttacaccgagctgcttcggaagaaagtggacactcagcccggagctgcgggagaagccgtctctgaggccctatgcgtcgtactgaataacgtcgaactggtgcgaaaagccgcagggcaggccctgaagggccttgcgtggccagaaggtgccactggtccagaaggggtcctgcctcggccacttctgtcatgtacccaggcgttggacgatgatctccagagagaggcccatacagtgacagcccatctcaccagtaaaatggtgggcgacattagaaaatacgtacagcacatcagtctgtcacccgacagtatccagaacgatgaggcggtagccccactaatgaagtacctagacgaaaagctggcgttgctcaatgcgagcctggtgaaagggaatttatctcgcgtcctcgaagctctgtgggagctcttactgcaggcaatactccaggccctgggagcaaatagagacgtatcggccgatttttactcccggttccatttcactctcgaggctctggtcagctttttccatgccgaagggcagggactcccgctcgagagcttaagagacggctcatataagcgattaaaggaggagctgagactccacaaatgttctacacgcgagtgtattgagcagttttatctggacaaactgaagcaaagaacacttgaacagaaccggttcgggcgactgtcagtaaggtgtcattacgaggccgcagaacagagattggctgtggaagtgctacatgccgcagatttgctgcctctcgatgctaatggtctctctgatccctttgtcatcgtggaattaggccctccacacctttttcccctcgtgcgatctcagagaacgcaggtgaaaacacgcaccctacacccagtttacgatgaattgttctactttagcgtgccagctgaagcatgcaggcgccgagctgcatgtgtcctgtttactgtaatggaccacgattggctaagtaccaatgatttcgccggtgaggccgctctgggcctggggggagtaaccggcgttgctcggccacaagttggcggaggcgctagagccggtcaacccgtgacgctgcacttatgtcgcccacgggctcaggttagaagcgccctgcgcaggttggagggacggaccagcaaggaggcccaggaattcgtcaaaaagctgaaagaattggaaaagtgtatggaggcagatccctag

SEQ ID NO: 215567 - DNA, 3510 bp, Artificial Sequence
  Description of Artificial Sequence: Synthetic coding sequence
atgtccactctgttagatattaagtcatctgtactccggcaagtgcaggtttgccctagcttccgccgtcggactgagcaggaccctgggtccgccagtgctgacccccaggagccagccacaggcgcttggaagccaggggacggcgttgaatttttcgctcatatgaggctgatgctcaagaagggcgagggtcgccagggtttaccgtgcctggaggcttggggctcaccatgccgccagtctccccaccccggaccacacactcaggtgcccctccgcagtgggagccctgccccaccagaaccagtggacccatcacttggcttgcgagccctcgctccagaagaagttgaaatgctctacgaggaagctctctataccgtgctgtatagagcagggactatgggtccagatcaggtcgacgacgaagaggctcttctgtcgtatctacagcaggtgttcggcacatctttggaagagcatactgaggcaatcgagcgagtcaggaaggcaaaagctcctacttatgccctgaaggtaagcgtgatgagagcaaaaaatctgctggctaaggatccaaatggcttcagcgacccttactgcatgctgggcattttacccgctagcgacgcgacgagggagccacgggcacaaaaggagcagcggttcgggtttagaaaaggaagcaagcgcggaggacctctcccggctaagtgcatacaggtgacagaagtcaagtcctctactctcaacccagtctggaaggagcacttcctgttcgagatcgaagatgtttctaccgatcagttgcacctcgacatctgggatcacgatgatgacgtgtcactggtggaggcttgccggaagttaaatgaagtgattggcctgaaagggatgggcaggtattttaagcagatcgttaaaagtgcaagggcaaacgggactgctggacccacagaggaccacacggacgattttttgggttgtctaaacattccggtgcgggaggttcctgtcgccggtgtcgatcggtggtttaagctggagccacgtagttcggcaagcagggtgcagggccattgtcatctggtgcttaaactcattaccacacaacgagacaccgctatgtctcaaagagggcgatcaggattcctctcgcacctgttgctattgtcacatcttctgagattggagcattctgccgaggagcccaacagcagctcatggagaggtgagctgtcaaccccagccgctacaatcttatgcctccacggcgctcagagtaatctgtccccactgcagctcgcagtgcttcattggcaagtgtcgtcccggcaccaccagacctgtaccctcgattattcttacctacttggtcttttggaagacatgcaggcccattgggaggaggccccatccctgccccaggagcaggaagaatctctggccgacagcttgagcgcttttagcgagtttggcctccaactgctccggcagttgcgcgattatttcccagcaaccaactctaccgccgtgcaccgcctggagctgctgctcaagtgcctgggtaagctgcagctgttccagccatcatttgagatttgtcctttcgaatccgagctaaacatggacattgcggctgcactgaagagaggcaatcgagagtggtatgataggatcttgaacgacaaatcacctagagaacagcctggacctcaaaggttgcccggtcttgttgtactggccgatgcagtctatgatgacctgcagttctgttacagcgtgtacgcctccctgttccacagcatcctgaacgtggatgtgttcactctgacttttaggcagctagaaagactcgttgccgaggaagcctgggttctgaccgaagagctctctcctaaaatgaccctggaagtcgcttcagggctatttgaactgtatctaactctggcagatctacagagattctgggactcgataccgggtagggacagtcgttctctagcactcgccggtatccacgctcctttcctacctgcagtgaaactatggtttcaggtgttaagggatcaggcaaagtggagacttcaaggcgcagttgacatggatactcttgagccagtcgacgcaagttcccgtcactccagtagcgctgcaacagcagggctttgcctgagtcatatccaggagttgtgggttaggctcgcctggcccgaccccgctcaggcacaggggttggggactcagcttgggcaagacgtctgcgaggctactttgttctacaccgagctcctgaggaagaaagtggatacccaaccaggggctgcgggagaagcggtatcagaagctctgtgtgtggtcctgaacaacgttgaactcgtacggaaggccgcaggtcaggctctaaaagggcttgcatggccggaaggtgccacagggccagaaggggtgctgcccaggccattactgtcctgcactcaggctctggacgacgacctgcagcgtgaagcgcacaccgtgaccgcccacttgaccagcaagatggtcggtgatattcgaaaatacgttcagcacatctctctgtcacccgattctatccaaaatgacgaagcggtcgcacccctgatgaaatatctcgacgaaaagttagcgctgctcaacgccagtctcgttaaaggcaacttgagcagggtgctggaagccctgtgggaacttctgctccaggccatcctccaggccctcggcgctaatcgcgatgtatctgccgatttttatagccgcttccatttcactcttgaggccttggtttcattcttccatgcggaaggacaggggctccctctggagagcctgcgcgacggttcttataagagactgaaagaagagcttcgtcttcacaagtgtagcacgagagaatgtattgagcagttttacctggataaactgaagcaaagaaccctggagcaaaacaggttcggacggctcagcgtgcgctgtcactatgaagcagcggagcagagattggccgttgaagtgctgcatgctgccgatcttttgcctcttgatgctaatgggctgtcagatccatttgtgattgtggaattgggcccaccacatctgtttccgctggtgaggagccagcgcacccaagtcaagacaagaactcttcaccctgtttacgatgagctcttttacttctcagtacccgctgaagcttgtcgtcggagagccgcatgtgttctttttaccgtgatggaccacgactggctgtcaaccaatgacttcgcgggtgaagcagcgctcggcctcggaggcgttacaggggtcgccaggcctcaggtcgggggaggagccagagccggacagcccgtcacactacatttgtgcaggcccagggcccaggtccgtagcgcactccgtcgattagagggacgtacctctaaggaggcccaggaattcgtgaaaaaactaaaggaattggagaagtgcatggaggctgacccatag

SEQ ID NO: 215568 - DNA, 3510 bp, Artificial Sequence
  Description of Artificial Sequence: Synthetic coding sequence
atgagtacactgctcgacataaaaagctccgtcctccgccaagtgcaggtctgccccagctttcgcaggagaacggaacaggaccccggttcggcatccgcagacccacaggagccagctaccggtgcttggaaaccgggagacggagttgagttttttgcccatatgcgcctaatgctcaagaaaggggagggacgtcaagggttaccctgcctagaagcctggggcagcccatgccgacaaagtccccacccgggtccacatacacaggtcccattaaggtccggaagtcccgcaccgccagagcctgtggatccatccctgggcctccgcgcactagctccagaagaggtggagatgctgtacgaagaagctctgtacactgtgctgtatcgagcaggcacaatgggacccgatcaggttgacgatgaagaagcattgttaagctatctccagcaggtgttcggcacatcactcgaagagcacactgaggcaatcgagcgggtgagaaaggctaaggcaccaacctacgctttgaaggtgagtgtcatgagggccaagaacctgctggctaaagatcctaatggcttttccgatccttactgtatgttgggcatcctgcccgcttccgacgccacacgggagcccagggcgcaaaaggagcaacgtttcgggttccggaagggctccaaacgcggaggccctctgcctgccaagtgcatccaggtgaccgaagttaaatcaagcactctcaaccccgtttggaaagagcatttcttgtttgagattgaggacgtgtcaactgaccagctgcacctcgatatttgggatcacgacgacgatgtctcacttgtggaggcctgcaggaagcttaacgaagttatcgggctgaagggaatgggacggtatttcaagcagatcgtgaaatcggcgcgtgccaatgggacagccggacctactgaggaccatacagacgactttctcgggtgcctgaacatccctgtgcgcgaagtacccgtggccggtgttgatcgctggttcaagcttgaacccaggtcctctgccagccgggtgcaaggacattgccatctggtgctgaagttaatcactactcagagggacaccgccatgtctcagagggggcgaagcgggttccttagtcatttgctgctgctcagtcatctgctccgcctggagcatagcgctgaggagcctaattccagctcttggaggggagagctgtccacacctgccgcaactatcctatgtctgcatggggcacagtcaaaccttagcccactgcaactggcggtcctgcattggcaagtgtccagccgccatcaccaaacttgcacgctcgattactcctaccttctagggctacttgaagatatgcaagctcattgggaggaggccccaagtctaccgcaggagcaggaggaatcactggctgatagcctgagtgcattttcggaattcggattgcagctgctgcgccaactccgcgattacttcccagccacaaacagcacggctgtgcatcggctggagttactcctaaaatgcctcgggaagttacagctgtttcagccatcctttgaaatctgcccattcgagtctgagctgaacatggatattgccgcagcgctgaagcgcggaaaccgcgaatggtacgataggattcttaacgataagagcccgcgagaacagcccggaccacagcggctgcctggactggtagtgctagcggatgcagtctacgatgatctccagttctgctactcggtgtatgctagtctgttccattcaatcctaaatgtggatgtgttcacactgacgttccgtcagttggaaaggctggtggccgaggaagcatgggtgctgaccgaagaactgtctcccaaaatgaccttggaggtagcgtcaggactttttgagttgtatctcaccctggcagaccttcagagattctgggacagcatccccggtcgcgactctcgtagcttggccctggcgggaatccacgctccttttctccccgctgtgaaactctggttccaggtgttgcgggaccaggccaagtggcggctgcagggagcagttgacatggataccctcgagcctgttgatgcctcctcgagacatagttcttcagcagcaaccgctgggctgtgtctgtcgcatattcaggagctgtgggtccgcctcgcatggcccgaccctgctcaagctcaagggctggggacacagctcggccaggatgtatgtgaagcaaccctcttctataccgagctgttgaggaagaaggtggacactcagcctggagcggcaggcgaagcagtgtctgaggccttatgcgttgtgctgaataatgtcgagcttgttcgcaaagctgccggtcaggctctgaaggggctggcctggcccgaaggcgcaaccggacctgaaggggtattgcccaggccgcttttgtcatgcacccaggctctggatgacgacctgcagagggaagcacatacagttaccgcccacttgactagcaagatggtaggcgatattcgtaagtatgtgcagcacatttccctttccccagatagtatccagaacgatgaggctgtggccccactaatgaagtatctagatgagaaactagcattactcaacgccagccttgtaaagggcaacctcagtcgtgtcctcgaagctctgtgggagctcttgttgcaggccatcctccaagccctgggcgcaaacagagatgttagcgcagacttctattctagattccattttaccctggaagctctcgtttcattttttcacgccgagggccagggactaccacttgagagccttagagacgggagctacaagcggctgaaggaggagctgagactgcataagtgtagtaccagggagtgcattgaacagttttacctggataagctaaagcagcggactttggaacagaataggttcggccgactctccgtccgctgtcactatgaggctgcagaacagagactcgcagtagaggtacttcatgccgctgacttactgcccctagatgctaacgggctgagtgaccctttcgtcattgtggaacttggacctccacacctttttccactggttaggtcccagaggacccaggtcaagaccaggaccctgcaccctgtttatgatgaactgttttattttagcgtaccagccgaggcttgtcggagaagggcggcatgcgtgctctttacagtgatggaccacgactggttgtccaccaacgactttgctggagaggctgctctggggctcgggggagtgactggagtggctcgaccacaggtgggcggaggggcaagggctgggcagccagtgacactgcatctgtgcaggccgagggcccaggtgcggagtgccctacgacgccttgagggtagaacaagtaaagaggcccaggaattcgtcaagaaactgaaagaactcgagaagtgtatggaggcagatccatag

SEQ ID NO: 215569 - DNA, 3351 bp, Artificial Sequence
  Description of Artificial Sequence: Synthetic coding sequence
atgtctactctgctggacataaaaagcagtgtgctgagacaggtgcaggtgtgcccctccttccgcaggagaacagagcaagatccagggtctgcaagtgccgatccacaggagcctgcaacgggcgcttggaagccaggggacggcgttgagttttttgcgcacatgagacttatgctaaaaaaaggcgagggaagacagggtctgccatgcctggaagtgcccctgaggagcggtagtcctgcgccacctgaacctgtggatccatcgctagggctgagagctctggcccctgaagaggtagagatgctctacgaagaagccctttacacagtgctctaccgggcaggaacaatgggccctgatcaagttgacgatgaagaggcactgttgtcatacctccagcaggtatttgggacgtctctcgaagaacatacggaggcaattgagcgcgtccgcaaggctaaggccccaacgtatgcgttgaaggtgagcgtgatgagagccaaaaatctgctggcgaaggacccaaacggcttctcggatccttactgtatgctcggcatccttccagcaagtgacgcaactcgggagccaagagctcagaaggagcagcgttttggcttcagaaaggggtccaagcgtggtggtcccttacccgctaagtgcatacaagtgaccgaagtcaagtcctcaactctaaatccagtatggaaagaacactttttgtttgagattgaggatgtgagcaccgaccagttacatttggacatttgggatcacgatgacgatgtgagcctcgtcgaagcctgcagaaaactgaacgaggtgatcggcctgaaaggtatgggacgctatttcaagcaaatcgtgaagtcagcaagggcaaacgggaccgccggacctaccgaagaccatactgacgacttcctaggatgtctgaatataccagtgagaagagataccgcaatgtcccagagaggaagatcaggtttcctgtctcatctgctcttattgagtcatctgttgcgcctggagcactccgctgaagagccgaatagcagcagctggcgcggagagctgtcaacccctgctgcaacaatcctttgcttacatggagcgcaaagtaatctaagtccacttcagttggccgtgctccactggcaggtgtcatcgagacatcaccagacctgcaccctggactactcgtacttgctggggctgcttgaggacatgcaagcgcattgggaggaggcaccatcactgccgcaggaacaggaggaatcgctggctgatagtctgtctgcattttccgagtttggcctccagctgctaagacaactccgggattacttccccgctaccaattccacagccgttcacagactagaacttcttctgaagtgtttggggaaactgcaactattccagccctcattcgagatctgtccttttgagagtgagctcaacatggacattgcagccgctctcaagcggggtaaccgggagtggtatgatcgaatcttgaatgacaagagtcctcgagagcagcctgggcctcaacgactgcccggtctggtcgtgttggctgacgctgtgtacgacgacctacagttctgctattctgtgtacgcttctcttttccactcaatcctgaatgtcgacgtgtttaccctgacgtttaggcagttagagcgcctggtggctgaagaggcctgggtattgaccgaggaactgtctcccaagatgacccttgaagttgcatccgggttgtttgaactttatttgaccctggcagacttgcaaagattttgggactctatcccagggagagattctaggtccctcgcattagcagggattcatgctccattcctacccgcagtgaaactctggtttcaggtgctgcgtgaccaggctaaatggcgccttcaaggcgcagttgacatggacaccctggagcccgttgatgctagctcccggcattcatccagcgccgctaccgcaggcctatgcctctcgcatatccaggaactatgggtgcggctggcctggcccgatccagcccaggcgcaaggactcggcacgcaacttggtcaagacgtctgcgaggccacccttttctataccgagttgttgaggaagaaagtggacacgcagccaggggcagcaggcgaggcagtgagcgaagcgctatgcgttgttctgaacaacgtcgagctcgtgagaaaagctgcagggcaggctctgaagggacttgcttggccagaaggtgcgacagggccagaaggcgtactgccacgcccacttttgtcctgcacccaagcgttggacgatgatctccagcgcgaagcccatacagtcacagctcatcttaccagtaaaatggtgggagatatcagaaagtatgtgcagcatatttcattaagccctgattctattcagaacgacgaagccgtggccccactcatgaaataccttgacgagaagttggccctgctgaatgctagcctggtgaaaggaaatttgagtagggtgctagaagctctttgggaacttctgctccaggcaatcctccaggcgctaggcgctaatagagatgtgtccgccgacttttactcgcggttccactttaccttagaggctcttgtgtcatttttccacgccgagggccaggggctgccactcgaatccctgcgtgatgggagctacaagcgcctcaaggaggagctccgtctgcacaagtgctccacaagagagtgtatcgaacaattctacttggacaaactcaagcaacggaccctcgagcagaaccgattcggcagactgagcgtgcgctgccactatgaagccgctgaacaaagactggccgtcgaagtgctgcacgctgcagacctgcttccactcgacgcgaatggtttatcagacccctttgtcattgtcgaactcggtcccccacacttgttcccattagtccgctcccaaaggacccaggtcaaaacccggaccctgcatcctgtctacgacgagctgttctacttctcagttcccgctgaggcctgtcggaggcgagcagcctgcgtactttttactgtgatggatcatgactggctgtcgactaatgacttcgctggggaagctgctcttggccttggaggcgtaaccggcgtggctagacctcaggttggcggaggtgcacgcgctgggcagccagtcacactgcacctttgccgcccaagggcgcaagtcagaagcgcgttgcgtcgtctggagggcagaacctctaaggaagcccaagaattcgtcaaaaaattgaaggagctagaaaaatgcatggaagccgatccttag

SEQ ID NO: 215570 - DNA, 3459 bp, Artificial Sequence
  Description of Artificial Sequence: Synthetic coding sequence
atgtcgactctgctagacatcaaatccagcgtactgcgacaggtgcaggtgtgtccgtcttttcggagaaggactgaacaggaccccggaagcgcctctgccgatccccaggagccggcaaccggagcatggaagcctggagatggggtggagttcttcgcccatatgagactcatgttgaaaaaaggggaagggaggcaaggactgccctgcctggaggtgccacttcggtctggttctccagcgcctccagaacccgtggatccttccttaggcctgcgggcattggcccctgaggaagttgagatgctctacgaagaggctttgtacactgtactctacagggctggcaccatgggcccagaccaggtcgatgatgaagaggccctcctcagctatttgcagcaagtgttcgggacctccttggaagaacacaccgaggcgattgagcgcgtacggaaggcaaaggcacctacatacgctctgaaggtgagtgtgatgcgcgcaaagaacttgctggcgaaagaccccaacggcttttccgacccatattgcatgctgggaattctgcctgcaagtgatgccacgcgagaaccgagggctcaaaaggagcaaaggtttgggtttaggaaaggcagtaagcgtggcggtcctcttcctgcaaagtgtattcaggtcaccgaagttaaatcaagcaccctgaatccggtttggaaagagcactttctgttcgagatcgaggacgtttctaccgaccagctgcacctggatatctgggaccacgacgatgatgtaagtctggttgaagcatgtcgcaagttaaatgaggtcatcgggctcaagggcatggggcgatactttaagcagatcgtcaaatccgcgagagctaacggaactgctggacccactgaggaccatactgatgatttcctgggctgtctgaacatccccgtcagggaggtgccagtggcaggcgtcgaccgctggttcaagctcgagccacgctccagcgcaagccgtgttcaggggcattgccatctggttctgaaactgatcactacacagagggataccgcaatgtcccaaagggggaggtcggggttcctaagccatcttctgctcctgtctcatttgctgcgactagagcactccgccgaggagcccaactcttctagctggaggggcgagctgtccacccctgccgcaactattctgtgcctgcacggagctcagagtaatctgtctcctcttcaactggccgtgcttcactggcaggtgtcgtcccgacaccatcagacgtgcacgcttgactattcttaccttctcggactcctggaggatatgcaagcacactgggaggaggctccatctctgccgcaggagcaggaggagagccttgccgactctctgtcagcctttagcgaattcggtctacaactgctgaggcagctgagagattatttccccgcaacgaacagcactgcagtgcataggctcgagttgctcctgaagtgcttaggaaaactacagctgttccagccatctttcgagatctgcccgtttgagagtgagttgaacatggacattgcggcagccctcaagaggggtaatcgcgagtggtatgataggatcctgaatgacaaatcccctagagagcagccaggccctcaaagactgcccggactcgtggtgctcgccgacgctgtctacgatgacctgcagttctgctactccgtctacgcgtcgctgttccattctatactgaatgtggacgtgttcaccctgactttcaggcaactggagcgactagtggctgaagaggcctgggtgcttactgaggaattgtctccgaaaatgacactggaagtggcgagcggcctgtttgagctgtatctaactctggctgacctccaacgcttctgggattccattcctgggagagattctcgctctctcgcccttgccggaattcatgcaccgttccttccagcagtgaagctgtggtttcaagtgttgagagatcaggccaagtggcggttgcagggcgcagtggatatggatacccttgagcccgtggacgcctcttcccgacattctagctctgctgccaccgccggactttgccttagccacatccaggagctgtgggtgcgcctcgcctggccagatccagcacaggcacagggcctggggacacagctagggcaggacgtttgcgaggcgacactgttctataccgaactcctgcgcaagaaagtggatactcagcccggagctgctggcgaggccgtgagcgaagcgctgtgcgtggtcctcaataacgtggagctggtgcgtaaggctgccggtcaggcgcttaagggactggcctggccggagggggcaactggacctgagggggtcctcccgagaccattgctttcttgcacccaagctctagatgatgacctacagcgagaggctcacactgttactgcccacttgacaagtaaaatggttggagatatccgtaagtatgttcagcacatatcactgagccctgattcgatccagaacgatgaggccgtagcccctctcatgaagtacttggatgagaagttggcactcctcaatgcaagcctggtaaaaggcaatctttctcgagtactcgaggcgctgtgggagttgcttctgcaggccatattgcaggccttgggagccaatagggacgtgtctgccgatttctacagtcggttccattttacactcgaggcgttggtgagttttttccatgccgagggacaaggccttcccttggagtctttgagagacggtagctataagcgcctcaaggaggagctgaggctccataagtgctccaccagggagtgcatagagcagttctatctggataagctgaagcagagaacccttgagcagaatagatttggcagactatcagttagatgccattacgaagctgctgagcagagactcgcagtggaggtcctacatgcagccgacctattgcctctagatgctaacggcctgagtgaccctttcgtgattgtagagctgggaccccctcatctattcccacttgtccgatctcagaggacccaggtgaagacacggactttgcatcctgtgtatgatgagctgttctattttagtgtgcctgctgaagcctgcagaaggcgtgccgcatgtgtcttgtttaccgtaatggaccatgactggctgtctactaatgacttcgctggcgaggccgcattgggactcggtggagtaaccggggtagctcggcctcaagtgggaggaggagcaagagccggtcaacccgtaacacttcatctgtgccgacctagagcccaagtccgatcggcccttcggaggctggaagggcgaacgtcgaaagaggcacaggaatttgttaaaaaattaaaggagttggagaagtgcatggaggccgatccctag

SEQ ID NO: 215571 - DNA, 537 bp, Artificial Sequence
  Description of Artificial Sequence: Synthetic coding sequence
atgtcacaacgtggtagaagcgggttcttgtctcacctcctccttctatcacacctgctcaggctggaacattctgccgaagagccaaactcctcctcctggcgaggcgagctgtcaactcccgcagcaactatactttgccttcacggagctcaatctaacctgtcccccctgcagttagcagtcctgcactggcaggtctcctccagacaccatcagacttgtactctcgactattcctatctactcgggttactggaagacatgcaggcccattgggaagaagctccctctctgccacaggagcaggaggagtcacttgcagacagtctgtccgcctttagcgagttcggtcttcaactcctccgtcaactccgcgactattttccagccaccaactccaccgccgtccacagactggaactccttctgaagtgcctcggaaagctccagctatttcagccaagcttcgaaatatgcccccgagtcggggcagagcatggtcactgctgcgggcctgaagaaaggcagccctag

SEQ ID NO: 215572 - DNA, 1782 bp, Artificial Sequence
  Description of Artificial Sequence: Synthetic coding sequence
atggcggctgcgtcctcgtccgacagtgacgcttgtggtgctgaaagcaacgaggccaatagtaagtggctcgacgcccactacgatccgatggctaacatccacacattcagcgcctgccttgcactggccgacctgcatggcgacggcgaatacaagctcgttgtcggggatctgggccctgggggacagcagcccagactgaaagtcctcaaaggacccctggtgatgaccgaatcgcctctgccagccctgcctgctgctgccgcaactttccttatggaacagcacgagcctagaactcctgctctcgctctggcatctggcccttgcgtctacgtgtataagaatctgcgtccgtatttcaagttctccctgcctcagcttccccctaatccactcgagcaagatctgtggaaccaggccaaagaggatcggatcgatcccttaacactgaaagaaatgctggaatccatccgtgaaacagcggaggaaccactaagcatccagtccctgagattccttcagttggagctgtcggagatggaggcattcgtaaatcagcacaagagcaactctattaagcggcagaccgtcatcaccactatgacaacgctaaagaagaatctcgccgacgaggacgcagtgagttgtctggtactgggaaccgaaaacaaggagcttctggtcttggaccctgaagccttcactattttggctaaaatgtcactgcccagtgtacctgtgttcctggaggtaagcggacagttcgatgtcgagtttcgactcgcggctgcatgtcggaacgggaatatctacatcctgcggagggacagcaagcacccgaaatattgtattgagctgagcgcccagcctgtcggattaatcagggtccataaagttctggtggttgggtcaactcaggactctttgcatgggttcacccataaggggaagaagctatggaccgtgcagatgcccgctgccattctgactatgaatcttctggagcaacacagcaggggtctccaggccgttatggcgggactcgccaacggcgaggtgcggatctaccgggacaaggcgctgctgaacgtaatacacaccccggatgcggttacaagtctgtgctttgggcgttatgggagagaggacaacactctgattatgacaacgcggggtgggggtttgatcatcaagattctgaaacgaaccgcagttttcgttgagggagggtctgaagtggggccaccaccagcccaggccatgaagctgaatgttcctcgcaaaacacggctgtacgtagatcagaccctccgggagcgcgaagctgggactgcgatgcatcgggcatttcaaacagacctatacctccttcggctgcgggctgccagggcctatttgcaggcactggagtctagtttgtctccgcttagcaccaccgcgcgtgagcctttgaagcttcatgccgtcgtccagggtttagggcctactttcaagcttaccctgcacttgcagaacacatccacaacccggcctgtgctgggtctgcttgtgtgttttctctacaacgaagctctttacagcctccccagggcttttttcaaagtgcctctgctggtgccaggcctcaactaccctctcgagacttttgtggagtctctcagtaacaagggcatttccgacattatcaaggtactcgtgctgagggaaggacagtcagctcctctgttgtcagcccacgtcaatatgcccggtagcgaggggctggccgcagcctag

SEQ ID NO: 215573 - DNA, 498 bp, Artificial Sequence
  Description of Artificial Sequence: Synthetic coding sequence
atgtccccaggcccacagctttggcacctgttgcaggccttagtgtctatgtgcataagaatttctgacccgacctcttcgagcgcttgtccgaattgcctccagatattgtggaataaaaccttcgggaccaggccaaaaagggaaaccgcagaagagccacttagtattcaatcgttgaggttcctgcagcttgaactgtcagagatggaggcatttgtgaaccagcataagtccaacagtatcaaaaggcagaccgtgattacaacaatgactacgttaaagaagaatctggcggatgaagatgccgtctcgtgcctcgtcctggggactgaaaataaagaactcttggtactagaccctgaagcgtttactattctggcgaagatgtctcttccctccgtccccgttttcctggaggtgtctggccagttcgacgtggagtttaggctggcagcagcgtgtagaaatggcaatatctacatcttgaggagatag

SEQ ID NO: 215574 - DNA, 2172 bp, Artificial Sequence
  Description of Artificial Sequence: Synthetic coding sequence
atgctttcaagtatggctgcagccggttccgtgaaggctgctctgcaggtagctgaagtgctcgaagctatagtgagctgctgtgtgggccctgagggacggcaggtgctctgcactaaaccaactggtgaggtgttgctcagccgcaacggagggaggctgctcgaggccttgcaccttgagcaccccatcgctaggatgattgtggactgcgtttcaagccaccttaagaagacaggtgacggcgctaagacattcatcatctttctgtgtcatctgctgagaggacttcatgctatcaccgatcgcgagaaggaccctctgatgtgcgaaaatatccagactcacggacgacattggaaaaactgcagccgctggaagttcatatcccaggccctccttacattccagacccagatactcgatgggatcatggaccaatacctcagtcggcattttcttagtattttctcctcagccaaagaacgaaccctatgtcgtagctccttggagctcctcctggaggcttatttttgcggtcgagtcggcaggaataaccataaattcatcagtcagctgatgtgtgactattttttcaaatgtatgacttgcaagagtggaatcggcgtctttgaattggtggatgaccactttgtcgagctgaatgtcggggtgacaggcctgcccgtaagtgattctcgcatcattgccggattagtcttgcagaaggattttagcgtttaccgtccggcagatggtgacatgcgaatggtgattgttactgagactatccagccattattcagcacctccgggtccgaatttatcctgaacagtgaggcccagttccaaacctctcaattctggatcatggagaaaaccaaggctatcatgaagcacttgcactcacagaacgttaaactgcttatttccagcgttaagcagccagacttggtgtcatactatgctggggtgaacggcatatctgttgttgaatgcctgtcctccgaggaggtgtctctcatcaggcgcattataggactgagtccgtttgttccaccacaggctttttctcagtgcgagatccctaatacagctctggtgaagttttgcaaaccactgattctccgtagcaagagatatgttcatctgggactcatttcaacatgtgccttcattcctcactccattgtgctttgcggtccagtgcacggcttaattgaacagcatgaggacgcgctgcacggcgcacttaagatgctgagacagctcttcaaggacctggatcttaattatatgacccagactaatgaccagaacggaacctcatccctctttatttacaagaattctggagagtcctatcaggcaccggatcctggtaatggtagtatccagcggccatatcaggatacggtcgccgagaataaggacgccctcgaaaaaacacagacatatctaaaggtccacagcaatctggttattcccgatgttgagctggaaacttacattccctactctacccccacactgacaccgaccgacacatttcagactgtagagaccctgacctgtctgagcctggaaaggaacaggttaacagattactatgagcctctcctgaaaaacaattccaccgcgtactccacgcgcggtaacagaatcgagatctcatacgaaaacctacaggtgaccaacataactaggaaaggctccatgctccccgtctcttgcaagttgcccaacatgggaacttcccagtcatatctcagcagttccatgcccgcaggctgtgtccttcctgtcgggggtaactttgagatcctgctccattattacctcttgaattatgcaaaaaaatgtcaccagtcggaagagacaatggtaagcatgattattgctaacgccctgctcggcattcctaaagttttatataagagcaaaaccgggaaatattcatttcctcacacgtatataagggcggtgcacgcgctccagacgaatcagcctttagtgtccagccaaacaggcctcgagtccgtgatggggaagtaccaattattgacgtccgtgctgcagtgcttaaccaagattttaacgatcgatatggtcattactgtcaagaggcatccccaaaaggtgcacaaccaggattccgaagatgaattatag

SEQ ID NO: 215575 - DNA, 2133 bp, Artificial Sequence
  Description of Artificial Sequence: Synthetic coding sequence
atggtcatggcctgtcgcgtggtgaataagcgtcgtcatatgggcctgcagcaattatcaagctttgctgagacgggtcggacattcctgggaccactaaagtctagcaagttcataatcgacgaggagtgtcacgagtctgtcctgattagcagcaccgtccggctgttggagtcgctcgatctgacatctgccgtgggccagctactcaacgaagcagtccaagcacagaataatacatacaggaccggaatctctaccctgctgtttctggtgggcgcttggagcagtgcggtcgaggaatgtctgcatcttggggttcctatttccattattgtcagcgtgatgtctgaggggctgaatttctgttcagaagaggtggtatctctccatgtccccgttcacaacattttcgattgcatggattccaccaagacgttctcccagctagaaacattttctgttagcttatgtccctttttgcaggtccctagcgacactgatttgatagaagagctgcacggactgaaagacgtggcgtctcagaccctgactatctccaatctgagcggaagacccttaaagtcttacgaattgttcaaacctcagactaaagtcgaggccgacaataacactagccgcaccctaaaaaattcactgttggctgacacctgttgtaggcagtcaatcttgattcacagtcgacacttcaatcgcaccgataacacagagggcgtgagcaagccagatgggtttcaggagcatgtgacggcgacccataaaacctaccgctgcaatgatttggtggagcttgctgtcggtttgtctcatggagaccacagctcaatgaaactcgtggaggaagccgtgcagctgcagtaccagaatgcatgcgtccagcaggggaactgcacaaaacctttcatgttcgacattagtagaatctttacttgctgtctgcctggacttcccgagacctcctcctgcgtgtgcccaggctacataaccgtcgtgagtgtaagtaataatcctgtgatcaaggaactgcagaaccagcctgtacgaatagtgctgattgagggggatctcaccgaaaactatcgccatttgggcttcaacaaatccgccaatatcaaaactgttcttgactccatgcgcctccaagaagactcctccgaagaattatgggccaaccacgtgctccaagtccttattcagtttaaggtgaacctggtgctggtgcagggcaacgtgtccgaacgcttgatcgaaaagtgtattaatagcaagagactggtcattggtagtgtcaatggatccgtgatgcaagcattcgcagaggccgcaggggcagtgcaggtggcatacataacccaggttaatgaagactgcgtgggcgacggtgtctgcgtgactttctggaggtctagtcccctggatgtggtggatcgtaataacaggatagcgatcttactcaagactgaggggataaacctggtgacagctgtgctgaccaatccagtgactgctcagatgcagatcaaggaggaccggttctggacatgtgcctataggctttattacgccctgaaggaggagaaagtattcctgggaggcggagccgtggaattcctctgcctgtcttgtcttcatatcctcgccgagcagtcactgaaaaaagagaatcatgcttgtagtgggtggctgcataacacaagtagttggctggcatcttcactcgctatttaccgccctacagtgctgaagttccttgctaatgggtggcaaaaatatctgtcgacactgttatacaataccgccaactattcatcggagttcgaagcttccacctatattcagcatcacctgcaaaatgcaaccgacagcggcagtccatcttcatacatactcaacgagtactcaaaacttaactcccggatttttaactctgacatctcaaataaattagaacaaattcccagagtatacgatgtcgtcactcccaagatcgaggcctggaggcgagccctagacctggtccttctggtgctccagaccgattctgaaattatcaccggacatgggcatacacaaatcaatagccaggagttaacaggctttctttttctgtag

SEQ ID NO: 215576 - DNA, 576 bp, Artificial Sequence
  Description of Artificial Sequence: Synthetic coding sequence
atggttatggcctgccgcgtggtgaataagagacgtcacatgggactacagcaactcagcagcttcgccgaaaccggacgcacgttcctaggccctctgaagtcaagcaaatttataattgacgaggaatgccatgagtcggttctgatttcttctacagtgagactgctggagagtctcgatctgacttctgccgtggggcagctattgaatgaagcagtccaggcccagaacaacacatacagaaccggcatcagcacgctcctcttcttggtgggggcatggtccagtgccgtagaggagtgtctgcatttaggcgtacctatctcgatcattgtgtccgtcatgtccgagggtctgaatttttgtagcgaagaggtggtctccctccacgtgccagttcacaacattttcgactgcatggatagcacaaaaacgttttctcagttagagacattttcagtctctctgtgcccctttcttcaagtgccaagcgatactgacctgattgaggagctacatggcctgaaggatgtggcatctcagacattaacgattagtaacctttccggctag

SEQ ID NO: 215577 - DNA, 2133 bp, Artificial Sequence
  Description of Artificial Sequence: Synthetic coding sequence
atggtcatggcttgcagggtcgttaacaagcggagacacatgggtttacagcaattaagctcgttcgctgaaacaggccgaacatttctcggaccactgaagagttctaagttcattatcgacgaggagtgccatgagtcagtgctcatttcttctacagtgagactgcttgagagcctcgacctgacttcagccgtcgggcagctgctgaacgaggccgtgcaggcccagaacaacacctatcgaaccggcatttcaacgttgctctttttggttggtgcctggagcagtgcagtggaagaatgcttgcatttgggggtgcctatctcgatcatcgtgagcgtaatgagcgagggcctgaatttttgttccgaagaagttgtttctctgcatgtcccagttcacaacatcttcgattgcatggatagcaccaagacattctctcaactcgagacgttctccgtttctctttgcccattccttcaagttcctagcgacaccgacctgatcgaggagcttcatggacttaaggacgttgcatcgcagacactcactatcagcaatctctcaggtagacccttaaaatcctatgaattgttcaaacctcaaaccaaggtggaagctgacaataatacctcccggactctgaaaaacagtctacttgctgacacatgctgccggcagtccattctcatccattcccgccattttaacagaaccgataatacagaaggcgtctctaagccggatggctttcaggaacacgtgaccgccacacacaagacgtatcgttgcaatgacctggttgagctggcagttggactgagccacggagaccatagcagtatgaagctcgtggaggaagccgtacagctgcagtatcagaatgcctgcgtccagcagggaaattgcacgaagccttttatgttcgatatctcacgcatatttacctgttgtctgccgggtctgccagaaacgtcaagttgcgtctgtcctggatatatcactgtggtctctgtgagcaacaatcctgtaattaaggagcttcaaaaccaacctgtcagaattgtgctgattgagggggacctgaccgagaattatagacatctgggatttaataagtcagccaacattaaaacggtgctggattccatgcgactgcaagaagactcaagcgaggagctctgggcaaatcatgtgctccaggtgttgattcaatttaaggttaacctcgtactcgtacagggcaatgtgtccgaaagactgatagagaagtgcataaattctaagcgtctggtcatcggttcagtgaacggcagcgtgatgcaggcgttcgccgaggccgctggtgcggtgcaggtagcctacatcacccaagtgaacgaggattgcgtgggggacggcgtttgcgtgaccttctggaggtcctcgcccctcgatgtggtggacaggaacaatcgcatcgccattctcttgaaaactgagggaattaacctagtcactgcagttctaacgaaccccgtcacagcgcagatgcagattaaggaggacaggttttggacttgtgcgtacagactctattacgccctcaaggaggaaaaagtcttcctggggggtggagctgtggagttcctctgcctgtcatgtctccacatactggcagagcaaagccttaagaaagagaatcatgcctgctcaggatggctgcacaatactagttcctggcttgccagctcattggccatttacaggcctacggtcctgaaattcctggctaacgggtggcaaaagtacttgtctaccctgctgtacaacacagctaactactcatccgaattcgaagcttcgacctatatccagcatcaccttcagaatgctaccgacagtggctctcctagctcctacatcctcaatgaatactcgaagctaaattcccggatctttaacagtgatataagcaacaaactggagcagattccgagggtgtacgacgtggtcactcccaagatcgaagcctggaggagggccttggacctggtgctgctggtgctgcagactgacagcgagattattaccggacatggccatacacagatcaattctcaggaactgactgggttcttgtttttgtag

SEQ ID NO: 215578 - DNA, 2166 bp, Artificial Sequence
  Description of Artificial Sequence: Synthetic coding sequence
atgctactccctgtcttcacactgaagctgcgtcataaaatctcaccaagaatggtggctattggtagatacgatgggacacatccctgcctggctgcagctacccaaaccggcaaagttttcattcataacccgcatacccgcaatcagcatgtgtctgcttcacgcgtcttccagagtcccctcgagtccgatgtttctttgctctctatcaaccaggccgtcagttgtcttacagcaggagtgcttaaccccgagctaggctatgatgcactgcttgtggggacacagacaaatttactggcgtacgacgtgtacaataatagcgatctcttttaccgcgaggtggcagacggagccaatgccatcgttctgggcacgcttggcgacatcagtagccctctggccataattggcggaaactgcgcactccagggcttcaaccacgagggatccgatctgttttggaccgtcaccggcgacaacgttaactctctggcgttatgcgactttgacggtgacggaaagaaagaactactagttggctcagaagactttgatatcagagtgttcaaagaggatgaaatcgtagcggagatgaccgaaacagaaatcgttaccagcctgtgcccgatgtatgggtccagatttggctatgcactgtccaacggcaccgtgggcgtatacgataaaacgtcccgctattggaggatcaagtccaagaaccatgctatgagtattcacgcatttgaccttaactccgatggagttaacgaattgattaccggatggagtaacggcaaggtggatgctcgttctgatagaacaggtgaggtgattttcaaagataattttagcagcgctattgcgggagtggtagagggcgactataggatggacggacacatccagctcatctgctgctctgttgatggggagattcgaggttatctgcccggaactgccgagatgcgcggtaacttgatggacaccagcgccgaacaggatctcattcgggagctctctcagaagaaacagaatctgctgctggagttgcgcaattatgaagagaatgctaaggcagagctggctagcccccttaacgaagccgacgggcatagaggcatcatccctgccaatacaagattgcacaccacactgtctgtttctctgggaaacgagacccaaaccgctcatacagagctccggatatctacctccaatgataccatcatccgggctgtgctgattttcgctgaggggatctttacaggcgaatcacatgttgtacacccttcgatccacaacctatcgtctagcatctgcatccccattgtgcctccaaaagatgtgccggtagatctgcacttaaaggctttcgttggatatcgtagcagcacacagttccatgtgttcgaaagtaccaggcagctgccacgatttagtatgtacgcactgacctcgctggatcctgcgtcggagccgatcagctacgtgaactttacaatcgccgaaagggcacagagggttgtggtttggctaggtcagaattttttgctaccggaagacacgcatatccaaaatgccccttttcaggtgtgtttcacctccctgcggaacggcggacatctacatatcaagatcaagctctccggggagattaccatcaacaccgatgatattgatctggcgggagatatcatccagtcaatggcgtcatttttcgctattgaggacctgcaggtcgaagctgactttcctgtgtactttgaggagcttcgtaaggtgctggtgaaagtggatgaatatcactccgtgcatcagaaactctcggctgacatggcggatcactccaacttgatcaggtctcttctggtcggggctgaggacgcccgactgatgagggacatgaagactatgaaaagccgttacatggagttgtatgatcttaatagagacttactcaacggttataaaatccgttgcaacaatcatacagaactcctgggcaacctgaaagcagtgaaccaagcaatccagcgcgcagggaggctgagagtagggaagcccaaaaatcaggtaattacggcttgcagagatgccattcgtagcaataacatcaacacccttttcaagatcatgagggttggcaccgcttccagctag

SEQ ID NO: 215579 - DNA, 1560 bp, Artificial Sequence
  Description of Artificial Sequence: Synthetic coding sequence
atggctgaggagcgcgtagcaactagaacccagtttcctgtgtcaactgagagccaaaaacccaggcagaagaaagcccctgagttccccatcttagagaagcagaattggctaattcacctccactatattagaaaagactacgaggcctgcaaagctgtaattaaagagcagctgcaggaaacccaggggttgtgtgagtacgcaatttatgtgcaggctcttatttttaggttagaaggtaatatccaagaatctctggagctctttcagacctgtgcagtgctctctccacagtcggccgacaatcttaaacaggtcgcacggtccttgtttctgctggggaaacacaaggcagcaatcgaggtgtataacgaggcagcaaaattaaaccagaaggattgggaaatatcacacaacctcggcgtctgttatatttatttaaaacagtttaataaagcccaggaccagcttcacaatgccctgaatttgaaccgacacgatctaacttacatcatgcttggcaagattcatctgctggaaggagatctcgataaagctattgaggtctacaagaaggctgtcgagttttcccctgagaacacggaactgctgacaaccctgggactgctttaccttcagctcggtatttaccagaaagcgtttgagcaccttggcaatgccctgacctacgaccccaccaactacaaggccattctggccgcagggtctatgatgcagactcacggcgactttgatgtggcactcacgaagtaccgtgtggtcgcgtgcgccgtaccggagtcacctcctctgtggaataacattggcatgtgctttttcggtaagaagaagtacgtggccgcaatatcctgtcttaaaagagcaaactaccttgcgccatttgactggaaaattctgtacaatttaggcctcgtgcacctcacaatgcagcagtacgcctcagcatttcatttcctgagtgccgcaataaacttccagcccaagatgggcgagctgtacatgttgctggccgtggccttgactaacctagaagacatagaaaatgcaaaaagagcctacgccgaagcagtgcatcttgataagtgcaatccccttgttaacctgaactatgcagtgcttctgtataaccagggagagaagaagaatgccctggcccagtaccaggagatggaaaagaaagtgagtctgctaaaggataattccagcctggagtttgacagtgagatggtggaaatggctcagaagctgggagctgcgctccaggtgggagaggcccttgtttggaccaagcctgtgaaggacccaaaatctaaacaccagacaactagcacttccaaaccagcctctttccagcaaccgctagggagcaaccaggccctcgggcaggccatgtcttcagctgccgcttacagaactctgccaagcggggctggaggaactagtcagttcactaagccaccgtctctcccgctggaaccagagccggcagtggaatcctcaccaaccgagacatctgagcagattcgtgagaagtag

SEQ ID NO: 215580 - DNA, 1584 bp, Artificial Sequence
  Description of Artificial Sequence: Synthetic coding sequence
atggccttgaccgtcgtgccctccttttctgtgtctggcgtctggaaacgcacccagtttccagttagcacagagtctcagaagcccaggcagaagaaagcacccgaattcccaatcctggagaagcagaactggctgatccatctacattacattaggaaagactatgaggcttgcaaagccgttatcaaggaacagcttcaagagacacagggactatgtgagtacgccatctatgtccaggccctgatctttagactcgagggtaatatacaagaaagcctggagttgtttcagacctgtgccgtgctgtcaccacagagtgccgacaatctgaaacaggtggcccgttctctgttccttttgggcaaacacaaggctgctattgaggtctacaacgaggcagccaagctgaaccagaaggattgggagattagtcataatctaggggtgtgttacatctacttgaagcagttcaataaggcacaggatcaactgcataacgcactgaatctgaaccggcatgatctgacttacatcatgctggggaaaatccacctgctggaaggcgacctggacaaggctatagaggtctacaagaaagccgttgagttctcccccgaaaatactgaactcctcaccacacttgggttactatatctgcagctcggaatctaccaaaaagcttttgagcatctgggaaacgccctgacatacgatcctaccaactataaggctattttggccgctggctcgatgatgcagacccacggggatttcgacgtggcgttgacaaagtatcgggtggtcgcttgcgctgtgccagagtccccccctctctggaacaacattggcatgtgctttttcggaaaaaagaagtatgtggctgccataagctgcctgaagcgggcaaactaccttgctcctttcgattggaaaatcctgtacaatttgggcctggtccaccttactatgcaacagtatgcgagcgccttccacttcttgtccgcagctattaatttccaacctaagatgggcgagctctacatgttgctagctgtcgctcttaccaacctggaagacattgagaatgccaagcgggcttatgccgaagcagtccacttggacaagtgtaacccgcttgtgaaccttaattacgctgtgttgctgtacaaccagggagaaaagaagaatgccctggcccagtaccaggagatggagaaaaaagtcagcctcctcaaagacaactcatccctggagtttgacagtgaaatggtcgaaatggctcaaaaactcggagccgctctgcaggtcggcgaggccttggtttggacaaaaccagtgaaggaccctaaatcgaagcatcagactacaagcactagcaaaccagctagttttcagcagccacttggctccaatcaggctctgggccaggccatgagctcagccgctgcctatcgtaccctcccctccggagcagggggtactagtcagtttactaagcctccgagccttcctctggagcccgagcctgctgttgaaagtagccctacagagacgtcggagcagattagagaaaaatag

SEQ ID NO: 215581 - DNA, 1524 bp, Artificial Sequence
  Description of Artificial Sequence: Synthetic coding sequence
atgatatggaacactcggaactctacttacatcttcactgcccctgaattccctattctggaaaagcagaactggctcatccacctgcattacatccgcaaggattacgaggcctgcaaagcggtgataaaagagcagctgcaagagacgcagggcctctgtgaatatgcaatttacgtccaagcactcatttttaggctggaagggaatattcaggagagcctggaactgttccagacatgcgctgttctgtctccccagtcagccgacaacctcaagcaggtggcacgctctctatttttgcttggcaaacataaagctgcaattgaggtctataacgaggctgcaaaactcaatcagaaagattgggaaattagccacaatctgggcgtttgttacatttatctcaagcaattcaataaggcccaggatcaactacataacgccctcaatctgaacagacatgaccttacttatataatgttaggcaaaatacacttgctggagggcgaccttgacaaggcaattgaagtgtacaaaaaggccgtcgagttttctcctgaaaacactgagctcctgacaaccctgggcctgttgtatcttcagttggggatttaccagaaggcatttgaacacctgggcaacgctctgacctacgatccaactaactataaagctatccttgcagccggatctatgatgcagacacacggtgattttgacgtagcgctgacaaagtaccgggttgttgcctgcgccgtgcccgaatcacctcctttgtggaataacatcggaatgtgcttcttcgggaaaaaaaagtatgtggctgcaatttcttgtcttaaacgggctaactacctggccccattcgattggaagatcctgtacaacctgggactggtgcatctcaccatgcaacagtatgcttccgcatttcacttcctctccgcagcaatcaactttcagcctaaaatgggcgaattgtatatgctgctggccgtagctcttacaaatctggaggacatcgagaacgcaaagagagcatacgcggaagccgtgcatctcgacaagtgcaaccctctggtaaacctcaactacgccgtcttgctatataatcagggcgaaaagaagaatgccctcgcccagtaccaggagatggagaaaaaggtgagtctcttgaaggacaattcatctctcgaattcgactcggagatggtggaaatggcacagaaactgggcgctgccctgcaggtgggcgaggctctagtgtggacgaagccggtgaaggacccaaaatctaaacatcagactactagcaccagcaaacctgcgtccttccaacagcccctcggatcaaaccaggccctcggacaagccatgtctagtgccgctgcttaccgaactcttccttcaggtgcaggcggtacatcgcaattcacaaagccgccatcactccctcttgagccagaaccagccgtagagagttctccaaccgagaccagtgaacagatccgggagaaatag

SEQ ID NO: 215582 - DNA, 1044 bp, Artificial Sequence
  Description of Artificial Sequence: Synthetic coding sequence
atgttggggaagatccacctgctggagggcgatctcgacaaggcaatcgaggtttataaaaaagcggtcgaattctctcccgagaacaccgaactgttaacaactctcggcctgctgtacctgcaactaggtatttaccagaaagctttcgagcatctgggcaatgccctgacctacgacccgaccaattataaggccattctcgctgccggtagcatgatgcagacccatggtgacttcgacgtagctttgaccaagtatcgagttgtggcatgcgccgttccggaaagtcctccactctggaacaacatcggaatgtgtttttttggtaagaagaaatacgtggccgcaatttcatgccttaagcgggctaattacctggcacccttcgattggaaaattctttacaacctgggcctggtgcaccttaccatgcagcagtatgcctcagcctttcattttctgtcggctgccattaatttccagccaaaaatgggagaactgtacatgctcctggccgttgccttaacaaatctggaagacatcgagaacgctaagagggcttacgcagaggccgtgcatctggataagtgtaatcccttggtgaacctgaactacgcggttctgctgtataatcaaggcgagaagaaaaacgctctggctcagtaccaggagatggagaagaaagtgtcactgcttaaggacaatagttcactcgagtttgactctgagatggtcgaaatggcccagaagttaggagctgctctccaggtcggcgaggcactggtgtggacaaagcctgtgaaagatcccaagtcaaaacatcagaccacctcaacttccaaacccgcttctttccagcagcctttggggagcaaccaggcccttgggcaggctatgtcaagtgccgctgcctataggacactcccctccggggcaggtggaacatcacagtttacaaagccacccagtctgccactggaaccagagcctgccgtcgaatcgtcccccacagaaacgagcgagcaaattagagagaaatag

SEQ ID NO: 215583 - DNA, 1026 bp, Artificial Sequence
  Description of Artificial Sequence: Synthetic coding sequence
atgtctgtactagacgctttgtgggaagatagggatgtcagatttgacctttccgcacagcagatgaaaactcggccaggggaagtccttattgactgcctggacagcattgaggacaccaaaggcaataacggagatcgaggtagactcctagtaactaatcttagaatcttgtggcattctcttgccctatcacgggtcaacgtctccgtcgggtataattgtatcctcaacataaccactcgcactgccaattcgaagctgaggggtcagactgaggccttatacattttaacgaaatgtaactctaccaggttcgaatttattttcactaacctggtgcccggttcaccccgtttgtttacaagcgtaatggccgtgcacagagcatacgagacttcaaaaatgtaccgggatttcaagttacggagcgcactcatacagaacaaacagctccgtctcttaccccaggaacatgtatacgacaaaatcaatggtgtgtggaatttgtcctctgatcaggggaacttagggacattctttataaccaatgtccgcatcgtgtggcatgccaatatgaacgacagtttcaatgttagtatcccgtacctccagattagatctataaagattcgcgattccaaatttggactagctcttgtcatcgaaagttctcaacagtccggcggatacgttcttggattcaagatcgaccctgtggagaagctgcaggagtcagtaaaggaaattaactccctgcataaagtgtattccgcctcaccaattttcggggtggactatgagatggaggagaagccacagccgctcgaagccttgactgtggagcagatccaggacgacgtcgaaatcgactccgacggtcatactgatgccttcgtggcgtatttcgctgatggcaataaacagcaggatcgcgagccagtcttttctgaagagctagggctagccattgagaagctgaaggacgggttcactctacagggcctctgggaagttatgagttag

SEQ ID NO: 215584 - DNA, 963 bp, Artificial Sequence
  Description of Artificial Sequence: Synthetic coding sequence
atgtccgttctggacgctctctgggaggacagagacgtcagattcgatttgtccgctcagcagatgaagacccgcccaggcgaagtgttgatcgattgcctggactcaatcgaggatactaaaggcaacaacggagaccgcggtcgcctgcttgtgaccaatcttaggatactgtggcactctctagcattaagtagagttaatgtgtctgtcgggtataactgtattcttaacattaccacccgtacagcaaattccaagctgcggggacagaccgaagcactttacatcctgaccaagtgtaacagcacaaggtttgagttcatctttactaacctcgtcccaggctctccccgactcttcaccagcgtaatggccgtgcacagagcatacgaaacttccaagatgtaccgcgattttaagctgaggtccgcactgatccagaacaagcagctacggctactgccccaggaacacgtttacgataagataaatggtgtttggaacctcagctcggaccaggggaacctggggaccttctttataactaatgtcagaattgtatggcacgctaatatgaacgattcttttaacgtgtccattccatatctccagatttctgggggttatgtcctcggtttcaagattgatcccgtggagaaattacaggagtccgtcaaggaaatcaacagcctgcacaaggtctactccgcctctccaatctttggagtggattacgaaatggaagagaagccccagcctctcgaagcccttaccgttgaacagatacaggacgatgtagagattgattccgatggccatacggatgcattcgtcgcctattttgcagatggcaacaaacagcaggatcgcgaacccgtattctctgaagagctgggcctggcaattgagaagctgaaggatggatttaccctccaggggctctgggaagtcatgtcgtag

SEQ ID NO: 215585 - DNA, 1635 bp, Artificial Sequence
  Description of Artificial Sequence: Synthetic coding sequence
atgtctgtactcgacgccctgtgggaggatcgcgatgtgcgatttgacttgtcagctcaacaaatgaagacaaggcctggggaggtccttatcgattgcctcgattctatcgaagataccaagggcaacaacggagaccgtgggaggcttcttgttaccaatttaaggattctgtggcactccctcgctttaagtcgggtgaacgtgagcgtaggttacaactgtatacttaatatcaccaccaggacggccaactccaaactgcgcggacagaccgaagccctgtatatcttaaccaaatgcaattctacccggtttgagtttatattcaccaacttggtccctggctctccgaggctgttcacctctgtaatggccgttcatagggcttacgagacttccaaaatgtaccgcgattttaagctgaggagtgccctgatccagaataagcaactcagactgctgccacaggaacatgtctacgataaaatcaacggagtgtggaatctcagcagtgatcaaggaaacctgggtacttttttcattactaatgtaagaatcgtatggcacgccaacatgaatgatagctttaacgtttctattccctacctgcaaatcaggagcattaaaatcagagactctaaattcggtctcgctcttgtgatcgagagttcccagcaatccggagggtacgtgctggggtttaaaattgatcctgtggagaagctgcaggagtccgtgaaggagattaattccctgcataaggtgtattccgcttctccgatcttcggggtcgattacgaaatggaggaaaagcctcaacccctagaagccctgactgttgagcagatccaggatgacgtggagatagactcagacgggcacactgacgcttttgtcgcctactttgctgacggtaacaaacttgattccattgccagcgaatgggtgggcctgccccctctgcctagcgcccgttgcctttttgggctgggagaagtggatgacaagatatatgtggtcgctggaaaagacctgcagaccgaagccagccttgattccgtcctttgctatgacccagttgcggcaaagtggaatgaagtgaaaaagctacctatcaaagtatatggtcacaacgtgatatctcacaaagggatgatttactgcttgggcggaaagacagacgacaagaagtgcaccaaccgtgtgtttatcttcaaccccaaaaagggcgactggaaagatcttgccccaatgaaaatccccaggtcaatgtttggcgtggccgtgcataagggtaaaatagttattgcgggtggcgtgactgaggatggtctgtctgcctccgtcgaggcctttgatcttaccacaaataaatgggatgtgatgaccgaatttccccaggagagaagttcaatctctcttgtgtctcttgctggtagcctgtacgcaatcggaggattcgcaatgatccagcttgagtcaaaggaatttgctccaaccgaagtcaacgatatttggaaatatgaagacgataagaaagagtgggccggtatgctcaaagagattcgctatgcaagtggtgcaagctgccttgctacacgcttaaatctgtttaagctatccaaactgtag

SEQ ID NO: 215586 - DNA, 2148 bp, Artificial Sequence
  Description of Artificial Sequence: Synthetic coding sequence
atggatttgattctgaaccgcatggactatctacaggttggcgtgacatcccagaaaaccatgaagctcatccctgcctcgcgacaccgcgcaactcagaaagtggtcataggggaccacgatggggtagtgatgtgtttcggcatgaaaaagggtgaagccgctgctgtgtttaagactctgcctggacccaaaatagcacggcttgagctgggaggcgtgatcaacaccccgcaagagaagattttcattgcagcagctagtgaaatccgagggttcactaaaagaggtaaacaattcctcagctttgagaccaacctgacagaatccattaaagctatgcatatttccggaagtgacctcttcctttccgccagctacatctacaatcactattgtgactgtaaggatcaacactactacctcagcggtgataaaattaatgacgtgatttgtctgcctgtagagaggttgtctcggattacacctgtcctcgcctgtcaggacagagtcctaagagtcctgcaggggagcgacgtcatgtacgccgttgaagttcctggcccacctacggttctggctctccacaatgggaatggcggagatagtggtgaagatctcttgtttgggacaagtgacgggaagttagcgctgatacagatcaccactagcaagccggtgcgtaagtgggaaatacagaatgagaagaagcgcggtggcatactgtgtatcgattcctttgacatcgtgggcgatggagtaaaagatctgctggtgggtcgagacgacggcatggtggaagtgtattcctttgacaacgctaacgagcccgtgctaagatttgatcagatgctgtctgaatcagtgactagtattcagggaggctgcgtggggaaggattcctacgacgaaatcgtggtctccacctacagcggctgggtgaccggcctcactacagagcctatccacaaggagagtggcccaggtgaagagttaaagattaatcaggagatgcagaacaagatttcaagtctcaggaatgagctggagcatctccagtataaggtcctgcaggagcgcgagaattaccagcagtcttcacagtcaagcaaagctaagtccgccgttcccagtttcggcattaatgataagtttacactgaataaagatgatgcctcttattccctgatcctggaagtccagacggctatcgacaacgttcttatccaatctgacgtgcccatagatctcttggacgtggacaaaaactcagcagtcgtgagtttttcctcctgtgacagtgaaagcaacgacaactttctgctcgccacatataggtgccaagctgataccacccggctcgagctgaaaatacggagtatagaggggcagtacggcactctccaggcctatgttactcctcggatacaaccaaaaacatgtcaagtaaggcagtatcatattaagcccctgtccctccaccagcgcacccacttcattgaccacgatcgccctatgaacaccctgaccctgaccggccagttttcttttgctgaagtgcatagctgggtggtattctgccttcctgaggtgcctgaaaaaccgcctgctggcgaatgtgtgactttttacttccaaaacaccttcttagacactcagctagagtccacctaccggaaaggcgagggcgtgttcaaatctgataatatctctactatatccatccttaaggacgtgctctctaaggaagcaacaaaacggaagatcaacctgaacatatcctatgagatcaacgaggtcagcgtgaaacacaccttgaagctcatccatcccaagttggagtatcagctcttgctggctaagaaagttcagctgatcgacgcactgaaagaactgcagattcatgagggcaacaccaattttcttatccccgagtaccactgtatcctcgaggaggccgaccatctccaggaagagtataaaaaacagccagctcacctggaaaggttgtacgggatgattacagatctcttcatcgacaaatttaagttcaaagggacaaatgtgaaaactaaggttccactcctgttggagatcctcgactcctacgaccaaaacgccctgatctcctttttcgacgccgcatag

SEQ ID NO: 215587 - DNA, 2019 bp, Artificial Sequence
  Description of Artificial Sequence: Synthetic coding sequence
atggacctgatattgaacagaatggattatttacaggtgggagttacaagccagaaaaccatgaagttgatccctgcctctcgccacagagccacacagaaggtggtaatcggggaccatgacggggtagtgatgtgcttcggcatgaagaagggggaggcagctgctgtgtttaaaactctgccgggtcccaaaattgctcgtttggaactgggaggtgttatcaatactccccaggagaaaatctttatcgctgcagccagcgagatacgcggattcaccaagagagggaaacaattcttatcctttgagacaaatctgaccgagtccattaaggccatgcatatctccgggagcgacctgttcttatcagccagctacatatataaccactattgcgattgtaaggatcaacactactacttgtctggagataaaattaatgacgtcatatgtctgcccgtggaaagattgtcccggatcacaccagtgctggcctgtcaagatcgggtgctgcgagttttgcaggggtctgatgttatgtacgcagtggaggtgcccggaccacctacagtattggccttgcacaatgggaacggaggcgattccggcgaggatctgctttttgggacctccgacggtaaactcgcgctcattcaaatcactacctctaaaccagtccgcaaatgggagattcagaacgagaagaaaagaggcggaatcctgtgtattgactccttcgatatagttggcgatggcgtaaaggacctgctggtcggcagagatgacggaatggtcgaggtgtatagcttcgataatgcgaacgaaccggtgttgcggttcgaccaaatgctcagtgagtccgtgacatcaatacagggtggttgcgtgggaaaagattcttacgatgagatcgtagtgagtacctattctggctgggtgaccggcttgaccacagagcccattcataaagagtcaggcccaggagaggaactcaaaataaaccaggaaatgcaaaataagatatccagcctacggaacgagttggagcacttacaatacaaagtactgcaggaaagagaaaactatcagcagagcagtcagtcttctaaagccaaatcagcagtgccctctttcggcatcaacgacaagttcacactcaataaggacgacgcctcttattctctaatcctggaagttcaaaccgctatcgataatgtcctgatccagagtgatgtccctatcgacctgttggacgtagacaagaattcagctgtcgtgtctttttcgagttgcgacagtgagagcaatgataatttcctgctggccacttaccgatgccaagccgataccacacgtctggagctgaagatcaggtcaatagagggtcagtatggcacattacaggcctacgtcaccccgaggattcagcccaagacatgtcaagttcggcagtatcatataaagcccctcagcttacatcaacgaacacacttcatcgaccatgaccggccaatgaacactctaaccctgacgggccagttctcctttgccgaggtacattcgtgggtcgtattttgtctcccagaggtccccgagaagccgccagctggagaatgcgtgaccttttatttccaaaataccttcctggacactcagctcgagtcaacctaccgtaagggcgagggcgtctttaagtccgataacatatcaactatatctatactcaaggatgtgctttccaaagaagccaccaaacgcaaaatcaacttgaacattagctacgagatcaacgaagtgtccgtcaaacatacgttgaagctgatccacccaaagctggagtatcagttactgctggccaaaaaggtgcaactgattgatgctctgaaagaacttcagatccatgaggggaacaccaattttctcattccagagtaccactgtatcctggaggaagctgatcatctgcaagaagaatataagaaacagcctgcacaccttgagcgcttgtatggatag

SEQ ID NO: 215588 - DNA, 417 bp, Artificial Sequence
  Description of Artificial Sequence: Synthetic coding sequence
gacgtactgtcaaaggaagctacaaaacggaagattaaccttaatatctcttatgagattaacgaggtgtctgtgaagcataccctgaagctcatccaccctaagctggaataccaactgctgttggctaaaaaagtgcagctgattgatgcactgaaggaactgcagatacatgaggggaatactaatttcttaattccagaatatcattgtattctggaggaggccgaccatttacaggaggagtataaaaaacagcctgcccacttggagaggctgtacggcatgattaccgaccttttcatcgacaaattcaaattcaagggtacgaatgtcaaaactaaggtacccctgcttctggagattctggattcatatgaccagaacgcgctgatcagcttttttgacgctgcctag

SEQ ID NO: 215589 - DNA, 2664 bp, Artificial Sequence
  Description of Artificial Sequence: Synthetic coding sequence
atgtcactcttcaaggccagggattggtggagtacaatcctcggggacaaagaagaatttgatcaaggctgcctgtgcctggcaaacgttgataattcaggcaatggtcaggataagattatagtgggaagctttatggggtacctgcgcatattcagcccgcaccctgctaagaccggtgacggtgctcaggccgaggacctccttctggaagtcgacctaagagacccagtacttcaagttgaagtcggaaagtttgtgtccggtaccgaaatgctgcacttggcagtcctccattctagaaaactgtgtgtgtacagcgtgtctggaacattaggcaacgtcgagcatggaaaccagtgccagatgaagcttatgtatgaacacaatttgcagcggactgcctgcaacatgacctatgggagttttggcggtgtgaaaggaagggacctgatttgcatccaatcaatggatggaatgctgatggtgttcgagcaggagagctatgcgtttgggcgattcttgccagggtttctcctgcccggtccactcgcctatagctctcggacagacagttttctgacggtgtcatcatgccagcaagttgagagttacaagtatcaggttctggcctttgccacagatgccgataaaaggcaggaaacagaacagcagaagttggggagcgggaagcgcttagtcgttgattggaccctcaacattggcgagcaggctttagatatctgcatcgtctcctttaaccagtctgcctcctcggtcttcgtactaggcgaaagaaactttttctgccttaaagataacggtcaaattcggtttatgaaaaagctagattggtcacctagttgtttcctaccttattgtagcgtgtccgaggggacgatcaatactctaattggaaaccacaataacatgctccacatctatcaagacgtgactctgaaatgggccactcagctccctcatatacccgtggcagtgcgcgttggctgcttacatgatttgaagggggtgatcgtaacactcagtgatgacgggcacctgcaatgcagttatctcggtacggatccatcactgttccaagctcccaatgtgcagagcagggagctcaactatgacgaactggacgtggaaatgaaggaattacagaagatcataaaagatgttaataagagccagggagtgtggccaatgaccgaacgtgaagatgatctgaatgtgagtgtggtcgtttcccctaactttgatagcgtaagtcaggcaaccgacgttgaagttgggacagacctggtgccaagtgtgactgtaaaggtgaccttacagaacagggtcatcttgcagaaggccaaattatccgtgtatgtgcagcccccattggagctcacatgtgatcaattcacatttgagttcatgaccccagatctgacaagaactgtcagcttcagcgtgtatttaaagaggagctacacgccgagtgagctcgaaggtaatgcagtagttagctactctaggcccactgatcgtaaccctgatggaattccccgagtgattcagtgcaagtttcggctgcccctgaagctgatatgcctgcctggacagccgagtaaaactgccagtcacaagattaccattgatacaaataagtctcccgtctcactgttaagcctgtttccaggcttcgcctctcagtccgacgatgaccaggtcaacgttatgggatttcacttcctgggaggggctcggattacagtgctggcttccaaaacttcccagagatatagaattcagtccgagcagttcgaagatttgtggttgatcactaatgagttgatcttacggctgcaggaatattttgagaagcaaggcgttaaggactttgcgtgctctttctcagggagcatccctctgcaggagtatttcgagcttatcgaccaccactttgaactccgaattaatggtgagaagctggaagaactgctaagcgagcgagcagttcaattcagggccatacaacggcgactgctggccaggttcaaggacaaaacacccgctcctcttcagcacctggacacgctgctggacggtacctataagcaggtgatagccctcgccgacgctgtggaggagaatcaggggaatctttttcaatcgttcacacgcctgaaaagcgccactcatctggttatccttttaattgccctctggcaaaaattgagcgcagatcaagtcgcaattctggaagccgctttcctaccattgcaggaggatacccaggaactgggctgggaagagacggtcgacgccgcaatatcacacctgctaaagacctgtctgagcaagagtagtaaggagcaagccttgaacttgaactctcagttaaatattcctaaggatactagtcagttgaagaagcacataacactgctgtgcgacaggctgtcaaagggaggtaggctgtgtttgagtactgatgctgcagcgcctcagacaatggtgatgccaggaggctgcaccacgatccccgaaagcgatctggaggaaaggtccgtggagcaggactcaaccgagctgtttactaatcaccgtcacttgactgcagagaccccccgacccgaagtctccccgctccagggtgtctccgagtag

SEQ ID NO: 215590 - DNA, 2544 bp, Artificial Sequence
  Description of Artificial Sequence: Synthetic coding sequence
atgtctctctttaaagctcgtgattggtggtctactatactaggcgacaaggaggagtttgaccagggatgtctctgtctggcgaacgtcgacaatagcggcaacggccaggacaaaatcattgtcggaagctttatggggtacctcagaattttctcccctcacccggcaaagactggcgatggcgcacaggcagaggaccttcttctagaagttgacctgcgggaccccgttctgcaggtggaggtgggaaaatttgtcagcggaaccgagatgctccacctagctgtcctccactcaagaaaactgtgcgtgtactccgttagtgggactcttggaaacgtagaacacggcaatcagtgtcaaatgaagctgatgtatgagcataacctgcagagaacggcctgcaacatgacctatggttcattcgggggtgtgaagggccgagacctcatatgcattcaatctatggacggcatgctaatggttttcgagcaagaatcttatgctttcggacggtttctcccaggtttcctcctgcccggtcccctagcatattcctctcggaccgactcatttttaacagtgagtagctgccagcaagtggagtcctacaaatatcaggttctggcatttgccaccgacgctgacaaacgacaggagacagaacaacagaagctcgggagcggaaaacgtctagtcgtggactggacccttaatatcggcgagcaggctttggacatctgcatcgtgtccttcaatcagtcagcgtcctctgtattcgtgctgggagagaggaatttcttctgtctgaaggataatggacaaatccgattcatgaagaagcttgactggagcccctcttgctttctgccctactgttctgtgtcagagggcacaataaatacgctgatcggcaaccacaacaatatgctgcacatctaccaagacgtgaccctgaaatgggcaacccaactgcctcatattccagttgccgtgagggtggggtgtctgcacgacttaaagggagttatcgtgaccctgagcgatgacggacatctgcagtgcagctacctcggaaccgacccttctttgtttcaagcgcctaatgttcagtccagggagctgaactatgatgagcttgatgtcgaaatgaaagaactgcaaaaaatcattaaggatgtcaataagtcccagggcgtgtggccaatgaccgaacgcgaggacgatctcaacgtgagtgtggtggtttctccaaacttcgattcagtatcccaggctaccgacgtggaagtgggcacagatctagtcccttccgttaccgtcaaagttactctgcagaatagagtgatcctccagaaggcaaaattgtccgtctatgtccagccaccactcgaacttacatgtgaccagtttacatttgagtttatgtcaatcccacgggtcatccagtgcaaatttagattgcctctgaaactgatctgtctgcctggtcagccctcaaagactgccagccataagattaccattgacacaaataagtcaccggtctctcttctgtccttatttcccggatttgcgagccaatccgatgatgatcaagttaacgtcatgggattccattttttggggggtgcaaggataaccgtactggcctccaaaacatcccagcgttaccggatccagtctgagcaattcgaggatctgtggctaatcaccaacgagttgatcctgcgcctgcaggagtacttcgagaagcaaggcgtaaaagacttcgcttgcagtttttccggatccatccctctgcaggaatacttcgaactcattgatcaccactttgaactgcgaatcaatggagagaagctcgaagagctgctgagcgagagagccgtccaatttcgcgctatacaaaggaggctcctcgccaggtttaaggacaagacccccgcacctctgcagcacctggacaccttgctggatgggacctacaaacaggtgatcgcactagcggatgctgttgaggagaatcaagggaatctgtttcagtcttttacgcgtctgaaaagcgccactcatcttgtgattctgctgattgcattgtggcagaagctgtctgcagaccaggtggctatccttgaagctgccttccttcctctccaggaagacacccaggagctgggctgggaagagacagtcgacgccgcaataagccatcttctcaagacttgtctgtcaaagagttctaaagagcaagcccttaacctgaatagccaattgaacattcctaaggacacaagccagctgaagaagcatattactttgctttgcgacagactgtccaaaggcggacggctgtgcctatccacagacgccgcagcccctcagacaatggtgatgcccggtggctgtactaccattcctgagtccgacctcgaggaaaggagcgtagaacaggacagcacagagctcttcaccaatcaccgccatttaacggctgaaactccgaggccagaggtgtctccactacagggagtctcggagtag

SEQ ID NO: 215591 - DNA, 2559 bp, Artificial Sequence
  Description of Artificial Sequence: Synthetic coding sequence
atgagcctgtttaaggcccgagactggtggtctactatcctgggggacaaagaggagttcgaccagggttgcctgtgcctggctaacgtggacaactccggcaatgggcaggataaaatcatagtcggatcatttatgggatacctccggatattctctcctcaccccgctaaaaccggtgacggcgctcaggcagaggacctgctgctggaggtggatctccgggaccccgtgctgcaggtcgaggttggaaagtttgtcagcgggactgaaatgttacacctcgccgtcttgcatagtcgcaagctatgtgtttattccgtgtcggggaccctgggaaatgtggaacacggtaaccaatgtcagatgaaactgatgtacgagcacaatctccagagaaccgcctgtaacatgacctacggctcctttgggggtgtcaaaggccgagacctgatctgtattcaatcaatggacggcatgctgatggttttcgaacaagaatcatatgccttcggaagatttctgcccggattcctcttgcctgggccactggcctactcgtccagaaccgacagtttcctcaccgtgtcttcctgtcagcaagtcgaatcctataagtatcaggtgttggcattcgcaacggacgcagataagcggcaagagactgaacagcagaagctggggagcggcaagagactggtggtagattggactctgaacatcggcgaacaagccctggatatctgtatcgtaagcttcaatcagtccgcatcttcagtgtttgtcttgggggagagaaactttttctgtctgaaagacaacggacagattaggtttatgaagaagttggattggagcccaagttgtttcctgccttactgctccgtttcagaaggaactatcaacactctcatcggcaaccacaataacatgctgcacatttaccaggacgtgactctgaaatgggccacccagttgcctcacatcccggtcgcggtccgtgttggttgcctgcatgacctcaaaggtgtgatcgtgactcttagcgacgacggacatttgcagtgcagctacttgggaacagacccatccctcttccaggctcctaatgtgcagagcagggagctgaactatgacgagcttgatgtggaaatgaaggaattgcagaaaattataaaagacgtgaacaaaagtcagggggtgtggccgatgactgagagggaggacgaccttaatgtctctgttgttgtgagtcctaacttcgattcagtttcccaggcaaccgacgtggaagtgggcaccgatctggtgccatccgtcaccgtcaaggtaactctgcaaaatcgcgtcatcttacagaaggccaaactgagtgtgtatgtgcagcctccactggaattgacctgtgaccagtttacattcgaattcatgtccctcaatgtgttagggattcccagagtgatccagtgtaaattcagactcccactaaagctgatctgtcttcctggccagccctccaaaactgcctcacataagataactattgataccaacaagagccctgtcagccttttgtctctatttccgggattcgccagtcagtcagatgatgaccaggtcaacgtcatggggttccactttctaggaggcgctcgtataactgtcctggcatccaaaacatctcagcgctatagaattcagtcagagcagttcgaagacctgtggttgatcactaatgaactcatcctgcggctccaggaatactttgaaaaacagggagtgaaggattttgcttgctcattctcagggtccattcctctccaggagtatttcgagctgattgaccatcactttgaactgagaattaacggtgagaagttagaagagctgctaagtgaacgggcagtgcagtttcgcgctattcagaggaggcttctggctaggttcaaagataaaacaccagcgccacttcaacacttggacaccctgcttgacgggacttataagcaggtcattgccctcgccgatgctgttgaggaaaaccagggtaatctgttccagtccttcactaggttgaaaagcgccacccacctggtgatccttctaatcgctttgtggcaaaaattgagcgcagatcaggttgctatcctggaggccgcattcctgccactccaagaggacactcaagagctagggtgggaagagacagtcgatgccgcaatctcacacctgctgaaaacatgcctcagtaagagttctaaggagcaggccctaaacctgaactcacagctcaacatccccaaggatacctcccagttaaagaagcacatcaccttgttgtgcgatcgtctcagcaagggaggtcggctctgcctgtccaccgatgccgcagcacctcaaacgatggtcatgcctggaggttgcactactatccccgagtcggatctagaggagcggtcagttgaacaggactcgaccgagctcttcaccaatcataggcatctcactgccgagaccccccgtcctgaggtctccccgcttcaaggggtgtccgagtag

SEQ ID NO: 215592 - DNA, 2649 bp, Artificial Sequence
  Description of Artificial Sequence: Synthetic coding sequence
atgtctttatttaaggcacgcgactggtggagtactatactgggagataaggaggaattcgaccagggctgcctttgcttggccaacgtcgataattctggaaacggccaggacaagattattgttgggtccttcatgggctatctccgtatattctctccccatcccgctaaaactggtgacggagctcaggctgaggacctgctgctcgaggtggaccttagggatccagttctgcaagttgaagtcggaaaattcgtgagcggaacagagatgctgcacctggccgtgcttcattctcggaagctgtgtgtctactctgtgtcgggaaccttaggcaatgtcgagcacggcaaccagtgtcagatgaaactgatgtatgagcacaatctccagcgcaccgcctgcaatatgacctacgggtcttttggtggagtgaagggtcgagacttaatttgtatccagtcgatggacggcatgctgatggtcttcgaacaggagagttatgcttttggacggtttctgccaggcttcctattgcccggaccactggcttactcttccagaactgactcgtttctgactgtgagtagttgtcagcaggtcgaatcttataaataccaggtgctggcttttgccacagacgcagacaagagacaggaaaccgaacagcaaaagctgggcagtggcaaaaggctggtggtggactggaccttaaatattggcgagcaggctttggatatctgcatcgtttcatttaaccaatccgcttcgagcgtgttcgtactgggcgagagaaattttttctgcttgaaagataacggacaaatcagattcatgaagaagctcgattggagtccttcttgttttcttccctattgttcagtgtcagaaggcacaattaatacattgatcggaaatcataataatatgctgcatatttaccaggacgtaacgctgaagtgggccacacaactgccccatatccccgtggctgtgcgcgtaggatgtttacatgacctaaaaggcgtgatcgttacactgtccgatgatggccacttacagtgctcgtatctgggcaccgacccttctctctttcaagctcctaatgtgcagagcagagaactgaattatgacgaactcgacgtcgagatgaaggagcttcagaagattataaaggatgtgaacaagagccagggggtgtggcctatgactgagcgtgaggacgaccttaacgtatctgtggtggtatccccgaattttgacagcgtttctcaggctactgacgtagaggtaggcactgacctagtgccgtccgtgacagtgaaggtgactttgcagaatcgtgtgattctccagaaggccaaattgtcagtttacgtccagcctccactagagctgacctgcgatcaattcactttcgaattcatgaccccggatttgacgagaacagtgtcatttagcgtgtatctgaagcggagttataccccatctgagcttgagggaaatgcggttgtctcttactcccgaccaacgggtatccccagggtcatccagtgcaaattccgccttccactcaagttgatttgcctgccgggacaaccaagcaagaccgccagtcacaagatcactatcgatacaaataaaagccccgtcagcctcctgagtctctttccaggatttgctagccagagtgatgatgaccaggtgaatgtgatgggcttccattttctgggaggcgcaagaatcacagtgctcgcaagcaaaacgtcccagaggtatagaatccagtcagagcagtttgaggatttgtggctgattaccaatgagctgatcctccgtttacaagagtattttgagaaacaaggagtaaaggacttcgcttgcagcttctccggatctatcccattacaggaatatttcgagctgatcgaccaccactttgagctgaggataaacggcgaaaaactggaagaactgctgtccgagcgcgcagttcaatttagagctatacagaggcggctcctcgctcgcttcaaagataaaactcctgccccactgcagcatctggatacactcctggacgggacttacaaacaggttatagctcttgctgacgccgtcgaggaaaaccagggcaatctgttccagagcttcacccgactcaagtcagccacacacctcgtgatactactgattgcattatggcagaaactgagcgcagatcaggttgctatcctggaagcggcttttcttcctctgcaggaagatacccaggaactcggttgggaggagactgttgatgcagctatttcccatctgctgaagacatgcttgtccaaaagttccaaggagcaagcccttaatttgaatagccagctgaatatccctaaggacacgtcacagcttaaaaagcacatcaccttgctgtgtgacaggctgtctaagggaggcagactttgtttgtccacagatgccgcagcccctcagaccatggttatgcccggtgggtgtacgacaatccctgaatctgacctggaagagcgctccgtagagcaggatagtactgagctgtttactaatcatcggcacctgaccgcagagacaccacgacctgaggtgtcaccattgcaaggcgtgagtgagtag

SEQ ID NO: 215593 - DNA, 1446 bp, Artificial Sequence
  Description of Artificial Sequence: Synthetic coding sequence
atgagtctattcaaagccagggactggtggtctaccatcctcggagacaaggaggagtttgatcagggctgtttatgtctggctaacgtggataacagtgggaatgggcaggataagatcatcgttggcagcttcatgggctatctgaggattttttctcctcatccagcgaagacgggggatggcgcacaggccgaggatttgcttctggaggtcgaccttagagatccagtgctacaggtcgaagtggggaaattcgtgtccggaaccgagatgctacacctcgctgtgctccattcccggaagctttgtgtctatagcgtgtcaggaaccttgggtaacgtggagcatggcaaccagtgccaaatgaagctcatgtatgaacacaatctgcaacgaacagcctgtaacatgacctacggctctttcggaggggttaagggaagggaccttatttgtatccagagcatggatgggatgctcatggtttttgagcaagaatcatacgcctttggtcgctttttgccaggcttccttctgcctgggccacttgcatatagctcaaggacagactcttttttgacagtcagctcatgtcaacaggtcgagtcttacaaataccaagtgctagcctttgctacagacgcagataagcggcaggaaactgaacaacagaagctggggtctgggaagaggcttgtggtggactggacactcaatataggggaacaggccctggatatctgtattgtgtctttcaaccagtccgcgagctctgtgttcgtgctgggagagcggaattttttctgtctgaaggacaatgggcagatcagattcatgaagaagctggattggagtccgtcgtgcttcctaccatactgtagcgttagcgaagggacaatcaataccctcattggaaaccataataacatgctgcacatctatcaggacgtgaccctgaagtgggctacccagctccctcacatccctgttgctgtgcgcgtcggatgtctgcatgacctaaaaggcgttattgtcaccctgtcagacgacgggcatctgcaatgctcctacctgggcactgacccaagtcttttccaggccccaaatgttcagagtcgcgagctcaactatgatgaattggacgtggagatgaaggaattgcaaaaaataatcaaagacgtcaacaagagtcaaggggtgtggcctatgacggagcgggaggacgatctgaatgtcagcgtggtcgtgagtcccaacttcgattctgtctcccaagcgacagacgttgaagtagggaccgacttggtgccatcggtgacagttaaggtgactctgcagaacagagtcatattacagaaggctaagctgtctgtgtacgtgcagcctccattagaactgacgtgtgaccaatttaccttcgaattcatgaattttcccagctag

SEQ ID NO: 215594 - DNA, 2559 bp, Artificial Sequence
  Description of Artificial Sequence: Synthetic coding sequence
atgtcattgtttaaggcaagggactggtggtccacgattttaggggacaaagaggaattcgatcaagggtgcctgtgtctcgctaacgtggacaacagcggcaacgggcaggacaagatcatcgttggcagcttcatgggctatctgaggatcttcagtcctcatcctgctaaaaccggcgatggcgctcaggccgaggatctgctcctcgaggtggatctgcgtgaccctgtcctacaggtggaagttgggaagtttgtgagcgggacagagatgcttcatctcgcggtgcttcatagtagaaagctatgtgtctactccgtctccggcactctgggcaacgtggagcatggcaaccagtgccagatgaagctcatgtatgagcacaaccttcagcgaacggcatgtaacatgacttatggctcttttgggggagtgaagggtagagatctcatatgcatccaatcaatggacggcatgttgatggtgtttgagcaggaatcatacgcgtttggtcgatttctcccagggttcctactgccaggccctctagcgtacagctcccgtacagatagctttctaaccgtctccagctgccagcaagtcgaaagctacaagtatcaagtcttggcattcgcaaccgacgcagataaacggcaggaaacagaacagcagaaactgggaagcggcaagcggctggtagtggattggacactgaacattggtgaacaggctctggatatctgcatcgtcagtttcaatcagagtgctagcagtgtgttcgtgctcggagagagaaactttttttgtctgaaagataacggtcagattcgcttcatgaaaaaacttgattggagcccaagctgttttctcccctactgtagtgtgtctgagggcaccatcaatacgctgattggtaaccacaacaacatgctccacatttaccaggacgtaacattaaagtgggccacgcagcttccacatatccctgtggcggtacgggtgggatgccttcacgatctgaagggtgtgattgtcacactgagcgatgacggtcatctgcagtgttcctatctcgggaccgaccctagtttgttccaggccccaaatgttcagtcgagggagctgaactatgacgaactggatgtggagatgaaggaacttcagaaaatcatcaaagatgtaaataaaagccaaggcgtatggcccatgacagagagggaggatgatctcaacgtgagcgttgttgttagcccgaacttcgatagtgtctcccaggcaacagatgtggaggtgggaacagacctggtgccaagtgttaccgtcaaggttacgctccagaatcgggtaatactgcagaaggccaagctctccgtgtatgtgcaaccacccctggagttgacttgcgatcagtttaccttcgaatttatgaataggaatccagacgggattccaagagtcatccaatgtaagtttaggctgccgctgaagttgatctgcttgcccggtcagccctccaagactgcatcacacaagattaccatcgacaccaacaagtctcctgtttccctgctgtctctttttccaggattcgcctctcagtccgacgacgaccaggtcaatgtcatgggtttccatttcctggggggagcccgaataactgtgctcgctagcaaaacatctcagagatatagaatccagtctgagcagttcgaggatctctggttaatcaccaacgagttgatattgagactccaggaatacttcgagaaacagggggtgaaggatttcgcttgcagcttttcaggatccattcctctgcaggagtactttgaactgatcgaccatcacttcgagcttcggatcaacggggagaagttagaagagcttctgtccgagcgagctgtgcagttccgagctatacagcggagacttctcgcgcgattcaaggataaaacccccgctcctctgcaacatctcgacactctcctggatggtacttataagcaggtgatcgcacttgcggatgctgtggaagaaaaccagggaaatctttttcagtctttcaccagactgaaaagtgccacgcacttagtgattctgctaattgcactgtggcaaaagctgtccgcagaccaggtggcaatcctggaggcagccttcctgccgctccaggaggacacacaggagttgggatgggaagagacggtcgacgctgctataagtcacctcttgaaaacatgtttgtccaagagcagcaaagagcaagctctgaacctcaattcacagctcaacatacctaaggatacaagccagctgaagaagcatatcacactgctttgcgaccgacttagtaagggtgggagattatgtctgtcaacagacgcagctgccccacagactatggttatgccagggggttgcaccaccattcctgagtctgatctcgaggagcgttcggttgaacaggattctaccgagctatttaccaaccatcgccacctgacagccgaaacccccaggcccgaggttagtcctcttcaaggagtgagtgaatag

SEQ ID NO: 215595 - DNA, 2664 bp, Artificial Sequence
  Description of Artificial Sequence: Synthetic coding sequence
atgtcgctctttaaggcgagggactggtggagtacaattctgggagacaaggaagagttcgaccaaggctgcctttgcctggcaaacgtggataatagcggaaatggccaggacaaaatcatcgtaggctcattcatgggttacctccgcattttcagtccccatccagctaagaccggggacggcgctcaggccgaggacctgctcttggaggtagacctccgcgacccagtcttgcaagtggaagtcggaaagttcgttagtgggaccgagatgctgcatctagccgtcctccatagcagaaagttgtgcgtgtactccgtgtctgggactctcgggaatgtggagcacggtaatcagtgtcagatgaaactgatgtacgagcacaatctgcaacgcacagcatgtaatatgacttacggttcttttgggggtgtaaaagggcgagatctcatatgcatccaaagcatggatggaatgctgatggtgttcgagcaggagagttacgccttcggccgtttccttccgggattcctgctccctgggccactagcttacagtagccggactgactcattcctgactgtcagctcatgccagcaggtggagtcgtataagtatcaggtccttgccttcgcaaccgatgcagacaagagacaagaaaccgagcagcagaaacttggctcgggcaaacggctggtggtagattggacattaaatattggagagcaagctttggatatctgcattgtttccttcaaccagtcggcttccagtgttttcgtgcttggcgaacgcaactttttttgtctgaaggacaacggacagatcagatttatgaagaaactggattggtcgccctcatgctttctgccatattgctcagtttccgagggaacaatcaatacactgattggtaaccataataacatgctgcacatctatcaggacgtcaccctgaaatgggcgactcaactacctcacatacctgtggccgttcgcgtagggtgtcttcacgaccttaaaggcgtaatagtgactctaagcgacgatgggcacttacagtgtagttacctcggaaccgaccccagcttgtttcaagctcccaatgtgcagtccagagagctgaactacgacgaacttgacgtggaaatgaaagaactgcagaagattattaaagacgttaataaaagccagggtgtttggccaatgaccgaacgggaagacgatttgaatgtgtccgtggttgtgtctcccaactttgatagcgtttcacaggcaaccgacgtcgaggtgggaaccgacctagtgcccagtgtgactgtgaaagtgactctgcagaaccgagtcattctccaaaaggccaagctctccgtctacgtacaaccgccattggagctcacctgcgaccagtttacgttcgagttcatgacaccggatcttacccgtacagtctctttctccgtctacctaaaacgaagttacactccatccgaattggaaggtaacgccgttgtgagttatagcagacctacggtgcagaactcactcgggatccccagggttattcaatgcaagttccgcctacctttaaaattaatttgcctgcctggccagcccagcaaaaccgccagtcataagattactatagatacaaacaagtctccagtatctctcctttccctgttcccgggatttgcctctcaatctgacgacgaccaggtcaacgtgatgggctttcactttttgggcggtgctcgcattaccgtactagctagcaagacgtctcagaggtatagaattcaatccgaacagttcgaagacctgtggttaataacaaatgagctgattctccggctgcaagaatactttgagaaacaaggcgttaaggactttgcctgctctttctctgggtctatcccactgcaggagtactttgaacttatcgatcatcattttgagctccgaatcaacggagaaaagctggaagagcttctgagtgagagggccgtgcagtttcgcgctatccaacgacgccttctggccagattcaaggacaagacacccgctcctttgcaacacttagacacacttctggacggcacatacaaacaggtgatcgcactggccgacgcagtggaggagaatcaaggcaaccttttccagtcttttaccaggcttaagagcgctacccatctggtgatactgctgatcgccctgtggcaaaagctgtctgccgatcaggtggctattttggaggcggctttcctccccctacaagaagacacacaggaactcggttgggaggagaccgttgacgccgctatcagccaccttctgaagacatgcctaagtaagagctcgaaagaacaagctctgaatctgaactcccagctgaatattcccaaagacacttcccagctgaagaaacatatcaccctactatgtgaccggctgtctaagggcggacggctgtgtctatccacagacgcagccgcaccacagaccatggtaatgcctgggggatgcacaaccattccagagtccgatctggaagaacggtccgtggaacaagactctaccgagttgtttacgaaccaccgacatttgacagccgagactcctcgacctgaagtgagtcctcttcaaggagtgagcgaatag

SEQ ID NO: 215596 - DNA, 933 bp, Artificial Sequence
  Description of Artificial Sequence: Synthetic coding sequence
atgggttatctgaggatctttagtccccatcccgctaaaactggcgacggtgcacaagcagaggaccttctactggaagtggatctgcgggacccggtattgcaggtggaggttgggaagtttgtgtccgggacagagatgctgcacctggctgtcttacattccaggaagttatgcgtgtactccgtgagtggaacactgggcaatgtggagcacgggaaccagtgtcagatgaagcttatgtatgagcataaccttcaacgaaccgcctgcaatatgacgtacggctcctttggcggtgtcaaaggcagggatctgatttgcatccaatccatggatgggatgctgatggtttttgaacaggagagctacgcctttggtaggtttctaccaggttttctgctgccaggcccactggcatactcttcacggaccgattcatttctgacagtgtctagctgtcagcaggtggagtcttataaatatcaggtcctcgcctttgcgacagatgcagacaagcgccaagagaccgaacagcagaagctcggttctggcaaaaggttggtggtggattggaccctcaatattggcgagcaggcactggacatatgcatcgtgagctttaatcagtccgcttcaagtgtcttcgtcttgggcgaaaggaatttcttttgtctcaaggataatggccagatacgcttcatgaagaaactcgattggtcaccctcttgcttcctgccctactgcagcgtctccgaggggacgatcaatacgcttatcgggaaccacaataacatgctgcacatttatcaagatgtcactcttaaatgggccacccaacttccgcacattcccgtagctgtacgagtcggatgtctgcagttctccctgtggaagcatctcctgcccagatcgagcacactggaaaagtag

SEQ ID NO: 215597 - DNA, 294 bp, Artificial Sequence
  Description of Artificial Sequence: Synthetic coding sequence
atgagtctgttcaaggcccgtgattggtggtccacaatcctgggagacaaggaggagttcgaccagggctgtttgtgccttgcgaacgttgataacagtggtaacggccaagacaagatcatagtcggttcattcatgggctatctcagaatcttcagcccgcacccagcgaaaacgggagacggcgcacaggctgaagatcttctgctcgaagtcgacctcagagacccggtgcttcaggttgaagttggaaagttcgtttccggaactgagatgctgcacttggccgtctag

SEQ ID NO: 215598 - DNA, 1365 bp, Artificial Sequence
  Description of Artificial Sequence: Synthetic coding sequence
taagatttagtgcctagcgtaaccgtcaaggtcacactgcagaatagagtgatattgcagaaggctaagctctccgtctacgtgcagccaccgctggagctgacatgcgaccagtttacctttgagtttatgacacccgacctgacgaggacggtcagtttctcagtgtacctgaagaggagctacacaccaagcgaactggaaggtaatgccgttgtcagttatagtagacctaccgatcgaaaccctgacggaattccccgtgttattcaatgtaagttcagactacccctgaaattgatttgtctgccaggacagccttctaagacagcaagtcataaaattaccatcgacacgaataagtctcctgtgtccctgttaagcttgttcccaggattcgctagccaaagcgatgacgatcaggtaaacgtgatgggcttccactttctgggcggagccagaatcacagtgctagcttccaaaacttcgcagcgctatcgcatccagtccgagcagttcgaagatctgtggctaatcacaaatgagctgattcttagactgcaggaatatttcgagaaacaaggggtaaaagactttgcctgttcctttagtggctcaatccctctgcaagagtatttcgagcttattgaccatcatttcgagcttcgtataaatggagaaaaacttgaggaactgttgtctgagcgcgctgtgcagttccgcgcaattcagagacggctcctggcccgttttaaagataaaactcctgccccactccagcatctggacacactgcttgatgggacgtacaagcaagttattgccctcgccgacgccgtggaagagaaccagggcaatctcttccaatcctttacccgcctgaaatctgccacccacctggtgatcttactaatagccctctggcagaaattaagtgcagatcaggtagctatcctggaggccgcattcctccccctccaagaggacacccaggagctcggttgggaggagactgtggacgccgcaatctcgcatctcctgaaaacgtgcctgtccaaatcttcgaaagagcaagccctcaacctgaactcacaactaaacattccaaaagatactagccagttaaaaaagcacatcacattactgtgcgaccgcctatcaaaagggggacgattatgcctgtctactgatgcagctgcacctcagaccatggtgatgccaggaggatgtaccaccattcccgagtctgatttggaggagcggagcgttgagcaggatagtactgagttgttcaccaatcaccggcatctcaccgcagaaaccccccgtcctggcaagcgcttggacgggctgcacaagcggtag

SEQ ID NO: 215599 - DNA, 1227 bp, Artificial Sequence
  Description of Artificial Sequence: Synthetic coding sequence
atgaagttaatgtacgagcacaacttgcagcggaccgcatgcaatatgacatacggctctttcggaggagttaaagggagagatcttatatgcattcagtccatggacgggatgttaatggtttttgaacaggagtcctatgccttcggccgtttcttgccaggctttctcttacctggcccactggcatacagtagtcgcacagattcctttctcaccgtgtcctcctgtcagcaggtggagtcttacaagtatcaggtgcttgccttcgcaactgatgctgataagaggcaagaaactgaacaacagaaactgggcagtggaaagcgactcgtcgtggattggactctgaacatcggagagcaggctttggacatttgcattgtgtcatttaatcaaagtgccagcagtgtcttcgtgctgggagagcggaactttttctgtcttaaagacaatggtcagattcggttcatgaaaaagctggactggtccccctcttgttttctgccttactgcagtgtgtctgagggaacaatcaatacgcttattggcaaccacaacaacatgctgcacatctaccaggatgtcacactcaaatgggctacacagctgccccatatcccggtcgccgtaagagtgggatgcctgcacgacctgaagggtgttatcgttacactctcggatgatggtcacctgcagtgcagctacctcgggactgaccctagtctcttccaggctcccaacgtacagtctagagaactgaattatgacgagctcgatgttgagatgaaggaattgcagaaaatcatcaaagacgttaacaaatctcagggtgtgtggcctatgactgaacgcgaggacgacctcaacgttagtgtcgtggtgtctcctaattttgatagtgtgtcgcaggctaccgacgttgaggtcggcactgacctggttcccagtgtcactgtgaaagtcacactgcaaaacagggttatccttcagaaggccaagttgtcagtttacgtgcaaccacctctcgagctgacttgtgatcagttcacttttgaatttatgacacctgacctcactaggaccgtgtcgttctccgtatatcttaagaggagtatccatcaccagaattggaaggaaatgctcctgttccttattccagatcaacagattgagatcctgatggcttttagagagttgagtaacgtgaatcttgactttccatag

SEQ ID NO: 215600 - DNA, 984 bp, Artificial Sequence
  Description of Artificial Sequence: Synthetic coding sequence
atggaaggctctaacggtttcgggatcgatagtatcctgtcccaccgggctggatctcccgctctccccaagggcgacccgctgctgggtgactgccgcagccccctggaattgtcacctcggtcagagagcagtagtgactgctcatcacccgcttctccaggcagggactgtttagagacgggaacaccccgacctggaggcgctagtgggccaggactagatagccatctgcagcccggtcagctgtcggctcctgcccagtctcgcaccgtgactagctcatttcttattagagatatcctggctgattgcaaaccattggccgcatgcgctccatatagtagctcggggcagccagccgcacctgagcccggtggcagactggccgctaaagcggctgaagacttccgcgacaaactcgataagtcgggatccaacgccagttctgatagcgaatacaaggtgaaggaggaaggcgatagagaaatttcgtcttcaagggacagtcctcccgtgcgcttgaagaagcctaggaaggctcgaactgcattcacagaccaccagctggcccagctggaaaggagcttcgagagacagaaatacttgagcgtacaggacagaatggagctggccgctagcttaaacctaactgacactcaggttaaaacatggtaccaaaaccgacgaaccaaatggaagcggcagaccgccgtgggactggaactgctggccgaggcgggtaactacagcgctctgcagcggatgtttcccagcccgtatttttatcctcagtcactggtctctaacttggatcctggcgctgcattgtatctgtatagaggcccttcagccccaccaccggctctgcagagacccttggttccaagaattctgatccatggattgcagggggcatccgagccaccaccccctcttccccctctagccggagtcctgcccagggcagcacagccgagatag

SEQ ID NO: 215601 - DNA, 984 bp, Artificial Sequence
  Description of Artificial Sequence: Synthetic coding sequence
atggagggttcaaacgggtttggtattgatagcattttatcccaccgtgctggcagtcctgcgctgccaaagggggatccactgctgggagattgtcggagtccgctggagctgagtccaaggagcgagtcctctagcgattgctcatcaccggcatccccgggtcgcgactgtctggaaactggcacaccgcgtccgggtggagcatccggcccaggcctggattcgcatctgcagcctggccagctatccgccccagcccagtctcgcactgttacctcttcctttcttatccgggatattcttgcagactgtaagcccctggccgcttgcgctccctacagctcctccggacagccagcagccccagagccaggaggaaggttggcagctaaggcagctgaggacttccgcgacaaacttgataagtccggcagcaatgcttcgtctgactccgagtacaaagtgaaggaagagggggaccgcgagatatcctcatccagggactcaccacccgtgcgactgaagaagccacgaaaggcacgaaccgcattcaccgaccaccagctggcccagcttgaacgctcgtttgagaggcagaaatacctttccgttcaagatcgcatggagctggcagcttctctgaacctgaccgacacccaggtaaagacatggtaccaaaatcgaagaacgaaatggaagagacagacagctgtggggctggagctgctggccgaagccggaaattattccgcgctccagcgaatgttcccgtctccatatttctatccacagtccctggtctcaaacttagatccaggcgcagccctctacctgtaccggggaccatctgcccctcctcccgcactgcagcgtccgttggtaccacgcatactgatacatggcctacagggagcctctgaaccgccacccccattaccccctctggccggagtgctgcctcgcgctgcccagccacgctag

SEQ ID NO: 215602 - DNA, 270 bp, Artificial Sequence
  Description of Artificial Sequence: Synthetic coding sequence
atgaccactagtcagaagcaccgggacttcgtggccgagccaatgggggaaaaaccagttggctcccttgccggaattggcgaggtattagggaaaaagctggaggaacgcggattcgacaaggcctatgttgttctggggcagttccttgtcctgaaaaaggacgaggatctcttccgggagtggttgaaagacacctgcggggctaacgctaagcagtctcgggattgctttggctgcctgcgcgagtggtgcgacgccttcctctag

SEQ ID NO: 215603 - DNA, 270 bp, Artificial Sequence
  Description of Artificial Sequence: Synthetic coding sequence
atgacaacatcccagaaacatagggatttcgtggccgagccgatgggagagaagcctgtcggctcccttgcaggtatcggagaagtactcgggaaaaagttagaagagagggggtttgacaaggcttacgtagtgctggggcaattccttgtgctgaagaaggacgaagatctgtttagagaatggctcaaggatacatgtggtgcaaatgctaaacagagtcgggattgtttcggctgtctaagggagtggtgtgatgcatttctgtag

SEQ ID NO: 215604 - DNA, 270 bp, Artificial Sequence
  Description of Artificial Sequence: Synthetic coding sequence
atgacaacatctcagaaacaccgcgatttcgtcgccgagccaatgggcgaaaagcctgttggctctctggcaggcatcggcgaggtcctcggcaaaaagctcgaggaacgaggcttcgataaggcatatgtggtcctgggtcagttcctcgtgctgaagaaggacgaagacctgttccgtgagtggttaaaggacacctgcggcgcaaacgctaagcagagccgggattgcttcggctgtctccgcgagtggtgcgacgctttcctttag

SEQ ID NO: 215605 - DNA, 87 bp, Artificial Sequence
  Description of Artificial Sequence: Synthetic coding sequence
atgactactagccagaagcacagggactttgttgcagagccaatgggggagaagcctgtcggaagcctggctggaatcggtgaatag

SEQ ID NO: 215606 - DNA, 270 bp, Artificial Sequence
  Description of Artificial Sequence: Synthetic coding sequence
atgacaacctcgcagaagcatcgggatttcgtagctgaaccgatgggagaaaagcccgtgggaagtctggccggtattggggaagtgttggggaagaagctggaagagcgaggattcgataaagcttatgtggtcttaggccagttccttgtgctgaaaaaggatgaagatttgttccgtgagtggctaaaagacacatgcggagctaacgctaagcaaagcagggattgtttcggctgtttgagggagtggtgcgatgcttttctgtag

SEQ ID NO: 215607 - DNA, 963 bp, Artificial Sequence
  Description of Artificial Sequence: Synthetic coding sequence
atggccgatgaaaaaactttcagaatcggatttatagtgctcggcctctttctactggccttgggtacttttctgatgagtcacgatcgtccgcaggtctatggtaccttttacgccatgggcagcgtgatggtgattgggggaatcatctggtcaatgtgccagtgctatcccaagatcacttttgtccccgctgactccgactttcagggtatcctctctccaaaagcaatggggctccttgagaacggtctcgctgccgagatgaaatccccatctcctcagcctccatacgtcagactgtgggaagaagctgcctacgaccagtccctccccgacttctcccacattcagatgaaagttatgagctatagtgaagaccacaggagccttctggcaccggagatgggacagccaaaactgggtacttctgacggtggcgagggtggccctggcgacgtgcaggcttggatggaggctgccgtggttatccacaaaggttccgatgaatcagagggcgagaggagacttactcagtcctggcccggtccccttgcatgcccacaggggcctgcaccactcgcctcatttcaggatgatttagatatggactcgtccgagggctcgtcccccaacgcttcaccacatgacagggaggaagcatgttctccacagcaggagcctcaggggtgtaggtgtcctctggatcgctttcaggacttcgcgctcatagacgcgccaactcttgaagacgaacctcaagaaggccagcaatgggagatcgccctgcccaataactggcagcgctatccacgtacaaaggtggaggaaaaagaggccagcgatacagggggtgaggagcccgagaaagaggaggaagatttgtattatggcctgcccgacggggctggcgacctcctgcccgacaaggagctggggttcgaaccagatacccagggttag

SEQ ID NO: 215608 - DNA, 765 bp, Artificial Sequence
  Description of Artificial Sequence: Synthetic coding sequence
atgcagagacccggagaacccggtgccgctcggtttggaccgcctgaaggctgtgctgatcatagaccgcacaggtacaggtcgtttatgatagaggagattctaacagaaccgccaggaccgaaaggtgcagcccctgctgcagcagctgcggctgcgggagaactgcttaaattcggggtccaggctcttctcgctgcgaggccttttcacagtcatctggctgtgttgaaagccgagcaggcagccgtgttcaagttcccacttgccccattgggctgctctggactaagctccgcgcttctggctgcaggcccagggttgccaggagctgccggtgcaccacatcttcccctagagctccagctgcggggtaagctcgaagccgcaggacccggtgagcccggtaccaaggccaaaaaggggaggcgctcacgcaccgtctttaccgagctgcagctgatgggattggaaaagagattcgaaaagcagaaatacctgtccacaccagacagaatagacttggccgagtctctgggtttgagtcagcttcaggtgaaaacttggtaccaaaatcgaagaatgaaatggaagaagattgtactgcaaggcggaggcctggagtcaccaacaaagcctaaggggagacctaagaaaaattccatccccacgtcagaacagctgaccgaacaggagcgggcaaaggatgcagaaaagcccgctgaggtccccggtgagccatctgaccgcagccgggaagattag

SEQ ID NO: 215609 - DNA, 303 bp, Artificial Sequence
  Description of Artificial Sequence: Synthetic coding sequence
atggggcttgagaagaggtttgagaaacagaaatatctctctactcctgataggattgacctggccgagtccctgggcctgtcccaactgcaagtgaaaacttggtaccagaatcgtcggatgaagtggaaaaaaatcgtgttgcagggtggagggctggagagcccgaccaagccaaaaggacggccaaagaagaattccattcccacatctgaacagctgaccgagcaggagcgggctaaagatgctgagaaacccgcagaagttcctggagagccgtccgatcggagtagagaggactag

SEQ ID NO: 215610 - DNA, 840 bp, Artificial Sequence
  Description of Artificial Sequence: Synthetic coding sequence
atgcattgtcacgccgagttgcggttgagcagcccaggtcaattgaaggctgccagaaggaggtacaaaacttttatgattgacgaaatcctatctaaggagacctgcgattatttcgaaaagctgtcactgtatagcgtctgtccaagcctcgtcgtgcggcctaaaccacttcactcatgcacaggctcaccgtcactgcgagcctacccactactgagtgtgataactagacaaccaaccgtgatatctcacctagtgccagcaacgccagggatcgcacaggccctctcatgccatcaggtgaccgaagcggtttccgccgaggctcccggaggcgaggcgctggcaagctcagaatctgaaactgaacagcctactcccaggcaaaaaaagcccagaaggtccagaacgatattcaccgagcttcagctgatgggactggagaaaaagttccagaaacagaaatatctcagtacaccagaccgcctggaccttgcccagagcctgggtctgactcagttgcaagttaaaacctggtaccaaaatagacgcatgaagtggaagaagatggtgctgaaggggggacaggaagctccaacaaagcctaaaggccgaccaaaaaaaaatagtataccaacatcagaagaaatagaggccgaagagaagatgaatagccaagcacagggccaggaacagctggaaccaagccagggacaggaggagttgtgcgaagctcaggagcctaaagccagagatgtgcctctcgagatggccgaaccccctgatcctccgcaagagctgccaatcccgagcagtgagcccccacctctgtcatag

SEQ ID NO: 215611 - DNA, 1887 bp, Artificial Sequence
  Description of Artificial Sequence: Synthetic coding sequence
atggaacctccagacgctcccgctcaggccaggggtgcccctcggctgctgcttctagccgtgctgctcgcagcccacccagacgctcaggccgaggtgcggttgtctgtgcccccactggtcgaggtgatgagggggaagagcgtgatcctggattgcacccccacaggaacgcacgaccactacatgttggaatggttcctcaccgaccggtcaggggctcggcctcgcttggcgtccgccgagatgcaggggagcgagctgcaagttactatgcatgacacccggggaagatcccctccctatcagttagattctcagggaaggctggtactcgccgaggcccaggtgggagatgaacgggactatgtgtgcgttgtccgcgcaggagctgctggtactgcagaagctactgccaggttaaatgtgttcgccaagcctgaggccacggaggtgtctcctaacaagggtacattgtcagtgatggaggattcagcacaagaaatagccacctgcaattcgaggaatgggaaccccgctccaaagataacctggtataggaacggccagagacttgaagtgccagttgaaatgaaccctgaaggatatatgacatctcgtactgtcagagaggcttctggtctcctctccctgacctcaaccctgtaccttcgtctgcgcaaagatgacagagatgccagctttcactgcgctgcccattattcccttcccgaggggcgtcacgggaggttggacagtcctaccttccatcttaccctccactatccaacggaacacgtgcagttttgggtaggttctcctagtaccccggctggatgggtgagagagggcgacaccgtccagttattgtgtcgcggagacggaagtccatcgcccgaatacaccctttttcgacttcaagacgagcaggaggaagttcttaacgtgaacctggagggtaacctgacccttgagggcgtgacccgcggtcaatcggggacctacggatgtagagtagaagattacgatgcagccgacgatgtacagctgagcaagacactggaactccgtgtggcctacctggatcccttggagttaagcgaggggaaggtgctttctctgccgctcaactcttccgccgttgttaattgcagtgtccacggcctccccacacccgcactccgctggaccaaagattccacccctcttggcgatggacccatgctgtcgttgtcttcgattacatttgactccaacgggacctatgtatgtgaggcaagcctgccaactgtgccagtattgtctcgtacacagaatttcaccctcctcgtgcagggcagtcctgagctgaagactgctgagatcgagcccaaagcagacggaagctggcgcgagggggacgaggtcaccctcatttgcagtgccaggggacatcccgaccccaagctgtcatggagccaactcggtggaagtccagccgagccaataccagggagacaggggtgggtgtcttcaagcttgacacttaaagtcacatctgcgctcagccgggatggcatatcttgcgaagcatccaatcctcacggaaataaacggcacgtttttcattttggtaccgtgtcacctcagacctcccaggcgggagtcgccgttatggcagtggctgtcagcgtgggactactcttgctagttgtggcagtgttctactgcgtgagacgaaaaggcggaccttgctgtcggcagaggagggagaaaggagcccctcctccaggagagccaggtctttctcattccggctccgagcagcctgaacagactggtctcctgatgggtggagcctccggcggagcacggggaggctccggcggattcggggatgagtgctag

SEQ ID NO: 215612 - DNA, 1767 bp, Artificial Sequence
  Description of Artificial Sequence: Synthetic coding sequence
atggaaccccctgacgccccagcccaggctcgtggcgctcccaggctgctgctactggccgttctcttagccgcacacccagacgcacaggccgaggtgcggcttagtgtccctccccttgtggaggtcatgaggggcaaatcagtcattctggactgcactcccaccggaactcacgaccactatatgctggaatggttcctaacagataggagcggcgcaaggccaagactcgcctccgctgaaatgcagggttccgaattacaggtgacaatgcatgatacccgcggaaggtcaccaccctatcagctggattcacagggcaggttggtgctggccgaggcccaggtcggcgacgaacgagattacgtgtgtgtggtcagagccggagccgctggaacagccgaggccactgcacgcttgaacgtgtttgccaagccagaagcaactgaggtgtcaccaaataaggggaccctttctgtgatggaagactccgcccaggaaattgctacctgtaattcgaggaatggcaaccctgccccaaaaatcacatggtatagaaatggacagagactagaggtaccagtcgaaatgaacccggagggatacatgactagcagaaccgtgcgcgaggcgtccgggttattgtctttaaccagcactctctacctccggctgcgaaaggacgacagggatgcatcgttccactgcgctgcccactactctctcccagaaggcaggcatggcagattggattctcccacattccatcttaccctacattatcctacagagcatgtgcagttctgggtggggtccccctccactcccgctgggtgggtccgggagggtgatacagtacaactgctgtgccgcggagatggcagcccgtccccggaatataccctgtttaggctgcaggacgaacaggaggaggttctcaacgttaacctggagggtaatttaacattggagggcgtaaccagaggccagtccggcacttacggctgtcgcgtcgaggactacgacgctgcagacgacgtccagctgagtaagacactcgaactcagggtggcgtaccttgatccgctggagctctctgaagggaaagttctctctcttccactgaatagttcagcagtcgtcaattgttcggtccatgggctgccaacgccagctcttcggtggacaaaggacagcactccactcggagacgggccaatgctgtccctgtctagtatcactttcgactccaacggaacttatgtgtgtgaagcgagtctcccaacggtgcccgtcctcagtaggacgcagaactttaccctgctggtgcaaggttcacccgaactgaaaacggccgagattgaacccaaagctgacggttcttggcgcgagggagacgaggtcacacttatctgcagtgcacgcggacatcccgatccaaagttaagttggtcccaattaggaggatctcccgctgaaccaatcccaggacggcaggggtgggtctcctctagcttaaccctgaaggtcaccagtgcattatcgcgagatggaatctcatgtgaggctagtaaccctcacggaaataagaggcatgtgttccacttcgggaccgtgtctccacaaacctctcaggccggtgtggctgtcatggctgtggccgtcagtgttggcctgctgctcttagtagttgccgtcttctactgcgtacgccgaaaggggggtccttgctgtcgccagcggcgagaaaagggggctccttag

SEQ ID NO: 215613 - DNA, 321 bp, Artificial Sequence
  Description of Artificial Sequence: Synthetic coding sequence
atgatgacacttgtccctcgagctcggacacgtgccggtcaggatcattacagccacccttgccccaggttctcacaggttctgctaaccgaaggcattatgacatactgcctaaccaagaatctgtcagatgtgaatatccttcaccgcctgcttaaaaacggcaacgtgcggaatactctattacaatcaaaagtgggacttctgacttactatgtgaagttgtacccaggcgaggtgactctgctcaccaggccttctattcaaatgcgcctttgctgtattacaggcagtgtgtcaaggccccgatcacagaagtag

SEQ ID NO: 215614 - DNA, 321 bp, Artificial Sequence
  Description of Artificial Sequence: Synthetic coding sequence
atgatgacactggttccacgggcacgcacaagagccggacaggatcactattcgcatccatgtcccagatttagtcaggtgcttttgaccgagggcataatgacatactgtcttacaaaaaacctcagtgatgtgaacattctgcatcgcctgctcaagaacggtaatgtgcgcaatacgctgttgcagagcaaagtgggattgctcacgtactacgtgaaactgtatcccggagaggtgaccctgctgactcggccttccatacagatgcggctgtgttgcattaccgggtctgtaagtcgtccccgatcgcaaaagtag

SEQ ID NO: 215615 - DNA, 1146 bp, Artificial Sequence
  Description of Artificial Sequence: Synthetic coding sequence
atggagcgcggaatgcatctgggtgccgcagccgctggcgaggacgacctctttttgcataagtccctgtccgcctctactagcaagcggctcgaagcggcttttagatcaacaccccctggcatggatctgtctctcgcacccccaccgagggagagacccgcatcaagttcttctagccctcttggttgttttgagcccgcagatcccgagggggctggattgctcctgccacccccaggtggcggaggcggtgggagcgctggatccggaggaggaggcggaggcggagtcggcgtgccaggtctgctggtagggtctgctggggtagggggagacccaagcctatcgtccttacctgccggagctgccctctgtctgaagtatggagaaagtgcaagccgaggatccgtcgcggaatctagcggcggagagcagagtcccgacgacgacagcgacggtcggtgcgagctggtgctccgggctggcgtggctgaccccagagcctcacctggggcaggtggtgggggagcaaaagccgcagagggctgctccaacgcccatttacatggtggcgcaagcgtccccccaggcggattgggcggtgggggtggtgggggatccagcagcggttcctcggggggtgggggtggcagtggtagcggatcaggtggcagcagctcctccagcagctcctctagtaaaaagtccaaagaacagaaggctctgaggctgaatatcaatgctagagagcggaggcgtatgcatgacctgaacgacgccctcgacgagctccgggctgttattccttacgcccactctccctcggtgagaaagttatccaaaatcgcaaccctgctgcttgccaaaaactacattttgatgcaggcccaagcccttgaagagatgcggcgactcgtcgcttacctaaatcagggccaggcaatttccgctgccagccttccaagctcagcagctgcggctgctgcggctgccgctctgcatcccgctcttggggcatacgagcaggccgctggctatccattctcagccggtttgcccccagctgcatcttgtcctgagaaatgcgccctctttaatagcgtgtcctcgtctctgtgtaagcagtgtacggaaaagccttag

SEQ ID NO: 215616 - DNA, 678 bp, Artificial Sequence
  Description of Artificial Sequence: Synthetic coding sequence
atggctgaactgaagtctctcagcggagatgcatatttggccctttctcacggatatgccgctgcagctgcagggctggcgtacggggcagcacgggagcccgaagcggcaaggggctacgggacaccgggacctggcggtgacctgccagctgctcctgccccacgtgcacccgcacaggcagctgaaagttcgggggaacagtctggcgatgaagacgacgcgtttgaacaaagaagaagacgccgaggtcccggtagtgcggcagatggacgcagaagaccgcgtgaacagcgctcactccggttgtccattaacgctcgcgaaagaaggcggatgcacgacctcaacgacgctctggacggcctgcgtgccgtgatcccctatgctcatagccctagcgtgaggaaattgtccaagatagcgactctgctgctggccaaaaattatatcttgatgcaggctcaggccctggacgagatgaggcgattggtggcctttcttaatcagggtcagggcctcgccgctcccgttaacgccgctcctctgacccctttcggccaggcgactgtgtgtcccttttcagccggagccgctttaggcccatgccctgataaatgtgctgcattttccggcactccttcagctctgtgcaaacactgtcacgagaaaccatag

SEQ ID NO: 215617 - DNA, 1239 bp, Artificial Sequence
  Description of Artificial Sequence: Synthetic coding sequence
atggagaggattccctccgcccagccccctcccgcatgtctgcctaaagcacccggtcttgagcatggggacctcccaggtatgtatcccgcacatatgtatcaagtgtacaaatctagacgcggaatcaagaggagcgaggattcgaaggagacctacaagctaccccaccgtctcatcgagaagaagcggagggatcgcattaatgagtgcatcgcacagttaaaagacctgctacccgagcatttgaagttgaccactctaggccacttggaaaaggccgtggtcttggaattaaccctgaagcacgtgaaagccctgaccaaccttatcgatcagcaacaacaaaagattatcgccttacaatccggtttacaggctggagaactgtctggcagaaacgtcgaaaccgggcaggagatgttttgctcagggttccaaacctgtgctagggaagtgttgcagtacctggcaaagcacgaaaacacccgtgacctcaagtctagccaactcgtcactcacttgcatcgcgttgtcagcgagctactgcagggcggtacatcccgaaagccatcagacccagcccctaaggttatggattttaaagagaagccatccagcccggcaaaaggatctgagggtcctgggaagaattgtgtgccagtaatccagcggaccttcgcccactcgagcggcgagcaatcagggtccgacaccgacacagactccggctatggaggtgagtctgagaagggcgacttaagatcggagcaaccatgctttaaaagcgatcacgggcgtcgatttacaatgggggaacgtatcggggcaatcaaacaggagtctgaggaaccacccactaagaagaataggatgcagttgtctgatgatgaggggcatttcacctctagcgatctcatttcctccccatttctgggcccacacccgcaccagcctccgttctgcctgcctttttacctaattcctccctccgccaccgcatacctcccaatgctcgagaaatgttggtaccctacatcggtgcccgttctgtaccccggacttaacgcatccgcagcggctctgtcatcatttatgaacccagacaagatttcggcccctctgctcatgccccagcgcctgcccagcccactgcctgcacacccctccgttgatagcagcgtgcttttgcaggcacttaagcccatcccacctctgaatcttgaaacaaaggattag

SEQ ID NO: 215618 - DNA, 378 bp, Artificial Sequence
  Description of Artificial Sequence: Synthetic coding sequence
atgcctcattcttcagactcttctgattcaagcttcagccgttcgcctcccccaggaaaacaggacagttcggacgacgtgcggagggttcagcggagggagaagaacagaatcgccgctcaaaaatcgcgccagagacagacccagaaggccgacacactccacttagaaagtgaggatctcgaaaagcagaatgcggcacttaggaaggaaatcaaacaactaacagaagaactcaagtactttactagcgtgcttaattcccatgagccactgtgtagcgtgcttgctgcatccaccccttcaccccctgaagtggtgtatagtgcgcatgcgttccaccagccccatgtcagctcaccaaggttccagccgtag

SEQ ID NO: 215619 - DNA, 384 bp, Artificial Sequence
  Description of Artificial Sequence: Synthetic coding sequence
atgagtcaggggcttcccgcagccggttcagttctgcagcgttctgtcgccgctcccggaaatcaaccgcagccccaaccacagcagcaatcgccagaggatgacgaccggaaggtgagaaggagagagaaaaatcgagtcgctgcgcagcgaagtcgcaaaaaacaaactcagaaagcagacaagcttcatgaggagtatgagtcactggagcaggagaatacaatgctgcgcagagaaatcggcaagctgacagaagaactgaaacacctcacagaagccctaaaagaacatgagaagatgtgtcccttattactatgtcccatgaacttcgtgccggttccccctaggcccgatccagtggctggttgcctgccccgatag

SEQ ID NO: 215620 - DNA, 489 bp, Artificial Sequence
  Description of Artificial Sequence: Synthetic coding sequence
atgaaagagaccatcatgaaccaggagaagctggctaaactccaggctcaggttagaatcggcggaaaaggcaccgctcgccgtaagaagaaggtggtccataggacggccacggcagacgataagaaactccagttcagcctgaagaaactgggcgtcaataacatttctggaatcgaggaggttaatatgtttaccaaccagggtactgtcatccacttcaataatccaaaggtgcaggcatcattggccgctaacactttcaccattactgggcatgcggaaaccaagcagctgactgagatgctgccttcgatcctgaatcaactaggcgctgattccctgacatctctccggagactggcagaagcattaccaaaacaaagcgtggacggcaaggcacctctcgctaccggagaggatgatgatgatgaggtgcccgatctggttgagaacttcgatgaagcttctaaaaatgaagcaaactag

SEQ ID NO: 215621 - DNA, 621 bp, Artificial Sequence
  Description of Artificial Sequence: Synthetic coding sequence
atgaggaggaccggagcccctgcacaggcagattctcggggtagaggcagagcaagggggggatgtccgggaggcgaagccaccctgtcgcagcccccaccgagaggtgggacaagagggcaggagcctcagatgaaagaaacgatcatgaaccaggagaaactggcaaaattgcaagcccaggttaggatcggcggaaagggcaccgcaagaagaaagaagaaggtggtccataggacagcaaccgcagatgacaagaaactacagttttctctgaaaaaactgggcgtcaacaatatctccggaatagaggaagtgaacatgttcaccaaccagggaaccgtgatccacttcaacaatccgaaagtccaggcaagcttagccgcaaataccttcacaatcaccggccatgcggagaccaagcagcttaccgaaatgctccccagcatcttgaaccagttgggagcagactccctgacatcgttgagacgcctagcagaggccctgcccaaacagtcggtagatgggaaggccccactggctaccggcgaggatgacgacgatgaggtgcccgacctggtggagaacttcgatgaggcaagtaagaacgaggccaattag

SEQ ID NO: 215622 - DNA, 1158 bp, Artificial Sequence
  Description of Artificial Sequence: Synthetic coding sequence
atggccgcagccttgttcgttctgttgggctttgccctcctcggcacccatggagcgtccggcgctgcaggctttgtacaagcccctctaagtcagcagcgctgggtgggaggatccgtcgaattgcattgtgaagctgtgggttcacctgtgccagagatacagtggtggtttgagggccaggggcctaacgacacatgctcacagctatgggacggcgctcgactggatcgcgtccacatccatgccacctatcaccagcacgccgcttccaccatcagcattgacaccctggtggaggaagacacagggacctatgagtgcagggcctccaatgatcccgatagaaatcatcttacccgcgctcccagagtcaaatgggtgcgagcccaggccgttgtgctggtattagaaccagggacggtgttcaccacagtggaggacctcggatccaagatcctcctgacgtgctctctgaatgattccgctacagaggtaactggtcaccggtggttgaagggcggtgttgtactgaaggaggacgctctgcctggccagaaaaccgagttcaaggtcgactctgacgaccaatggggagagtacagctgtgtctttttaccggagcccatggggactgcgaatatccaactacacgggccaccgagggtcaaagcagttaagtcctccgagcacatcaacgagggggagaccgctatgctggtttgcaagtctgagagcgtacctcctgtgacagactgggcatggtacaaaattacagattcagaggacaaagcactgatgaatggcagcgagagccggttctttgtgagctccagccagggcaggagcgagttacacatcgagaacctcaacatggaagccgatcccggacaataccgttgtaacggcaccagctcaaagggatctgatcaggccatcatcactctgcgtgtccggtcccacttggcagctctatggccttttctgggaatagtggcagaagtccttgttctcgttacaattatattcatctacgaaaagcggcgaaaaccagaggatgttcttgatgatgacgatgcgggtagcgccccactgaaaagttccgggcagcatcagaatgataaaggtaaaaatgtcaggcaacggaactctagctag

SEQ ID NO: 215623 - DNA, 618 bp, Artificial Sequence
  Description of Artificial Sequence: Synthetic coding sequence
atgaagcagtccgatgcatcacctcaagagagagttgattccgatgatcaatggggggagtattcctgcgtgttcctgcctgagccgatgggcactgcaaatattcagttacacggcccacccagggtaaaagcagtgaaatcaagtgagcacatcaatgagggagaaaccgcaatgcttgtgtgtaagtcagagagcgttccgcctgtgacagactgggcttggtataagataactgacagtgaggataaagccctgatgaacggaagcgagtcgcgcttcttcgtgagctcctctcaaggtcgctccgagctgcatattgaaaatttaaatatggaagccgatcctggccagtataggtgcaacgggacttctagtaaaggatccgaccaggctatcatcaccctgcgggttcgttctcacctggctgcactctggccattcctcggcatcgtggccgaggtactggtgctggtcacgattatctttatctacgaaaagcgacgcaaacccgaggatgtccttgacgatgacgacgctggatctgctcccctgaagtcctcagggcagcatcagaacgataaaggcaaaaatgtaaggcagaggaacagctcatag

SEQ ID NO: 215624 - DNA, 810 bp, Artificial Sequence
  Description of Artificial Sequence: Synthetic coding sequence
atggctgccgctttgttcgttctgctggggttcgccctgcttggtacccacggagcatccggtgcggcaggaacggtgtttaccacggttgaggacctaggcagtaaaatcctgctcacttgcagcctgaatgattccgcgaccgaagtgaccggacacagatggctcaagggaggagttgtcctcaaagaagatgctctgcctggtcagaagacagagttcaaggtggattcagatgatcagtggggggaatacagttgcgtattcctccccgaacctatggggaccgccaacatacaactgcatggccctcccagggttaaggcagtaaagtccagcgagcatataaatgagggagagaccgcgatgctcgtgtgcaagagcgagtccgtccctccagtaacagactgggcctggtacaaaataactgattccgaagataaggctctgatgaatggcagcgaatcgaggtttttcgtcagttccagccagggcagaagtgagctccatatcgaaaacttaaacatggaagccgaccccggtcagtaccgatgtaatggaactagttcgaagggatccgatcaagcgatcataacactgcgggttcgatcccacctagccgctctgtggcctttcttggggatcgtggcagaggtgctagtgctagtgactataatctttatctacgagaaacgtaggaaaccagaagatgtcctcgatgacgatgacgcaggatcggctccactgaaaagttccggacagcatcagaacgacaaaggcaagaatgtgcgtcagcggaatagttcatag

SEQ ID NO: 215625 - DNA, 531 bp, Artificial Sequence
  Description of Artificial Sequence: Synthetic coding sequence
atgggaacagccaacatccagctccacgggccacctcgggtgaaagccgttaaaagctcagagcacatcaacgaaggtgagactgcaatgctcgtgtgcaagtctgaaagcgttcctcccgtgaccgattgggcttggtataaaattaccgactcagaggataaggccctgatgaatggatctgaaagccgattctttgtatcctcttcgcaaggaaggagcgaactccatattgagaacctgaatatggaggcagatcctggccaatatcggtgcaatggtaccagctccaaaggttcagatcaggcaatcatcaccctgagggtgcgatcacaccttgcagccttatggccattcctgggaattgttgccgaagtgcttgtactggtcaccattatcttcatttatgagaaacgtcggaaaccggaggatgtcctcgacgacgatgatgctggcagcgctcccctcaagtcctctggacaacatcagaacgataagggcaagaacgtgagacagcggaacagctcctag

SEQ ID NO: 215626 - DNA, 2985 bp, Artificial Sequence
  Description of Artificial Sequence: Synthetic coding sequence
atgcgccgtagaccgccttctcgcggtggcaggggagcggctcgagcccgagagacaagaaggcaacctcgacatcggagcggtagaagaatggctgaggctatatcatgtaccttaaactgtagttgtcaaagcttcaaaccgggaaaaattaatcatcgccagtgcgatcagtgtaagcatggctgggtggctcacgccctgtctaagctccgcattccacctatgtatccgaccagccaagtcgaaatcgtgcagtcaaacgtggtgttcgacataagctctctgatgctgtacggtactcaggccatccccgttcggcttaagattttgttggacagattattttcagtcctgaaacaggatgaggtgttgcaaatcctgcacgctctagactggaccctgcaggactatattcgtggctacgtcctgcaggatgccagtggcaaggtgctcgaccactggagcatcatgacctcagaggaggaagtggccacattgcagcagttcctacgcttcggagagacaaagtctattgttgaactcatggccatccaggagaaggaggagcagtcaattatcatcccaccgtctacagccaacgtggatataagggctttcattgaaagttgttcacaccgatccagctcattacccacccctgtggacaaaggcaacccaagctccatccaccccttcgagaacctgataagtaatatgaccttcatgctcccgtttcagttttttaaccccctaccaccagctctcataggctcattgccagagcaatatatgctggagcaagggcatgatcagagccaggacccaaaacaggaggtgcatggcccatttcccgattcctcgtttctgactagttcctctaccccttttcaggtggagaaggaccagtgcctgaactgcccagacgccataacaaagaaggaggattctacacacctgagcgattcttcctcatacaatattgttactaaatttgaacgcactcaactgtccccggaggcaaaagtgaaaccagaaagaaacagcctaggaaccaaaaagggcagggtgttctgtacagcttgcgaaaagacattttatgataagggtacactgaaaatccactacaatgcagtccaccttaaaattaagcacaagtgtaccatcgaagggtgtaacatggtctttagttcactgcgttctcgcaaccgccactctgctaaccctaatcccaggctacacatgcccatgaatcgaaataatcgagacaaggacctgagaaactccctgaatttagcctcatcagagaactacaagtgcccgggttttaccgtgacatcgcccgattgccgccctccaccgtcctatcctggtagcggggaggatagtaaaggacagccggcatttcccaatatcggccagaacggcgtactatttccgaatctgaaaactgttcagccggtgttacctttctatcgctccccagctacgccagctgaagtggccaacaccccaggtattttgccttctcttccactgctgtcctcttctattcctgagcagctgatcagtaatgagatgccatttgatgcactgcctaaaaaaaaaagccgcaaaagcagtatgccaattaagattgagaaggaggctgttgaaatcgccaacgaaaaaaggcataacctgtcctctgacgaggacatgcccctgcaggtcgtctccgaagacgaacaggaggcgtgttcaccccagagtcatcgagtctccgaggaacaacatgtgcagtccggcggacttgggaaacccttccctgagggcgagaggccgtgccaccgcgagtcagtaatagagtcatcaggcgctatatcccagacccccgagcaagccacacacaattcagagcgggaaaccgagcagactcctgccctgatcatggtcccacgcgaggtcgaagatggcggacatgagcattactttacccccggaatggaacctcaagttccattttctgattatatggagcttcagcagagactgcttgccggagggctcttctccgcactgagtaaccgcggaatggcatttccatgtttggaggatagcaaggaactggagcacgtcggacagcacgctcttgcaaggcaaatagaagaaaacaggttccagtgtgacatatgtaagaagacgtttaaaaacgcatgcagcgttaagattcaccataaaaatatgcacgtaaaagagatgcacacctgtaccgtggagggctgtaatgccaccttcccttctcggagatccagagatagacactccagcaatttgaatctgcaccagaaggcactctcacaggaagctctcgaatcctccgaagatcacttcagggccgcatatttactgaaggacgtggcaaaggaggcttatcaagatgtggcttttactcagcaggcatcccagacgagcgtgattttcaaggggacatctaggatgggatccctggtctatcccatcacacaggtgcatagcgcatcactggagtcctataacagcggccctcttagtgagggcacaattttagacctctccacaactagcagcatgaaaagcgaatccagctcacacagttcctgggactcagacggtgtaagcgaggagggaacggttctgatggaggattctgacgggaactgcgaaggtagttctctagtgcccggagaagatgagtaccctatctgtgtcctcatggaaaaggccgaccaatctttggcttccctgccgtccggactccctattacttgccatttatgccaaaagacatattcaaataagggtacgttccgggctcactacaagacggttcacctgcgccagctgcacaaatgcaaagtccccggatgcaataccatgttctccagcgtcagatcaaggaacagacattcccagaatccgaacctgcataagagcctcgcaagttctccctcgcatctgcagtag

SEQ ID NO: 215627 - DNA, 2964 bp, Artificial Sequence
  Description of Artificial Sequence: Synthetic coding sequence
atgagatgcaggaacatgttcttttctttcaaggccagtctttgtggctgcggagcggctactgccccaagtctgaccgccattagttgtactctcaactgttcttgccagtcattcaagccagggaagataaatcataggcagtgtgatcagtgtaagcatggctgggtggcacatgccctctcaaagctgagaattcctcccatgtatcctacttcccaggtcgagatcgtacaatctaacgtggtatttgacatttccagtcttatgttgtacggaacacaggctatccctgtgcggctcaagatactgctggacagactgttttcagtgttgaaacaagacgaggtgttacagatactccacgctctggactggaccctgcaggattatattaggggatatgttttacaggacgcttccggcaaagtcctggaccattggtccattatgacatccgaggaagaggtagctacactccaacagttcttacggttcggcgagacgaaatctattgttgagttgatggcaattcaggaaaaagaggagcagagcattattatcccaccttctaccgccaacgtggacatcagagccttcatagaatcttgcagccacagaagcagtagtttgccaactcccgttgataagggaaatccatcatctattcatccgttcgaaaatctcatttccaatatgaccttcatgcttccttttcagtttttcaatcccctccctcctgccctgattgggtccctgcctgagcagtacatgctggagcagggacacgatcagtcacaggatcctaaacaggaggtgcatggcccttttccagactcaagttttctgacctcatcaagcacaccgtttcaggtggagaaagatcagtgcttgaactgccctgatgccatcaccaagaaagaagattccacccacctgtccgattcctcttcctacaacattgtcaccaaattcgaaagaacccaactgagccccgaagctaaggttaagcccgagcggaattctctgggaactaaaaaaggccgagtgttctgtacagcctgcgagaaaaccttctacgataagggaacgctcaaaatacattataatgctgtgcacttaaaaattaagcacaagtgtactatcgaaggctgtaacatggtgtttagtagccttagaagcagaaatcgccactccgccaaccccaaccctcgccttcacatgcctatgaaccgcaacaatagggataaggatctaaggaacagcctgaatctggcatcctcagaaaactacaagtgcccaggatttaccgtcacttcaccggattgtagacctcctcctagctaccctggatcaggggaggattccaagggccagcctgctttcccaaatattggacagaacggggtgctgtttcctaacctgaaaacagtgcaaccagtgctaccgttttacaggagcccagctacacctgctgaggtggccaacactccaggtatcctgccttctcttcccttactttctagctctatacctgaacaattgatcagcaacgagatgcctttcgacgccctgccaaaaaagaagtctcgtaagagcagtatgcccatcaaaatcgagaaggaggcagttgaaatcgcgaacgaaaagcgacacaacctcagttccgacgaagacatgcccttgcaggttgtttccgaggatgagcaggaggcctgctcacctcagagccacagggtaagcgaggagcagcacgtacaatctggaggattaggtaagcctttcccagagggtgagaggccatgccaccgggagtctgtcatcgagagctctggagccatcagccaaaccccggagcaggccactcataactccgagcgtgagactgagcagacacctgctctgataatggtgcctcgagaagtggaggacggaggacatgagcattatttcacccctgggatggagccacaggtgccctttagtgactacatggaacttcaacaaagacttctggccggagggctgtttagcgcactgtctaaccgtggaatggcattcccttgcctggaagactctaaggaacttgaacatgtgggtcagcatgccttagccaggcagatcgaagagaatcgcttccaatgtgacatatgcaaaaaaacgtttaaaaacgcatgttctgttaagatccatcacaagaatatgcatgtgaaggaaatgcacacttgtactgtcgagggttgcaacgctacgttcccgagcaggagatcaagggacagacattcttccaatctcaatctgcatcagaaggcgctgagccaggaggctctcgagtcttcagaggaccactttcgcgctgcatatctactgaaagacgttgccaaagaagcgtaccaagatgtagctttcacccaacaagcctctcagaccagtgtgattttcaagggcacttctaggatggggtccctggtatatccgattacccaagttcactcggcctccctcgaaagttacaactctggaccactgtctgaaggaacaattctggatctctccacaacctccagtatgaaaagtgaatcttcttcacacagctcctgggactccgatggcgtgtcagaggagggcaccgtgcttatggaggatagtgacgggaactgtgagggctcctcgctggtgcctggggaggatgaatacccaatttgcgttctcatggagaaagccgaccagagtctggcaagcctcccatctggtttgcctatcacatgccatctttgccagaaaacatattcaaacaaggggacatttcgagcacactataaaactgtgcacctccgccaattgcacaagtgtaaggtccccggatgcaacaccatgtttagtagcgtccgctccagaaaccgtcatagccagaacccaaatctccataaatccctggcctcatccccgtcgcacctgcagtag

SEQ ID NO: 215628 - DNA, 2712 bp, Artificial Sequence
  Description of Artificial Sequence: Synthetic coding sequence
atggcgcatttggggcctacaccccctccccatagcctcaattacaaatctgaggatcggctgtctgagcaggattggccagcatacttcaaggtgccttgttgcggcgtagatacgtcccagatcgaaagcgaagaggctgaggtggatgtgcgggagcgcgagacacagcgcgacagggagccaaagagagctagagacctgactctgcgggactcttgtacagacaactcaatgcagttcgggacccgaactaccaccgccgagccaggcttcatggggacatggcagaacgctgacacaaatctactctttcgaatgagccaacaggctatcagatgtactctagtgaattgcacatgcgagtgctttcagccaggtaagatcaacctgcggacatgcgaccagtgtaagcatgggtgggttgcccatgccttggataaactgtccactcagcacttataccaccctacacaggtggagatcgttcagtctaatgttgtgttcgacatcagctcactgatgctgtatggaacacaggccgtccctgtgcggctaaagatactattagatcggttgttttctgttctcaagcaagaggaagttctgcacattctgcacggcctcgggtggaccctgagagattacgtaagaggctatatcctccaagacgctgccggtaaagtcctcgatcgatgggctatcatgtctagggaagaggaaataattacactgcagcaatttctcaggttcggtgaaaccaaatctatcgtggagctgatggccattcaagagaaagagggccaggccgtcgcggtacctagtagcaaaaccgactctgatatccgcaccttcatcgaatcgaacaaccggacccgaagcccatctctgcttgctcacctagaaaattctaatccatcttctatacaccactttgagaacatccccaattccctcgcatttctcttacccttccagtacatcaatcctgtgtccgccccacttttgggcctccccccaaatggccttctcctagaacagccaggcctccgattacgcgagcctagcctgagtacccagaacgaatataatgaaagctcagagtccgaggtatccccaaccccctataaaaatgaccagacccctaatcggaatgctctgacaagcattaccaatgtggaacccaagacggaaccagcttgcgtaagtcccatccagaactccgcacctgtgagtgacctcacaaagactgaacatccaaaaagctcatttcgcatccataggatgcggagaatgggttccgcttctcgaaaagggcgtgtcttctgtaacgcttgcgggaaaactttttacgacaagggtaccctgaaaattcattacaacgcggtacacctgaaaataaagcatcggtgtacgatcgagggctgcaacatggtgttctccagcttgaggtctcggaatagacactctgctaacccaaaccccaggttacacatgcctatgctgcgtaacaaccgggataaggaccttatccgggcaactagcggagctgctaccccggtgatcgcaagtacaaagtcaaacctagcactgacttccccaggtcgtcctccaatggggtttacaactcctccacttgacccggttctgcaaaatcctctgcctagccagcttgttttcagtggactcaagacggtccagccggtcccgcctttctataggagtctcctcactcctggcgagatggtttccccacccacttcgctcccgacgagtccaatcatccctacgtccggtacaatcgaacagcaccccccacccccttccgaacccgtggtgcctgccgtcatgatggctactcacgaaccatccgcggatctggcccctaagaaaaagcccaggaaatcctctatgcctgtcaagattgagaaagaaatcatagacacagccgatgagtttgacgacgaagatgacgatcccaatgacggcggtgcagtcgtgaacgatatgtcacatgacaaccactgtcattcccaggaggaaatgtcccccggtatgtcagtcaaggatttttcaaagcataaccgaactcgatgcatctcacgaactgaaattcggcgagctgattcaatgaccagcgaggatcaggaacctgaaagagactatgagaatgagtctgaatcaagtgagccaaagctgggtgaggaaagtatggagggggacgagcatatccacagtgaggtgagcgagaaggtgctgatgaacagtgagaggcccgatgagaaccatagcgagccctctcaccaggacgtgattaaagtgaaggaagagttcaccgatccaacttacgacatgttctatatgtcacaatacggactttacaacggcggtggcgcttccatggcagccctccacgagtccttcacttctagtctcaattatggaagcccccaaaagtttagccccgagggtgatctttgcagttctccagatcctaaaatatgctacgtgtgtaagaaaagctttaagagcagttatagcgtcaagttacattaccgtaatgtgcatctgaaggaaatgcacgtgtgcaccgtggctgggtgtaacgctgcctttcccagtcggagatccagagacaggtattgggagaaatcaaacgagcaaaacggactactcgttagctggggggagacactcagcagtttgaagtag

SEQ ID NO: 215629 - DNA, 3099 bp, Artificial Sequence
  Description of Artificial Sequence: Synthetic coding sequence
atggcccacctgggccctactcctccacctcactcactcaactacaaatccgaagataggttgtcagaacaggattggccagcgtacttcaaagtaccatgttgtggcgtggatacttcacaaatcgaggccattcgctgcacactcgttaattgcacttgcgagtgttttcaaccaggaaagatcaaccttagaacatgcgaccagtgcaagcatgggtgggtcgcgcacgctctggataaattgagcacgcagcatctttaccatcctacccaggttgagattgtacaaagcaacgtggtgttcgacattagctctctcatgttgtatggaacgcaggccgtcccagtgagactgaaaatactgcttgaccgtctgtttagcgtactcaaacaggaagaagtgctacatatcctgcacggtctcgggtggacccttagggactacgtgcgagggtacatcctgcaagacgccgcagggaaagtactggatagatgggcgatcatgtcccgcgaggaagagatcattacattgcagcagttccttcgattcggtgaaactaagtccatcgtagagctcatggctatccaggagaaggaaggccaggcagttgcagtgccaagcagcaaaactgattctgatatccgaacattcatcgaaagcaacaacaggactcggtccccgtcactgctagcccatctggaaaacagcaaccctagctcgatccaccacttcgaaaatattcccaactcgctcgcattcctgctgccgtttcagtacataaaccctgtgtccgcaccactcctcgggctgccacccaacggactgctcttggagcaacccggacttagactacgggagccatctctgtctacgcagaatgagtacaatgaaagcagtgagagcgaagtgtctccgactccctacaaaaacgatcagacacccaaccgcaatgctctgacaagtatcactaacgtggagcctaaaaccgagccagcctgtgtctctccgatccagaattccgcaccagtatcagacctgaccaaaaccgaacatcctaagtctagctttagaatacaccggatgcgcagaatgggctcagcatccaggaaaggacgagtgttttgtaatgcatgcggcaagaccttctacgacaagggtacactcaaaatccattacaacgcagtgcatctgaaaattaaacatcgctgcactattgaagggtgtaatatggttttctccagtcttcggtcccggaaccgccactcagcaaaccccaaccctcggctccacatgcccatgctccggaacaatcgggataaagatctcataagagccacatcaggagcagccacaccagtgattgcctcgacaaagtctaatcttgcccttacttcccccggacgcccacccatggggtttacaacacctcccttggaccccgtcttgcagaaccccttaccctcgcagcttgtgttctccgggctcaaaacggtccagcctgtccctcctttttaccggtcactgctgacccctggtgaaatggtctccccccctaccagcctgcctacctcaccaatcattcctacctccgggacaatcgaacagcaccctcctccaccgtctgagcccgttgtgccagcagtgatgatggctacccatgaaccaagcgctgacttggctcctaaaaagaagccaaggaagtcatcaatgcctgttaagatcgagaaagaaattatcgacactgctgacgagttcgacgatgaggatgacgatcccaatgatggcggagccgtggtaaacgatatgagccacgataaccattgtcactcacaggaagagatgtcgcctggcatgagtgtgaaggatttcagcaaacataaccggactaggtgcatttcaaggacggaaattcggagggctgatagtatgacttctgaggaccaagagcctgaacgcgactatgagaatgaatcagagtcctcagaacccaaactgggcgaggagtcaatggagggcgacgagcacatccattcagaagtaagtgagaaagtgttgatgaactccgagagacctgatgaaaatcactcagagccatctcaccaggatgtcattaaggtgaaagaagaattcactgacccaacctacgatatgttttacatgagtcagtacggcctttacaatggaggcggagcatccatggctgctctacacgagagctttaccagctctttaaattatggcagcccacagaagttttcaccagagggtgacctatgcagctcccccgacccgaagatctgctacgtctgcaagaaaagtttcaagagttcttatagtgtgaaattacactatcggaatgtacatttgaaggagatgcacgtatgtacagttgcaggttgcaatgctgctttcccctctcggaggagtcgggaccggcactccgccaatatcaacttgcaccggaagctgttaactaaagagctggacgatatgggtttggattccagccagccttccctgtcgaaagacttgcgggacgagttccttgtgaaaatctacggcgcacagcatccaatgggcctggacgtccgggaggatgcatcaagcccagctggcacagaagacagtcacttgaacggatacggacggggaatggcagaggactatatggtacttgacttgtctaccacatcctcccttcagagcagctcatccatccactccagcagggaatcagatgccggaagcgacgaggggattctgctagatgatatagacggcgcttccgacagtggagagagcgcccacaaggcagaggcccctgcactgcctggatcgctgggcgcagaggtgtcaggctctctcatgttctcatcactgtctggatccaatggcggaatcatgtgtaacatttgtcacaagatgtattcaaataaggggactctgcgcgtacactacaagacggtgcacctgcgagaaatgcacaagtgtaaggtccccggatgcaatatgatgttctcatccgttagatccagaaataggcacagtcagaaccctaatctgcacaaaaatattccattcacaagcgtcgattag

SEQ ID NO: 215630 - DNA, 3300 bp, Artificial Sequence
  Description of Artificial Sequence: Synthetic coding sequence
atggcccacttgggtcccactccgcctcctcacagcttaaattataagagcgaagaccggctgtctgaacaggactggcctgcttacttcaaagttccatgctgcggagtggacacatctcagatcgagtctgaagaggccgaggtcgacgtaagagagagagagactcagcgtgacagggaaccgaaacgggcacgtgatctaacactgcgagatagctgcacggacaactcaatgcagttcggcaccagaaccacaacagccgagccaggctttatgggaacttggcaaaacgcagacactaatctgctgtttcgcatgagccagcaggccatccgctgcactttggtgaattgcacgtgcgaatgctttcaacccggaaagattaacctgcgcacttgcgatcagtgtaagcacgggtgggtagcccacgccctggacaagctgtctacccaacatctataccacccgactcaggtagaaatcgtacagtctaatgtcgtattcgatataagctcgttgatgctgtacggtacacaagcggtgcccgtgagacttaagattctgttggaccgcctcttttctgtgcttaaacaggaagaagtgctgcacatcctgcacggtttaggttggactctgagggattacgtgcgagggtatattctgcaggacgctgcgggaaaagtcctagataggtgggcgattatgtcccgggaggaggagatcattacgctccaacaatttttgaggtttggcgagaccaagagcatcgtagagctgatggccatccaggagaaggaggggcaagctgtggctgtgcccagcagcaagacggattcagacatccgaacctttatcgaatctaacaacaggacaaggagtccgagcctcctggctcaccttgagaactccaacccctcatccatccaccatttcgaaaacatcccgaacagcctcgcgttcctattgccctttcagtacatcaatccggtttccgcgccattactagggctcccacccaatggattgctactcgagcagcctgggctgagactgagggagcccagcctgagcacccaaaacgaatacaacgagtccagcgaatccgaggtgtctcctacgccctacaaaaatgaccagacaccgaataggaatgcactgacgtccatcacgaatgtcgaacctaaaaccgagccagcatgcgtttctccaatccaaaattccgcaccggtgtctgatctgacaaaaaccgagcatccaaagtcatctttccggatacatcggatgagaagaatggggagcgcctccagaaaaggtagggtcttctgtaacgcgtgcggcaagaccttttatgacaaagggacactgaagatccattacaatgccgtgcatcttaagatcaagcacagatgcaccatcgaagggtgtaacatggtcttcagcagtttaagatccagaaacaggcactctgcaaacccaaacccccgactgcatatgcccatgctgcgcaataacagggacaaggatctaattcgagccacgtccggagccgctactcctgtgatagcatccacaaaatctaacttggcccttacgtccccagggaggccccctatgggattcactacccccccactagatcccgtacttcaaaacccgttgccttctcaactggtgtttagcgggctaaaaactgtacagccggtgcccccattttacaggagcttgctaacaccaggggaaatggtctctccccctacgtcgttgccaacatcaccaattatccctactagcggaactatagagcagcacccccctccgccatcagaacccgtggtccctgccgtgatgatggctacacatgaacctagcgccgatttagctccaaagaaaaaacccaggaagtctagcatgcctgttaaaatcgagaaagaaattatcgataccgccgacgaatttgacgatgaagacgatgaccccaacgacggcggtgccgtcgtcaacgacatgtctcatgacaatcactgccactctcaggaagagatgagccctggcatgtctgttaaggatttctcaaagcacaacaggacccgctgcatttcccggactgagataaggagagcagactcaatgacaagtgaggatcaggagcccgagcgcgactatgagaacgagagcgagtccagtgaacccaagctgggcgaagaatcaatggaaggggatgaacacattcactccgaggtgtcagagaaagtgttaatgaacagtgaacgccctgatgaaaaccatagtgagccgtcccatcaggatgtgatcaaggtgaaggaggaatttaccgatcccacctacgatatgttttacatgtctcagtatggtctttataacgggggaggcgctagcatggccgctctccacgagtcctttaccagtagtcttaactacggaagccctcaaaagttttccccagagggtgacctctgcagctcccccgacccaaaaatttgttacgtgtgcaagaagagcttcaaaagttcctacagcgttaaactacactaccgtaacgtccatttgaaagaaatgcatgtctgcaccgtggctggctgcaacgcagcctttccctcaagaaggtcgagggatcgccacagcgctaacatcaacttgcatcgtaagctccttacaaaggagctggatgatatgggacttgactcctcccaaccgtccctgtcaaaagacctgagggacgaatttctggtaaaaatctacggggcacagcaccccatgggattagatgtccgtgaggacgccagttcccctgcaggaacagaggatagtcacctcaacggatatgggaggggaatggccgaggactacatggttctggatctgtctacgacttcgtcgctgcagagttcaagcagcatccatagcagccgagagtccgatgccggatcagatgagggtattctgctggacgatatcgacggtgccagtgatagcggagagtctgctcacaaggccgaagccccagccctgcccggtagcctgggcgctgaggtcagcgggtccctcatgttcagctcactttctgggtctaacgggggtatcatgtgcaacatttgtcacaagatgtacagtaataaaggcacactccgcgtacactacaaaactgtacacctgcgggaaatgcataagtgtaaggttcccggatgtaacatgatgttctcatccgtgagatcacgcaacagacatagccagaatcccaacctgcataaaaatattcccttcacctcagtagattag

SEQ ID NO: 215631 - DNA, 984 bp, Artificial Sequence
  Description of Artificial Sequence: Synthetic coding sequence
ccatctgaacctgttgtgccagcggtgatgatggctacccatgagcccagcgcagatctcgcacccaaaaagaaacccaggaagtcctctatgccagttaaaatcgaaaaagaaattattgacacagcagatgagttcgatgacgaagacgatgatccgaacgatggtggagccgtggtgaacgatatgtcccacgacaatcattgccatagtcaggaagagatgtcacctggcatgtccgtcaaagactttagcaaacacaatcgaacgaggtgcatctctcggaccgaaatccgcagggccgattcaatgaccagcgaagatcaagagcctgaacgggattatgagaatgagtcagaatcatctgagccgaagctcggcgaagagagtatggaaggtgacgagcacatccacagcgaggtctctgagaaagtgttgatgaattcagaacggccagacgaaaaccatagtgagccgagtcaccaggacgtaattaaggttaaggaggaattcaccgaccctacctacgacatgttctatatgtcacagtatggactatacaatgggggaggtgcctctatggctgccttgcatgaatcttttacttctagcctcaactacggatcccctcagaaattctcacctgaaggggatttatgttcatccccagatccaaagatatgctacgtctgcaagaagagcttcaagtcatcttactctgtaaagctccactatcggaacgtgcacttgaaagaaatgcatgtgtgcacagtcgccggatgcaacgccgcttttccttctcgtcgctctcgtgaccgcaatcgtaacttaaggatggaacggaccattggccctggacaccgggactcacttcacttgcgaagaggcaacagtaatcgacctggcacttgttgtcttcatacgggcgactcacttgaggaaagtgtgatcgttagaatcagttgcaagcgactggaaagctag

SEQ ID NO: 215632 - DNA, 2583 bp, Artificial Sequence
  Description of Artificial Sequence: Synthetic coding sequence
tctgaggaagccgaggtagatgtgagggagcgggaaacacagcgtgatcgggaacctaagagagccagggatctgacactcagggacagttgtaccgataactccatgcagttcggtacccggacaaccactgcggagccaggttttatggggacttggcaaaacgctgatacaaacctcctgtttcggatgagccagcaggctatcaggtgcactctggtgaactgtacttgtgagtgctttcagccaggcaaaattaatctcaggacatgcgaccagtgcaagcacggctgggtagcccatgcgctggataaactgagcacacagcacttataccatcccacacaggtggagatcgtacagagtaacgtcgtgttcgacatatccagcctcatgctttatgggacccaggcagtgcctgtgaggttgaaaatcctcttggacagactctttagtgtccttaagcaggaggaagtgctgcacatactccatggcctgggatggacccttagggattacgtccgcggatacatcttgcaggatgctgccggaaaagtactggatcggtgggccattatgtccagggaagaagaaatcattaccttacagcaattcctgaggtttggcgagaccaagtcaatcgttgaactgatggctatccaggaaaaagaaggacaggcagtcgctgtaccctccagcaagacagactcagatatacgcacgtttatcgaatcgaataaccggacaaggagccccagtctgctggctcacttggaaaattccaaccccagttctattcatcactttgaaaatatcccaaacagtctggcatttctacttcccttccagtatataaaccctgtatctgctcctctgctgggcctgccgccaaacggactgctgctcgaacaacccggtctgagactgcgggagccaagcctctccacgcagaatgagtacaatgaaagctccgaatccgaggtctctcctaccccctataagaacgatcagacccccaaccgaaacgccctgacctctataactaatgtcgaacctaaaacagagcccgcttgcgtctcacccattcaaaattctgctcccgtttctgacctgacgaagacagagcaccctaaaagcagctttaggattcatagaatgcgcagaatgggttccgcgagccgcaaaggacgtgtcttctgtaatgcgtgcggaaagacgttctacgataagggtacgctcaaaatacactataacgccgtgcacctgaagatcaaacaccggtgcactattgaagggtgtaacatggtcttctcaagtctacgctcccgcaacaggcacagtgccaacccgaaccctaggctgcacatgccaatgttgaggaataatcgtgataaagatctcattcgggcaacttccggggcagctacacctgtgatagcgtccacaaaatccaacctggcgttgacttctccgggtagacctccaatgggcttcaccacgccccctctggatcccgtactccaaaaccccctgcctagccagttagttttcagtggtctcaaaacagtgcagcctgtgcccccattttatcgaagcttgctcacgccaggcgaaatggtgagcccaccaacatctctccccactagcccaattattcctacctccgggaccatcgaacagcatcctccacccccttccgaacccgttgtaccggcagtgatgatggccacccacgaaccttcagcggacctggcaccaaagaaaaaacccaggaaatcttctatgcccgtgaaaatagagaaggagatcattgataccgcagatgaattcgatgatgaggacgatgatccaaatgacggtggcgctgtggtaaacgatatgagtcacgataatcactgccatagccaggaggaaatgtccccagggatgtctgtcaaggatttctcgaaacacaataggactcggtgcataagcagaacggagattcgcagagctgactcaatgacaagcgaggaccaggaaccagaaagagattacgagaatgagtccgaaagcagcgaaccaaagctcggcgaagagtcaatggagggggacgagcacattcactctgaggtttctgagaaagtcctgatgaattctgagaggcccgatgagaatcattcagagccaagtcatcaagacgtaatcaaggtgaaagaggaattcaccgaccctacctacgatatgttttacatgagccaatacggattatacaacggcggaggggctagcatggcagccctgcacgagtcgttcacaagttctctgaactacggctctccccaaaaattctctccagaaggcgatctctgctctagcccagaccccaagatctgctacgtatgcaagaaatcttttaagtcatcctactctgtcaagctacattaccgcaacgtgcatctgaaggaaatgcatgtttgcacagtggccggttgtaacgcagcattccccagtaggcgcagtcgagaccggaaccgcaatctcagaatggagcgcaccattggcccagggcatcgagattcactccacctactgcctacatag

SEQ ID NO: 215633 - DNA, 1206 bp, Artificial Sequence
  Description of Artificial Sequence: Synthetic coding sequence
atggctcacttgggaccaacgcctcctccccattccttgaattacaaatctgaggatagattgtcagaacaggactggccggcatattttaaggttccgtgttgtggcgtcgatactagccagattgaatctgaggaagccgaggtggacgtgagagagcgcgaaactcagagggaccgcgagcccaagagggctagggatttgaccttacgcgatagttgtacagacaattcaatgcagtttgggacgcggacaaccacagcagagccgggttttatgggaacatggcagaacgcagataccaacttattgtttcgcatgtcacagcaggtcccactagcttgcacagggagagtgctgggcgctgacttctgcccaaacttggaagagccttatcatagactagaagtgcaggctatcagatgtaccttggtgaactgcacctgcgaatgctttcagcctgggaaaattaatctgagaacttgtgatcagtgcaaacatgggtgggttgcccatgccctggataagcttagcacacagcatctgtaccacccaacacaggtcgagatcgttcagtctaacgtggtctttgatatcagcagtctgatgctatacgggactcaggcagtgcctgtaaggctgaagatactgctggaccgactgttcagcgtgctcaaacaggaggaggtgctgcacatcctacacggcctgggctggacactgcgggattatgtgcgaggttatatcctgcaagatgccgctgggaaagtcctagatcggtgggcaattatgagcagggaggaagagattatcacattgcaacagttcttgagattcggggagaccaaaagtatcgttgaactaatggccatccaagagaaggagggacaggcagtagcagtacccagcagtaagactgacagtgacattcgaacgttcatcgaatccaataataggacaagatctcccagcttgctggcacaccttgagaattcgaatcctagcagcatccatcatttcgaaaatattcccaattccctggccttcctgcttccgtttcagtacatcaatcctgtgagtgctccgctgttaggtttgcctcccaacgggctgctactagagcagcctggccttcgcctccgcgaaccgagcctaagcacgcagaacgagtataatgagagctcagaatcggaagtatcaccctag

SEQ ID NO: 215634 - DNA, 306 bp, Artificial Sequence
  Description of Artificial Sequence: Synthetic coding sequence
atgtgtagattgctggtgccactcgcttgtaccggacgcgttctgggagcagatttctgccccaacctggaggagccctaccatcgcctggaggttcaagctattaggtgtactctggtgaattgtacctgcgaatgcttccagcctggaaaaatcaacctgagaacctgcgatcagtgtaagcacggatgggtggcccatgccctggacaaactgtccacccagcacttgtaccatcctacccaggtggaaatcgtccagtctaatgttgtctttgacatcagttctcttatgctctacgggtag

SEQ ID NO: 215635 - DNA, 1233 bp, Artificial Sequence
  Description of Artificial Sequence: Synthetic coding sequence
atggcgcatctgggaccgacaccccctcctcactcactcaattacaagagtgaggatcgactttcagaacaagattggccagcctattttaaggtcccgtgttgcggagtggacacctcacagatcgaaagcgaggaggcagaagtggacgtgcgggagcgggagacacaaagggacagggaaccaaagagagcccgtgacctcacccttcgtgattcctgcacagacaattccatgcagttcggcaccaggaccaccaccgccgaacctggattcatgggcacatggcagaacgccgacacaaacctgctctttcgcatgagtcaacaggccggactgaaactgctcacctcaggggatccgcctgtgctcgactttcagtccgcaggtatcaccggcgttagccattgtacaagactgaaggttgcaatgatcagtaaggctattagatgtacgttggtaaactgcacgtgcgagtgctttcagccaggcaaaatcaacctgcggacttgcgaccagtgcaagcacggctgggtcgcccacgcactggacaagctgtccactcagcacttgtatcacccgacgcaggtggagattgtgcagtccaatgtcgtgtttgatatcagcagtctgatgttgtatgggacacaggcagtgcccgtgcggctgaagatccttttggatagactatttagtgtgctgaaacaagaggaagtgctgcatattttacacggcctcggatggaccctgcgggactatgtccggggatacatcctgcaggacgctgcgggaaaagtgctggatcggtgggccattatgtcaagggaggaagagatcatcactctgcagcaatttctgcggttcggtgagactaagtcgatagtggaactgatggccatccaggagaaggaaggtcaagcagtggccgttccttcctccaagacggacagcgacattcgcaccttcattgagtccaataaccggacaaggtcacctagtctgctggcccaccttgaaaacagcaacccctcaagcatccaccatttcgagaacatccccaattctctcgcattcctgctaccctttcagtacattaaccccgtgagtgcacccctgttggggttaccaccgaatggacttctgcttgaacagcctggcctgaggctcagggagccttctttatcgactcagaatgaatataacgaatccagtgagagtgaggtaagcccgtag

SEQ ID NO: 215636 - DNA, 2712 bp, Artificial Sequence
  Description of Artificial Sequence: Synthetic coding sequence
atggcacacctcggcccaactccgcctccccacagtctcaattataagagcgaggatagactcagtgagcaggactggccagcctatttcaaggtgccctgctgcggagtcgacacatctcagattgagtccgaggaagctgaagtcgacgtaagagaaagggaaacccagagggatcgggagcctaaacgggcacgtgatctgaccctgagagacagctgcaccgataatagcatgcaattcggcaccagaactaccaccgccgagccagggtttatgggaacctggcagaatgctgacacgaacttgttgttcaggatgtcccagcaggctatccgttgcacacttgtcaactgtacctgcgaatgctttcagccgggaaaaattaatcttaggacttgtgatcagtgcaagcacgggtgggtggcacatgccttagacaagctatcgacccaacacctctaccatccaactcaggtcgagattgttcagagcaatgtcgtcttcgatatatccagtcttatgctttacggaacgcaagctgtgccagtgcggctgaaaatcctgctggatagattattttccgtgctcaagcaggaggaagtgctgcacattttacatggcctgggctggaccctacgggattacgtgagagggtacatccttcaagacgcagcaggcaaagtgctagatcgttgggccataatgtcccgcgaggaggagatcattacgctgcagcaatttctccgctttggggaaaccaagagtattgtggaactgatggccattcaggaaaaggagggccaggccgtcgctgtgcctagtagcaaaactgactcagatatccgaacattcattgaaagtaacaatcggactcggtctccctcgctgcttgctcatttggaaaacagtaacccgagttcaatacaccattttgagaacatccctaattcattggctttcctgcttccttttcagtacatcaacccagttagtgcccctcttcttggcttaccaccaaacggcctgctgctggagcaacctggtctaaggctcagggaaccctccctcagcactcagaatgaatataacgaaagtagcgagtctgaggtgtctcctaccccctacaaaaatgatcaaacccctaaccgtaatgccctgacaagtatcacaaacgtcgagccaaaaaccgaacctgcatgcgtctctccaatccagaactctgcaccagtaagcgacctcacaaagaccgaacatcctaagagttccttcagaatccatcgtatgaggcggatgggaagcgcctctcgaaaaggcagagtcttttgtaatgcctgtggcaaaacattttacgataaaggaaccctgaaaatccactacaacgccgtccacctcaaaatcaagcatcgctgcacaatcgaggggtgcaacatggtcttctcaagtctccggtcccggaacaggcatagtgctaaccctaatcccaggctgcacatgcccatgttacgcaacaacagggacaaggacctgattcgggctacaagtggtgccgcaacgcccgtgattgccagcacaaagtccaacttagccctcacatctcctgggcgaccacccatgggattcacaacaccccctttagatccagtgttgcaaaatcccctgccatctcagctagttttcagcgggctgaagactgtgcagcccgtcccacccttttataggtcacttttgacgccaggagagatggtcagtccccctacttcattgccaacgtctcctattatccctacttctggaactatagagcagcacccaccacccccatctgagccggtggtgcccgcagtaatgatggcaactcatgaaccaagcgctgatttagctccaaagaaaaaaccacggaaaagctccatgccggtgaaaatagagaaggaaatcatcgatactgcggacgaattcgatgatgaagacgacgatcccaacgatggaggagccgtcgtgaatgacatgtcgcatgacaatcactgtcatagccaggaggagatgtctcccggaatgagcgtgaaggacttcagcaaacacaacagaacgcgatgcatctctcggaccgagatcaggagagctgactccatgacttccgaagatcaggaaccagagcgcgactacgagaacgagtcagaatccagcgaaccaaagctgggagaagaaagcatggagggcgacgaacacatccattccgaagtatccgagaaggttcttatgaactccgagcggccagacgagaatcacagtgagccttctcaccaggatgtcatcaaagtgaaggaagagtttaccgatccaacctatgatatgttttacatgagtcagtatggcctctataacgggggaggagcctccatggccgcactgcacgaatcctttactagctccttaaattacggcagcccccaaaaattcagccccgaaggggatctgtgtagcagtcccgacccaaagatttgctacgtttgcaagaaatcattcaaaagttcatatagcgtcaagctacattacagaaatgttcatcttaaagaaatgcacgtttgtacagtcgccggatgcaacgccgctttcccctcgagaagatctcgggacagatattgggagaagtctaatgaacaaaatgggctgctggtgagttggggtgagaccctctcaagtctgaagtag

SEQ ID NO: 215637 - DNA, 2712 bp, Artificial Sequence
  Description of Artificial Sequence: Synthetic coding sequence
atggcacatctggggccaacaccaccgccacatagccttaattataagagcgaagataggctttcagagcaggactggcccgcttactttaaggttccatgctgcggcgtggatacttcccagatcgagtcagaagaagcggaagtagacgtgcgagagcgtgaaacacagcgagatagggagcctaagcgcgcaagggaccttactctgagggactcctgcacggacaactctatgcagttcggcacaaggacgaccacagctgaaccaggattcatgggcacttggcagaacgccgatacgaatttgctctttcgtatgagccagcaagcaattcgctgtaccctggtaaactgcacgtgcgagtgcttccaacccggaaagattaatttacgtacctgtgatcagtgcaagcacggttgggtagctcacgcacttgataaactgtccacacagcacctgtatcaccccactcaggtagagatcgtccagtcaaacgtcgtgttcgacatcagctcacttatgctgtatggtacacaggcggtacccgtgcgcctgaagatcctgttggaccggctgtttagcgtcctgaaacaggaagaagtcctccatattctccatggactaggatggactttgcgtgactacgtaagaggttacattctgcaggacgctgccggtaaagtgctcgatcggtgggctattatgagtagggaagaggagatcataacactacaacagttccttcgttttggagagactaagagtattgtggagctgatggccatccaggaaaaagaagggcaggccgtcgccgtgcctagctcgaagaccgattccgatattcgaacgttcatagagtcgaataatcgtacacgctccccctccctgctggcccatctagagaattccaatccttcatctattcaccactttgaaaacatccctaatagtcttgcctttctgctgccattccagtatataaatcctgtgtctgcaccccttctgggtctgcctccaaacggccttctgttggagcaacccggactgcgccttcgagagccctccctttctacacaaaacgaatataacgaatcttctgagtcagaagtgagccctaccccttataaaaacgatcagacccctaaccgaaacgcactgaccagcataactaacgtcgaaccgaagactgagccagcctgcgttagcccaatccaaaactcggcccctgtgtctgaccttaccaagaccgagcatcccaaatcaagttttagaattcatcggatgcggcgaatgggttccgcatctcggaagggcagggtcttctgtaacgcctgtggcaagacattttacgacaagggcactctcaagatacattacaatgcggtgcatcttaaaataaagcatagatgcacaattgagggatgtaacatggttttctcatcgctgcggagcaggaatagacacagcgcaaaccccaacccacgtctgcacatgcctatgcttagaaacaaccgtgataaggatttgattcgcgcaacgagcggtgccgctacaccggttatagcaagcaccaagtcaaacctcgccctgacctctccaggaaggcctcccatgggattcacgacacctcccctggaccccgtcctgcagaacccgctgccttctcagcttgtgttcagtgggctgaagaccgtccagcctgtaccccctttttatcgttcgctgctcacaccaggagagatggtgtccccacccacgtctctgccgacctcacccatcattccaaccagtggcacaatcgaacagcatccaccgcctccatctgagccggtcgttcctgctgtgatgatggcaacccacgaaccaagcgctgatctggcccctaaaaaaaaacctaggaaaagcagcatgccagtgaagatagagaaagaaatcattgacacagcagatgaatttgacgacgaagacgatgacccaaacgatgggggtgcggtagtgaacgacatgagtcacgataaccactgccactctcaggaagaaatgtctcctgggatgagtgtcaaggattttagcaagcacaacagaacaaggtgtatctctcgaactgagatccgccgtgccgactccatgacgagcgaagaccaagagccagaacgtgattatgaaaatgaaagtgagagttccgaacctaaactgggtgaagagagcatggaaggagatgaacacatacattcagaggtgagcgagaaagtgctcatgaatagcgagcggccagacgaaaaccacagcgaaccgtcccaccaggatgtgattaaggtaaaggaagagtttacggatcctacatacgacatgttttacatgtcccagtatggcttgtataatggaggaggtgcctctatggccgctctgcatgagtccttcacgtcctcactgaactatggatcaccacagaaattctcccccgaaggggacctatgctcttcgcccgatccaaaaatttgctatgtatgcaaaaagagcttcaagtccagctattcagtgaaactccattaccgcaatgtgcatctgaaagaaatgcatgtctgtaccgtggctggatgcaacgcggctttcccgtcccgccgatcgagagatagaaacagaaatttgcggatggaacggactatcggccctggtcaccgggatagtctacaccttagaagtacttag

SEQ ID NO: 215638 - DNA, 1950 bp, Artificial Sequence
  Description of Artificial Sequence: Synthetic coding sequence
atgctgtacggtactcaggcagtcccagttcgtcttaagatccttctcgaccgcctgttcagcgtcctgaagcaggaagaagtgttacatatcctgcatggtcttggctggacattgagggactacgtcagaggttatatcctacaggatgccgcaggcaaggtgcttgaccgatgggcaattatgtctcgggaagaggaaataataacgctgcagcaattcttgcgtttcggcgagaccaagagcatcgttgagctgatggccatccaggaaaaagaaggtcaggctgtggctgtgccttcctccaaaacggactccgacattcgaaccttcattgagagcaataatagaacgagaagtccctcactgctcgcacacctggagaacagtaatcccagctcgatccatcactttgagaatatccccaactccctcgcctttcttctcccctttcaatatattaatcctgtttctgcccctctacttgggctccccccaaatggcttgctactggaacaacctggcctgcgattgagagaaccctccctttctacccagaacgagtacaatgaatcctccgagtcagaggttagtcctacgccctataagaacgatcagaccccgaacagaaatgcattgacctcaattaccaatgtcgaacccaagacagagccggcatgcgtctcccccatccagaactcagcccctgtaagcgatcttactaaaacggaacatccaaaatcttcttttaggattcataggatgaggcgtatgggatccgccagtcgaaagggcagggttttttgcaacgcctgcggcaaaacgttctatgataaaggcactctcaagatccactacaacgccgtccacctgaaaattaaacatcgatgcaccatagaggggtgtaatatggttttttcctcactaagatctagaaatcgccactcagccaatcccaacccacggttacatatgcccatgttacggaataatagggacaaagaccttatacgcgcaaccagtggggcagcgacacccgttatagcctctacaaagagcaacttggccctgacatcaccaggaagacctcctatgggttttactactccccctctagaccctgtgctccaaaatcccctcccatcacagcttgtctttagtggtctgaaaactgtgcagcctgtaccccctttttaccggagtctcctcacccctggagaaatggtgtcaccaccaacttccttaccaacgtcacccattattcccacgtcagggacaatcgaacagcacccccctcctccatctgagcctgtcgttccagctgtgatgatggccactcacgagcctagtgccgatctggcgcctaaaaaaaagccccgaaaatcttctatgcctgttaaaatcgagaaggagatcatcgacactgctgatgagttcgatgatgaggacgatgatccaaacgacggaggggcagtggtcaatgatatgtcgcatgacaaccactgtcattcccaggaggagatgagcccaggaatgtcagtgaaggacttcagtaagcataaccgaactaggtgtatttctcggaccgagatccgccgtgccgacagcatgacctctgaagaccaggagccagagcgtgactatgagaatgaatcggaatccagcgaacccaagttgggtgaggaatcaatggagggtgacgagcacatacactcagaggtgagcgaaaaagtcttgatgaacagcgagcgcccagacgaaaatcacagcgaaccatctcatcaggatgtaataaaagtcaaagaggaattcactgaccccacctatgatatgttctacatgtctcagtatgggttatacaacggtggcggagcttccatggccgctctccatgaatctttcactagctcacttaactatggatcacctcaggttttgcccagacgctag

SEQ ID NO: 215639 - DNA, 3015 bp, Artificial Sequence
  Description of Artificial Sequence: Synthetic coding sequence
atgaccgacgacgtcaaagagccatcgcggttcagccttctattagcgataaggtgcaccctggttaactgtacttgcgagtgtttccagccaggcaagatcaatctacgtacgtgtgatcaatgcaagcatggctgggtcgctcatgccctggacaagctgagcacccaacatctctaccaccccacccaggttgaaatagtgcagtccaatgtcgtcttcgacatctcctccctgatgctgtatggcacccaagccgtcccagtccgtctaaaaatactgctggaccgtctgttctctgttctcaagcaggaggaggttcttcatattctgcatggtctcggatggaccctccgcgactatgtccgtggttatattctgcaggatgccgctggcaaagtgcttgatcgttgggccatcatgtcccgagaagaagaaataatcacactccagcaattcctcaggtttggggaaacaaaatcgattgtagaactaatggccatccaggaaaaggagggacaggccgtcgctgttccctcatcaaagaccgatagcgatatcaggacatttattgaatccaacaatagaacacgctccccttctctgctggcccatctcgagaactccaacccgagttccatccatcacttcgagaatattcccaacagcctcgccttcttgctgccattccagtacattaatcccgtaagcgctcctctactgggccttccacccaatgggctgttactcgagcagcccggactcagactccgagaacctagccttagcacacagaacgaatacaacgagtcttccgagtcggaggtgtccccgaccccctacaagaacgaccagacccctaacagaaacgctctgacgagtattactaacgtggaacccaagacagaaccggcatgtgtgtcacccattcagaatagtgcacccgtttcggatctcacaaaaaccgaacaccctaagtcgagcttccggattcatcgaatgagacgaatgggttctgctagccgcaaggggcgtgtgttttgtaacgcttgtgggaagacattctatgataaagggacacttaaaatccattacaacgctgtgcacttgaagatcaaacaccggtgcacaatagaaggttgtaatatggttttctcctccctgcggtcccggaacagacactctgcaaatcctaaccccaggctgcatatgccaatgttgaggaacaatcgggataaggacctaattagggctaccagtggagcagcaacgccagtgatcgccagcaccaagtctaacttggctctgacatcccccggaagacccccaatgggtttcaccacacctccgctcgaccctgtgctccaaaacccactgcctagccagctcgtgttttcaggcttgaaaaccgtccagcctgttccaccattttaccggtcactgctcacacccggagaaatggtctccccaccaaccagcctgcctacttcacccattatacctacatccgggaccattgagcaacaccctcccccacctagcgaacctgttgtacctgctgtgatgatggctacccatgagccatcggccgatttggcacctaagaagaagccccgaaaatcgagcatgccggtgaaaatagaaaaggagattatcgacacagcggacgagttcgatgacgaggacgacgatccaaatgacggaggcgctgtcgtaaacgatatgagccatgataatcattgccacagccaggaagagatgagccctggcatgagcgttaaagacttcagcaaacataatcggacccggtgtataagccgcaccgaaatccggagggccgattcgatgacaagtgaggatcaggaaccagagcgtgactacgagaacgagtcggagagcagtgagccaaaactgggagaggaatcaatggaaggggacgagcatattcactctgaggtgagtgagaaggtactgatgaatagcgagaggccggatgaaaatcacagcgagccttctcaccaggatgtgatcaaggtgaaggaagagttcaccgaccctacttacgacatgttttatatgtcccagtacggcctctataatgggggaggggcaagcatggcagcactgcacgaatccttcacttcctcattgaattacggatctccccaaaaattctcccccgagggggatctctgcagctcaccagacccgaagatctgctatgtgtgcaaaaaatctttcaaatcctcgtacagcgtcaagctccattatcgcaatgtacacctgaaagagatgcatgtgtgtaccgtggctggctgcaatgccgcattcccgtctagaaggtctagagataggcattcagccaacatcaacctgcatagaaagcttctgaccaaggagctcgatgacatggggctggacagcagccaaccatcgttgtcaaaagacttacgagacgagttccttgtgaaaatttacggagcgcagcatccaatgggtctcgatgtcagagaagatgctagctctcccgcaggcaccgaggattctcacctgaatggctacggcagaggcatggccgaggactatatggtcctggatctctctacgacgagcagcctccagtcctccagctccattcattcttctagggagagcgatgccggatccgatgagggaatacttctggacgacatagacggcgctagcgactcaggtgagagcgcccataaagccgaagcccctgctctgcccggatctctcggggcagaggtttctggatcgttgatgttcagcagtctatctggctccaacgggggaattatgtgtaacatctgccataagatgtatagtaataagggaactctgagagtgcactacaaaacagtgcaccttcgggaaatgcacaagtgtaaagtgccgggatgcaacatgatgttttccagcgttaggtccagaaatcgacactcgcaaaacccaaacttacacaaaaacattcccttcaccagtgtcgattag

SEQ ID NO: 215640 - DNA, 11781 bp, Artificial Sequence
  Description of Artificial Sequence: Synthetic coding sequence
atgggaaatgaggtctcgctggagggaggggctggagatggacccctacctccgggaggtgccggtcccggtcccggtcctggtcctggacctggcgcagggaagcccccatccgccccagccggaggaggtcagctccccgcagctggtgccgcacgaagcaccgctgtaccccctgtcccagggccagggcctggcccaggcccagggcctggcccaggctcaacttcgcgtaggctcgaccctaaagaacccctgggcaaccagcgggcagcatcacccacacctaaacaggcatcagccacgacaccgggtcacgaatccccccgagagactcgcgcacagggacctgctggccaagaggccgacggccctcgtaggactctacaagtggattccaggactcagagaagcgggagaagtccgagtgttagtcccgaccgcggaagtactcctactagcccctactccgttccccagatcgcgccattgccatcaagcaccttgtgccctatctgcaaaacctcagacttgaccagtactccctctcagccaaattttaatacctgcacacagtgccacaacaaggtgtgtaaccagtgcggctttaacccaaacccccacctgacccaagtgaaggagtggctctgcttgaattgccagatgcagcgcgctctcggcatggacatgacaaccgctcccagatcgaaaagccaacagcagttgcactctccagccctgtccccagcccattctcccgctaagcagcctctggggaagcccgaccaggaacgtagccgaggtcccggaggaccccagccaggcagccgccaagccgagacagccagggcgaccagtgtcccaggtcccgcacaggctgctgctcctcccgaggtggggagggtgtcaccgcagccacctcaacctactaagccgtctacggccgagccaaggcctccagctggtgaagctcccgctaagtcagcgactgccgtaccggctgggttgggcgcaaccgagcaaactcaagagggccttactggaaaactttttgggctcggtgcgtcattgcttacccaggcttccactttgatgtccgtacagcccgaggccgatacacaagggcagcccgcaccatctaaggggacacccaaaatcgtctttaatgacgcttcaaaagaggccggtccgaagcccctcggcagcgggcctggtcctgggccagcccctggggctaaaacagagccaggcgcaagaatggggccagggagtggcccaggcgctctgcctaagacaggcggaactacttcgccaaagcacgggcgtgccgaacatcaagcggcttcgaaagcagccgcaaagcctaaaacaatgccaaaggagagagccatatgcccactgtgccaagctgagctcaacgtgggctccaaatcgccagccaattataacacctgtacgacctgtagactgcaggtttgcaatctgtgcggattcaaccctactccacatttggtggagaaaaccgaatggctgtgccttaactgtcaaaccaagcgactgcttgagggtagtttgggcgagccaacgccactccctccacccaccagccagcagccaccggtgggagctccacatcgcgcatcaggcacaagcccacttaaacaaaaagggcctcaggggcttggacaaccatccggcccactgccagctaaggcctctccactgagcaccaaggcctcacctttgccaagcaaggcaagtccgcaggctaagcccctgcgtgcctccgaacctagtaaaaccccttcttcggtgcaggaaaaaaaaacaagagtccccaccaaggccgagccaatgcctaaacctccacccgagaccaccccgacccctgcaacaccaaaagtcaaatccggggttcgtagagctgaacccgctactccagtggtgaaagcagtgccagaagcaccaaagggaggagaagcagaggatctcgtgggaaagccatactctcaggacgcatccaggtctccccagtccctttccgacacggggtactcctccgacggcatcagtagcagccagagcgagataaccggggtcgtccagcaggaagtcgagcagctcgactctgctggcgttaccgggccacacccgccaagcccctcggaaattcacaaagtgggctcttctatgcgccctctgctccaagctcagggtcttgcccctagcgagcgctcaaaacccttgagctccgggacaggcgaggagcaaaaacagagaccacacagcctgtcaattacaccagaggccttcgacagtgacgaggaactggaagatatcttggaggaggacgaggactcagccgaatggcggagacgcagagaacagcaggacacagccgagtccagcgatgactttggctcacaactgcgccacgactacgtggaggactctagcgagggaggtctctccccgctacccccacagccccctgcccgagcggctgagctaactgacgaagacttcatgaggcgacagattctcgaaatgtcagcggaggaggacaatctggaagaggatgatacggccaccagcggcagaggcctggccaaacatgggacccagaagggagggcctagaccacgacccgagccctcacaggaaccagccgctctcccaaagcgaagattgcctcacaacgcgacaaccggttatgaggagctccttcccgaggggggttcagctgaggcaaccgacgggtccgggactcttcaagggggactcagaaggttcaagacaattgagctgaactccacaggcagctacggccatgagctcgatttgggccagggacccgaccctagcctggatcgcgagccggaactcgagatggaaagtctgaccggttcgcccgaagaccgcagtcgaggagaacacagctccacgttgccagcttctacacccagctacacatcggggaccagcccgacctccctcagcagcctggaagaagatagtgactcttctccatcgcgacggcaacgtttggaggaggccaaacagcaaagaaaagctagacaccgatcacatggcccactgctgccaacgattgaggacagttcagaagaggaagagctgcgcgaagaagaggagctcctgcgtgagcaggagaaaatgagggaggtcgagcagcagaggattcgctctaccgcgcgaaaaaccaggcgggataaggaggagctgcgcgcacagcggagaagggaacggtctaaaactccgccatcaaatctgtctccaatcgaagatgcctcccccacagaggaactgaggcaagcagccgagatggaagagcttcaccgctcctcttgctccgaatacagccctagccccagcttggactccgaggccgaggcactggatggaggaccctccaggctgtataaaagtggaagtgagtacaaccttcctacctttatgagtctctacagtccaacagaaacaccaagcggatcttctacaaccccttctagcgggcgacccctgaagtccgccgaggaagcctacgaagaaatgatgaggaaggctgaacttctgcaacgccagcaaggacaggctgcaggagctcgcggaccacacgggggacccagccaacctaccggaccgaggggactaggcagcttcgagtaccaggatactactgacagagagtatggccaggcggcacaacccgcagcagagggtactccggcatctctgggcgcagctgtatacgaggagatcctccagacctcacagtctatagttagaatgcgccaagcaagttcccgcgacctggcattcgccgaagataaaaagaaagaaaaacagttcctgaacgccgaatctgcatacatggaccccatgaagcagaacgggggaccactcactccagggacgtcccccacacagcttgctgcgcctgtgtccttcagcacccccaccagctcagattcaagtggaggcagagtaatcccggacgtgagagtgacacagcactttgccaaagagacccaggaccctttgaagcttcattcttctcccgcaagtccaagcagtgcgagcaaagaaatcggtatgcccttcagtcaggggcctgggactccagccacaacggcagttgccccttgtccagctggtttgcccagaggttatatgacccccgcttccccagctgggtcagagaggtccccatcgccctcttctacagcacacagctacgggcactccccaaccacagccaactatggcagccagaccgaagatctgcctcaggcacctagcggcttggccgcagcaggtcgcgcagccagggaaaaaccactctccgcatctgacggcgagggcggaaccccccagccttcaagggcttactcctactttgcctcgtcttctccacctcttagccccagttctccgtccgaatcccctactttctcgcccggaaagatggggccacgggctaccgcggaatttagcacacaaacgccatcaccagcccctgcgtccgacatgcctcgtagcccaggcgcacccacaccgtcacctatggtcgcccaggggacacagacaccccacaggcctagtacaccaaggctggtgtggcaagagtctagccaggaagcaccctttatggtgattacattggcttctgacgcctcctcccaaacgcggatggtgcacgcttccgcttctacatcccctctgtgttcccccacagagacacagcccaccactcacggatacagtcagaccacacccccatctgtgagccagctgccaccagagcctccgggaccccctggattccctcgcgtgccttctgcgggtgcagatgggcctcttgccctctacggctggggtgcacttcctgcagagaacatcagtctgtgtaggatatcctcagtgcctggtacttcaagagtggaaccaggccctaggaccccgggaacggcagtggtcgacctccggaccgcggtgaagcctacacctataatcctgacagatcaaggcatggaccttacctctttggcagtggaggctaggaaatatgggctcgcacttgacccaatccccggtcgccagtcaacggccgttcagccactcgtgatcaatctgaatgcccaggagcacaccttcctggcaaccgctaccactgttagtattaccatggcgtcaagcgtgtttatggcccaacagaaacagcctgtggtgtacggtgacccttatcaaagccggttagattttgggcagggtggcggatcccctgtgtgccttgcacaggtgaagcaggtcgaacaagctgtgcagacagcaccataccggtccggcccacggggacggccacgcgaggctaagttcgcgcgttataatctccccaaccaggtcgctcctctcgcccgtcgcgacgtgctaatcacccagatgggtactgcgcagtcaattggtttaaaacccggaccagtgccagaaccaggcgcagagccccaccgcgcaacacctgcagaactgaggtcacacgccctgcccggtgcaaggaagcctcacacagtggttgttcagatgggagagggtaccgctggtacagtgacaactcttctccctgaagagccagcgggagcacttgacctgacagggatgaggcctgagtcacaactggcatgctgcgatatggtgtacaagctgcccttcgggagcagctgtacaggcaccttccaccccgcaccatctgtccctgagaagtctatggcagatgccgctccacccggacagtcctcatctccgttctacggccctcgggaccccgagccaccagaacccccaacataccgcgctcaaggggtggtaggaccagggcctcacgaagaacaaaggccatacccacaggggctgcctggtcgactgtactcaagtatgtccgacaccaacctggctgaggccggattgaactatcacgcccagcgcatcggccaactattccagggcccagggagagatagcgctatggatctttctagtctgaaacattcctactcccttggctttgcagatggacgctacctcgggcaggggctgcagtatggctctgtgaccgacctgaggcatccgacagaccttctggctcatcctctccctatgagacgatactcctcggtcagtaacatctattcagaccacaggtacggtcccagaggcgatgccgttgggttccaggaggccagccttgcacagtactcagcaactaccgctcgagagatttcgcgaatgtgtgcagccttgaacagcatggaccagtacggcggtcgccatggatctggcggaggaggaccagacttggtccagtatcagcctcagcatgggccaggtctgagtgcccctcagtcactggttcccctccgtcccggtttgcttggtaatccaacattccccgaaggccaccccagtcctgggaatcttgcccagtacggaccggcagccggacagggcacagcggtgagacagctcctgccctctacggctaccgtacgagcagcagacggcatgatttattcgaccattaacacaccaattgccgctacgcttccaattaccacgcagcccgcaagtgtgctcagacccatggtgcgcggaggaatgtacagaccctatgcctctggtggcattactgcggtgcccctgaccagcctgaccagggtgccgatgatagccccaagggtccctctcgggcctacgggcctgtaccggtaccccgctccctcgcggtttcccatcgcctctagcgtgcccccagcggagggtccagtctatttgggtaagccagccgctgccaaggccccaggagcaggcggtccctctagacctgagatgcctgtcggtgccgctcgcgaggagcccctgcctactaccacccccgctgccattaaagaagccgctggggctcccgctcccgcaccactcgcgggacagaagccacccgctgacgctgctccgggtggcggttcaggggctcttagccgaccgggattcgaaaaggaagaagccagccaggaggaacgacagcggaagcagcaagaacagctgctgcagctcgaacgcgagcgcgttgaactcgagaagctgaggcagctgaggctgcaggaagagctggagcgggaaagagtggagctgcagcgacaccgcgaggaagagcagctactggtgcagagagagctgcaagaactccagacgatcaagcaccatgtgctgcaacagcaacaggaggagaggcaggcccagtttgcgcttcaaagagaacaattggcccaacagagactccagttagagcagatccaacagctccaacagcagttacagcagcagcttgaagaacaaaaacagcgacagaaggccccattcccggctgcttgcgaagcccctggcagggggcctcctcttgcagccgctgaattagcccaaaatggtcagtactggccgccactgacacacgctgccttcattgcgatggccggtcctgaagggctcggacaaccccgagagccagtgctccacagaggcctgccttcatcggcttcggacatgagcctgcagaccgaagagcagtgggaggcctctagaagcggcattaaaaagaggcactccatgccaaggctgcgagacgcctgcgagctggaatccggaacggagccttgtgtagttcgccgtatcgctgattcatccgtgcagacagacgacgaggatggtgagtcacggtacctcctgagccgtagaagaagagctcgacgttcagcagactgtagtgtccagactgatgacgaagactccgccgagtgggaacagcctgtgagacgcagaagaagccgattgccaaggcatagtgatagcgggtccgattccaaacacgacgcaactgcgtccagcagctcggcggctgccactgtcagagccatgagctccgtgggcatccagactatatcagactgctcagtgcagaccgaacccgatcaattacccagggtctctccagccatccacatcaccgccgctacggacccgaaggtggaaatcgtgaggtacatctccgccccagaaaagactggccgaggggagagcctcgcttgtcaaacagaacctgatggccaggctcagggcgtggcaggccctcagctggtaggccctacggctattagcccctatctgcctgggatacagatagtgacacccggaccacttgggagattcgagaaaaagaagcccgaccccctcgagattggctatcaggcacacttaccacctgagagtttgtcacagctggtgagccggcaaccaccaaagagtccgcaagttctctattcccctgtttctcctctatcccctcatcggctattggatacaagctttgccagctccgagcggctcaacaaagctcacgtcagccctcaaaagcacttcaccgccgactctgcgctccggcagcagaccttgcctcgcccaatgaagactcttcagcggtccttgtccgatccaaagcccctcagtcccactgccgaggagtcggccaaggagaggttctcactgtaccaacatcaggggggtctcggtagccaagtgagtgctctcccacctaattctctggtccgcaaggtcaagaggacactaccttccccacctcctgaggaggcacatctgccactggctggccaggcatccccccagctgtatgccgctagcctgctgcagcggggtctgaccggacctaccaccgtgcccgctaccaaagccagcctgctccgggagctggaccgtgatttgcgactagtggagcatgagagtacgaagttgcgcaaaaagcaggctgagttggacgaggaagagaaggagatcgacgccaagctgaagtacctggagctgggcattacccagcgcaaggagagccttgccaaagatagagggggacgcgattacccacctcttcgcggactgggtgagcacagggattacctgtcggactcagagctgaaccagttgagattacaggggtgtaccacacccgctggccagtttgtggactttcccgctaccgccgctgcaccggctacaccctccgggcctactgctttccaacagcccagattccagcccccagccccacagtactctgccggatcaggaggaccgacacagaacggttttcctgcccaccaggccccaacttatccgggaccctcaacgtatcccgcacccgcattccccccaggggcatcctatcccgcagaaccaggtttacccaatcagcaggcttttcgacccacaggccattatgccggtcagaccccgatgccaaccacccaatcaacccttttccccgtgcccgctgactcacgggctccacttcaaaagccgcgtcagacgtccctggccgatctggagcagaaggtgccaaccaattatgaggtgatagcctcacccgtcgtgcccatgtccagcgctccctcggagacatcttacagtggcccagcagtatcttcggggtacgagcaggggaaggtgcccgaagttccaagggctggagacaggggttcggtcagccagagccctgcaccaacctacccatccgacagccattatacatccctcgagcagaacgtccctcggaattatgtcatgattgacgatataagcgagttgactaaagatagcacctctaccgccccagattctcagaggctggagcctcttggccctggcagcagtggcaggccaggtaaggagcccggagagccaggcgtccttgacgggcctaccctgccttgttgctacgctcgaggtgaggaagagtccgaagaggatagttatgaccctagagggaaaggaggtcacctcagatctatggagtccaacggacggccagccagcacacattactacggggacagtgactaccgtcacggagctcgagtagaaaaatacggaccgggtccgatgggaccaaagcatccatctaagagcctggcacctgccgcaatctcatcaaagagatctaagcacagaaagcagggaatggagcagaaaatatcgaagttcagtcctatcgaagaagccaaggacgttgagtccgacctcgctagttatccaccgccagctgtgagcagttcactggtgtcaagggggaggaaatttcaagacgagattacatatggcctgaagaagaacgtgtatgaacaacagaagtattacggaatgtcctctcgtgatgctgttgaggacgacaggatatacgggggttcttccagatcccgggctccttccgcttatagtggggagaagttgtccagtcacgattttagtggctggggcaaggggtacgaacgagagagagaagcagttgagagattgcagaaagctggccctaaacctagcagcctgtcaatggctcactcccgagtgcggcctccaatgcggtcccaggcctccgaagaggaatcacccgtgagcccacttggacggccaagaccagccggtggccctcttcctcctggcggagatacttgtcctcaattctgctcatcccactccatgccggacgtccaggagcacgtcaaagatggtcctagagctcacgcttataagagggaagagggatatattctggacgactcacactgtgttgtgtctgatagtgaagcttatcacttaggccaggaggagaccgactggtttgataaaccgagggacgctcggtcagatcgcttccgccatcacggaggtcacgctgtttcctcttcaagccagaagcgagggcctgcacgacactcttaccatgattatgacgagccacctgaagaaggcctttggcctcacgacgaaggcggacctggtagacatgcaagcgctaaggaacacaggcacggcgaccacggcagacactcggggcgtcacacaggagaagagcctgggaggcgcgctgctaagccgcacgcaagagatcttgggaggcatgaggcacgaccccacagtcagccaagctccgctcccgctatgccaaagaaggggcagccaggatatccttcctccgcagagtatagccagccgtcccgggcatcttccgcgtaccatcacgccagcgatagtaagaagggtagtcgccaggctcactctggtcccgcagctctgcaatctaaggctgaacctcaggcccaacctcagttgcagggcagacaggctgcacctggccctcagcaaagccagagtccgtcgagtcgacagattcccagcggcgcagcctctcgtcagcctcaaacacagcaacagcaacaggggcttggcctgcagcccccacagcaagccctgacgcaggcccgacttcagcagcaaagccaaccaactaccaggggatccgcgcctgccgcttctcagcccgctggcaagccacagcccggtcctagcactgcgacaggcccacagcccgcagggcctcccagagctgagcaaactaatggaagtaaaggcactgcaaaggcgccacagcagggacgcgctccccaggcccaacctgcccctggtccaggcccagcaggcgtcaaggctggcgctcgcccagggggtacacccggagcccctgctgggcagcccggtgccgatggagagtctgtcttctccaagattctcccagggggtgcagcagagcaagccggaaagctgacagaagctgtgtcagctttcggcaaaaagttttcatccttttggtag

SEQ ID NO: 215641 - DNA, 702 bp, Artificial Sequence
  Description of Artificial Sequence: Synthetic coding sequence
atggagcctaccgcaccatcgttaacagaagaggacctgacggaggttaaaaaggatgctcttgagaacttgagagtgtatttgtgcgagaagattattgcggagaggcactttgatcacctgcgcgcaaaaaagattctctcgcgagaggataccgaggagatcagctgtcgcactagctctcggaagagagccggaaaactcttagattacttgcaagaaaatccgaaagggttggacacactggtcgaatcaattaggagagaaaaaacacaaaatttcctgatccagaaaattaccgatgaggtactgaaactgcgcaatatcaagctcgaacatctgaaagggctcaagtgtagttcatgcgagcccttccctgacggtgctaccaataacttaagccgcagcaactctgacgaatccaatttcagtgaaaagttgcgggcatctactgtcatgtaccaccctgagggcgaatcctccacaactccttttttctcaaccaactcctccctaaacttgcccgtgctcgaggtgggtaggacagaaaacacgattttttcaagcactacgctgccacgccctggcgatccgggtgcaccgccactgccccctgacctgcagttggaggaggaagggacctgcgccaactcatcggaaatgttcctgcctctgcggagccgtacagtgtcgaggcagtag

SEQ ID NO: 215642 - DNA, 702 bp, Artificial Sequence
  Description of Artificial Sequence: Synthetic coding sequence
atggagcccaccgcaccatccttgacagaagaagacctgacagaggtgaaaaaggacgcactggagaacctgagagtgtacctgtgtgagaagataatagcggaacgccatttcgaccacctgagggctaagaagatactgagcagggaggatacagaggagatctcgtgtcgaacatcaagtagaaaacgggcaggcaagcttctggactacctgcaggaaaatccgaagggcctggataccctcgttgagagcattaggcgcgaaaagacacagaattttctcatccagaagataacggatgaggtgctgaaacttcgcaatatcaagctggagcacctcaagggattgaagtgtagctcttgtgaaccattccctgacggggcaacaaataacctgtctcgcagcaattccgatgagtcgaatttctcagagaagctgcgcgctagcactgtgatgtaccatcctgaaggggaaagctcaactacccccttcttctccacaaattctagcctgaatttgcccgtgttggaggtggggcgtactgagaatacaatttttagcagcacaacccttccaagacctggagatcccggtgctcctccattgcctccagaccttcaactggaggaagagggcacatgtgccaacagcagcgagatgtttcttcccctcaggagtcggactgttagtaggcagtag

SEQ ID NO: 215643 - DNA, 471 bp, Artificial Sequence
  Description of Artificial Sequence: Synthetic coding sequence
atggaacctacggctccgagcctgacagaagaagaccttacagaggtgaagaaagatgccctcgaaaacctgcgagtgtatctctgcgagaaaatcatcgcagaacggcacttcgaccatttgagagcgaaaaaaattctgtctagggaggacactgaggaaattagctgtcggaccagtagccgaaagagggccggaaagctgctggactacttacaggagaacccgaaggggctagatactttggtcgagtccatcagaagagagaagacgcaaaactttcttatccagaagattactgacgaggttctcaagctcagaaacatcaagctggaacacctgaaagatggggcaactaacaatctgtctcggtccaattctgacgaaagtaacttctctgagaagttgcgggctagtactgtaatgtaccacccggagggcgagagttcgaccactccgtttttttattag

SEQ ID NO: 215644 - DNA, 2508 bp, Artificial Sequence
  Description of Artificial Sequence: Synthetic coding sequence
atgtcccggaggaaacaaggaaaaccgcagcatttgtccaagcgggagttctcacccgaaccgctggaggcaattctgacagacgacgaacccgaccatgggccacttggggcacctgagggtgatcacgacttacttacctgcggtcagtgtcaaatgaatttccccttaggggatatccttatctttattgagcacaagcggaaacagtgtaatggctccttatgcttggagaaagccgttgacaagccccctagcccctctcccatcgaaatgaagaaggccagcaatcccgttgaagtgggcattcaggtaacccctgaggatgatgattgcctgtccacttcatcaagggggatatgcccaaaacaggagcatatcgcggataaactgctccattggcgtgggctcagttctcctcgttccgcccacggggcactgatccctacgcctgggatgtccgccgagtacgctccccaggggatatgcaaggatgaaccctccagctacacctgtaccacatgtaagcagcccttcacctcagcttggtttctgctgcagcacgcgcaaaacacccacggactgagaatttatttggagtctgagcacggctctcccctgacacccagggtgggaataccttccggcctcggtgctgaatgcccttcccaaccaccccttcacggcattcacatagccgataacaatccctttaatctcctccggattccagggagcgtgtctcgcgaagcttccggcctggccgaaggacggttcccgccaacaccaccactgttcagccctcctccaagacaccatctagatccccaccgtatcgaaagactcggcgctgaggagatggccctggcaacccaccacccttccgcctttgaccgcgtgctcaggctgaatcccatggcaatggagcctcccgcaatggacttttctagaagactgcgtgagctagctggcaacacctcttcaccaccgctgagcccagggagaccctcacctatgcagaggctgctgcagccttttcaacctggctccaagcctccctttctggccactccccctctgcctcctctgcagtctgcgcctcctccatcacagcccccagtgaaaagtaagtcctgcgagttctgcgggaagacattcaaattccaatcaaatctggtcgtgcataggagaagccacactggtgagaagccttacaaatgcaatttatgtgatcatgcctgtacccaggcaagtaaactcaaacgccacatgaaaacacacatgcacaaatctagcccaatgacagtgaaatcagatgacggcttaagcacggctagtagtccagagcccggtacatcggatctggttggttctgcatcctccgccttgaaatccgtggtggccaagttcaaaagcgaaaacgacccaaatctaattcccgagaacggggatgaggaagaggaggaggatgatgaggaagaggaagaagaagaggaggaagaggaagaggaattgaccgaatctgaaagggtagattacggctttggactgagcctggaagcagctagacaccacgagaactccagcaggggagccgtagtaggcgttggtgacgagagccgcgcactgcccgatgtcatgcagggaatggtgctttccagtatgcaacatttttcggaagcgttccatcaagtattgggggaaaagcataagaggggtcacctagccgaggccgaaggtcaccgagacacctgtgacgaggattccgttgcaggcgaatcagaccgtattgatgacggtaccgtgaacggtagaggttgctcaccgggtgagtccgcttccggaggcctgagtaagaagctactcttgggctcacccagcagcctgtcccctttttctaagcgcattaagttagagaaagagttcgatttgcccccagctgccatgcccaatacagaaaacgtctatagccaatggcttgcgggatatgctgccagccgtcagctgaaggatccattcctctcttttggggatagtcgtcagagccccttcgcatcctccagcgagcatagtagtgagaatggatccctcaggttctctaccccgccaggcgaattggatggcggaattagcggcaggtcaggcactggcagcgggggtagtacaccccatatctctggtcctggaccgggaagaccatcgtccaaagaggggcgaagaagcgacacttgtgaatactgtggcaaagtgttcaagaactgctctaatttgaccgtacacagacgttcacacactggagagcgtccatataaatgcgaactctgtaactatgcttgcgcccaaagctcaaaattaaccagacatatgaagacccacgggcaggtcggcaaagatgtttataaatgtgagatatgtaaaatgccgttttcagtgtacagcactctggaaaaacatatgaaaaaatggcattctgacagggtactgaataacgacatcaaaaccgagtag

SEQ ID NO: 215645 - DNA, 2322 bp, Artificial Sequence
  Description of Artificial Sequence: Synthetic coding sequence
atgagccgtcgcaagcaaggaaaaccacagcatctgtctaaaagggaattcagcccagaacctctggaagctatcctcaccgacgacgaacccgatcatgggcctctcggagcgccagagggggatcatgatttattgacctgcggccaatgccagatgaacttccctttgggggacattctcattttcatcgaacataaacggaagcagtgcaatggatctctgtgcttagaaaaggcagtcgacaagcctccctcaccgtcacccatcgagatgaaaaaggccagcaaccctgtcgaggtgggcatccaggtgacgccagaagacgatgactgtttaagtacatctagtagagggatatgcccaaaacaggagcacatcgcagacaagctgctgcactggcgcggattgagcagtcccagatccgcccatggcgcactgattccaacaccgggaatgtccgccgagtacgcccctcaggggatctgcaaggatgaaccttcctcctacacttgtactacatgtaaacaaccattcacctccgcctggtttctgctgcaacatgcccagaatactcatggcctcagaatctacttggagtccgaacatggatctccacttacgccaagggttggcattcccagtgggcttggagctgagtgtccaagccaaccgccacttcacggaattcacatagcagacaacaacccctttaatctgctacggattcctggcagtgtgagcagagaagcctctgggctcgcagaaggcagatttcccccaacacctcccctatttagcccgccacctcgacaccacctggatcctcaccgcattgaacggctgggggcagaggagatggccctcgccacacatcacccatctgccttcgaccgagtgctccggcttaatcctatggctatggagccaccggctatggacttctccagaaggctgcgggagctggccggtaatacttcgtcacccccactgtcgcccggaagaccgagcccaatgcagcgcttgcttcagccctttcagccaggctccaagccgccattcctggcaaccccccctctgccccctctccagtcagcgcctcctccctcccagccccctgtgaagagcaagtcctgcgagttctgcgggaagaccttcaagtttcagagtaaccttgttgttcatagaagatcccacaccggcgaaaagccttacaagtgcaacttgtgcgaccacgcttgcactcaggcttctaaactgaagcgacatatgaaaactcacatgcacaagagctcaccaatgacggtgaagtccgacgacgggctcagcaccgccagttccccggagcctggcacaagtgatctcgtggggagcgcatctagcgcattgaagtctgtggtggccaagtttaagtccgagaacgatccaaatcttattccagagaacggtgacgaggaggaggaagaggacgacgaggaggaggaagaggaggaagaggaagaggaggaagagttaaccgagagcgagcgagttgactacggattcggactctctcttgaggcggcacgccaccatgaaaacagctcacggggtgccgtggtgggcgtcggtgatgagtcaagggctttgcccgacgtcatgcagggtatggtcctgtcttccatgcaacatttctctgaggcctttcaccaagttttgggcgaaaagcataaacgcggacacctggcagaggccgagggccatcgcgacacatgcgacgaggatagcgtggctggcgagtccgatagaattgatgatggcactgtgaacgggagggggtgtagcccaggtgagtctgccagcgggggactttccaagaagctgctgttagggagccccagcagcctgagcccattcagtaagagaatcaagctggagaaagagttcgacttgccccctgccgctatgccgaatacggaaaacgtttattcacagtggctcgccggatatgccgctagcagacagttgaaggatccatttctgtcttttggcgactcgaggcagtctccctttgcaagcagctccgagcacagctcagagaatggaagtctacgcttttcaactccccctggagagcttgacgggggtatcagtgggagaagcggcaccggatcaggaggttcgaccccccacatcagtgggccaggtccaggaaggccaagttcaaaggagggccgtcggagcgacacatgttcttctcacactcccatccgtcggtccacacagagagcgcaggatgtgtggcagttctcggatgggagtagccgcgcactgaagttctag

SEQ ID NO: 215646 - DNA, 2406 bp, Artificial Sequence
  Description of Artificial Sequence: Synthetic coding sequence
atgtctagacgcaagcagggcaagccacagcacctgagcaaacgggagttcagccctgagccccttgaggccatccttacggacgatgagcctgatcatgggccacttggggcaccggaaggagaccatgacctactaacatgtggacagtgtcagatgaattttcctctgggagatatactcatttttattgagcataagcggaaacaatgcaacggatcactttgtcttgaaaaggccgtcgataaaccaccaagcccatctcccatcgagatgaaaaaggcatccaatcccgtcgaggttggaatccaagttaccccagaagatgacgactgcttgtctacttcaagccgcggaatctgccccaagcaagaacatatcgcgggtaaggatgaaccctcaagctatacctgcacaacttgcaaacagcccttcacatctgcctggtttcttctccagcacgcccagaatacacatggactgaggatttatctggagtccgaacatggatcccctcttacaccccgtgtaggaataccatccggcctcggagccgaatgcccttcacagccccctctccacgggattcacatagctgacaacaatccttttaacttactccgaatccccggatcagtaagccgggaggcctctgggcttgctgagggtcggtttcctcctactccacccctgttcagtccaccacctcgacaccacctcgatccccaccggatcgaacggcttggagccgaagaaatggctctggctacacaccacccttctgcatttgatagggtgctcaggctcaaccctatggctatggaaccgccagcaatggatttcagtcgaagattgcgagagttagcagggaacacctcgagcccccctctctctcccggtcgcccttcaccaatgcagcggttgctccaaccatttcagccaggatccaagcccccattcctcgctacacccccactgcccccactgcagtcagcccctcccccttcgcaaccacctgtaaagtcaaaatcttgcgagttttgcgggaaaacctttaagttccagtctaatttagtggtgcacagacggagtcatacgggagagaagccctacaagtgcaacctctgcgatcacgcatgcacccaggccagtaaactgaaacgccacatgaagacacacatgcacaaaagcagcccaatgacagtgaaaagtgatgacggcctgtcaacggcatctagccccgaacccggaacctccgacttggtgggctccgcatcttccgcactgaagtcagtggtggcaaagtttaagtctgagaacgaccccaacctgatccccgagaatggcgatgaagaagaggaggaagacgacgaagaggaagaggaggaggaggaggaggaggaggaggaacttacagagagtgagagggtagactacggattcgggctcagtctagaggcggcacgccaccacgaaaatagcagccgcggagctgtggtgggtgtcggtgatgagtcaagagctctgccagatgtcatgcagggcatggtgctgtccagcatgcagcatttcagcgaagccttccatcaggtcctcggcgagaagcacaagcgcggacacctggccgaggctgagggtcatagagacacttgtgatgaggactccgtagcaggtgagtccgacagaatcgatgacggcactgtgaatggacgcggatgcagccctggcgagtcagctagcggtggacttagcaaaaagcttctgctcgggtctcccagttccttgtcccctttttccaagagaattaagctggagaaagaatttgatttacccccagctgcaatgcccaacaccgaaaacgtctattcgcagtggctagctggctacgctgcctctaggcagcttaaagacccattcctaagtttcggcgacagtcggcagagtccattcgctagcagttccgagcattcgagcgagaatggatctctgaggttttcgacccctcccggtgagcttgatggcggtatcagtggcagatccggcaccggctctgggggttccaccccccacatcagtggcccaggtccaggccgacctagcagcaaggaaggcaggcgctctgatacatgtgagtactgcgggaaggtgtttaaaaactgttccaacctcactgttcacaggagaagccataccggagagcgcccatacaaatgtgagctgtgcaactacgcatgcgcacagagttctaagctcacaaggcatatgaagactcacgggcaggtgggcaaggatgtgtacaagtgcgaaatatgcaagatgccattcagtgtttactcaaccctcgagaagcatatgaagaagtggcactccgacagagtgctaaacaatgatatcaagaccgagtag

SEQ ID NO: 215647 - DNA, 732 bp, Artificial Sequence
  Description of Artificial Sequence: Synthetic coding sequence
atgagtcgccgaaagcagggcaagccccagcatttatctaagagagagttcagccccgagccactggaggccatcctaacagatgacgagccagatcacggcccactaggtgcccctgagggagatcacgaccttctaacttgtggccagtgtcagatgaacttccccctaggtgacatcctaattttcatcgaacacaagcgcaaacaatgcaacggatccctatgcctcgaaaaagcagtcgacaaacctcctagtccttcacccattgagatgaagaaggcctctaacccggtggaagtgggaatccaggtgacaccagaggatgatgactgtttgagtacatcttccagagggatctgtcctaagcaggaacatatcgctgataaactgctccactggcgaggactgtcctcccccaggtctgctcacggcgctctcataccaacacctggaatgtcagccgagtacgcccctcaggggatctgtaaggacgagccctcttcatatacatgcaccacttgtaaacagccctttacaagtgcctggttcctgctccagcatgctcagaatacccacggacttcgaatttatctggaaagcgagcacggaagtcctcttacacctcgcgtgctccacactcccccttttggcgtggtccctagagaacttaagatgtgtgggagttttagaatggaagctagggagcctctgagtagcgaaaaaatttag

SEQ ID NO: 215648 - DNA, 2397 bp, Artificial Sequence
  Description of Artificial Sequence: Synthetic coding sequence
atgagcaagggcacagacgaggacattttctccggggtgagtttttttctgactcgcctgtcaaggtgcgaaccatcaaggcgtccaccacctgcccctcaacctactatgtcccgtagaaaacaaggaaaaccacagcatctttctaagcgagaattcagcccagaacctctagaggctatattaactgatgacgagccagaccacggccctcttggagcgcctgagggtgatcacgatctgctgacgtgcggccagtgtcagatgaatttcccccttggagacatactgatctttatcgaacacaagagaaagcaatgtaacgggtctctctgtctggagaaggccgtagataagcctccgagcccatccccaatcgaaatgaagaaagcatctaatcccgtcgaggtggggattcaggtgactccggaagatgatgattgcctctccacatctagccggggaatttgcccaaagcaggaacacatcgctgataagctgctccattggcgaggattatcctcccccagaagcgcccacggcgcactgatacctaccccgggaatgtcagctgagtatgctccacagggcatttgtaaagacgagcctagctcatatacctgtacaacctgcaagcagccatttacctccgcttggtttctgttgcagcacgcccagaacacacacggcctgcgaatatatctagagtctgagcacggaagccctctgaccccaagagtgggcattcctagcggccttggggcagaatgcccaagccagcccccacttcacggtattcacattgcggataacaatccttttaatcttctcaggatcccaggatccgtatcacgcgaagcaagtgggctggcagaaggacgcttcccccctacacccccactgttttcaccgcctcccagacaccatctagacccacataggatcgagaggttgggagccgaagagatggccctggctactcaccacccttcagccttcgatcgcgtgttaaggcttaaccccatggcaatggagccccctgcaatggacttctcgaggcgcctccgggaactcgcgggtaacacttcaagtccaccattgtcacctggaagacctagtcccatgcagagacttctccaaccgtttcaacccggatccaagcccccatttttggccacccctccactgcccccattgcagagcgcaccaccaccctctcagccccctgttaagtcaaagtcttgtgagttttgtggcaagacgtttaaatttcagtccaacctggtcgtacaccggaggagccataccggtgagaaaccctacaagtgcaacctgtgtgatcatgcttgcacccaggcgagcaagctgaagaggcatatgaaaacccacatgcacaagtcaagccctatgacagtgaaatcggatgacgggctttctactgcctctagtcccgagcctggaacgtctgacctcgtggggagcgcgtcctccgctttgaaatcagtggtcgctaagttcaaatcagagaacgatccaaacctgatccctgaaaacggcgacgaggaggaagaagaggatgacgaggaagaagaagaggaggaggaggaagaagaggaggaacttaccgagagcgagcgagtagattatggtttcggcctgagcctggaggccgtcgtcggggtgggggatgaatctcgggcactccctgatgtcatgcagggcatggtactgtcgagtatgcagcacttctccgaagccttccatcaagtgctgggtgagaagcacaagcggggacatcttgctgaggctgagggccaccgcgatacttgcgacgaggactctgtggcaggcgaaagtgataggatcgatgacggcacggtcaacggcagaggatgttctcctggcgaatcagcctccgggggtctcagcaaaaaactcctgctcggatccccgtcctcgctcagtccctttagcaagcgtatcaagctggaaaaggaattcgatctgccccctgctgccatgcccaacaccgaaaatgtgtattcccagtggctcgccggttacgctgcttccaggcagctcaaagatcctttcttgagcttcggtgacagtcgccagagccctttcgctagcagctctgagcattcaagcgaaaacggatcactgaggttttccaccccccctggcgaactggacggaggcatctccgggcgttcaggcaccggatctggcggaagtacaccacatatctctggaccaggcccaggcagacccagctcaaaggaaggtcgtagatccgatacctgcagctcccacaccccaatcagacgctcgactcaaagagcccaggacgtctggcaattctctgatgggtccagccgagcacttaagttctag

SEQ ID NO: 215649 - DNA, 1329 bp, Artificial Sequence
  Description of Artificial Sequence: Synthetic coding sequence
atgtctgccgagtacgcgccacaaggaatctgtaaagacgagccctcctcttacacttgcaccacctgtaagcagcctttcacatcggcgtggtttctccttcagcacgctcagaatacacatgggctgaggatttatttggaatcggagcacgggtcccccttgaccccccgaagcaacctcgtggtgcatcgcagatctcacacaggcgagaaaccctacaagtgtaacctttgcgatcatgcttgtactcaggcttcaaagctgaagcgacacatgaagacacatatgcacaaatccagtcccatgaccgtaaagtccgatgacggtttgagcacggcatcatcaccagagccaggcaccagtgatttagtcggctccgctagctctgccctgaagagcgttgtcgcaaaatttaagagtgagaatgacccaaacctaatccccgagaatggcgacgaggaggaggaggaggacgatgaggaggaagaagaagaggaggaggaggaagaggaagagctgacggagagcgagagagttgactatggctttggcctaagcctcgaagctgccaggcaccacgagaattcatcccgcggagccgtcgtcggtgttggcgatgaaagccgcgctctccccgatgttatgcaaggcatggttctgtcctcaatgcagcatttcagtgaggcttttcatcaggtgttaggggagaagcataaacgcggtcatctagcagaggccgagggccacagggatacctgtgatgaggattccgtcgccggagagagcgatcggatcgacgacggcaccgtcaatggccgtggctgcagtccaggggaaagtgcctctggcggactgtctaaaaaactgttgttagggtctcctagcagtctcagtcccttctcaaaaaggattaagctggagaaggaatttgacttgcctcctgccgcaatgcctaacaccgaaaatgtatacagccagtggttagcaggatacgcagcatccaggcagttaaaagacccctttctgagtttcggagacagcaggcagtcaccctttgcaagctccagcgagcactcttcagagaacggttccctccgcttctcaacaccccctggagaattagacggaggaatttccgggcgaagtggaactggctcgggcggatccacaccccacatcagcggccctggcccaggtaggccttccagtaaagagggcagacgctcagacacctgtagttcccacacccctatccgccgtagcacacaaagggcacaagatgtgtggcagttttcagatggcagctcccgagccctcaaattctag

SEQ ID NO: 215650 - DNA, 2382 bp, Artificial Sequence
  Description of Artificial Sequence: Synthetic coding sequence
atgtcccgcagaaagcaaggaaaaccgcagcacttgtccaagcgcgagtttagcccggagccccttgaagccatactgactgacgacgagcctgatcatggcccactgggggctccggaaggcgatcacgacctcttaacatgtggtcaatgtcagatgaatttccccctgggcgacattttaattttcatcgagcataaacggaaacaatgcaatggttccctgtgcttagaaaaagcggtggacaagccaccctctcccagcccaatcgaaatgaagaaggcctctaaccctgttgaggtcggcatccaggttacacctgaggacgatgactgtcttagcacgtccagccgaggaatctgtcctaagcaggagcacatcgctggtaaggatgaaccttcttcttatacctgcacaacatgcaagcagcctttcacatctgcctggttcctgctccaacatgcccaaaatacacacggactgcgcatttacctggagagtgagcatggcagtccactcaccccgagagtagggattccatctggcttaggggcagagtgcccgagccagcctcccttgcatggaatacacatagctgataacaacccattcaatctgcttaggatcccgggatccgtgtctagagaggccagcggacttgccgagggcagattcccacccacccccccactattctcccctccacccagacaccatctggacccacaccgcatcgagcgtttgggagcagaggagatggctctggccacacaccacccttcggcctttgacagggtacttaggctgaacccgatggccatggagcctccagcgatggattttagccggcgactgcgagagctagctgggaacacaagctctcctccactgagtccaggtagacctagtccaatgcagagacttttgcagccatttcagcctggctccaaacccccattcttggccacacctcctctaccacccttgcaaagtgccccaccaccgtcgcagccccctgtgaagtccaagagctgcgagttctgcggtaaaactttcaaattccagtcgaatctggtcgttcacagacggtcccacacgggcgagaaaccttataaatgcaatctgtgtgaccatgcttgtactcaggcaagcaagttaaaaagacacatgaagacccacatgcacaaaagcagtcccatgacggtgaaatcagatgacggcctgagcactgcatcaagcccagagcctggaacgtctgacttagtgggttcagccagctcagccttaaagagcgtcgtcgccaaattcaagtccgagaatgaccctaatcttatcccagagaatggagacgaggaggaggaggaggatgatgaggaggaggaggaggaggaggaggaggaggaagaggagctaaccgaatctgaaagagttgactatggctttgggcttagcctggaggctgccaggcaccatgagaattctagtcgaggggcagttgtgggcgtcggagatgagtcaagagccctgcctgatgtaatgcaggggatggtgctgtccagcatgcaacactttagcgaggctttccaccaagttctgggggagaagcacaagagagggcacctggccgaggctgagggccacagagacacatgtgatgaagactcagtcgctggggaatcagataggattgatgatggaactgtgaacggcagaggttgctctcccggtgaaagcgctagcggaggactgtccaaaaagctcctgcttggctctcctagctctctcagcccttttagtaaacgcattaaactcgaaaaagaatttgacctgcccccagccgcaatgcctaatactgaaaatgtatattcccagtggcttgcaggctatgccgcaagccggcagctcaaggacccattcctgtcgtttggcgactccagacagtccccatttgcgagcagttctgagcactcctcagagaatgggagtctccggttctctacccctccaggcgaactggatggaggcattagtgggagatctggaactggatccggcggatccacaccccatatctctggaccagggccaggcagaccgtcaagcaaggaggggagacggagtgacacgtgcgagtattgtgggaaggtcttcaaaaactgcagcaacctgacagtgcaccgccgatcccataccggagagcggccttataagtgcgaattatgtaattatgcatgcgcccagagctctaaactgacaagacatatgaagacacacggacaagtacttcataccccgcctttcggcgtggtccccagagaactaaaaatgtgtggctcattcaggatggaagcgagagagcccttgtcttctgagaaaatctag

SEQ ID NO: 215651 - DNA, 2472 bp, Artificial Sequence
  Description of Artificial Sequence: Synthetic coding sequence
atgtcgcggaggaagcagggcaacccccagcatctgtctcagagagagctgattacacccgaagcggatcacgtggaggctgccatcctcgaggaggatgagggtctggagattgaggaaccatccgggttagggttaatggtaggcggtcccgacccggacctgctgacatgtggtcagtgccagatgaattttcctcttggcgacatccttgtctttatcgagcacaagagaaagcagtgtggagggagcctgggcgcatgttacgacaaggccctcgataaagattcccctccgccatcatcccggtccgagctcagaaaagtttcggagcctgttgagatcgggatacaggtgacaccagatgaggacgatcatctactgtcccccaccaaagggatttgcccgaagcaggagaacatcgctggaaaggatgagccttctagttatatatgtactacttgtaagcagccttttaattcagcttggtttctgctgcaacacgcccagaacacgcacggcttccggatctatctagaaccgggacccgcaagctcctccctaactccacgtctcacaataccacctccactgggacccgaggctgtggcacagagtcctctgatgaacttcttgggtgactccaatccctttaatctgctacggatgactggacctatcctgagagaccaccctggcttcggagagggtaggctacctggcaccccgcctctgttcagtccgccacctcgccaccacctggaccctcacagactgagcgctgaagaaatggggctggtggcccagcatcccagtgccttcgacagggtgatgaggctgaaccccatggccatcgactcccctgctatggacttttcccgcaggctgcgggagctggcagggaattcgagcaccccacccccagtttccccagggagaggcaacccgatgcaccgtctgctgaaccccttccagccatcccctaaaagccccttcctgtcaactcctccgttaccacccatgcctcctgggggtacaccacctccccaaccccctgcgaagagcaaatcgtgcgagttttgtggcaagacctttaagtttcagtccaacttgatagttcacaggagatcccacaccggtgaaaagccctacaaatgtcagctctgtgatcatgcttgctctcaggcttcgaaacttaaacggcacatgaagactcacatgcacaaggcaggatctctcgctggccgatctgacgacgggttatccgccgcaagctctcccgaacccggaacatcggagctggctggtgaaggactcaaggccgcagacggtgactttaggcatcatgagagcgacccttccttaggacacgaacccgaagaagaagatgaggaggaggaggaggaagaagaggagctgctgctggaaaacgagtcaagacccgagagctctttcagtatggacagcgagttatctagaaatcgggagaacggcggaggtggtgtcccaggtgtgcccggagctgggggaggcgcagctaaagcccttgcagatgagaaggccctggttttaggaaaagtgatggagaacgttgggctcggggcactacctcagtacggagagctgctcgctgataagcagaaacgaggagctttcctaaagcgggctgcgggtggtggggacgcaggagatgacgatgatgctggcggatgcggcgacgctggggcaggaggtgccgttaacgggcgtggagggggatttgcccctggcactgaaccattcccaggcctcttccctcgtaaacccgcacctctcccctcccccggtttaaactccgctgccaaacggattaaggtggagaaagatctggagctgccccctgccgcactaatcccatcggagaatgtctactcccaatggcttgtcgggtatgcagcttcccgccacttcatgaaggacccgttcctcggctttacagacgcgaggcagtcgccattcgctacttctagcgaacactcaagtgagaatggatctctaaggttcagcacaccccctggcgatctcttggacgggggactttctggtcgctcaggcaccgcctccgggggatcaacccctcatctgggtggacccggaccaggcaggccctcgtccaaggagggcagaagaagcgatacgtgtgaatactgcgggaaggtgttcaaaaattgttcgaacctcacagtccaccggagaagccacaccggagagcgcccatacaagtgtgaactgtgtaactatgcttgcgcccagagctcgaaattgacccgacatatgaagacacacggacaaattggtaaggaggtgtaccgctgtgatatatgccaaatgccattttcagtgtatagcaccctggagaagcatatgaagaagtggcatggcgaacacctgcttaccaatgatgtaaaaatcgagcaggcggagagatcatag

SEQ ID NO: 215652 - DNA, 2685 bp, Artificial Sequence
  Description of Artificial Sequence: Synthetic coding sequence
atgagtagaagaaagcagggaaacccgcagcacctgtctcagcgcgagctgattacccccgaggctgatcacgtggaagctgcaattctggaagaagatgagggactggaaatcgaggaacctagtggcttaggtctgatggtaggtggccctgacccagatctgctcacatgcggccagtgccagatgaacttccctttgggtgacatactggtgttcattgaacataagagaaagcagtgcggcggtagccttggagcatgctacgataaagcactggataaagacagcccacctcctagctccagatcagagctgcgcaaggtgtcagagcctgtcgaaatcggcatccaggtgaccccagacgaagacgaccacctactctccccaactaaaggcatctgcccaaagcaagaaaacatcgctggtccttgcagaccagcacagcttcctgcagttgccccaatcgcagcgagttcccacccccactcaagcgtcattaccagccctctgcgcgctctcggcgcactgccaccctgcctgccattgccatgctgctcagccagacccgtgtccggagacggaacgcagggcgaagggcaaaccgaagccccttttggttgccagtgccagctttccgggaaggatgaaccgagctcttatatctgcaccacctgtaagcagccttttaactcagcttggtttctgctacagcatgcacagaacacccacggctttcgcatctatctcgagccagggccagcctcgtcaagtctgactcctaggctcaccatcccccctcccttggggcctgaagccgtggcgcagagcccactcatgaatttcttgggggactcgaaccccttcaatctgctgcgtatgaccggtcccatcctgcgggaccaccccggattcggggagggaagactgccgggaacacccccactgttttcaccgcctcccagacatcacctggatcctcatcggttatctgcagaggaaatgggcctggtggcccagcacccgagcgcattcgacagagtcatgcggctgaacccaatggctatcgattcccccgcaatggatttctcacgcagactgagagagcttgcagggaatagttctactcccccacccgtgagtcctgggagagggaatccaatgcataggctgctgaatcccttccagccatctccgaaaagcccttttctgtcaaccccacccctcccacctatgccccctggcggaacccccccaccacagccacctgctaaatcaaagagttgtgagttctgtggcaagacgttcaaattccaatctaacctgattgtacatcgtcgaagccacaccggggagaagccttacaagtgtcagctgtgcgaccatgcgtgcagtcaggcaagcaaacttaagaggcatatgaaaactcatatgcacaaggcgggaagcctggccggacgaagcgacgacgggttgagtgccgcttcaagccccgagcccggtaccagtgaactggccggtgagggcctgaaagccgctgatggtgactttcgacaccacgaaagtgatccctccctcggacacgagcccgaagaggaggatgaggaggaagaggaagaagaagaagaactcttgctggagaatgaaagccggccagaatcatctttttctatggactctgaactgagtcgcaatagggaaaacggcggaggtggggtgcccggagtccccggagctgggggaggtgctgccaaagcactcgcagacgagaaggccctcgtcctgggtaaagtgatggagaatgtagggctcggagcccttcctcaatacggagaactgctcgcggataagcaaaagcggggagcttttcttaaacgggcagccggaggaggtgacgctggtgacgatgacgatgctggcggatgcggagacgcgggagcaggtggggctgtcaacgggcgaggtggcggattcgcgccaggcaccgagccctttcctggattgttcccgcgaaagcccgcaccgcttccctccccaggcctgaattccgccgctaagaggattaaggtcgaaaaagaccttgaactgccacccgctgcccttatcccttccgaaaacgtgtattctcagtggctggtgggatacgccgcttcgcgccacttcatgaaagacccatttctcggctttaccgacgccagacagtcaccttttgccacttctagtgaacattccagcgagaacggatcactgcggttttctacaccaccaggggacctgctcgacggaggtctgagcggcaggtcgggcacggcttccggcggatctacacctcacttggggggaccaggtcccggtaggccttcatctaaagaggggcgtcgttccgacacctgcgagtattgtggaaaggtgttcaaaaattgttccaatctgaccgttcatagaaggtctcacaccggcgagcggccttacaaatgcgaactgtgcaactacgcgtgcgcccagtccagtaaactcaccagacatatgaagacgcacggccagatcggtaaagaagtctatcgatgtgacatatgccaaatgcccttctctgtgtattccacccttgagaagcacatgaaaaaatggcatggtgagcatctgctgaccaacgatgtgaaaatcgagcaggcagaaagaagctag

SEQ ID NO: 215653 - DNA, 1365 bp, Artificial Sequence
  Description of Artificial Sequence: Synthetic coding sequence
atgcctaggtgccctgccggagccatggacgaaggacccgtcgacctccgcaccaggccaaaagcggcaggactaccgggagccgcactgcccctccgcaagcgacctctgcgggctccctcaccagagccagctgcgccaaggggagcggcaggcctagtagtgccattagaccctctcaggggcggatgcgacttacctgcagttccaggccctccccacgggcttgcgcgacctgaagcgttgtactaccctggcgctttgttacccctttaccctactagggctatgggctccccgttcccactggtcaacctccctactccactgtaccccatgatgtgtcccatggagcaccctctttcggccgacatcgctatggccacacgggcagatgaagacggagatacacctctccatatagccgttgtccagggtaatctgcccgctgtgcatcgccttgtcaacctcttccaacaggggggtagagagctggacatctataataacctgaggcaaacacccctgcacctggccgtgattacaactcttccttcagttgtcagactcctcgtgactgcaggcgcaagtcccatggctctagataggcatgggcagaccgcagcccatctggcgtgtgagcatagatctcctacgtgtctgagagccctgctggacagtgcagcacccggtacccttgatttggaggcgaggaactacgatggtttgaccgcactgcacgtagccgtcaatactgaatgtcaggagaccgtgcagctgctactagaacgaggggctgacatcgacgcggttgacattaagagcggtaggagccctctaattcacgccgtggagaacaactcgctgtcaatggtccagctgctgctacagcacggagctaacgtgaatgcccaaatgtactcaggttcttctgcgttgcacagcgctagtggacgcggtctgctaccactcgtacgcactctggtgagatcaggcgctgatagctccctcaagaactgccacaatgacacccctctgatggtggcccgttcacgccgagtcatcgatatccttcgcggtaaggccacacggcctgcctcaacctcgcagccagaccccagccccgatcggagcgccaacacctccccggagtcttcctcccggctcagcagtaatggattgctttccgcctccccgtcatcttccccttcacaaagtcctccaagagacccccctgggttcccaatggcccctccaaacttctttctgccatcccctagcccccctgcttttttgccgtttgctggggtgcttcgcggtcccggtagacctgttcctccaagccctgcgcctggtggttcatag

SEQ ID NO: 215654 - DNA, 1071 bp, Artificial Sequence
  Description of Artificial Sequence: Synthetic coding sequence
atggaggaaggaagggaaaggaaccgatcctggccgccagccgaatgccagagcctgccgcgagtgagattgtttacaccaaccaaggaggagaccgcccaaaggggtgaagtgttcggccaggggcatcccgctagagctttgctcccgctctatcccaccagggccatggggtcaccattccccctggtgaacctcccaacacccctgtatcctatgatgtgtccaatggagcacccattatccgctgatatagccatggctactcgggcagatgaagacggggacacccccctgcacatcgctgtggtccaagggaacctacctgccgtgcaccgactggtgaatcttttccagcagggaggtcgtgaactggacatctacaacaatcttaggcaaaccccactgcacctggcagtgatcaccacgttaccctccgtggtgcgcttacttgtgacagccggagcttctccaatggcacttgacagacacggtcagacagctgcccacctggcttgcgagcacaggtcacctacatgtttgagggcactgctcgattcagctgccccaggcaccctggatctggaagcccgtaactatgacggcctgaccgctctccacgtggccgtgaacacggagtgccaggagacagtgcagctcctgcttgagagaggtgccgacattgacgccgttgatatcaagagcggacgtagtcctctgattcatgccgtggagaacaacagtttatccatggtccagttactcctgcagcatggcgctaacgtcaacgcacagatgtacagtggaagctccgcactgcattcagcaagtggaagagggctgctaccactggttagaactttggtacgcagcggcgctgacagtagcttgaaaaactgtcacaacgatacccctttaatggttgcgaggtctcggagagtgagcaggggctcttgcggccacgccccatgtaccagagtctctgctggatggctccaggcctctgtccccgaaagaaggggtgtaagggtgtccgtccctctacggggaggcgagtgggtttcactttag

SEQ ID NO: 215655 - DNA, 1440 bp, Artificial Sequence
  Description of Artificial Sequence: Synthetic coding sequence
atgggctccccagccgcaccagagggagcacttggttatgttagagagtttacacgtcactcatccgatgtcttggggaacctgaatgaattgaggctgcgaggaattttgacggatgtgactcttctcgttggcggacaacctctgcgcgctcataaagccgtgttaatcgcctgttccggatttttctatagtatcttccgaggccgagcaggggtgggggtcgatgtcttgtccctgcccggagggccagaggcgagaggcttcgccccattgctcgacttcatgtatacctcaaggctgcgccttagtcccgcaaccgcgcctgctgtgcttgcagcggctacgtaccttcagatggagcatgtcgtgcaggcttgtcacaggttcatacaggcttcctatgaaccccttgggatttcactgaggccactcgaagcagagccaccgaccccacccacagcccctcctccagggtcaccccgtcgctccgaagggcatccagaccctcccaccgagtcccgcagctgtagccagggccctccatccccagctagtcctgatcccaaagcctgcaattggaagaagtacaagtacattgtccttaatagccaggccagccaggccggatcactggttggggaaagatcaagcggccagccttgccctcaagcaaggctaccatctggagacgaggcttctagcagtagcagtagttcaagtagctcctcggaagagggaccgatcccaggaccacagtcccgcttgtcgcccactgctgctactgttcaattcaagtgtggggctcccgcatccaccccatatctcctgacaagtcaagcgcaggacacctcaggaagccccagcgagcgtgccagacctctgcctggcagcgaattctttagttgccaaaactgcgaggccgtggccggatgttcctccgggttggattcgctggtcccgggtgatgaagacaagccctacaaatgtcagctgtgtagaagctcctttcgctataaaggtaaccttgcatctcatcggactgtccacacaggggaaaagccttaccactgcagtatttgcggagccaggttcaatcggcctgctaatctgaagactcacagtcggatccattccggagaaaaaccctacaaatgtgaaacttgcggtagtcgctttgtacaagtggcccatcttcgagctcatgtgttgattcacacaggggagaaaccctacccatgtccaacctgcggcacacgcttccggcatctgcaaacccttaaatcacacgtgcggatccacacgggtgagaagccgtaccactgtgatccatgcggccttcacttccggcacaagtctcagttgagactgcacctgcggcagaaacatggcgctgccacaaataccaaggtacattatcacatcctcggtggaccctag

SEQ ID NO: 215656 - DNA, 129 bp, Artificial Sequence
  Description of Artificial Sequence: Synthetic coding sequence
attcacacgggagagaaaccatacccctgtccgacctgcggtactcgcttcagacatctccagacgttgaagtctcatgtccggatccacactggagagaaaccatatcacgaacccgtcactagctag

SEQ ID NO: 215657 - DNA, 633 bp, Artificial Sequence
  Description of Artificial Sequence: Synthetic coding sequence
atgtcaggaaggagtgttagagccgagacgcgcagcagagcaaaggatgatattaaacgagttatggccgcaatcgagaaggtgcggaaatgggaaaaaaaatgggtaacagtcggtgacacttctctgcggatctacaaatgggtccccgtaacagagcccaaagtagacgataaaaataagaacaagaaaaagggtaaggacgaaaagtgtgggtcagaggtaacaacacctgagaatagcagctctcccggaatgatggacatgcatgatgacaactccaaccagtcctctattgccgatgcttctcctataaagcaggagaatagcagtaattccagtcctgccccagagccaaactctgccgttccatccgatggcacagaagcaaaggtggacgaggcccaagcagatggcaaagaacatcccggtgccgaagatgcctctgatgagcagaactctcaatcctctatggaacattcgatgaactcaagcgaaaaagtggatagacagccgtcaggcgattcaggactcgccgctgaaacatccgcgatcagccaggatttagaaggggttcctccgtccaaaaaaatgaagctggaagcttcacagcaaaactctgaggagatgtag

SEQ ID NO: 215658 - DNA, 696 bp, Artificial Sequence
  Description of Artificial Sequence: Synthetic coding sequence
atgtctggccgatctgttcgggctgagactcgaagtcgggcaaaagacgacattaaaagagtaatggcagccatagagaaggtgcgtaagtgggagaaaaagtgggtgacagtgggtgatacatctctgcgaatctacaaatgggttcctgtcacagagcccaaggtggacgacaaaaacaaaaataagaaaaagggtaaggatgagaaatgtggcagcgaggttacaacgcctgagaactcctcctcccccggtatgatggacatgcatgatgataacagcaatcagtccagcatagccgacgctagtccgattaagcaggagaactctagcaattcgagtcccgctcccgagccgaactctgctgtgccttccgatggcacggaagctaaggtggatgaggcgcaggctgatggaaaggaacacccaggagccgaagacgcgtcggacgaacagaattcccagtcttccatggagcactccatgaacagctcagagaaggtagatagacagccttcgggcgatagcggcctggccgctgagacaagcgcaatcagtcaggttcccagaagtaggagccagcggggatcccagatcggcagggagccgattggactttctggcgatctggaaggcgttcctcccagcaagaaaatgaagctggaggcaagccaacagaattccgaggagatgtag

SEQ ID NO: 215659 - DNA, 528 bp, Artificial Sequence
  Description of Artificial Sequence: Synthetic coding sequence
atggctagcaggaaggcgggaaccaggggaaaagtggcagccaccaaacaggcacagagaggaagtagcaacgtcttttcaatgtttgaacaggcgcagatacaggaattcaaggaggccttctcatgcatcgaccagaatagagacgggatcatctgcaaagcagacctacgggaaacctattcacaactgggcaaagtgtctgtccctgaggaggaactcgatgctatgctccaggaaggcaaaggacccataaacttcaccgtcttcctcaccctgttcggtgagaaacttaacggaacggaccctgaggaggcgattctgtcggctttcaggatgtttgacccatctggtaaaggcgtggtgaacaaggatgaatttaaacagcttctgcttacccaggctgacaaattttcccctgccgaggtagagcagatgttcgccctgactcccatggatctggccggtaacattgactataaaagcttgtgttacatcatcacccacggtgatgaaaaagaagaatag

SEQ ID NO: 215660 - DNA, 438 bp, Artificial Sequence
  Description of Artificial Sequence: Synthetic coding sequence
atgagcggcaggagcgtgcgggctgagactcgctccagggctaaagatgacataaaaaaggtgatggcggctatagagaaggttcgaaaatgggagaaaaaatgggtgaccgtcggggacacatccctacggattttcaagtgggtgcccgttacagactctaaggaaaaggagaagtccaaaagcaattcaagcgccgctagggaacccaacgggtttccttctgacgcctcggctaattcatccctgctacttgaatttcaggagccctcgctgccatcttccgaggtggccgatgagccaccaaccctgacgaaggaggaaccagtgccgctggagacacaagtggtggaggaagaagaagacagcggggcaccacccttgaagaggttttgtgttgaccagccaactgttcctcagaccgccagcgagtcttag

SEQ ID NO: 215661 - DNA, 867 bp, Artificial Sequence
  Description of Artificial Sequence: Synthetic coding sequence
atgaaggataggacacaagaactccgctcagccaaagattcagacgatgaggaagaagttgtgcatgtcgatcgcgaccatttcatggatgagtttttcgagcaggtggaggagatacgagggtgtatcgaaaaacttagcgaagatgttgagcaggttaagaagcagcactccgctatcctggccgcacccaaccccgatgaaaaaaccaagcaggaactcgaagacctgaccgctgatattaagaagacagccaacaaagtgagatctaaactcaaagctatagaacagagcatcgaacaggaggagggtctcaatcggagtagcgcagacctgagaattcgcaagacacagcactctacattgtcccgaaaatttgtcgaggtaatgaccgagtataatgctacacagtcaaagtacagagaccgttgtaaggaccgtatccagaggcaattggaaataacaggcaggactacgactaacgaagaattagaggacatgctcgagagcggtaagctcgcgatctttactgacgacataaagatggactcccagatgacaaagcaagcactcaacgaaatcgagacccgtcacaacgaaattatcaagctggagacgtcaatccgtgagttacatgacatgtttgtggatatggcaatgctggtcgagtcccaaggcgaaatgatagacaggatcgaatacaatgtggagcactcagtcgactacgtcgagcgcgctgtgtccgatactaagaaggccgttaaatatcagtccaaagccagacgaaagaagattatgattatcatttgttgtgttgtacttggcgtggtgttggctagttctataggcggaactctgggcctgtag

SEQ ID NO: 215662 - DNA, 729 bp, Artificial Sequence
  Description of Artificial Sequence: Synthetic coding sequence
atggccggacgtacggtcagagcagagacaaggagtagagccaaagacgacattaaaaaggttatggccacgatcgaaaaagtacgcagatgggagaagcgctgggttactgttggcgacactagcctgaggatctttaagtgggtgcccgtggtggacccgcaggaggaagagcggagaagagccggagggggagcggagcgttctagaggaagagaacgcaggggcaggggagcttccccccgaggaggaggaccccttatcttgctggatctgaacgacgagaactccaatcaatcctttcactcggagggcagtctccaaaagggaacggagccttctcctgggggtacacctcagcccagtcgtccggtgtcacccgcagggccacctgaaggggtgcctgaagaggctcagcccccaagacttggtcaggagcgcgacccaggcggtattacggcgggatcaactgatgagcctcctatgctcacaaaggaagagccagtcccagaacttctagaggctgaggactctggtgtgcgaatgactaggagagccttgcacgaaaaagggctaaagactgaacccctgagaagactccttccacggcgaggcctccgaaccaacgttcgcccatcaagcatggcggtcccggatactcgcgcaccaggcggaggtagcaaagccccacgggctccaaggactataccacaggggaagggacgttag

SEQ ID NO: 215663 - DNA, 1680 bp, Artificial Sequence
  Description of Artificial Sequence: Synthetic coding sequence
atgcacagcttcatccacgctgccatgggcatggttatggcttggtgcgcagcggtgatcacccaaggtcagtacagctttctggtggtgccctgtactggaaccaattctttcggaagccccgcagcccagacctgcctgaacgaatatcacctttttttcctgttgactggtgctttcatgggctattcctacagtcttttatacttcgtgaataacatgaactacctgccctttccgatcatccaacagtataagtttctgaggtttcgccgaagcctacttttgctggtgaaacacagttgtgtggaaagtctgtttttggtgcgcaacttctgtattctgtactatttcctgggatatattcctaaagcctggatttccaccgccatgaatctgcatattgacgagcaggtgcatcgcccactggacactgtgagtggcctattgaatctctccctgctgtatcatgtgtggttgtgcggtgtgtttctactgaccacatggtacgtgtcatggattctgtttaagatctacgcaaccgaggctcacgtcttccctgtccagcctcctttcgccgagggatctgatgaatgcctacctaaggtgctcaattccaaccccccacctattattaaatacttggctctccaagatctgatgctgttgtcccagtacagtccctcacgcagacaggaggtttttagtctctcacagcccggtggacacccgcataattggacagctatttcacgggaatgtctgaacttattaaatgggatgacacaaaaattaattctttaccaggaggccgctgctaccaacggaagagtctctagctcctacccggtggaaccaaaaaaattaaatagtccagaggaaactgcttttcaaaccccgaagagttcccagatgccgcgacccagcgtgccccctctggtgaagacaagtctgttttcatcgaaactaagtacaccagatgtggtgagtcccttcggcaccccatttggatcctcagtcatgaaccggatggccggaatttttgacgtcaatacttgttacggaagcccacaatcaccccaactgatcagaagggggccacgcctgtggacctcagccagcgaccagcagatgactgagttttccaacccatcaccaagtactagtataagtgccgagggtaagacgatgcgccaaccgtccgtgatttactcgtggatccagaataaaagagagcagattaaaaacttcctcagtaaacgcgtgctgatcatgtacttttttagcaagcacccagaagcctcaattcaagcagttttcagcgatgcgcaaatgcacatctgggctcttgaggggctgagccacttggttgccgcttcatttactgaggaccgtttcggtgtggtacagaccacgctccccgcaatcctcaatacccttttgaccctgcaggaggccgtcgacaaatatttcaaactgcctcatgcaagttccaagcctcctagaatttccgggtctctagttgacacatcatacaagaccctccggtttgcctttagggccagcctgaagaccgcaatttatcgaatcaccacgacgttcggagaacacctgaacgccgttcaggcctctgccgagcatcagaagcgtttacagcagttcctagaatttaaggaatag

SEQ ID NO: 215664 - DNA, 4499 bp, Artificial Sequence
  Description of Artificial Sequence: Synthetic coding sequence
atgagaatcctggccaacaaaactcgcctgccccacccacgcaggagagaggccccaggaagccctcctctaagtccaagaggacattgcccacctgcacctgctaaaccaatgcaccccgaaaataagctgaccaatcacgggaagaccgggaatggtggagcccagtcacagcatcaaaatgtgaaccagggacccacgtgtaacgtgggatccaagggggtcggtgccggtaaccatggcgctaaagctaatcaaattagcccatcaaactctagcctgaaaaacccacaggccggagtcccaccattttccagtctgaagggtaaggtgaagcgagatagatctgtatccgttgactctggcgaacagcgagaagccggaacacctagcttggacagtgaagccaaagaggtggcacctcgtagcaagagaagatgcgtcttggaacggaaacagccgtactctggagatgaatggtgttctggacctgattcagaggaagacgataagccaatcggagccacgcataactgcaacgtggcagatccagcaatggccgctccacagttgggaccaggccagactactcagctgcctttgtctgagagctcggtgcccggtgcccctcacggacccccaccaggccttcgcccagacgcacccggtggaggagggggaggcggaggcgttcccggaaaacctccaagccaattcgtctatgtgtttaccactcacctcgcgaatacagcggctgaggctgtgctacaggggagggccgatagcattctggcttatcatcagcagaacgtgcctcgggcaaagctggaccaggcccctaaggtgcctcccaccccagaacctctgcccctctcgacgccctccgctgggaccccacagtcacagcccccacccctgccaccaccgccaccacccgctccgggatctgctcctcccgctcttccacctgagggcccaccagaggactcaagtcaggacctggcgccaaacagcgtgggagccgcttccacaggcggaggaaccggaggaacccaccctaacacaccaactgccacaacagccaataaccctttaccgcctgggggtgatcctagcagcgccccaggccctgccttgcttggcgaagcggctgcgccaggaaacggtcagcgaagtctggtcggatcagaagggctgtccaaggagcagcttgaacacagggagaggagtcttcagacgctcagggacatcgagcgcttactgctgaggtccggggagaccgagccgttcttgaagggtccgcctggaggcgctggagaaggtgggccaccagcgcaagcccctcctccaccccagcagccacctacagcacccccatctggactaaagaagtacgaagaacccctgcagagtatgatcagccagacccagtccctgggcggtcctccacttgagcacgaagtgcccggtcatccacccggaggggacatgggccagcagatgaatatgatgatacagaggcttggccaagactcgctaacacctgagcaagtagcttggcgtaagctccaggaagagtattacgaggagaagcggaggaaggaggagcagataggtcttcacggctcaagaccacttcaagacatgatgggcatgggtggaatgatggtgcgtggacccccacctccctaccattccaagccaggcgaccagtggcctccgggaatgggcgctcagctgcgtggaccaatggacgttcaggaccccatgcagctaaggggcggaccaccctttccagggccaaggttccctggtaaccagatacagcgcgtgccgggtttcggtggcatgcagtctatgccaatggaggtgcctatgaatgcaatgcagaggcccgtaaggcccggtatgggctggaccgaagacctccctcctatgggcggtccctcgaatttcgctcagaataccatgccttaccccggaggtcaaggggaagcggaacgtttcatgacccccagagtgcgcgaggagcttttacgacaccagttgttggaaaaacgctctatgggtatgcagcgtcccctgggcatggctggaagtggaatgggtcagagcatggagatggagcgaatgatgcaagcccacaggcagatggatccagctatgtttcccggacaaatggctggcggagaaggattggcgggtacccccatgggcatggagtttggcggagggcgtggtcttctgtcccctcccatgggacagtccggccttcgggaggttgacccaccgatgggcccaggcaatctcaatatgaacatgaatgtgaacatgaacatgaatatgaatcttaatgtgcagatgacaccccagcagcagatgctgatgtctcaaaagatgagggggccaggggacctgatggggccacaggggttatcacctgaggaaatggcgagggttcgcgctcaaaacagcagtggtgtcatgggcggtccacagaagatgttaatgccaagccagtttccgaaccagggccagcagggcttcagcggtggacagggcccataccaggccatgtctcaagacatgggaaatacccaagatatgttttctcctgatcagtcttcgatgccaatgagtaacgtggggactactaggctcagtcatatgcctcttcctcctgcctccaatccgcctggcaccgtgcatagcgccccaaataggggcctcggaaggcgacctagtgacctcaccatctctattaaccaaatgggctcaccaggcatgggacacctgaaaagcccaaccctgtcgcaggtacatagccctctcgtaacaagcccgtcagcgaatttgaaatcaccacaaacaccatcacaaatggtgccactgcccagtgccaaccccccaggacctctaaagtcaccgcaagtgcttggtagctccttgtctgtccgaagcccaaccggtagcccaagccgactcaaatctcctagtatggctgtcccaagtcccggatgggtcgctagccccaaaaccgctatgccatccccgggagtgagtcagaacaagcaaccaccattgaacatgaacagtagcaccaccctaagtaacatggaacaaggaaccctaccccctagcggacccagaagttcaagtagcgcacctcccgctaaccctcccagcggactcatgaacccctccctgccctttacgagcagcccagaccctaccccttctcaaaaccccctcagccttatgatgacccagatgagtaagtatgcaatgcctagcagcacccctctgtaccataatgccattaagacgattgcgacgtccgacgacgagctgttacccgatcgcccactgctgccaccccctcccccaccccagggctcgggccctgggatctctaactcacagccgtctcagatgcatttgaatagcgcagccgctcagtcacccatggggatgaatctcccaggtcagcagcccctgagccacgagccgcctcccgcaatgctgccgtctccaactcctctcggcagtaatatcccactccatcctaacgcacaggggaccggtgggcctccacagaattccatgatgatggcaccaggtgggcctgatagtctaaacgctccatgcggccctgtcccttctagtagtcagatgatgcccttcccccctagacttcagcagccccatggtgcgatggccccaacagggggtggaggaggcggaccagggctgcagcaacattatcctagcggaatggctttaccacccgaagatctgcccaatcagcctcctgggcctatgccaccacaacagcatctaatggggaaggccatggccggacggatgggggacgcctatccaccaggggtcctcccaggagtggcttcagtcctcaacgatccggaattatcagaggtaatcaggcccactcctaccggaataccagaatttgatttgagcaggatcatcccttccgagaagccttcctccacgctccagtactttccgaaatcggagaaccagccccctaaggctcagccgccaaatctccacctcatgaacctccaaaatatgatggcagagcagactccctcacggcctcctaacctgcctggacagcagggagtacagcggggtctcaacatgagtatgtgccacccgggtcagatgtctttactgggacggaccggcgtccccccacagcaggggatggtaccccatggtctccatcagggtgtaatgtccccccctcagggtctgatgacccagcagaactttatgttgatgaaacaacgcggagtgggaggcgaggtgtattctcagcctcctcacatgctgtccccccagggctcgcttatgggccctccccctcagcagaacctgatggtttcacatccattacgacagagatcggtgagcctggactcacagatggggtatcttccagccccaggagggatggctaaccttcccttcta

SEQ ID NO: 215665 - DNA, 4188 bp, Artificial Sequence
  Description of Artificial Sequence: Synthetic coding sequence
atgcggattctggctaacaaaacccgcctgcctcacccgcgtcgtcgggaagcacccggtagccctcccttgtcacccagaggtcattgccctcctgccccagctaagccgatgcaccccgagaataagcttactaaccacggcaaaaccggaaatggcggagcgcagagccagcatcaaaacgtgaaccagggacctacttgcaacgtcggctctaagggggttggagccggtaaccacggtgctaaggctaaccagatctctcctagcaattcttcgctcaaaaacccccaggccggtgtacctcctttctcttctctgaaaggcaaagtcaaacgagacaggtccgtgagtgtagactctggggagcaacgggaggccggaacccccagtttggatagcgaagctaaagaagtcgctcccaggagtaagcggagatgcgtcctggagaggaaacagccctacagtggcgatgagtggtgttccggcccagattccgaagaggacgacaagcccattggtgccacccataattgtaatgtggcagaccctgccatggccgcacctcaattgggtccaggccagactacccagctgccactgtcagaatcttccgtgcctggggctccacacggccctccacccggtctgaggcctgatgctcctggcggtggcggagggggtggaggcgttcctgggaaacctcccagccaattcgtgtatgtatttacgacacatcttgctaataccgctgctgaggctgtgctgcagggaagagctgatagtattctagcctaccatcaacagaacgtaccgcgagctaaactggaccaggcacctaaggtgccaccaacccccgaacccttgccactgagtacccctagtgccggtactcctcagtcacagccaccaccattacctccacctcccccaccggctcctggctccgcaccaccagcacttccccctgaggggccacctgaagacagctcacaggacttggcaccaaactcagtcggcgcagcctcaactggcggaggcaccggtggaactcatccaaacactccaacggccaccactgccaacaaccccctgccgccaggaggagacccctcgtccgcgcctggtcctgcactattaggcgaagccgctgcacccggtaacgggcagcgatccctggtggggtccgaaggacttagcaaggagcaactggagcatcgggagagaagccttcaaaccttaagggacattgagcggctgcttctcagaagtggcgagacggagccgtttttgaaaggacctcctgggggagccggagaggggggtccacccgctcaagccccaccccctccacagcaaccaccaaccgctccaccttctgggctcaagaaatatgaggagcccttgcagtccatgatttcccagacacaatccttgggtggtccacccttagaacacgaggtgcctgggcaccctcccggaggagacatgggccaacagatgaacatgatgattcaacgtctgggccaagactcgttaactcccgagcaggtcgcttggcgcaaattgcaggaggagtattatgaagagaagcggaggaaagaagagcagatcgggttacatggctcacgacctctgcaggatatgatgggcatgggaggcatgatggtgcggggtccccctcctccgtaccattcaaaacccggagaccaatggccccctggcatgggtgcccagctcagaggtccgatggatgtgcaagatcccatgcagctgcgcggaggccctcccttccccggaccccgatttcccggaaatcagatacagcgcgttccagggttcggtggaatgcagagcatgcctatggaagtgccaatgaatgccatgcagagacctgtgcgcccaggaatggggtggacagaggatctgcctcccatgggcggtcctagcaattttgcccagaatacgatgccctacccaggtggacagggcgaggccgagcgtttcatgaccccgagggtgagagaggagctgttacgacaccagcttctggagaaacggtcaatgggcatgcagcgaccacttggaatggcaggtagtggtatggggcagtcaatggagatggagaggatgatgcaagctcacaggcaaatggatcctgccatgtttccaggacagatggccggtggcgagggcctggcgggtaccccaatgggcatggaatttggcggagggagggggctgctgtcgcctccaatgggacaatccggattgagagaagttgacccgcctatgggtccaggaaacctgaatatgaacatgaacgtgaacatgaacatgaatatgaacctcaacgtccaaatgacgccccagcagcaaatgctgatgtctcagaaaatgcgtgggccaggtgatttaatgggccctcagggcctctctcccgaggaaatggcaagggtgagagctcagaatagctcgggagtgatggggggaccccagaaaatgcttatgccaagtcaatttcccaatcagggccagcagggattctctggaggccaaggcccataccaagctatgtcccaggacatgggcaatacacaggatatgttttctcctgaccagtcaagtatgcccatgtcaaacgtaggcacgaccaggttgtctcatatgccattgcctcccgcttctaaccctccaggtacagtccactcagctcccaatcggggtttgggcaggagaccaagcgacttaaccatcagcataaaccaaatgggtagtcctgggatgggccatttgaagagtcccaccctttctcaggttcattcccctttggtcacttcaccatcagctaaccttaagtctccccagacccccagccagatggtaccactccccagcgccaatcctccgggaccccttaagagcccacaggtgttaggctcatcattaagcgtgagaagccccaccggatcaccttcaaggctcaaatctccttctatggccgtgccttccccagggtgggtcgccagtcctaagacagcaatgccatcccccggagtaagtcagaataagcagccacccctgaacatgaattcaagtacaaccctgtctaacatggaacaaggaaccctgccgccatccggccctagaagctctagcagtgcaccaccggctaatcccccatccggccttatgaatccctccttgccttttacttcatcccctgatcccactccatcacagaatcctctgtccttgatgatgacccagatgtccaaatatgctatgccaagcagtacacccctctatcataatgctattaaaacgatcgccaccagcgatgacgaactgcttcccgaccgaccgttgctacctcccccacctcctccacaaggtagcggcccaggtatcagcaattcacaaccaagccagatgcatctcaactcggcagccgctcagtccccgatgggaatgaatctccctggccagcagcccctgtcacacgagccaccccctgccatgctccctagccccacaccgctgggcagtaatattccactgcaccctaacgctcagggaaccggtggccctccacagaacagcatgatgatggccccaggcggtcctgacagcttgaacgctccatgcggaccggtgccatcttctagtcagatgatgccgtttcctcccaggctccagcaacctcacggtgcgatggcccctactggaggtggcggtggaggcccagggctgcagcagcactatccttctggtatggccctccctcctgaggatttacctaaccagcctcccggaccaatgcctccccagcagcatttgatggggaaggccatggcgggacgaatgggtgacgcttacccccctggtgtgctcccaggtgtggcatctgtccttaatgaccctgagctttcggaagtgatcagacctactccgaccgggatacctgaatttgacctatcccggataattcctagcgaattcctacgaaccaggcccttttccttctgtctctatcttttaagaattctgtctctgttgatgtggttaacaccgctcccacccctgcccgcaggcggttggccaggcggacaagtccccgctggcgctgttaatcgcgcactcaggttttgtgccggattatgtgtgtgctgcatctcagttttttag

SEQ ID NO: 215666 - DNA, 4365 bp, Artificial Sequence
  Description of Artificial Sequence: Synthetic coding sequence
atgagaattctggccaataagactcgacttcctcatcctcgtaggcgagaagcaccaggaagtcctcctcttagcccgaggggtcactgtccccctgcccctgccaaaccgatgcatcccgagaataaattaaccaatcacggaaaaaccggaaatgggggagcacagtctcagcatcagaatgttaaccaaggaccaacgtgtaatgtggggtctaagggcgtgggcgcaggcaaccacggggctaaggctaaccagataagtccatcaaacagttctctaaaaaacccgcaggccggagtccccccattctcatctttgaagggaaaggtaaaacgcgatcgcagcgtgtccgtggactctggcgagcagcgagaggccggtaccccaagcttggattccgaagcaaaagaagtggcccctagatccaaacggaggtgcgtgctcgagcgcaaacaaccctactctggcgacgagtggtgttcgggaccggactcagaagaagacgataagcccattggtgctacacataactgcaacgtggcagatcccgcaatggctgcaccccagctggggcctgggcagactacccagctcccactgtccgagtcttcggtgcccggagcaccacatggaccccctcccggactgcgaccagatgctcccggagggggaggcggtggcggtggagtgcccggtaagcccccaagtcagtttgtgtacgtattcactactcatctggcaaacaccgccgcagaggctgtactgcagggcagagccgactccattctcgcttaccaccaacagaatgtgccacgagcaaaactagatcaagcacccaaggtacctccgacgcccgaacctctgcctttgtcaaccccttctgccggtacaccacagtctcagcctcctcctcttccaccaccaccaccaccagcccctgggtctgcgcctcccgctctaccgccagagggccctccagaggatagctctcaggacctagctcctaactcggtgggagccgcttctacgggagggggtactgggggaacccatcccaatacaccaactgctacaactgctaacaacccgctccccccagggggtgatccgagctccgcaccagggcctgcacttctcggagaggcagccgcaccaggtaatggtcagaggagcctggtaggcagcgagggactgtcaaaggagcagctggagcatcgtgagagatcactccagaccctgcgtgacattgagcgcttactgctacgctccggtgagactgagcccttcctgaaggggccacccggaggggcaggtgagggcggaccacccgcacaggctcctccacccccacagcagcccccaacagcgcctccttccggactaaaaaagtacgaggaacccctccagtccatgattagccaaacccaatccctgggtggccctccactggagcacgaggtccccggacaccccccagggggagacatggggcagcagatgaatatgatgatacaacgccttggacaggacagcctaacacctgagcaggtggcttggaggaagctccaggaagagtactatgaagaaaaacgccgtaaggaggaacaaataggcttgcacggctcaaggcctttgcaggacatgatgggtatggggggaatgatggtgagaggccctccaccaccctaccattctaagcctggagaccagtggccccctggaatgggggctcagctccgagggccaatggatgtgcaggatcctatgcaactgagagggggtcccccttttccaggtccacggtttccagggaaccagatccaacgggtgcccggtttcgggggaatgcagtcaatgccaatggaggtgcctatgaatgccatgcaacgaccggtgaggcctggcatgggctggactgaagatctgccaccaatgggtgggccatctaactttgcgcagaatacaatgccgtaccctggcggtcaaggtgaagccgagaggttcatgacgccaagggtgagggaggagctcctgagacaccagctgcttgagaaacggagcatgggaatgcagcgtccactcggtatggcaggatccggcatgggccagtctatggagatggaacggatgatgcaggcccacaggcagatggaccccgcaatgttccctggccagatggccggaggtgaaggcttggccggtacccccatggggatggaattcggcggaggtcgcggattattaagtccccctatggggcagtccgggctccgcgaggtggaccccccaatggggccaggaaacctcaatatgaatatgaacgtaaatatgaatatgaacatgaacttgaacgtccagatgaccccccaacagcagatgcttatgagccaaaagatgaggggacccggtgatctcatgggaccgcagggactaagtcctgaagagatggccagagtacgggcacaaaactccagcggggtgatgggcggtccacagaaaatgctgatgcctagccagttccccaatcagggtcagcaggggttcagcggagggcaggggccttaccaggccatgtctcaggatatgggcaacacacaagacatgtttagccccgaccagtcttctatgcccatgagcaacgttggtacaacaaggctgagccacatgcccctgccccctgcttctaacccgccagggactgttcacagcgcgcctaatcgtgggctgggacgcagacctagcgacttaactatatctatcaatcagatggggtctcccggaatgggccacctgaagtcacctacgcttagtcaggtacactctcccctcgtcacaagtcccagcgctaacctgaagagtcctcagaccccgtcccagatggtccctctgcccagtgccaaccccccaggaccattgaagtccccgcaggtgttaggctctagtttgagcgttcgatcccccactgggtcaccaagccggctgaagtcgccctctatggccgtgccctcccctggatgggttgcaagccctaaaacggctatgccctctcctggagtcagtcagaataaacagcctcccctgaacatgaattctagcacaacattatccaatatggaacagggcacactcccgccatccgggccacggtctagcagtagtgcacctcctgccaaccctccgtcaggcctcatgaatccttcactcccatttacctctagcccagatcctacgccctctcagaatcccctgagtctgatgatgacccagatgtctaaatatgcgatgccttcctctactccactgtaccataatgcgataaagactatcgctacgtccgacgacgagctcctgcctgataggccgcttctgccccctcctcctccccctcaagggtccggacccggtatctccaactcccagcctagtcaaatgcatcttaacagcgcagcagcacagagcccaatgggaatgaaccttccagggcaacagcctctgtctcatgagcctccccctgccatgttgcctagtcccactcccttgggcagcaacatacccctgcatcccaacgcccaggggaccgggggaccaccacaaaatagcatgatgatggcacccggaggtccagattcactcaatgcaccatgcgggcctgtcccgtcttccagccagatgatgcccttccccccacggctgcaacagcctcacggagcaatgatggctggcagaatgggcgacgcttacccaccaggggttctacctggcgtggcatctgtgctgaacgacccggaactgagtgaggtcataagaccaacccctaccggaatccccgagttcgacctctcgcgcatcatcccatctgagaagccgtctagcacactgcaatactttcctaagagtgaaaaccaaccgcctaaggcccaacctccgaacctccatctaatgaaccttcaaaacatgatggctgagcagaccccatcccggccaccgaatctccccggacagcagggtgtccaaagaggtctgaacatgtcaatgtgtcatccgggtcaaatgtctttgctaggcagaaccggagtccctccacagcaagggatggtgccacatggactccaccaaggagtcatgagccctcctcagggcctgatgactcagcaaaattttatgctcatgaagcagagaggagtgggtggggaagtgtatagtcagcccccacacatgctctctcctcagggcagtctgatgggaccaccccctcaacagaatctaatggtctcccatcccctgaggcagagatccgtgtccctggattctcagatgggctacctgcccgctccgggtggaatggccaacctgcccttttag

SEQ ID NO: 215667 - DNA, 1401 bp, Artificial Sequence
  Description of Artificial Sequence: Synthetic coding sequence
atgagcacaagatcagtcagctcttcgagctaccggaggatgttcggcggtccaggaaccgcctcccggccatcgtcctccagatcatatgtaacaacttcaacgaggacctactccctcgggagtgcactgagacctagtacgagccggtcactgtatgcctcctcccctggcggtgtgtatgcgacacgaagcagcgccgtcaggctgcggagttctgtccctggagtgcgtctgttgcaggactccgttgactttagtcttgccgacgcgattaatactgaatttaaaaacacccggacaaatgaaaaggtcgaactgcaggaactcaacgacaggttcgctaactatatcgacaaggtccgcttcctggagcagcagaacaagatccttctcgctgagctggaacagctgaagggccagggcaagtctcgtctcggagatctttatgaggaagagatgcgggagctcaggcgacaggtggatcagctgactaacgacaaagccagagttgaggtcgaacgcgataacctagccgaagacatcatgcgacttagagagaagctgcaggaagagatgcttcagcgcgaggaagccgagaacacactgcagtcatttcggcaggacgtcgataacgcgagtctggccagattggatcttgagaggaaagtggaaagtctgcaggaggagatcgcctttttgaaaaagctccatgaagaggaaatccaggaattacaggcacagatccaggagcaacacgtccagattgatgtggacgtctctaaacccgatctgaccgctgcacttagagatgtacggcaacaatatgaaagcgtagccgctaagaacttacaagaagctgaggagtggtacaagtcaaagtttgcagacttgtctgaggcagctaatagaaacaacgacgcactgcgtcaggctaaacaggagtccacagaatacaggagacaagtgcagagcttgacttgtgaggttgacgcgctcaagggaactaatgaatccttagagagacaaatgcgcgaaatggaggagaattttgctgtcgaagccgctaattatcaggacaccattggaagactgcaggacgaaatccagaatatgaaagaggaaatggccagacacctgagggagtaccaggatctactcaacgtcaaaatggccctggacatcgaaattgctacctaccgcaaactactcgagggagaggaaagtaggatttccttacccctgcccaactttagttctttaaatctgcgggaaaccaacttggacagcctgcctctggtcgatactcatagcaagaggaccctgttgattaaaaccgtcgagacacgcgacggccaagttattaatgagacttctcagcatcacgacgacctggagtag

SEQ ID NO: 215668 - DNA, 1302 bp, Artificial Sequence
  Description of Artificial Sequence: Synthetic coding sequence
atggataagctcaataagataaccgtgccagcaagtcagaagctgagacagctccagaagatggtgcacgatattaaaaataacgagggcggaattatgaacaaaatcaagaagctcaaagttaaagcgcctcctagcgttccgcgacgcgattatgcgagcgagagtccagcagatgaggaggagcagtggtccgacgactttgattcggattatgagaacccagatgaacattccgattccgaaatgtacgttatgcccgctgaagagaacgcggatgactcttacgagccaccccctgtcgaacaggaaactcgccctgtgcaccctgccctccccttcgcgaggggagagtacattgataatcgatcatcacaaaggcattcaccccctttctccaagacactcccttctaagccaagctggcctagcgaaaaggccagactgacgagtacgctccccgctttgaccgctttacagaagccacaggtgccacccaaaccaaagggcctgctggaggatgaggccgattacgtggtccccgtggaagataatgacgagaactatattcacccaacagaatcatcaagtccgcctcccgagaagggccgaaactcaggcgcttgggagactaagtccccccctccagcggctccctcccccttaccaagagctgggaaaaagcctaccaccccgctgaagacgaccccagttgccagtcaacagaacgcgtcttccgtctgtgaagaaaaacctattccagctgagcgacaccggggatcgtcccaccgacaagaagcagtccagtctccagtgtttccgccagctcaaaaacaaatccaccaaaaacccatccccctccccagattcactgagggtggcaatcctacagtcgatggacctctacctagcttctccagcaacagcaccatctcagaacaggaagccggtgtcctttgtaagccctggtacgcgggagcctgcgatagaaaatccgccgaggaggcacttcataggtcgaacaaggacggctccttcttgattagaaaaagttccgggcacgactccaaacaaccctacacccttgttgtgtttttcaacaagagggtttacaatattcctgttcgtttcatagaggccacaaaacagtatgccctgggcaggaagaagaatggggaggaatactttggaagcgtggccgaaataatcagaaatcatcagcatagtcctttggtgcttatcgatagtcagaacaacactaaagatagcacacgcctcaagtatgccgtcaaggtttcatag

SEQ ID NO: 215669 - DNA, 525 bp, Artificial Sequence
  Description of Artificial Sequence: Synthetic coding sequence
atggacaagttgaataagatcaccgtcccagcatcccagaaactccgacagctgcagaagatggtgcacgatattaaaaacaatgagggtggcattatgaacaagatcaagaagctcaaggttaaggcccctcctagcgtgccacgcagagactatgctagcgagtctcctgccgacgaagaggagcaatggtcggatgacttcgattcggactacgagaacccagatgagcactctgattcagagatgtatgtgatgcctgccgaggagaatgccgatgattcctacgaacccccacccgtggaacaggaaacaaggccagtccaccctgctctgccttttgctcgcggtgagtacattatcttcttatgcgacctgctcaaacaacagaataacatgccctgggcggaaaggaagatggtgaaaagcaccctggaggtgctacttaagtcttccggcattatcaacatcgttctgtggttcctgcttacagtacgaattactcagaagatccccccagattag

SEQ ID NO: 215670 - DNA, 558 bp, Artificial Sequence
  Description of Artificial Sequence: Synthetic coding sequence
atggacaaattaaataaaattaccgtaccagcttctcaaaagctgaggcagctgcagaaaatggtgcacgatatcaagaataatgagggcggtattatgaacaaaattaagaagttgaaggttaaagcacctccatccgttcccagacgagactacgccagcgaatcacccgcagatgaggaagaacagtggagtgacgattttgactccgattacgaaaaccccgacgagcatagtgattccgagatgtatgtcatgcccgctgaagaaaacgccgacgatagctacgaaccgcctcctgtggagcaagagacccgtccagtccatccagctctcccctttgcaagaggcgagtatatagacaatagatctagtcagaggcactcccctcctttcagcaaaactttgccatctaaaccatcttggccatccgagaagtacttcggttcagttgccgaaattatccggaaccaccagcattcacctctcgtcctgatcgatagtcagaataataccaaagattcaaccagactaaagtacgcagtgaaggtctcttag

SEQ ID NO: 215671 - DNA, 204 bp, Artificial Sequence
  Description of Artificial Sequence: Synthetic coding sequence
cttgatagttattcctgtctgctgcaactgccaaataggatggacaagctgaacaagatcaccgtccctgcatctcaaaagctgcgccaattgcagaaaatggtacatgatattaagaacaacgaaggcggaatcatgaacaagatcaaaaagacggccaccatgaaaatacagatgagcaccaggacacagcgttgtacttag

SEQ ID NO: 215672 - DNA, 1215 bp, Artificial Sequence
  Description of Artificial Sequence: Synthetic coding sequence
atggataaactgaacaagatcactgtgccagcctcgcagaagttgcggcagcttcagaaaatggtgcatgacattaaaaacaatgagggcggaataatgaataagattaagaaactcaaagtgaaagcccctccgtctgtgccgcgtcgcgactatgctagtgagtcccctgctgatgaggaggaacaatggtctgatgatttcgatagtgattacgagaaccccgacgaacatagcgattccgagatgtacgtaatgccggctgaggagaacgcagacgactcatatgaacctcctcccgtagagcaggagaccagacccgtgcatccagcactcccctttgctcgcggagagtacattgataaccgctcatctcagaggcacagtccaccgttctctaagaccctgccatcgaagccgagttggccttccgaaaaagccagactcacctccactctgccggctctcacggccctacagaagcctcaagtccccccaaaacctaaagggcttctcgaggatgaggccgactatgtcgtgcctgtagaggacaatgatgagaactacattcacccaaccgaatcgtccagcccccctcctgaaaaggcaccaatggtcaacagatccactaaacctaatagctccaccccagccagccccccaggtactgcctccggacggaattccggggcatgggaaaccaagagccctccccctgctgccccatctccgttgccaagagccggaaaaaaacccactactcctttgaagacaacccccgtcgcttctcagcaaaatgcttcttccgtgtgtgaggaaaaacctattcctgcagaacgccacaggggatcctcacaccgccaggaggcagtgcagtcccctgtcttccctccagcccagaagcaaatacaccagaaaccaatccccttgccccgtttcacagagggcggaaatcctactgtggatggtccgctcccttccttttcctcaaatagtacaatttccgaacaggaagcaggcgtcctctgcaagccctggtacgccggagcctgcgaccgcaagagcgcggaagaggctctgcacaggtctaacaagtatttcggttctgtggctgagattattcggaatcaccaacactctcccctggttctgatagatagccagaataacaccaaggattctacccgtcttaagtacgccgttaaggtgtcttag

SEQ ID NO: 215673 - DNA, 1266 bp, Artificial Sequence
  Description of Artificial Sequence: Synthetic coding sequence
atggataagctgaataaaatcacagtgccggctagccaaaaacttcgtcagctgcagaagatggtccacgatataaaaaataatgagggcggtatcatgaataaaatcaaaaaactgaaagtgaaggcccctccaagcgtgcctagaagagattatgcgtccgagtctcccgcagatgaagaagaacagtggtccgacgattttgacagtgattacgaaaaccctgatgagcattctgacagcgagatgtacgttatgcctgcggaagaaaacgccgacgatagctatgagcccccacccgtcgagcaggagactaggcctgtgcatcctgctttaccctttgccagaggggagtatattgataacaggtcgagtcaacgacactctccccctttttcaaaaaccttgcctagcaagccttcatggccttcggagaaagcccgactgaccagcacgctccccgctctcacagcactgcaaaaaccacaagttccaccaaaacctaaaggattactggaagatgaggctgattacgttgtgccggtcgaggataacgacgagaactacattcaccccacagagtccagttctcccccacccgaaaaagcccctatggtgaaccggagcacaaaacccaactcgtctacccccgcttcgccacccggaaccgcctctgggagaaattccggagcctgggaaaccaaatctcctcctccagcagccccatctccactcccgagagccggtaagaagccaacaacgcccctgaaaaccacccccgtggctagtcaacagaatgcatctagcgtctgtgaggagaagcctattcctgcagagcgtcaccgaggctcctcgcacagacaggaggccgtccagtctcctgttttcccccctgctcaaaaacaaatccaccaaaagccaatccctctcccacggttcacagagggcggaaacccgaccgtggacggtccattaccatcgttcagctcaaattcaacaatcagtgagcaggaagccggagttctatgtaagccctggtacgccggagcctgcgatagaaagagtgctgaggaagccctccatcggagcaacaaagacccccaacccccacttccttccaagcagtgggagactcgaaaactgcagtatttcgggagtgtagctgagatcatacggaaccaccagcactcacctcttgtcttgatagactcgcaaaataacacgaaggacagtacccgtttaaaatacgctgtaaaggtttcctag

SEQ ID NO: 215674 - DNA, 630 bp, Artificial Sequence
  Description of Artificial Sequence: Synthetic coding sequence
atggataaattgaataagatcactgtgccagcctctcagaaactgcgccaactccagaagatggttcacgacatcaagaataatgaggggggaatcatgaacaaaatcaaaaaactgaaggtgaaggctcccccttccgtgccacgtagagactatgcgagcgaaagccctgccgacgaggaggagcaatggagcgatgatttcgattccgattacgagaaccctgacgaacactctgacagtgagatgtacgtcatgccggcagaagaaaacgccgatgactcctatgaacccccacccgtcgagcaggagacgcgccctgtccacccagccctgccctttgcacgcggtgagtatattgataataggagttctcagcggcactctccccctttctcaaagacattgccaagtaagccgtcgtggccctccgagaaggcacgtctgacctccaccctgcccgcactgactgctctgcagaaacctcaggtgccaccgaagcccaaaggactgctcgaggacgaagccgattacgtcgtgccagtcgaagacaatgatgaaaactatattcaccccaccgaaagctctagccctccacccgaaaagggtaaaaatcagagacaccattag

SEQ ID NO: 215675 - DNA, 900 bp, Artificial Sequence
  Description of Artificial Sequence: Synthetic coding sequence
atggataaacttaataagataacagtgccggcaagtcaaaaactgcgccagctgcagaaaatggtacacgacattaagaacaatgaagggggtataatgaacaaaattaagaagttgaaagtgaaggcgccaccttctgtaccgcgtcgagattacgcgtccgaatccccagccgatgaggaggaacaatggtcggacgacttcgatagtgattatgagaaccctgatgagcattcggactcagagatgtacgtgatgcccgcagaggaaaatgctgacgactcctacgaaccgccacccgtggagcaagaaacccggccagtacaccctgctctgcccttcgccaggggcgaatacataggaaggaactcaggggcttgggaaaccaagtcacctcctccagccgcaccttccccactcccgagagcgggaaagaagcctacaaccccccttaaaactacaccggttgccagccagcaaaatgcctctagtgtatgtgaggagaaacctatcccagcggagaggcaccgcggttcttcccacagacaggaagcggtgcagagcccggtgttccccccagctcaaaagcagatacatcagaaaccaataccactgcctcgatttacagaagggggtaaccctacagttgacggaccattgcctagtttctccagcaattccactatttcagagcaagaggccggagtgctgtgtaaaccttggtacgcaggcgcttgcgacagaaaatcagccgaggaggccctccaccggagcaataagtattttggctccgtggcagaaattattcgaaatcaccaacacagtccccttgtcttgatagacagccaaaataatactaaggactcaacgcgcttaaagtacgctgtgaaagttagttag

SEQ ID NO: 215676 - DNA, 2358 bp, Artificial Sequence
  Description of Artificial Sequence: Synthetic coding sequence
atgctccctgctgctcctggaaaaggtttaggttccccagatcccgcaccttgtggccctgccccaccaggcaacacgaaagacatcattatgatctacgaggaagacgctgaggagtgggcgttgtacttgaccgaggtgtttctgcatgtcgtgaaaagggaggccattctgctgtaccgcctggaaaatttcagcttcaggcatctcgaactgttgaacctgacatcatataagtgcaaactgctgattctctctaatagcctactgagagacctgacacccaaaaaatgtcagtttcttgaaaaaatcctccactcaccaaaaagcgtggtgactttgttatgtggagtgaagagctcagatcagctctacgagttattaaacattagtcagtctcgatgggaaatttcgacagaacaggagcccgaagactacataagcgtgatccaaagcatcatctttaaagactccgaggattattttgaggttaacataccaacagacctcagggcaaagcactctggagaaattagcgagcgtaaagagattgaggaactaagtgaagcttctagaaataccattcctctcgccgtggtcttgccgactgaaataccgtgcgaaaaccctggcgagatatttatcatacttcgggacgaagtgattggtgacacggtagaggtggaattcacatcctctaacaaaaggatcagaactcgcccagcgttatggaacaaaaaggtatggtgtatgaaggcactagagttccccgctggctccgttcatgtaaatgtgtattgtgatggtattgtaaaggctactaccaagatcaaatactatcctacagctaaagccaaagagtgtctcttccgcatggctgatagcggggagtctctttgtcagaattctattgaggagctggacggtgtcctgaccagcatttttaagcacgagataccatactatgaatttcagtcattgcaaacagagatctgcagccagaacaagtatacacattttaaagagctccccacactactgcattgcgcggcaaaattcggcctgaaaaatcttgccattcacctgctgcaatgctccggggctacttgggcttccaaaatgaagaatatggaagggtccgaccccgcacacatagccgaaaggcacgggcataaggagctgaagaagatcttcgaagacttctctattcaggagattgatatcaacaatgaacaggagaacgactacgaagaggacatagcgagcttcagtacctacatcccttccacacagaatccagcgttccatcacgaatccagaaagacatacggtcaatctgcggatggagcagaagctaatgaaatggagggtgaaggcaaacagaacggatccgggatggaaaccaagcacagccccctggaggttgggtccgagagctcagaggaccagtacgacgacctctacgtgttcattcccggagctgaccccgagaacaactcacaagagcctctgatgtccagcagacccccactccctcctccaagacctgtagcgaacgcctttcagttagaacgtccgcacttcacgctccccggtactatggtcgagggacagatggagcgctcacaaaattggggccaccccggagtgcgacaggaaactggagacgagccaaagggcgaaaaggagaaaaaggaagaagagaaggagcaagaagaagaggaagacccttataccttcgccgagatcgatgattcagagtatgacatgattctggctaacctgtctatcaagaaaaaaaccggaagcagaagctttattatcaatcgcccaccagcccctaccccacggccaacgtccatcccccctaaggaagaaaccacgccttacatcgcacaggtgtttcagcagaaaacagccaggaggcaaagtgatgatgataaattctgcggtctacctaagaaacaagatcgggctcgtattgaaagtcctgcattctccaccctgcgcggttgcctcacagatggtcaggaagagttaatcttgctgcaagagaaggtcaagaatggaaaaatgagtatggacgaagccctggagaaattcaagcactggcagatggggaagagcggactggagatgattcagcaggaaaaacttcgccagttgagggactgtattatcggaaagcggcctgaggaagaaaatgtgtacaacaagctcaccatcgttcaccatccgggagggaaagaaacggcccacaacgaaaataaattttataacgtacacttttcaaacaaacttcctgcacgccctcaagttgagaaggaatttggcttctgttgcaaaaaagaccattag

SEQ ID NO: 215677 - DNA, 1959 bp, Artificial Sequence
  Description of Artificial Sequence: Synthetic coding sequence
atgctccccgctgcgccaggcaaggggttagggtcgccagatcccgctccatgcggccctgccccacctgactctgaggactattttgaggtgaacattcctaccgatcttcgtgccaaacactcaggtgagatctccgagcgcaaggaaatcgaagagctgtcggaggcaagccggaataccatacctctggccgtggtgctccccacggaaatcccttgtgagaacccaggcgaaatatttataatcctcagggatgaggtgatcggcgataccgtggaggtggagtttacctcctctaacaagcgaatcagaacgcggccagcactttggaacaaaaaggtttggtgcatgaaggccctcgagtttcccgcaggttcggttcacgtcaatgtgtattgcgatggaattgtcaaagcaactacaaagatcaagtattatcccactgccaaagccaaggagtgtctgttcaggatggccgattctggagaaagcttgtgtcaaaacagtatagaggagctggatggtgtcctaaccagtatatttaagcacgagatcccttattacgaattccagtcattgcaaactgaaatttgctcacagaacaaatatacgcatttcaaggaactgcccacccttctgcactgcgcggctaaattcgggctgaagaatctagctatccacttactgcaatgctctggtgcgacgtgggcttccaagatgaaaaacatggaaggaagcgacccggcacacatagctgagagacacggacacaaagaattaaagaaaatttttgaggattttagcattcaggaaatcgacattaataatgagcaggagaacgattatgaggaggacattgcgtctttctccacatacattcccagtactcagaatcccgcatttcaccacgaaagccgtaaaacttacggccaatcggctgacggtgctgaggcaaacgagatggagggagagggcaaacaaaatggtagcggtatggagactaagcactcccccctggaagtaggcagcgaaagctctgaagaccagtacgacgacctatacgtcttcatcccaggcgcagatcctgaaaacaacagccaggaacctctgatgagtagcaggcccccactgccaccacctaggcccgtcgctaacgcatttcagctggaaaggcctcattttacccttcctgggactatggtcgagggacagatggagagatcgcagaactggggacacccaggggtgaggcaagaaacaggagacgagcctaagggggaaaaggagaagaaggaggaagaaaaagaacaggaagaggaggaggacccttatacgttcgcagagatcgatgactccgagtacgatatgatactcgccaatttgtccatcaagaagaaaaccgggtcacgttcattcattattaatagaccacctgcacccaccccacgtcccacctcgatcccacctaaagaggagacaaccccatacatcgcccaagtcttccagcagaagactgccagacgccagtcagatgacgacaagttctgcgggctgccaaagaaacaggaccgcgcacgcattgaaagtccagcattttctacgctgcgtggctgtctgaccgacggccaggaggagctgatccttctccaagagaaggtgaaaaacggaaagatgtctatggacgaggctttggagaagttcaagcactggcagatgggtaaatcaggccttgagatgattcagcaggagaagctgagacagctccgtgattgtataattgggaagagacccgaggaggaaaatgtgtataataaactgaccatagtgcaccatcctgggggtaaagagaccgcacacaacgagaacaaattttacaatgtgcacttttccaacaagctgcctgctagaccccaagtggagaaggaattcggattctgctgcaagaaggaccattag

SEQ ID NO: 215678 - DNA, 2268 bp, Artificial Sequence
  Description of Artificial Sequence: Synthetic coding sequence
atgatatacgaagaagatgcagaggaatgggccctttatctgaccgaagtattccttcatgtggtaaagcgcgaggcaattttgctgtacaggctcgagaatttctcctttaggcacctggaattgttaaatctaacgagctataaatgcaaacttctgatcctgtctaattctttgctccgcgatctcactcctaagaagtgccagtttctggaaaagatcctacactcgcccaaatctgtcgttaccctgctgtgtggagtgaagagtagcgaccagctgtatgaactcctcaatatttcccagtcccggtgggaaattagtactgagcaggagccggaagattatattagcgtgatacagtcaattatcttcaaggactctgaagattattttgaggtgaatatccccactgacctccgggcaaagcattctggcgagattagtgagcggaaagagattgaggaactgtctgaggcttcccgaaacacaatccccctggccgtcgtgctccccactgagataccctgtgaaaatccaggagagatcttcatcatactcagggatgaagtgatcggcgacaccgtagaggtcgagtttactagctccaacaagcggatcaggacacggcctgccttatggaacaaaaaagtgtggtgcatgaaagctctcgagttcccagccggttcagttcatgtgaacgtctattgcgatggcatagtgaaggctaccacaaagatcaagtattaccccacagcgaaagccaaggagtgtctcttccgaatggctgactctggagaatcactgtgtcagaactctatcgaagagcttgatggtgtcctgacctccatcttcaaacacgaaataccctactacgaatttcagagcttgcagacggagatctgctcccagaacaaatacactcatttcaaggaattaccaaccctgctgcattgtgctgccaaatttggcctcaaaaacctggcaattcatctgctccaatgcagcggcgcaacatgggctagtaagatgaaaaacatggaaggcagtgatccggctcatattgctgaaaggcacgggcacaaggagcttaagaagatttttgaagatttttcaatccaagaaattgacatcaacaacgaacaggagaacgattacgaggaggatatcgcctctttcagcacatacattccaagtacgcagaatcctgccttccatcacgaatcccggaagacctacggacaaagcgctgatggagccgaagcaaacgagatggaaggagaagggaagcagaatggatctggcatggagacgaaacatagccctcttgaagtgggctccgaaagttcagaagatcaatatgatgacctttatgtctttatacctggcgctgaccccgagaacaattctcaggaacccctaatgtcgtccaggcctccactgcccccacccaggccagtcgccaacgcattccagctagagcgccctcacttcacactgccaggtacaatggtggaggggcaaatggagaggtcacagaattgggggcaccccggtgtgaggcaggagacaggcgacgaacctaagggcgaaaaagagaagaaagaagaggaaaaggaacaggaggaagaagaggacccttacacatttgctgaaattgatgactcagaatatgatatgatcctcgccaacctgagcatcaagaaaaagaccggatcacgatctttcatcatcaataggccgccagctcctacccccagaccaacttcaattccccctaaagaggaaacaaccccttatattgctcaggtttttcagcaaaaaactgcgaggagacagtctgacgatgataagttctgtggactgcccaagaagcaagacagagcccgtatagagagccccgctttctctacgctgcgcggatgtctgacagacggccaggaagaattaattctgttacaggagaaggtgaagaatggcaaaatgtctatggacgaagctcttgagaagtttaagcattggcagatgggcaagtcaggactcgagatgatccaacaggaaaagcttcgccagctcagggattgtatcatcgggaaaaggcctgaagaggaaaatgtgtacaacaagctgaccattgttcatcacccgggagggaaggagactgcccataacgagaataaattctataacgttcacttctccaacaaactgcctgctcgaccacaggttgaaaaagagtttgggttctgttgcaagaaggatcattag

SEQ ID NO: 215679 - DNA, 2313 bp, Artificial Sequence
  Description of Artificial Sequence: Synthetic coding sequence
atggtcaactgccatttaaaaatcgggaataccaaggacatcatcatgatctatgaggaggacgccgaggaatgggctctctaccttacagaggtgttcttacacgtcgtgaagcgcgaagcaatcctgctgtacagattggaaaacttttcctttcgccatctggaactcctgaatctcacgagctacaagtgcaagctactgatcctttctaactccctcttgcgggatcttactcctaagaagtgccaattcctggagaagattctccacagcccaaaaagtgtggtgactctgctgtgcggcgtgaagagcagcgatcaactgtatgaactgctcaatatctcccagtccagatgggagatttcgacagagcaggaacctgaggattacatcagcgttatccaaagcataattttcaaagatagcgaagactactttgaggtgaatatacctaccgacctgcgcgctaagcattctggggaaatttccgagcgaaaggaaatcgaagagctatctgaagccagcaggaataccattcctctggcagtggtgctgcccactgagataccttgtgaaaaccccggagagatcttcataatcttaagagatgaggtaattggggacaccgtagaagtcgaatttacaagctcgaacaagcggatccgcacaaggccagcattgtggaacaagaaggtgtggtgcatgaaagcgctagagtttcccgctggcagcgtgcatgtgaatgtctactgcgatggaattgtgaaagctaccactaagattaagtactatcccacagccaaggctaaggagtgcctgtttcggatggccgattcaggagagagtctgtgccagaacagtatcgaggaattagatggggtcttaacatcgatttttaaacatgagataccttattatgagttccaatcactccaaacagagatatgttcccagaacaagtacactcattttaaggagctgcccacactgctacactgcgcagctaagttcgggcttaagaatctagcgattcatttactgcagtgctctggcgcaacctgggctagtaagatgaagaatatggaaggctcagatcctgctcacatcgccgaacgccacggccacaaggaactaaaaaagatcttcgaagacttctccatccaggagatcgatatcaataacgagcaagagaatgactacgaggaagatatagcaagcttcagtacctatattccaagcactcaaaacccggctttccatcacgagtccaggaagacttatggtcaaagcgctgacggtgcagaggcaaatgaaatggagggcgagggtaaacaaaatgggagtggaatggagacaaagcacagtccgctggaagtggggtctgaatcttccgaagaccaatatgatgacctctatgtattcatccccggtgccgaccctgagaataactcccaggaacctctgatgtcttcaagaccacccctgcctccgcctagaccagtggctaacgcctttcagctcgaacgaccccactttacattgccgggtacaatggtggaggggcagatggaacgatcccagaactggggccatcctggggtcaggcaggagacaggcgacgaaccgaagggcgagaaagagaagaaggaggaagagaaggagcaagaagaggaggaagatccctacacatttgccgagattgacgatagtgagtatgacatgatcctggctaatttgtctataaaaaaaaagaccgggagccggtcattcatcatcaacagaccacctgccccaaccccgcgaccaacctccattcctcccaaagaggagaccactccctatattgcacaggtatttcagcagaagaccgctcggcgacagagcgacgatgataaattctgcggcctccccaaaaaacaagatcgggcaagaatcgaaagccctgccttttcaacgctgagaggctgcctaaccgacggtcaagaagaactgatactcctgcaggagaaggttaagaatggcaaaatgagcatggacgaggcccttgagaagtttaaacattggcaaatggggaaaagtggcctcgaaatgatacaacaggaaaagctcagacagctcagggactgcatcataggcaagaggccagaagaagagaacgtttataacaagctgaccattgtacaccatccaggtgggaaagagacagcacacaacgagaataagttctacaatgtgcacttcagtaataagttgcccgctaggccacaagtggaaaaggagtttggtttttgttgtaagaaagaccattag

SEQ ID NO: 215680 - DNA, 1959 bp, Artificial Sequence
  Description of Artificial Sequence: Synthetic coding sequence
atgctaccggcagctccgggaaaagggctgggctctcctgaccctgccccatgtggtccagcccctcccgacagcgaagattatttcgaggtaaatatccccaccgatctgagagcgaaacatagtggagaaatttcggaaagaaaagagattgaggaactcagtgaggcaagccgaaatacaataccactggcagttgtgctgccaactgagatcccatgtgagaatcccggagaaattttcatcatcctgcgcgacgaagtgatcggtgacacggtagaagttgagttcacttcatcaaacaagaggatcaggacccggcctgcactgtggaataaaaaagtttggtgcatgaaggctcttgaattccccgctggctcagtgcacgttaatgtctactgtgatgggatagtcaaagctactaccaagatcaaatactatcctacagctaaagccaaagagtgcctgttcaggatggctgacagtggcgagtctctctgccagaactcaattgaggagttggatggagttctcaccagcatatttaagcacgaaattccatactatgagtttcagtctctgcagaccgagatctgttcccagaacaaatatacccattttaaggagcttcctacactgctccattgcgccgcaaaatttggacttaagaacttggcgatacatcttctacagtgctcaggtgctacgtgggccagcaaaatgaagaatatggaagggtccgaccctgctcatatcgccgaaagacacgggcataaggaactgaagaagatctttgaggatttctcaattcaagagatcgacataaacaacgaacaagagaatgattacgaggaggacatcgccagcttttcaacatacatacccagcactcagaaccccgcttttcaccatgaatctagaaaaacttatggtcagagcgctgatggggcagaggcgaatgaaatggaaggcgagggcaagcagaatggttcaggcatggaaaccaagcactctcctctggaagtggggtcagagtcctcagaagaccagtatgacgacctgtacgtgttcatcccaggcgcagaccctgaaaacaacagccaggaacctctgatgtctagccgccctcccctacccccacccagacctgtggccaatgctttccagttggaacggcctcacttcacactgcccggtacaatggtcgaggggcaaatggagcggtctcagaattgggggcacccgggagtgcgacaggaaacaggcgatgaacctaaaggagaaaaggagaagaaggaggaggagaaggaacaagaagaggaggaggacccatatacctttgcagaaatcgatgactccgagtatgatatgatcctcgccaatttgtccattaaaaaaaaaacgggaagtcgaagctttattatcaacaggccccctgccccaactccacgacctacgtccattcctcctaaggaggaaaccactccctacattgcccaggtcttccagcagaagaccgctcgtcgtcaatcagatgatgataagttctgtgggcttccgaaaaagcaggatagggccaggattgagagtcccgcattttccaccctccggggttgcctgactgatggccaagaggagttaatactcctgcaggagaaggtcaaaaatgggaagatgtccatggacgaagctcttgagaaatttaaacactggcaaatggggaaaagcgggttggagatgattcaacaggagaagctcagacagctgcgcgactgcattatcggcaaaaggcctgaggaggagaatgtgtataacaagcttacaatagtgcaccatccaggcggtaaggagactgcccacaacgaaaacaagttctacaatgtacacttctccaacaaactcccggctcgcccacaggtagaaaaagaattcggcttttgttgcaaaaaagaccactag

SEQ ID NO: 215681 - DNA, 516 bp, Artificial Sequence
  Description of Artificial Sequence: Synthetic coding sequence
atgcatccattctacactcgagccgcaacaatgattggcgagattgctgccgctgtctcgttcatttccaagttcctgcgcactaagggactgacttctgagcgtcagctgcagactttttcccagtcgctgcaggagttactggcagagcattacaaacaccattggtttcccgaaaaaccctgtaagggatccggctaccggtgcatcaggattaaccataagatggacccactcatcggacaggccgctcagcggatcggactaagttcacaggaactttttcggctgctcccaagcgagctaacgctatgggtggatccctatgaagtgagttacagaattggagaagacggatccatttgtgtcctctacgaggcaagccccgctggcggatcgacacagaacagcaccaatgttcaaatggtcgactctcgcatctcttgtaaagaagagcttctgcttggcagaacctccccctcaaaaaattataacatgatgactgtttccggctag

SEQ ID NO: 215682 - DNA, 672 bp, Artificial Sequence
  Description of Artificial Sequence: Synthetic coding sequence
atgcgagatgaaatagcaacaacggtgtttttcgtgacacgtctggtaaagaagcatgacaaattaagtaagcagcagattgaagacttcgcggagaaattgatgacaatcttattcgagacttatcggtctcattggcacagcgattgtccgagcaaagggcaagcattcaggtgcatacgaattaacaataatcagaacaaagaccccatactagagcgagcctgcgtggagtccaacgttgatttcagccacctgggactgcctaaggagatgaccatttgggtcgaccctttcgaggtatgctgtagatacggggagaagaaccacccttttactgtggcttctttcaagggtcggtgggaagagtgggaactgtaccaacaaatatcttatgccgttagcagggcaagtagtgatgtgagctccggcacttcatgtgatgaggaaagctgttcaaaagaaccaagagtaattcccaaagtgtctaatccaaaatcaatatatcaggtggagaaccttaagcagccctttcagagctggctacagatcccacgcaaaaagaacgtggtggacggcagggtaggacttttaggcaatacctaccacgggagccagaagcatcctaagtgttaccgacccgcaatgcatcgccttgatcgaatcctctag

SEQ ID NO: 215683 - DNA, 483 bp, Artificial Sequence
  Description of Artificial Sequence: Synthetic coding sequence
atgcgggatgagattgcgaccaccgtattctttgtgactcgtttggtcaagaaacacgataagctcagcaaacagcagatcgaggattttgctgagaaactaatgacgatactctttgaaacttacagatcgcactggcattctgattgccctagtaaaggccaggccttccgttgtatcagaattaataacaaccagaataaggatcctattttagaacgcgcatgcgttgagtctaacgtcgatttttcccatctggggctaccaaaggaaatgactatctgggtggacccatttgaggtgtgctgcagatacggggagaaaaatcatcccttcacagtagcgagctttaagggtcggtgggaggagtgggaattgtaccagcagatctcttacgctgtctcgagggcatcctcagacgtaagctctggaacatcctgcgatgaggaatcctgctcaaaagaacctcgtgtgattccctag

SEQ ID NO: 215684 - DNA, 1188 bp, Artificial Sequence
  Description of Artificial Sequence: Synthetic coding sequence
atgagtttagtggacttgggcaagaagctgttagaagcagcacgggctggccaggatgatgaagtgcggatcctcatggccaacggggcacccttcacgaccgactggttggggacctccccattgcatctcgccgcacagtatgggcactacagtaccacggaggtcctgttacgagcaggagtgtccagagacgcaaggacgaaggttgataggactcctctgcacatggccgctagtgagggacatgcctccattgtggaagttctcctgaagcacggagccgacgtgaacgccaaggacatgttgaaaatgactgctctccactgggctacagagcataatcatcaggaagttgtcgaattattgataaaatatggcgctgacgtgcatactcagtctaaattctgtaagacagcattcgacatatcaattgacaacggtaacgaagatctcgccgagatcctgcagatcgctatgcaaaaccagatcaacaccaacccagagtcacctgatactgttaccattcatgctgccactcctcagtttatcatcggcccaggcggagttgtgaacctgacagggctggtgtctagtgaaaactccagtaaggccaccgacgaaaccggcgtaagcgctgtgcaattcgggaacagctccactagcgtgctggcaacactggccgcactggcagaggccagcgcacctctcagcaacagcagcgaaactcctgtagttgctacagaagaggtagttacagccgaaagtgtggatggtgctatccagcaggtggtttcatcgggcggacagcaagtgatcaccattgtcaccgacggcattcaattgggaaatctgcattcaatacctacctcgggcatcggacagccgattatcgttacaatgcctgatggccagcaggtgctcactgtcccagccactgacattgcagaggaaacggtgatctctgaggaaccccctgccaaaaggcaatgcattgaaatcatcgagaaccgagtagagagcgcagagattgaggagagagaggctctccaaaagcaactggacgaggcaaatagggaagcccaaaaatatcgccagcagttgctgaagaaggaacaggaggccgaggcttatcggcagaagcttgaggctatgacaaggctccagacgaacaaagaagccgtatag

SEQ ID NO: 215685 - DNA, 555 bp, Artificial Sequence
  Description of Artificial Sequence: Synthetic coding sequence
atggagcctagccagtgcgtcgaggagctggaggatgacgtcttccaacccgaagatggggaaccagtaactcagcctggaagtcttctgtccgctgacttgtttgcacagtctctgctggactgtccccttagcagactgcagttatttcccttgactcactgctgcggtcccggtttacggccaacatcacaagaggataaggcaacccagaccctgtcccccgctagtccatcacagggagtgatgctgccctgtggggtaaccgaggaaccacagcgcctcttctacggtaatgcaggctatcgtctccccctccccgcatcctttcccgctgtattgccaattggagagcagccacccgaaggacagtggcaacaccaggccgaggtgcaaatcgccagaaagctgcagtgtattgccgaccaattccacaggttgcacgtgcagcaacaccagcagaatcagaatagagtttggtggcagatactattattcttgcacaacttggccctaaatggcgaggagaaccgcaacggtgccggaccacggtag

SEQ ID NO: 215686 - DNA, 555 bp, Artificial Sequence
  Description of Artificial Sequence: Synthetic coding sequence
atggaaccttcgcaatgtgtggaagagctggaggatgatgtgtttcagcccgaggacggcgagccagtgacacagccaggtagtctattgtcagcagacttgtttgctcagtcccttctggactgccccctgtctcgtctgcagctgtttcctctcacccactgttgcggacccggactgcgccctacctcccaagaggacaaggctacacagacactaagccctgctagcccttcccagggggtgatgctgccttgcggggtgacagaggagcctcagagattgttttacgggaacgctggatatagactgcccctgccggcttcatttcccgctgtgctgccaataggagagcaacctcccgaaggccagtggcaacaccaggcggaggttcagatcgctcgtaaattgcaatgtatagcggaccaattccacaggctgcacgtacagcagcatcaacaaaaccaaaatagagtatggtggcagatcctgcttttcctccataacctggccttgaatggagaagaaaatcggaacggagctggacctaggtag

SEQ ID NO: 215687 - DNA, 492 bp, Artificial Sequence
  Description of Artificial Sequence: Synthetic coding sequence
atggagccgagccagtgcgtcgaggaactcgaggacgatgtgttccaacctgaggatggcgaacctgtgacccagcccggttccttgttgtctgcggacctttttgcccagtccttgctcgattgtcctttatcgcggctgcagctgtttcccctgactcactgctgcggccctggactaaggcctaccagtcaggaggataaagccacacagactctcagccccgcatctcctagtcagggcgttatgctaccctgtggagtaacggaggagccccagcgcctgttttacgggaacgccggatacagacttccgctgcccgcttctttccctgctgtgctgcctattggggagcagccacccgaaggccagtggcagcaccaggcggagcatcagcaaaatcaaaaccgagtttggtggcagattttactcttcttacacaatctagccctgaacggggaggagaataggaacggtgccggaccacggtag

SEQ ID NO: 215688 - DNA, 186 bp, Artificial Sequence
  Description of Artificial Sequence: Synthetic coding sequence
atggagccttcccagtgcgtggaggagcttgaggacgatgtctttcagcctgaggacggcgagcccgttacccagcccggttcactactgagcgctgacctttttgcccagtccctgcttgactgcccattgagccggctccagctgtttcccctgacacattgctgcggtcctggcctgcgttag

SEQ ID NO: 215689 - DNA, 390 bp, Artificial Sequence
  Description of Artificial Sequence: Synthetic coding sequence
atggagcccagccagtgcgtcgaagaactagaggacgacgtgttccaacccgaggatggagagcctgtaacccagcccggttctctcttatccgcagatttgttcgcccagtccctgctagactgccctctgagtcggcttcagttgtttcccctgactcattgttgcggtccagggttacgccctaccagccaagaagataaggccactcagactctgtccccagctagtccctctcagggggtgatgctcccttgtggtgttaccgaggagcctcaacgccttttctacgcccctgcagagcccaagagctgcgtagtggccgatccccctctcccagcgcagccttgttttgagtggaggcgtgaacaggagagaggcaggccctag

SEQ ID NO: 215690 - DNA, 42 bp, Artificial Sequence
  Description of Artificial Sequence: Synthetic coding sequence
atggagccatcccagtgtgtggaggagcttgaagatgactag

SEQ ID NO: 215691 - DNA, 555 bp, Artificial Sequence
  Description of Artificial Sequence: Synthetic coding sequence
atggaaccctcgcaatgtgtagaagaactggaagacgatgtgtttcagcccgaggacggcgagcctgttacacagcctggcagccttcttagcgctgatctgtttgctcagtcgttacttgactgcccactgtccaggcttcagctgtttccactaactcattgttgcggcccaggcttacgcccaacttcccaggaagataaagccacacaaactctaagtcccgctagcccaagccagggtgtcatgctgccatgtggcgtgacggaagaaccacagcggttgttttacggaaacgcaggctacaggttgccgctgcccgcatcattccccgcagttctgcctatcggcgaacagcctccggagggacaatggcagcaccaggcagaagtacagatcgccagaaagctgcagtgtatcgcagatcagtttcatcgcctccatgttcaacagcaccagcagaatcagaatagggtttggtggcagatcctgctcttcctccataatctcgctctaaacggcgaggagaatagaaatggagctggaccacgctag

SEQ ID NO: 215692 - DNA, 555 bp, Artificial Sequence
  Description of Artificial Sequence: Synthetic coding sequence
atggagccttctcagtgcgttgaagagctcgaagacgacgtgtttcagccagaagacggggagcccgtgacccagcccggttcgttgctttctgcagatctcttcgcccaatcactcctggactgtccactttccagattgcaattgttccctctgacccattgctgtgggcctggactgaggccgactagccaggaagacaaagcaactcagacactgtcaccggcaagccctagtcagggtgtgatgctgccctgcggcgtgactgaagagcctcagaggctgttttacggcaacgccggatatcgattgccattgcctgcttctttccccgctgtgttaccaatcggagagcagcctccggagggacaatggcagcaccaggctgaggttcaaatcgcgagaaagcttcaatgtatcgctgaccaatttcaccgcctgcacgtgcaacagcaccagcaaaaccaaaaccgggtgtggtggcagattctgctcttcctgcataatttggctctcaatggcgaagagaaccgtaatggcgctgggcctagatag

SEQ ID NO: 215693 - DNA, 585 bp, Artificial Sequence
  Description of Artificial Sequence: Synthetic coding sequence
atgtcccaaaatggcgctcccggaatgcaggaggagtcacttcagggttcctgggtggagctccatttctccaacaacggcaatggaggtagtgtgccagcgtccgtctccatttataacggggatatggagaaaatcctgctggacgcgcagcatgagagcggcagaagtagttccaagagttcccattgtgactccccacctaggtcccaaaccccccaagacaccaatcgcgcatcagagactgacacccactccatcggtgagaaaaatagcagccagtctgaggaggatgacatagagcggagaaaagaggttgaaagcatacttaaaaaaaactccgactggatatgggattggtcctcccgcccagagaatatccctcccaaagagttcctgttcaaacatcccaagcgtacagccacgctgtctatgagaaatacctcagtgatgaagaaggggggaatcttcagtgccgagtttctcaaggttttcctgccatctctgctcctctcacacctcctcgcgattggacttggcatctatatcgggaggagactcactacctcaacatcaaccttctag

SEQ ID NO: 215694 - DNA, 543 bp, Artificial Sequence
  Description of Artificial Sequence: Synthetic coding sequence
atgtctcagaatggggctccaggaatgcaagaggagtccttgcaaggatcttgggtggagcttcatttctccaataacggcaatggaggatcagtgcctgcctccgtgagtatttataatggggacatggagaaaatcctcttagacgcccagcatgagagcggcaggtcaagcagcaaaagtagccactgtgactctcctccgagatcacagacgcctcaggatactaatcgagcgtccgagaccgacacacattctatcggtgaaaaaaatagctcacagagcgaagaggacgacatcgagcgcagaaaggaagtggaatctatcctcaaaaagaattctgactggatttgggactggagctccagacctgagaacatccccccaaaggaattcctgttcaaacatcctaagcgaacagctactctgtccatgagaaatacatctgtcatgaagaagggcggaatcttttcggctgagtttctcaaagtgtttctgccgtctttactgttgtcccatctgttggccatagggctgggctag

SEQ ID NO: 215695 - DNA, 1071 bp, Artificial Sequence
  Description of Artificial Sequence: Synthetic coding sequence
atgtctaggccactgttgattacattcactccagcaaccgatcccagtgacctctggaaggatggccagcagcagccccagccagaaaaacccgagtctacgctggatggagccgcagctctcgcattctacgaagctttaatcggcgatgagtcttcggcccctgattctcagaggtctcaaaccgaacctgcaagggaacggaaacgcaagaaaaggaggatcatgaaggctcccgcagcagaggcagtggccgaaggagcttcagggcgacacgggcagggaagaagcctggaggccgaggacaagatgactcatcggatacttcgggcagcacaggagggcgatctaccagagttaagaaggctcctggaaccacatgaggccggaggggctggcggaaacatcaatgcacgcgatgccttttggtggaccccactgatgtgcgccgctcgagccggacaaggcgctgccgtgagctaccttctgggcaggggggcagcctgggtcggggtgtgcgagctgagcggacgcgatgcagcgcagctggcagaagaagccggattccctgaggttgcacggatggtgcgggagagtcatggggaaacccggtcccctgagaaccgctctcctacaccttcactccagtactgtgagaactgcgacacccatttccaagactctaatcaccgaacgtcaaccgcccacctcctgtccttgagccagggccctcagcctccaaatcttccactgggcgtacccataagtagtccgggttttaagttacttctgcggggtggctgggagccgggaatggggctggggcctcgcggtgaagggagggctaatccaatacctactgtgctgaaaagagaccaggaagggctcggttaccgctccgcgccacaacccagagtgactcactttccggcttgggacaccagagctgttgccggtcgcgaacgccctcctcgagtagccactctgtcctggagggaagagcggcgaagagaggagaaggaccgagcatgggagcgagacctccgaacttacatgaatttggagttttag

SEQ ID NO: 215696 - DNA, 3399 bp, Artificial Sequence
  Description of Artificial Sequence: Synthetic coding sequence
atggagcctaacgattcaacctccaccgccgtagaggaacccgatagcttagaagtgcttgtgaaaacccttgatagtcaaactagaacatttatcgttggagcgcagatgaacgtgaaagagttcaaggagcatattgcagcctccgttagcataccttctgagaagcagagactcatttatcagggacgtgtgctgcaggacgacaagaagctgcaggagtataacgtcggagggaaggttatccacttagtcgagcgtgcccctcctcagacgcacctgccctctggcgcatcatccggaacaggaagtgctagcgctactcatgggggtggcagtcccccaggaacgagaggacccggagcctcggttcacgacagaaacgctaactcctacgttatggtagggaccttcaaccttccatcggacgggtccgccgtggacgtccatatcaacatggaacaggcgcctatacaatccgaaccccgtgtgagactcgttatggcacagcacatgattcgtgatattcaaacactcctgtctagaatggagacactcccttacctccaatgtaggggtggccctcagccccagcatagccagccgccaccccagccacccgcagtaacgcccgagcctgtggccctgtccagccagacatcagaacctgtagaaagcgaggccccacctcgtgagcctatggaagcggaggaagtggaagaacgcgctcctgcccaaaaccctgagctcacgcccggtcccgctcccgctggtcctactccagcaccggaaactaatgctcccaatcatccatcccctgctgaatacgtggaggtgctgcaagagctgcagaggctcgagtctcgtcttcaaccttttttgcagagatactacgaggtgcttggcgcagccgcaacaacagattacaacaacaatcatgaagggagagaggaagaccaacgtctgattaacttggtgggggagagccttaggctgttgggaaatacctttgtggccttaagcgacctgcgttgcaacctcgcctgtaccccccctcgtcacctgcacgtggtgcgtccaatgagtcattacacaactccaatggtccttcaacaggcagccatccctatccagatcaatgtgggcaccaccgtaacaatgactggtaacggcaccagacctcctccgacccccaacgctgaagccccaccacccggaccaggccaggcatcatcggtagccccaagctcaaccaacgtggagagctccgcggagggtgcacctccccctgggccagcaccccctcccgcaacatcccacccccgtgtgatccgcatctcacaccagtccgtcgagccagtggtaatgatgcacatgaatatccaggatagtgggacccaacccggaggcgtgccttctgcccctactggccctctggggccacctggacacgggcaaacattgggacagcaggtccctgggtttcctactgcacccacacgtgtggtgatcgccagacccactcctcctcaggcgcgacccagtcaccccggtggacccccagtgtctgggaccctgcagggggcaggtctcggaaccaacgccagtctcgcgcagatggtgtccgggcttgtcgggcagcttttgatgcaacctgtcctggtggcccagggcacccccggtatggccccacctccagctcccgctaccgcgtcggcctccgccggaaccacaaacacagccaccacagccggacccgcacctgggggacccgcacagccaccgcctacaccacaaccatctatggctgatctccagtttagccaactccttggaaacctgctgggcccagccggaccgggagcgggtggttcaggagtggcatccccaacaatcaccgtggccatgcccggagtgcctgctttcctccagggaatgaccgacttcctgcaagcaactcagactgctccacccccacccccacctccgcctcctccccctcccgcacctgagcagcagaccatgccccctcccggttcaccctccgggggagccggaagccctggcggactcggattagagtcactctcgcccgaattttttacctccgtggtgcagggggtgctgagcagccttctgggctctctcggcgcaagagctggtagcagcgagagcatcgccgcatttattcagagactgagcggatctagtaacatattcgaaccgggagcagacggagctctgggattctttggagcactccttagtcttctgtgccagaacttctcaatggtggacgtagttatgctcctacacggacactttcagcccctccagaggttacaaccccaactgcgttctttctttcaccagcactacctgggcggacaagaacccactccctctaatatcaggatggcgacacacactctgattaccgggcttgaagaatacgtccgcgagtcattcagcctcgtccaggtccaacctggcgttgacattattaggacaaatttggaattcctacaggagcagtttaattctatagctgcacacgtgctgcactgtaccgattcaggctttggcgcaagattgctagagctgtgtaatcaagggctctttgagtgcttggccttaaatttgcattgcttgggcggacagcagatggagctcgcggcagtgattaatggaagaatcaggaggatgtcaagaggggtaaacccttctttggtttcctggctgacaaccatgatggggctgcggctccaggtcgtgctagagcacatgccagtaggcccagacgcaattctgcgatacgtacgcagggttggcgacccaccccagccactgcccgaggagccgatggaggtgcagggagccgaaagggcaagccctgagcctcaacgagaaaatgccagcccggctcctggaactactgcagaagaagccatgtcaagaggccctccacctgctcccgagggtggatctcgtgacgaacaggacggggcaagtgctgaaactgagccatgggccgctgctgtcccccctgaatgggtccctataatacagcaggatatccagagccagaggaaagtgaaacctcagccccctctatccgacgcatacttgagtgggatgccggcaaagcggaggaagacaatgcagggcgaagggccacagcttcttttgtcagaagccgtctctcgcgcagcgaaggcagcgggagcaagaccactgacaagcccagagtcactgagcagagatttggaggctcctgaggtgcaagagtcttaccggcagcaactacgatcagatattcagaaacgactccaggaggaccccaattatagccctcagagatttccaaatgcccagcgggcatttgccgatgacccatag

SEQ ID NO: 215697 - DNA, 3234 bp, Artificial Sequence
  Description of Artificial Sequence: Synthetic coding sequence
atggagccaaacgactccaccagcacagccgtggaggaacccgacagcctcgaggtgctggtgaagaccctggacagccagactcgtaccttcatcgtaggcgcacagatgaacgtgaaggaattcaaagaacacattgcagcctctgtgagcatccccagtgagaagcagagactgatctaccagggccgtgtgctgcaagacgacaagaaactgcaggaatataatgtaggcggaaaagtgatccacctcgtagaacgcgcaccgccacaaacccatttgcccagcggcgcatccagtggaaccggctcagccagcgccactcacgggggtgggtcaccgccaggaacccgcggtcccggagcttccgtacatgacaggaacgctaattcctatgtgatggtcggaaccttcaatctgccaagcgacgggtctgcagtggatgtgcacattaacatggagcaggctcctattcagagcgagccgagagtgaggttggtgatggcacaacacatgatccgcgacatccaaaccctccttagtcggatggagtgccgaggtgggcctcagccacaacatagtcagccaccccctcaaccccctgctgtaacaccggaacccgtagctcttagctcccaaacctcagagcctgtggagagtgaagcccctcccagagagcccatggaggccgaggaggtggaagaacgggctcccgctcagaacccagagttgacgcctgggccagctccagcaggtcctacaccagccccagagacaaatgctcctaatcatccttcccccgctgaatatgtcgaggttcttcaggaactccagcgtttagagtctagactacagccattcctacagcgctactatgaggtgttaggagccgctgcgacaacagactacaataacaatcatgaaggacgggaggaagaccaacgcttaatcaaccttgtgggagaatccctgagattgctgggtaacacattcgtggctctgagcgatctccgatgtaacctcgcctgtactccacctcgccacctgcatgtggtgagacccatgtcccactacactacccccatggtacttcagcaggctgcgatcccaatccagatcaacgttggtacaacagtgaccatgaccggaaatggcactaggccaccaccaacacccaatgcggaggcccctccccctggccctgggcaagcatcttccgtggccccttctagcacaaatgtggaaagctccgcagagggtgcaccaccccctggtcctgcgcctcctccagctacaagccacccaagagtcattcgaatcagccaccagagcgttgagccagtagtgatgatgcacatgaatatccaggactcaggcacacagccaggaggcgtgccttccgccccaactgggcctctgggcccacccggacatgggcaaactctcggccagcaggtgcctggattccctacggcacccactcgggtggtaattgcacggccaacacctcctcaggcccgtccctctcacccaggcggacctccggtgtccggcacgctgcaaggcgctggcctggggaccaatgcctcactagctcaaatggtgtctggcctggttggccagcttctgatgcaacccgtgttggtcgctcaggggaccccaggaatggccccaccgccagcccctgccactgcgtccgcatcagccggaaccacaaacacggcaactacagctggccctgcgcctgggggacctgcccagcccccacccactcctcagccctccatggctgatcttcagttctcccaactgctgggcaacctgctcggcccagcaggacctggcgcaggagggtcaggagttgcctcacccaccatcacagtggctatgcctggcgttccggcattcttacaaggtatgacggatttcctgcaggccacccagacagctcctccgccacctcctcctccaccccctcctccccctgctcctgagcagcagaccatgcccccaccagggtccccttcggggggtgccggatccccaggaggacttggtcttgaatctctgtctcccgagttcttcacatcagttgtgcagggcgtattgagcagtcttctcggatcattgggcgctcgagccggaagctctgaaagtattgccgcttttatccagagactttccggaagctcaaatatttttgagcctggggcagatggggctctcggcttctttggagcattgctgagtcttctatgccagaacttttccatggtagatgtagtcatgctgctgcatggacacttccaaccccttcagcggctgcagccgcagctgcgcagttttttccaccagcactacttgggcggacaagaacccaccccgagcaacatccgcatggcgacacataccctgatcacgggtctcgaggaatacgtgagagagagtttttccctggtacaggttcaacccggtgtggatataatacgcaccaacttagagtttctgcaggaacaatttaactcaatagctgcgcacgttttacactgtacagattccggtttcggggctcgattgttggagctttgtaaccagggactctttgagtgtctggctctcaaccttcattgtctggggggtcagcaaatggagttagctgccgttatcaacggccgtatcagacgcatgtctcgcggagttaatccttccctagtttcctggctcacaaccatgatgggcctacggctccaggtggtgctcgagcatatgcccgtcggccctgacgccattttgcgctatgttaggcgagtaggagaccctccccagcctctccccgaggagccgatggaagtgcaaggcgctgaacgcgctagtccggaaccccaacgtgaaaatgcctccccagctcctggaacaacggctgaggaggcaatgagtagggggcctccaccagcgcctgagggaggcagtcgggacgagcaagatggggcatctgcagagacggagccttgggcagccgcagtgcccccagaatgggtgccgatcatacagcaggatatccagagccagaggaaggtgaagccacagccccctctgagcgacgcttacctgagtggaatgccggctaaaagacggaagctccgcagcgatatccaaaagcggttgcaggaggaccccaactacagtccccagaggttccctaacgctcaaagagcctttgctgatgatccatag

SEQ ID NO: 215698 - DNA, 3399 bp, Artificial Sequence
  Description of Artificial Sequence: Synthetic coding sequence
atggagcccaatgactctacatctaccgcagtggaagaaccagactctctggaggtgctggtgaagactcttgactcacaaacccggacattcatcgttggcgcacagatgaatgttaaggagttcaaggagcacatagccgcatccgtcagtattcccagcgaaaaacaacgactgatataccaaggcagagtcctgcaagatgataagaagctgcaggaatataacgtcggaggaaaagtcatacacttggtcgaacgagctccacctcaaacccacttgcctagcggcgcatccagcggcacaggctccgccagtgcaacccacgggggaggcagtcctcccggaactcggggtccgggtgcctctgtgcacgatcggaatgcgaattcatatgtgatggtgggaacttttaacctgccctctgatggcagtgccgtggatgttcatatcaatatggaacaggccccaatccagtccgagccacgtgttaggctggtgatggctcagcacatgatccgcgatattcaaaccctgctgagccggatggagaccctgccctatttgcagtgtcggggaggcccacagccacagcatagccagcctccacctcaacccccagctgtgacccctgagcccgtggctctgtcaagtcagacatccgagcccgtggagtccgaagcgccaccacgggagccgatggaagcagaagaagtggaagaaagggcccctgcccaaaatcccgagctgactcctggcccagcccctgccggtcctaccccagcgcctgaaaccaatgctcccaaccatccaagccctgctgaatatgttgaagttttgcaagagctgcagcgcctagagtccaggctgcagcccttcctccagagatactacgaagttctcggggcagccgcaactacagactacaataataatcacgagggcagggaagaagatcagagactgatcaacttagtcggtgagtcactgagactcttagggaatacgttcgtcgctctgtccgacctccgatgcaacctcgcctgcaccccaccgagacaccttcatgtggtgaggccaatgtcacactacacaaccccaatggtgcttcagcaggcggcaatcccaatccagattaacgtgggcactactgtgactatgactgggaatggaactagaccccctccaacgcccaacgccgaggctcctccacctggaccagggcaggcgagcagcgtggctccctcttcgaccaacgtggaatcctcagccgagggagccccacccccaggcccagcaccccctcccgctacctcccatcccagagtcatacggatctctcatcagtcggtggagccagtggtgatgatgcatatgaatatccaggactctgggacacaacctggcggtgtcccctccgcacccaccgggcctctgggcccacccggacatggacaaacactcggtcagcaggtgcctggctttccgacggctcctacccgggtggtgatcgctagaccaacaccccctcaggcacgtcccagccatcccggtggccctcccgtttctggaacgctgcagggggctgggttaggcaccaatgcctccctggcacaaatggtgtctggactggtgggacagcttctgatgcagcctgttcttgtggctcaaggtacgcctgggatggcaccccctccagccccagccacagcctcagcttctgctggcaccacaaacaccgctactacagccggtccagctccagggggtccggctcaaccccctcctactccacagccttcgatggccgatctgcagttcagccagctcttggggaaccttctcggcccagctggaccaggggcaggaggaagtggcgtcgctagcccgacgattacagtggcgatgccgggagtacccgcttttctgcagggaatgaccgacttcctgcaggctacccagaccgcccctccccctcctccaccccctccccctccgccaccagccccagagcagcagactatgccacctcccggaagccccagcggaggagcaggcagtcccggagggctcggcctggaaagtctgagtccagagttcttcacatcagtggtgcagggcgtcttgtcatctctgctcggctctctgggtgccagggccggaagttcggaatctatagccgctttcatccagaggctgagcgggagctcaaacattttcgagccaggggcagacggggctctaggtttctttggggcactgttgagtctgctctgccagaacttcagcatggtcgatgttgtgatgctgctccacgggcatttccagcctctccagaggctgcagccccagcttaggtcctttttccaccagcattatttggggggtcaggagccaacacccagcaatatacggatggctacccatacccttatcacgggtttagaggagtacgttagagagtcatttagcctagtccaggtgcaacccggagtcgacatcatccggactaatcttgaattcctccaagagcagttcaattcaatcgccgctcatgtgctccattgcaccgattcaggctttggggcacgcctgctcgaactgtgtaatcagggcctttttgagtgcctggccctgaacttacactgcctggggggacagcagatggagttggcagctgtcattaatgggaggatcagacgcatgtccagaggagtcaatccaagccttgtgagttggctaacaacaatgatgggcctcagacttcaggtggtcttggaacacatgcctgtgggaccagatgcaatcctccggtacgtgagaagggttggggacccacctcagcccctcccagaagagcctatggaagtacaaggtgctgagagggccagcccagagccccaaagggagaacgcttctcctgcccctggcaccacagccgaagaggctatgagccgagggcctccccctgcccctgaggggggttcaagagatgaacaggatggcgcaagcgccgaaaccgagccttgggctgcagcagtgccgccagaatgggttcctatcattcagcaggatatccagtcccagagaaaggtgaaaccacagccccctctgagcgatgcatatctgtcgggcatgcctgcaaaacggaggaaaacaatgcagggcgaggggccacagctgcttcttagcgaggccgtatcccgagccgcaaaagctgctggagctagaccattaaccagccctgagtcactgtctcgcgacctcgaagcccctgaagtgcaggagtcttatcggcagcaactcagaagcgacatccagaaaaggctccaggaggaccctaattactcaccccagcgctttcccaacgcccaacgggcattcgcggatgatccctag

SEQ ID NO: 215699 - DNA, 3381 bp, Artificial Sequence
  Description of Artificial Sequence: Synthetic coding sequence
atggagcctaatgattctactagtacagcagtcgaggagccggattctctagaggtcctagtaaaaactctcgattcacagactagaacatttatcgtgggcgctcagatgaatgtaaaggaattcaaggagcacatcgccgcatccgtgtccatacctagtgagaaacaacggttgatctatcagggacgggtccttcaggatgacaagaaactccaggagtacaatgtcggcggaaaggtgatacatttggtggaaagagcaccgcctcagacccatttaccaagtggagctagctccggcacagggtccgcctcagcgacccacggaggtggcagccctccaggaacccgcggaccaggcgcatcggtacacgatcgcaatgctaacagctacgttatggttggtacttttaacctccccagcgacggtagcgccgtcgacgtgcacatcaatatggaacaagctccgatacagtctgaacctcgagtgaggttagtcatggcgcagcacatgataagagatatacaaaccctgctgagtaggatggaatgcagaggcggaccacagcctcagcatagtcagcccccacctcagccacccgctgttactccagagccagtcgcgttaagttcgcagacaagcgagcccgtcgagtccgaagcgccacctcgggaacccatggaggctgaggaggtggaggagagagcccctgcccagaaccctgagctaacaccagggcctgctcccgcagggccaacccccgcaccagaaaccaatgccccaaaccatccctctcccgctgagtacgttgaagtgctgcaggagttgcagaggctagagtcgaggctgcagccatttctgcaacgctactatgaggtgctgggagccgctgctactacagactataacaacaatcatgagggaagggaggaagaccaaagacttattaacctggtgggcgaatccttaaggctgctgggaaatacttttgttgcccttagcgatctcagatgtaacttggcttgcacaccgccaaggcatctgcatgtggttcgccctatgtcccactatactacaccgatggtgctccaacaggctgcgattccgatccagatcaatgtgggaacaacagtcacaatgacagggaacggtacccgtcctccaccaaccccaaatgctgaggctccgcctccaggccctgggcaagccagtagtgtggccccttcctcgacaaacgttgaatccagtgccgagggcgcacctcctcctgggcctgcccctcccccagccacatcccaccctcgagtgatccgtatcagtcatcagtcagttgagccagtcgttatgatgcacatgaatattcaggacagtgggactcagccaggtggagtgcccagtgcgcctactggcccactaggtcctccaggccacgggcagactttgggacagcaggtgccaggcttccctaccgcgcctacgcgagtcgtgatagcgagacctactcctccccaggccagacccagccacccgggaggaccacccgtgagtgggactctgcaaggagctggactcgggacgaatgcttctctggcccagatggttagcgggctggtcggacagctccttatgcagccagtgctcgtcgctcagggaactcccggaatggcacccccacccgctcccgctacagccagtgcctctgcaggtacaaccaacacagctaccacggcgggacccgctcccggtgggccagcgcagccgccacctacaccccaacccagcatggccgatctgcagtttagtcagttgctgggcaatttactcggtcctgctggacccggagctggtggctcaggcgtggccagccccactatcaccgtagcgatgcccggtgtgccagccttcttgcagggcatgaccgatttcctgcaggccactcagacagcaccccctcctccaccccctcctccaccgcctccccctgcacccgaacagcagacaatgccccctcctggctctccttccggcggagcgggttcccccggaggcctgggcttggagtcactgagtcccgagtttttcacctctgtggtgcagggagtgttaagttctttattaggctcactcggcgctcgcgcaggttcatccgagtccatcgcagcttttattcagcgcttatccggctcctctaacatcttcgagccgggagccgatggagctttagggttctttggggcactgctgtccctcctctgtcagaatttctctatggtggatgtggtcatgcttctgcatgggcactttcagccactccagagactgcagccacagctgcgctccttcttccaccagcattacctcggaggccaagagcccactccttcaaacatccggatggcaactcatacactgattaccgggctggaggagtacgtccgcgagagctttagcctggttcaggtgcagccaggcgtagatattatcagaacaaatctcgagttcctgcaggagcagtttaatagcattgccgcacatgtgctgcactgtactgactctggttttggcgcacgcctgctagaactctgcaatcagggtctatttgagtgccttgcactgaacctccactgtttgggagggcagcaaatggagctggccgcagtaatcaacggcaggatcagacgcatgagcagaggtgtgaatccgagcctggtctcctggctgaccacaatgatgggtcttcgattacaggtcgtcctggaacacatgccagttgggccagacgcaatactccgctatgtccgcagagtgggggaccccccacagcctctgcccgaggagcctatggaggtgcagggggcagaacgggcatctccagagccacaaagagagaatgcctcacccgcaccaggtacaaccgcagaagaggctatgagcaggggccctccgccagcccctgaaggcggatcacgggatgagcaggacggcgctagtgcggaaactgaaccctgggcagcagcagtcccgccagaatgggtgcccatcatacagcaagacatccagagccagaggaaggtgaagcctcagccaccactctccgacgcttacctatctggcatgcctgccaagcgacgcaagaccatgcagggtgagggacctcagctgctcctgtctgaagcggtttcaagagcagcaaaagccgcaggagccagaccacttacaagccctgagagcctgtctcgggatttggaggctcctgaggttcaggaaagctaccggcagcaactccgctctgacattcagaagaggctccaggaagacccaaactactccccccagcggtttccgaatgcacagagggccttcgccgatgatccctag

SEQ ID NO: 215700 - DNA, 3381 bp, Artificial Sequence
  Description of Artificial Sequence: Synthetic coding sequence
atggaacccaatgactcaaccagtaccgcagtggaagagcctgatagtttggaggtgcttgtgaagaccttagacagccagacacgaacatttatcgtgggggctcagatgaacgttaaggagttcaaggagcacattgccgcttcggttagtatcccctccgagaagcaacgcctaatatatcaagggagagtgctacaggatgacaagaaacttcaagagtacaacgtcgggggaaaagtgattcacctggttgagcgtgccccaccccaaacacacctcccttccggtgctagtagcggcaccggatctgcttccgctactcatggaggagggtcccccccaggtacacgtggacctggagcctccgtgcatgatagaaatgccaatagctacgttatggtcggtacattcaaccttcccagcgatggctccgccgtggacgtgcacattaatatggagcaggccccaatccagtctgaacctagggtgcgattggtgatggcccagcacatgataagagacattcagaccctcttaagcagaatggagtgccgaggcggacctcagcctcagcattctcaaccccctcctcaaccccctgccgttacccccgaacccgtggccctgtcatcacaaacaagtgaaccagtcgaaagtgaggcccctcctcgagagcccatggaggcagaggaagtcgaggagcgggctccagctcaaaaccctgaattaacgccgggtccagcacccgctggccctacccctgccccagaaactaatgctcctaatcatccaagtcctgcagagtacgtggaagtattgcaggagcttcagcgtctggaatccagattgcagcccttcctgcagcggtattacgaggtgttaggggcagcggcaactactgattataacaataatcacgagggaagagaggaagaccagaggttgattaatcttgtgggcgaaagcctgcggctcctaggaaatacttttgttgcactcagtgatctgcgatgcaacctggcatgtactccacccagacacctgcatgtcgtcagacccatgtcccattatacaacacctatggtactccagcaggcagccatccccatccagatcaatgtcggcacaacagtaacaatgactgggaacgggaccagacctcctcctacccctaatgctgaagcacctccaccaggccctggccaggcctcctccgtggcaccttcctctaccaacgtggagtcttccgccgagggcgctcctccacccggaccggctccacctcctgcgaccagccatcccagagtcataagaatctcgcatcagagcgtggagccggtggttatgatgcatatgaacattcaagatagcggcacacaaccaggcggagtcccgtcggcacccacaggccctctgggccctcccggacatgggcaaaccctggggcagcaggtgcccggatttcctactgcaccaactcgtgtggttattgcacggcctacaccaccacaagccaggcctagtcatccaggaggcccacctgttagtgggaccttgcaaggggcagggctcgggactaatgcctcgttggctcagatggtgtcgggactggtcggccagttgcttatgcagcccgtcctcgtcgctcagggcaccccaggcatggctcctccccctgctccagccacagcttctgcctctgctgggacaacaaacactgccacaaccgccggtcctgcacccggtggaccggcacagccgcctccaacaccccagccttcaatggctgatctgcagttctctcaactgcttggcaatctgctgggacctgctgggcctggcgctggcggtagtggcgtcgctagtcccaccataacagtcgccatgccgggagtgcccgcatttcttcaaggaatgaccgatttccttcaggcgactcagaccgcccctcctcctccccctcctccacccccaccgcctcctgctccagagcagcagacaatgccaccccctggttctcccagcggcggagccggttcacctgggggactcggccttgagtcattgtctcctgagttcttcactagcgtggtccagggcgttctctcttctctccttggatccctcggcgcaagggctggttcttctgagagtatagctgctttcatccaaaggctatcggggtcctccaacatttttgagccgggtgccgatggcgctttggggttctttggcgctttattgagcctgctctgccaaaattttagcatggttgatgtagtcatgctgctccacggacactttcagccactgcagaggctccaaccacagctgcggagcttctttcaccaacattatcttggaggacaggaacctactccatccaatatcagaatggccacccatactctgatcaccgggctggaagagtacgtgcgcgagtcattcagcctggtccaggttcagcccggagtcgatatcatacgtactaatctggaatttctgcaggagcagtttaatagcattgctgcccacgtcctgcactgcacagacagcggctttggagctcgactcttagaactttgtaaccaaggattatttgagtgtctggcccttaatctgcactgcctgggagggcaacaaatggagctagcagcagtcattaatgggcgtatcagacgcatgagcagaggagtaaacccgtcactggttagctggctcacaactatgatgggtcttagactgcaggtggttttggaacatatgccagttggaccagacgcgattctgagatacgttaggcgggtgggcgatcctccacaacctctccccgaagagccaatggaggtccagggggctgaaagggcctctccagaaccgcagcgcgagaatgccagccccgcacccggtacgaccgctgaggaagcaatgtcccggggaccgcctccagcccctgaagggggatccagggacgaacaggatggagcgagcgcagaaacggagccgtgggctgctgcagtgcccccagaatgggtgccaatcatccagcaggacattcagagccagcgcaaagtgaagccccaaccaccgttaagtgatgcttacctgtcagggatgcccgctaaacgtcggaagaccatgcaaggcgagggcccacagctgctcctgtcagaagcagtttcccgggctgccaaggctgctggagcgagacctttaacgagtcctgagagcctgagtagggacctggaggctcccgaggttcaggagtcatatcgtcaacaactgaggagtgacattcaaaaaagactgcaagaagaccctaattattctccccagcggttcccaaacgcccagcgggctttcgccgacgacccatag

SEQ ID NO: 215701 - DNA, 3381 bp, Artificial Sequence
  Description of Artificial Sequence: Synthetic coding sequence
atggaaccgaatgattccactagcaccgccgtggaagagcccgactcgctcgaggtgttagtgaaaacccttgattcgcaaactcgaaccttcatcgtgggcgcacagatgaatgttaaggaattcaaagagcacatcgcggcttccgtgtctattccaagcgagaaacagagactgatctaccaaggccgtgtcctgcaagatgataaaaagctgcaggagtataatgtcggtggaaaggtcattcaccttgtggaacgtgcgcctccccagacccatctgccttcaggcgcttccagtggcacagggtcggcctcagctacgcacggcggagggtcccctcctggaacccgagggcctggtgcttcggttcacgatagaaatgcaaatagctatgtaatggtaggaacctttaatctgcctagcgacggctccgccgttgacgtgcacatcaacatggaacaagcccctatccagtccgaacctagagtacgcctggtgatggcccagcacatgattagggacatccaaactcttctcagccgaatggagtgcaggggtggaccacagccgcaacacagccagccgccaccccaacccccagctgtcaccccagaaccggtggccctgagcagccagacatcggagcctgtggagtccgaggcgccacctcgtgaaccaatggaagccgaggaagtggaagagagggcgccagcacagaatcccgagctgacccccggaccagctccagctggcccaacaccggctcctgaaactaatgcccctaatcaccccagccccgcagagtacgtcgaggtgctgcaagaacttcagagacttgaatcccggctgcaaccctttttgcagagatactacgaggtcctgggcgcagcagctacaactgactacaacaacaatcatgagggacgcgaagaggatcagcgtctaataaacttggttggcgagagccttagattgctcggcaacacatttgtcgccctaagtgatctgcggtgcaacctcgcctgtactccacctaggcacctgcacgttgtgaggccgatgtcccattacacaacgcctatggtgctgcagcaggctgctattccgatccagatcaatgtcggcacgacagtaaccatgacaggcaacggcacacgccctcctcccacaccgaacgccgaagctccaccacccggtccaggccaagccagtagtgtagcaccgtcctctaccaacgtggagtcctctgcagaaggagcccctcccccaggacctgcccctcccccagccactagccatcctcgggttatccgcatttcgcaccaatcagttgaacctgtagtcatgatgcacatgaatatacaggatagtggaacgcagcctggcggtgtgccatctgcacccacgggaccgctggggcctccagggcacgggcagactttaggacagcaggtgccagggttccccactgcgccaacaagggtggtcattgccaggccaactccccctcaggccagaccatcgcacccgggtggtcctcccgtctctggaaccctccagggggctggactaggcaccaacgcttctcttgctcagatggtaagcggtctagtcggccaactgctgatgcagcccgttttagtggcccagggaaccccaggcatggcacctccgcctgctccggcaactgcttcagccagcgctggcaccacgaacaccgccacaacagctggacctgctcccggtggtcccgctcagccccctcctactcctcagccgagcatggccgacttgcagttcagccagctcttgggcaacttgctgggcccagcaggcccaggtgccggtggaagcggtgtggcaagccctaccattaccgtggcaatgccgggtgtgcccgctttccttcaggggatgactgacttcctgcaagctacccagaccgccccacctcctccgcctccgcctccaccgcctccccctgccccagaacaacaaaccatgccaccacccggttctccatcaggcggagcaggaagcccaggtggccttggcttggaatcattgtcccctgagttctttaccagcgtagtccagggcgtgttatcctcgttgttaggcagtcttggagcaagggcaggctcctctgagtctatcgctgcttttattcagaggctgtctggatcgtccaacatctttgagccaggtgccgatggcgctctgggattcttcggggcactcttaagcttactctgtcagaacttttccatggtcgatgtggtgatgctactgcacggccattttcagccattacagcgcttgcagccacaattgcgttctttcttccaccagcattatctgggcggtcaggagcctactcccagtaatattagaatggcaacacataccctcatcactgggctagaagaatacgttagagagtctttttccctagttcaggtgcagcccggagtggacattatccgcactaatttggagttcctgcaagagcaatttaacagtattgctgcccatgtccttcactgcacagatagcggctttggcgcacgcctgctggagctctgcaatcagggtctcttcgagtgtctagccctgaacctgcattgtcttgggggtcagcagatggagctggcagccgttatcaacgggagaatacgcagaatgtccaggggcgtgaatccgagcctagtgagttggttaacaacgatgatgggactgcggctgcaggtagtgctggagcatatgcccgtgggcccagacgccatccttagatacgtgaggcgagttggtgacccgcctcaacccctgcccgaggaacccatggaagtgcagggcgcagaacgcgctagccccgaaccccaaagggagaacgcttctcctgcacctggaacaacggcagaagaggccatgtctcggggacctcccccagcccctgagggaggtagcagagacgaacaggatggggcatctgctgagaccgaaccctgggctgcagctgtgccaccggaatgggtgcctattatccagcaagatatccagtctcaaagaaaggttaaaccacaacccccattgagcgatgcttatttaagcggaatgcccgctaagaggagaaagactatgcagggagagggaccccaactactcctatcggaggctgtgagtcgagcagccaaggctgcaggcgctcgtccgctgacctctccagagtcattgtcccgggatttggaggcgcctgaagtccaggagtcttaccggcagcagctaagatctgacattcagaaacggttacaggaggacccgaactactcccctcagcggttccccaacgcccaaagggcgttcgccgatgacccatag

SEQ ID NO: 215702 - DNA, 3489 bp, Artificial Sequence
  Description of Artificial Sequence: Synthetic coding sequence
atggaacccaatgattctacgagcaccgccgtggaggagcctgactcattagaagtcctagttaagacactggactcgcaaacccgaacatttatcgttggcgctcagatgaatgtcaaagaattcaaggagcacattgccgcttcagtgagtatcccctccgagaagcagagacttatctatcagggacgagtactgcaggacgataaaaagctgcaggagtataacgtaggaggaaaagtaattcaccttgtcgagcgcgctccccctcaaacccatttaccctccggggcaagcagtggaactggctccgcaagtgctacgcatggcggtggaagtcctcccggtacaaggggacccggagcttccgtccacgacagaaacgctaacagctacgtgatggtcggcacctttaacctgccttccgatggatcagcggtagacgttcacattaacatggaacaggcccctatccagagcgagcctagagtgcggcttgttatggcgcaacacatgatccgggatatccagacgctcctaagccgcatggaatgtcggggtggccctcagcctcagcactcccagcccccaccccagcctcccgctgttactccggagccagtggctctgtcttcgcagactagcgagccagttgagtccgaagcgccacctcgagaacccatggaagcagaggaggtggaggaaagagctcctgcccagaacccggaacttacaccaggcccagcacccgcaggccctacaccagcaccggaaacgaatgctccaaaccaccccagtcctgctgaatatgttgaagtattgcaggagctgcagcggttggagtcccgcctccagccctttctacagcgttactacgaggttcttggagccgctgccactaccgactacaataataaccacgagggacgcgaagaggaccagcgcctgatcaaccttgtcggagagtctcttcgtttactgggtaatacttttgtagcactgagcgatctacggtgcaacctagcgtgcacaccaccaaggcatcttcatgtggtccgacccatgagccactacaccactcctatggtgttgcaacaggccgcaattcccattcagattaacgtgggcactacggtcacaatgaccggaaatggcacccggcctccccctacccccaatgcagaagccccaccccctggccctggccaggcttcctcagttgccccatccagcactaacgtggagagcagcgcagagggcgctcctcccccaggaccagctccacccccagcaaccagtcatcccagggtgattcggatatcccatcaaagtgtggagccagttgtgatgatgcatatgaatatccaagattccgggacccagcccggaggagttcccagtgcgcctaccggacctttgggtcctccagggcatgggcagactttgggatctacccttatacagttaccttccctccctcctgaatttatgcacgcggtcgctcatcagatcacgcatcaggccatggtggccgctgtcgcctccgcagcagccggacagcaagtgcctggatttcctaccgcccctacacgtgtggttatcgctaggcctacccccccacaggcccgacccagtcacccgggaggccctccagtcagcggtacattacagggcgctggattgggcaccaacgcgtcattggcccaaatggtcagcggtttggttggccagctgcttatgcaaccagtacttgtcgcccagggaacgccgggtatggccccacctccagcgcctgccaccgcaagtgcgtccgctggcactacaaacaccgcaaccacagctggaccggctcctggaggcccagcccaacctcccccaaccccccagcccagcatggcagatttacagtttagtcaactgctgggaaacctcctgggccctgctgggccaggagccggtggtagtggtgtagcctcccctactatcacagtggcgatgccaggagtgcccgcattcttgcagggaatgactgattttcttcaggctacacagaccgctccaccgcctcctccaccacctccaccaccgcctccagcaccagagcagcagaccatgcctcctcctgggtccccctcagggggagccggttctccgggaggactaggactcgagtccctctctcccgagtttttcacatctgttgtgcaaggcgtcttgtcttcgctgcttgggtcgctcggagctcgcgcaggtagctccgaaagcatcgcagcgtttattcagagactatcaggatcatcgaacatatttgaacctggcgctgatggggctcttggttttttcggtgcacttctgagtttgctgtgtcagaactttagtatggtcgacgttgtgatgctgctccatggtcatttccagccccttcagcgccttcagccacagctgcggtcttttttccaccagcactacttgggcggtcaagagccgacgccgagtaacatcagaatggctactcataccctgatcaccggcctcgaggaatatgtgagagagtcatttagcttagtgcaggttcagcccggagtcgacattattaggactaatttagaattcctgcaggaacaatttaactccatcgccgctcacgttttgcattgcactgatagcggatttggtgcccgtttgttggagctctgtaaccagggtctctttgagtgtctggctttaaacctgcattgtttgggtggccaacagatggagctcgcagcagttatcaacggtagaatcaggcgcatgtccagaggcgtaaacccctcgctcgtcagttggctcacaacaatgatgggcctgaggctgcaagttgtcctggagcacatgcccgtgggccctgacgccatactgagatacgtcaggagagtcggcgacccgcctcaacctctccctgaagaacctatggaggtacagggtgctgagcgggctagccctgagccacagagggagaatgcatcacctgcccctggaaccaccgcggaggaggctatgagtaggggccctccaccagccccagagggtgggagccgagatgagcaagatggagcaagcgctgaaacagagccttgggcagccgcagttccaccagagtgggtaccaattatccagcaggacattcaaagccaaaggaaggtgaaaccccagcctcccctcagtgatgcttacctttccggcatgcccgctaagaggcggaaaactatgcagggcgagggtccacaacttcttctatccgaggctgttagccgggcagctaaagccgctggagccaggcctctaacctctcctgaaagcctgagcagggacttagaggccccagaggtgcaagaatcctatcggcagcagctgaggtccgacatccagaagcgcctgcaagaggatccaaattatagccctcagcgattcccaaatgcccagagagccttcgccgacgatccctag

SEQ ID NO: 215703 - DNA, 738 bp, Artificial Sequence
  Description of Artificial Sequence: Synthetic coding sequence
cctccacggcacctacatgttgtgcgtccaatgtcgcactatactacacctatggtattgcaacaggccgcaatccctatccagattaacgttggcactaccgtgacgatgacagggcctgcgcctccaccagccaccagccatccgagagtcatcagaatatcgcatcaaagcgttgaacccgttgtgatgatgcacatgaacattcaggacagtgggacacaaccaggcggagtaccttccgcccctactgggccactggggcctccaggccatggccagactcttggccagcaggttccaggtttccctaccgctccaaccagggtcgtgatcgctcgacccacacctccccaggccagaccctcccacccaggtggccctcctgtctccgggacacttcagggcgcagggctgggaacgaacgcatcgctggctcagatggtgtccggcctagttggccagcttctgatgcaacctgtattagttgctcaggggacaccagggatggccccacctcctgccccagccaccgcttccgccagcgccggaacgacaaacacagctaccactgccggaccagcacctggtggtccagcccagcctccacctactccacagccaagtatggccgaccttcaattcagccaacttctgggcaacctgttgggtcctgccggaccgggtgcgggagggtctggggtggcatctcctaccattacggtggccatgccatag

SEQ ID NO: 215704 - DNA, 3381 bp, Artificial Sequence
  Description of Artificial Sequence: Synthetic coding sequence
atggaaccaaatgactccacgtcaacagctgtggaggagcccgacagtctggaggtacttgtaaagactctggactctcagacgaggacattcattgtaggggcacaaatgaacgtcaaagaattcaaggagcacatcgctgcttcagtaagcataccctctgagaaacagagactgatttaccagggaagagtgctacaggatgacaagaaactgcaagaatacaacgtgggaggtaaagtaatacatcttgtggagcgggctcccccacaaacgcacctgccatcgggggcatcgtcaggtacaggtagtgcctccgccactcacggcggaggttctccacctggcactcgtgggcctggcgctagcgtgcatgaccgcaacgccaacagttatgtcatggtcggcacatttaaccttccctccgacggtagtgcagttgacgtgcacataaacatggaacaggctcctatccagtcagaacccagggttcggctcgtgatggctcagcatatgattagggacatccagaccctgttgagtcggatggaatgccgaggcggtccccagccccagcattcccagcccccacctcaaccccctgctgtgaccccggagccagttgctctcagcagccagacttccgaaccagtcgagtccgaagctccgccacgtgaacctatggaggcagaggaagtggaagaaagggcccctgctcagaatcctgagctgaccccgggacctgctcccgcaggaccaacaccagcccctgaaactaatgcgcctaatcacccctcaccagcagagtacgtggaggtgctgcaggagctccagcgcttggagagcagactgcagccattcttgcaaaggtactacgaggtgctgggagcggctgccacaactgattacaacaataatcatgaaggcagggaagaggatcagcggctgattaacctggttggagagtccctgaggctcctcggaaatactttcgtagctctgtccgacctccgatgcaatctggcctgtacgccacccagacacctccatgtggtccggccaatgtctcactacaccacaccgatggtgctgcagcaagccgcaattccgatccaaatcaatgtcgggaccactgtgaccatgacaggaaacggaacccggccacccccaactcctaacgccgaagcccctccacctggacccggtcaggcaagctccgttgcacccagcagcactaacgtggaatcttccgccgagggggctccaccaccaggtccagcaccacctccagccacgtcacatcccagagttatccgaatctcccaccaatccgtggagcctgtcgtgatgatgcacatgaacatccaggacagtggtacccagcccggaggggttccttctgcccctaccggccctttgggcccacccggacacggacagacactcggccagcaagtacccggtttccccaccgcccctacccgggtggtgatcgcccgacccactccgcctcaggctaggcccagccaccccggagggcctccggtttcaggaaccctgcagggggcagggctcggcaccaacgcctcactagcccagatggtgagcggactggttgggcagctgctcatgcagcccgtgctcgtggcacaaggcacccccggtatggcccctccccctgcaccggcaacagcctcggcatcagccggaacaaccaacactgctaccacggcgggtccggctcccggtggccctgctcagcctccacccaccccacagccatcgatggcggacctgcagttttcacaactgctggggaatctgttgggacccgcaggacctggtgctggtggccctggcgtggcatctcccaccattacagtggccatgcccggagttccagcgttcttacagggaatgaccgatttcctgcaggcaacccagacggctcccccacccccaccaccgcctccgccaccacctcccgctccagagcagcagacgatgcctcctcccggatcccctagtggaggtgctgggagcccgggtgggctcggcctggaatctctttcacctgaatttttcacctccgtcgtccagggggtgctgtcaagcttgcttgggagtctcggagctcgcgcaggttcgtccgaatctatcgcagccttcatccagcgcttatctggatcttccaacatattcgagcccggagcggacggagcgctggggttttttggcgctttattatcgctcctgtgccaaaatttttccatggtggacgtcgtgatgctacttcatgggcactttcagccactacaaaggctccaacctcaactcagatcctttttccaccagcattatctggggggtcaggagccgacaccaagcaatatccgaatggccacacataccctgatcactggactggaggagtacgttagggagtctttctctctagtccaggtgcagccaggagtggatatcatacgcacaaaccttgaatttctgcaggagcaatttaatagcattgccgcacatgtcttacactgtaccgattccggtttcggggctagactgctcgagctctgtaaccaaggattgttcgagtgcctcgctcttaatctgcactgcctcggcggacagcaaatggagcttgcggcagttatcaacggtcgcattaggcggatgtctcgtggcgtgaatcccagcctcgtgagttggctcacgactatgatggggctgagactgcaggttgtgttagaacacatgccagtgggcccagatgcaatcttacgatacgtgcgtcgcgttggagatccacctcagccacttcccgaagagccaatggaagtgcagggtgcagagagagcctctccagagccccaaagagaaaatgcatcgccagcccctggtactactgcagaagaggccatgtcaaggggacctccccctgctccagaaggcggatcaagggatgagcaggacggcgctagtgcggaaaccgagccctgggcagccgcagtgccgccagagtgggtccccatcatccagcaagacattcagtcccagaggaaggtgaaaccacagccaccactctccgacgcctatctatccggcatgcccgctaagcgccgtaaaacgatgcagggcgaggggcctcagctgctgctgagtgaagctgttagccgcgcagcgaaggccgctggagcgcgtccgttaacctcccccgagagcctatccagagacttggaggctccggaggtgcaagaaagctatcgtcagcagctgagaagtgatattcagaagaggctccaggaggaccccaactactcaccgcagcgctttcccaacgcacaaagagccttcgctgacgatccatag

SEQ ID NO: 215705 - DNA, 789 bp, Artificial Sequence
  Description of Artificial Sequence: Synthetic coding sequence
atggagccaaacgattccacatccactgcagtggaggagcctgattctttggaagtcctggtgaagacgctcgattcacaaacccgtaccttcatcgtcggggctcagatgaacgtgaaggagtttaaagaacacattgccgcatccgtctctataccttcagaaaagcagcgccttatttatcaaggcagagtgctccaagatgacaaaaagctccaggagtacaatgtgggcggaaaagttatccatctggtggaacgggcaccaccacagacccacctcccctcgggggcaagtagcggcacaggcagtgcttccgcaacacatggaggcggatcgccccctggaactagaggcccaggggcttccgtgcacgatcgcaacgctaattcttacgtgatggtcggaacatttaacctgcccagtgacggttcagcagtagacgtgcatattaacatggagcaggcccctatccagagcgaacccagggtgaggttagtaatggcacagcacatgatcagggatattcagacccttctctcaagaatggaatgcagagggggtccccagccacagcattcccagcctccacctcagcctcccgcagtaaccccggaacccgtcgccttgagctcacagacatcagaacccgtggaatctgaagctccgcctagggagcctatggaggcagaagaggtggaggagagagctccagcacaaaatcccgaactgacccccggacccgcacccgcagggcctactcctgccccagaaactaacgcgccatag

SEQ ID NO: 215706 - DNA, 717 bp, Artificial Sequence
  Description of Artificial Sequence: Synthetic coding sequence
tcctctgctgagggcgcacccccaccaggccctgcaccgccacccgcaacctcccatcctagagtgatcagaatttcccatcaatccgtcgagcccgtcgtcatgatgcatatgaacatccagggcccactgagtttgtctccgtgcccggactcaggaactcaacctggtggggttccctcagctccaaccgggcctcttgggcctcccggacacggacaaactctgggacagcaggtcccgggattccctactgcaccaacacgagtagtgattgcacgccctacccccccacaagctcgcccttcccacccgggagggcctcctgtctcaggaaccctgcagggagcaggccttggcacaaacgcaagcctcgctcaaatggtgtcaggtctggtggggcagctgttgatgcagccggtgttggtcgcacaagggacacccggtatggccccacccccagccccagcaacggcaagtgcgagcgctggtactactaacactgctacaacagccggacccgcaccgggagggcctgcccagcccccacccacccctcagccaagcatggctgatctgcagttttcccagctgttgggaaatctcctcggccctgcaggcccaggggctggcggacccggagtggctagtccaacgatcacggttgcgatgcctggcgtgcccgcttttctgcaggggatgacggactttctgtag

SEQ ID NO: 215707 - DNA, 3381 bp, Artificial Sequence
  Description of Artificial Sequence: Synthetic coding sequence
atggagcccaacgattccactagtaccgccgtggaagagccagactcactagaggtcctggttaaaactcttgattctcagacaagaaccttcatcgtcggtgcccagatgaacgtcaaagagtttaaggagcacatcgcggcttcagtctccatcccttcggagaagcagagattgatttatcagggacgggtgctgcaagacgacaaaaagcttcaggagtataacgtcggcggaaaagttattcacctagtggagcgcgcaccacctcagacacacctcccttcgggcgcatcttctgggaccgggagcgcatcggcaacacatgggggaggcagccctccagggacacgtgggccaggcgcaagcgtgcatgacagaaacgccaatagttatgttatggtgggaactttcaatctgccctctgatggctccgctgtcgatgtgcacattaacatggaacaggcacccattcagtctgaaccgcgagtgcgactggtgatggcccaacacatgatccgcgatatccagaccttgctcagtcggatggaatgtcgtggcggaccacaacctcagcattctcagccacccccacaaccaccagctgtgacaccagaacccgtcgctctgtcatcgcagacatccgagcccgttgaaagcgaagcccctccacgagagccaatggaagccgaagaagtcgaggaacgggcaccagcacagaaccctgagctcaccccaggccctgccccagccggtcccacacctgcccctgagactaatgctcctaaccatccgtcccccgctgagtatgtggaagtcctgcaggaactgcagcgcctcgaatccaggcttcagccctttctgcaaaggtactacgaagtgttaggtgccgctgcgacaactgactataataacaatcatgaaggcagagaggaggatcagcggctaatcaacctggtaggcgagtccctgagactcctcgggaatacttttgtggcgctgtcagacctgagatgtaatctagcttgcactccccctcggcatctgcacgtggttcgcccaatgtcacactacacaactcctatggtcctgcagcaagccgctattccaatccagataaacgtgggcactaccgtcactatgaccggcaatgggacaagacctccccctacaccaaatgcagaggctccacccccaggtcccggtcaagcgtcaagtgtagctccctctagtaccaatgtggagagttctgctgaaggcgcacctcctcctggccctgcccctccgccagccacttcacaccccagggtaataaggatatctcatcagtcggtggagcctgtggtgatgatgcacatgaacatccaggattccggaacacaacccggaggggtccctagcgctcctacagggccactggggccacctggtcatggtcagaccttgggccagcaggtgcctggctttccgacagcacccactcgggtggtgatcgcccgtcccacacctccacaagctcgccctagccatccaggtggccctccagtcagtgggacgcttcaaggagccggtcttggaaccaacgcctctctggcccaaatggtcagtggcctggttggtcagttgcttatgcagcctgtcctcgttgcccaggggacccccggaatggccccacccccagcacccgcaactgcctccgccagcgccggaaccacaaatacggctacaactgcagggcctgctccgggaggcccagctcagccaccacccactccacaaccatcgatggcggatctccagttctcgcagctgctgggcaacctactggggccagcaggtcccggagctggaggcccaggagtggcaagcccaaccatcacagtggccatgcctggagttcccgcattcctgcagggcatgacagattttctgcaggccacacaaacggcgcctccacccccaccgccacctcctccacccccacctgccccagagcagcagactatgccaccacctggaagcccgtcaggaggtgccggatcacctggagggctgggcctcgagagtctgagccctgaatttttcacttccgtggtacagggcgtactctcaagcctgttagggtccctcggggcaagagctggctcaagtgagtccattgcggcattcatccaaagactgagcgggagcagcaacattttcgaacccggtgcagacggggctcttggattcttcggggcactgctatctctgctctgccaaaatttctcgatggttgacgtggtgatgctgctacatggccactttcaacccctgcagcgtttacaaccacagcttcgatcattcttccatcagcattacctagggggacaggaaccgacaccgtccaacatcagaatggcgacacacacactgatcacaggtttagaagagtatgtacgagagtccttctccctcgtgcaggtccagcccggagtagacattataagaactaacctggagtttctccaagaacagttcaactcgattgccgctcatgtactgcactgcaccgacagtggtttcggtgccagactcttagaactctgcaaccagggcttgtttgagtgtctcgcactgaacctgcattgcctgggtggtcagcagatggaactggcagcggtcattaatggtcggattcgcaggatgtccagaggagtgaacccgtccctggtgagctggctgacaacaatgatgggcctgagactgcaggtggtcctggagcacatgcccgtggggccagacgctattctgcgctacgtgcgacgggttggtgatcccccacagcctctcccagaggagcccatggaggtacaaggcgctgaaagagcgtcccccgagccccaaagagaaaacgcatcccccgcacctgggaccacagccgaagaagccatgtcccgaggccctccacccgctcccgagggtgggagcagggatgagcaagacggcgcaagcgcggagactgagccctgggccgctgccgttccaccagagtgggtgcctatcattcagcaggacattcaatctcagcggaaggtgaagccacagcccccactgagtgatgcctatctgtcaggaatgcccgctaaaaggagaaagactatgcagggagagggaccacagctcctattatccgaggctgtctccagagccgcaaaggccgctggggcaagacctctgacgagccccgaaagcctcagtagagacctcgaggctcctgaggtgcaggaatcttaccgccagcagttgcggtcagatatccagaagaggctccaggaggacccgaattactcaccccagaggtttcccaacgcccaaagagcttttgccgacgacccatag

SEQ ID NO: 215708 - DNA, 648 bp, Artificial Sequence
  Description of Artificial Sequence: Synthetic coding sequence
atggagcccaatgactccacatctactgccgtagaggagcctgactcgctggaagtgctggtgaaaacattggattctcagacccgcacattcatcgtgggcgctcagatgaacgttaaggagtttaaggaacacattgccgcttctgtgtccataccatcagagaaacaaaggttgatctatcagggaagagtcttgcaggacgataagaagctgcaggagtacaatgtcggcggaaaggtgatccaccttgtagaacgagcgcctcctcagacgcacttgccatccggtgcctcctccggcacgggctccgcatctgccacacatggcggaggaagtccacccggtaccaggggacctggggctagcgtgcatgatcgcaatgcaaacagttatgtcatggtcggtaccttcaaccttccatctgaacctcgggtgagactggtgatggcgcagcacatgattcgcgatattcaaaccctgttgtcacgtatggaatgccgcggaggtccccagccacaacactcccagcctccacctcagccgcctgcagtgacaccggaacccgttgcattatcatcacagacctccgaacccgtggaaagcgaggcacctccacgtgaacctatggaggcagaggaggtctag

SEQ ID NO: 215709 - DNA, 789 bp, Artificial Sequence
  Description of Artificial Sequence: Synthetic coding sequence
atggaaccaaatgacagtacctccactgctgtcgaagaacctgattccctggaggtgttggtgaagacattagacagtcaaaccagaacgttcatcgttggagcacagatgaacgtaaaggaattcaaggaacacattgccgcatccgtttccattccatccgaaaaacagcggcttatctaccagggcagggtcctgcaagacgacaagaagctgcaggagtacaatgtcggcggtaaggttatccaccttgtggagcgagctcccccacagactcacctccccagtggtgccagttccggcaccggctccgcgagcgcaactcatggagggggaagtccgccagggacacgtgggcctggtgcaagcgtgcatgaccgaaatgccaatagttacgttatggtcggcactttcaacctcccatccgatggctccgccgtggatgttcatatcaacatggaacaggccccaattcagagcgaaccgagggtgcgactggttatggcacagcacatgatcagagacattcagacgctcttaagccggatggagtgtcgcggaggcccacagccacagcattcccaaccccctccccagccgcctgcagtgacccctgagcccgtggccttgtcaagtcagacctctgagcccgtcgaatccgaggctcctccgagagagcccatggaagctgaagaggtcgaggaaagagcacccgctcagaatccagaactgaccccaggtccggctcccgcaggtcctacacccgcacctgaaacgaacgctccttag

SEQ ID NO: 215710 - DNA, 2232 bp, Artificial Sequence
  Description of Artificial Sequence: Synthetic coding sequence
atggagcctaatgactcgacatccaccgcggtggaagagcccgacagcctagaggtgctagtgaaaactcttgactcccagactaggaccttcatagtgggagcacagatgaacgtgaaggaattcaaagagcacatcgccgcaagtgtctctattccaagtgaaaagcagcgtcttatctatcagggaagagttctccaggatgacaagaaattgcaagagtataatgtgggcggaaaagtgatacacctggtagagagggccccaccccagactcatctccctagcggtgcttcaagcggaactggctccgcatctgccacccatggtggagggtcgccacctggaaccagaggcccaggggcttccgtccacgatagaaatgccaattcttatgtgatggtcggaactttcaatctgccaagtgacggatccgccgtggatgtgcatattaatatggaacaggctcctatccagtccgaacccagggtccggcttgtgatggctcagcatatgattagagatatccagacactcctctctagaatggaatgcaggggaggccctcagccacaacacagccagcccccaccccagccacctgctgttactcccgaacctgtcgcactcagtagtcaaacgtctgagcccgtggagagcgaggcccctcccagagagcccatggaggccgaagaggtggaagagagggcccctgctcagaatcccgagctgaccccaggccctgcgccagcgggtccgaccccagctccagaaacaaacgccccaaaccatccgtccccagcagagtatgtcgaagtcctccaggaattgcagcgcctcgaaagtcgcctgcagccattcctgcaaagatactatgaggtgctaggcgctgcggctacaactgattacaacaacaatcacgagggtagagaggaggatcagcggcttatcaatttggtgggggaatctctgagattgcttggaaatacattcgtcgcccttagtgacctcaggtgcaatttggcctgcacacctccgcgtcacttacacgtggttcgccctatgtcacattataccacaccaatggtgttgcagcaagccgctatccctattcagattaatgttggcaccacggttactatgacaggcaacgggacacggcctcccccaactcctaatgccgaggctcccccaccaggccctgggcaggcctcgtcagtggcgccaagttccacaaacgttgaatcttccgcagaaggggctcctccccctggtccggctcctccacctgccacgagtcacccccgagttattcgaatctcacatcagtctgttgagcccgtggtaatgatgcacatgaacatacaggactctggcacgcagcctgggggagtgccctctgcacctaccggtcctttgggtccacctgggcatggtcaaactctaggatccactctgattcagctgccctcccttccgcctgagttcatgcacgccgtcgcccaccaaattacccaccaggcaatggttgcggctgtggccagcgcagctgccggacagcaagtgcctggattcccaacggcccctactagggtggtcatcgcccgtccaacaccgccacaagctcgcccaagtcaccccggaggacctccggtttcaggcaccctccagggagctggcctcgggacaaatgcaagtttggctcagatggtctccggacttgtagggcagctgcttatgcagcccgtcctcgttgcccaggggacccccggaatggctccaccccctgcgccagcgacagcgagtgcctcagctgggaccactaatacggctacaaccgccggtccagcacccggaggcccagcacagcccccacctacaccgcagccaagcatggcggacctgcagttttcacagctgcttggaaacctgctgggccctgcagggcctggcgctggcggtcccggagttgcaagtccaaccattactgtagccatgcctggagttccagccttcttgcagggtatgactgatttcctgcaggcaacccagactgccccaccgccaccccctccccctccacctcctcctcctgctccggaacagcagaccatgccccctcctggatcccctagcggtggtgccggtagtccaggtggcttgggattggaaagccttagtcccgagtttttcacttctgtggtgcagggagtactctcttccctgctctag

SEQ ID NO: 215711 - DNA, 3381 bp, Artificial Sequence
  Description of Artificial Sequence: Synthetic coding sequence
atggaaccgaatgacagtacctcaacggctgtcgaagagccggacagcctggaggtgctcgtcaaaaccctggacagccagactcgcactttcattgtgggcgcacagatgaacgtcaaagaatttaaagaacacatagctgcctccgtgtcgatccctagcgaaaagcagcggttgatctatcagggcagggtactccaggatgacaaaaaattacaggagtacaacgtggggggaaaagtgattcacttggtggaacgggctccaccgcagacccatctcccttccggggctagtagtggaactggctcagcctccgccactcacggtggaggatctcctcccggaacccgaggccctggcgcaagcgtgcatgatagaaacgccaatagctatgttatggtgggaacttttaaccttccatcggacgggagcgcagtggatgtccatataaatatggagcaagcccctattcaatcggaacctagagtacggttagtgatggcacaacatatgatccgggacatccagaccctgctcagccgcatggagtgtagagggggtcctcagccacagcactcccagccaccacctcagccccctgcggtcaccccggaacccgttgcactctcatctcagacctcggagccagttgaatccgaagctccccctcgcgaacccatggaagccgaggaggtcgaagagcgcgctccggctcagaacccagagctcaccccaggaccagcgcctgcaggcccaactccggcacccgaaactaatgccccaaaccacccctcccccgcagaatacgtcgaagtgctacaggagctacagcgcctggaatcacggttacagccattcctccaaaggtattacgaggtgctcggagcagccgcaaccacggactacaacaacaatcacgagggcagagaggaggatcagcggttgattaatctggtaggggagtcactgaggctgttgggcaacacatttgtagccctctccgatttacgctgcaacctggcatgcactccacctaggcacctgcatgtggtgcgtcctatgagccactacacaacgccaatggtcttgcagcaggcagcgatcccaatccagataaatgttggcaccaccgtgaccatgacaggtaacggcaccagaccaccccctacacccaacgccgaggcgccaccgccaggcccaggccaggcatcctctgtggctccgagtagtactaatgtggaaagctctgccgaaggcgctccccctcccggaccggcaccgccacctgctacaagtcatcctagggtcatcaggatttctcatcaatccgttgagcccgtggtgatgatgcatatgaatatccaggactccggaacacagccaggcggagtgccctctgccccaacaggtcccctcggtcctccagggcacggccagaccctgggacaacaggtaccagggttcccaaccgcccctacgagggtcgtaatcgcaagaccaactccacctcaggcccgaccaagccaccctgggggtccacctgtgagtggaacactgcagggcgcaggcctaggcacgaacgccagtctggctcagatggtgagtggcctggtgggacagctgctcatgcagcccgttctcgtggcccagggcactcccggaatggctccacctcctgcccctgccactgccagcgccagcgctggtacaacaaatacagcgacaactgcaggccctgccccaggcggacccgctcaacctcccccaactccccagccatctatggccgacttacagttctctcaactcctgggaaacctactgggacccgcaggcccaggcgctggaggcccaggtgtcgcatctcccaccataacagtcgcgatgccgggagtccccgcattcctgcagggaatgaccgatttcttgcaggccacccagaccgctccccctcctccccctccaccacctcctccccctcccgcaccagaacagcagaccatgccccctccgggtagcccctcaggcggtgccggatcccctggcggtctgggccttgagagcctgagtcctgagtttttcacttcagtggtccaaggagtgctgtcctcattgctgggatctttgggggctcgagctggatctagcgaaagtatcgcagcctttattcagcggctcagcggcagcagcaatatttttgaacccggagccgatggggctctgggattcttcggcgcactgctctcccttctttgtcagaatttttcaatggtggatgtggttatgcttttgcatggacactttcagcctctgcaaagacttcaaccacaactgagaagtttttttcatcaacactatctggggggtcaggagcccacaccctcaaacatccgtatggccactcacaccctgatcacagggttggaggaatacgtgcgcgaatctttttcgttggtgcaagtccaacctggagttgatatcatccggactaatttggaatttctccaggagcagtttaattctatcgccgctcatgtgctgcattgcaccgactccggcttcggcgcaagactgctggagctctgtaaccaaggccttttcgaatgccttgcccttaacctccattgtctgggcggacagcagatggaacttgccgctgtgattaatggacggatcaggaggatgtctagaggcgtcaatccctcacttgtgtcatggctgacaacaatgatgggactccgtctccaagttgtcctggaacatatgccggtcggccctgacgcaattctgaggtatgtgcgcagggtgggcgaccctccacagcctctgcccgaggagcccatggaggtccaaggggctgagcgagcatcacccgagccacagagagagaacgcctctcctgctcccggaacaacggctgaggaggccatgtctaggggcccaccgccagcgccagagggcggttctagagatgagcaggatggggcttctgccgagaccgagccgtgggctgccgcagtccctccagagtgggtgccaataatacaacaagatatacagagtcagaggaaggtgaagccacagccacccctctctgatgcctacctgagcggaatgcctgcaaagaggcgcaagacgatgcagggggaagggccacagctcctactgagcgaggccgtatcaagagccgcaaaggctgcgggtgcaaggcctctgacttcccccgagtccctctctagagacctggaggcgcctgaagtgcaggagtcatatagacagcagctgaggtctgatattcaaaagcgcctacaggaggacccaaactattctccgcaaagattcccaaacgctcagcgggcttttgctgacgatccatag

SEQ ID NO: 215712 - DNA, 3381 bp, Artificial Sequence
  Description of Artificial Sequence: Synthetic coding sequence
atggaaccaaacgactccacatctacggccgttgaggagcctgacagcctggaggtgctggtaaaaactctggacagccagacccggaccttcatagtcggcgcacaaatgaacgttaaagagtttaaggaacatattgctgcatctgttagtattccttctgagaagcagcgtttgatctaccaggggagagtcctccaggacgataaaaaattgcaggagtacaatgtggggggaaaagtcatacacctcgtggagagagcacctccacagacacatctgccttcgggtgcttcatccggtacaggcagtgcatctgcgacccatgggggagggagcccacctggtactcgcggtcccggtgcctctgttcacgaccgaaatgctaacagctatgtcatggtgggtactttcaatcttcccagcgacggaagtgctgtcgacgttcacatcaatatggaacaggcacctatccagagtgaaccaagggtgcggctggtgatggctcaacatatgattcgagatattcagacactgttatctaggatggagtgtcggggtggcccacagccccagcactctcagccccctcctcagcctccggctgtgacacccgagcccgtggccctgtcctcccagaccagcgagcctgtcgaaagtgaagcccctcctagagagcctatggaggcggaggaggttgaggaacgggcaccagctcagaaccccgagctcactccagggccagctcctgctgggccaactcctgcaccggaaacgaatgctccgaatcaccccagtcccgcagagtacgtcgaggtgctgcaagagctccagagacttgaaagtaggctgcagccattcctgcagagatactacgaagtgctaggtgcagctgctacaactgactacaacaacaatcatgaggggagagaagaggatcaaaggttgatcaacctggttggggagtccctgagactgctggggaatacatttgtcgcgctctctgatctgagatgtaatttagcctgcacacctcctaggcacttgcatgtagttcgccctatgtcacattacacaactcccatggtcctccagcaggccgcaattcctatccaaatcaacgttgggactacggtgacgatgactggcaacggcacacgcccacccccaacccccaatgccgaggccccaccccctggacccggtcaggcatctagcgtagcaccatcatcgacaaacgtggagtcttctgcggagggtgccccacctcctggcccagcccctcctccggctaccagtcatcctcgggttattagaatcagccatcagagcgtggagcccgtggtcatgatgcatatgaacatacaggatagtggcactcagccagggggagtccccagtgctccgacaggtcctctgggacctcccggacatggacagactttggggcagcaagtgcccggattcccaaccgccccaacacgggtcgttattgcccgacccacacctccgcaggcgagaccttctcaccccggaggccctccagtttctgggactctccagggtgcaggcctaggcacaaacgcaagcctggcccagatggtctccggtctcgttggccagttacttatgcagccggttctggttgctcagggcacccctggaatggcccctccgccagctccagcgaccgccagtgcgtcggctgggacgaccaataccgctaccactgctgggcctgcaccaggtggtcccgctcagccaccccctaccccgcaaccctccatggccgacctgcagttcagccaacttctcggaaatctgttgggtccagcgggaccaggggctggaggacccggagtcgcgtcccctactatcaccgtcgccatgccaggcgtgcccgcatttttgcaagggatgaccgattttttgcaggctacacagaccgcgcctcccccaccccctcccccaccaccacctccacctgcaccggaacagcagactatgccccctccaggttccccatccggaggggctggtagtccaggcggactcggattggaatcattgagcccagagttttttacatcagtcgttcagggagtgctgtccagtctgctgggtagtctcggcgctcgcgcaggctcgagcgagtcgatcgccgcattcatccaacggctgtctgggagctccaatatcttcgagcctggagcagacggtgcacttggatttttcggcgctctgttatccctgttgtgtcagaacttcagcatggtggacgtggttatgctgctccacggtcactttcaacctttacaacggttgcagccacagctcagatcctttttccaccaacactacctgggaggtcaagaacctaccccttctaacattagaatggctacacacaccctgattaccggattagaggaatacgtgagggaatcattctcactcgtgcaggtgcagcccggagtcgatattatccggacaaatctcgaattcctgcaggagcagttcaactccattgctgcccacgtgctgcactgcaccgatagcggctttggtgctagattgttagaactttgcaatcagggtctgtttgaatgcctcgccctgaatctgcactgcttgggcggtcagcagatggaacttgcagccgttattaacggcaggattaggagaatgagccggggtgtgaatccatcactagtgtcctggctgaccactatgatggggctgcgactccaagtcgtgttagagcacatgccagtgggccctgacgccatcctgagatacgtgcggagagtgggagatccgcctcagcctttacccgaagagccaatggaagtgcagggggctgagcgcgcatctcccgagcctcagcgcgagaatgcgtcccccgcacccggaactactgctgaggaagccatgagtcgtgggcctccacccgctcccgagggtggaagccgtgacgagcaggatggagcatccgcggaaacagagccatgggctgctgcggtacccccagaatgggtgcctataatccaacaggacattcagtcccaacgaaaggtcaaaccacagccccctctgtcagacgcgtatctttctgggatgccagccaagagacgtaagacaatgcagggggaagggccacaattgctattgagtgaagcagtctctcgggcagcgaaagctgccggtgcccgtccattgacatccccagaatccctgagccgcgacctcgaagcacctgaggtgcaagagtcctaccgccagcagctgcgcagtgacatccagaaaagactccaagaggatccaaactatagccctcagaggttcccgaacgcccaacgagcgtttgcagatgatccctag

SEQ ID NO: 215713 - DNA, 411 bp, Artificial Sequence
  Description of Artificial Sequence: Synthetic coding sequence
tgacggatgtccagaggggtcaatcccagtctcgtaagctggcttactactatgatgggcctacggttacaggtagtgctcgaacacatgcctgtgggccctgacgctattttgagatatgtccgcagggtgggagatcccccacagcctttgcccgaggagcccatggaagtgcaaggcgctgaacgtgcctctcccgagccccaggagtgggtgccaatcatccagcaggatattcagagtcagcggaaagtcaagccacaaccaccactgtctgatgcctatctaagcggtatgcccgcaaagcgcaggaagcttaggagtgatattcagaaaaggctgcaggaggaccctaactactcaccccaaagattcccaaatgctcagagagctttcgctgatgacccctag

SEQ ID NO: 215714 - DNA, 789 bp, Artificial Sequence
  Description of Artificial Sequence: Synthetic coding sequence
atggagcccaatgattctacgagtacagccgtggaagaacctgactcgctggaagtccttgttaaaaccctcgatagccagacgagaactttcatcgtgggggcacagatgaacgtgaaggaattcaaagagcacatcgccgcatctgtgagcatacccagcgagaagcagaggctgatctatcagggcagagttcttcaagacgataagaagttacaggaatataacgtgggcggtaaggtgatacatcttgtggaacgagcacccccacagacccatttgccctcgggcgcttccagcggtaccggcagtgcttccgctacccacggcggaggaagcccacctggtacacggggtccgggagcttctgtgcacgatcggaatgctaactcttatgtgatggtaggcacattcaacctgccctccgacggatctgctgttgacgttcacatcaacatggagcaggctcctatacagagtgagcctcgggtacgcctcgtcatggctcagcatatgattagagatatacagaccttactttctagaatggagtgcagaggagggcctcaacctcaacatagtcagccccctccccaacctcccgctgtgactcctgagcccgtagccctgtctagccagacatcagaacctgtggagtctgaggcgccacccagagaaccaatggaggcagaggaagtggaggaacgggcaccagcgcaaaatcctgagttaacacccggaccagcccctgctgggcctacccctgcgcctgagaccaacgccccatag

SEQ ID NO: 215715 - DNA, 735 bp, Artificial Sequence
  Description of Artificial Sequence: Synthetic coding sequence
atggaacctaatgattcaaccagcacagctgtggaggaacccgactctttagaggttctggttaagaccttggactcacagactcgcacttttatagtcggagcccagatgaacgtgaaagaattcaaagagcatatagccgcatcggtgagcatcccgagtgagaagcagagattgatctatcagggaagagtgttgcaagacgataagaagctgcaggaatacaacgttggaggaaaggtgattcatctagtggagagggctcccccacagacccatctgccctctggagcttcttccggaaccgggagcgcctcagcaacacatgggggagggtctcctccagggacacgaggtccaggtgcttctgtacacgaccggaacgctaacagctacgttatggtgggaacttttaatctgccatccgagcccagagtgcgcttggtcatggcgcagcatatgattcgcgatatacagactttgctgtcccggatggagtgtagaggaggccctcagcctcagcatagccaacctcctccccagcctcccgctgtgacccccgagccagtggctctctctagtcagaccagcgagcccgttgaatctgaggcaccccctcgagaacccatggaggccgaggaagtcgaagagagggctcccgcacagaaccccgagctcacacctggcccagcgcctgccggtccgacccctgctccagaaactaatgcaccatag

SEQ ID NO: 215716 - DNA, 594 bp, Artificial Sequence
  Description of Artificial Sequence: Synthetic coding sequence
atggaacctaatgattctacgtctacagccgtggaggagcctgatagtttagaggtgttagtgaaaaccctggactctcagacccggacgtttattgtgggcgcacagatgaatgtgaaggaattcaaggaacatatagcagctagcgtcagtattccgtctgaaaaacagcggctgatttaccaggggcgagtcctgcaagacgacaagaaactgcaggaatataatgtgggaggcaaagttatccatctggtggagcgagccccaccacaaactcacttgcctagcggagctagcagtgggacgggaagtgccagtgccacccatggagggggatcaccacccggaacacgcggaccaggcgcatccgtccacgaccgcaacgctaactcatacgtcatggttggcacatttaacctgccttccgacggctccgccgttgacgttcacattaatatggaacaggccccaatacagagcgaaccaagggtgcgccttgtgatggctcagcatatgatccgggatattcagacactactgagtcggatggaatgtcgcggtggccctcagccccaacattcacagcctccctag

SEQ ID NO: 215717 - DNA, 621 bp, Artificial Sequence
  Description of Artificial Sequence: Synthetic coding sequence
atggagcccaatgatagtacaagtaccgctgtcgaggaaccagacagtctggaagttcttgttaaaacattagactcacagacccgcacctttattgtaggagcccagatgaacgttaaagagttcaaggaacacattgctgctagcgtgtccatcccatcagagaaacagcggctgatatatcagggccgagtgctgcaggatgataagaagctgcaagagtacaatgttggtggcaaggtcattcatcttgtagagagagcccctccccagacacacctgccgagcggggctagcagtggtacgggatctgcctctgccacgcatggtggaggctctcccccaggcactcgagggccaggtgctagcgttcacgaccgtaatgcgaacagctacgtgatggtggggacgttcaatctgccgtcggagccaagagtaagactagtgatggcgcagcacatgatccgggacatccaaactctgctgagcaggatggaatgcagagggggtccacagccacagcactcacagcccccaccccaaccccctgccgtcacacctgagcccgtcgctctcagtagtcagaccagcgagccagtggaaagcgaggcccctccctag

SEQ ID NO: 215718 - DNA, 735 bp, Artificial Sequence
  Description of Artificial Sequence: Synthetic coding sequence
atggagcctaatgatagcaccagtaccgctgtcgaagaacctgattcactggaggtcctggtcaaaacgctagacagccagacaaggacttttattgtcggggctcagatgaacgtcaaagagttcaaagaacatatcgccgcttctgtgagcatcccctcagagaaacagaggcttatctaccagggacgcgtgctgcaggatgacaaaaaacttcaggagtacaacgtcggtggcaaggtgatccatctggtcgaaagggcgccaccgcagacccaccttccctcaggagcttcctctggtactggaagcgcctcagccactcatgggggaggctctccccctggaacacgcggtcccggagcatctgtccacgataggaatgccaattcgtatgtgatggtgggtaccttcaatcttccaagtgagcctagagttcgcctggtcatggctcagcacatgatccgcgatatccagactctcctgtctcgcatggagtgtcggggaggtccccagccacagcatagccaaccccctccccagccaccagccgtaactcccgagcctgtcgctctctcaagtcaaacttctgagcctgtcgaatctgaggccccaccccgagagccaatggaggccgaagaggtggaagagcgcgctccagcacagaatcctgagctcacacccggtcccgcaccagcagggccaacacctgctcccgaaacaaatgcaccttag

SEQ ID NO: 215719 - DNA, 3381 bp, Artificial Sequence
  Description of Artificial Sequence: Synthetic coding sequence
atggaaccaaacgattccacctcaaccgctgtagaagagcctgattcattagaggtgctcgtaaagacactagattcgcaaacacgcacatttatcgtcggagcgcagatgaacgtgaaagagttcaaagaacatattgcagccagcgtgagtattcccagtgagaagcagcgcctaatttatcaggggagagttctgcaggatgacaagaaattgcaagagtacaacgtgggaggaaaggtgatacatctcgtagagagggcgcctcctcagacccacttgccgagcggtgcttcctccggaaccggatcagcctccgccacccacgggggaggcagtccccctggcactcggggacctggtgcctcagttcatgaccgaaatgcaaacagctacgtgatggtgggaactttcaacctgccaagcgatggctccgctgtcgacgtgcatataaatatggagcaggctcccattcaatctgagccaagggttcgcctggtgatggcgcagcatatgatcagggacattcagactcttctaagcagaatggagtgcaggggcggtccccagccacaacattcacaaccgcctcctcagccacccgcagtgacccctgagcctgtcgcgctgagcagccagacctcagagcccgtcgagtcggaagctcccccaagagaacccatggaagctgaggaggtggaggagcgcgctcccgcacagaatcccgaactgacaccgggacctgcccctgcaggcccaactccagcacctgaaaccaatgcgcctaaccacccctcacccgctgagtacgttgaggttctgcaggagctgcaacgattggaaagcaggctccagcccttcctgcagaggtattacgaggtccttggcgctgctgctactactgactataacaataaccatgagggtagggaagaagatcaaagactcataaatctcgtaggggaaagcttacgcctgttaggcaacacctttgtggcgctaagcgacctgcgatgcaacttagcctgtacgcctcctcgacatctacatgttgtgcggcctatgtcacattacactactcccatggtgctgcagcaggccgcaatccccattcagattaatgtcgggaccacagtcacaatgactggcaatggaacgaggccccctcccacaccaaacgccgaagctcctcctccaggccctggacaggcctcgtccgtggcaccatctagcactaacgtcgagtctagcgcggagggagcccctccccctgggcctgccccacctccagcaacgtcacatccacgtgtaattcggatctcgcaccagtccgtagaacctgtggtgatgatgcatatgaatatccaggactcagggactcagccagggggagtcccatccgccccaactggccctctcggccctcctggtcacggtcagactttggggcagcaagttccaggctttccgaccgcacctacacgagtggtcatcgccaggcctacacctcctcaagcccgacccagccaccctggagggcctcctgtttcagggacgctgcagggcgcagggctgggtaccaatgcttccctggctcagatggtatcaggcctcgtcgggcaattgctgatgcaacctgtgctcgtggcgcagggaacaccagggatggcacccccacctgcaccagccacggcttccgcatctgccggtactactaatactgcgaccaccgctggtccagcccctggcggacctgctcagcccccacccacccctcagccaagcatggcagatcttcagttctcccagctcctcgggaatctcttaggtcccgctggcccaggagctggaggatccggtgttgctagccccactataaccgtggccatgccaggagtgcctgccttcctgcagggtatgacagatttcctccaggcgactcaaacggcccctccgccaccacctccaccgccaccccctccccctgcccctgagcagcagaccatgccccctcccggaagcccgtccggaggtgcaggatctccagggggtttggggctggagtccctgagccccgaattcttcacctccgtcgtgcagggagtcttgagttctctgctcggctcacttggggctagggcgggtagcagcgagtcaatcgcggcttttatccagcgactttccggatcaagtaatatcttcgagcccggagcagacggcgctctcggcttttttggagcactgttatctcttctgtgccagaatttctccatggtggacgtggtcatgctgctccacggccacttccagcccttgcagagactccagccccagctacgttctttttttcatcagcattacctgggagggcaagagccgaccccctctaacatcaggatggctacccataccctaattacaggacttgaagagtatgtgagggaaagtttttctctcgtccaggtgcagcccggtgtggatatcattagaaccaacctcgagtttctgcaggaacagtttaacagcatcgcagcgcacgtgttacactgtactgacagcgggttcggcgctcgactcttggagctgtgcaaccagggcctgtttgaatgtctggcgctgaacctgcattgcctgggaggccagcaaatggaactggctgcagtcatcaatgggcgtatccgtcggatgtccagaggggtgaatccttcacttgtgagctggcttaccacaatgatggggctgcggcttcaggtggtcctggagcacatgccagtgggccctgatgcgatcctgcggtatgttcgcagggtgggggacccccctcagccactgcctgaggagcctatggaggtgcagggcgctgaacgggcttctccggaaccccaacgggaaaatgctagccctgcccctggtaccaccgctgaggaggccatgtctagaggcccacccccagctccagagggcggaagcagagacgagcaggatggtgctagcgctgaaaccgaaccatgggcagcagcagtccctccagagtgggtgcctatcatccaacaggacatccagagtcagcgaaaagttaagccccaaccccctttgtcagatgcctatctgtccggaatgccagccaagcggcgaaaaaccatgcagggggagggcccacagctgctactgtcagaagccgtgagtcgtgcggctaaagcagctggagctcggccacttacctctccagaatcactgagcagagacctagaagcaccagaagtgcaggagagttacagacagcagcttcggagcgatatccaaaagcgccttcaggaggaccccaactattctccccagcgattccctaatgcccagcgagccttcgcagatgacccctag

SEQ ID NO: 215720 - DNA, 735 bp, Artificial Sequence
  Description of Artificial Sequence: Synthetic coding sequence
atggagcccaacgattctacatcaacagctgtggaagagcctgactccttggaagtgctcgtcaaaacactggactctcagacacgcacatttattgtgggtgcgcagatgaacgtgaaggagtttaaagagcacatcgccgcttcggtgtccatccctagcgagaagcaacgcctcatctatcagggtcgcgttctccaagacgataagaagctgcaagagtacaatgtgggaggaaaggtgattcaccttgtggagcgggctccaccccagactcatctgccctctggcgctagcagcgggacgggtagcgctagtgccacccatggagggggaagcccccctggcacaagaggccctggggcaagcgtgcacgaccgaaacgctaactcatatgttatggtgggaacttttaacctgcccagcgaacctagagtgaggctggtgatggcacagcacatgatcagggatatccaaacactgctctcacgtatggaatgccgagggggaccgcaaccacagcattctcagccaccccctcagccccctgccgtgacccccgagcccgtggctctgtcttcccagacctctgaaccggtcgagtccgaggcccctcccagagagcccatggaggccgaagaggtggaagaacgtgctccagcgcagaatcccgagctgacccccggacccgctcctgccggacccacccccgcaccagaaacgaacgccccatag

SEQ ID NO: 215721 - DNA, 717 bp, Artificial Sequence
  Description of Artificial Sequence: Synthetic coding sequence
agcagcgccgaaggggcacctcctccagggccagctccgccacccgcaacatctcatccgagggtcattcggatatcacatcagtcagtggagcccgtggtgatgatgcacatgaatattcagggtccattgtcactttctccttgcccagatagcgggacccagcccggaggagttccatccgctccgactgggccactcggccctcccggacatggccagacattggggcaacaggtcccaggttttccaacagcccctactcgtgtggttatcgctcgccctactccaccacaggccaggccaagtcatccaggtggaccaccagtatccggaactctgcagggcgctgggctggggaccaacgcttccctcgcacaaatggtgtctgggcttgtcggacaactgcttatgcagcccgtgctggtggcacagggcacccccggaatggcccctcctccagctcccgctacagctagtgcctctgccggaacaaccaataccgccaccacagccggacccgcacccggagggccagcgcagccccctccaaccccccaacctagtatggccgacctgcagttttcacagcttcttggcaacctgctaggacccgctgggccaggcgctgggggttcaggagtggcctcaccaacaatcaccgtggctatgccaggtgtgcccgcttttttgcagggaatgacggacttcctttag

SEQ ID NO: 215722 - DNA, 735 bp, Artificial Sequence
  Description of Artificial Sequence: Synthetic coding sequence
atggagccgaacgattcaacttcaactgccgtggaagagcctgactcactggaggtgctcgttaaaacactggactcccagactagaaccttcatagtgggagcccagatgaatgtcaaggagtttaaagaacacattgctgcgtctgtgtctatccctagtgaaaaacagcggttaatataccaggggcgagtgctgcaggacgataagaagctgcaggagtataatgttgggggaaaggtgattcatctggtcgagagagcccctccccagacacatttacctagcggggctagctctggcactgggtccgccagcgcaactcatgggggtgggagcccacccggtacccgcggacctggcgcttctgtgcacgatagaaatgcaaactcctatgtaatggtcgggactttcaatctgccatcggaaccaagagtgaggttagtgatggctcagcatatgattcgcgatattcagaccctgctctcacggatggagtgcagagggggaccccagccccagcacagccagcctcctccccagcctccagctgttacgcctgagcccgtggccttaagtagtcaaaccagcgagccagtggagagtgaggcccctccacgggagccaatggaagcagaagaggttgaagaaagagctccagcacagaatcccgaacttaccccaggtcccgcacctgcgggtccaacccctgctccagagactaacgccccatag

SEQ ID NO: 215723 - DNA, 2232 bp, Artificial Sequence
  Description of Artificial Sequence: Synthetic coding sequence
atggaaccgaatgactccacttctaccgccgtggaggaacccgacagtctggaggtgctggtgaagaccctggactctcagacccgtaccttcattgtgggggcacaaatgaatgtgaaggaatttaaggaacacattgctgcgtctgttagcatcccctccgaaaaacaacggcttatatatcagggcagggtcctgcaagacgacaaaaagctgcaggagtacaatgtggggggtaaagtgattcatttggtggagcgggcaccaccacagacacacctcccatctggagccagctctggcactggttccgcgagtgctacccatgggggagggagcccccctggaacccgaggtccgggagcctccgtgcatgacaggaatgctaattcctacgtaatggtgggaacctttaacctgccttccgacggatccgccgtagacgtccacattaacatggagcaagctccgatacaaagcgaacctcgcgtgcggctggtcatggcccagcacatgattagagatattcagaccctgctgagccggatggagtgtagagggggtccccaaccgcaacacagccaaccaccaccacagccaccggctgtgacgcccgagcccgtggcgcttagctctcaaaccagcgagcctgtggaaagtgaggcccctcctcgggagcctatggaggctgaagaagtcgaagaacgggctcccgctcagaatcctgaattaacaccaggacccgctcctgctggccctactcctgccccagagacaaatgctcctaatcacccaagccccgctgaatatgttgaggtgttacaggaattgcagcgcttagagagcaggctacaaccgtttctgcagaggtattatgaagtgctgggtgctgccgctacgacggactataacaataatcacgaggggagagaagaagatcaaaggttgattaatctcgttggagagtccctcaggctgctggggaacacctttgtagccttgtcagacttgcgctgtaacctggcctgcacacccccacgccacttgcatgtggttaggccaatgagccactatacaaccccaatggtccttcagcaggccgctatccctatacaaattaacgtcggaacaacagtaaccatgacaggcaacgggacgagaccaccccctacacccaacgcagaagcccctcctccaggccctggccaagcaagtagcgtggccccttcctctaccaacgtggaatcctctgctgagggcgcacctcctccaggacctgcccctcctcctgcaactagccacccaagagtgattcggatcagccatcagtctgtcgagccagtcgtgatgatgcacatgaatattcaggacagtggaactcagcccggaggagtgcccagcgcccctacaggtccattgggacccccaggtcatggacagaccttaggcagtactctaatccagctcccttcattgccccctgagtttatgcacgcagttgcacatcagatcactcaccaagccatggtcgctgcagtggcctcagccgcagccggacaacaggttcccggtttcccaacagcccctactcgcgtggtgatcgcacgccctacaccacctcaggctcgtccttcacatccaggaggcccacctgtgagcggcactttgcagggagcaggactgggcacaaatgcaagcctggcacagatggtgtcgggcctggtcggtcaactgctgatgcagccagtgcttgtcgctcagggcactccaggaatggctccacccccagcacctgcaacagcatcagcatccgcaggaaccacaaatacagccacaaccgccggaccggcacccggtggacctgctcagccaccacctaccccccaaccctctatggcagatctgcaattttctcaacttctgggcaacctgttggggccagccggacctggagcgggaggtagcggggtcgcgtcccccactatcacggtagcaatgccaggggttccagctttcctgcagggtatgacagattttctgcaggcgacgcaaacagcccctcctcctccacctccccctcctcccccacctccagcgccagagcagcaaacaatgccccctcctgggtcacccagcgggggagccggatccccgggaggtctgggactagagagcctctcgccggagttttttacgtctgtagtgcagggggtgttgagctcgctcctctag

SEQ ID NO: 215724 - DNA, 477 bp, Artificial Sequence
  Description of Artificial Sequence: Synthetic coding sequence
atggaacctaacgactcgacatcaactgcggtagaggagcccgattcgctggaagtgctggttaaaacactagatagccagacacggaccttcatcgtgggtgcacaaatgaatgtgaaggaatttaaagaacacattgccgcttcggtatccattccctcggagaagcaacgcctaatctaccaaggcagagttctccaagacgacaagaaactgcaggagtataatgtaggagggaaggtaattcatctggtggagagggccccaccccagacacatctcccatctggcgcatctagcggtacaggttctgcttctgctactcatggcggaggctcccctccgggaacacggggaccaggcgcaagcgtgcacgatcgcaatgccaatagttacgtcatggtgggtacatttaacctgccttcagacggttctgccgttgacgtgcacatcaacatggaacaggctcccatttag

SEQ ID NO: 215725 - DNA, 681 bp, Artificial Sequence
  Description of Artificial Sequence: Synthetic coding sequence
tagagcggcttcggcgcacggctgcttgagctgtgtaatcaaggactgtttgagtgtctggctctcaatctgcactgcttaggagggcagcagatggagctagctgcagtgatcaatggcaggattcgcaggatgtctaggggggtgaacccctcactggtgtcatggttgacaacaatgatgggactgcgccttcaggtggtgctggaacatatgccagtgggccctgatgctattctccgctacgttcggagggtcggagatcccccacaacctctgcccgaggaaccgatggaggtgcagggtgcagagcgagcgtccccagagccgcagagagaaaatgcctcgcccgctcctggaaccacggcagaagaggccatgtctcgtggacctcctcctgctccggaaggcggaagccgagacgagcaggacggagctagcgccgaaacagagccctgggcagcggcagtgccacccgagtgggttccgatcatacagcaagatatccagagccaacggaaggtgaagccccaacccccactctccgatgcttacctatctggtatgcctgccaagcggcgtaagttacgtagcgacatacagaagaggctccaagaggaccctaactattcaccccagcgctttcccaacgcacaacgggctttcgccgacgacccatag

SEQ ID NO: 215726 - DNA, 717 bp, Artificial Sequence
  Description of Artificial Sequence: Synthetic coding sequence
tcctccgcggagggcgcaccccctccaggacccgcacccccaccagcaacatctcatcctcgggtaatcaggatctcccaccagtcagttgagcccgttgtgatgatgcatatgaatatacaggggccattaagccttagcccctgccccgactcaggcactcagcccggtggagtgccatctgccccaacgggcccactggggccaccaggtcacggccaaacattgggccaacaggtcccgggttttccaacagctcctaccagagtggtgatcgctcgccctaccccaccacaggccaggcccagccatcctggtggcccacccgtgtcagggactctgcagggagcaggcctggggacaaacgccagccttgcccaaatggtctcagggctcgtgggccagctgctgatgcagcctgtccttgtggctcaaggcacgcctggtatggctccccctcctgctcctgcgacagccagcgcaagcgctgggaccaccaacaccgcaactactgctggcccagcaccaggaggaccggcacagccacccccaaccccgcagccctctatggccgacctgcaattctctcagctcttaggcaacttgctgggccctgccggacccggagcaggcggtccaggagtggcatcccccacaataactgtagccatgcctggtgtgccagcttttttgcagggcatgacagatttcctgtag

SEQ ID NO: 215727 - DNA, 3381 bp, Artificial Sequence
  Description of Artificial Sequence: Synthetic coding sequence
atggaacccaatgatagcacgagcactgccgtggaggagcccgatagcctggaggtactggtcaaaacattggacagccagactcggaccttcattgttggggctcaaatgaatgtaaaagagtttaaagaacatatcgctgcctctgtctctattccatctgaaaagcagcgacttatttaccaggggagggtactgcaggatgacaaaaagctgcaggagtataacgtgggaggaaaagtcatccacctggttgaacgtgcaccccctcagacccacctgccttccggagcctctagtggaacgggcagcgcctctgcgacacacggtggcggatctccccctggtaccagaggccctggtgcctctgtccatgataggaacgcaaattcatatgtgatggtcggaacatttaacctccccagcgacggaagtgccgtcgatgtgcacataaacatggaacaagcgccaattcagtccgagcctcgagtgaggctggtgatggcccagcacatgattagagacatacaaactctgctttcccgtatggaatgtagaggcggtccccagccacagcactcccagccgcctccccaacccccagctgtgacccccgagccggtggcactgtctagtcaaacttcagagccagttgaatcggaagcaccccctagggaacctatggaagccgaggaagtcgaagagcgcgctccagcccagaaccccgagctgactccgggaccggctcccgctggcccaactcctgcgcctgaaacaaacgccccaaatcatccatctcccgctgaatacgtggaagtattgcaagaactgcagcgtttggaatcaaggctgcagccttttctgcagaggtactatgaggtcctcggggcagcagctactacagactataataacaaccatgaaggcagagaggaagatcagcgactgatcaatctggtaggcgagtctcttagattattagggaacacctttgtggccctgtcagacttgcggtgtaacctggcatgtacgcccccaaggcacctgcacgtagttagacctatgtcccactataccactcccatggtgcttcaacaagcagccatccccattcagattaacgttggtaccactgtgaccatgacgggcaatggaacccggcctcctccaaccccaaatgcggaagctcctccccctgggccaggccaggcttcgtccgtcgcaccaagctccaccaacgtggagtccagcgcagaaggcgcacctcctcctggcccagccccacctccagcaaccagccacccgagggtcatcagaatctcccaccagtcagtagagcctgtggtcatgatgcatatgaatatacaagatagcggtacccaacccggaggtgttccctccgctccaaccggccctttgggacctcctggtcacggccagaccctgggccagcaggtgcctgggttcccaacagcccctacccgtgtggtgatagctcggccaacccctccccaagctaggcccagtcaccctggcggaccgcctgtcagcgggacattgcagggagccggactaggtactaatgccagcttggcccagatggtctcaggcttggtgggacagctgctcatgcagcccgtactggttgctcagggcacccccggtatggcccctccgccagcccctgcaaccgctagcgcatctgctgggaccacgaatacagccaccaccgctgggcctgcacccggaggtcccgctcagcccccacccacaccacagccgtcaatggctgacctccagtttagccagttgcttggaaatttgctcggcccagccggtccaggcgcaggaggctccggagtcgcttctcccactattacagttgcaatgcctggggttcccgcattcctgcagggcatgactgatttcctccaggcaactcagaccgccccaccccctcctccaccaccaccacctcctcctcccgctccagaacagcagaccatgcccccaccaggatccccatcaggaggggctgggtcccctggaggactcggtctcgagagcctctcccccgaattctttactagcgttgttcaaggcgttctgtcctctctcctgggcagccttggcgctagggctgggagtagcgagagcatagcagccttcatccagcgtctgtctggcagttctaacatctttgagcctggagccgatggggcactgggtttcttcggagccctgttgagcctgctctgtcagaacttctccatggtggatgtggtcatgctcttgcacggccacttccagcctcttcagcggttgcaaccacagctgcgttctttcttccaccaacactatttgggcggtcaggaacctaccccatcaaacattaggatggcgacacatacactgataacagggctggaggaatacgtgcgcgagagtttctctctggtgcaggtgcagcccggagttgatatcatcaggactaacctggagttcctgcaagaacagttcaattctatcgctgcacacgtcctgcattgtaccgactccggcttcggagctcgcctcttggagctatgtaatcagggcctgttcgaatgcctggcccttaatttgcactgtctgggtggtcagcagatggagctggctgccgtcatcaacgggcgaatccggaggatgtcaagaggcgtcaatccctcactcgtgagctggctcacaaccatgatgggactcagactccaggtcgtcttagaacatatgccagttggcccagatgccattcttagatacgtaagacgtgtcggtgaccctcctcagccactacctgaagagcctatggaagttcaaggagctgaaagggcgtctccggaacctcaaagagagaatgcctctccggcacccggtactaccgcagaggaagccatgtctcgcggtccaccccctgcacccgagggaggctccagagacgaacaagacggggcttctgcagagaccgagccatgggcggcagctgtgccacccgaatgggtgccaataatccagcaggacattcagagccaaaggaaggtgaagcctcagcctcctctgtcagacgcctacctgtctggaatgcctgcaaagagaagaaaaacaatgcagggcgagggccctcagctcctactttctgaagccgttagccgtgccgcaaaggcagctggtgcaagacccctgacttctcctgaaagcctttcccgcgacctcgaagcaccagaggttcaggaatcatatcgtcagcagctacgatcagatattcaaaagcgcttgcaagaggatccgaactactcaccccaacggtttcccaacgcacagagggcatttgcagatgatccctag

SEQ ID NO: 215728 - DNA, 789 bp, Artificial Sequence
  Description of Artificial Sequence: Synthetic coding sequence
atggagcccaatgattccaccagcactgcggtcgaggagcctgattcactcgaggtcctggttaagacactcgattcccagactaggaccttcatcgtcggggcacagatgaatgtcaaggagtttaaggaacacatagccgctagtgtgagcataccttctgagaaacagcgcctgatctatcaaggaagagttctccaggacgataaaaaactgcaggagtacaacgtcggcggaaaggtcatccatctggtggagagagccccaccacagacacaccttccttcgggcgcttccagcggaactggcagtgcatcagctactcatggcggtggcagtcctccaggcactaggggaccaggtgctagcgtgcacgatagaaatgccaacagttacgtgatggttggcacgttcaatcttccttcagacggctccgcagttgatgtccacatcaatatggagcaagcaccgatccaatctgagcccagggtgcgtctagttatggcccagcatatgataagagatattcaaacactcctgagtcgcatggaatgtagaggcggaccccagcctcagcactcccagccccctccacaaccacccgctgtgaccccagagccagtcgcgctgtcttcccagaccagcgagcctgtggaatctgaagcgcctcccagagagccaatggaggccgaagaggtggaggagcgtgcaccagctcagaatcccgaattgactccgggacccgctccagccggaccgacaccggcacctgagaccaacgcaccatag

SEQ ID NO: 215729 - DNA, 477 bp, Artificial Sequence
  Description of Artificial Sequence: Synthetic coding sequence
atggagccgaatgatagtacctcaactgccgtggaagagcccgatagtctcgaggtcttagttaagacactcgatagccagactagaacctttattgtgggcgctcaaatgaatgtaaaggagtttaaagaacacatagccgcttccgtgtcaatcccaagtgagaaacagaggttgatctaccaggggcgtgtgctgcaggacgacaagaaactgcaggaatacaacgtgggtggaaaggtgatccatctcgtggaacgcgctccaccccagacccacctgccctcaggcgctagcagcgggacaggatcagcttccgccactcatgggggaggtagccccccaggcacaagagggcctggtgcgtccgtgcacgaccgtaacgccaacagctacgtgatggttgggacttttaatctgccctccgatgggtcagcggtcgacgtgcatattaacatggagcaggcaccaatttag

SEQ ID NO: 215730 - DNA, 777 bp, Artificial Sequence
  Description of Artificial Sequence: Synthetic coding sequence
atggaacccaatgactccactagcacagcagtggaggaacctgattcgctggaggtgctagtgaagacattggactcccagaccagaacctttattgttggcgctcagatgaatgttaaggaattcaaggagcacatcgccgcatcagtgtccatcccctccgagaaacagaggcttatttatcagggacgggtgttacaggacgacaaaaagcttcaggaatataacgtcgggggaaaagtgattcatctagtggaacgcgctcctccacaaactcacctgcccagtggggcatcttcagggaccggttctgcgtcagcgacgcacggcggtggatccccacccggtacaaggggacccggagcatcagtgcatgacagaaacgcgaacagctatgttatggtcggcaccttcaatctgccatctgacggatccgctgtggatgtgcacattaatatggagcaggctccgattcaaagtgagccccgtgtaagactcgtaatggcccagcacatgattagggatatccagaccctgctcagccgaatggaatgtcgaggcggaccccaaccacagcacagtcaacccccaccccaaccaccagccgtcacaccagagcctgtcgctctgtcctctcagacttcagaacccgttgagagcgaggcgcctcccagggagccaatggaggctgaagaagtggaagagcgcgctccggcacagaatccagaactcacccccggtcccgcaccggcaggtcccacccccgcaccggaatag

SEQ ID NO: 215731 - DNA, 735 bp, Artificial Sequence
  Description of Artificial Sequence: Synthetic coding sequence
atggagccaaacgattcaacttccacagcagttgaggagccggactcactcgaggtactggtgaagacacttgatagtcagactcggacttttattgtcggagcgcaaatgaacgtgaaagagttcaaggagcacatcgccgctagcgtgtcaatcccctccgaaaagcagcgactgatctatcagggtagagttctccaagacgacaaaaaactgcaggagtataatgtcggcggaaaggtcatccacctggtggagcgtgctcctcctcagacacacctaccttccggcgcttcatccggcacgggttccgcctccgcaacacacggcggtgggagccccccaggtactcgtgggccaggcgcatctgtccacgatagaaatgcaaactcttacgtgatggtgggcacctttaacctgccgtcagagccacgcgtgaggctggtgatggcacagcacatgattcgcgatatccagactttgttgtccagaatggagtgtagaggagggccacagccccagcatagccagccgccaccacagccgcctgctgtgaccccagagcctgtggcattaagctcacagacatctgaacctgtggaaagcgaggcacctccaagggagcctatggaagctgaagaggtggaagaacgggctccagcccaaaaccccgaattgacacctggccctgcgccagctggcccaacccctgcgcctgaaactaatgccccatag

SEQ ID NO: 215732 - DNA, 1548 bp, Artificial Sequence
  Description of Artificial Sequence: Synthetic coding sequence
atggaacctaacgattcgacatctacagcagtggaggagcccgattctctggaggtgcttgtcaaaactttggactcccagacccgtacatttatcgtcggagctcaaatgaatgtcaaagaatttaaggaacatatcgctgcatccgttagtatcccctccgagaaacaacgcttgatttaccaggggcgtgtgctccaggatgacaagaaactacaggaatacaacgtgggcggaaaagtgattcacctggtggaacgcgcacccccacagacacatctgccatcgggagcctcctcagggactggatccgcctcagccacccacggaggcggatcaccaccaggaactcgaggacccggagcttctgtccacgaccgaaatgcgaattcttacgtgatggtgggcactttcaatcttccgtctgacgggagcgctgtggatgtccatattaatatggagcaggcacccatccagtcagagccgagggtccgtcttgtgatggctcagcacatgattagagatattcaaaccttactttccaggatggagtgtcgagggggtccacagccccaacatagccagcctccccctcagccacccgcagtcactccagagcctgtggcgcttagcagtcagacaagcgaaccggtggaaagcgaagccccaccacgcgaacccatggaggccgaagaagtggaagaaagggcaccagcccagaacccagagctgacccctggaccggctccagccggtcccacccctgcgccagaaactaatgcccctaatcatccgagtcccgctgaatatgtagaagtgttgcaggagctgcagaggctcgaaagcagactacagccatttctgcaacggtattacgaggtgctgggcgcagcggctaccactgactacaataataaccacgaaggaagggaagaagatcagaggctgatcaatctcgtcggtgaaagcctccgactactgggaaacaccttcgttgcactgtccgatctcaggtgcaatctggcctgcactcctcctagacatctccacgtcgttcgccctatgtctcactacacaaccccgatggttctgcagcaagccgcaattcccattcagatcaacgtgggaacaaccgtgactatgacaggcaacgggacgcgcccaccccctacacccaacgctgaggcccctcccccaggcccaggccaggcctccagcgttgctccaagctcaactaatgtggagtccagtgcagaaggggctcctccgcctggcccagctccaccccctgccacttctcaccctcgagtgatcagaatatcacatcagtcggtggagcctgtagtcatgatgcacatgaacatacaggactccggcacacaaccaggaggggtgccatctgctcctactgggccattagggccacccggtcacggccagactctcggatctactctgatccagttgccatctctgcctcccgagttcatgcacgctgtggcgcatcaaataacacaccaggcaatggttgctgccgtcgcttcttag

SEQ ID NO: 215733 - DNA, 702 bp, Artificial Sequence
  Description of Artificial Sequence: Synthetic coding sequence
atggaacccaacgatagtacaagcaccgccgtggaagaacctgactctctcgaggtgctggttaaaaccctggatagccagacacgtaccttcatcgtgggcgctcagatgaatgtcaaagagttcaaggaacatatcgcagcctccgtgagtatcccaagcgagaagcagaggctcatttatcaggggagagtgctccaggatgacaagaaattacaagagtataatgtcggaggaaaagtgattcatctggtggagagagcccctccacagacacaccttccatccggagccagtagcggcacaggttctgcttcggcaacacacggcggaggttcacctcccggaacacggggtcccggtgcatccgtccatgacaggaatgccaactcgtatgtgatggtaggtacattcaacctcccgagtgacggatcagctgttgatgtccacattaacatggaacaggcaccgatccagtcagagccccgagttagactggtgatggctcagcacatgattagggatatccagactcttctgagtcgaatggagacactaccctatctgcaatgtcgaggtggccctcagccccaacattcccagccaccaccccagcctcccgcagttactccagagcctgttgcactatccagccagacttccgagcccgtcgagagtgaggccccacccagggaaccgtag

SEQ ID NO: 215734 - DNA, 3381 bp, Artificial Sequence
  Description of Artificial Sequence: Synthetic coding sequence
atggagcccaacgattcgacctctactgccgtcgaagagcctgactcactggaggtgctggtgaagactctggattctcagacgcgcaccttcatcgtgggcgctcagatgaatgtgaaggagtttaaagaacatatcgccgcatctgtatctattccgagcgagaagcagcgcctaatctatcaaggccgagtgctgcaggacgacaagaaactccaggaatataatgttggaggcaaagttatacacctggttgagcgagcgccacctcagacccatctgccgtctggagccagctctggcaccggaagtgctagtgccacacacggcggagggtcccctccaggcaccaggggaccaggtgcctctgtccacgatcgcaatgcaaacagttatgtgatggtgggcacattcaacctcccttccgatggtagcgccgtggatgtgcacataaatatggagcaggcccctatccagagtgagcccagagtgcgcttagttatggctcagcacatgatacgcgatattcaaaccctactgtcacggatggagtgccgaggtggaccgcagccacaacactcacagccacctcctcagccccctgctgtcacccccgagcctgtggctcttagtagccagacaagcgaaccagtcgaatcagaggctccacctcgcgaacccatggaagccgaggaggtcgaagaacgtgctccagcacagaatccggaacttacacccggtcccgcacccgcaggcccaaccccagcaccagaaacaaacgccccaaatcacccaagtcctgcagagtatgtggaggtgctgcaggagctgcagagactggagtctagattacaacccttcctgcagcgatactatgaggtcctgggggctgcagcgaccacagactataataataatcatgagggcagagaggaggaccagagactgatcaacctagtgggagaatcactacggctccttggcaacaccttcgtggcgctgtccgacttgaggtgtaacctcgcctgtaccccaccgcgtcatctgcacgtcgtcaggcctatgtctcactacacgactccaatggtgttgcagcaggccgctattccaatccagatcaatgttggaactacagttacgatgactggcaacggtacccgccctccccctacccccaatgctgaggccccaccaccgggtcctggccaagcatcatcagtggccccatcctcaactaacgtcgaatctagtgcagagggagcgcctcccccaggaccggctcctccccctgcaacatctcaccctcgagtcatcagaatctcacatcagtctgtggagcccgtcgttatgatgcacatgaatattcaggattcaggcactcaaccaggtggggtgcccagtgcccctactggacccctcggcccacctggacatgggcagaccctggggcagcaggtgcctgggttccctacagctccgactcgcgtggtgattgcgagacctaccccccctcaagctagaccctctcacccgggtggccctccggtatcaggaactctccagggcgcaggcctggggacaaatgcctctctcgcccagatggtttctgggctggttggccagctactgatgcagcccgtcctggtcgctcagggaacacccggaatggccccacctcccgcaccagcaaccgcttccgctagtgcagggaccacaaacaccgccaccacagcagggcctgcccctggtggccctgcgcaaccaccacctactccacagccgtccatggcggacctccagttctctcagcttcttggcaatcttttgggccctgccggacctggggcaggcggacctggagttgcgtcccccacaattacggttgccatgcctggagttccagcgtttttgcagggcatgaccgatttcttgcaggctacccagaccgccccaccccctcctcctcctccaccccctcctcctcctgccccagagcagcagaccatgcctcctcctgggagtccatccggaggggcaggcagtcctggtggtctcggcctcgaatcactcagccctgagtttttcacgtccgttgtccaaggggttctttcatcattgctgggctcactaggcgcacgagcaggatcaagtgaaagtatcgcggctttcattcagcgactgtcggggagctccaacatcttcgaacccggtgccgatggtgccttgggcttctttggggctctcctgagcttactgtgccagaacttttcaatggtggacgtagtcatgctgctacacgggcatttccagccgttgcagaggttacagccacaactgcgaagtttctttcatcagcattacctgggcggtcaagaacccaccccttcaaacatcaggatggccacgcatacccttatcactgggctggaagaatacgtcagagaaagcttttccctagttcaggtacagcctggggtggacatcatccgaacaaatcttgagtttctgcaggaacagttcaactcaattgcggctcatgtgctgcactgcacggattccgggttcggggcacggttgttggagctgtgcaaccagggcctattcgaatgtttagctttgaatctccactgtctgggtggacaacagatggaacttgcagctgtgatcaatggcagaatcaggagaatgagtagaggggtgaatccatcccttgtgtcttggctgactactatgatgggcttgcgcctacaggtcgtcctggagcacatgcccgtagggccagatgccatcctgcggtatgtacgtcgggtgggggatccacctcagccgttgccagaagagcctatggaagtccagggagccgagagggctagtcccgagccccagagagagaacgcaagccctgccccaggaactacagccgaggaggcaatgagccgtggcccaccacctgcaccagaaggcggaagccgcgacgagcaggatggagcttctgccgagacggagccgtgggcagccgctgttccaccagagtgggtgcccataatccagcaggatatacagagccaacgtaaggttaaaccacagcccccattgtcagacgcctatctgagcggaatgccagcaaagaggcggaagaccatgcagggagagggcccacagttactgctgagtgaagcagtgagcagggctgctaaagctgccggagcaagacccttgacctccccagaaagcttatccagagacctcgaagcccctgaggttcaggagagttaccggcaacaactcaggagcgatatccagaagcgcctgcaggaggaccccaactattcaccacagcggtttccaaatgctcagcgggctttcgctgatgacccttag

SEQ ID NO: 215735 - DNA, 789 bp, Artificial Sequence
  Description of Artificial Sequence: Synthetic coding sequence
atggaaccaaatgattccaccagtacagccgtggaagagcccgactccctggaggtgttggtgaagaccctggattcccaaacacgcaccttcatcgtaggcgctcagatgaacgtgaaagaattcaaggaacacatcgccgcttcagtgtccattccctctgagaaacaacggttaatttaccagggcagggttcttcaggacgacaaaaaactccaggaatacaacgtgggtggaaaagttatccacctcgtggagagggcgcctccacagacgcatttacccagcggcgcatcttctggaactggatcggctagcgcgacccatgggggaggcagcccacctggcactagagggccaggcgcttctgtgcatgaccgcaacgccaacagttacgtgatggtgggtactttcaacttgccctctgacggatccgcggttgacgtacacatcaacatggaacaggcccctattcagagtgagccacgagttcggctggtgatggctcagcatatgatcagggacatccagacattgttgagtcgaatggagtgtcgcggaggccctcagccccaacactcacaacctcctccccagccacctgccgtcactcctgagcccgttgctcttagctcacaaacatctgagcctgtggaaagtgaggcacctccaagagagccaatggaggcagaagaagtagaggagcgtgcccctgcgcagaaccccgaattaactcctggaccagcacccgcagggccaactcctgcccctgagactaacgctccgtag

SEQ ID NO: 215736 - DNA, 411 bp, Artificial Sequence
  Description of Artificial Sequence: Synthetic coding sequence
tgacgcatgtctcgcggtgtgaacccctctttggtcagttggctgacgaccatgatggggttgcggctgcaggttgtgctggagcatatgccagttggccctgacgccatcctgcggtatgttcgcagagttggcgacccccctcagccattgccagaggaaccaatggaggttcagggcgcagaaagggcatcaccagaaccccaggaatgggtacccattattcagcaggatatccagagtcaacgtaaggtaaagcctcagccgccactgagcgacgcttatctgagcggaatgcctgccaaacgcagaaaattacggagtgacattcagaagcggttgcaggaagacccaaattattcccctcagagattccctaacgcccaaagggctttcgctgatgacccatag

SEQ ID NO: 215737 - DNA, 558 bp, Artificial Sequence
  Description of Artificial Sequence: Synthetic coding sequence
tgacttgcttgcaccccccctcgccacctccacgtggtgcggccaatgagtcactatactacgcctatggtactgcaacaggctgctatcccgattcagatcaacgtcggcaccacggttaccatgacgggaaatggtacacggccaccccctactcctaacgccgaggctccccctcctggtcccggacaagcttcttcggtggcccctagtagcaccaacgtggaaagctctgccgaaggggctcccccacctggacctgcgcctcctcctgcaacatcacacccacgggtcattcggataagtcatcagtccgtggaacccgttgtcatgatgcacatgaacatccagggtcaacaggtccctggattccccactgccccaaccagggtcgtaatcgcacgaccaactcctccgcaggccaggccaagtcaccccggaggcccaccagtgagcggtaccttacagggagccggactcggcacaaacgcaagtttagcccagatggtgagcggcctggtcggccagcttctcatgcagccagtcctggtggcctag

SEQ ID NO: 215738 - DNA, 681 bp, Artificial Sequence
  Description of Artificial Sequence: Synthetic coding sequence
taatctggctttggagcgaggctcctagaactgtgtaatcaagggctcttcgagtgcttggccctgaacttacattgcctcggcggtcaacaaatggagttggccgctgtgatcaatggacgaattagacgtatgagccgtggcgtcaacccatccctcgtgagttggctcacgactatgatgggattacgacttcaggtggtgttagagcacatgccagtgggacctgatgcgatactccgttatgtacggagagtcggcgaccccccacagcccctgccggaggaaccaatggaagtgcagggcgcagagcgcgcttcacctgagccacagagggaaaatgcatcccccgcacccggaaccaccgccgaagaagcaatgagccggggtccgcctcccgctccagagggcggaagccgggacgagcaggatggggcttctgccgagactgagccttgggccgctgccgtccccccagaatgggttcccataatccagcaggatatccaatcccaaagaaaggtaaaaccacagcctcctttgtcggacgcgtatctgtctggcatgcccgcaaaacgacggaagctgaggtcagacatccagaagaggttgcaggaggatcccaactacagcccacagagattccctaatgcacaacgcgcattcgcagatgacccttag

SEQ ID NO: 215739 - DNA, 594 bp, Artificial Sequence
  Description of Artificial Sequence: Synthetic coding sequence
atggagcctaacgatagcacaagcactgccgtcgaggaacctgacagcttggaagtgctggttaagaccctggacagccagacgcggaccttcattgtaggtgcacagatgaatgtcaaggaatttaaagagcacatagccgcttctgtcagcatcccttcagaaaagcaacggctgatctaccagggacgggtgttgcaggatgataagaaactgcaggagtataatgtgggaggaaaggtgattcacctggtcgaaagagcccctcctcagactcaccttccatcaggagcatcaagtggaacagggagtgcctccgctactcatgggggaggttccccccctggcacccgaggcccaggcgcttctgtgcatgacagaaacgcaaattcgtacgttatggtgggaacgttcaacctcccaagcgacggctccgccgtcgacgttcacatcaacatggaacaggcccctatccagtcggaacctcgggttagactagtgatggcccaacatatgatccgagacatccaaaccctcttgtcccgaatggaatgcaggggtggcccacagccccagcactcacagcctccatag

SEQ ID NO: 215740 - DNA, 648 bp, Artificial Sequence
  Description of Artificial Sequence: Synthetic coding sequence
atggagcctaacgactccacttcaacggctgttgaggagcctgattcccttgaagtcctggtgaagaccttggacagccagaccagaacatttattgttggcgctcagatgaacgtgaaagaatttaaagagcacattgctgcttcggtgagcatcccctcagaaaagcagcggttgatttaccaggggcgtgtattacaggacgataagaaactacaggagtataatgtcggtggcaaggtgattcacctggttgagagagcacctccacagacgcacctaccttcaggcgcaagtagtggcaccggctcggcctctgctacacatggcggtggctctccccctggcacaagggggcctggcgctagcgtgcacgaccggaatgcgaattcctacgtgatggtcggcactttcaatctgccttctgagccacgggtgcgtctggtaatggcccagcatatgatcagggatattcagactctgctaagccggatggagtgtcgtggcggaccccaaccacagcacagccagccaccacctcagcctcctgccgtgacccccgagccagtggcattgtccagccagacgtctgaacccgtagaaagtgaggcaccacctcgcgaacccatggaggccgaggaagtgtag

SEQ ID NO: 215741 - DNA, 702 bp, Artificial Sequence
  Description of Artificial Sequence: Synthetic coding sequence
atggaacctaatgattcgacaagtaccgccgtagaggagccagacagcctcgaggtgctggtgaagactttggacagccagacaagaacgtttatagtcggggcacaaatgaacgtcaaagagttcaaggagcatatagccgcaagcgtttctatcccctccgagaagcaaagattgatctatcagggtcgggtcctgcaggacgacaaaaaactgcaagaatataacgttgggggaaaagtgatccatttggttgagcgcgctccaccacagacccacctgccgtctggggcatcttccgggacaggctccgcaagcgccacacacgggggtggaagtccccctggaacccggggacctggagcttcagtgcacgaccgcaacgcgaactcctatgtcatggttggcacatttaatctaccttcagacggctcagcggttgatgtccatataaatatggaacaagcacccatccagagcgagcctcgagtcagactcgtcatggcacagcacatgatcagagacatccagaccttactgtccaggatggagacactcccttacttgcagtgtaggggcggtcctcagcctcaacattcccagccccctccacagcctcccgctgtgaccccagagcctgtggccctaagctcccagaccagcgaacctgtcgaatcagaggctcctcctcgcgaaccatag

SEQ ID NO: 215742 - DNA, 777 bp, Artificial Sequence
  Description of Artificial Sequence: Synthetic coding sequence
atggagcccaatgactctacctcaaccgccgtggaagagccggattccctggaagttctcgtaaagacattggattcacagacacgcacatttattgtaggcgcacaaatgaatgtgaaggagtttaaggagcatatcgctgctagcgttagtatcccatcagagaagcagcgtctaatctaccaaggcagagtcctccaggacgacaagaaactacaggagtacaacgtgggtggcaaagtgattcacctagtggagcgagcaccaccccagacgcacttaccttctggcgctagttccggaaccggcagcgctagtgcaacccatggaggtgggagccctcctggaaccaggggcccaggagcttccgttcacgacagaaacgccaactcctacgtgatggttggaaccttcaatctcccctcagatgggtctgccgtagacgtgcatattaatatggagcaggccccaattcagtcagaaccccgagtgcgactggtgatggcccagcacatgattagagatattcagacactcctgtcgagaatggaatgccgcggaggtccccaaccacagcattcccaaccccctccccagcctccagccgtgacccccgaacccgttgctctgtcctcacagacctccgagcctgtcgagagtgaggcaccaccaagggagccaatggaagcagaagaagtggaagagagagccccagcacagaaccccgagctgacgccaggtccagcccctgccggacccacgcctgcacccgagtag

SEQ ID NO: 215743 - DNA, 411 bp, Artificial Sequence
  Description of Artificial Sequence: Synthetic coding sequence
tgacggatgtccagaggcgtcaaccccagcctcgttagctggctcaccaccatgatgggtctgcgacttcaggttgttctcgagcacatgcctgtggggcctgacgcaatcctgcgctatgtgcggagagtcggagatccacctcagcctctccccgaggagcccatggaagttcagggggcagagcgggcatcaccagaaccacaggagtgggtgccgatcattcaacaagacatccaaagccagaggaaagtaaagccccagccccctctttctgatgcctatctgtcagggatgcctgctaaaagaagaaagctccggtcagatatccaaaagcggctgcaagaggaccccaactattctccacagcgattccccaacgcacagcgcgcttttgctgacgatccctag

SEQ ID NO: 215744 - DNA, 780 bp, Artificial Sequence
  Description of Artificial Sequence: Synthetic coding sequence
atggagcccaacgactcgacatctacagctgtggaagaacccgattccttagaggtgcttgtgaagacgttggactctcagacacgcacctttatcgtcggtgcacagatgaatgttaaagagtttaaagaacacattgccgctagcgtgtcaatcccatctgaaaaacagaggctgatctaccaggggagagtgcttcaggacgataagaagctgcaggagtataatgttggtggaaaggtgatccatctcgtggaaagagcgccacctcagacgcatttgcctagcggggcatcctcgggcaccggtagtgcctctgctactcacggagggggttcccctccaggcacaagagggccaggcgcttctgtgcatgacagaaatgcgaacagctatgtaatggtcggcacctttaatctcccctcagatggaagtgccgtggacgttcacattaacatggagcaggctcctattcaaagcgagccgagggtgagacttgtaatggctcagcacatgatccgggatattcagaccctcctcagtcggatggagtgccggggaggccctcaacctcagcacagtcagcccccaccccaacctcctgcagttactcctgaacccgtggcactctcgtctcagacgtctgaaccggtggaatctgaggcgcctcctagagaacccatggaagcggaagaagtggaggagagggccccagcccagaatcccgagctgacacctggtcctgcaccggctggcccaactccagccccagagacttag

SEQ ID NO: 215745 - DNA, 2232 bp, Artificial Sequence
  Description of Artificial Sequence: Synthetic coding sequence
atggagcctaatgacagcacctctaccgccgtcgaggaaccagacagcctggaagttttagtcaaaacattagattcccagacacgcacatttattgtgggagctcagatgaacgtgaaagagttcaaagagcatatcgctgcgtctgtgtcaataccctctgaaaagcagcgcttgatctaccaaggacgtgttcttcaggatgacaaaaagctgcaggagtacaatgtgggtggcaaggttatccatctggttgaaagagccccaccccagactcacttacccagtggcgcaagtagcgggacaggttccgcctctgcaacccatggaggtgggtctcctccgggtactcggggaccaggcgcatcggttcatgatcggaacgctaattcttacgttatggtcggcacctttaacctgccctccgacggatccgctgtcgatgtgcatataaacatggagcaagcccctatccagagcgagcccagagtgaggctggtcatggcccagcacatgatccgtgatatacaaacgttgctttcgagaatggagtgtagaggtggaccccagcctcagcatagccaacctccccctcagcctccagcagttacaccagaacctgtcgctttgtcgagtcagactagtgaaccagtggaaagtgaggcaccgcctcgggagcccatggaggccgaagaagtggaggaaagggcccctgctcagaaccccgagctcacaccaggccctgctcccgctgggcctaccccggcacccgagactaacgcaccaaatcatccgtcccctgccgaatacgtggaagtgttacaagagctgcagaggctggaaagtcggctacagccttttttgcaaagatactacgaggtgcttggtgcagccgctacaaccgactataataacaatcacgaggggagggaagaggaccagagacttatcaacttggtcggtgaaagtctgcgtctcctggggaacactttcgtcgccctctccgacctcaggtgtaatctcgcgtgtacgcctcctagacatctgcatgtagtccggcctatgtcacattacaccactccgatggtgctgcagcaagcagccatccctatccagatcaatgtcggcactaccgtgaccatgactggtaatgggacccgcccaccgcctacacctaatgcagaagcgccacctcccggaccaggccaggctagctcagtagcgcctagctccacaaacgtggagtctagcgcggagggggcacctcctccaggccctgcgccaccacctgccacctcacatcccagggtgatcagaatcagccatcagtcagtcgaaccagtggtgatgatgcacatgaatatccaggattctggcactcagcccggaggagtgccgtccgccccaaccggtcctctcggacctcccggtcacgggcagaccctcggatccaccctaattcagttaccatcgcttcctccggagttcatgcacgctgtggcacatcagatcacacatcaggctatggttgctgctgtcgcttcagctgcggctggacaacaggtgcctgggttcccaactgcgcctacccgcgtggttattgcgagacctaccccccctcaggcacggccatcccatccaggagggcctcctgttagcggtaccctacagggagctgggcttggaacgaacgcttccctggcgcaaatggtcagcggcctagtcggacagctgctgatgcagccggtgttggtcgcccagggaacaccaggaatggcccctcctccagctcctgcaactgcttcggcttcggcaggaactactaatactgcgactacagcaggcccagccccaggcggtcccgctcagccgcctcccacgccgcagccaagcatggccgacctgcagtttagccagcttcttgggaacctgttggggccagccggacccggagctggcggttccggtgtcgctagcccaacgattaccgttgccatgcccggagtgcctgctttcctacaggggatgaccgacttcctgcaggcgacacaaaccgcccctccccctccaccaccccctccgcctcccccaccggcacccgagcagcagacaatgccccctccagggtctccgagtggtggggctgggagccccggaggtctgggccttgaaagtctctcacccgagttcttcacaagtgttgtacaaggggtactgtcctcactcctctag

SEQ ID NO: 215746 - DNA, 3399 bp, Artificial Sequence
  Description of Artificial Sequence: Synthetic coding sequence
atggagccaaatgattctaccagtaccgccgtggaggaacctgacagtctggaagtcctcgtcaaaacattggatagtcaaactcgtacctttattgtaggagcccaaatgaacgtaaaggagtttaaggagcatatcgccgcttctgtatccatccctagtgaaaagcagcgtctgatctatcagggcagggtccttcaagacgataagaagctgcaagaatataatgttgggggtaaggtaattcacttggtcgaaagggcccctccccagactcacctgccctccggcgctagctccggcaccggctctgcgagtgccacgcatgggggagggtcaccacctgggactcgcggacctggagcctccgtgcatgatagaaatgcaaattcttacgtgatggtaggcacattcaatctgccttctgatgggtccgcagtggacgtccatattaatatggagcaagcccctattcagtccgagccgagggtccggctcgttatggctcagcatatgattcgggatattcagacactgttgagcaggatggagactttgccttacctccagtgcaggggcggtccacaaccacaacacagccagccaccacctcaacctccagcagtaacccctgagcctgtggctctctcttcccagacgagcgaacccgtggagtctgaagcacccccacgggagcccatggaagccgaagaagtagaggagagggcacctgcccagaaccctgagctgacaccagggcctgcacctgcagggcctactccagcccctgagacaaatgcacccaaccacccctcccccgcagaatacgtagaggtcctgcaggagcttcaaagactggaaagcaggctgcagcccttcctgcagagatactacgaggtgctaggtgccgcagccacgacagactacaataacaatcatgaggggagggaggaggaccagcgcctgattaacctggtcggcgagtccctccggcttcttggcaacacgttcgtggcgttgagcgacttacgctgcaatctcgcctgtaccccccctcgccatctgcatgtcgtgcggcctatgagccactacacgactccgatggtcctccagcaagcagctattccaatacagattaatgtcggcacgacggtgaccatgactggaaacggcaccagaccacctcccaccccgaatgcagaggcgccacctccgggacctggccaggcttcctcagtagcacccagcagcaccaatgtagagtctagcgctgagggggctccaccaccagggccagcccctcccccagccacatcacatccaagggtgattcggattagccatcaatctgtggaaccagtcgtgatgatgcatatgaatatccaggactcaggcacgcagcccggaggtgtcccctcagcccctacgggtcccttgggaccacccggacacgggcaaaccctcggtcaacaggttcccggtttcccaaccgctccaacccgagtcgtcatcgccagacccacgccccctcaagctcgcccttcccacccaggaggaccacctgttagtggcactctgcaaggcgcaggactaggaactaacgcttcgttggcacagatggtgtcgggtctagtggggcagcttctcatgcagcccgttcttgttgcccagggcacacccggaatggcaccacccccagctccagcaaccgcttctgcttccgccggtaccactaataccgcaaccactgccggaccagctccgggaggtcctgcacagcccccaccaacaccccagccaagcatggccgaccttcaattctcacagctgctgggtaatctactcggtccggctggtccgggagccggtggtcccggagtggccagccctacaattaccgtcgcgatgccaggcgtgccagctttcttgcagggcatgacagacttcctgcaggcaacccagaccgcccctcccccaccgcctccaccaccccctccacctcctgcacccgaacagcagaccatgccaccacccggtagcccatctggtggagccggatcacctggtgggctggggttagaatccctttcacctgagtttttcacatccgtcgtgcagggagtgctgtcatctctcttaggatccctgggtgcgagggctggctccagcgagtctatcgcggcattcatccagaggctctctggaagctcgaatatctttgagccaggggcagatggtgccttaggattcttcggcgctctcctgagtctcctctgccaaaacttctctatggtcgacgtagtgatgctcctacacgggcatttccagcctctacagaggctccaaccacaattacgcagttttttccaccaacactatctgggtggacaggaacctacaccctcgaatatccgcatggccacccacaccctgattactggcctcgaggaatatgtgcgggagagtttttctctggttcaggtccaacctggcgtagacattataagaactaacttggagtttctgcaagagcagtttaacagtattgccgcacacgtccttcactgcacagacagcggctttggtgctcgcctgctggaactttgcaatcaaggccttttcgaatgcctggctctaaacctacactgtctggggggtcaacagatggagctggccgctgtcatcaatgggagaatcaggaggatgtctcgtggagtgaatccaagtttggtgagctggctgacgaccatgatgggactgaggctgcaggtggtgttggagcatatgccggtgggccctgacgccatcttaagatatgtgcgcagggtgggagaccctccccagcccctcccagaggagcccatggaagtgcagggagccgagcgggctagccctgagcctcaaagagaaaacgctagtccagctccagggaccacagcagaggaggccatgtcacgcggaccaccacccgctcctgaagggggttcgagagatgagcaggacggcgcatcggcagagacggaaccttgggcagcagcagtccctcctgagtgggtgcccataatccagcaggatattcagtcccagcgaaaagttaagcctcagccaccactgagcgatgcctatctgagtggaatgcccgctaaacgcagaaagacgatgcagggtgaagggccacagctgctgctgagtgaagccgttagtagggcggcaaaggctgccggagctcggccactgaccagtccagagtcattgagtagggatctcgaagccccagaggtgcaggagtcatatcgacagcagcttaggagcgacatccagaagaggctccaggaggatccaaactactctccgcagcgcttccccaatgcccagcgggctttcgcggatgatccctag

SEQ ID NO: 215747 - DNA, 594 bp, Artificial Sequence
  Description of Artificial Sequence: Synthetic coding sequence
atggagccaaacgattccacatcgacagcggtcgaagaaccggattctcttgaggtgttagttaagacactggacagtcagactagaacttttatagtgggagcccagatgaatgtgaaggagttcaaagagcacattgctgcctctgtatcaattccctccgagaaacagagattaatttatcaggggcgagtcttacaggatgataagaagctgcaggagtataatgtgggcggaaaggtcatccacctggtggagagggctccgcctcagactcaccttccttccggggcaagcagtggcaccgggtcagctagtgctacacacggaggcggttctccaccaggcacgcgcggaccgggtgcgagtgtccatgacaggaatgctaacagctacgtgatggtaggaacttttaatttgccttcagatgggagcgccgtggacgtgcatatcaatatggagcaggcacctatccagtccgagccccgtgtccgcttggtgatggcacagcacatgattagggacatacaaacactcctgtctcggatggaatgtcgaggaggaccccaacctcaacacagccagccgccttag

SEQ ID NO: 215748 - DNA, 735 bp, Artificial Sequence
  Description of Artificial Sequence: Synthetic coding sequence
atggagcctaatgactcaacatctaccgccgtcgaagagccggacagtctggaggtgttagtgaaaacattggacagtcagacgcgcaccttcattgtgggggctcagatgaacgtaaaggagttcaaagagcacattgcagctagcgtcagcattccttccgagaaacagcggcttatttaccagggtagagttttacaggacgataagaagctgcaagaatataacgtcggcggaaaagtcattcatctagtcgagcgcgctcctccccagactcacctgccttctggggctagcagcgggacagggtctgcctccgccacacatggaggcggatcccctcctggcacccgcggtcccggtgcttctgtgcatgaccggaacgccaattcctacgttatggtcggcacctttaacctgccatcggagcctagggtcagattagtgatggcccagcatatgatcagggatatacagacactgctttcaaggatggagtgtagaggaggccctcagccgcagcacagccagccgcctccacagcctcccgctgtaacaccggaacccgtggctctatcatcgcaaacttccgaacccgtcgagagtgaggctcccccaagagagccaatggaggctgaggaagttgaagaaagagcaccagcacagaaccctgaattaacaccaggacccgctcccgctggtcctacacccgcaccagaaacaaatgctccctag

SEQ ID NO: 215749 - DNA, 594 bp, Artificial Sequence
  Description of Artificial Sequence: Synthetic coding sequence
atggagccgaacgacagcacctccacggctgtcgaagagcctgacagcttggaggtgctagtcaagaccctggattctcaaaccaggacctttattgtgggcgctcagatgaatgttaaggagttcaaagaacacatcgccgcttcagtgtccattcctagcgagaagcagaggttaatctatcagggccgagtcttgcaggatgacaagaagctccaggaatataatgtcggaggaaaggttatacatctggtcgagcgcgctcctcctcagacgcacctgccatcaggtgcctcaagtggcaccggaagtgcgtccgccactcacgggggtgggagcccacccggaacacgaggcccaggggcatctgttcatgacaggaatgcgaattcttacgtgatggtgggaacatttaacttgccatctgacggcagcgccgtggatgttcacataaatatggaacaagcgccaatacaaagtgagccccgagtgcggctggttatggcccaacacatgattagggacatccagactcttctgtcccggatggaatgtcgtgggggacctcaacctcagcactcccagcctccttag

SEQ ID NO: 215750 - DNA, 1548 bp, Artificial Sequence
  Description of Artificial Sequence: Synthetic coding sequence
atggagccaaatgacagtacctcaaccgcagtggaggaaccggattctctggaggtgctcgtcaagactctggatagccagactagaacattcatcgtgggggctcagatgaatgtcaaggagtttaaagagcatatcgcggcttcagtgtctatccctagtgagaagcagaggctcatttaccaaggccgtgtcctccaggatgacaagaagctgcaggaatacaacgtaggaggcaaggtaatacatcttgtggagagggcacctccgcaaacacatttgccatccggcgctagcagtgggaccggctcagccagcgctactcacggaggcggatcaccccctggcacccggggaccaggcgcaagcgtgcacgatcgcaacgccaactcgtacgtgatggttggaacctttaacctccccagcgacggcagcgccgtggacgtccatattaacatggagcaggctcctattcagtctgagcctcgggtaaggttagttatggcccaacatatgattagagatattcagactcttctgtcaagaatggagtgtcgtgggggaccacagccacagcacagccaaccgcctccccagccccctgcagttactcctgaacctgtggcacttagctcccagacgtctgagcctgtggaaagtgaggccccacccagagaaccgatggaggccgaagaagttgaggagagagcaccagcccagaatcccgaactaacaccgggtcctgctccggctggcccaacccccgctccggaaacaaatgctcccaatcacccctcccccgcagaatacgtcgaagtgttgcaagagctccaacgtctggaaagccggctgcaaccattccttcagcgatactatgaagtgctgggcgcagctgcaacaaccgactacaataacaaccatgagggccgtgaggaagatcaacgcctgatcaacctggtcggggagtccctgcgcttacttggcaatacatttgtggcacttagtgatctgcggtgtaatttggcgtgcactccgcctcggcatctgcacgtagtgcgacctatgtcccactacaccacgccaatggtgcttcagcaggccgcaattcccatccagattaatgtcgggacgactgtcaccatgactgggaacggaaccaggccaccgccaactcccaatgctgaggccccacccccaggcccagggcaggcctcttcagtggcgccatcatccacaaacgtggaaagttcagctgagggagcaccccctccaggcccagctcctcctccggcaaccagtcatccgcgtgtaatccggatatcccatcagtctgtcgagcccgttgtgatgatgcatatgaacatccaggatagtgggacccagccagggggtgtgccctctgcacctacaggtcctctggggcctcctggccacggacagacgctcgggagtaccttgatccaattaccttctctcccgccagagtttatgcatgcagtagctcaccagatcacacatcaggcgatggtggccgcagtcgctagctag

SEQ ID NO: 215751 - DNA, 735 bp, Artificial Sequence
  Description of Artificial Sequence: Synthetic coding sequence
atggaaccgaacgattcaacgagcacagccgtggaggaaccagacagtcttgaggtgttggtgaagactctagatagccagacgcgcaccttcatcgttggagcacagatgaatgtgaaagaattcaaggagcacattgccgcatctgtatcgatcccctccgaaaaacagagacttatatatcaggggagggtgctgcaagatgataaaaagcttcaggagtacaatgtcggtggaaaggttattcacctggttgaaagggcaccaccacagacccaccttccatccggagcctcaagtgggacaggctccgcttcggctacccacggagggggaagccccccagggacacgcggtcccggtgcctccgtccacgatcggaatgcaaattcttatgttatggtcgggacttttaatttgccttctgaacccagagtgaggttagtgatggcacaacatatgattcgagatatccagaccctgctgtccaggatggagtgccggggtggaccacagcctcagcatagtcagcctccccctcagccacctgctgtaacccccgagcctgttgccctgagcagccagactagtgagccagtggagtcggaggctccacctcgggagcctatggaagctgaggaagtcgaggaacgggcacccgctcagaatcccgaactgacccccggtcctgcgcctgcgggtccgactccagctcccgaaacgaatgcaccttag

SEQ ID NO: 215752 - DNA, 789 bp, Artificial Sequence
  Description of Artificial Sequence: Synthetic coding sequence
atggaaccaaacgatagtacaagcacggcagtcgaggaaccggacagtctggaagtgctcgtaaaaaccctggatagccaaaccaggacattcatcgtcggggctcagatgaatgttaaggagttcaaggaacacatagccgctagcgtgagcattccctcagagaaacaaagactgatctaccaaggaagggtgttgcaggatgataagaaattgcaagaatacaatgtggggggtaaagttattcatctggttgaaagagctcccccacaaactcatctcccctctggggcttccagtgggactgggtctgccagcgctactcatggagggggaagtccgccaggcacacgcggaccaggagcaagtgtacacgatcgaaacgcgaatagctatgtgatggtaggcactttcaacctgcctagtgatggaagtgctgtggatgtgcacattaatatggaacaagcaccgatacagtccgagccacgcgtgcggctggtgatggcccagcacatgataagggacatccagactctgttatctcgaatggagtgtaggggcggaccgcaaccccagcacagccagcctcctccacaaccacccgcagtgacgccagaacccgtcgctttaagcagtcagaccagcgagcctgtggagtcagaggcccctccaagagaaccgatggaggccgaggaggttgaggaaagagcacctgcccagaatcccgagcttacgcccggaccagcacccgcaggcccaactccggcaccagagactaacgccccatag

SEQ ID NO: 215753 - DNA, 789 bp, Artificial Sequence
  Description of Artificial Sequence: Synthetic coding sequence
atggagcctaacgactctaccagcactgctgtcgaagagccagatagtcttgaggtcttagtgaagacactagacagtcagacaaggacgttcattgtgggtgcccagatgaacgtgaaggagttcaaggagcacatcgcagcgtctgtgtcaatcccctccgagaaacagaggctcatttaccaggggagagtgctccaagacgacaaaaagcttcaagaatacaacgtaggtggaaaggtcatacacctggttgagagggcgccacctcaaacgcacctgcccagtggtgcctcatcagggacgggatcagcttctgctactcatggaggcggatcacccccagggacaagaggaccgggtgcctctgtccacgatcgcaacgccaactcctatgtgatggtcggaacgttcaacctgccaagcgatggcagcgcagtagatgtgcacattaatatggagcaggccccaattcagtcggagccaagggtccgccttgtgatggcacagcacatgattagggacattcagacattattaagccggatggagtgtcggggtggaccacagccacagcactcccagcctccacctcaaccccctgctgtcacgcccgagcctgtggctctgagttcacagactagcgagccagtggaatccgaggcacctccacgtgaaccaatggaggcagaagaagtggaagagcgcgcacctgcccagaaccccgagttgaccccaggccctgccccagccggtcccacaccagcgccagaaactaacgccccatag

SEQ ID NO: 215754 - DNA, 717 bp, Artificial Sequence
  Description of Artificial Sequence: Synthetic coding sequence
tccagcgctgagggcgctcccccaccaggtcccgctccaccacccgctactagtcatccccgagtcatcagaatctcccatcagtctgtagaaccagttgttatgatgcatatgaacattcaggggcctctctcacttagtccttgccctgattctggaacccagcctggaggggtgccttcagccccaacgggccctctgggtccacccggacatggtcagacccttgggcagcaggtacccggttttcctacggctcctactcgggtggtgattgctaggcctactccaccacaggccagaccctcacacccgggtggccctcccgtgagcgggactctccagggggcaggactcgggaccaatgccagtctcgcccaaatggtctctggactggtgggacagctgttaatgcagccagtactggtggcccaggggacaccaggcatggccccaccacccgcaccggctaccgcaagcgccagcgccggaaccactaatacggccaccaccgccggacccgctcctggaggaccggcacagcccccacccacgcctcagccttcaatggccgacctgcaattttcacagcttcttggaaatctgttggggcctgcaggaccgggagctggcggatccggggtcgctagcccaactatcaccgtggctatgcctggggtgccagctttcctgcagggaatgaccgacttcctctag

SEQ ID NO: 215755 - DNA, 735 bp, Artificial Sequence
  Description of Artificial Sequence: Synthetic coding sequence
atggagccgaatgatagcacttcaactgccgtggaggaacctgatagtctggaagtgctggttaaaactctggactcacagacgaggacctttatagtcggagcgcagatgaacgtaaaggagttcaaggaacatatcgcggcttccgtttccatacccagcgaaaaacagcgactcatctatcagggacgcgtgctgcaggacgacaaaaagcttcaggagtataatgtcggcggaaaagtgatacaccttgtggaaagggctccgccacagacacaccttccttccggcgcttccagtggtacaggctcagcctcagctacgcatggcggtggcagtcctcccggaaccagaggtcccggtgcttctgtgcacgacaggaatgcgaattcatacgtaatggtcggcacctttaacctcccaagtgagccaagagtaaggctggtgatggcacaacatatgattcgtgacatccagaccctgttatcacgaatggagtgccggggaggacctcagcctcagcacagccagccaccccctcagccgccagctgtgacgcctgaaccggtcgcactcagttctcagacaagcgagcctgtagagagtgaggcgcctccaagggaaccaatggaggccgaggaagtggaagagagggccccagcgcagaacccagagctgaccccaggcccagcgcctgctgggccaacacccgctccagagaccaatgcaccctag

SEQ ID NO: 215756 - DNA, 621 bp, Artificial Sequence
  Description of Artificial Sequence: Synthetic coding sequence
atggagcccaacgactccactagcacagccgtcgaggagccggattccctggaggtgctcgtgaagaccttggactcgcagactaggaccttcattgtcggcgcacaaatgaacgtgaaggaatttaaagagcatatcgctgcatctgtctctatcccgagtgaaaaacagcgcttgatctaccagggcagggttctgcaggatgataagaagttgcaggagtataatgtcggcggaaaagtgatccatctggttgaacgcgcacccccacagacccatttgccctcgggggcttcaagcgggactggatccgctagcgccacccatggagggggaagtccgcctgggacccgcggacccggtgcaagcgtacatgacagaaatgccaacagttatgttatggtgggcactttcaatcttccctccgagcccagggttaggttggtgatggctcaacacatgatcagagatatacagacgctgctgtctagaatggagtgcagaggcggtccacagccgcagcattctcagccacccccacaacctccagccgtgaccccagaaccggtggctctttcaagtcagacttcggaaccagttgaaagcgaagcccctccttag

SEQ ID NO: 215757 - DNA, 735 bp, Artificial Sequence
  Description of Artificial Sequence: Synthetic coding sequence
atggaacctaacgactccactagcaccgccgtggaagagcccgacagcctggaagttttggtgaaaacactggactcgcaaaccagaacgttcatagtgggcgcacaaatgaacgtcaaagagttcaaggaacacattgcagcaagcgtttctataccatctgagaaacaaagactgatctatcagggacgggtcctgcaggacgacaaaaaacttcaggaatacaatgttggagggaaagtcattcacctggtggagcgcgctcctcctcagacccacctgcccagcggagcttcctccggaacaggaagtgcctccgccacgcacggagggggtagtccgcctggcacacggggtcccggagcatctgtacatgatagaaatgctaactcgtacgtgatggtgggcacatttaacctaccatcagaacccagagtccggctggtgatggcacagcacatgatccgagatattcagacactactgtccaggatggaatgtcggggtggcccacagccacagcactctcagcctcctccacagccccctgccgtcacacccgaacctgtggcactgagctctcagacaagcgaaccagtcgagagtgaggcccctcctagagagccgatggaggcggaggaggttgaagagcgcgcacctgctcagaaccctgagctgactcctgggcctgctcccgcaggtcccaccccagcccctgagactaatgcaccctag

SEQ ID NO: 215758 - DNA, 780 bp, Artificial Sequence
  Description of Artificial Sequence: Synthetic coding sequence
atggaaccaaacgactccacttcaacagccgttgaagagcccgactcactcgaagtgcttgtaaagacccttgacagtcagactcgtacctttatagtcggagcccagatgaatgtgaaggagttcaaagaacacattgcagcttccgtgagcatcccgtctgagaaacagcgcctaatctaccagggccgagtgctgcaggatgataagaagctgcaggagtataacgtcggtggcaaggtcatccacctggtggagcgggcacccccacagacccacctgccctccggagccagctcagggactgggagtgcgtccgccacacacggcggtgggtcgccccctggaacccggggacctggggcttcagtgcatgatcgcaacgcaaactcatatgtaatggttggaaccttcaaccttcccagtgacggatctgcagtcgacgtgcacatcaacatggaacaggcgcctatccagtcggagcccagagtccggttagtaatggctcagcacatgattagggacatccaaactctgctctcaagaatggaatgccgtgggggacctcaaccacagcactcccagccccctccacagccccctgcagtcaccccggagcctgtggctctttcatctcagacaagtgaacctgtggaatctgaagctcccccaagagagcccatggaagcagaagaagtggaggagcgcgctcctgcgcaaaacccagagttaactccaggacccgctcctgctggccctacacctgctccagagacttag

SEQ ID NO: 215759 - DNA, 558 bp, Artificial Sequence
  Description of Artificial Sequence: Synthetic coding sequence
tagttagcatgcaccccccctaggcacctccatgtggtacgccctatgagccattacacaacccctatggtgctccaacaggccgctatccccatacagatcaacgtcggcaccaccgtcacgatgactgggaacggcaccaggccccctcctaccccaaatgcagaggcaccgcctcccggtcctggtcaggcctccagcgtagccccttcttctactaacgtggaaagtagtgcagagggtgcacccccaccaggtcccgcaccccctccagctactagtcaccctcgcgttatccgaatctctcaccagagcgtcgagcctgttgttatgatgcacatgaacatacaggggcagcaagtgcccggatttcccaccgctccaactagagtggtcattgccagaccaacgccacctcaggcacgtccctcacaccccggtggcccaccggtgtcaggaaccctgcagggagctgggctgggtacaaatgcatcgctggcccagatggtgtcaggcctcgttgggcagttgttaatgcagcccgtcctcgttgcctag

SEQ ID NO: 215760 - DNA, 621 bp, Artificial Sequence
  Description of Artificial Sequence: Synthetic coding sequence
atggaacccaatgatagcaccagcactgctgtggaggagccggattctctggaagtgctagtgaagacgctcgactcacaaacccgcacattcattgtcggtgctcagatgaatgtcaaagaattcaaagagcatatcgccgcttctgtctcaataccaagcgagaagcagcggttaatataccaggggagagtccttcaggacgataagaagttgcaggaatataatgtgggtggaaaggttatacatctcgtggaacgcgcaccccctcaaacgcatctgccatccggggcatcttccggcactggaagcgcttcagccacccatggcggtgggagcccacctggcactcggggaccaggtgcttcagtgcacgatcgcaatgccaattcttacgtcatggttggcacctttaatctgccatccgagccacgagttagacttgtgatggcgcagcatatgattagggacatccagaccttattgagcagaatggaatgtcggggtggacctcagcctcagcactcccagcctccccctcagccacccgctgtgaccccggagcctgtggctttatcaagccagacaagcgaaccagtcgaatcagaggcacccccatag

SEQ ID NO: 215761 - DNA, 735 bp, Artificial Sequence
  Description of Artificial Sequence: Synthetic coding sequence
atggagcctaacgactccacttccactgctgttgaagagccagattctctcgaggtcctggtcaaaacactcgactcccagactcgcacgttcattgttggcgctcagatgaacgtgaaggaattcaaggagcacatcgcagcttccgtctcaattcctagcgaaaaacagcggcttatttatcagggcagagtcctacaggatgacaagaagcttcaagagtataacgtcggcggaaaggtgatacacctcgtggaacgagccccaccgcaaacccacctgccaagcggagcaagtagcggcaccggatccgcctccgcgacacacggcggaggatctccaccaggaaccaggggtccgggagcatccgtccatgatcgtaatgccaacagctacgtgatggttggaactttcaacctgccttcagagccaagagtgagattggtgatggctcagcatatgatccgagatattcaaactctcctcagccgaatggagtgccgtgggggtccacagccacagcactcccagccacctcctcagccacccgcagttacccctgagccagtggccctatcgagccaaacaagcgaacctgtagagtctgaggcccctcccagggagcctatggaggcagaggaagtagaagagcgggctccagcacagaatcctgaattgacacctggccctgcccctgcaggacccacacccgctccggagaccaacgcaccatag

SEQ ID NO: 215762 - DNA, 1548 bp, Artificial Sequence
  Description of Artificial Sequence: Synthetic coding sequence
atggagcccaacgattctacatccacggccgtggaggagcccgactccctggaagtgttggtgaaaacccttgattctcagacaaggaccttcatcgtgggggctcagatgaacgtcaaagagtttaaagagcatattgcggcatcggtgtccattcctagcgagaaacagcgcctaatttaccagggacgagtcctccaagacgataagaagctccaggagtataatgtgggcggtaaggtgattcatctggtcgaacgggctcctccacagacccacctcccgagtggagcctcatcggggacaggttcggcgtctgccacccacggaggtggctctccccctggcacacgaggtcccggagctagcgttcatgatagaaacgcaaactcttacgtaatggtaggcacatttaatctgccgagtgatggatcagccgttgacgtgcacatcaatatggagcaggcgcctattcagtcggagcccagagttagactggtcatggctcagcacatgattcgggacattcaaacattattatctagaatggaatgccggggtggaccccagcctcaacattctcagccacctcctcagccaccagccgtgacacccgaacctgtcgcgttatcatctcagacctctgagccggtggagtctgaagccccaccacgagagccaatggaggccgaagaggtggaagaacgcgcaccagctcagaatcctgaactgactcctgggcctgcccctgcgggacccacgccagcaccagagacaaacgccccaaaccaccccagccccgcagaatacgtggaagtgctgcaggaactccagaggctggagtccagacttcaacccttcctacagagatattatgaggtactgggcgctgctgctaccactgattacaataacaaccacgagggccgagaagaagaccagagattaatcaacctggtgggggaaagtttaaggctcctaggcaacacatttgtagctctttcagacttgagatgtaatcttgcctgcacacctccgaggcacctacacgtcgttagacctatgagccactatactaccccaatggtactccagcaggccgctatccccatacagataaacgtcgggacaactgtgacaatgaccggaaacggcacaagacctcctcctactcccaatgccgaagcacctccaccaggcccaggacaggcatcctccgtggccccttccagcaccaatgttgagtcaagcgcagagggggctccgcctcccggaccggctcccccacctgctacttctcacccacgggtgatcagaatcagccaccagtccgtagaaccagttgtgatgatgcatatgaatatacaagatagcggcacgcagccaggcggtgttccttccgcccctaccggccctctcgggcctcctgggcatgggcagacgctggggtcaactctgatccagctgccctcattgccccctgagttcatgcacgctgtggcgcaccagatcacccaccaagctatggtcgctgctgtagcttcttag

SEQ ID NO: 215763 - DNA, 717 bp, Artificial Sequence
  Description of Artificial Sequence: Synthetic coding sequence
tcctctgccgagggggctccaccaccgggtcccgcaccccctcctgctacatcgcatcctagggtgatccgcatttcccatcagtctgtggagcctgtagtgatgatgcacatgaatattcaaggcccactgagtctgagcccctgcccagatagtggaacgcagccaggaggagtcccatcagcccctactgggccactgggcccacccggtcatggtcagacattgggccaacaggtacccggatttcccacagccccaactagagtcgtgattgctagacccacacctccacaagcaagacccagtcatccaggcggtccacctgtgtctgggacactgcagggagccggactgggaaccaatgctagcctggcgcagatggtatccggcctggtgggccaactgctgatgcagcctgtgctggtagctcagggtactcccggaatggccccacctcccgcacccgcaaccgcgagtgcatccgctggcacaacaaacacagccacaaccgccggtcctgctcccggaggtcccgctcagccacctcccaccccccagccatcgatggctgatctacagttcagtcagctcctaggcaatctgctgggacctgccggtccaggggctgggggtcccggagtcgcttcgccgacaataactgtggccatgccaggggtacctgccttcctccagggcatgaccgacttcctctag

SEQ ID NO: 215764 - DNA, 648 bp, Artificial Sequence
  Description of Artificial Sequence: Synthetic coding sequence
atggagccaaacgacagcacttccactgcagtcgaagaacctgattccctcgaggtgttggtaaaaactttggactctcagaccagaacgtttattgtaggagcccagatgaacgtcaaagagttcaaggagcacatcgctgcctccgtgtctatacctagcgaaaagcagcgcctcatctaccagggccgtgtactgcaggatgataagaaactccaggaatacaatgtggggggtaaagtcattcatctcgtggagagggccccacctcagactcacttaccttccggcgctagctctggaacggggtccgcctctgccactcatggcggtggatcccctccaggtacccggggtcccggagcctcagtacacgatcgcaatgcaaattcttatgtgatggttggaaccttcaaccttcccagtgagccaagggtgcgacttgtgatggctcaacatatgattcgagacattcagacacttctgtctaggatggaatgccgcggtggtccacagccacagcatagtcagcccccaccgcagcctcctgccgtgaccccagaacctgtcgccctgtcctcacagacttcagaacccgtcgaatcggaggctcccccaagagagccaatggaggcagaagaggtgtag

SEQ ID NO: 215765 - DNA, 477 bp, Artificial Sequence
  Description of Artificial Sequence: Synthetic coding sequence
atggagcccaatgactctacatccacggcagtggaagaacctgactccctggaagtgctagtcaaaactttggactcccagaccaggacgtttattgttggagcccagatgaacgtcaaggaatttaaggagcacattgccgctagcgtgtcaatcccctctgaaaaacagcgtctgatttaccaaggcagagttctacaggatgataagaagcttcaagagtacaacgtgggtggaaaggtgatccacctggtggagcgtgccccaccccagactcatttgccctctggtgctagtagcggaactggaagcgcatctgccacccacgggggaggttctccccctggaaccagaggacccggtgcatcagtgcacgacagaaatgcaaactcttacgtgatggtcggcactttcaacctgccgtcagatggcagcgccgtggacgtgcacattaacatggagcaagctcccatctag

SEQ ID NO: 215766 - DNA, 702 bp, Artificial Sequence
  Description of Artificial Sequence: Synthetic coding sequence
atggagcccaacgattcaacaagcaccgctgtggaagagcccgatagcctggaggtcctcgtcaagacattggacagccagaccaggactttcatcgttggagcacagatgaatgtaaaggagttcaaagaacatatcgcagctagtgtgtccattccctccgagaaacagagattgatttatcaaggcagagtccttcaggatgacaagaaattacaagagtacaacgttggaggcaaggttatacacctggtggagcgggcacccccacaaacacatctgccctctggagctagctcaggtactggaagtgccagcgctacacatgggggaggcagcccacctggcacgcgcggacccggagcatctgtgcatgacaggaacgctaatagctacgttatggttgggacattcaacctcccttctgacggatcagccgtggatgtgcatattaacatggaacaagctcctatccagtcggagccacgggtaagactcgtaatggcgcagcacatgatacgcgacattcagacgctgctgtcaaggatggaaacccttccatacctgcagtgccgcggtggaccacaacctcagcactcccagccaccgccacagcccccagcagtgacacccgaacccgtggctttaagtagccagacgagcgaaccagtggagtccgaagccccaccaagggaaccatag

SEQ ID NO: 215767 - DNA, 780 bp, Artificial Sequence
  Description of Artificial Sequence: Synthetic coding sequence
atggagcctaatgactcaacatccaccgcggtggaggaacccgatagcctggaggtacttgtgaaaaccttggattcacagacacggaccttcattgttggcgcacagatgaacgttaaagaattcaaggagcacatcgccgcaagcgtcagtatcccctccgagaaacagcgattaatttatcagggacgcgtgctgcaggatgataaaaagctacaggagtacaacgtggggggtaaagtaatacatctggtagaacgcgcaccacctcagactcatctgccgagtggggctagctcagggaccggcagcgcgagtgccactcacggtggaggtagcccccctggaaccagaggaccaggtgcgagcgtccacgatagaaatgcaaatagctatgtcatggtgggcacattcaatctgccaagtgatggatccgccgtggacgttcatatcaatatggaacaggcgccaattcagagtgagcctcgagtgcggctcgtgatggcacagcacatgatccgggatattcaaaccctgctgtcccggatggaatgccggggaggtcctcagccccagcattcccagcctcctccacaaccgccagccgtcacccccgaacccgtcgccctcagctcccagacctccgagcctgttgagtctgaggcccctccccgagaaccaatggaagctgaggaagtggaagagcgggctccggctcagaatccagagctgacaccaggcccagcgcctgctggccctaccccagctcctgaaacgtag

SEQ ID NO: 215768 - DNA, 411 bp, Artificial Sequence
  Description of Artificial Sequence: Synthetic coding sequence
tgaaggatgagcagaggcgttaaccccagcctcgtgtcttggttgacaacaatgatgggactcagattgcaggtggtgcttgagcacatgcctgtgggtccagacgccattttgagatatgtgaggagagttggcgatcccccacagcctctgcctgaggaaccaatggaggtgcagggcgctgagcgcgctagcccggaaccccaggagtgggtcccaattatccagcaggacatccaatcccagcggaaggtaaaaccccagcctccactatcagacgcctacctgtccgggatgccggctaagcgcaggaaactgcggtctgacatccagaagaggctgcaggaggaccccaattatagtccgcagcgcttcccaaatgcacaaagagccttcgccgatgatccatag

SEQ ID NO: 215769 - DNA, 735 bp, Artificial Sequence
  Description of Artificial Sequence: Synthetic coding sequence
atggagcccaatgattctacatctaccgctgtggaagaaccagattctctagaagttctggtgaaaacactcgacagtcaaacgcggacctttatagtcggcgcacagatgaacgtcaaggagtttaaagaacacatcgcggcttcagtgtccatccctagcgagaaacaaaggctgatctaccagggacgggtgttacaggatgataaaaagttacaggagtacaacgtgggtggtaaggtgattcacttggtggaacgggctccaccccaaacacacttaccatctggcgcttcatccggcaccggttcagcaagtgccacccatggcggaggatctcctcctgggacaagagggccaggagcttccgtgcatgaccggaatgccaactcttacgtgatggtgggcacttttaacttgccttcggagcccagggtgcgacttgttatggcccagcacatgatcagggacatccagaccctcctgagtagaatggaatgtagaggaggaccgcaaccccagcacagccagcctccccctcaaccaccagccgtcactcctgaacctgtggctctcagtagccagacgtctgaacctgttgagtcagaggcaccacctagggaaccaatggaggccgaggaggtggaagaaagagcaccggctcagaatcccgaacttacacccggacctgcgcctgccggaccaacacccgctcctgagaccaacgcgccttag

SEQ ID NO: 215770 - DNA, 3381 bp, Artificial Sequence
  Description of Artificial Sequence: Synthetic coding sequence
atggagcccaacgattctacgtctacggccgtcgaagagccggattcactcgaagtgctggtgaaaactctggacagtcaaactcgcacatttattgtgggtgcccagatgaatgtaaaggaattcaaggagcacattgccgcatctgtctccattcccagcgaaaagcagcgcctaatttatcagggtcgtgtgctgcaggacgacaagaagctacaagaatataacgtgggcggtaaggtcatacacctggtcgagcgcgctcctccccagacccatctgccctccggagctagcagcggaactgggagtgcaagtgctactcatggagggggatcacctccaggtaccagaggtcctggagccagtgttcatgatcggaatgccaacagctacgtgatggtagggacattcaatttgcccagcgacgggtccgcagtggacgttcacataaacatggagcaggcccctattcagagcgaaccacgggtgagattggttatggcccagcacatgattcgcgacatccagaccctgctctctagaatggagtgtcgtggcggacctcaaccccagcacagccagccgcctccccagcccccagccgttacccccgagcctgtggctttgagttcccaaacgagcgagccagtcgaaagcgaagcaccgccacgggaaccgatggaagccgaagaagttgaagagagggcccctgctcaaaatcctgagttgacccccggtccagcccctgcaggccctactcccgctcctgaaacaaacgctcctaaccatccatctccagcggagtacgtcgaggtgctccaggaattgcagcgcctggaatcccgcctgcaaccattcctgcaacggtactatgaggtgttgggagctgcggctacgactgattacaataacaaccacgagggacgggaagaagatcagcgcctgattaaccttgttggggagtccctgcgtctgttgggcaatacctttgtcgcactgagcgacctcagatgtaatctggcatgcactccgccacgccacttgcatgtggttaggcccatgagccattatacaactcccatggtgctgcagcaggcagccatcccgattcaaatcaacgtgggtactacggtgacaatgactgggaacggcacccgccctccgccaactcccaatgcggaggcacccccacctggccctgggcaggctagttccgtggcaccgtcaagtaccaacgtggagagcagcgccgagggagccccacctcctgggccagcgcctccacctgctaccagccaccctagagtgattcggatatcccaccagtccgtagaacccgtggtgatgatgcatatgaatattcaggattccggaactcaaccgggaggcgtgccctccgctccaacaggcccactgggacccccaggacatgggcaaacccttggccaacaggtgccaggcttccccactgcccctacccgggtagtgattgcacgacccactccacctcaagcccgtccatcccatcctggcggacctcccgtttcaggaaccctgcaaggggcaggcctggggaccaacgctagcttggcgcagatggtatcaggtctggtagggcaactgctaatgcagcctgtgcttgtcgctcagggaactcccggaatggctcccccacctgctcccgctacagcctctgcaagcgcaggaactaccaatacagcgacgacagctggaccagccccaggagggcctgcacagccacctccgaccccacagcctagcatggctgacctccagttcagtcagctgctgggcaacttgctcggtcccgctggccctggcgctggcggacccggagttgcttctcccacaatcactgtggctatgccaggggttcctgcattcctacaaggaatgacagatttcctgcaggccacccagactgcgccacctcctccaccccctccacctccccctcctcctgctccagaacagcaaacaatgccaccacccggatccccaagcgggggagccggatcacccggtggtttgggtctagagtcacttagcccagagttctttactagcgtcgtacagggagtcctcagctctctgcttggctctcttggcgcacgtgcaggaagctcagaatccatcgccgcttttatacagagactctctggttcaagtaacatcttcgagcccggtgccgatggggcactcggctttttcggggctcttttgtccctgttgtgtcagaatttctcaatggtcgatgtcgtcatgctgctgcacggccatttccaacctctgcaaaggctgcaaccccaattgcgtagcttttttcatcagcactacctgggaggccaggaacccacgccatccaacatccgtatggcaacccacaccctcatcacagggctggaagaatatgtccgtgaatcattctcccttgtgcaagtacagccaggagttgacattataagaactaacctcgaatttcttcaggagcagttcaatagtatcgccgcacatgtgcttcattgcactgattctggtttcggtgcccgactgcttgaactctgtaatcaaggtctctttgagtgcctcgcacttaacctgcattgcctaggtggacagcagatggagctggcagccgtaatcaatgggaggatacggagaatgtcccgaggagtgaacccgtcactcgtgagctggctaaccaccatgatgggtctgaggctgcaggtcgtgctggaacacatgccagtcgggccagatgctattctcagatacgttcgcagggttggagatcccccacagccgcttcctgaggaaccaatggaagtacaaggagcagaaagagcaagcccagagccgcagcgagagaatgcctcacccgctcccggaacaaccgctgaggaagccatgagccgcggacctcctccagctcctgagggagggtccagagatgaacaagacggtgcgagcgctgagaccgagccttgggccgcagcggtgccccctgaatgggtccctatcatccagcaggacattcagagtcagcgcaaggtcaaaccccagccacctctaagtgatgcctatctgtctggcatgccagctaagagacggaaaacaatgcaaggagaagggccacagttactcttatctgaggctgtctcacgagcggctaaggccgcaggggctaggccgcttacatctccagaatcactgagccgcgacctagaagcccctgaagtgcaggagtcttaccgccagcagttgcggtccgacattcagaaacggctgcaggaagatccaaattacagtccgcagcggttccccaacgctcagcgcgctttcgccgacgatccctag

SEQ ID NO: 215771 - DNA, 411 bp, Artificial Sequence
  Description of Artificial Sequence: Synthetic coding sequence
tagcgtatgtcaaggggtgtcaacccatctctggtgtcatggctcacaaccatgatggggcttcggctgcaggtggtgctcgagcacatgccagtcgggcctgacgcaatactgcgatatgtgcggagagtgggtgatcctcctcaacccctgccagaggagccgatggaggtgcagggagccgagcgagcatcgcctgagcctcaggagtgggtgcccattatccaacaggacatccagagccaacggaaagtgaagccacagcccccattgtctgacgcttatttgtcaggaatgccagctaaacggaggaagctgcggtccgacatccaaaagaggctgcaagaggaccctaactatagtccgcagagattcccaaacgcacagcgcgctttcgccgacgatccgtag

SEQ ID NO: 215772 - DNA, 648 bp, Artificial Sequence
  Description of Artificial Sequence: Synthetic coding sequence
atggagccaaacgatagtacatcaaccgccgtggaagagccggactcactcgaggtgctggtgaagactctcgattcacagacccggaccttcattgtgggtgcacagatgaacgtgaaggagtttaaagagcatatcgcagctagcgtgagcattcccagtgagaagcagagattgatttatcagggtcgagtgctgcaggacgataagaagctccaggaatacaatgtggggggtaaagtaatccacctcgtcgagagagctccgcctcagactcacctgccgtcaggtgcgtcatctggaaccggatccgcttctgccacacatgggggaggctcaccacctggtactagggggcctggcgcatctgtgcatgatcggaacgcgaactcttacgtcatggttggaactttcaatctccccagcgagcccagagtgcgtctggtcatggcgcagcacatgattcgcgatattcagactctgttatccagaatggagtgtcgcggtggacctcaaccgcagcattcccaaccgcctccccagccacctgctgttactccagagccagtggcgctgtcctcccagactagcgaacccgtggagtctgaagctccccctcgcgaaccgatggaggcagaggaggtttag

SEQ ID NO: 215773 - DNA, 594 bp, Artificial Sequence
  Description of Artificial Sequence: Synthetic coding sequence
atggaacctaacgattcgacgagtaccgcagtcgaggaacctgattctttggaggttctcgtgaagactctcgatagtcagaccaggacctttatagtcggcgcacagatgaacgtaaaagaattcaaggaacatatagcagcctccgtgtccataccatctgaaaagcagaggctgatctaccaggggcgagtcctgcaggatgataagaagcttcaggagtacaatgtaggaggcaaggtgatccatctggttgagcgggctcctccccagacgcatttacccagcggggcaagttcagggacagggtccgctagcgcgacccacgggggaggctctcccccaggaacccggggacccggtgctagcgtgcacgacaggaacgccaatagctatgtgatggttgggacttttaacctgccctcggacggctctgcagtcgacgtccatattaatatggagcaagcgccaatccagagcgagcccagagtgagacttgtgatggctcagcatatgattagggatattcagactcttctttccaggatggagtgtaggggcggaccccagccccagcattcccagcccccatag

SEQ ID NO: 215774 - DNA, 1548 bp, Artificial Sequence
  Description of Artificial Sequence: Synthetic coding sequence
atggaacctaacgatagcacctctacagccgtggaagagcccgactcgctggaggtgctggtcaagacacttgattcccagacacgtactttcattgtgggcgctcagatgaatgtgaaagaattcaaagagcacatcgctgcctctgtatccattccatcagaaaagcaaaggctgatataccaagggagggtgctgcaggatgataagaagctccaagagtataacgtgggtggcaaggtcatccatctcgtggagagggcccctcctcagactcacctgccctccggagcatcctcaggaacaggaagtgcctccgccacacatggaggcggttcgcccccagggacccgaggaccaggcgcatctgtgcacgaccggaatgccaactcttacgtaatggtaggtactttcaacctaccgtctgatggctcggctgtcgacgtgcacataaatatggagcaggcacctatccagtctgagccacgtgtcagattagtgatggcacagcacatgattcgcgatatacagacactactttcaaggatggagtgccgcggaggaccccagccccaacactcgcagccgccaccacagcctccagcagtgacgccagaacctgtcgctctcagtagtcagacgagcgaacccgtagagtcggaagctccccctagagagccaatggaggcggaggaagtggaggagagagctccagcccagaatcctgagttaacaccagggcctgctcctgccggtcctacaccagcacctgaaaccaatgcccctaatcaccctagccctgcagagtacgtggaagtattgcaagagttgcaaagactggagtcacggctgcaaccattcctccagagatactacgaagtgctcggagccgcagcgaccacagactacaacaacaaccatgagggaagggaggaggaccagagattgattaacttggtcggagaaagtcttagacttttaggcaataccttcgttgctttatctgacctgcgctgcaacctagcctgtaccccaccgagacatctgcatgttgtcaggccgatgtcccactatactaccccgatggtgcttcagcaggcggctattcctatccagataaatgtcggcaccacagtgactatgactggaaacggcacacgccctccacccaccccaaatgcggaagctccaccaccaggaccgggacaggcaagttcagtcgcgccaagctctacaaatgtggaatcctcagcagaaggagccccaccacctggtcccgcacccccacctgccacctcccacccacgcgtcatcagaatcagccaccagagtgtggaacccgtggtcatgatgcatatgaatattcaggattccggcacccagccagggggagttccctcagctccaactggaccactggggcctcccggacacggacagaccctggggtccacactgatccaactgccctctctccctcccgagttcatgcacgcggttgctcaccagattacccatcaggccatggttgctgccgttgcttcctag

SEQ ID NO: 215775 - DNA, 738 bp, Artificial Sequence
  Description of Artificial Sequence: Synthetic coding sequence
ccgcctagacatctgcacgttgtgcgcccaatgtcccattacaccacgcctatggtcctgcagcaggcagccataccaattcagatcaacgtggggacaacagtcacaatgactgggccagcacctccacccgcaaccagtcatcctagagtgatccggatctcccaccagagtgtcgagccagtagttatgatgcatatgaacatccaggacagtggcacccaaccgggaggtgtgccatccgccccaactggccctctcgggcctcctggtcacggtcagactctaggtcaacaggtgccaggtttcccaaccgcgcctactcgcgtggtaatagcaagacccacacccccacaggccaggccgtcccatcccggaggacccccagtgtcaggtacgctgcagggcgcaggcttagggacaaacgccagtcttgcccaaatggtgtctggactggtgggccagttgttgatgcagcccgtactggtagcacagggcacgcccggtatggcgccaccacctgccccagctacagctagtgcatcggctggcaccactaatactgctactaccgcaggtcccgctcccggaggccctgcacagccaccgccaacaccacagcccagcatggccgaccttcagttctcgcagctgctaggaaacctactgggacccgctgggccaggcgctggaggtccaggagtggccagccctactataacagtggcaatgccatag

SEQ ID NO: 215776 - DNA, 738 bp, Artificial Sequence
  Description of Artificial Sequence: Synthetic coding sequence
cctcctcggcatctgcacgtggtgagacccatgtctcactatacaacacctatggttctacagcaggcagcaatcccgattcagatcaacgttggcaccactgtgacaatgaccggcccagcccctcctcccgcaacttcccatcccagggtcatcagaattagtcaccagtcagtggagccagtcgtaatgatgcacatgaacattcaggactccgggacacagcccggtggagtgccaagtgccccaacgggaccgctaggaccccctgggcacggccagactctggggcagcaggttccgggattccctacagcccctacccgagtcgttatagcaaggcctactcctccacaggcacggccatctcaccctggaggcccacctgtttctgggactctccagggggctggcctgggtaccaatgcatctctggcccagatggtctctgggttagtcggccaactcctgatgcagcccgttctggtagcccagggaacacccggtatggctccccctcccgcacccgctaccgcatccgcaagcgctggtactaccaacacagctactacggccggacccgctcctggtggacccgcacagcccccaccaactccgcagccatctatggctgacctccagtttagtcagctcctcggcaacctgttaggccctgccggaccgggtgctgggggttcaggagtcgccagtccaactatcaccgtcgctatgccatag

SEQ ID NO: 215777 - DNA, 777 bp, Artificial Sequence
  Description of Artificial Sequence: Synthetic coding sequence
atggagccaaatgactcgacatccacagcggtcgaggagccagattcattggaggtgctagtaaagaccctcgattctcaaaccagaacttttattgtgggcgcacagatgaacgttaaagaatttaaagagcacatcgcagctagtgtgagcatccccagcgagaagcagcgcctgatttatcagggtcgtgtacttcaggatgacaagaagctgcaggagtacaacgtcggtggcaaagtgattcatctggtggagcgtgcacccccacaaacacatctgccttcaggggcatcctcaggtacgggcagcgcctctgccacacacggcggaggctcacccccaggaactagaggaccaggtgcatcagtgcacgaccggaacgccaacagttacgtgatggtcggcacattcaatctgcctagcgacggaagtgcggtggacgtgcacatcaatatggagcaggccccaatacagagtgagcctcgcgtgaggctcgtgatggctcagcacatgataagggatatccagaccctgttgtcccgcatggagtgccgaggtggacctcagcctcaacactcacaaccaccacctcaaccgcctgctgtaactccagagccagtggccctgagcagccaaacatctgagcctgtagagtctgaagcaccaccaagggaaccaatggaggctgaagaagtggaggagcgcgcaccagctcagaatcctgagctgacacccggacccgctcccgctgggcctacccctgctccggaatag

SEQ ID NO: 215778 - DNA, 789 bp, Artificial Sequence
  Description of Artificial Sequence: Synthetic coding sequence
atggagccgaatgacagtacctccactgccgtggaggaaccagatagcctggaggtgcttgtgaaaaccctggactcacagacgaggaccttcattgtgggggctcagatgaacgtaaaggagttcaaagaacacattgccgcaagtgtgagcattccttccgagaagcaacgcctcatctatcagggaagggtgttgcaggatgacaaaaaactccaggagtataatgtaggtggtaaagtgattcatctggtggagcgggctccgccacagactcatttgcctagcggcgcatcatctggcactggatctgccagcgccactcacggtgggggtagcccgcctggcacgagaggccctggggcaagcgtgcacgataggaatgcaaactcctatgttatggtcggaacctttaatctaccatcggatggttcagcagtagacgttcacataaatatggaacaggcacccattcaaagtgagccacgagtccgattagttatggcacaacacatgattagggatatccaaacactgctttcacgcatggagtgccggggagggcctcagcctcaacacagccagccaccccctcagcctcccgctgttacaccggaacccgtagctctaagctcacagacttcagagcctgttgaaagcgaggcaccacccagagagcctatggaagctgaggaggtggaggaaagagcccctgcccagaacccggagctgacaccgggtccagcacctgctggccctacaccagctccagagacgaatgctccttag

SEQ ID NO: 215779 - DNA, 2232 bp, Artificial Sequence
  Description of Artificial Sequence: Synthetic coding sequence
atggaacctaacgactcaactagtacagccgtggaggaacccgattcccttgaggtgttggtcaagactctagattctcagacccggacattcattgtgggtgctcagatgaatgtgaaggagttcaaggaacacatagcagctagtgtgtctatccccagcgagaaacagagactcatctatcagggtcgcgtgctgcaggacgataaaaaactccaggagtacaacgtggggggtaaggtgattcacttggttgaaagggccccacctcaaacccacctgcctagtggtgcatccagcggtaccggttctgcctctgctacacacggaggcggttcccctccgggtactcgcggtcccggtgcttccgtgcatgacagaaatgccaattcctatgtgatggtgggcacctttaacttgccaagcgatggatccgccgttgatgtccatataaatatggaacaggcacctatccagtcggaaccgagagttaggctggtgatggcgcagcacatgattcgggacatacaaacgcttctcagcagaatggaatgtcgcggaggcccacaaccccaacattcacagcctcctcctcagccacccgcagtgacacctgaacccgtcgccttaagctctcaaacctccgaacctgtggaatccgaggctcccccaagagaaccgatggaggcggaggaggtggaggagcgagcccctgctcagaatccagagctaacccccggtcctgcgcctgctggtcccacacccgcaccggagacaaacgccccaaaccacccatcccccgcagagtacgtggaagtgctccaagagttgcagcgcctggaatcaagactgcagccttttctacagcgctactatgaggttctaggagcagcggcaaccactgattacaataataatcatgaggggagggaggaagaccagagattgatcaatctggtgggggaatcacttaggctgctgggcaacacttttgtggccctctccgatctgaggtgtaatctggcctgcaccccaccccgacacctgcacgtcgtccggccaatgagtcactatacaacacccatggtcctccagcaggctgccatccccatacagatcaatgttggcaccaccgtcaccatgactgggaacgggacacgcccaccacccacccctaacgcagaagcacctccacctggacccggtcaggcatcctccgtcgcaccatcttcaaccaacgtagaaagtagtgcagagggggcacctccgcctggccctgcacctcccccagccacttctcaccccagggtcatccgaatatcccaccagagtgttgaacctgtggtgatgatgcacatgaacatccaagattcaggaactcagcccggtggcgtcccatccgcccctaccgggcctcttggccctcctggtcacggacagaccttgggcagcacactcatacagctgccttccctgccaccagaatttatgcacgccgtcgcccatcagattactcatcaggcaatggtcgctgcagtggcttccgccgctgcgggacagcaagtgcccggattccccacggcacctacaagggtggtcatcgcaagacctactcccccacaggcaagaccttcacaccccggaggccctcctgtgtctggtaccctgcagggggctgggcttggcactaatgctagtcttgcccagatggtgagcgggctggtcggtcagcttctaatgcagccggtcctcgtggcccagggcactcccggaatggcgcctccacctgccccagccaccgcgagtgccagtgcaggaacgacgaacaccgctactacagcaggcccagctccaggtggccctgcgcagccgcctcctacacctcagccaagcatggccgatctgcagttctctcagcttctgggaaatctgctgggtcccgctgggccaggtgctggcggtagcggagttgcatcaccgaccattacagtagctatgcctggagtgcccgctttcctgcagggtatgactgattttctccaggcaacacagacagctccaccccctcctcctccacctccgccacctcctccagctcctgagcagcagactatgcctccaccaggatcacctagcggaggggctggctcacccggaggattgggcctggagagcctcagtccagaattctttacttcggtagtgcagggagtactctctagcctgctttag

SEQ ID NO: 215780 - DNA, 777 bp, Artificial Sequence
  Description of Artificial Sequence: Synthetic coding sequence
atggagccaaacgactctactagcacggctgtggaagagcctgatagcctggaggtgctcgtcaagacccttgactcacagactcggacattcatcgtgggagcgcagatgaatgtgaaagagttcaaggaacacatcgccgcaagcgtgagcataccctctgaaaaacaaagattaatataccaggggagagtgctgcaggacgacaagaagctgcaggaatacaacgtggggggtaaagtcattcacctggtcgagcgtgcgccaccacaaactcacctgccaagtggtgcctcctccgggactggatctgctagcgccactcacggcggtgggtccccacctggaacaagaggtccaggggcttcagtccatgataggaacgccaacagctacgttatggtcggtaccttcaacctgcccagtgatggtagcgccgtcgacgtccacatcaatatggaacaagcaccaattcagagcgaacctagggtgagactggtgatggcgcagcacatgataagggatatccagacactgttgagtagaatggagtgccgcggaggcccacagccgcagcacagccagcccccaccccagccaccggctgttactccagagcccgtcgcgctctcaagccaaacttcagagccagtggagtccgaggctcccccacgggaaccaatggaggccgaagaagtagaggagagggctccggctcaaaatccagagctgacccccggacctgccccagccggacctacccctgctccagagtag

SEQ ID NO: 215781 - DNA, 558 bp, Artificial Sequence
  Description of Artificial Sequence: Synthetic coding sequence
taattagcatgtacaccgccacgccatctgcacgtggtcaggccgatgtcccactatacaactcccatggtattgcagcaagccgcaatacctatccagattaacgtaggtacaaccgtcacaatgaccggcaatggtaccaggcccccacccactccaaatgccgaggccccacctcctggcccagggcaggcttcttccgtagccccttcctcaacaaatgttgagtccagcgcagaaggcgcaccacctcctgggccagctcccccacccgcaacctcccatcccagagtgatccggatcagccatcagagcgtggaaccggtagtgatgatgcacatgaacatccaggggcagcaagttccagggttcccaacagctcctacccgagttgtcatagcccgtcctacaccaccacaggcgagaccgagccatcccggagggcctccagtcagtggtactctgcagggcgctggccttggcaccaacgcgtcccttgcacagatggtttccgggctcgtcggccagctgctgatgcagcctgtcctcgtcgcatag

SEQ ID NO: 215782 - DNA, 648 bp, Artificial Sequence
  Description of Artificial Sequence: Synthetic coding sequence
atggaacccaacgatagcacatccacggctgtcgaagagccagacagtctcgaagtgctggtgaagactctggatagtcagacacgtacattcattgttggcgctcagatgaacgtcaaagaatttaaggaacacattgcagcctccgtgtccattcctagtgaaaaacaaaggctgatctaccagggcagagtgttgcaggatgataaaaaattacaggaatataacgtaggaggtaaagttattcatttggttgaacgagcaccaccacagacccatctgccttctggcgcatctagtggcactggctccgcatcagcaacccacgggggaggatcaccccctgggactcggggacccggagcgagtgtccatgataggaacgctaactcctacgtgatggttggaacttttaaccttccatctgagccaagagtgcgattggtgatggcccagcacatgatacgcgatattcaaaccttgctgagcaggatggagtgcaggggaggccctcagcctcaacatagccagccccctccccaaccacctgccgtgacgcccgagccagtcgcgctctcctcccaaacaagcgaaccagtggagagtgaagcccctcctagagagccaatggaggcagaggaagtatag

SEQ ID NO: 215783 - DNA, 780 bp, Artificial Sequence
  Description of Artificial Sequence: Synthetic coding sequence
atggaacctaacgattctacgagcaccgccgtagaagaaccagactccctcgaggttctcgtcaaaacccttgactcacagacacgaaccttcattgtcggcgcacaaatgaacgtcaaagagttcaaggaacatattgctgcatcagtgtccataccttcagagaagcagcggttaatctatcagggtagagtgcttcaggacgataagaagttgcaggaatataacgtcgggggaaaggttatccatctagtggagagggctcctccccaaactcacctcccctctggtgcatcctcgggcaccggaagtgcttccgccacacatgggggtgggagcccgccaggaacccgcggacccggtgcgtcagtacacgacagaaatgctaacagttatgtcatggtaggaacatttaacttgccctcggatggctcagccgtggacgttcacatcaacatggagcaggctcccatccagtccgagcccagagttaggctcgtaatggcccagcatatgattcgcgacatccagactcttctttcccgaatggagtgtcgtgggggtccccagcctcagcattctcagcccccacctcagccacccgctgttacaccagaaccagttgcactgagctcacaaacaagcgaacctgttgagagtgaggctccgccaagagagcccatggaggccgaagaggtggaagaaagggctccagctcagaaccccgagttgacacccggaccagctcccgctggtccaaccccagcccctgaaacatag

SEQ ID NO: 215784 - DNA, 477 bp, Artificial Sequence
  Description of Artificial Sequence: Synthetic coding sequence
atggaacctaacgatagcacctcaactgccgtcgaagaacctgattcactggaggtgctcgtgaaaactttagactctcagacgaggacctttatagtgggcgctcagatgaacgttaaagagtttaaggagcatattgccgcttccgtcagcataccctccgagaaacagcgcttaatctatcaaggtagagtgcttcaggacgataaaaagctccaggaatacaacgtgggtggcaaggtaattcacctcgtggagagggctcccccacaaacccatctgccttcaggggcaagctctggaacaggaagcgcaagtgcgactcacggcggtggttcccctccgggaaccagaggcccaggggcatccgtgcacgatagaaacgctaacagctacgttatggtggggacctttaacttgccctccgacggttctgccgtcgatgtccacatcaatatggagcaggcccctatttag

SEQ ID NO: 215785 - DNA, 621 bp, Artificial Sequence
  Description of Artificial Sequence: Synthetic coding sequence
atggagcccaacgactctacctcaactgccgtggaggaacccgacagtcttgaggtcttggtcaagactctcgacagtcaaaccagaacattcatagttggggctcagatgaacgtcaaggaatttaaggaacacattgcggcttctgtcagcatcccgagcgagaaacaacgactgatttatcagggtcgagtcctccaagacgacaagaaactccaggaatacaatgtcggagggaaggtgatccacctcgttgagcgtgctccacctcagacccatcttccatcaggtgcaagctctggaaccggatctgcttcagccacgcatggtgggggatccccacctgggactcggggtcccggtgcctctgtccatgacagaaacgccaatagttacgtgatggtgggcacttttaacctcccctccgaacctagggtccgtctggttatggcccagcatatgatccgtgacatacagacgctactctctagaatggagtgcagagggggacctcagccccaacattcgcaaccgcctccacagcctccggcagttacaccagaaccggtcgcactgtccagccagacctccgaaccagtggagagcgaagcacccccttag

SEQ ID NO: 215786 - DNA, 2232 bp, Artificial Sequence
  Description of Artificial Sequence: Synthetic coding sequence
atggaacctaatgacagtacctctaccgcagtggaagaaccagatagcctagaggttttagtaaagactctcgattcccagacccggacctttatcgtaggtgcccagatgaacgtgaaggaatttaaagagcatatcgcagcctctgtctcaatacctagcgagaaacaacgcctgatttaccaggggagagtgcttcaggacgataagaaactgcaggaatacaacgtgggcggaaaggtgatacatctggtcgaacgggcaccacctcagacacacctcccttccggcgctagctctggaactggctcagcctccgcaactcacggcggaggcagtcccccaggtaccaggggtccaggggcatccgttcatgaccgcaacgccaattcttatgttatggtaggcacattcaacctgccgtccgacggctccgcagtggatgtgcacatcaacatggagcaggcccctattcagagcgaacctagagttagattagttatggcccagcacatgatccgagacatccagaccctgttatccagaatggagtgtcgcggaggcccacagccacagcatagtcagccaccgccacagcccccagccgtgacacctgaaccagtggccttgtcatctcagacatccgagcctgtcgaaagtgaggcgccacccagggagcctatggaggccgaagaagtggaggagcgtgcccctgcgcaaaacccggagcttacccccggtcctgccccagcgggacctacacccgctcctgaaaccaatgctcctaatcaccctagtcctgccgagtatgttgaggtcctgcaggaattacaacggctggagagcaggcttcagccattcttgcaaagatactacgaagtcctgggtgctgcagccacaacagactataataacaatcacgaaggccgtgaagaagaccaacgtctcatcaatttagttggcgagagcctcaggctcctgggtaatacattcgttgcactgtccgacctccgatgcaacctagcttgcacgcctccacgacatctgcatgttgtacggccaatgtcccactacaccacacccatggtgctgcagcaagcagctattcccatacaaattaatgtaggcaccaccgttacgatgaccggaaatggcacacgtccccctccaactccgaatgccgaggctcccccacctggccctgggcaggcttcctcagtcgcaccaagcagcacaaacgtcgagagcagcgccgaaggagcccctcccccaggtccagcccctcctcccgctacttcccatcctagagtaatcaggatctcccaccagtccgtggagcctgtggtcatgatgcacatgaatatccaggatagcggcactcagcctggcggagtgccatccgcccctaccggccctctggggcctcccggacacggccaaacattggggtctaccctgatccagctgccctcgctcccacccgagttcatgcacgcagtggcacaccagatcacgcaccaggccatggttgctgcagttgctagcgcagccgctggtcagcaggtgccaggttttcctactgctcccactagggtcgtaattgctcggcctactccaccccaagcgagacctagccaccccggaggccctcctgtctctggaacactgcagggggctggtcttggtaccaatgcgtccctggcacaaatggtgtccggactggtgggacaactgcttatgcagcccgtgcttgtggctcagggtactccaggtatggctccaccccctgcgccagccacggccagcgcctccgccggtactacaaatacagccaccactgcaggacctgcacctggaggccctgctcagcctcccccaacccctcagccaagtatggcagatctacaattttcacagctcctgggcaacctgcttgggccagctggaccgggagcgggaggcagcggtgtcgccagcccgaccattaccgtggccatgcccggagtgccagcctttctccaggggatgactgacttcctgcaggccacacagacagcccctccccctccccctccacccccacctcctccaccggctcctgaacagcagaccatgcctccgccaggctcacctagtggaggcgcaggatctcccggtggcttgggccttgagtccttgagtcccgaatttttcacgagcgtggtacagggagtactcagctcgctgttgtag

SEQ ID NO: 215787 - DNA, 681 bp, Artificial Sequence
  Description of Artificial Sequence: Synthetic coding sequence
taatccggcttcggagcccgactgctggagttatgtaaccaggggctgttcgagtgcctggccctgaatctccattgcttggggggacagcagatggaactagctgctgttataaacggcaggatcaggcggatgagcagaggggtcaatccttccttggtgagttggttgacaaccatgatgggcctcaggttacaggtcgtgttagagcatatgcccgtcggccctgacgccattctgcggtatgtgaggagagtcggcgacccccctcagcctctccccgaagagcccatggaagtgcagggcgcagaacgggctagtcctgaacctcagcgcgagaacgctagtccagccccaggcacaaccgccgaagaggccatgtcacggggacctccacctgcaccagaaggcggaagtagagacgagcaggacggggctagcgctgagactgagccgtgggccgctgccgtgccaccggagtgggtccctattatccagcaggatatacagtctcagcgaaaagtgaaacctcagccacccctttccgacgcctacctgtccggaatgcccgcaaaacggcgaaagctgaggtccgacattcagaaacgcctgcaggaggatcctaactattctccgcaaaggtttccaaacgcacagcgagctttcgccgatgacccttag

SEQ ID NO: 215788 - DNA, 594 bp, Artificial Sequence
  Description of Artificial Sequence: Synthetic coding sequence
atggagcccaacgacagcacttctaccgctgtggaggagcctgattcgctcgaggtcctcgtcaaaacgcttgactctcagacccgcacctttatcgtcggcgctcagatgaacgtcaaagagtttaaggagcacatcgccgcttccgtgagtatccccagcgaaaaacagcggctgatttatcaagggagagttctacaagatgacaaaaagcttcaagagtacaacgtaggcggaaaggtcatacacctggtggagcgcgctcctccccaaactcacctcccttcaggagcctcatccggcacagggtccgccagcgccacccacgggggtggatcccccccaggtacacgagggccaggtgcgtctgtgcacgatagaaatgccaattcttatgtaatggtaggaaccttcaacctcccgagcgatggcagtgctgtcgacgtgcacatcaatatggagcaggcccctatccagagcgagcccagggtgaggttagtgatggcccagcacatgatcagagatatccagacgttactttctcgtatggagtgcaggggcggaccccagcctcaacactcacaaccaccttag

SEQ ID NO: 215789 - DNA, 717 bp, Artificial Sequence
  Description of Artificial Sequence: Synthetic coding sequence
agctctgctgaaggggcacccccacccggtccagcccctcctccagctacttcacatcctagggtcatccggatttcacatcaaagtgtcgagcctgtcgtgatgatgcacatgaacatccaggggccactgtccctatcaccttgtccagacagtgggacccagccaggaggcgttccgagtgctcccacagggccacttggcccaccaggacacggtcagacgctggggcagcaggtgcctggattccccaccgccccaacgcgggtggtcattgcaaggcccacccccccacaagcaaggcctagccaccctgggggtccacctgtaagcggaaccctgcagggcgcaggacttggaactaatgcatccttagcacagatggtgtcaggattggttggacagctgttgatgcaacctgtcctcgtggcgcagggcacgcctggaatggcacctccacccgcacccgcaaccgctagtgcaagcgctggcactaccaatacggccacgacagctgggcctgctcccggaggacccgctcaacctccccctacgcctcaacccagtatggccgacctgcagttttcccagctcttaggtaacctgctgggccctgctgggcctggcgcaggcggatcgggggtagcctcgccaaccattactgtcgctatgcccggtgtgcctgcttttctccaaggcatgacagatttcctctag

SEQ ID NO: 215790 - DNA, 735 bp, Artificial Sequence
  Description of Artificial Sequence: Synthetic coding sequence
atggaacccaatgacagtacctctactgctgtcgaggaaccggatagtttggaggtcctggtgaagactctggatagtcagaccagaacgttcattgtgggggctcagatgaacgtgaaggagtttaaagagcacattgctgccagcgtttctatcccctcagagaaacagaggcttatctatcaaggtcgggttctgcaagacgataagaagctgcaggagtacaatgtgggtggaaaggtgattcacttggtagaacgagctcctccacagacccacctgccctcaggggcttcttccggcacagggtccgcttccgcaacacacgggggtggctcccccccaggcacaaggggtcccggtgcatcagtgcacgaccggaatgcaaacagctacgtgatggtgggaacgtttaatttgccatcagaaccacgagtgcgactggttatggctcagcatatgataagagacatccagaccttgctgagccgcatggaatgccgcggagggcctcagccacagcactcccaaccaccaccacagcctccagcagtgacacctgaaccagtagcgttgagctctcaaacaagtgaacctgtggaaagcgaagcccctcctagggagccgatggaagcagaggaggtggaggaaagagcccctgcccagaatcccgagctgactcctgggccagccccagccggaccaacccccgcacccgaaacgaatgcaccttag

SEQ ID NO: 215791 - DNA, 789 bp, Artificial Sequence
  Description of Artificial Sequence: Synthetic coding sequence
atggagcccaatgactccacatcaaccgcagtggaagaaccagactcgctggaagtcctggtgaagactctagacagtcagactagaacatttattgttggagctcaaatgaacgtaaaggaattcaaagaacacattgccgcaagcgtgtcgataccatccgaaaagcaacggctcatataccagggacgggttctccaggacgacaagaaacttcaggagtataacgtcggaggaaaagttatacatttggttgaacgggcaccgcctcagacacacctcccctctggagcctcttccggaactggctccgccagcgcgactcatggtggtgggtcccctccaggaaccagagggccaggcgcaagtgtgcatgatcgcaacgccaacagttatgtgatggtcggcacttttaacctcccgagcgatgggtctgccgtggacgtccacataaacatggagcaggccccaatccaatccgaacccagagttcggctggttatggcccagcatatgataagggatattcagaccttgcttagtcgtatggagtgtagagggggacctcagccccagcatagccagcccccaccacagcctccggctgtcactccagaacctgtggcattatctagtcagacttcagagcccgtggagagcgaggccccaccacgtgagcccatggaggccgaggaagtagaggagcgagcgcctgctcagaatcctgaactcactccaggcccagcacctgccggacccacaccggcacccgaaaccaatgcaccatag

SEQ ID NO: 215792 - DNA, 2232 bp, Artificial Sequence
  Description of Artificial Sequence: Synthetic coding sequence
atggaacctaatgatagtacatctacagccgtggaggagcccgatagtctggaggtacttgtgaagaccctggattcacagacacggaccttcatagttggggctcagatgaacgtgaaagagtttaaggaacatatcgctgccagtgtcagcataccttccgaaaaacagagacttatctaccaaggtagggtcctgcaggatgacaaaaaactgcaggagtacaacgtgggaggcaaggtgatacacctggttgagcgcgctccgcctcagacacacctgccttcgggtgcttcatctgggactggatcagcttcagccactcacggtggcggatctcccccagggactcgcggacctggtgcgtcagtccacgaccgaaatgccaacagttatgttatggtgggaacctttaacctgccttcagatggctctgccgtggacgtgcatattaacatggagcaggccccaatccagagtgaacccagagtcaggctggtgatggcacaacacatgattagagatattcagacgttattaagtcgaatggagtgcagaggtgggcctcagcctcagcactcccagcccccaccacagccgccagccgtcactccagagcctgtcgctctgagttcccagacgagtgaacctgtggagtctgaggccccaccccgtgagcccatggaggctgaagaggtggaagagagagccccagcccagaaccctgaacttacccccggaccagcacctgccggacccaccccagccccagagacaaatgcaccaaaccacccctctcccgctgagtacgtggaggtgctgcaagagctgcagcgcctcgaatctcggctacagccctttctacagaggtactacgaggtgctgggggcagctgccacgactgattacaataataatcatgagggtagggaggaagatcagcggctgataaatctcgttggtgagtccctgcgactcctggggaacacgttcgttgcactctctgacctgagatgtaaccttgcctgtactccaccccgacacctgcatgtggtgcgacccatgtcccattacacaacccccatggtgctccagcaagctgctattcccattcagataaacgtgggaaccaccgtgacaatgacaggtaacggaactcgccctcctcccacccctaacgctgaggctccaccccctggcccaggccaggcgtcaagcgttgcaccctcttctaccaacgtagagtctagcgctgagggagctcccccaccaggaccagccccaccacccgctacctcccatcctcgcgtcatccggatcagtcaccaatctgtagagccggtcgtgatgatgcatatgaacattcaggactctggcacccagcctggtggagtccctagcgcaccaaccgggccactgggtcctcccggacacggtcagacactgggctcaacactcatacagttgccgagcctgccaccggagtttatgcacgccgtggctcaccagatcacacatcaggctatggtcgccgcagtggcttctgcagcggctggacaacaggtaccgggattccctacagctccaactagggtggtgatcgcaagacccacacctccgcaggctcgtccttcccatcctgggggtcccccagtgtcaggcactctgcaaggggcaggtctgggcacaaatgccagtctggcccagatggtctcaggcctggtgggccaactgctgatgcaaccggttcttgtagcacagggcacaccagggatggcccctccccctgcccctgcaacagcttccgctagcgcaggaaccactaacacagcgacaaccgccggtccagccccaggtggtcctgctcaacccccaccaacccctcaacccagcatggctgatctgcagttttctcagctcctgggaaacctcctgggtcctgccggacctggcgcaggagggccaggtgttgcgagtcctacaatcacagtcgcaatgcctggtgttcccgctttcttacagggaatgaccgacttcctacaggctacccagacagcccctcctccccctccaccacctcccccacctcctcccgcaccagagcaacaaactatgccccctcccggtagcccttccggaggcgctggatcaccgggtggactgggacttgagagtctaagtccagagttcttcacctcagtagttcagggggttctttcctctctcctgtag

SEQ ID NO: 215793 - DNA, 735 bp, Artificial Sequence
  Description of Artificial Sequence: Synthetic coding sequence
atggaaccgaacgattccactagtactgcagtagaggaacccgattctctggaagtgttagtaaaaacactggatagtcagacacgaacatttatcgtgggcgcacaaatgaacgtgaaggagttcaaggaacacattgccgcttctgtatcaataccatctgagaaacagaggttgatttaccagggcagggtactgcaagacgacaagaaactgcaggaatacaatgtcggaggaaaggttattcatttagtagaacgggcacctcctcagacccatctgcctagcggagccagctccggcaccggcagcgcctcagccacacatggaggcggatcccctcccggtactaggggacccggtgcttccgtccacgaccggaacgccaattcttacgtgatggtcgggacttttaaccttccgtccgaacctcgcgtcaggttagtcatggcacagcacatgatcagagacatacagacccttctgtcacggatggagtgcagaggagggcctcagccccagcactctcagcctccaccacagcctccagccgtgactccagaacccgtcgctttgtcttcacaaacttcggaaccggttgaaagcgaagctcctccacgcgaacccatggaagctgaagaagtagaagaacgcgcaccggctcagaatcccgaactcactccagggcctgctcctgctggcccaacccctgccccagagacaaacgccccttag

SEQ ID NO: 215794 - DNA, 789 bp, Artificial Sequence
  Description of Artificial Sequence: Synthetic coding sequence
atggagcccaatgatagcacttccacagctgtggaggaaccagattctcttgaagttttggtgaaaacacttgactcccagactcggacattcatcgtcggggcacaaatgaatgtcaaggagtttaaggagcatatagcagcatctgtgtccattccgtcagaaaaacagcggttaatttatcagggcagggtgctgcaggacgataaaaagctacaggaatataacgtgggcggtaaagtgattcatctcgtagagcgggcacctccacagacccacctaccctctggggcaagtagcggtacgggctcggctagcgcgacacacggcggaggtagccccccaggcacacggggaccaggagcctccgttcacgaccgcaacgctaattcgtacgtcatggttggcaccttcaatctgccaagtgatggttccgccgttgacgtacacattaatatggaacaggcaccaattcagtcggagcctcgggtgagactcgtgatggcccaacacatgatccgggatattcagacactgctatcccgcatggagtgccggggaggtccccagccacagcacagccagccacccccacagccgccagccgtgactcctgagcccgtggctctcagtagccagacctccgagcctgttgagtcggaagcccctccaagggaaccgatggaggcagaggaagttgaagaacgggcacctgcacaaaaccctgagctcactcctggccctgccccagcaggcccaaccccagctcccgagaccaacgccccatag

SEQ ID NO: 215795 - DNA, 2712 bp, Artificial Sequence
  Description of Artificial Sequence: Synthetic coding sequence
atggaacccaatgactctacttctacggcagtggaggagccggattctctggaagtcctggtgaagacactcgacagccagacacggacattcattgttggagcccagatgaatgtcaaagaattcaaggaacacatcgctgcctccgtgagcattccaagcgagaagcagaggctcatctatcaagggagggtcttgcaggatgacaaaaaactgcaggagtataacgttggaggtaaggtcatccaccttgtcgagcgcgctcccccacagacgcatttaccaagcggtgcgtcctcaggcaccggatcagcctctgctactcacgggggaggaagcccccctgggacccggggtccaggagcaagtgtgcacgaccgaaacgcgaacagctacgtaatggttggcacatttaatttaccaagtgatggatctgctgtcgatgtgcacattaacatggagcaggctccaatccagagtgagccacgtgtgcgcctggtcatggcccagcacatgatccgggatattcaaaccctgttgtcccgcatggaatgtcggggtggtcctcaaccacagcatagtcagcctccaccgcagccacccgcagtgacccctgagcccgtggcactttcgagccagacctctgagcccgtggagagcgaggctccccctagggagcccatggaagcagaggaggtagaagagagggcgccagctcagaacccagagcttactcctggtcccgctcctgcaggccctacaccagccccagagaccaatgcaccgaatcaccctagtcccgctgaatatgtggaggtcttgcaggaactgcagagactagaaagtcgcctgcagccatttctgcagcggtattatgaagtgctcggtgcagccgctaccacagactacaataataaccatgagggcagagaggaagaccaaaggctcatcaacttggttggagaaagtctgcgactgctgggaaacaccttcgttgccctgtcagatctgcggtgtaatcttgcctgcaccccgccaaggcatcttcacgtggttcgcccaatgtcacactataccacacccatggttcttcagcaggccgctattcccatccagatcaacgtgggaaccactgtcacgatgacggggaatggcactcggcctccccctactcccaacgccgaagcccctccccctggcccaggacaggcctctagtgtggctccgtcttcaactaatgttgagagtagtgcggagggagccccaccacctgggccagcccctccgccagccaccagtcaccctcgggtgattagaatttctcaccagtccgtggaacctgtggtaatgatgcacatgaatatccaagacagtggtacccaacccggaggcgtccccagtgcccctacaggacctctgggaccacctggtcacggccagaccttaggccagcaggtgcctgggtttcctacagctccgacaagggtggttatcgctcgccctacgcctcctcaagccagaccttcacacccgggagggcctccggtctcaggaacacttggcgcaggcctgggaaccaatgcatctctggcgcagatggtgtcggggctggtgggccaactcctgatgcagcccgttctggtagctcaagggaccccagggtcaccgggagggctcggtctggagtctttatcaccggagttttttacaagtgtggtgcagggcgtactcagtagcctcctgggatctctgggagcgagggccggtagcagtgagtctatcgcagcctttatacagcgcctctcaggatcgagcaacatttttgagcctggggctgacggcgctctaggatttttcggggcactattgagtctgctctgtcagaacttttccatggtagacgttgtgatgctgctgcatgggcacttccagccccttcaaaggctgcagccccagctacgttccttctttcatcaacattatctgggcggacaggagccgaccccttctaatatccgcatggctactcacacactgataactggattggaagagtatgtgcgggagtctttctctctggtgcaagtccagcctggagtggacatcataaggaccaatctggagttcctccaagagcagttcaacagcatagccgcacacgtccttcactgtactgacagtggatttggagccaggctgctggaactgtgtaaccagggtctttttgagtgtttagcactcaatctgcattgtctgggcggacagcaaatggagctggcggcagtgattaatggtagaattaggaggatgagccggggtgtgaatccctcactcgtttcatggctgactaccatgatgggcttacgcctgcaggtagttctagagcatatgcctgtgggccctgatgccatcctcagatacgtgcgcagggtgggcgatccaccacaaccactgcccgaggagccaatggaggttcagggtgcggagcgcgcttccccagagccccaggagtgggtcccaattatccagcaggacatccagtcccagcgcaaggtgaagcctcagccccctttgagcgacgcgtacctctctgggatgcccgctaaaaggcgcaagttgcgcagcgacatccagaaaagactgcaagaggatcctaattactcacctcagcggttccccaacgcccagcgagcgttcgcagatgacccttag

SEQ ID NO: 215796 - DNA, 558 bp, Artificial Sequence
  Description of Artificial Sequence: Synthetic coding sequence
taactcgcttgcacaccgccacggcatttgcacgtggtgcgcccaatgtcgcactataccacacctatggtcctacaacaggcagccatcccaatccagatcaatgtgggaactacagtcacaatgacaggaaatggcacaagacctcccccaaccccaaacgcggaagcccctcctcccggtcccggtcaggcgtcttccgtcgctccctccagcactaatgtagagtcttctgccgaaggcgcaccaccaccaggaccggcaccacctccggcaactagccatcctcgcgtgattagaattagtcaccagtcagttgagcctgtggtgatgatgcatatgaacatccaaggccagcaggtgcccggatttccaaccgctcctactagagtagtgatcgcgcgtccaaccccacctcaggccagaccttcccatccaggcggtcctcccgtgagtggaaccctccaaggggcagggcttgggacaaatgcctctcttgctcaaatggtgagcgggcttgtcggtcaactgctaatgcagccagtccttgtggcttag

SEQ ID NO: 215797 - DNA, 789 bp, Artificial Sequence
  Description of Artificial Sequence: Synthetic coding sequence
atggaaccaaatgactccactagtaccgcagtggaggagccagattctcttgaggttttggtgaagacactcgattcccagacgcgcacgttcatagtgggcgcacagatgaacgttaaagagtttaaggaacacattgccgcaagcgtgtccattcccagcgaaaagcagcggctcatttaccagggtcgggtgctgcaggatgacaaaaagcttcaggagtacaacgttggtggtaaggtaatacatttggtggaacgggcaccaccacagacgcacctacctagcggtgcttcgagtggaacaggctccgcaagtgctactcacgggggagggtcaccgcctggcacgcggggacccggagccagtgtacacgatcgaaatgccaatagttatgtgatggtcggcacatttaatttaccctcagacggcagcgcggtagacgtgcacattaatatggagcaggcacccatacagtcagagccaagggtccgactggtgatggcgcagcatatgattagagacatccagaccctgctatctagaatggaatgtcggggaggaccccagcctcagcacagccaaccccctccccagccaccggctgtcactcctgagcccgtagccctttctagtcagacatctgaacctgtcgagtcggaggccccacctcgggaacctatggaagctgaggaagtggaggaaagggcccctgcccagaaccccgagttgactcccggacccgctccagcaggccctacaccagctcctgaaaccaacgcaccctag

SEQ ID NO: 215798 - DNA, 621 bp, Artificial Sequence
  Description of Artificial Sequence: Synthetic coding sequence
atggagccgaatgattccacctcaacagctgtggaggaacctgactcactggaagtgttggtgaagacattagattcacagacacgcacatttatagtaggagcgcagatgaatgttaaggagttcaaggaacatatcgccgcatccgtgtccatcccttcagagaagcagcgcctgatctaccagggcagggtgttgcaggatgacaaaaagctacaagagtataacgttggtgggaaggtgattcacttggtggagagagcgccaccgcaaacacatcttccgtccggggctagttcgggcaccggttctgccagtgctactcatggagggggttctccccctggaacccggggtccaggagcatcagtgcacgatcggaacgctaatagctatgtaatggttgggacctttaacttgccatccgaacctcgcgttaggctggttatggcacagcacatgataagagatattcaaacattgctgagtcggatggaatgtagaggtggccctcagccgcagcactcccagccaccaccccagccccctgcagtgacccctgaaccggtcgctctgtcttctcagacctcagaaccagttgaatcagaggcacccccatag

SEQ ID NO: 215799 - DNA, 681 bp, Artificial Sequence
  Description of Artificial Sequence: Synthetic coding sequence
tagtccggattcggggctcgcctgctggaactatgcaatcagggtttgttcgaatgtcttgctctgaacctgcattgtttaggcggacagcagatggagttggcagctgtgattaacggaagaatccgcaggatgtctagaggggttaatccttccctggtgtcctggttgaccactatgatgggactgagactgcaggtggtacttgaacatatgcctgtgggcccagatgccattctaagatacgtgcgcagggttggtgatcctccgcaacctcttcccgaagaaccgatggaggtgcagggggcagaacgagcatcccccgaacctcagagagagaacgcctcaccagcaccaggcaccaccgcagaagaggccatgagtagggggccaccgccagcgcctgagggaggttctcgggatgaacaggatggcgctagcgccgagaccgagccctgggctgcagctgttccccctgaatgggtccctatcatccagcaagacattcagagccagcggaaggtaaaaccacagccacctctcagcgacgcgtacttgtccggaatgcccgctaagcggcgaaaactgcgctccgacattcaaaaaaggctgcaggaggaccctaactacagtcctcagaggtttcctaatgcccaacgcgcatttgctgatgatccctag

SEQ ID NO: 215800 - DNA, 780 bp, Artificial Sequence
  Description of Artificial Sequence: Synthetic coding sequence
atggaaccaaatgatagcacttccactgcagtagaagaaccggactccttggaggtactggttaagacactggattcgcaaacacggacgtttatcgtgggggcacagatgaatgtgaaggagttcaaagaacacatcgcggcatctgtgtccattccttccgaaaagcagcggcttatctaccaggggagagtccttcaagacgacaagaagcttcaggagtataacgtgggcggaaaagttatacacctggtggaacgggctccgccacagacccaccttcccagtggagcaagttcaggaaccggctctgcatcagctacacacggcggtggttcaccccctggcactcggggacccggagcttcagtacacgatagaaacgcaaattcatacgtcatggtggggacatttaatctcccatcggacggcagtgccgtggacgttcatattaatatggaacaggcacctatacagtccgagcctcgagttcggctagtgatggcccagcatatgattagagatattcaaacgctcctctccagaatggaatgtcgcggtggcccacagccgcagcacagtcagcccccaccccagcctcctgctgtgacacctgagcccgtggccttatcctcccagacttcggagccggtggagtccgaggcaccccctagagagccgatggaggcagaagaggtcgaagagcgggcacctgcccagaaccccgagctaactcctggcccagccccagctggccctacccccgcaccagaaacatag

SEQ ID NO: 215801 - DNA, 777 bp, Artificial Sequence
  Description of Artificial Sequence: Synthetic coding sequence
atggagcctaacgattcaacatccacagctgttgaggagcccgactcactagaggttctcgtaaaaactctcgactcccagacaagaaccttcatagtgggtgcccagatgaatgtcaaagagtttaaggaacatattgctgcatcagtctcaattccaagcgagaaacaaaggctgatctaccagggaagggtcctgcaggacgataagaagctgcaggagtacaatgtagggggaaaagtgatacaccttgtcgagagggcaccgccacagacacatctgccgtctggtgcaagctcgggaaccggcagcgcttcagctacccacgggggaggtagccctccagggacaagaggacctggcgcaagcgtacatgacagaaacgcgaactcatacgtgatggtggggaccttcaacttgccgagcgatggttcagcggtcgacgtgcacatcaacatggagcaggccccaattcagtccgaaccacgggtcaggctggtgatggctcaacacatgatccgcgatatccagacacttctctccaggatggaatgtaggggagggccacaacctcagcactctcagccccctccacagccaccggcagtcacgcccgagcccgtcgcactctcttcacagacatctgagcctgtggagtctgaagcccctccacgagaacctatggaagctgaagaagtggaggagcgggctccagcccaaaatcccgagctgacaccagggcctgccccagctggcccaacgcctgcgcctgagtag

SEQ ID NO: 215802 - DNA, 477 bp, Artificial Sequence
  Description of Artificial Sequence: Synthetic coding sequence
atggagccgaatgacagcacatccactgcagtcgaggagccagattccctggaggtgttagtgaagaccctcgatagccagacacgtacatttatagtgggagcgcagatgaacgtgaaggagttcaaagagcacatcgccgcaagtgttagcattccatcagagaagcagagactgatctatcaaggcagggtcctccaggacgataagaagctccaggaatataacgtggggggaaaggttattcatttagtcgagagggctccacctcaaacacacctcccatccggtgcaagtagcggaacagggagtgcaagtgctacccatggaggtggcagcccgcctggaacgcgaggccctggcgcatcagtgcatgatcggaacgcaaacagttacgtgatggtggggaccttcaacctgcccagcgatgggtctgcagtggatgtacacatcaacatggagcaggctccgatctag

SEQ ID NO: 215803 - DNA, 735 bp, Artificial Sequence
  Description of Artificial Sequence: Synthetic coding sequence
atggaaccaaatgattccacctccacagctgtagaagagcctgattctctggaagtgctggtgaagaccctggattcacagactcgcacttttatagtgggggcacaaatgaacgtgaaggagtttaaggagcacattgccgctagcgtttctatccctagcgaaaaacagagactgatctatcagggtcgcgtactccaggacgataagaaactgcaggagtacaatgtggggggaaaggtgatccacctggttgaaagagcccctccccagacgcacttaccatcaggagctagtagcggaacggggagtgcgagtgctacacatggcggaggatctccacccggaactcggggtccaggcgctagtgtccacgaccgtaatgctaatagctatgtgatggtgggcacatttaacttgccaagtgaaccccgagtccggctagtgatggctcaacatatgatcagggatatacagactctgctgagccgcatggagtgtagagggggtccacaaccgcaacatagtcagcctccccctcagcccccagccgtgacccctgagccagtggccctgtcatcgcagactagtgaacctgtggaatccgaagcccctcccagagaacctatggaggcagaggaggtcgaggaacgcgcacctgcacagaatccagaattgacgcccggaccagcacccgcaggaccaactcctgcccctgaaacaaatgccccatag

SEQ ID NO: 215804 - DNA, 3381 bp, Artificial Sequence
  Description of Artificial Sequence: Synthetic coding sequence
atggagcctaatgatagcaccagcaccgcggttgaggaacctgactcgctcgaggtcctggtcaagaccctggatagtcagaccagaaccttcatcgttggtgctcagatgaacgtgaaagagtttaaagagcacattgctgcctctgtgtcaattccctccgagaagcaacgcctgatataccaggggagagtcttgcaagacgacaaaaagctgcaggaatataatgtagggggaaaagtcatccacctggtggagagagctccaccccaaacacatctgccaagcggtgcctcctctgggaccggcagcgcctccgcaacccatggaggtggctctccacctggcacacgcggtcctggcgctagtgtccacgacagaaatgccaactcatacgttatggtgggcacctttaaccttccatctgacgggtccgcagtggacgtgcacatcaacatggagcaggcacctattcaatctgagcccagggtccgactggtgatggcacaacacatgattcgtgatattcaaacattactttcacggatggaatgtaggggtggcccacagcctcagcactcgcaaccccctccgcagccacccgctgtgacacccgaaccggtggcccttagcagtcaaaccagcgagcctgtggagtctgaggccccaccacgggagcccatggaagcagaggaggtggaagagagggcgccagcacagaaccccgaactgacacccggtcctgccccagccggaccaacgcctgctccggaaaccaatgccccaaatcatcccagccccgcagaatacgttgaagttttacaggagctgcagaggctcgagtcgaggcttcaacccttcctgcagagatactacgaagttcttggggctgccgcaacaaccgattataacaacaaccacgaaggccgagaagaggatcaacggctcatcaacttggtgggggagtctcttcggctactgggaaatacgttcgtcgccttgagtgacttacgttgtaaccttgcgtgcacaccccctcgacatttacacgtcgtccgcccaatgtcccactacacaaccccaatggtgctgcaacaagctgctataccgatccaaatcaacgtagggaccacagtgaccatgaccgggaacggaacacgtcctcctccaacccctaatgctgaggcacctccacccggacctggccaagctagttctgtcgcaccatcctcaaccaacgttgaatctagcgccgagggcgctcccccacctggaccagcaccgccaccggctacttcacaccccagagtgattcgcattagtcatcagtctgttgaacccgttgtaatgatgcacatgaatattcaggactctggaacccagccgggtggcgtcccttccgccccaaccggtccgctgggacccccaggccacgggcaaacactgggtcagcaagtccccggtttccccaccgctcccaccagagtcgtgattgctaggcctactccccctcaggctagaccatcccatcctggcggacccccagtctctggcacactgcagggagccggtctgggaacaaatgcatcactggcccagatggtgagtggtcttgttgggcagctcctgatgcaacctgtgttggttgcacagggaaccccaggcatggcccctcccccagcccctgccactgcctccgctagtgccggaacaactaacactgccacgactgcgggaccagccccaggcggacctgcacaacctcccccaactccgcaaccttctatggcagacctgcaattcagccagctgttggggaacctgcttgggcctgctggccctggggcaggcggaagtggcgtggcaagccctaccataaccgtagcgatgccaggcgtacctgcatttctgcaaggtatgacggattttctccaggctacccagaccgcacccccaccacctccccctccccctccgcctcccccagccccagaacagcaaacaatgccaccccctggttcccccagcggtggcgctggtagtcctgggggattgggactggagagcctgagcccagaatttttcactagtgtggtccagggcgtgctgtcgtcactgctcggaagcctgggcgcacgtgcaggttcctctgaaagtatcgctgcatttattcagaggttgagcggctcctccaacatattcgagccaggcgcagacggcgctctgggattcttcggcgctctgttgtcactgttgtgccaaaatttcagcatggtcgacgttgtgatgctgcttcacggacattttcagccactacaaaggctgcaacctcaactgaggagcttctttcaccagcactacctcggcggacaggagccaactccatccaacatccgaatggctacccacactttgataaccggcttagaagagtatgtgcgggaaagcttttcgttagtccaggtgcagcctggcgtcgacatcataagaacaaatctggagtttttgcaagagcagtttaatagcatcgcagcccacgtactgcattgtaccgattctggtttcggcgctagactgctcgagctttgcaaccaggggctgttcgagtgcctggctttgaacctccattgtctgggcggacagcagatggagctggcagcggtgatcaatggcagaatcagacgaatgtccaggggcgtcaaccctagccttgtttcgtggctgacaactatgatgggcctgcggctccaggttgtcctggaacacatgccagtagggcctgacgcaatccttcggtatgtaagacgggtgggggatccaccccagcctctgccagaggagcccatggaggttcagggagccgagagggcctctcctgagcctcagagagagaatgcctccccagctcccggaacgactgccgaagaagcaatgtctcgcggtcccccaccagcgcctgaaggcggaagccgagacgaacaagacggcgcaagtgcagagactgagccctgggcagctgctgtgccccctgaatgggtgcctattatccagcaggacatccaaagccagcgtaaggttaaaccacaacctcccttgtctgatgcatacttgagcgggatgcctgcaaaaaggcgaaagacgatgcagggtgagggacctcaattgctcctatctgaggccgtcagtagggctgcgaaagccgctggagcacgccctctgaccagtcccgagtcactgagtcgggacctggaagccccagaggtgcaggaaagttaccggcaacagctgcgaagcgacattcaaaaaagactccaggaagatcctaattactctcctcaacgctttccgaatgctcagcgcgcattcgccgacgacccctag

SEQ ID NO: 215805 - DNA, 735 bp, Artificial Sequence
  Description of Artificial Sequence: Synthetic coding sequence
atggagcctaacgactctacctccactgccgtagaagaacctgattctctggaagttctagtgaaaacactggattcccagacccgaactttcatcgtaggagctcagatgaacgttaaggaatttaaagaacacattgcagcatccgttagcattccttctgaaaagcagaggctcatatatcaaggtcgggttctccaagatgacaagaagctgcaggagtacaacgttggcggtaaggtcattcatcttgttgaacgcgctccccctcagacccacctcccaagcggagcatcaagcggtaccggaagcgcaagtgcaacacatgggggaggctctccaccgggtactaggggcccaggagcttcggttcacgatagaaatgccaactcatacgttatggtgggcacctttaatctgccttcggagcctcgtgttcgcctcgtgatggcgcagcacatgatcagggatatacagaccctgttgagccggatggagtgtcgtggaggccctcagccgcagcatagtcagcctcctccacagccgcctgccgttacacccgagcctgtcgctctgtcatctcagacctctgagcccgttgagtccgaggcaccacctcgggagccaatggaggctgaggaagtggaagaacgggctcccgcacagaatcctgagctaactcccggaccagcccctgccggtcccacgcccgcaccggagactaatgccccttag

SEQ ID NO: 215806 - DNA, 1548 bp, Artificial Sequence
  Description of Artificial Sequence: Synthetic coding sequence
atggagcctaacgacagcacatctacagctgtagaggagccggattcgctggaggtgctcgttaagacgctcgattcccagacaagaacattcattgtgggggcacaaatgaacgtgaaagagttcaaggagcacatagctgcctccgtgagcattccttctgaaaaacagagattgatttatcaggggcgagtgctgcaggacgataaaaaattgcaggagtacaatgtgggcggtaaagtgatccacctcgtggaacgcgcaccaccccagacacacctgccttccggggcatcaagcggcactggaagcgcctcggccacacacggcggtggcagtccgcctggcacaagggggcctggtgcctctgttcacgaccggaatgctaactcttatgtaatggtgggtacgtttaatctgccctctgacggctccgcagtggacgtgcacattaatatggagcaggctcccattcagtccgagcctcgcgtacgcctcgtcatggcccagcacatgatccgagatatccagactcttctcagccgaatggaatgtcgtggagggccacaaccccaacacagtcagccccctccacagccccctgccgtgacgccagaacccgttgccctgtcaagtcagacttctgagccggtggagtccgaagctccccctagagagccgatggaggccgaggaggtcgaggagcgggcaccagcccaaaatccagagctcacccccggacctgctcctgccggtccaacaccagcccctgagactaacgccccaaaccatccaagcccagcagagtacgtggaagtattgcaagaactccagcgcttggagtcacgacttcagccgtttctgcagcgatactatgaggtacttggagctgccgctacaaccgattataacaataaccacgagggccgagaagaagaccagaggttaatcaacctcgtaggagaatccttgcggctcctgggcaacaccttcgtcgctctaagcgatctacgctgcaatctcgcctgtacgcccccaaggcacctccacgtcgtgagacccatgagccattacactacacccatggtgcttcagcaggccgctatcccaattcaaattaacgttgggactacggtgactatgactggaaacggcacaagacccccaccaacaccaaacgccgaagctccccctccgggtcccggtcaagcttcttccgtggctccgagttcgacaaatgtggaaagttctgctgagggcgctcctcccccaggacccgcaccgcctcccgcaacctcacacccgagggttatcagaatcagccaccagtcagtggagcccgttgtgatgatgcacatgaacatacaggactctggaacacaacctggtggggtacccagtgcacccacgggcccactcggcccaccagggcatggtcagacgttgggaagtactctgatacaactaccatcactccccccagagttcatgcacgccgtggcacatcagatcacccaccaggccatggtcgccgctgtggcatcatag

SEQ ID NO: 215807 - DNA, 3381 bp, Artificial Sequence
  Description of Artificial Sequence: Synthetic coding sequence
atggaaccgaacgacagtactagtacggctgttgaagagcccgattcactggaggtgctcgtgaaaaccttggattcccagactaggacgttcattgtcggcgcacagatgaatgtcaaagagtttaaggagcacattgcagctagcgtgtctattcccagcgaaaagcagagactgatataccagggcagagtgctacaggacgacaagaaactgcaggaatacaacgtcggcggtaaggttattcacctcgtggagagagcacctccacagactcatctgccctcaggggcttcgtctggcaccggatccgcttccgccacccacgggggtggaagtcctccaggtacgaggggacccggagccagcgtgcatgacagaaacgctaattcatacgtgatggtggggaccttcaacctccccagcgacggcagcgccgtggacgtccacatcaatatggaacaggcaccgatccagagtgaacccagagtgaggctggtcatggcacagcacatgattagagacatccagacgctcctctcacgcatggagtgtcgagggggtccgcagccccagcactctcaaccaccgcctcagccacccgcagtgactcctgagcccgtggctctatcctcccagacctctgaaccggtggaaagcgaagccccacctagggaacctatggaagcagaagaagtcgaagagagagccccagcccagaaccccgagctgaccccaggcccagcacctgccggtcccaccccggcacccgagactaatgctcccaaccatccgtcgcccgctgagtatgtggaggtgttacaggagctacagagactggagagccggttacagccgttccttcagcgctactacgaggtactcggcgcagctgcgacaaccgattataacaataaccatgaaggcagagaggaggatcagaggctgatcaacctggtaggcgagtcactcagactactcggaaacaccttcgtcgcactgtcagatcttcgatgcaatctggcctgcaccccaccccgtcatctgcacgtcgtgcggcctatgtctcattacaccacacctatggtcttgcagcaggctgcgatcccaatacagataaatgttgggacaacagtgacaatgacaggcaatggaacgcgcccacccccaactcctaacgccgaggccccacccccaggacccggacaggccagctcagtggccccaagttctactaatgtggagagcagtgctgagggcgcaccccctcctgggcctgcccctcctcccgcaacgtctcacccacgtgtgattcggatctcacaccaatctgtagagccagtggtgatgatgcacatgaatatccaagacagcggcacccaacccggtggcgttcccagtgcccctactggacctctgggcccaccgggtcacggacagaccttgggccagcaagtaccgggattccctacggctcccacaagggtggtaattgcgaggccaacacccccacaagcccgacccagccacccaggcggtcctcccgtcagcggcaccctacaaggcgctgggttaggcactaacgcatctctcgcacagatggtgtcaggtctagtgggacagcttctgatgcagcctgtgctggtggctcaaggcacccctggaatggctcctccaccggcacccgctacggcatctgcatcagccggaacaacaaacaccgctacaactgccggacccgctccaggcggacctgcacaaccaccccctaccccgcaacctagcatggccgacttacagttctctcagcttctcggcaatctacttggcccagccggaccgggagcagggggatctggcgtcgcatcacccacaataacagtcgcgatgcccggtgtgcctgcttttctgcaaggtatgactgattttttgcaggctactcaaactgctcccccacccccaccgccaccgccaccccctccccctgctcccgaacaacagaccatgccaccccctggttccccctccggtggcgctggaagcccaggaggacttggcctggagtcactgagccctgagttctttaccagcgtggtgcagggcgtgcttagctctttactggggtctcttggggcacgtgccggatctagcgaatccattgccgctttcatccagcgactttctggatcatctaatatctttgaaccaggcgctgacggggctctaggatttttcggggctttgcttagcctactttgccagaactttagcatggtggatgtcgtcatgctcctccacgggcacttccagcccctgcagcggctacaaccgcagcttagaagcttttttcaccagcattacctcggcggacaggagccaacaccctcaaacatacgcatggcaacgcacaccctcatcaccggcctggaggagtacgtccgcgaaagcttctctcttgttcaggtccaacccggtgtggacattatccgcaccaacctggagttcctgcaagaacaatttaattctatcgcggctcacgtgttacactgcactgacagcggattcggagctagattgcttgagctgtgcaaccagggactgtttgagtgtttagccctgaatttacattgtctggggggtcagcagatggaactggccgcagtgattaatggtcggatacggcgaatgtcacgcggtgtgaatcctagcctcgtctcttggctgactactatgatgggcctcagactgcaggtcgtcctggagcatatgcccgtaggtcctgacgctatcctgcggtacgttcgaagagtaggcgacccgccacagcctcttcccgaggaacctatggaagttcagggcgctgagagggccagtccagagcctcaacgagagaatgcatcgcccgctcctgggacaaccgctgaagaagccatgagccggggaccccctccagcacccgaagggggtagccgcgacgaacaagatggagccagcgctgaaaccgaaccttgggcagccgctgtgccccctgagtgggtaccaattattcagcaggacatccagtcacagagaaaggttaaaccccagccgcctttgtcagatgcctatctgagcgggatgcctgccaagcgcagaaaaacaatgcagggcgaaggaccccagcttttgctctcagaggccgtgagccgagccgctaaggctgcaggggcaaggccacttaccagtcccgaaagtctgtccagggatctcgaggctccagaggtgcaggagtcttaccggcagcagctgcggtctgatatccagaagcgactacaggaagaccccaattattctcctcaacgttttcccaatgcacaaagggcattcgccgacgatccctag

SEQ ID NO: 215808 - DNA, 411 bp, Artificial Sequence
  Description of Artificial Sequence: Synthetic coding sequence
tgacggatgtcccggggtgtcaatccttcacttgtctcttggcttacaaccatgatgggccttaggctgcaagtggtgctcgagcatatgcccgtaggccctgacgctattctaagatatgtgcgcagggtaggggatccacctcaacctcttcccgaggagccaatggaggttcaaggggcagagcgggcaagtccagagccccaggagtgggttccaatcattcagcaagacatccagtcccaacgcaaagtgaagcctcagccacctctgtccgatgcgtacttaagtgggatgccagcgaagcgcagaaagctcagaagtgatatccagaaaagattgcaggaggatcctaactattcaccccagaggtttcccaatgcacagagagctttcgcagatgacccgtag

SEQ ID NO: 215809 - DNA, 3399 bp, Artificial Sequence
  Description of Artificial Sequence: Synthetic coding sequence
atggaacctaacgatagcacctctacagctgttgaggagccggattcactagaagtattagtgaagaccctagatagtcagacacggacgttcattgtcggcgctcagatgaacgtgaaggagtttaaggagcacatagcggcaagcgtctccatccctagtgaaaagcagaggctgatctaccagggtagggtattgcaggatgacaaaaagttacaggagtataacgtgggaggaaaggtaatacacctggtggagcgcgctccaccacaaacccatctgccaagcggagcatcttccggaactggctccgcttctgccacccatgggggagggagccccccaggcacgagaggacctggagcctcagtccacgacaggaacgccaatagttatgtgatggtgggcaccttcaacctgccatctgatggctctgctgtcgacgttcatattaatatggagcaagcgccaatccagtccgaacctcgggtgagactggtgatggcacagcatatgatccgggatatccaaactttactgtcgaggatggagacattgccgtaccttcagtgcagaggcggtccgcagccccaacatagccagccacctccccagcctcctgccgtcaccccggagcccgtggcgctttcatcccagacaagtgagcctgttgagagcgaggctccccctcgtgaaccaatggaggcagaggaggttgaggaacgcgcacctgcccaaaaccctgagctgactcctggacccgctcctgccggacccacccctgcacctgaaacaaatgccccaaatcaccccagtcctgctgagtatgttgaggtgctgcaggaactgcagcgtctcgagagcaggctacagccgttcctccagaggtactatgaagtgttaggagccgcagccactactgattataacaataaccacgagggtcgcgaggaggatcaacgtctgattaatctggtcggcgagtcactgagactgctcgggaacacctttgtcgctttgagcgaccttaggtgcaacctggcctgcactccgcctcgacatctgcatgtggtcagacctatgtctcactataccactccgatggtgttgcagcaggcggcaattcccattcagatcaacgtcggaaccacagtaacaatgactggaaatggtacacgccctcctccaacccctaacgccgaagccccacccccaggcccagggcaagcaagcagcgtagcaccatccagtaccaacgtggaaagcagtgccgagggagcacctccccctgggcctgcaccacctcccgcaaccagccatccccgtgttatccgcattagccatcagagcgtggagccagtggtcatgatgcatatgaacatccaggactcaggaacacagcctggcggagtcccatccgccccaaccgggcctttggggccacccggacatggtcagaccctcgggcagcaagtccctgggttcccaactgctccaactcgggtcgtgatagctcggcctactccccctcaggccaggccttcacacccagggggtcctccagtgtctgggaccctgcagggagccggtctagggaccaatgctagtctagcccaaatggtgtctggactcgtcgggcagctcttgatgcaacccgtgctggttgcccaaggtactcctggaatggcaccccctccggctcccgctaccgcttccgcttcagccggtaccacaaacacggcgaccaccgccggaccggctcctgggggaccagcccaacctcctccaactccccagccttcaatggcggatctccagttctcacagctgctcggcaaccttctcgggcctgctggtcctggtgctggaggaccaggggttgccagccctaccattactgtagccatgcccggagtgcctgcttttttgcagggcatgactgactttcttcaagcaacccagaccgcccctccccctcctccccctcctccgccacccccacccgctcctgagcagcagacaatgccacctccaggcagcccttccggcggagctggctcccctggcggattgggcttagaaagcctgtctccggagttctttaccagcgtggtacagggtgttctaagttccctccttggcagcctgggggctagggctggaagcagcgagtccatcgccgcatttattcagcgcctgtcgggttcaagcaacattttcgaacctggggcagacggggctcttggattcttcggggcactcctatctctcctctgccaaaatttctctatggtggatgtggtgatgctcctacatgggcacttccaacccttgcagagactgcagccacaattacggtccttttttcatcaacattatcttggaggccaagagcctacacctagtaacatcaggatggcaacccacaccctgatcactggcctggaggaatatgtcagagaaagcttctcccttgtgcaagttcagccaggggttgatataatccgcactaacttggagttcctgcaggagcagtttaattccattgctgctcatgtgctccattgcactgattcgggtttcggagcgaggttgctcgagctttgtaaccagggtctattcgaatgtctggctttgaatctccactgcctgggcggtcaacaaatggaacttgcggcagttatcaacggtcgaatccgccgtatgagtaggggcgttaacccctctctagtgtcttggttaaccaccatgatgggcctgagactgcaggtggtgctggagcacatgccagtgggccctgatgctatactccgatatgtacgtagagttggcgacccgccacagcctcttcctgaagaacccatggaggtgcaaggcgctgagcgggctagtccagagccacagagagagaacgcatctcctgccccaggcaccacagctgaagaggctatgagccgcggaccgcctcctgccccagaaggcggaagcagggacgagcaggatggcgctagtgccgaaaccgaaccctgggcggctgccgttcccccagagtgggtccccatcattcagcaggacatccaatcgcaacgtaaagtgaaacctcagcccccattatcagatgcctatctttccggaatgcccgcaaaacgacgaaagaccatgcagggtgagggcccacagctgctcctttcggaggcggtgagccgagccgctaaggctgctggcgctcggcctctgacctctccagagtcactgtcacgggatttggaggcacccgaggtccaggagagctaccggcaacagctgaggagcgatatacagaagcgattgcaggaggatccaaattatagcccccagcgtttccccaatgcacaaagagcattcgccgacgacccctag

SEQ ID NO: 215810 - DNA, 702 bp, Artificial Sequence
  Description of Artificial Sequence: Synthetic coding sequence
atggaacctaacgactctacttccactgcagtggaagagcctgactctctggaggtgctggtaaagacgctggactctcagacacgaacgtttattgttggggcacagatgaacgttaaggagtttaaggagcacatcgcagccagtgtctctatccctagtgaaaagcagaggttgatttaccagggtagagtgctccaagacgataagaagctgcaggagtacaacgtgggcggaaaggtgattcatcttgtcgaacgagcccctccccagacccacctgccatccggggcatcgtcgggcacagggagtgctagtgctactcacgggggaggaagcccgccagggacacgcggacccggagcttccgtgcatgacaggaacgcgaattcctacgtaatggtagggacgttcaacctgccttccgacggctctgcagtggacgttcacataaatatggagcaggcacctatccagagtgagcccagagttcgcttggtgatggctcagcatatgatcagggatattcaaacacttttaagcagaatggaaaccctaccctaccttcagtgccggggtgggcctcagccccaacactcccagccccctcctcagcctcctgctgtgactcccgaacctgtggctctatccagtcagacgtctgaaccagtcgagtcagaggcacccccaagggaaccctag

SEQ ID NO: 215811 - DNA, 558 bp, Artificial Sequence
  Description of Artificial Sequence: Synthetic coding sequence
taactggcctgtacacctccaaggcatcttcacgttgtgagacctatgtcacactacacgactcctatggtgctgcagcaggctgcaattccaattcagatcaatgttggaacaaccgttaccatgacaggaaacggtacccgaccacctcccaccccaaacgccgaggctccccctccaggcccaggccaggcaagtagtgtagccccttcctctaccaacgtggaatcctcagctgagggagccccaccaccaggacccgctccaccacctgctactagccaccctcgggttattagaatcagtcatcagtcggtcgaacctgtcgtgatgatgcatatgaatatccaaggacagcaggtccctggcttccccactgcaccaactcgcgtggtcatcgcacgccctaccccgcctcaggctagaccaagccatccagggggtccacctgttagcgggaccctccaaggagccggactcggtacgaatgcaagcttagcccaaatggtgagtggactggtgggccagctccttatgcagccagtactcgtggcctag

SEQ ID NO: 215812 - DNA, 738 bp, Artificial Sequence
  Description of Artificial Sequence: Synthetic coding sequence
cctccacgccatctacatgttgtgcgccctatgtcgcactatactacaccgatggtgctgcagcaggcggctatcccaatacagattaacgtagggaccacagtgacaatgacaggcccagcccctccacccgctacttctcaccctagagttatccgcattagtcaccaaagtgtcgagcctgtggtgatgatgcacatgaacatccaggatagcggaactcagcctggcggagttccgagcgcacctaccggaccactaggcccacctggacacggccagacgctgggccagcaagttccaggctttcccactgctccgactagggtggtcatagctcgccctacacccccacaagccagaccctcccacccagggggacctcctgtgagcggtacactccagggtgccggacttgggaccaatgctagtctcgcccagatggtgagtggcctagtcggtcagctcctcatgcagcccgtattagtcgcccagggaacacccggaatggcaccccctccagccccagcgactgcctctgcgagtgctgggacaacaaacaccgccaccacagcaggccctgccccaggtgggccagcacagcctccaccaaccccacagccttccatggcggatctgcaattctctcagttgctgggcaatttgttaggaccagccggacccggtgccggtggaccaggcgtcgcatcccctaccatcactgtcgctatgccttag

SEQ ID NO: 215813 - DNA, 702 bp, Artificial Sequence
  Description of Artificial Sequence: Synthetic coding sequence
atggagcccaacgattctaccagcactgccgtagaggagccagactcactggaggttctcgtcaaaactctcgacagtcagacacggacttttatcgtaggggcacaaatgaatgtcaaagaattcaaagagcacatcgccgcaagtgtcagcattccttcagaaaagcagaggctgatttatcagggcagggtcctgcaagatgacaaaaaactacaggaatacaatgttggcggtaaagtgatccacctcgtggagcgcgcacctccacagacccacctgccaagtggcgcatcctccgggaccggaagcgctagtgccacccatggaggtgggtctccccctgggacacggggaccaggggcaagcgtgcacgataggaatgctaattcatacgtgatggttggtaccttcaatctgccatcggacgggtccgcagtcgatgttcatatcaacatggagcaagccccaattcagagtgaaccgagggtgcgcttggtgatggcccaacatatgattcgggatatccagacgttgttgtctcggatggaaaccctcccatatttgcagtgtcggggaggacctcagcctcagcactcccagccaccacctcagccacccgcagtgactcccgagcccgttgctctgagctcacagacctcagagcctgttgagtccgaggctccaccgcgagaaccttag

SEQ ID NO: 215814 - DNA, 780 bp, Artificial Sequence
  Description of Artificial Sequence: Synthetic coding sequence
atggaacccaatgactccacaagtaccgcggtggaagaaccagactcattggaggtcctggttaaaaccctggactcgcagacacgaacattcatagtaggggctcagatgaacgtgaaggagtttaaagaacatattgccgctagtgtttccattccaagcgaaaagcagaggttaatttaccagggacgcgtattacaggatgacaagaagctgcaagagtacaacgtcggcggaaaggtaattcacctggttgaacgcgcacctccccagacccacctgccctccggagcaagcagcggcaccggtagcgccagtgctacccacgggggtggttcaccaccaggcactagagggcctggcgcaagtgtgcacgacaggaatgcaaacagctacgtgatggtgggtacatttaacttgccgagcgatggatcagctgtggacgtgcacatcaacatggagcaagccccaattcagtcagaacctcgtgtgcgactggtcatggcccagcacatgatccgggacatccagactctgttgagccgcatggagtgtagagggggtccacagccccagcacagtcagcccccaccacagccaccagccgtgacccccgaaccagtcgccctgtctagccagacaagtgaacctgtggagtcggaggctccaccaagggaaccgatggaagcagaagaagtcgaagagcgggcacccgcacagaaccccgagctcacccccggaccagccccagcagggccaactcccgctcccgagacttag

SEQ ID NO: 215815 - DNA, 702 bp, Artificial Sequence
  Description of Artificial Sequence: Synthetic coding sequence
atggagccgaatgactctacttccacagcagttgaggaaccagatagcctggaagtactcgtgaaaactctagattcccagacaagaacatttattgtaggcgctcagatgaatgttaaggagtttaaggagcatatcgccgcatcagtgtctataccctcagagaaacaacgtttgatttaccagggtcgggtcctccaggatgacaagaaactgcaggaatacaacgttggtggaaaagtgatccatctggtggagcgcgctcctcctcaaacccacctcccatcaggcgcatcttctggcaccggcagcgcaagcgcaacacacggcggtggcagcccccctggtacacggggtcccggtgcctcagtgcatgatcgcaacgccaactcttatgtcatggtgggcacattcaacctgcctagtgacggatctgccgtggacgttcatatcaacatggagcaagctcccatccagtcggagccgagggttcggttggtgatggctcagcatatgatacgcgatatccaaacattattgagcaggatggagactctgccttacctgcagtgcagagggggtccacaaccgcaacattctcaaccccctccgcagcctcctgcagtcactccagagcccgtggccctcagttctcagaccagtgagcctgtagagagcgaagccccaccccgtgagccctag

SEQ ID NO: 215816 - DNA, 1548 bp, Artificial Sequence
  Description of Artificial Sequence: Synthetic coding sequence
atggaacctaacgactccacaagcaccgccgttgaagaaccagactccctcgaggtccttgtgaaaactttagactcccaaacaaggacttttattgttggtgcccagatgaacgtaaaagagttcaaggagcacatcgctgcctctgtttctatcccctccgagaaacaacgattaatataccagggtcgggttctgcaggacgataagaaacttcaagagtataacgtaggcggaaaggttatacatctggtggagcgcgctccacctcaaacccatctgccctctggtgcttcttctgggactgggagcgcctcggctacccacggaggcggaagccctccgggaactcgcggtccgggtgcatctgtgcacgatagaaatgcaaactcctacgtaatggtgggcactttcaaccttcctagtgacggctcagctgtagacgtgcacatcaacatggagcaagcacccatccaatccgagccgcgagtgagactcgtcatggctcagcacatgatccgggacattcagaccctcctaagcaggatggagtgtcgaggagggccacagccacaacattcacaaccccctccgcagcctccagccgttacacctgaacccgttgcactctcttcacagactagtgaaccggtcgaatcagaggctcctccacgcgagcctatggaagccgaggaggtggaagagagggctccagcgcagaacccagagctgactccgggacctgctccagccggacctacccccgctcccgaaaccaacgcacctaatcacccatcgccagccgaatacgtggaggtacttcaggagttgcagcgtctggaatcccgcctacagccttttctacagagatactatgaggttctgggagccgcagcaactaccgactacaacaacaaccacgaggggcgtgaggaagaccaaagactaattaatttagtaggtgagtcccttcgacttcttgggaatactttcgtggcgctatccgacctcagatgcaatctggcctgcacccccccaaggcacctacacgtggtgcggcctatgagccattacacgacccccatggtactccaacaggctgccattccaatccagataaatgtcggcaccactgttactatgacaggtaacggcacgcgccctccgccaacgcccaatgctgaggctcctcctcctggcccaggccaggcatcctctgtggcgcctagcagcacgaatgtggagtcttccgccgaaggcgctccacctcctggtcccgcaccacccccagccaccagccatccccgtgtgattcgaatcagtcaccagtccgtggaaccagttgtcatgatgcatatgaatattcaggatagcggaacccagccgggaggggtcccttccgccccaacaggtccactcggcccaccaggccatggccaaaccctcggttctaccctgatacagctgcctagtctgcctcccgaattcatgcatgcagtggctcaccagattactcatcaggctatggtcgctgctgtcgcctcttag

SEQ ID NO: 215817 - DNA, 477 bp, Artificial Sequence
  Description of Artificial Sequence: Synthetic coding sequence
atggagcctaatgatagcacaagtaccgctgtagaggagcctgattcgctggaagtactcgtaaaaacactcgattcgcaaacgagaactttcatagtgggtgctcagatgaatgtgaaggagttcaaagagcacattgccgcttcggtttccattccctccgaaaagcaaagactgatttaccagggcagagttctgcaggatgacaaaaagcttcaggagtataacgtcggcggtaaagttattcacctggtggaaagagctcccccacagacacacctgccctcgggcgcaagcagcggcacagggtccgcttctgcaacccacggcggaggatcccctcctggcacaaggggacctggcgcaagtgtacacgatcgcaatgctaactcctacgttatggtgggtactttcaacctccctagcgatggatcagcagtggacgtgcatatcaatatggaacaagctcccatttag

SEQ ID NO: 215818 - DNA, 702 bp, Artificial Sequence
  Description of Artificial Sequence: Synthetic coding sequence
atggagcctaacgactctacctccacagcggtggaggaacctgacagcctggaggtgttggttaagactctagacagccaaaccagaacgttcatcgtcggcgctcaaatgaacgtgaaagaattcaaagagcacatcgctgcttccgtgtcgattccgtctgagaagcagaggctgatataccaaggtcgggttctgcaggatgacaaaaagctacaagagtacaacgtgggaggtaaagttatccatttggtggaacgggcacccccacagactcacttgcctagcggcgcatctagtggtacaggatctgcatccgctacccatggaggagggtcccccccaggaacaagaggccctggggcttccgtgcacgatagaaatgctaactcatatgtcatggttggcacctttaatcttccatccgatggatccgccgtggatgtgcatataaatatggagcaggctccaattcagtctgaaccacgggtgcggttggtgatggcccagcacatgattagggacattcagacccttctctcacgcatggaaacactcccctacctgcagtgtagagggggaccccagccacagcatagccagcctccaccccagccacccgcagtgaccccagagcctgtcgctctgtcatcccaaactagtgagcctgtggaaagcgaagcccctcccagggagccatag

SEQ ID NO: 215819 - DNA, 735 bp, Artificial Sequence
  Description of Artificial Sequence: Synthetic coding sequence
atggaacccaacgacagtacctccacggctgtggaggagcccgattcactggaggtcttggtcaaaacactggatagccagacccggacattcatcgtcggagcccagatgaatgttaaggagttcaaggaacacatagcggcttcggtctccatccccagtgaaaagcagagactcatctatcagggacgggtgctacaagatgacaaaaagctgcaggaatacaatgtcggaggaaaggtgattcatctcgtggagcgcgctcccccacaaactcacttgccgtccggcgcaagctctggaacagggtccgccagcgccacccacgggggtggttcaccaccagggacccgcggaccaggcgctagcgttcacgaccgcaatgctaactcgtacgtgatggtaggaacctttaatttacctagcgagccccgtgtgagactggtaatggcccagcatatgattcgtgatatccagaccttgctctctagaatggagtgtagggggggaccccaaccgcaacattctcaacctccgcctcagcctcctgcagtgacccccgagcctgtcgctctgagttctcagacctcggagcccgtggaaagcgaggcaccacctcgagagccgatggaagcagaagaggttgaggagcgtgcccctgcccaaaacccagagctcactccaggcccagcccctgcagggccaaccccggcaccagaaactaacgctccatag

SEQ ID NO: 215820 - DNA, 3399 bp, Artificial Sequence
  Description of Artificial Sequence: Synthetic coding sequence
atggagcccaatgactcgacgtccacggccgtggaggaaccagactcactcgaggtcttagtgaagacacttgatagtcagacgagaacatttattgtgggtgcacagatgaacgtgaaagagttcaaggagcacatcgccgcttccgtttctatccccagtgagaagcaacgtttgatataccaaggacgcgtgctccaggacgataagaagttgcaggagtataacgttggcggaaaagtcatccatctggttgagcgggctcctccacaaacgcatctaccgagtggcgcttcctccggtacaggctctgcaagtgcaacgcacggaggaggaagcccacccggtaccagaggccctggcgctagtgtccacgatcgtaacgcaaatagctatgtcatggttgggacttttaatcttcctagcgacgggagcgccgtggatgtgcatatcaacatggaacaagctccaatccaaagcgaacccagagtccgactagttatggcccaacacatgatcagggatatccagaccctccttagccgtatggagacgctgccatacctgcagtgccggggtggaccgcagcctcagcattcgcaacccccacctcaaccccctgcagtgacgccagagcccgtagctctttctagccagacctctgagcctgtcgagagcgaagcgcctccaagggagccaatggaagcggaagaagtcgaggaaagggccccagcgcagaacccagaactgacaccaggcccagcccctgccggacctaccccagcgcctgaaactaacgcccctaaccacccgtcccctgccgagtacgttgaagtcctgcaggaactccagaggctcgaaagcaggctgcaaccctttctccaacggtattacgaggtgctcggtgcggctgccacgacagattacaacaataatcacgagggccgagaggaagatcagcggctgattaatctggtgggtgaaagtttgcgcctgttaggtaacacattcgtggcgctgtccgacctcaggtgtaatctggcctgtacacctcccagacatctccacgtggtccgccctatgtcacactatactactccaatggttctccagcaagcggctatcccgatccagatcaatgtggggacgacagttacgatgactgggaacggcactcgccctcccccaactcctaacgcggaggcccctccaccaggccctggtcaagcaagttcagtagcaccttcctctaccaatgtggagtcttccgcggagggggctcccccacctggtcccgcaccacctccggcaaccagtcatccaagggtgatacggatcagccatcagtccgtggaacctgtcgtaatgatgcacatgaatatacaggacagtgggacacaacccggaggtgtgccctcggcgcctacaggacctctcggtcctccaggacacggacagaccctgggccagcaggtacctggtttcccgacggcccctacgagagtggtgatagccaggcctactcctccacaagcacggccatcccacccaggtgggccacccgtgagcggaactctgcaaggcgctgggctcggaaccaacgcaagtctcgcccagatggtgtcggggctggtgggtcagctgctgatgcagcccgtactggtcgcccagggtacacctgggatggcgcctccccctgctccagccacagccagcgcctccgcaggtactacaaacacggctactaccgccggtccggcaccaggcggaccagctcagccccctccaaccccccagccctctatggctgatctgcagttctcccagctactcgggaatctcctggggcctgccggaccaggtgcaggcggaagcggagtagcctcacccacaatcaccgtcgcaatgccgggtgtccctgcttttctacaggggatgactgactttcttcaggccacacagactgctccccctccaccaccacccccaccccctccccctcctgcacctgaacagcagacaatgcccccacccggatccccttctggcggagcaggcagtcctgggggactagggctcgagtcacttagtcctgagtttttcacatccgtcgtgcagggagtgctgtcatccctactcggtagcttgggagccagggcaggctcaagtgagtccattgcagcgtttatccaacggctcagtggcagttcgaacatctttgaacctggagcggatggggcactgggttttttcggagccctgctttccctgttgtgccagaacttctcaatggtagatgtagtgatgttgctgcatgggcacttccagccactgcagcgcttacagccacagttaagaagctttttccaccagcactacctgggcggacaagaaccaacaccaagtaacattcgcatggcaacacatacccttatcacaggactggaagagtacgttcgggagtcattctccctagtgcaggtgcagcccggagtagacataataaggacaaatctagaattcctgcaggaacaattcaatagtattgcagcacatgtccttcactgcactgactcgggattcggcgcacgactgttagaactgtgcaatcaggggttgttcgaatgcctggctctgaaccttcattgtcttggaggtcagcagatggagttagctgcagttatcaatggacgcatacgccgtatgtcccgcggtgttaaccctagtctggtcagctggttaactaccatgatgggcctaaggctccaggtggttctcgagcacatgcctgtcggtccggacgccatacttcggtacgtccggagggttggggatccccctcagccgctccccgaagagcctatggaagtccagggcgctgagcgcgcttcccccgagcctcaacgggagaatgcctccccagctccaggcacaactgccgaagaggcaatgagtagaggcccaccaccagccccagaaggcggatccagagacgagcaagatggcgcatccgccgaaacagagccatgggctgctgcagtgccccctgagtgggttccaataattcaacaggatatccagagccagcggaaagtaaaaccacagccaccgctgtccgacgcctacctgtctgggatgcccgctaaacgccgaaagaccatgcagggagaagggcctcagcttctactaagcgaggctgtgtcgagggcagctaaggctgcgggtgccagaccccttacttctcccgaaagcttgtccagagacctggaggccccagaagttcaggagagctataggcaacaactccgatctgacattcagaagaggctgcaagaagaccctaactactccccccagcggttccctaacgcccagcgtgcctttgctgacgacccctag

SEQ ID NO: 215821 - DNA, 1548 bp, Artificial Sequence
  Description of Artificial Sequence: Synthetic coding sequence
atggaacccaacgacagtaccagcaccgctgtcgaggagccagattccctggaggtgctcgtgaaaactttggattcacagactcgaacctttattgtgggcgctcagatgaatgttaaggaatttaaagaacacatcgccgcaagcgtcagcataccatccgaaaagcaaagactaatttaccagggtcgcgtactgcaggacgataagaagctccaggagtataacgtaggcggtaaggtaatccacctggtagagcgagcacctcctcaaacacacctaccctcgggcgcaagcagtgggacgggaagcgcatcagccactcacggcggagggtcgcccccaggtacccgaggccctggcgcttccgtgcacgacagaaatgctaatagctacgttatggttggcacctttaacttgccatcggatggcagcgctgtggatgttcacattaatatggagcaggccccaatccaatctgagcccagagtaaggcttgtgatggctcagcacatgatccgcgatatccaaaccttattgtcacggatggagtgtcgcggtggtccacaaccacagcactctcaacctccaccccagccccctgctgtgacaccagagcccgtggctctctcttcccaaacatccgaacctgtcgaaagtgaggccccaccacgggagccgatggaagccgaggaagtcgaagagcgtgcacctgcacagaatcccgaattgacccccggacctgcgcctgccggtccaacacctgccccagaaaccaatgcccctaaccacccatcccctgcagaatacgtggaagttctccaggagctccagagacttgagtctcggttgcagcctttcctccagagatactatgaggtgctgggagcggcagcaacaaccgactataacaataaccacgaggggcgagaggaggatcagaggttgatcaacctggtgggcgagtcactgcggctcttagggaatactttcgttgccctttccgatctgcggtgtaatctagcatgcactccaccacgtcatctccatgttgtgcggccaatgagccactatacgactccaatggtgcttcagcaggccgcaattcccattcagatcaatgtggggactacagtcacaatgactggcaacggcactaggcctccacctacaccgaacgctgaggcacccccaccaggcccaggtcaagcctcgtctgtcgccccttcatccactaacgtggaaagctccgcagagggagcgccacctcctgggcctgctccaccacctgcaactagccacccacgcgtaatccggatctcgcatcaatccgtagaacctgtcgtgatgatgcatatgaacatccaggacagcggaacacagcctggtggggtgccctctgcacccacaggccctctcggccctccagggcatgggcagacgctgggcagcacgctgatacagctgccttctttgccgcctgagtttatgcacgccgtggcacatcaaataacacatcaggctatggtggcagcagtcgcctcttag

SEQ ID NO: 215822 - DNA, 735 bp, Artificial Sequence
  Description of Artificial Sequence: Synthetic coding sequence
atggagccaaacgatagtaccagtaccgccgttgaggaacctgatagtctagaggtgttggtgaagacgctcgatagccagactagaacctttatcgtaggcgctcagatgaacgtgaaggaattcaaggagcacattgctgccagcgtgtccattccaagcgagaaacagcgtctgatctaccaggggagggtcctgcaggacgataaaaaactccaggagtataatgtaggtggcaaggtcattcatctggtagagcgagctccccctcagactcacctgcccagcggagccagctcgggaacaggttccgccagtgcaactcacggagggggatcacccccaggaacgcgcggacctggggctagcgtgcatgatcggaacgccaattcgtacgtgatggtcggcactttcaacctaccatccgagcccagggtgcgactggtaatggctcagcacatgatccgcgatattcagacactcctctcccggatggagtgtcgtggcggtccccagccacaacatagccagccacctccccagccgcctgcagtgacacctgaaccagtggcacttagcagtcagactagcgaaccggtcgaatccgaagcccctccaagggagcctatggaagcagaggaggttgaggaacgagcgccagcacagaacccagaactgacacccggtcccgcacctgccggtcccacccccgctccagagacgaacgccccatag

SEQ ID NO: 215823 - DNA, 2232 bp, Artificial Sequence
  Description of Artificial Sequence: Synthetic coding sequence
atggagccaaacgactctacctctacagctgtggaggagccagactctcttgaggttctggttaagactctggattctcagacgcgcacattcatcgtcggggcacagatgaacgtcaaggagtttaaggagcacattgctgcgtcggtgtcaatcccatctgaaaagcagaggcttatctatcagggaagagttcttcaagatgacaagaagctgcaggagtacaatgttggcggtaaagtcattcacctggtggagcgtgcaccccctcaaacccatctcccctcaggggcttcctcaggtacaggctcagcctcggcaacccatggagggggatctccgccaggtactaggggcccaggtgcttcagtgcatgaccgcaacgcaaatagctatgtgatggtgggtacattcaatctgcccagcgacggctcagccgtcgatgtgcatattaacatggagcaggcaccaatccaaagcgaacccagggttcgactggttatggcacagcacatgatcagggacatccagaccctcctgtcccgcatggagtgccgtggaggtccccagccccaacattcacagcctcctccccagcctcctgccgtcactcccgaacctgtagcattgtcaagccaaaccagcgaaccagtcgagtcggaggccccacccagggagcccatggaggcagaggaggtggaggaaagagcgccagcccaaaaccccgagcttaccccaggtcctgcccctgctggaccgacccccgctcccgagacgaatgccccaaatcacccgagccccgctgaatatgtggaagtgcttcaggaactccagagactcgagtcacgcctgcagccatttctgcagcgttactacgaagtgttaggggctgctgccactaccgattacaacaataatcacgagggacgggaggaggaccagcgactcatcaatctggtgggggagtcattaaggttactggggaacactttcgtggcgctctctgatctccgctgcaacctggcatgcaccccccctaggcacctgcatgtggtgcggcctatgagtcactacaccacacccatggtcctgcaacaggccgctatacctattcagatcaatgttggcaccaccgtcaccatgaccggaaatggcacacgtcctccacccactcctaatgccgaagctcctccaccgggtccaggacaagcatcttccgtggccccaagctcaaccaacgtcgagagcagtgcagagggagcaccacctccaggtccagccccaccaccagccacaagccacccgcgagtaatccgcattagtcatcagtctgtcgaacctgtggtcatgatgcatatgaatatacaggactcaggcactcagcctggcggagttccctccgccccaaccggccctctgggcccacccggacacgggcagacactaggttcaacactcatccaattaccatcgctgccacctgagttcatgcatgccgtcgcgcaccagataactcatcaggctatggtcgctgcagttgccagtgcagctgcaggacaacaggtccctggctttccaaccgcacccaccagagtggtgattgctagacctactcctcctcaggctaggccctcccatcccggtggaccacccgtgagcggaaccctacagggagctggtcttgggaccaatgctagtttagctcagatggtaagcgggttagtgggacagctgcttatgcagcctgtgttggtcgctcaaggcaccccagggatggccccaccgcctgcaccagcaacagcaagcgccagtgcaggtaccacgaataccgcaacaactgccggtcccgctccaggaggtcccgcacaaccaccaccaaccccgcagccatcaatggccgatctgcaattttctcagttactcggtaatctactgggtccagcaggacctggcgcaggagggcctggtgttgcctctccgaccatcacagttgctatgccaggcgtcccggcattcctccaggggatgaccgactttctgcaggcaacccagaccgcccctccaccaccccctcccccaccacctcctccgcctgcccctgagcagcagacaatgcctccaccaggctcgccgagtggtggggctggtagtccagggggactggggctcgagtctctgtctccggagttctttacgagtgttgtccaaggcgtcctgtcctccctgttgtag

SEQ ID NO: 215824 - DNA, 735 bp, Artificial Sequence
  Description of Artificial Sequence: Synthetic coding sequence
atggagcccaatgactccacttccaccgccgtggaggaaccggattccctcgaggtactggtcaagaccctggatagccaaacacggacctttatcgtcggagcccagatgaatgttaaagagtttaaggagcatatcgctgcctccgtgagcataccgtctgagaagcagcggcttatatatcagggcagggtcctgcaggacgataagaagctgcaagagtacaacgtgggcggaaaggtgatacacctggtggaaagagcccctcctcaaacacatctgccatctggcgcatccagcggaacaggcagtgcttcagctactcatggcggaggttcccctccaggtactagggggccaggcgcttctgtgcacgatcgtaatgctaattcatacgtcatggttggcactttcaatctgcccagcgagccacgcgttcggctagtgatggcacagcatatgattagagatatccagaccctgctgtcccgaatggagtgcagagggggtccgcagccccagcactcccagccccctccccaacctcctgccgtgacgcccgagcctgtggcgctttcctcccagaccagtgaaccagttgagtccgaagcccctcctcgcgagcccatggaggcagaggaggtggaagagcgcgctccagctcagaaccccgagctgacacccggacctgctcccgcagggccaacccctgcccctgagacaaacgcaccctag

SEQ ID NO: 215825 - DNA, 735 bp, Artificial Sequence
  Description of Artificial Sequence: Synthetic coding sequence
atggagccgaacgactccaccagtactgcagtcgaggaaccagactccctggaggttctcgtaaagacacttgacagtcagacacgcactttcattgtgggggcacaaatgaatgttaaggaatttaaagaacatatcgctgcatccgtgagcatcccgtccgaaaagcagagactaatttatcagggtcgcgtgttacaggacgataaaaagttgcaggaatataacgtaggaggcaaggttattcacttggtggagagagctcccccacagacccatctgccaagcggcgcaagctccggtactggatcagcatccgctacccacggcggaggctcacccccaggcaccaggggacccggtgccagcgtccacgacagaaacgccaatagttacgtgatggtcggcacattcaatcttccctctgagcccagagtgcgacttgtcatggcccaacatatgatacgggatatccagacccttctctctcgtatggaatgcaggggcggaccacaacctcagcattcgcaacccccaccgcaaccgcctgcagttaccccagaaccggtcgccctgtcgtctcagacatcagaaccagttgaaagcgaagccccacccagggaacccatggaggctgaggaggtggaggaaagggcacctgcccagaatcctgagttaactcctgggcctgccccagctgggccaacgccagcccctgaaactaacgcaccatag

SEQ ID NO: 215826 - DNA, 3399 bp, Artificial Sequence
  Description of Artificial Sequence: Synthetic coding sequence
atggagccaaacgactctacctccaccgcagtcgaggaacccgatagtctcgaggtgctggtgaagactctcgactcccagactaggactttcatagttggcgctcaaatgaatgtgaaggaatttaaagaacacatcgcagcatctgtgtccatccctagcgagaagcagcggcttatctatcaaggccgagtactgcaagatgacaaaaaactccaggaatataacgtgggcggtaaggtcatacacctggtggagcgtgctccccctcagactcatctgccaagcggagcaagctccggcaccggaagcgcttctgccacacacggtggtggaagtccacctggcacaagggggcctggtgcatctgttcacgaccgtaatgccaactcgtacgtgatggtcgggacctttaatcttccctcggacggctcagccgtcgatgtgcatattaatatggaacaagcccctatccagtccgagcccagagttcgcctcgtgatggcccagcatatgatccgcgacatccagacactcctgtcccggatggagactctcccttacctgcagtgccgtggtgggcctcagccacaacacagccagccaccgccacagccccctgctgtcaccccggagccagtggctctgagctctcaaacctcagagcctgtcgagagtgaagccccaccgagagaacctatggaggcggaggaggtggaggagcgcgctcccgcacagaatcccgagcttacccccggtcccgctcccgcaggcccaacacctgcccctgagactaacgctcctaatcacccgtcccctgccgagtacgttgaggtactgcaggagctccagcgcctcgagagccgtctgcagcccttcctgcaaagatattacgaggttctgggggctgccgctactacagattacaataataaccacgagggcagggaggaggaccagagactgattaacctggttggcgaatctcttaggctgcttggcaacactttcgtagccctgagcgacctgagatgcaacttggcctgtaccccccctaggcatttgcacgtggttagaccaatgtctcactacacaacaccaatggtgctacagcaggctgctatcccaatccaaattaatgttggcactacggtgactatgaccggaaatggcacccgaccccctccaacccccaatgccgaagccccacctccaggtccgggacaggctagctccgtagcccctagctcaacgaatgtggaaagtagcgcggagggggctccccctccaggcccagcccctcctcccgctacaagccatccccgtgtgatccggatttcccaccaaagcgtggagcctgtagtcatgatgcacatgaatatccaggattcggggacacagccagggggagttccatctgctcctactggtcccctgggtccccctggtcatggccagacacttgggcagcaggtgccagggttcccgacggctccaacacgcgttgttatcgctaggccaacaccgcctcaggccagaccgagtcacccagggggtccgccagtttccgggaccctgcaaggcgcagggttgggcaccaatgcctcgctggctcagatggtgtcaggcttggtggggcagctgttgatgcagccagtacttgtggcccagggcaccccgggtatggcccctccaccggcaccagccaccgcaagcgccagtgctggcaccacaaataccgcgaccacggcagggccagcaccaggcggaccagctcagccacctccaactccgcagccaagtatggcagatctccaattttcccagcttttaggcaacctgttaggacctgcaggcccaggggctggcggaagtggcgtggcgtcaccgactatcacggttgccatgcccggagttccggcatttctccagggcatgaccgattttctgcaggccacacagacagcacccccaccccctccacctcctccaccgccaccacccgctcccgaacagcagacgatgccacctcccggaagtccctcaggcggtgcgggttctcctggcggattgggcctcgaatcccttagcccagagtttttcaccagcgtggtccaaggagtactctcctccttactggggtccctgggggcaagagcgggaagctctgaatcaatcgcagccttcattcagagactctccggaagctcgaacatattcgaaccaggagccgacggcgcactgggatttttcggtgctttattatccttgctttgccagaacttttctatggtcgacgttgtcatgctactgcacgggcatttccagccgcttcaacgtctccagccccagttgagaagttttttccaccagcactatttagggggtcaggaacccacaccctccaatattaggatggccactcacacccttattacagggctagaagagtacgtcagggaaagttttagtctcgttcaagtccagccaggggtcgacatcattcggaccaatcttgaattcctgcaggaacaattcaacagtatcgcggctcacgtccttcactgcactgactctggtttcggcgcaagactcctggagttgtgtaatcagggattattcgagtgcctcgccctcaatctgcactgcctcgggggacagcagatggaacttgccgctgtcatcaacggcagaatacggagaatgtctcgcggtgtcaaccccagcctcgtctcatggctgacaaccatgatgggccttcggctccaggtggtcctcgagcatatgcccgtaggcccagacgccattctgcggtatgtgagacgggtcggagatccccctcagccactccccgaagaacctatggaagtccagggcgctgaacgcgcatcccccgagccccagagggaaaatgcttccccagccccaggcacaacagcagaggaagcaatgagccggggtcccccaccggcaccagaggggggtagcagagacgagcaagatggtgcatctgcagagacagagccctgggctgcagcagtgccccctgaatgggtccctatcattcagcaagatattcagtcccagcgcaaggtgaaaccccagcctccccttagtgacgcgtacctttctgggatgccagccaagcggagaaaaaccatgcagggagagggccctcaactgctcctttcagaagctgttagcagagcagccaaggccgcaggagcccgtcctctgacaagccccgaaagtttatcgcgcgatctggaggcccctgaagtgcaggagtcttaccgccaacaactgcgctctgacatacagaagcgcctacaggaagacccaaactattctccccagagatttccaaatgctcaacgcgcttttgctgatgacccgtag

SEQ ID NO: 215827 - DNA, 738 bp, Artificial Sequence
  Description of Artificial Sequence: Synthetic coding sequence
cctcctcgacaccttcacgttgtcagaccaatgtctcactataccacacccatggtactgcagcaagccgcaattccaatccaaataaatgtagggactaccgtgaccatgacggggccagctcccccacccgcaacctctcatcccagggtgatcagaatatctcaccagtccgtcgagcccgttgtcatgatgcatatgaatatccaagactctgggacccaaccgggaggggtgccgtccgccccaaccggcccattagggcctccaggtcatggacagaccctagggcaacaggttcctggttttcccaccgcccctacccgggtcgtcatcgcacggcctacacctccgcaggctaggccatcacatccagggggacctccagtcagcggtactcttcagggcgcaggtctgggaactaacgccagtctggctcagatggtttccggactcgtgggacaactgttgatgcaacctgtgctcgtggctcagggaactccgggaatggccccaccaccagctccggcaacagcctctgcctccgccggtaccaccaatactgctactacagccggaccggctcctgggggaccagcgcagccacctcctaccccacagccaagtatggctgacttacagttctctcaactactgggcaacctcttggggccagcagggcctggggcaggcggacctggagtggcctcgcctacgatcaccgtggctatgccttag

SEQ ID NO: 215828 - DNA, 777 bp, Artificial Sequence
  Description of Artificial Sequence: Synthetic coding sequence
atggagcctaatgactccaccagcacagctgtggaggaacccgatagccttgaagtgctcgttaagacgctagatagtcagaccaggacctttattgtaggagcacaaatgaacgtgaaagagttcaaggaacatatcgctgcctccgtttccatccctagcgagaagcaacgcttgatataccagggaagagttctgcaggatgacaaaaaacttcaggaatataacgttggcggaaaagtgatacaccttgtcgagcgggcaccaccgcagacgcatttgccttccggggcttctagcggcaccggctcagcatccgccactcacggcggaggatccccgcctggtacacgcggacccggagctagtgtccatgaccggaacgcaaactcatacgttatggtgggaaccttcaacttaccttctgacggttctgcagtggacgtccatatcaacatggagcaggctccaattcaaagtgagcccagggtgcgtttagtaatggcacagcacatgatccgtgacatccagactctgctttcacggatggagtgccggggagggccacagccacagcactcccagcccccaccgcagccccctgctgtaacaccggagcctgtggccctgtcttcacagacatcagagccggtggaaagcgaagcccctcctcgggaacctatggaggccgaagaagtcgaagagcgggcaccagcgcagaacccagagcttacccctggcccagcccctgccggaccgactcctgcgccagagtag

SEQ ID NO: 215829 - DNA, 789 bp, Artificial Sequence
  Description of Artificial Sequence: Synthetic coding sequence
atggagcctaatgacagcacaagcaccgctgtggaggagccagatagccttgaagttcttgtgaagacattggactcccagacgagaaccttcattgtcggtgcccagatgaacgttaaagagttcaaagaacatatcgcggcttcagtcagcatcccgagcgaaaagcagaggttgatctaccaaggcagagtcttgcaggacgataagaagctgcaagaatataacgtaggcggtaaggttatccacctggtggagagagcccctccccaaacccatctcccatccggagcttcttctggcaccggtagcgccagtgcaactcacggcggaggaagcccaccgggtactagagggccaggagcctcagtccacgaccggaatgccaactcatatgtgatggtggggacctttaatctcccttccgatggaagtgctgttgacgtccatattaacatggaacaggctcccatccagagcgagccacgcgtgcgtctggtcatggcccagcatatgattcgcgacatccagaccctgctctccagaatggagtgtagaggcggaccacagcctcagcactctcagccaccacctcaaccaccagccgtgacacctgagcctgtggctctgtcgtcccagacaagtgagccagtcgaaagcgaggcaccaccacgggagcctatggaggctgaggaggtggaggagcgcgctccagcacagaacccagaacttactcctggtcctgcgccagctggcccaaccccggctcccgaaactaacgcaccctag

SEQ ID NO: 215830 - DNA, 789 bp, Artificial Sequence
  Description of Artificial Sequence: Synthetic coding sequence
atggagcccaatgacagcacctctaccgcagttgaggaaccagatagtctggaggtattagtcaagactctcgactcacagactaggactttcatcgtgggtgcgcaaatgaatgtgaaggagttcaaggagcatatagcagcgtccgtgtccattcctagcgaaaaacagcgcctgatatatcaggggcgagtcctgcaagacgataagaagctacaagaatacaacgttggcggtaaagtcatccacttggtggagagggcgccaccccagactcatctcccaagcggcgcttccagcggaacggggtctgcaagcgccactcatgggggaggaagcccgccaggaaccagagggcctggagcctcagtgcacgaccggaatgccaactcctatgtgatggtgggcaccttcaacctgccttctgatggcagtgctgttgatgttcatatcaacatggagcaggccccaatccaatccgaacccagggttcgcctcgttatggctcagcatatgatacgcgatattcagaccctgctgtccagaatggagtgtaggggcggtccccagcctcaacactctcagccacccccacagcctcccgcagttacacctgagccagtggcactttcatctcagacatcagagcccgtggaatcagaggcccctcccagggagccaatggaagctgaagaggtcgaagaaagggcccctgcccagaaccctgagctgacgcctggccctgcacccgctgggccaactccagctcctgagaccaatgctccttag

SEQ ID NO: 215831 - DNA, 738 bp, Artificial Sequence
  Description of Artificial Sequence: Synthetic coding sequence
ccacccaggcacctgcacgtcgtcaggcctatgtcgcattataccacccccatggtgctgcaacaggcggctattccaatccagattaatgtgggaactacagtaacgatgacgggacctgctccccctccagcgaccagccatccccgtgtaattcgaatcagccatcagagcgttgagcctgttgtgatgatgcatatgaacatccaggattccggcacgcagcccggtggtgttccatccgccccaaccggccctttaggaccgccaggacatggacaaaccttaggacagcaggtgcccggatttccaacggccccaacccgtgtcgtaatcgccagaccaacgcctcctcaggctcggccaagccaccctggcggtcctcctgtctcagggacgctgcaaggagcaggccttggaactaacgcttcacttgctcagatggtttcaggattggttggccagctactaatgcagccagtgcttgtggcacagggaacacccggaatggctcccccacccgcacctgccactgcctctgcttcagcaggtacaactaatactgccactaccgcaggtcccgcacctgggggtcctgcacagcccccaccaaccccccagccctctatggccgacctgcaattttcgcagcttctcggaaatctgctgggtccagccggacccggtgctggcggatcaggagtggccagtcctaccataactgtggccatgccatag

SEQ ID NO: 215832 - DNA, 648 bp, Artificial Sequence
  Description of Artificial Sequence: Synthetic coding sequence
atggagccgaacgatagcacctcgactgccgttgaggaaccagactcgctggaggtcctcgttaagacccttgacagtcagacaagaacatttatagttggagcacagatgaatgttaaggagttcaaggaacatatcgctgcatctgtgtcgataccaagcgagaagcagagactgatctatcaggggagagtgctccaggatgacaagaaactccaggagtataacgtgggaggcaaggtgatccacttggttgaacgagcccctccccaaacccatttaccttctggggcatcaagcggcaccggctccgcctcagcaacacatggaggcggatcacccccagggacgcggggtcctggcgcaagtgtgcatgacaggaatgccaatagctatgttatggtcggaacctttaacctgccatccgagccacgtgtgcgcctagttatggcccaacatatgattagggacattcagacactgctgtctaggatggaatgccgtggcggtccgcagccccagcactctcagccccctccgcagccacctgcagtaaccccagagcctgtggcgctgagctcccagacctccgagcccgtggagagcgaggctcctccacgagaacctatggaagccgaggaggtttag

SEQ ID NO: 215833 - DNA, 735 bp, Artificial Sequence
  Description of Artificial Sequence: Synthetic coding sequence
atggaacctaacgattccaccagtaccgcagtggaagagcccgatagtttagaggtgctggtcaagaccctggatagccaaacgcgtacatttatagttggagcccaaatgaacgtgaaagagtttaaggaacacattgctgcatcagtcagcatccctagtgagaaacagaggctcatttaccaagggagggtactacaggacgacaagaagttgcaggagtacaatgtgggaggcaaagtgatccacctggtcgagagagcgcctccacagacccacctgccctctggagcctcttcaggtactggctctgcctccgccacccacggcggaggatcaccccctggaacaagaggtcccggagcctctgtgcacgatcggaacgccaactcctatgtgatggtgggcacgtttaatcttcctagcgagccaagggttcggctcgtgatggcccagcacatgatccgggatattcaaaccctcctgtctcgaatggaatgccgtggtggcccacagccccagcatagccagccaccaccccagccacctgctgtgacaccagagcctgtggctctttcaagccagacctccgagcctgtggagagcgaggcacccccaagggagcccatggaggccgaggaggttgaagagagggcccctgctcagaaccccgaacttacacctggaccggctcccgcagggccaacaccagctccagaaacgaacgccccttag

SEQ ID NO: 215834 - DNA, 558 bp, Artificial Sequence
  Description of Artificial Sequence: Synthetic coding sequence
tgactggcctgcaccccaccgagacacctgcacgtggtgagacccatgtcacattacactactccaatggtgcttcagcaggccgcaattcctatccaaattaacgtagggaccactgttactatgacaggcaatggcacacgacctcctcccacacctaatgcagaggctccccctccaggtcccggacaggccagttccgttgccccaagctcaaccaatgtggagagctctgcggagggtgctccacccccaggtcctgcaccgccacctgctacatcacatccacgcgtcatcagaatttcccaccagtccgttgagcccgtggttatgatgcatatgaacatccaggggcagcaggtgccagggtttcccactgctcccactagggtggtgatcgccaggcccactccccctcaagcgagaccttcacacccaggcggaccacccgtatccggcacactgcagggcgctgggctcggtacaaatgccagcctggctcagatggtgtccggcttagtcggacagctactcatgcagcccgttctggtcgcctag

SEQ ID NO: 215835 - DNA, 780 bp, Artificial Sequence
  Description of Artificial Sequence: Synthetic coding sequence
atggagcctaatgactcaacatctaccgccgtggaggaacccgacagcctggaggttctcgtgaagactctcgatagccagactagaactttcattgtgggagctcaaatgaatgttaaggagttcaaggagcacatcgctgcttcggtatctattcctagtgaaaagcagcgcctcatctaccagggcagggtgttgcaggacgacaaaaagctccaggagtataacgttgggggtaaagttatccatctggtggagagggcaccaccccaaacacatctacccagcggcgctagtagtggtacggggtctgcatccgccactcatggcggtgggagccctcccggtacccggggaccgggtgcctccgtgcacgatagaaatgctaactcctacgtcatggtcggcaccttcaatctgcccagcgatggttccgccgttgatgtccatataaatatggaacaggcgcctattcaaagtgagccaagagtccgtttggtgatggcccagcacatgatccgggatatccagaccctactttctcgcatggagtgcagaggcggacctcagcctcaacatagccagccgccaccacagccgccagctgtcacacctgaacccgtagctttgtcatcccagacaagcgagccggtggaatccgaggcgcctccccgtgaaccaatggaggccgaagaagtcgaagaacgggctcccgctcaaaaccctgagctgactcccggacctgcccctgctgggccaacacctgcccctgaaacatag

SEQ ID NO: 215836 - DNA, 477 bp, Artificial Sequence
  Description of Artificial Sequence: Synthetic coding sequence
atggagcccaatgacagcacgagcaccgccgtcgaggagcctgacagcctcgaggtgctggtgaagacgctcgattcccaaacccgaacatttatcgtgggagcacagatgaacgtgaaggagtttaaggagcacattgctgccagcgtctctatcccatccgagaagcagaggcttatctaccagggcagagtcctgcaagacgacaaaaaactgcaagaatacaacgtcggagggaaggtgatccatcttgtagaaagggcccctcctcagacccacctgccatccggggcttccagcggtactggcagtgcgagtgctacccatgggggtggaagccccccagggacccggggacccggtgccagtgttcatgataggaatgctaatagttacgtgatggtaggaacattcaacttgccctcagatgggagcgccgtggacgttcacatcaacatggaacaggcacctatctag

SEQ ID NO: 215837 - DNA, 621 bp, Artificial Sequence
  Description of Artificial Sequence: Synthetic coding sequence
atggagcccaacgatagcaccagcaccgccgtggaggagccggattccttggaggtcctggtgaaaaccctggactcacagacacgtactttcattgtgggggctcagatgaacgttaaagagttcaaggaacatattgccgcatctgttagcatcccttccgaaaaacagcgtcttatttatcagggtagagtcctccaggacgacaaaaagctgcaggaatataacgtcggtggaaaagtgatccacttggtggaacgggctcctccacagactcacttgcccagtggcgcatctagtggaaccggatcagcatccgctacacacggcggaggatcacccccagggacccgcggacccggtgcgtcagttcacgaccgtaatgctaacagctacgtgatggtagggacatttaatctgccctccgaacctcgcgttagattagtgatggcccagcatatgattagggacatccagacactgctgtctagaatggagtgccggggaggtccacagccgcagcacagccagccccctccccagccaccagccgtcactcccgaaccagtagccctgtcctcccagacttccgagccagtggagagcgaggccccaccgtag

SEQ ID NO: 215838 - DNA, 3399 bp, Artificial Sequence
  Description of Artificial Sequence: Synthetic coding sequence
atggagccgaacgattcgaccagcaccgccgtcgaggagcctgattccctggaagtcctagtgaagacattagatagccagacaaggacgtttatcgtcggcgcacagatgaacgtcaaggaattcaaggagcatatagcagcttcagtgtccatcccatccgaaaaacaaaggttgatctatcagggtcgcgttctgcaggatgacaaaaaacttcaggaatacaacgtcggcggaaaggttattcatctggtcgaacgggctcctcctcaaacccacctgccaagcggtgctagctctggcacaggcagtgcctctgcaacccacggaggcggaagcccacccggaacaaggggcccaggcgcaagcgtgcatgatcggaatgccaatagctatgtgatggtggggacctttaatcttcccagtgatgggtctgctgtagacgtccatataaacatggagcaggctcccattcagagtgaaccccgagtgcgcctggtgatggctcaacatatgattagggatattcagacactcctctctcgcatggaaacactcccatatctgcagtgccggggtggaccacaaccgcaacactcccagcctcccccacaacctcctgcggtgacccccgagcccgtggctctgtcgtcccagacctctgaaccggtcgagagtgaggcgcctcctcgggagccaatggaggctgaagaggtggaggagagggcgccagctcagaatccagagcttacaccgggacccgcacctgccggtccgacccctgcccctgagactaatgcaccgaatcatccatcacctgccgaatatgtcgaggtgttacaggagctccagcgactcgaatcacgcctgcaacccttcctgcaaagatactatgaagtgctaggggcagccgcaacgacagactataacaataaccatgaggggcgtgaggaagaccagcggctgatcaatctagtcggggagtcactgcgcctcctggggaatacattcgtcgcactttcagatttacgctgtaacctcgcatgcaccccgcctcggcatcttcatgtagtgcgccctatgtctcattacactacgcccatggtgttacagcaggcagctattccaatacagattaacgtgggcactacagtgacaatgactgggaacgggactcgtccacctccaacacctaacgccgaagctccaccacctgggccagggcaagcctcttcagtcgcccctagcagcactaacgtggaatctagcgctgaaggagctccacccccagggccagcacccccacccgctactagtcacccacgcgttatacgaatctctcaccagtccgtcgagcctgtggtgatgatgcatatgaatattcaggattcagggacacagcccggtggggtgccttcggcccctactgggccactgggcccacccggtcacggccagacactggggcagcaggtccccggtttcccgactgcccctacaagagtggtgatcgccaggcccacccctccacaggccaggcccagccatccagggggaccgcctgtttcgggaactctgcagggggcagggctcggaacaaatgctagcctggctcagatggtcagtggattggtcggacagttactcatgcagcctgtgctggtcgctcagggtacaccaggcatggccccacccccagctccagcaactgcctcagcatcagcaggcaccaccaatactgctacaactgctgggccagcgccaggcggtcccgctcagccccctcccacaccacagccttctatggcagatctgcagttttcacagctgttgggtaatctccttggccctgccggacctggcgctggtggacccggagtcgcctcaccgaccatcaccgttgctatgccaggtgttcctgcttttctgcagggcatgactgacttcctgcaggccactcagacagctccccctccgccaccccctcccccaccgccacctcctgcccctgaacagcaaacaatgccgccacccggaagcccctcaggtggagccggatctccgggtggactgggcctggaatccctgagccctgagtttttcacttctgtcgtccagggagtcctgtcctcactcctcggaagtcttggcgcaagggccggatcatccgaaagtatagcagcatttatccaacggctctcgggcagctctaatatttttgaacccggagccgacggtgcccttggattcttcggcgctcttctgagcctcctttgtcagaacttcagcatggttgacgtggtgatgttgctccatggacactttcagcctctccagcgcctgcagccgcaactaaggtcctttttccaccagcactatctggggggtcaagagccaactccctcaaacattcgtatggctacgcacacacttatcaccggccttgaggagtacgtgcgggagtctttcagcctggtacaagttcaacctggcgtcgatattatcagaaccaatctggaattcctgcaggagcaattcaactccatcgccgctcacgtgctccattgtaccgattccggctttggggctcgattacttgaactctgcaaccagggcttgttcgagtgcttagcccttaacctccattgtctgggtggtcaacagatggagctggcagccgttatcaatggccgaatcagaaggatgtcacggggtgtaaacccttcactggtgtcatggctaaccactatgatggggctcaggctgcaagtggtgctagaacacatgcccgtcggccctgacgccatcctccggtatgtgcggcgagtaggggaccccccacagcctctgccggaagaacctatggaggtgcaaggggctgaaagagcttctccagagccccagcgcgagaatgcatctcccgcaccaggaactaccgcggaggaagctatgtctagaggccctccccctgcccctgagggcggaagccgggacgagcaagatggggcatccgccgagactgagccttgggctgctgcggtcccgccagagtgggttcctataattcagcaggacatccagagtcagcgaaaagtcaagcctcaaccacccctgtccgatgcctacttaagtggaatgcctgctaaacgtaggaagacaatgcaaggggaaggccctcagctcctcctgtccgaagccgtttcaagagccgctaaagccgcaggcgcaaggcctctgacctcaccagagtctctctcccgggatctggaggccccagaggtccaggaatcataccggcagcagttaaggagcgatattcagaagagattgcaagaagaccctaactacagcccccagcgctttcccaatgctcagagagctttcgctgacgacccttag

SEQ ID NO: 215839 - DNA, 717 bp, Artificial Sequence
  Description of Artificial Sequence: Synthetic coding sequence
agtagcgccgagggagcacctccacccggtccagcacctcccccagctacaagccacccaagagtgattcgaatcagccaccagagtgttgaacctgtggtaatgatgcacatgaacatacaaggccctttatcactctctccatgcccggactctggtacccagccagggggtgtgccgtctgcaccaacggggccattggggccacctggacatggacaaacacttggacagcaggtccctggcttccccacagctccaacaagggtcgttatagctcggccaactccacctcaggcccgaccatctcatcccggtggccctcccgtttcagggacactgcagggggctggactgggaactaatgcgtcgctcgctcagatggtgtctgggcttgtcggccagctattaatgcagcctgtgcttgtggcccagggaaccccaggtatggcccctccaccagcaccagcaactgcctcggccagcgcaggaacgaccaacacggccacaactgcaggcccagcccctgggggtcctgctcagccccctccgacaccccaaccttccatggccgatctccagtttagtcagctccttggtaatttgttgggtccagccggaccaggagctggtgggagcggagtggcaagccctaccatcaccgttgcaatgccaggtgtgccagcctttctgcaagggatgacagactttctttag

SEQ ID NO: 215840 - DNA, 621 bp, Artificial Sequence
  Description of Artificial Sequence: Synthetic coding sequence
atggagcctaacgactcaacttccaccgccgtggaagaaccagatagcctggaggtgttggtgaagacattggattcccaaacaaggaccttcattgtgggagcgcagatgaatgtgaaggaattcaaggaacacattgctgcttctgtcagtatccctagcgaaaagcaaaggctcatctaccaaggcagggtgttgcaggacgacaagaaactgcaggagtataacgtcggcggtaaggtaattcatttagtcgaacgcgctccacctcagactcacttaccgagcggggcaagcagtgggacaggaagtgccagcgccacccatgggggtggtagcccaccaggtacacgaggcccaggggcttcagtacatgacagaaacgcaaactcttatgttatggtggggaccttcaatctgccaagcgagcctcgagttagactggtgatggcccagcacatgatcagggatatccagacattgctgagccgcatggaatgcagaggcggtccacagcctcaacacagtcagccccctccccagccccctgctgtgacgcccgagccggtagccctctcttctcaaacctctgagccagtggaaagtgaagcccctccttag

SEQ ID NO: 215841 - DNA, 558 bp, Artificial Sequence
  Description of Artificial Sequence: Synthetic coding sequence
taactggcatgcacaccacctagacatctgcacgtagtccggccaatgtcacattacacaactcccatggtactgcaacaggcagccataccaatccaaatcaatgtcggcactaccgtaacgatgacaggaaacggtaccaggcctccacctacgccaaacgcagaagctcctcccccaggccctgggcaagcctcgtccgtggcacctagctccaccaatgtggaaagctctgctgagggcgctcctcccccaggcccagctccgccacctgccacgtcacatccccgtgtgatccggataagccatcagtctgtcgaaccggtggtcatgatgcacatgaacatccagggtcagcaggtgcccggatttcccactgcacctactcgggtggtgatcgcccgacccacgccaccccaggcgcgtccttctcaccccggaggacctccggtttctggcacactgcagggtgccggtctgggcacaaacgcatctctagcccagatggtttctggcctcgtgggccaactgctgatgcagcccgtgctggtcgcctag

SEQ ID NO: 215842 - DNA, 648 bp, Artificial Sequence
  Description of Artificial Sequence: Synthetic coding sequence
atggagccaaatgatagcacttctaccgccgttgaagagcctgactctctcgaggtcctggtcaaaaccctcgactcccagactaggacatttatagtgggagcccagatgaatgtcaaggagttcaaggaacacatcgcagcctccgtttctattcccagcgagaaacagcggctgatctatcaagggcgtgtgcttcaagacgataaaaaattacaggagtacaatgtggggggaaaagtaatccacttagtggagcgggcaccaccccagacccacctgccaagtggagcctcctctggtaccggttcagctagcgcaacacatggtggagggtcacccccaggtacacgtgggccaggagctagtgtacacgaccgcaacgcaaatagttacgtgatggtggggacgtttaacctgccttctgaacccagagttcgccttgtgatggcacaacacatgattcgggacatacagaccttgctcagccgcatggaatgccgcggtggccctcagccccagcactcgcagcctccgcctcaaccacctgctgtgacacctgagcccgtcgctctgtctagccaaacctcagagcccgtggagtccgaggctccacctagagagcccatggaggcagaagaggtgtag

SEQ ID NO: 215843 - DNA, 789 bp, Artificial Sequence
  Description of Artificial Sequence: Synthetic coding sequence
atggaaccaaacgactccacctcaacagctgtagaagaaccagatagccttgaggtgcttgtcaaaactctggactctcagaccaggacctttatcgtcggcgctcagatgaatgtgaaggaatttaaggagcacatcgctgccagtgtatccataccctctgaaaagcaacggctgatataccaaggacgggttttacaagacgacaagaagttacaggagtacaatgtcggcggaaaagttatacacctggtcgagcgggctccgcctcagacccacctgccatcaggcgcatccagtggaactgggagcgcctccgcaactcacggtggtggtagtccgcctggtaccaggggtcccggagctagcgtccatgataggaatgctaattcatacgtgatggtggggaccttcaacctgccgtctgatggctctgctgtcgatgtgcacatcaacatggagcaggctcccatccaatctgaacctcgtgttaggctggtaatggcccagcatatgattcgcgacattcagacactcctctcgcggatggagtgtcgaggcggaccgcagccccagcattcccaaccccctcctcaaccccctgccgttaccccggaacccgttgcgttgtcctcacagacatccgagccagtagaaagtgaggccccacctcgcgaaccaatggaagccgaggaagtggaagagcgagctccggcacagaaccctgagctgacaccgggaccggctcctgctggcccaacccctgcaccagagaccaatgccccttag

SEQ ID NO: 215844 - DNA, 594 bp, Artificial Sequence
  Description of Artificial Sequence: Synthetic coding sequence
atggaacctaatgatagcacaagcactgccgtggaagagccagatagccttgaggtgcttgtcaagaccctggattcacaaacgcgaacctttatcgtgggagctcagatgaacgtgaaagaatttaaggaacacatcgctgcgtccgtatctatccctagcgaaaaacagcgccttatttaccaagggagggttttgcaggacgataaaaagctgcaggagtacaacgtaggtgggaaggtgattcatctggtcgaacgggcaccaccacagacccacctcccatccggagcatcgtctgggaccgggtctgcaagcgcgacacacgggggtggaagcccaccaggtactagaggacccggtgcatccgtgcacgaccgaaatgcgaattcgtatgtgatggtgggtacttttaatctgccaagtgatggatctgcagtggacgtgcatatcaacatggagcaggcacctatacagtccgaaccccgagtccggctggtgatggcccagcatatgattcgagatatacaaacgctcctgagcaggatggaatgccgcggaggtccccaaccccaacacagtcagcccccttag

SEQ ID NO: 215845 - DNA, 735 bp, Artificial Sequence
  Description of Artificial Sequence: Synthetic coding sequence
atggagccaaacgactctacatctaccgcggtggaggagcctgatagcttagaggtgctcgtgaaaactcttgactctcagacacgtacctttatcgttggagctcagatgaatgtgaaggagtttaaggaacacatcgcggcaagtgtttccattccgagcgaaaaacaaaggctgatctatcaggggagagtccttcaggatgataaaaagcttcaagagtacaacgtcggcggtaaggtaatccaccttgtcgaacgggcacccccacaaactcacctgccgagcggagcttcttctgggaccggttctgcttccgccacccacggtggaggttcaccgccaggaacgcggggtccaggagcctcagtccatgaccgcaatgctaacagctatgtcatggttggaacgttcaatcttccttcagagcctcgggtccggcttgtcatggcccagcacatgatcagagatattcaaaccctcctctctagaatggaatgtcgaggcggaccacagccccagcatagccagcctccacctcagcctcccgctgtgacacctgagcctgtggccctgtcttcccagacctcagagcccgtggagagcgaagctcctcccagggaacctatggaggccgaagaagtcgaagaacgggctcccgcacagaatcctgagcttactcccggaccagctccagcaggtccaacccctgctcctgaaacaaatgcaccctag

SEQ ID NO: 215846 - DNA, 681 bp, Artificial Sequence
  Description of Artificial Sequence: Synthetic coding sequence
tgaagtggcttcggtgctcggctgctcgagctctgtaatcaaggtctctttgaatgtctggcgctcaatttgcactgtctgggaggacagcagatggagctcgccgcagtcatcaacggtagaatccgcagaatgtcacggggtgtgaacccttcactggtgagttggttaaccacaatgatgggcttaagattacaagttgtgctcgagcatatgcccgtcggtccggatgcgatcttaagatacgtgcgacgggttggggaccctccccagcccctcccagaggaacccatggaggtgcagggagctgagcgcgctagtccggagccacagagagagaatgcgtcccctgctcctggcaccaccgcagaggaggctatgtcccggggtcctccacccgcacccgagggcggttctcgggacgagcaggatggggcatccgctgagactgaaccctgggctgctgctgtgcccccagagtgggtgcctatcattcagcaggatattcagagtcaacgcaaggtgaaacctcagcccccactttccgacgcatacttgagcggaatgcccgcaaagcggaggaaactccgcagcgatattcaaaaacggctccaggaggaccccaattattccccccagaggtttcccaatgcccagcgggcttttgctgacgatccgtag

SEQ ID NO: 215847 - DNA, 738 bp, Artificial Sequence
  Description of Artificial Sequence: Synthetic coding sequence
cccccaagacatttgcacgtggtaagacccatgtcccactacacaacgcccatggtgctgcagcaagctgccatccccatccagattaatgtggggaccaccgtgacaatgaccgggccagcccctcccccagctaccagccaccctcgagtgatccggattagccaccagtccgtggagccagtcgtgatgatgcacatgaacatccaagactctgggacacagcccggtggcgtgcccagtgcgccaacaggcccattaggacctcccggtcacggccagaccctagggcagcaggtgcctggctttcctactgcaccaactcgtgtagtgatcgccaggcccacaccccctcaagccagacctagtcacccaggagggcctccagtgtctggcactttgcaaggagcgggtctggggacgaacgcgagcctcgcacagatggtctctggtttagtggggcagctccttatgcagccagtgttagtagctcagggcacacctggaatggccccaccacccgctcctgcaactgcttccgccagcgccggtaccacaaacacagcgactacagctggaccagcgccaggtggacccgcacagcctccccctacaccccagccaagtatggccgatttgcagtttagtcaattgctgggtaatcttctggggcctgccggacccggagctggaggtagtggagttgcatcgcccacgatcacagtggccatgccctag

SEQ ID NO: 215848 - DNA, 681 bp, Artificial Sequence
  Description of Artificial Sequence: Synthetic coding sequence
tgaagtgggttcggagcgcgtttgttggagctatgcaaccaaggtctcttcgagtgcctagctctcaatttacactgcttgggcggacagcagatggagttggctgccgtcattaacggacgcatccgaagaatgtcccgcggagtgaaccctagcctggtaagctggctgactactatgatgggcctgcgccttcaagttgtcctcgaacacatgcccgtggggccagacgctattctgaggtatgtccggagagttggcgatccaccccagccattacccgaagagcctatggaggttcaaggcgcagagcgcgcatcccccgagcctcagcgcgaaaacgcaagccccgcaccaggtacaaccgctgaggaggccatgtctcgtggccctccaccagcccctgaagggggatcacgggacgagcaagacggagcttctgccgaaacagagccatgggctgcggcagtgccacccgagtgggttccaattattcagcaggatatacagagccagaggaaggtaaaaccccagccacctctgagcgatgcgtacctctctgggatgcctgccaagaggaggaagttgaggagcgatattcaaaaacgcttgcaggaggatccaaattatagtccccagcggtttccaaatgcacaaagggcctttgctgatgatccttag

SEQ ID NO: 215849 - DNA, 681 bp, Artificial Sequence
  Description of Artificial Sequence: Synthetic coding sequence
taaagcggtttcggagcgaggctcctggagttgtgcaaccaagggctgttcgagtgtctggcgctgaacctgcactgtctgggaggtcagcagatggagcttgctgccgtcatcaacggtcgcatacggcgtatgagtcggggtgtcaacccatccttggtctcgtggctcacaactatgatgggcctgcgactgcaagtggtgttagaacacatgcccgttggcccagacgctatattgcggtacgtacggagggtgggcgatccccctcaaccgttgcctgaggaacctatggaagtccagggtgcagagcgtgcatcccccgagccacaacgggagaacgcctcccctgccccaggcacaacagccgaagaagccatgtcacggggtcccccacctgcccctgaaggcggaagccgcgacgagcaggacggtgcaagtgctgagacagagccatgggcagctgccgttcccccagagtgggtccctataatccagcaggacatccaatctcaaaggaaagtgaaaccccagcctccactctctgatgcctatctctcagggatgccagcaaagagaaggaagctccggagcgatatccagaagcggctccaagaggaccctaactatagtccgcaacggttcccgaatgctcagagggcctttgctgacgacccttag

SEQ ID NO: 215850 - DNA, 777 bp, Artificial Sequence
  Description of Artificial Sequence: Synthetic coding sequence
atggaaccgaatgattcaacctctactgctgtcgaagagccagattctctggaggtcctcgtgaagacgttggatagccagactaggacctttatcgtcggagcacagatgaatgtgaaagaattcaaagagcacattgcggcttctgtctctattccttcagagaaacaaaggctcatctatcagggtagggtgctccaggacgacaaaaagctacaggaatataacgtaggaggtaaagtcatccacctggttgagagagctccaccacagacacaccttccaagtggggctagcagcggcacaggttcggcatccgccactcacgggggtggtagcccaccagggaccagagggccaggcgcttcagtacatgatcgcaatgcgaactcgtacgtcatggtcggtacattcaatctcccctctgacggtagcgccgttgacgttcacattaatatggagcaggccccaatacagtctgagcccagggtcaggctggttatggctcagcacatgattagagacatccaaacgctactgtcccgtatggagtgtagaggcggtcctcagccccaacactcccagccgccaccccaaccacccgctgtgaccccagagcctgtcgcgctaagctcccagacctctgagccagtcgagagtgaggcgcctcctagggaacccatggaagcagaagaagtggaggagagggcacctgcccagaatccggagttgacccccggaccggctcccgctggaccaacgccggctcccgagtag

SEQ ID NO: 215851 - DNA, 411 bp, Artificial Sequence
  Description of Artificial Sequence: Synthetic coding sequence
taaagaatgtctagaggagtgaatccgtccctggtctcttggctgacaaccatgatgggcctgcggctgcaggtggtcttggagcacatgcccgtgggccctgacgccatactgcggtatgttagaagggtcggcgaccccccacagcctcttcccgaggagcccatggaggtccaaggagccgaacgggcaagccccgaaccccaagagtgggtgccaattattcagcaggatatccagagtcagcgtaaggtgaagccacagccacctctgtcagatgcttatctttctggaatgcctgccaaaagacgcaagcttagatctgacattcagaaacggctccaggaggaccccaattattcaccgcagaggtttcccaatgcacagagggcattcgcagatgacccttag

SEQ ID NO: 215852 - DNA, 3489 bp, Artificial Sequence
  Description of Artificial Sequence: Synthetic coding sequence
atggagcctaacgattctaccagcacagctgttgaggagcctgattcccttgaggtgctggtgaaaacacttgattcccagacccgcacctttatcgttggggctcagatgaacgtgaaggagtttaaagagcacatcgcagcaagtgtgagtatcccgtccgaaaagcagcgcttgatctaccagggtagagtgttgcaggacgacaaaaagttgcaggaatacaatgtaggcggtaaggttatccacttagtagagagggcccctcctcagacgcatcttccatcgggcgcttcttccggaactggctcggcaagcgccacacacgggggaggcagcccccctggaaccagagggccaggggcttctgtgcacgatcggaacgcaaactcatacgttatggttgggacatttaatttaccttctgatggttccgctgttgatgtacatatcaacatggagcaggccccaattcagtcggaaccacgcgttagacttgtcatggcccaacatatgatcagagatattcagacactcctaagtcggatggagtgcaggggtggtccacagccacaacactctcaaccccctccacagccaccagctgtcacgcctgaacctgttgccctgagctcccagacatccgagccagtggagtccgaggcaccacctcgggaacctatggaggctgaggaggtcgaggagcgcgctcctgcccagaatcccgagctgacacctgggcctgcacctgccggacccacgcctgctcctgagaccaatgctcctaatcacccatcacccgctgaatacgtcgaggttctgcaggagctgcagcgactggagagccgcctgcagccatttctacagaggtactatgaagtgttgggtgccgcagccacaacagattacaataataatcacgaggggcgagaagaagatcagcggctgataaacctcgtaggcgaaagcctcaggctcttaggaaatactttcgtggccttatcggacctgcgatgtaacctcgcatgcacaccgccaaggcatctgcacgtcgtgagacccatgtcacactacaccacccccatggtactccagcaggccgcaatacctattcagattaatgtcggtacaactgtcacgatgaccgggaacggaacacgtccacctcctactcctaacgcagaagcaccgcctcccggtcccggtcaggctagttccgtcgcacccagttccactaatgtggagagttcagccgaaggggcaccccctcccggacccgcacccccaccggcaaccagccatccaagggtaatcaggattagccatcaatcagtagaaccagtagttatgatgcacatgaacatccaggactcggggacccagccagggggtgtgccttcagcgcctacaggacctctgggacccccaggacacggccagactctgggatctactttgatccagttgccaagtctgccacctgagtttatgcacgcagtggctcatcaaatcacacaccaggctatggtggctgccgttgccagtgctgcagccggtcagcaggttcctgggtttcccaccgcccctacccgcgtcgtgattgccagaccaacaccaccacaggcccgtccctcccatcccggtggtccacccgtatcaggaacactccaaggggcaggcctcggcacgaacgcctcgctggcacagatggtcagcggactcgtggggcagctgttgatgcagcccgtactggtggctcaagggacccccggtatggcgccaccacccgcacctgctaccgcttcagccagcgcgggaacgactaataccgcgacgaccgcgggtcccgctcctggaggtcctgcgcagccaccaccaacaccccagccaagcatggctgacctccagttcagccaactgctcggcaatctgctcggacccgcaggccctggcgctggcggacccggagtggcttcacctaccatcacggttgcaatgcctggcgtgccagctttcctgcagggaatgaccgatttcctgcaagccacccagacagctccaccaccacctcccccaccaccacccccaccaccggctcctgagcagcagacaatgccccctcctggctcaccgagtggaggggctggaagtccgggtggtctgggccttgaatcactgtcccccgagtttttcacctcggttgttcaaggcgtgctgtctagcctgttgggctcgttaggcgcacgcgctggttcctccgaatccatcgccgctttcatacagcggctctccgggtcgagcaatatctttgagcctggtgcagatggggctctcgggttcttcggggctctcctcagtctgctatgccagaattttagtatggtggatgtggtgatgctgcttcatggtcatttccaacccttgcagcggctgcagccacaactcaggagtttctttcatcagcattatctaggcggacaggagcccactccgtccaacattagaatggccactcacactctgatcacaggtctcgaggaatatgttagggagtcattctctcttgtgcaggtccagcccggagtggatattatacggactaacctggagtttctgcaggaacagttcaattccatcgccgctcacgtccttcactgcacagactcaggctttggagcacggctcctggaactgtgtaaccagggattatttgagtgcctggccctaaacctacactgcctcggcggacaacagatggagctggccgcagttatcaatggcagaatcaggcgcatgagtcgaggagttaatcccagtctagtttcctggttgactactatgatgggacttcggcttcaggttgtcctcgagcacatgcctgtcggacctgacgccattcttcgctatgtaagacgggttggagacccaccacagcccctgcccgaagaacccatggaggtccagggggctgaacgggcatctcctgagccccaacgcgagaacgcgtctccagcaccagggacaacagctgaggaggcaatgtctagaggaccgccaccagccccagaaggtggcagccgggatgaacaggatggggcttccgcagaaacagagccttgggccgctgcggtgccacccgagtgggtacccatcattcaacaggatatccagagccaacgtaaggtgaaaccccagccacccctgagcgacgcctatctctcagggatgccagcaaagcgcaggaagaccatgcagggcgagggcccacagctccttctttccgaggccgtgtcccgtgctgccaaagcagctggggcacgcccactgacaagccctgagagccttagtagagatctcgaagcccctgaagtgcaggaatcatacagacagcaacttaggtcagacatccagaaacgcctgcaggaggaccccaattacagcccccagagatttcctaacgcccaacgggcatttgccgatgacccatag

SEQ ID NO: 215853 - DNA, 2712 bp, Artificial Sequence
  Description of Artificial Sequence: Synthetic coding sequence
atggagccaaacgattctaccagtactgctgttgaagaaccggatagccttgaagtgctggtcaagacactggatagtcagacgcggacctttatcgtgggagcccagatgaatgtcaaggagttcaaggagcatatcgccgcttcggttagtatacccagcgaaaagcaaagacttatttaccagggaagggtgctgcaggatgataagaaattacaggaatacaacgtaggtgggaaagtgatacatctagtggaacgggctccaccgcaaactcacctccccagcggcgcttcttcgggaaccggttctgcctccgccacccacggaggagggtccccacctggtacccgcggtcccggtgccagcgtgcatgacagaaacgccaattcctatgttatggtcggcaccttcaacctgccaagcgatggttcggccgtggatgttcacattaatatggaacaggcaccgatccagtccgaacctcgtgtgcgactagtcatggctcagcacatgatccgcgacatccagacactgctgtccaggatggagtgcagaggagggccacagcctcagcattcccagcccccaccccagcctcccgctgtgactcctgaacctgttgctctgtcctcacaaactagtgagcctgtcgagagcgaggctccaccccgtgagccaatggaggctgaagaggtagaggagagggcaccagctcaaaaccctgaactgactcctggtcctgcccctgccggacctacacctgcccctgagactaacgcgccaaatcatccgagccctgccgaatatgtggaagtgctccaagagctgcagagattggaaagtagattacaaccatttctgcagcggtattatgaggtcctgggcgctgccgcaacaacggactacaataataatcacgaaggcagagaggaggaccaacgcctgatcaatctggtgggagaatcgttacgtctgttgggaaatacctttgttgcccttagcgacctacggtgtaacctggcatgtacaccaccacggcatctacatgttgttcggccaatgagtcactatacaacgcctatggtcctgcagcaggctgcaataccaatccagatcaacgttggaactaccgtcaccatgactggcaacggcactcgcccacccccaactccaaatgctgaggcgccaccccctggcccaggtcaggcttcttccgtggctccctcgagtactaacgtggaatctagtgccgaaggagcccctcctccgggacctgcgccaccacctgctacttcacaccccagagttattcgcatttcgcaccagtcggtggaaccagtggtgatgatgcatatgaacattcaggactccggcacacagccaggcggagtcccctcagctcctactggacccctgggcccacctggtcatggccaaaccctgggacagcaggtccctggattcccgaccgcacctacccgtgtcgttatcgcgcgtcccaccccaccccaagcaagaccatcccaccccggtggtccaccagtaagtggcacgcttggcgctgggctggggaccaatgcctccctcgcccagatggtaagtggcctggtaggccagcttttgatgcagccagtcctggtcgcacagggaaccccgggatcacccggaggcctgggcctggaatctctgtccccggagttcttcacatcagtggttcaaggagtattgtcttcattgcttggcagtctgggtgccagagctggatcaagtgagagtatcgccgcttttatacaacgactgtctggcagctccaacatctttgaacccggtgcggacggtgctctgggatttttcggggctctgctgtccctgctctgtcagaattttagcatggtggacgtggtaatgctactacacgggcactttcaacccctgcaacggcttcagccacagttgcggtcattttttcatcagcactatctaggtgggcaggagccgactccctccaacattcgaatggcaactcacacgctgatcaccgggctggaagagtatgtcagagaaagctttagcttggtgcaggtgcaaccgggagtagacataattcgaacgaacctggaatttctgcaggagcagtttaacagcattgccgcacatgtgctgcactgtacagatagtggcttcggagccaggttgcttgaactgtgtaatcaggggttatttgaatgtctagcgctcaacctgcattgcctgggcggtcagcagatggaattagcagccgtgattaatggtagaattaggcgcatgtcacgcggagtaaatcctagtttagtgagctggctgactacgatgatgggacttaggctgcaggttgtcctggaacatatgccagtgggacctgacgccatcctgcgttacgttcgccgagtcggagatcctccgcagcccttgcccgaggagcctatggaagtgcagggcgcagagagggcgagcccagaaccccaagaatgggtacccataatacaacaggatatccaatctcaacgtaaagttaagccccagccccctctgtccgacgcctatctctccgggatgcctgccaagcggagaaagcttcgtagcgatatccagaagcgacttcaggaagaccccaactactctccacagcggtttccaaacgcccagagggcatttgccgacgatccttag

SEQ ID NO: 215854 - DNA, 2712 bp, Artificial Sequence
  Description of Artificial Sequence: Synthetic coding sequence
atggagcccaacgattccacctcgactgccgtagaagagcccgactccctggaggtattggtgaaaactttggactcccaaacgcgcacatttattgtaggggctcagatgaatgtcaaggagttcaaggaacatatagcagcatcagtctccatcccatccgaaaagcagaggcttatctaccaggggagggtgctgcaggatgataaaaaactgcaggagtataatgtgggtggcaaggtgattcatctggtggagcgagccccaccgcagacgcatttgcctagcggcgctagctctggcacaggatctgcttctgccactcatggcggaggttctccaccaggcacccgcggacccggagcctcagttcacgaccgcaacgctaattcttatgtgatggtgggaacatttaaccttcccagcgatggttccgcagtagacgttcacattaatatggagcaagccccaattcagtctgaacctagagtcagactggttatggcacagcacatgatccgtgacattcagactctgctgagccgaatggagtgccgcggaggccctcagccacaacattcccaacctccacctcagcctcctgctgtaacacctgaaccagtcgccctgagttcgcaaacatccgagccagtggagtcagaggctcctccaagagagcccatggaggctgaggaggtagaggagcgggcacccgcacagaatcctgaactcacccccggtccagcccctgctggtcctacccccgctccagagactaatgcacccaaccatcccagcccagctgagtacgtcgaggtacttcaggagctgcaacggctcgaatctcgcctgcagccctttcttcaaaggtactatgaggtcttgggcgcagccgctaccacagattataacaataaccacgaagggagagaggaggatcaacggcttatcaacctagtgggggagtcgctgcgcctccttgggaatacttttgtggccctctccgacctcagatgcaacttggcctgtacaccaccgaggcatttacacgtggttcggcctatgagtcattatactacacccatggtgttgcaacaggctgcaatccccatccaaattaacgtggggaccacagtgacaatgactggcaacggaactcgcccaccccctactccgaatgccgaggcccctccccctgggcctggacaagcaagctccgttgcgccatcaagcacaaacgtggagagctctgccgagggcgctccaccacctggcccagcaccaccaccagccaccagccaccccagagttatccggatttcacaccaaagtgttgaacccgtggtcatgatgcacatgaatattcaagatagtggcacccagcccggaggggtcccctctgcacccacaggcccactagggccacccggtcatggtcagactctcggtcagcaggtccccggattccctaccgctcctacaagagttgtgatcgcgagaccaactccaccccaagcacgaccttcccatcctggtgggccaccggtttccggaaccttgggtgctggcctcggcactaacgcttccctcgcacagatggtgagtgggcttgtcgggcaactgttgatgcagcccgttctagtagcccaggggaccccaggatccccaggaggcctgggccttgagtcactttccccagagttttttactagcgttgtgcagggcgtgttgtcaagcctgcttggatctctcggggctagggccggttccagtgaatccatcgccgctttcatccagaggttgtctggctcgagcaatatatttgagccaggggctgacggagccctgggtttttttggagcactgctgtcgctcctgtgccaaaatttttctatggtagatgtcgtgatgctgctgcatggacacttccagccattgcagcgcctgcagcctcagttgcgttctttttttcaccagcattatctaggcggtcaggagccaaccccatccaatattcgcatggcaacccacaccctcattaccgggctcgaagagtatgttagagagtcttttagtctggtccaagtgcagccaggggtggatatcatcagaaccaatctcgagttcctccaagaacagtttaatagtatcgccgctcacgtgctgcattgcacagacagcggttttggagcacggctgttggagctgtgcaaccagggactcttcgagtgcctggcattgaacttgcactgtctaggcggacagcaaatggaattagccgctgttattaacgggagaatcaggcgcatgagcaggggcgtgaatccatccctggtttcgtggctgacaacaatgatggggttgcggctgcaagtcgtccttgagcatatgcctgtagggccagatgccatactccgatacgtgaggcgagtaggtgacccgcctcaacccctgcctgaggagccaatggaagtacagggcgctgagcgcgctagccccgagccccaggagtgggtaccaatcatccaacaagacatacagagtcagcggaaggtaaaaccccagcctcctctctctgacgcctacctctccgggatgcccgctaagcggagaaaactgcgaagcgatatccagaaacgccttcaagaggatccaaactatagtcctcaaagattcccaaacgcccagagggccttcgcggatgacccttag

SEQ ID NO: 215855 - DNA, 3234 bp, Artificial Sequence
  Description of Artificial Sequence: Synthetic coding sequence
atggagcccaatgattcaaccagtactgccgtcgaagaacctgattctcttgaggtcttggtaaagactctggattcacaaacccgcacgttcatcgtgggtgcccagatgaacgtcaaagaatttaaggagcacatcgcagcctccgtatccatcccatccgaaaaacagcggcttatctatcaaggtcgggtcttacaggacgacaagaagctccaggaatacaacgtgggagggaaagttatccatctggtcgaacgagctcctccccagacccatctgcctagcggcgcatcaagcggcaccgggtccgcctccgcaacccacggagggggatcccctcccggaacccgagggcctggcgctagcgtacacgaccgcaatgctaatagctacgtgatggttggcacctttaacctcccctccgatggcagcgctgtggacgtgcatatcaacatggaacaagcccctatccagtcagaaccacgggtgcgcctcgtgatggcccagcatatgataagggacatccagacactactatcaaggatggagtgccggggtggacctcaacctcaacatagccagccccctccccaacccccagccgtaacgcctgaacctgttgccctgtcttctcagacctccgaaccagttgaatctgaggcaccaccacgagaaccgatggaagctgaagaggtcgaggagagagctccagcccagaacccagagctgactcccggtccagccccagccggtcccacacctgctcctgagaccaacgcaccaaaccatccaagtccagcagagtatgtggaggtcctgcaggagctgcagcggctcgaaagccggcttcagccctttctccagagatactatgaagtgctgggagctgccgctaccaccgattacaataataatcatgagggccgagaagaggatcagcggttaatcaacctggtgggggagagcttacgtctcctgggaaatacctttgtcgctctttctgatctccgctgtaacttggcctgcactcctccccgacacctgcacgtggtcagacctatgagtcactacacaacaccgatggtactgcaacaagcggctattcccatccaaattaatgtcggcactacggtgacaatgacaggcaatggcacccggccacccccaacgccgaacgcagaggccccaccacccggacccggtcaggcttcaagtgtagctccatcttccacaaacgttgagagtagcgccgaaggagcccctcccccaggcccagcaccccctcctgcgacatctcacccccgtgtcattcgaatttcgcaccagtctgtggagccagtggtcatgatgcatatgaatatccaggattcgggaactcaacccggaggtgtgccgtccgcccctactggcccactcggtccccctggacacggtcagaccctggggcagcaagttccaggcttccctacagcccctacgcgggtggtgattgctcgcccaacccctcctcaggccagacctagtcatcccggaggccctcccgtttccgggactctccagggagccggactcggcactaacgcatccctggcccagatggtatcaggtcttgtggggcaactgttaatgcaacctgtcctcgtcgcccaaggaaccccaggaatggcacccccacccgctccagccactgcgtctgccagcgccggaactaccaatacagcgacgacggccggtcccgctccagggggtccggctcaaccacctccgactccccaaccatccatggccgaccttcagtttagccaacttctggggaaccttcttgggccagccggaccaggggctggcggaagcggggtggcaagtcctaccattacagtggcaatgcctggagtgccggcatttctgcagggcatgacagactttctccaggccacgcagaccgcacctcctcctcctccaccgccaccaccccctcctcctgccccagagcaacagacaatgccccctcccggaagtccctccgggggagctgggtcacccggagggctggggctcgaaagcctgtcccccgagtttttcacgtctgtggttcagggggtcttatcatctctcctggggtctctgggcgctagagcaggcagcagcgaatccattgctgcatttattcagcgcctgtcaggcagttcaaacatcttcgagcccggtgctgacggagcattaggattttttggtgcgctgctatctctactgtgtcagaattttagcatggttgatgttgtgatgcttctgcacggccacttccagcccttgcaaagactccagccccaacttaggagttttttccatcaacactacctggggggacaagagcccaccccttctaatattaggatggccactcataccctgatcaccggcttagaggaatacgtacgcgaaagcttctctcttgttcaggttcagcctggggttgatatcattcgaacaaacctggaattccttcaggaacagttcaattcgatagctgcgcatgttctgcactgcaccgatagtggttttggcgctcggctgctcgagctctgcaatcagggcctgtttgagtgcttggcattaaacctccactgtctgggcggtcaacagatggagctggccgctgtgatcaatggcagaattcgccgaatgtctcgaggggtgaatcccagcctggtttcatggctgaccacaatgatgggccttcggcttcaggtggtccttgagcacatgccggtcgggccagatgccattctgcgctatgtgcggcgagtgggcgatcctccccaacccctgccagaggagcccatggaagtgcagggggcagaaagggccagccctgaaccgcagcgggaaaacgcgtccccagcaccgggaaccaccgctgaggaagccatgagcagaggaccccctcccgcacctgagggtggcagccgcgacgagcaagatggggcatcagctgagaccgagccatgggccgctgcagtgccccctgagtgggtcccaataatacagcaggacattcaatctcagaggaaggtgaagccgcagcctccactgagcgacgcctatctgtcaggcatgccagccaagcggagaaagttaagatccgacatacagaagcggctgcaagaggacccaaactatagccctcagcgattcccaaacgcccagagggctttcgccgacgatccttag

SEQ ID NO: 215856 - DNA, 3234 bp, Artificial Sequence
  Description of Artificial Sequence: Synthetic coding sequence
atggagccaaatgacagcacctctactgccgtggaggaacccgactccctggaggtgcttgttaaaacattggattcacagacaagaacatttatagttggagcccagatgaatgttaaggaatttaaggaacatattgctgcttccgtttctattccctcggagaagcagaggctgatatatcagggccgtgtactgcaagatgacaagaagcttcaagaatataatgtggggggaaaggttatacaccttgtagagcgagccccaccccagacccatctgccgagtggcgcttcatctggtacagggtccgcctccgccacccacggtggcggatcgcccccaggtacccgtggtcccggtgcctcagttcatgatcgcaatgccaactcatatgtgatggtgggtacttttaacctcccctctgatggatctgcagttgatgtgcatattaatatggagcaggcacccatccagtcagagccacgagtgaggctcgttatggcccagcacatgatacgcgacatccagactcttttaagccgcatggagtgtaggggcggaccacagcctcagcactctcagccccctcctcagcctcctgccgtcacgcccgagccagtggcgctcagctcccagaccagtgagcccgttgaatccgaggcaccacctcgagagcccatggaagccgaggaagtggaggagcgggcaccagcccaaaatcccgaactaaccccagggcctgcaccggctggtcccactcctgcaccagaaacgaatgcaccaaaccacccgtctcccgctgagtatgttgaagtacttcaggaactgcaaagactggagtctcggctgcagccttttctgcagcgctactacgaggtcctgggagccgcagccacaactgactacaataacaatcacgagggtcgggaggaggatcagcgccttatcaatctagtaggcgaatctctgcgtctcctcggcaacacattcgtcgcattgagcgacttgagatgcaatctggcctgtacgcctccaagacatttgcatgtcgtgagaccgatgagccactacactacacccatggttctgcagcaggccgcaatacccatacaaatcaacgtcgggaccacagttactatgaccgggaatggcacccgtcctccgccaacccccaacgcggaggccccacctccaggccctggtcaggcctcatcagtggctccatcctctaccaacgtggagagttcggctgaaggggcaccacctcctggacctgccccaccccctgccaccagtcacccacgggtcataaggatctcacaccagtcagtagagcccgtggttatgatgcatatgaatattcaggattctgggactcagcccggaggggtgccttcggctcctacgggtcccctgggaccaccaggacacggccagacgctcggccagcaggtacccggattcccaacagcgccaacccgtgtggtaatcgctaggccaactcctccacaggctaggcccagtcaccctggcggacctcctgtgagcggcaccttacaaggggctggactcggtacgaacgcctcgttggcacagatggtgagcggtttggttgggcaacttctaatgcagccagttctggtggcgcagggtactccaggtatggctccaccccctgctcctgctacagcgagtgcttctgctgggaccaccaatactgcaacgacagcgggacccgctcccggagggcctgcccagccacctcccaccccacagccatccatggcagatcttcagttttcacagctcctcggaaacctgctgggtcccgctggtccaggcgcaggcggaccaggggtcgcgtcgcccaccatcacagtagccatgcctggagtgccagctttcctgcaaggcatgaccgactttttgcaggctactcagactgctcctccaccaccaccgccacctccccctcccccacctgctccagagcagcagacaatgccaccccctgggagtccatcagggggagccggatctcctggagggctgggtttggagagcctaagccctgaatttttcacctcggtggtgcagggcgtgctcagctcactgcttggcagcctgggggcacgggcaggcagcagcgaaagtattgctgcgttcatccaaaggttaagtggtagctccaacatctttgaaccgggtgctgatggggcattgggtttctttggggcactcctgagcctgctgtgtcagaacttctctatggtagacgtggtgatgctgctccacggacacttccagcctctgcaacgactccagccccagttgcgtagcttttttcaccaacattacttaggcggtcaggagccgacaccttcaaacatccgcatggctacacatacgctcataacggggcttgaggaatacgtccgcgagagctttagcctcgtgcaggtccaacccggagtagatatcattcggaccaacttggagttcctccaggaacagtttaacagtattgccgctcacgtattgcattgtaccgattcaggttttggcgcacgtctgctcgaactttgcaaccaggggctctttgagtgcctcgccttgaacctgcattgtttgggtggccagcagatggagctcgccgcagtgattaacgggcgtatacgcagaatgagtagaggggtgaatccaagtctggtgtcttggctaacaactatgatgggactgcggttgcaggtggtgcttgaacacatgcccgttggcccagatgccatcctgaggtacgttaggcgagtcggtgacccccctcagcccctgccagaagagcccatggaagtgcagggcgcagagcgtgcctcacccgagcctcagcgggagaatgcttcacccgctcctgggacaacagccgaggaagcgatgagcagaggacctccccctgctccagaggggggatcacgcgacgagcaggacggcgcaagcgctgagacagaaccgtgggctgctgcagtccctccagaatgggtgcctatcatccagcaagacattcagtcacagaggaaagtgaaaccgcagccccctctgtccgatgcatacctctcagggatgccggcaaagcggcgaaagctacgtagcgacattcagaagcgactgcaagaggaccccaattactctccgcagcgcttccccaacgcacagagggccttcgccgacgatccctag

SEQ ID NO: 215857 - DNA, 3489 bp, Artificial Sequence
  Description of Artificial Sequence: Synthetic coding sequence
atggaacccaacgattcaacatctaccgcagtggaggagccggacagcctcgaggtcctggttaaaaccctggattcccagacacgcacctttattgtgggcgcacaaatgaacgtcaaggaattcaaagaacacatcgctgcctctgtttccattcccagtgagaagcagcggttaatctatcagggcagagtgcttcaggacgacaagaagctgcaagagtataatgtgggtggcaaggtgatccacctcgttgagcgagccccaccccagactcatctcccttcaggagctagttccgggaccggttctgcttccgcaacacatgggggaggttccccaccgggtacccggggtcctggcgctagcgtgcacgatcgcaacgccaactcttatgtgatggtggggaccttcaacctgccctctgatggttcagcagtggacgtccacataaacatggagcaagctccaatccagtctgagccccgagtccgcctcgtaatggctcagcacatgattagggatatacagaccttgctgtcgcgcatggaatgccgaggagggccacagcctcagcactcccagcctccgccacaacctcccgcagtgacacccgaacccgttgcactgtctagtcaaacttccgagcccgtggaatctgaggcccctccgagagagcctatggaagccgaagaggtggaggagcgggcaccggcacaaaatcccgaactcacccctggacctgcccctgctggcccaacgcctgctcctgagacaaacgcgcctaaccacccttcccccgctgagtacgtggaggtcctgcaggagctgcaacgcctcgagtcgagactgcagccctttctgcaacgttactatgaggtgctcggcgcagcagctacaacggactataacaacaaccacgaaggacgcgaagaagaccagaggctgatcaatctggttggggagagtcttagattgctgggaaatactttcgttgccctgagcgaccttaggtgcaatttggcctgcacgccaccacgccatctgcacgtcgtcaggcccatgagtcactataccacacccatggtcctgcagcaggcggctatccctatacagattaacgttgggactaccgttacaatgacaggaaatggaacacgaccacccccaacccctaacgccgaagctcctcctccaggcccagggcaggcctctagcgttgcaccatcttcgaccaatgtggagtcctcggcggaaggcgcaccaccaccaggcccagccccaccgccagctaccagccaccctcgggtgatccgtatctcacaccagtcagtcgaacccgtggtgatgatgcatatgaacatccaagactccgggactcagcccggtggcgtgcctagcgcccctactggacctctcggtcccccaggacacggacagaccttgggtagcacgttgattcaattgccctctctaccgcctgagttcatgcacgcggtggctcaccagattactcaccaggccatggtggcagcggtggcatccgctgccgctgggcagcaggtgccaggatttccaacagccccaacgcgcgtggtaatagcacggcctaccccgccacaggccaggccctcccaccccggagggccaccggtgtccgggaccctgcagggagcagggctcggcacgaatgccagtctggcccaaatggtgtccgggttagtgggtcaactactcatgcagccagtattggtcgcgcagggaacgccagggatggcaccgcctccagcaccagctaccgcaagcgcttctgcgggtacgacgaatactgctaccacagcgggtccagcccctggtggcccagcccagccacctcccacaccacagcccagtatggctgatctacaatttagccagctgctcggtaacctgctggggcctgctggtcccggagctggagggccaggcgttgcctcccccactatcactgttgccatgcccggagttccagcttttctgcaaggcatgacggacttccttcaagcaacccagacagcccctccaccacctcccccacctcctcctcccccacctgctccggaacagcagaccatgcccccacctggctcaccctctggtggagcgggaagtcccggagggttagggctggaatccctcagcccagagttctttacgtccgtggtacagggcgtgctcagtagcctcctcggaagtttgggagcacgcgcaggcagctcagaatcaatcgctgccttcattcagagattgtctggttcctctaacatcttcgaacctggggcagacggcgctctagggttttttggcgctttactgagtcttctctgtcagaatttcagcatggtggacgtggtgatgctgctccacggacacttccagccgctacagcgactgcagcctcaactccgttcattcttccatcaacactatctggggggacaagaacccaccccttctaatatacgtatggccacacatacactgatcacagggctggaagaatatgtacgtgaaagtttctcactcgttcaggtacagcctggcgtggatatcatccggacgaacctcgagtttttgcaggagcaatttaacagcatcgctgcccacgtactgcactgcaccgactccggattcggagctaggctgcttgagctgtgtaatcaagggctattcgagtgcctggccctcaatcttcattgcctcggcggacagcaaatggagctggcagctgtcatcaacggcaggatccgtcgaatgagccgcggagtgaaccccagcctagtgagctggctgactacaatgatgggtcttaggctgcaagtagtgttggagcacatgcccgtgggccctgatgctatcctccgttatgtgagacgggtgggtgatcccccacagcctctcccagaagagccgatggaagttcagggcgcagaacgcgcttctccggagccacagcgggagaacgctagccctgccccaggaactacagctgaggaggctatgtctcggggacctccccctgctcctgaaggcggttctcgcgatgaacaggacggagctagcgctgagaccgaaccttgggcagctgctgttcccccagaatgggtcccgatcatccagcaagatatacagtcccaacggaaggtaaagccccaaccacctctgagcgatgcataccttagtgggatgcccgctaaacgcaggaagactatgcagggcgaggggcctcagctgctgctgtcagaggccgtatcccgagcagccaaagctgcaggcgcaagacctttgacgagcccagagagtctcagccgcgatctggaagcccctgaagtccaggagagttataggcagcagctaagaagtgacatacagaagcgtctccaagaggacccaaattactccccccagcgcttccctaacgcccagcgcgcattcgccgatgacccctag

SEQ ID NO: 215858 - DNA, 3234 bp, Artificial Sequence
  Description of Artificial Sequence: Synthetic coding sequence
atggagcccaacgattctacaagcaccgccgttgaagagcctgactcactggaagtcctagtcaaaacactggactcacagacacgcacttttattgtgggagcccaaatgaatgtaaaagaattcaaggaacacattgccgcttccgtgagtataccaagcgagaaacagcggcttatataccaagggagagtgctgcaggatgataagaagctgcaagagtataacgtggggggaaaggtgatacacttggtggaacgggctccaccccagactcacctgccttcgggagcatcttcaggcacagggtctgcctcagcgacacacggtggaggctcccctcccggaacccgtggacctggggcttccgttcacgatagaaatgccaattcctatgtgatggttggtacttttaatctgccctcggatggatctgccgttgatgtgcacatcaatatggagcaggccccaattcagagcgaaccacgcgttaggctggtcatggcacagcacatgattagagacatccaaactttgctttcccgcatggagtgccggggaggcccacaaccccaacattcccagccgccaccccagccaccggcagttacaccagagccagtagcgttaagttcacagacctctgagcccgtggaaagcgaggcgcctccccgtgagccgatggaggccgaggaggtcgaagagagggccccagcacagaatcccgaactgactcccggacctgccccagcgggacctacccccgctcctgaaacaaatgcaccaaatcatcctagccccgctgagtatgtggaggtcctccaggaactgcagagactggagtcgcgcctgcagcccttcctgcagagatattacgaggtattaggcgcagcagctaccactgattataacaataatcacgagggacgagaggaggaccagaggctgattaacctggtcggtgaaagtttgcggctgctaggtaatacctttgttgctctttctgacttaagatgcaatcttgcgtgcactccccctcggcacctccatgtggtgcggccaatgtcccattatacaacccctatggtcctacagcaggcggctattccgattcagatcaacgtggggaccacagttacaatgacggggaatggaacaagacctcctcctacccccaatgcagaagccccaccgccaggtcctgggcaggcctcctctgtggcacctagctccaccaacgtggagagtagcgctgagggcgctcccccaccgggaccggcaccaccgcctgctacctcacaccctcgggttattcggatcagtcatcagtccgtagaacccgttgtcatgatgcatatgaacatccaggattctggcacccagccagggggagtgccatcggcacccacgggacccctcggaccgcctggtcatgggcagacattggggcagcaagtgccaggcttcccgaccgcacccacgagggtggtgatcgcgcgaccaaccccaccacaggctcgcccttctcaccctggtgggcctccagtgagtggcactctccaaggagcgggattagggaccaacgcatccctggcccagatggtctcaggcttggtgggtcaactgctgatgcaacccgtattagttgctcagggtacccccggtatggcccctcctcccgctcctgccactgcctctgcctcagctggaactaccaacaccgccacaactgccggaccggcacctggaggaccagctcaacctcccccaacccctcagccgtcaatggccgatttacagttcagtcaactcctgggcaacctcctggggccagccggtcctggagctggtggcagtggcgtggccagtcctacaattactgtcgccatgccaggagttcctgccttcctccagggcatgacagacttcctccaggcaactcagacagctcccccaccgcctcctcctcctcctccacccccacccgctccagagcagcagaccatgccgcctccaggatctccttcaggcggtgccggatcgccgggaggcctgggcttggagagcctatccccagagttttttacctctgtggtacagggagtgttgagtagcctgctgggtagtctgggagcaagggcaggatcctccgagtccatcgctgcttttatccaacgtctgtctggctcctccaacatttttgagccaggtgcagatggagctcttgggtttttcggcgctttgttgtcccttctatgtcagaattttagcatggtggacgtggtgatgctcctccacgggcattttcaacctttacagcggctgcagccgcagttgcgaagtttcttccaccagcattacctcggcggtcaagagcctaccccaagcaacattcgtatggcgactcacactttgattactggcctggaagaatatgtgcgggagagcttcagccttgtgcaggtgcagccaggcgtcgacattatccgtaccaaccttgagttcctgcaagaacaattcaactccattgctgcccacgtgttgcactgtaccgattctggctttggcgctcgcctcctagaattgtgtaaccagggcctcttcgagtgccttgcgctgaaccttcactgcttaggtggacaacagatggagctcgccgctgttattaacggccgaattagacgcatgtcccggggagtgaacccaagcctggtgtcctggttaaccacaatgatgggactaagattacaggttgtattggagcatatgcccgtgggcccagacgccatcctgcgatacgtgcgtcgtgttggcgacccccctcagcccttgccagaggagcctatggaggtgcagggcgcagagagagcgtcccccgagcctcagagagaaaacgccagccctgcaccaggtaccactgccgaggaggcaatgtccagagggcctcctcccgctccagagggcggatctcgcgatgagcaggatggcgcatctgcagagacggaaccttgggcagcggcagtgccacctgagtgggtgccaatcatccagcaagacattcagagccaacggaaggtgaagccacagcctccactgtctgacgcctacctgtccggcatgcccgctaaacgtcggaagctgaggtcagacatccaaaaacgtctgcaggaggacccaaattactccccacagcgttttcctaatgcccagagggcatttgcagatgacccttag

SEQ ID NO: 215859 - DNA, 2712 bp, Artificial Sequence
  Description of Artificial Sequence: Synthetic coding sequence
atggaacctaatgattctaccagcacagcagtcgaggagcccgactccctggaagtgctcgtgaagacccttgacagccaaacacgaacatttatcgtaggcgctcagatgaacgttaaggagttcaaagaacacattgctgccagcgtctcaatccccagtgagaaacagaggctcatttatcaaggaagagtgttgcaggatgataagaagctgcaggagtacaatgtcggcggaaaagtgatccacctagtggagcgggctcccccacagacccatctcccgagcggagcctcttccggtactgggtcagcaagtgcgactcatggcggaggcagcccgccaggcactaggggccctggggcatccgtccatgaccgcaacgccaattcttatgtgatggttggcaccttcaatcttcccagcgacggctccgcagtggatgtgcacataaacatggagcaggccccaatacagagcgagcccagggtccggctagtgatggcgcagcacatgatccgggacatccagaccctcctgtccagaatggagtgccggggaggccctcaacctcagcattcccagccccctccacagccacccgctgtgacacctgagcccgtggccctgagttcccagacttcagagcccgtagagagcgaggccccacctcgcgagcctatggaagccgaggaagtcgaagaaagagctcccgctcaaaaccctgaattgacaccgggaccagcacccgctgggccaactccggctcccgaaacaaatgccccaaaccacccatctccggcagaatacgtagaagtgcttcaggaactacagcggcttgaaagtaggcttcagcccttcttacagcggtactacgaggtgctaggagccgcagcaacaaccgattataataacaaccacgaaggcagggaggaggaccaacgcctcatcaacctggtgggagagtccctgcgcctactggggaacacatttgtggccctctccgaccttcgatgtaatttagcctgtacaccgccacgacatctgcacgtcgtgcgcccaatgagccactacactacgcctatggtgctgcagcaagccgcaatccctatccaaattaatgtcgggacaaccgtgaccatgaccgggaacgggacccgtcctcctcccacccctaacgctgaagcccctccaccaggtcctggccaggcttcctccgtggcgccaagtagcactaacgtggaatcctccgcagaaggagcccctcctcccggtccggctccccctccagcgacctcacacccccgagttatccgaataagccaccaatccgtggagcccgtggtgatgatgcacatgaatattcaggacagcggtacccaacctgggggagtgcccagcgccccaaccggccctctaggccctccaggccatggccagaccctgggccagcaggttcctggatttcccactgctcctaccagagtcgtgatcgcgcgaccaacaccccctcaggcccgtcctagtcacccgggtggaccccctgtgtcaggaactttgggagccggtcttggcactaatgcgtcactggcccaaatggtgagcggtcttgttggccaattgcttatgcagccagtgcttgtggctcaagggacaccagggtcgcccggaggactgggcctggagtcactgagccctgagttttttacatcagtggtgcaaggagtcctttcttctctgttgggctctctgggcgcacgcgctgggagcagtgagagcattgctgcatttatccagcgactatccggctcttcaaacatcttcgaacccggtgccgacggggcactgggatttttcggcgctttactatcgcttctgtgccagaactttagtatggtagacgtagtcatgctgctacacggtcacttccaacctctgcaacggttgcagccccagctgcggtccttttttcaccagcattacctcggaggacaggagccgaccccctcaaacatcaggatggccactcataccctgattacaggtctcgaagagtacgtcagggagagctttagccttgtccaggtacagccaggcgtggatataatcaggaccaacttagagtttctgcaggagcagttcaatagtattgctgctcacgtcttacactgcaccgacagtggatttggggcacgactgctcgagctctgcaaccagggactgttcgagtgtctggccctgaacctgcactgtttaggaggtcagcaaatggaattggccgcagtaatcaacggaaggattcgacgcatgagcagaggcgtgaatccctctctggtgagctggttaacaacaatgatggggctaaggcttcaggtcgttctagagcatatgccagtaggcccagatgctatcctgaggtatgttcgcagagttggggaccctccacagcccctcccagaggagcctatggaagtccagggagctgagcgcgcttctcctgaaccccaggagtgggtgcctatcattcagcaggacatccagagccagaggaaagtcaagcctcaacctccactttccgacgcttacctgtccggcatgccagccaaacgaagaaagctgcgcagtgacatccaaaaacggttgcaagaggatcccaattacagcccgcaacgcttccctaatgctcagcgcgcatttgccgatgacccatag

SEQ ID NO: 215860 - DNA, 3489 bp, Artificial Sequence
  Description of Artificial Sequence: Synthetic coding sequence
atggaacctaatgactccacatctacggcggtagaagaacctgactcattggaggtgctggttaaaaccctggattcccagacaaggacctttattgtgggtgcccaaatgaacgtaaaggagtttaaggagcatatcgctgcttctgtcagtatcccatccgaaaagcaacgtttgatatatcagggtagagtgctgcaagacgacaagaagctccaggagtataacgtaggcggaaaagtcattcaccttgtggagagagcccctcctcaaacacacctcccctcaggtgctagcagtggaactggttcggcatccgcaacccatggaggcggatctccgccagggacccggggaccgggagcctcagtgcacgatcggaacgccaactcctacgtgatggtgggcacatttaatctgccttcagatggatcagcagtggacgtgcatataaatatggagcaggcacctatacaatctgaaccaagagtgaggctagtcatggcccagcacatgataagagatattcagaccctattgagccgtatggagtgtcgaggcggaccccagccccagcactctcagcctcctcctcagccccctgctgtaactccagagccagtagccctgtcgtcacagactagtgaacccgtggaaagtgaggcacctcctagagaacccatggaggccgaagaagttgaagaaagggctcccgctcagaacccggagctgactcctggcccagctccggcagggccaactcctgccccagaaactaacgcccctaaccatccatctcccgcagagtatgtcgaagtgctgcaagaattgcagagactcgaaagtaggctgcaacctttcctccaacgctattacgaggtattgggcgctgccgcaacaacggactacaacaacaatcacgagggcagggaagaggatcagagacttatcaacctggttggagagagcctgagattattaggaaatacgtttgtggcacttagtgacctcagatgcaacttagcatgtacccccccaaggcacctgcacgttgtccggccaatgagtcactataccactcccatggtcttgcagcaggctgcaatcccaattcagatcaatgtggggaccacagtcacaatgacggggaacggaacccggcctccacctacgccgaacgcagaagcccctccacctggccctggacaagcttcatccgtggcgccaagcagcactaacgtcgaatcaagcgccgaaggagccccacctcctggcccagcacctcctccggcaacctctcacccaagggtgattcggatttcccatcagtccgtggagccagttgtgatgatgcacatgaatattcaggactccggcacccagcctggtggcgtccccagcgccccaactggcccactgggacctcctgggcacggtcaaactctgggctccacacttatccagcttccaagcctacctccagaatttatgcatgcggtggcacaccagataacccaccaggccatggtggcagctgtcgcgagcgctgccgctggtcaacaagtaccgggtttcccgaccgctccaacaagagtcgtcattgctcggccaaccccaccgcaggctcgtcccagtcatccaggtggtccgcctgtgagcgggacacttcaaggcgcaggtctgggtacgaacgccagcttggcccagatggttagcggactcgtgggtcaacttctgatgcaacccgtgttggttgctcaagggacccctggaatggctcccccaccagcccctgccactgccagtgcatccgctggaacaaccaataccgctactaccgccggaccagcacccggaggcccagctcagcctcctcccacgcctcaaccttccatggccgatcttcagttttcccagttgctcggcaatcttctgggcccagcaggaccaggggcagggggttctggtgtcgcttccccaactatcacagtagcaatgcctggtgtccctgcctttctccagggcatgactgactttctgcaggccacacagacagcccctcctcccccaccccctcctccccctccacccccagctccagagcagcagacaatgccccctcccggttctcccagcggtggtgccggtagtcctggcggtctcggcctggaaagtctgtctcccgagttcttcacatccgtggtacaaggcgtgctcagttcattgctcggaagcctcggagctcgggcagggtcttcagagtcgatcgccgctttcatccagcgtctgagcggctcctccaacatctttgagcctggcgcagacggcgctttgggtttctttggcgctctccttagcctcctctgtcaaaatttctctatggtcgacgtggtcatgttactgcatgggcactttcagcccttgcagcgtcttcagccccagctgaggagtttttttcatcagcattacttgggcggtcaggaaccaacgcccagtaatatccgaatggctacccatactctaattaccgggctcgaagaatacgtaagggagtcgttttcccttgtacaggtgcagccgggtgttgatattatccgcaccaatttggagtttctgcaggaacagttcaactctatcgccgctcacgtgttgcactgtacagatagtggctttggcgcaagacttcttgagctgtgtaaccagggtttgtttgagtgtcttgctctgaatctgcactgcctcgggggacagcagatggaactcgccgcagttatcaatgggaggatcagacgaatgagtaggggagtgaacccttcactcgtgagctggttgaccacaatgatgggccttagattgcaagtggtccttgagcatatgccggtcggcccagacgctatcttgagatacgtccgtcgggtgggggatcctccacaacccctgccagaggagccaatggaagttcagggagccgagcgagccagtccagaacctcagcgggagaacgcatctccagctcctgggactacggccgaggaggctatgtcccgcggacccccacctgcgccagaaggcggttctcgcgacgagcaagatggtgcatccgccgagactgagccatgggccgcagctgtgcctccggagtgggttcccataatccagcaggatatccagtcccagagaaaggttaagccacagccccctttatctgacgcataccttagcggaatgcctgccaagcgacgcaaaaccatgcagggggaggggccacagctgttgctttctgaggccgtctcgcgcgctgcgaaagcggctggcgcacgccctttgacttctccggaatccctctcgagggacctcgaggcacccgaagtgcaggagtcctatcgtcagcaactcaggtctgatattcagaagcgattacaggaggatccgaattattcaccacagaggttcccaaacgcacagagggcctttgcagatgacccttag

SEQ ID NO: 215861 - DNA, 3234 bp, Artificial Sequence
  Description of Artificial Sequence: Synthetic coding sequence
atggagccaaatgacagcacatccacagccgtggaggaaccagattctcttgaagttctggtgaagactctcgactcacaaactagaacgttcatcgtgggggctcaaatgaacgttaaagaatttaaggagcacatagccgctagtgtatccatcccttccgagaaacagcgactgatctatcagggacgagtgctgcaggacgacaagaagctccaggagtataacgtgggagggaaagtgatccacctggttgagagggctcccccacaaacccatctcccttcgggagcctcctctggaaccgggtcggcctccgccacccacgggggtgggagtccacctggaacgagagggcctggagcttccgtgcacgatcgcaatgctaatagctacgtcatggtgggaactttcaacctgcctagcgacggatcggctgtagatgtacacatcaacatggaacaggcccctattcagagcgagcccagggtaagactcgtgatggctcaacacatgattcgcgatatacagactctgctctctaggatggagtgtagagggggtcctcagccccagcattcacagcctcccccacaaccacccgcagtgaccccagagcccgtggctctgagctcacagactagtgagccagtggaatccgaggcacctcctcgtgaacccatggaggcagaggaggtggaggaacgtgcacccgcacagaaccccgaacttacaccaggacccgcacctgccggaccgactcccgctcctgagactaacgccccaaaccatcctagcccggctgaatacgtagaagttctccaggagctccagcgactggagagccggctgcagcccttcctgcagcgctactacgaggtgcttggagcggcagcaaccaccgactacaataacaatcatgagggacgggaagaggaccagaggttaatcaacctggtgggagagtcattgcgactcctggggaataccttcgtggctctgagcgatctcagatgcaatttggcctgtactcctccaaggcacttgcacgtagttaggccaatgagccattacactaccccaatggtcctacagcaggctgccatccctatccagatcaacgtggggaccacggtgaccatgacaggcaacggaactcgccctcctcctactcccaatgccgaggccccacccccaggcccaggccaggccagttcggtggccccaagctccaccaacgtggaatcaagtgccgaaggagcccctccgccaggccctgcaccccctccagcaacctcccaccctagggtgatccggatttcacatcagagtgttgagcctgttgtcatgatgcacatgaatatacaagatagtggcactcagcccggaggagtcccgagcgccccaaccggtcctctgggtccaccagggcatggacagacattaggtcaacaagtcccagggtttcccaccgccccaaccagggtggtgattgccagacccacgccccctcaggccaggccttcccatcctggcggtcctcctgtgtccggtactttgcagggggcagggctggggactaacgcaagtctggcacagatggtctcaggactggtcggacagctgctcatgcaacccgtgctggtggcccagggtacaccaggtatggctccgccaccagctcctgccacagcaagcgcatcggctggaacaaccaataccgccaccaccgcgggacccgctcctggtgggcctgcgcagcccccaccgaccccccagccttccatggccgatcttcagtttagccagctgctggggaacctcctgggccctgccggacccggtgctggtggtcccggagtggcttcccctactatcactgtagccatgccaggggtacctgctttcctacagggtatgactgacttcctgcaagcaacacagaccgctcctcccccaccacctccgccaccgcctcctcccccagcgcctgaacagcagacaatgcctccccctggcagccccagcggcggtgccggtagccccggtggccttggtcttgagtccctctcacccgagttttttacgtcagtcgttcagggggttctgtctagcctcctggggtcgttgggggcacgcgctggctcctccgagtccattgctgcctttattcagcgcctgtctggttcatcaaacattttcgagcctggcgcagacggcgcactgggcttcttcggcgcattgctgtcactcctatgccagaacttcagcatggttgacgtagtgatgctactccacgggcactttcagcctctgcagaggctgcagccacagcttcgaagttttttccatcagcactaccttgggggtcaggagccgaccccttccaacattcggatggccacacacactctgatcacaggtcttgaggagtatgtcagggaaagtttttcactggttcaagtccagccaggcgtggatattatcaggacaaatctcgagtttctacaggaacagtttaacagtatagccgcacatgttcttcactgtactgactctgggttcggcgcacgcctgctcgaattatgcaatcagggccttttcgagtgcctggcgttaaacttgcactgcctcggcggacagcagatggaactggcagctgtgattaacggaaggatacgccgaatgagtagaggcgtcaatccctccttggtgagttggttgaccaccatgatgggtctccgcctccaggtggtgctggagcatatgcccgtgggtccggatgctattctgcgatacgtcagacgcgtgggagacccacctcagccactaccagaagaaccgatggaagtgcagggagctgaaagggcctcacccgagccgcagcgcgagaacgcaagcccagccccaggcactacagcagaagaggcaatgtcccggggacctccaccagcccctgaaggaggcagccgggacgaacaggatggcgctagtgccgagactgagccatgggccgctgcggtccccccagagtgggtaccgattatacagcaggacattcagtcccagcgtaaagtcaaaccacagccccctctgtccgacgcttatctgtctggcatgcccgctaaaagacgcaagcttagatctgacattcaaaagaggctccaggaggatccaaattacagcccgcagcggttcccaaatgcccagcgagcatttgcagacgacccatag

SEQ ID NO: 215862 - DNA, 2712 bp, Artificial Sequence
  Description of Artificial Sequence: Synthetic coding sequence
atggaacccaatgactctacctcaaccgcagtagaggagccagactcactcgaagtgctagtcaagaccctcgatagtcagacacgaaccttcatcgtgggcgctcagatgaatgtgaaggagtttaaagaacacatcgctgcaagcgtaagcattccatctgaaaagcagcgtcttatctaccaaggcagggtgctgcaggatgacaaaaagctgcaggagtataacgtaggaggaaaggttatccatctcgtcgaaagagccccaccacagacacacctgccctctggcgcaagcagtggtactgggtcagcctccgccactcatgggggagggtccccaccgggaaccagaggacctggtgccagtgtccacgatcgcaatgcaaatagctacgttatggtggggaccttcaacctgccatcagacggatccgccgtcgatgtccacatcaacatggagcaggccccaattcagagtgagccccgagtgaggctcgtaatggcccagcatatgatccgggacatacagacgctgttgtcacgtatggagtgtcggggtggccctcagcctcagcactcccagccaccaccacagcctccagcagtgacacccgagcccgtggccttgagttctcagacttccgaaccagtcgaatcagaagcacctccgcgtgagcccatggaggcagaagaagtggaggaacgtgcgccagcccagaaccccgaactgacgccgggtccagcaccagccggaccgaccccggcaccagaaacgaacgccccaaaccacccgtctcctgcagaatatgtagaggtgttgcaggaactgcagcgtttggagagtcggctgcagccctttttgcaacgctattacgaggtgctgggagctgctgctacaactgactataataataaccatgaaggcagggaagaagatcagcgcctgataaatctggtcggtgaatccctgaggctgctgggcaataccttcgtggctctttccgacctaagatgtaacctcgcatgtacccctccaaggcatctccacgttgtgcggcctatgagccattacactactccaatggtgctgcagcaagctgcgatccctatccagattaacgtgggcacaactgttaccatgactggaaacgggacgcgccctccccctacgccaaacgccgaagcgccaccgcctggcccaggccaagcctcatcggtcgctccaagtagcaccaacgttgagtcatcggccgagggcgcaccacctcccggaccagctccacctcccgctacatcccatccaagagtcatccgcataagccaccaatcagttgaaccggttgtcatgatgcacatgaatatacaagatagcggtacccagcccggaggcgtgccttcagctccaactggccctcttggacccccaggtcatggacagactctgggacagcaagtgccaggctttccgactgcccctactcgggttgttatcgcaagacctactcccccacaggccagaccctcacacccaggaggcccaccagtttcaggcacccttggagccggattagggacgaacgcgtccctggcccagatggtgtccgggcttgtggggcagctcctgatgcagcctgtgcttgtggctcagggcacaccaggttcccccggtggactggggctggagtccctgagccccgaatttttcacctctgtggtccagggggttcttagcagtctgttgggctctctgggggctagagccggtagttctgaatcaattgcagctttcatccagcgtctgtctggatcaagcaacatctttgagccaggtgcagacggagccctggggttcttcggagcactgctctctcttctatgccagaatttttccatggtcgatgtggtcatgctcctgcacgggcacttccagcctctgcagcggctccaaccacaattacgtagctttttccaccaacattaccttggtggccaggaacctaccccctctaacattagaatggccacacataccctcattacaggcctagaggagtacgtgagggagagcttcagtcttgtacaagtccaaccaggcgttgacattatccggacgaacctcgaattcctgcaggaacagttcaacagcatcgccgcacatgtcctgcattgcaccgactctgggtttggagcgagactgctggagttgtgcaaccaggggctgttcgagtgtttggccctgaacttgcactgcctgggcggacagcagatggaactggccgcagtaattaatggtcggatccggcgtatgtcaaggggcgtaaaccccagtctggtgtcctggctgaccacgatgatgggcttaagactccaggtggtgttagagcacatgccggtggggcctgatgcaattctgcggtacgttcgccgagtgggagatccccctcagcctctgccagaggaaccaatggaagtgcaaggcgcagaacgggcttcacctgagcctcaggagtgggtccctatcatccaacaggatattcagagccagaggaaggttaaaccgcagccccctctgagtgacgcctacctatccggcatgccggcaaagcgccgtaagttgagatctgatatccagaagcggcttcaggaagaccccaattattcgccgcagaggttccctaatgctcagcgagccttcgctgacgatccatag

SEQ ID NO: 215863 - DNA, 2712 bp, Artificial Sequence
  Description of Artificial Sequence: Synthetic coding sequence
atggaacctaacgactccacatctacagcagttgaagagccagactctttggaagtgttagtcaaaacccttgacagtcagactcggacatttattgtgggagcccagatgaacgtgaaggaattcaaggaacacattgccgcatccgtcagcatccctagtgagaagcagagactcatataccaggggagggtgttgcaggacgataagaaactgcaggagtacaatgttggcggaaaggtgatacacttagttgaacgagcccctcctcagacacatttgccgagtggtgcttctagcgggactgggtctgccagcgctacacatggagggggatcacccccagggacacgcggtccgggagcatccgtccatgatcgtaacgccaattcctacgtgatggtcggcaccttcaaccttccctcagacggcagcgcggttgacgttcatatcaatatggaacaggcacctatacagagcgagccacgggttcgcctcgttatggcacagcacatgattcgcgacatccagacactactgtcccgcatggaatgtcgaggcggtccacagccccagcattcccagcctccgccacaaccaccggcagttacccccgaaccagtggcattaagttctcaaacatctgaacccgtggaaagcgaagctccacctcgggagccgatggaagccgaggaggttgaagagcgtgccccagctcaaaaccctgagttaacgcccggacctgcaccagcaggcccaactccagctccagaaacaaacgcacctaaccatccctcaccagcagaatacgtggaggtgctgcaggaactgcaaagattggaatcccgattacaaccattcttacagcgctactacgaagtgctcggcgcagccgcaacgacagactacaataataaccatgaggggagggaggaggatcaaagattgattaaccttgtgggggaatccctgagactgttaggcaacacctttgtagccctttctgatctgcggtgtaatctcgcctgcaccccaccgaggcacctgcacgttgtgaggccaatgtctcactataccacacccatggtgctgcaacaggccgctatccccattcagatcaacgtgggcactaccgtgacgatgaccgggaacggcaccagacccccacccactcccaacgctgaggccccacctccaggcccaggacaagcctcctctgtggcacctagctccacgaatgtcgaatcatctgcagagggagccccaccacctgggccagctcctcccccagccaccagccacccaagggtgatcaggatctctcatcaatctgttgaacctgtggtcatgatgcatatgaacatccaggacagcgggacacagcctggtggagtgccttccgcgcctacagggcctcttggaccgcctggccatggccagacacttgggcagcaggtccctggcttccctactgccccaacgcgggtcgtcatcgctagaccaaccccgccacaggctagacctagtcatcccggaggcccaccggtgtctgggacattgggagcaggcctgggcactaatgccagcctggcccaaatggtttcaggtttggtgggccagctgctcatgcagcctgttctagtcgcccaagggacaccagggagccctggcggtctgggactggagagcctgtcaccagaattctttacatctgtagtgcaaggtgtgctgtctagcctgttaggctctctgggtgcacgcgctgggagctccgagtctattgcagcatttatacagcggctgtcaggttctagcaacatctttgaaccaggggctgacggtgccctggggttttttggagcgttactctcactcctctgccagaacttcagcatggtggatgtcgtgatgctgctccatggccattttcagcccctgcaaaggctgcagccgcagttaagatcttttttccaccagcattatctcggaggtcaagagccaactcctagcaacatcaggatggctacccacaccctgattacaggactagaagaatacgtcagagagtccttttccttggtgcaggtgcagcccggagtggacattattaggacaaatctggagttccttcaggagcaattcaactcaattgctgcccacgtgttacattgtactgacagcggctttggggctcggctgctcgagctctgcaatcaggggttgttcgaatgcctcgccctgaatctccactgcctcggcggtcaacaaatggaacttgcagctgttataaacggcaggatcaggaggatgtcccgcggagtgaatccgagtctagtgagttggctcactactatgatggggcttcggctgcaggtggttctcgaacacatgccagtgggacctgacgccatactgaggtacgtgagaagggttggggacccacctcaacccttgcctgaggaacctatggaagttcagggagccgagagagcatcccccgaaccacaggagtgggtgccaataattcagcaggacatccaatcccagcggaaggtcaagcctcagcctcctttgagcgacgcttacctgtccggcatgccagctaaacgaagaaagctacggagcgacatccagaaaaggctgcaggaggacccgaactacagcccccagaggttccccaatgcacaacgagcttttgcggacgacccctag

SEQ ID NO: 215864 - DNA, 3489 bp, Artificial Sequence
  Description of Artificial Sequence: Synthetic coding sequence
atggagcccaacgattctacatcaactgcagttgaagagccagacagcctcgaagtacttgtgaagacactggatagccaaacccgaaccttcattgtcggggctcagatgaatgtgaaggagtttaaggagcacattgccgcttcagtgtccatccccagtgaaaagcaaaggctgatctatcaagggagggttttgcaggacgacaagaaactgcaggagtataatgtcggcggaaaggtgatccacttagtggagagagcccctccgcagacccatcttccttctggagcttcctccggcactggatctgctagcgcgacccatggaggtggaagtccccctgggactcgtggccctggcgcaagcgtgcatgataggaacgctaactcttatgtgatggtcggaaccttcaatctgccctcggacggctctgctgtcgatgtgcacatcaatatggagcaggcgcctatccaaagcgagccacgggtgagattagtcatggcacagcacatgattcgggacattcaaactctccttagcagaatggagtgtagaggtgggcctcaaccacagcactcccagccaccaccacagccacctgccgtaactcctgaacctgtcgcacttagttcccaaacatccgagccagtagagagcgaagcacccccaagggagccaatggaagcagaggaggtcgaggaacgcgcacctgcacaaaatcccgaattaactcccggtccggctcccgcaggccctacccctgcacccgaaaccaacgcaccgaatcatccaagtccggctgaatatgtggaggttctgcaggaactccagaggctcgaaagccgcctccagccttttttgcaaaggtactacgaggtactaggcgctgccgcaactactgattataataacaatcatgagggacgggaagaggatcagagattgatcaacctggtcggcgagtcactgcgtctcttaggtaacacatttgtggcccttagcgatttgcgctgcaatctggcttgtacccccccaaggcaccttcatgtagtgagacccatgtcccactatactaccccgatggtactccaacaggctgccattcccatccagatcaatgttggtaccaccgtgaccatgactgggaacggcaccagacctcccccaacacctaatgccgaggccccaccgcctgggccaggtcaagcaagttcggtcgcacccagttccaccaacgtcgaatcatctgcagagggcgctccccctccagggcctgcacctcccccagccactagtcaccccagagttattcgcatttctcaccagagtgtggaacctgtggtcatgatgcacatgaacattcaagattcagggacccagccgggaggagtgcctagcgcccctaccggaccattgggaccccctggccatggtcaaacgctgggcagtactcttatccaactcccgtccttacctcccgagtttatgcatgctgtggcacaccagatcacccaccaagccatggttgctgctgtggcgtcagccgcagccggacaacaggtacccggatttcctacagccccaaccagggttgtcatcgcacggcctactccacctcaggcccgaccatctcatcccggaggacctccagtgagcggcacactgcagggcgcaggacttggaaccaatgcatctctggcacaaatggtgtctggtctggtggggcagctgcttatgcaaccggtacttgtggctcaagggacaccaggaatggctcctccccctgccccagccacagcttcagctagcgccggtacaactaatactgccacgaccgcgggtcccgctcccggaggccctgcccagccaccaccaacacctcagccatcaatggccgatctccagttttcccagctcctgggaaacctgctgggcccagctggacctggcgctggaggctcaggtgtcgcttctcctaccattacagtggctatgccaggagttccagcttttttacaagggatgactgatttcctgcaggctacccagacggctcccccaccccctcccccacccccacccccaccacctgcccctgaacagcaaaccatgcctccacctggatctccctctggcggagctggctctcccggagggctcggcctcgagagcctgtcacctgagttctttaccagtgttgtgcagggagtcctcagttccctgctcggcagcctcggtgcaagagctgggagtagtgagtcgattgctgcctttatacagagattgtctggcagtagcaatattttcgaaccaggggctgacggggcactggggttcttcggggctcttctgtcgctgttgtgccaaaacttctcaatggtcgacgtggtgatgctactacatggccacttccagcccttgcagagactgcagcctcagctgcggagctttttccatcagcattacctgggcggacaagagcctactccgtccaacatcaggatggctacccacacccttattactggcctggaagagtatgttcgggagtcattctccctggtgcaagtgcagccaggagttgatattatcagaaccaatcttgagttcttacaggagcaatttaattccatcgcagcccatgttctgcactgcaccgattccgggtttggagctcgtctgcttgagttgtgcaatcagggtctgttcgagtgtctggcacttaacctgcactgcttaggtggccagcagatggagcttgcggctgttattaacggtcgcatccgaaggatgagtcggggagtgaatccttctctggtcagttggttaaccacaatgatgggcctcaggctgcaagtcgtactggaacatatgcctgtggggccagatgccattctgaggtacgtgagacgcgtgggcgaccctccccagccactaccagaggaaccaatggaggtgcaaggcgctgaacgcgcaagcccagagccccagagagaaaacgctagtcccgcacccggtactactgccgaagaagcaatgagtcgcggacctccacccgctccagagggaggctcaagggatgagcaggacggcgctagcgccgaaacagaaccatgggctgcggctgtcccccctgagtgggtacccataattcagcaggacattcagagccagcggaaagtaaagccacagcccccactgtcagatgcttatctttcaggaatgcccgctaagcgacgaaaaaccatgcagggggagggaccccagctactcctgtccgaagctgtatcccgcgctgctaaggccgctggcgcaagaccactgacctctcccgaaagtttatctagggatttagaggcccctgaagttcaggagtcctaccgccagcaactgcgaagcgacattcagaaaaggctgcaggaggatccgaactattcgccacagcggttccccaacgcccagcgggcttttgctgacgatccgtag

SEQ ID NO: 215865 - DNA, 3489 bp, Artificial Sequence
  Description of Artificial Sequence: Synthetic coding sequence
atggagccgaatgattctacttcaactgcagtggaagaacccgactccctggaggtgctggtgaagacccttgatagtcagacaaggacattcatagtgggagctcaaatgaatgtcaaggagtttaaggagcacatcgctgcgagtgtatcgatccccagcgaaaagcagcgcctaatttaccagggccgagtattgcaagacgacaaaaagctgcaagaatacaacgtgggaggcaaagtgatccacttagtggagagagccccaccccagacacatttgcccagtggagcgagttcggggactgggagcgcgtccgccacacatggaggtggcagcccaccgggtacaaggggccctggagctagcgtccacgatcgcaatgctaactcttacgttatggtggggacattcaacctaccgagtgacgggtccgccgtggacgttcacatcaacatggaacaggcccctatacaaagcgagccgcgagtgagactggtgatggcccagcacatgatcagggacatccagactcttttaagccgcatggagtgtcgcggaggacctcagcctcagcattcacagcctccaccacagcctccagcggtcactcctgagcccgtggccctgtcatcccagacgagcgagcctgtagagtccgaggcaccgcctcgggagccaatggaggctgaagaggtcgaggaacgggctccagcacaaaaccccgagctgacccccggtcccgcacccgctggtcccacaccagcacctgagactaacgcccctaatcatcccagccccgctgagtatgtagaggtgctacaggagcttcaaagactggaatcccgccttcagcccttcctgcaacggtactacgaagtgctgggcgcagctgccaccaccgactacaataacaatcatgagggacgtgaggaggaccagcgtctgataaatctcgttggcgagagcctgagattgctgggcaatacgttcgtagccctttccgatctcaggtgcaacttagcttgcacacctccgagacatttgcacgtagtacgtccaatgagccattacaccaccccaatggtgctgcagcaagcggctatcccaatacaaatcaatgtggggaccactgtgactatgacaggcaacggtacacgaccacctccgacaccgaatgccgaggccccacctcccggacctggacaagctagctcggtcgcacccagcagcacgaatgtggaaagcagcgccgaaggggcaccaccaccgggtcccgcaccgccacccgcaacttcgcacccgcgagtgatcaggatttctcatcagagtgttgagccggtggttatgatgcatatgaacatacaggacagcggaacccagccagggggagttccgtcggctccgacaggcccattgggcccacctggacacggtcagacgctcgggagcaccctgatccaactcccaagtttacctcctgaatttatgcatgccgttgctcaccagatcacacatcaggccatggtggctgccgtagcttctgctgctgctggacagcaagttcctggattcccaactgctccaacccgggttgtaatcgccaggcccactcctcctcaggccagaccttcacacccgggaggtccaccagtatcaggaactctgcagggtgcaggcctgggaacaaacgcaagtctagcccagatggtgagtggattggtggggcaactgctgatgcagcccgtactggtcgcccaagggactcccggaatggccccacctccagccccagccaccgcctctgcctcagcaggcaccacaaacacagcaaccacggctgggcctgccccagggggacccgcacaacctcctccaacaccacagccttcgatggccgacctgcaattctcccagctcttgggcaacctcctcggtccagccggacccggagctggaggccctggcgtggcctcccccacaatcaccgtagctatgcctggggtgccagctttccttcaaggtatgacggatttcttacaggctactcagacagctcctcctcccccacccccacccccaccaccaccaccggcaccagagcaacagacgatgcctccacccggatcccctagcggaggtgccggaagccctgggggactcggactcgaaagtctgtcacctgagttcttcaccagcgttgtgcagggtgtactaagttctctgttgggtagtctgggtgcccgagctggctcctcagaatcgatagcggcatttatccagagattgagcggaagttctaacatcttcgaacccggagccgatggcgctcttggctttttcggggctctactgtccctgttatgtcagaattttagcatggtcgacgtggtcatgctgctgcatggtcatttccagcccctacagaggctccagccacaactcagatcttttttccaccagcactatctggggggtcaggaacctaccccttccaacatccggatggctacccatactttgatcaccgggctcgaggagtacgtgcgggaatctttctctctggtgcaggtccagccaggagtcgacatcatccgcacaaatcttgagtttttacaggaacaatttaactccatcgcagcgcacgttcttcactgcaccgattcaggattcggagctcgactgctagaactgtgtaaccaaggcctttttgaatgtcttgcactcaatttacattgcctcgggggacagcagatggagcttgctgctgttattaatggccgaatcagaagaatgagccgtggtgtcaacccaagtctggtgagttggttaaccactatgatgggactcagattgcaggtcgtgctggagcatatgccagtgggaccagacgcaatattgcgctacgtacggagggtgggcgacccacctcaaccactacctgaagagccgatggaggtgcagggtgcagagagggccagcccggaaccccagagagagaacgcatcccccgcaccaggtaccactgcagaggaggccatgagcaggggcccacctccagccccagagggcggaagcagagatgaacaagacggcgcatccgcagaaactgagccctgggctgccgcagtaccacccgagtgggtgccgatcatacaacaggatattcagagtcagcgcaaagtcaaaccccagccgccactctccgacgcttatttatctggaatgcctgctaagaggcggaagaccatgcaaggggagggcccacagttgttgctgtccgaggccgtctccagggcagccaaagcagcgggtgctagaccgctcacttctcccgaaagcctttctcgggaccttgaggctcccgaagtacaggaaagttaccgacagcaattacggagcgacatacagaagcgtttgcaggaagatccgaattatagcccacagaggtttccaaacgctcagcgcgcatttgcggacgacccgtag

SEQ ID NO: 215866 - DNA, 3489 bp, Artificial Sequence
  Description of Artificial Sequence: Synthetic coding sequence
atggaacctaatgattccaccagtacagccgtggaggaaccagattccctagaggtcctcgtcaagacgcttgactcacaaacacgcaccttcatcgtgggtgcccagatgaatgtgaaagaattcaaagaacacattgcggcatccgtatcaattccaagcgaaaagcagaggcttatctatcagggtagagtgttgcaggatgataagaagctgcaggaatacaacgtggggggtaaggtgattcacctggtggagagagcccctcctcagacacacctgccttcgggagcaagcagtggtaccggaagtgccagcgccactcatggaggtgggtcgcctccaggcactcgcggtcctggcgcttccgtccatgatcgcaatgctaacagttatgtgatggtcggaactttcaatctgcccagtgatggtagcgccgttgacgtccacatcaatatggaacaggcccctattcagtcggaaccgcgtgtgagacttgtgatggcccagcatatgataagggacattcagactttgttgtcaagaatggagtgtcgcggagggccacaaccgcagcactctcaaccccctccacagccgcctgcggtgacgcccgagccagtcgctctgagctctcagacgtcagaacccgtagagtctgaagccccacccagggagcctatggaagcagaggaggttgaagaacgtgcacctgcacagaatccagagctgacaccagggcctgcacccgcaggacctacccctgccccagagactaacgcacccaaccatccctcccccgcagaatacgtcgaggtgttgcaagagctccagcgcctggaatcccgactccaaccttttctccaaagatactacgaagtcctgggcgcagctgcaaccactgattataataataatcacgaaggtcgggaggaggatcagagattaattaatctggtcggggaaagccttagactcctgggcaatactttcgttgccctcagtgacctgagatgcaacctagcctgcactccacccaggcacctccatgtcgtccgtcctatgagtcattacactaccccaatggtgctgcagcaggcggctattccaatccagattaatgttggaacgaccgtgactatgaccggtaacggaacacgccctccccctactcccaacgccgaggcaccacctcctggtcccggacaagcaagcagcgtggccccaagcagtacgaatgtggagagctcggctgaaggcgctccaccccctggtccagctccgccaccagctacgtcccacccacgcgtgatccgtatttcccaccaatctgttgaaccagtggtgatgatgcacatgaacatacaggactccgggactcagccagggggtgttcctagcgcgccaacaggaccgctcggaccacccggacacgggcagaccctgggatctacgttgattcaactcccttcactccctccggaatttatgcacgcggtggcgcaccaaataactcatcaggccatggtggctgcagtcgcttctgccgcagctgggcaacaggttcctgggtttcctacagctcccactcgggtcgtgatcgcaaggcctacacctccccaggcacgccctagccaccccggtggcccacccgtttctggtacactccagggagcaggcctcggcactaacgctagccttgctcagatggtatccgggttggttggtcagcttctcatgcagcccgtgctcgtggcccagggtacacccggtatggccccaccccctgcccctgctaccgcctccgctagtgccggtacaaccaatactgccacaaccgcagggcctgcccctgggggacccgctcagccgcctcccactccacagccttctatggccgacctgcaattcagccaactgttggggaatttgctagggccagccggtcccggagctggcggaagcggtgtcgcttctccgacaatcaccgtagctatgcccggagtgcctgctttcctgcaagggatgactgactttctgcaggctactcagactgcccctcctccccctcccccaccccctcccccaccccctgccccagaacagcagacaatgccccctcccggttctccttccggcggtgcaggctcccccggaggcttgggccttgagtctctctcacccgagttcttcaccagcgtcgtccaaggagtactgagctccttgctgggctctctgggtgccagggcgggatcctctgagtctattgccgctttcattcagagattaagcggatccagtaacatcttcgagcccggagctgacggcgcattgggcttcttcggcgctctactgtctcttctctgtcaaaacttctccatggtggatgtcgtcatgctgctgcatggacatttccagcctctccagagactccagccccaacttagaagctttttccaccaacactatctcggcggacaagaaccgactccctcaaacattaggatggctacacacactctcatcaccgggcttgaggagtatgtgcgcgaatctttctctctcgtgcaggttcagcctggtgtcgacatcatccgtacaaatttagagtttctccaagagcagttcaactctatcgcggctcatgtactccactgtactgacagcggctttggggctaggctcctggaactgtgcaatcagggactcttcgagtgtcttgcgttgaacttacattgtctcggcggacaacaaatggaattggccgcagttatcaatggaagaattaggcgtatgtctagaggggtcaatccctctctggtaagctggctcacaactatgatgggcctgagactgcaagtggttctggagcacatgcccgtgggcccagacgccatcctgagatatgtgaggagggtgggcgatcccccacaacccttaccagaagagccaatggaggtgcagggtgccgagagggcctcccctgagccccagcgggaaaacgccagtccagctcccggaaccacggcagaagaggccatgtctaggggaccacctccagcccctgaaggtggaagccgcgacgaacaggacggagcttccgccgagacggagccctgggcggctgccgtgcctcccgagtgggtgcctatcattcagcaggatatccagtcccaacggaaggtcaaacctcagcctccgctgtccgatgcttacctgagtggcatgcccgcaaagaggagaaaaaccatgcagggcgaaggaccccaacttttgctgagtgaggctgttagtagagccgcaaaggcagcaggcgcacggccactgacgagtcccgagtccctctctagagatttggaagctcctgaggtgcaggagagttacagacagcagcttaggtcagatattcagaagcggttgcaagaggatccgaactattctccccagagattccccaatgctcaacgggcattcgcagatgacccctag

SEQ ID NO: 215867 - DNA, 3234 bp, Artificial Sequence
  Description of Artificial Sequence: Synthetic coding sequence
atggagcccaacgatagcacaagcacagcagtagaggaacctgatagcctggaggtccttgtcaagacacttgactcccagacacgaacctttatcgtaggggctcagatgaatgttaaggaattcaaggaacacatagccgcttctgtgtccataccaagcgagaagcagcgcctgatttaccaggggagggtgttgcaggacgataagaagctgcaggagtacaatgtggggggaaaggttatccacctggtcgagagggcaccaccccagacccatctaccttctggagcctccagcgggactggctccgccagcgccacacacgggggagggtctccacctggtaccaggggcccaggtgcttctgttcatgaccgcaacgccaatagttacgtaatggtgggcactttcaaccttccttcagatggtagcgcagtcgacgtgcacatcaatatggagcaggctccaatccaatccgaaccgagggtcagactggtgatggctcagcacatgatcagagatatccagacgctgctgagccgcatggaatgccggggaggccctcagccccaacactcgcagcctccaccgcaaccccctgctgtgacgcccgagcctgtggctctgtctagtcaaacttctgaaccagtggagtctgaagccccacccagagaaccaatggaagcagaggaggtggaggagagagctccagctcagaatccagagcttacccccggacctgccccagcaggtccaacgcccgcaccggagacgaatgcccctaaccacccctctccagcagagtacgtggaggtgctccaggagctccaacgactggagagcaggctgcagccgttcctgcagcgctattacgaagtgttgggagctgccgctacgacagactataacaataatcatgaagggagagaggaagaccagcgattaataaacctcgtcggcgagagtttaaggttgctcggaaacacattcgtcgcactgtctgatttgcggtgtaatctcgcctgtacaccaccccgtcatctgcacgttgttagacctatgagccactacactacacccatggttttgcagcaggcggctatccccattcagatcaacgtggggactaccgtcacgatgactgggaatggcaccaggcctccgccaacacctaacgccgaggcccctccgcctgggccaggccaggcctctagcgtcgcacctagcagcactaatgtggagagttctgccgagggcgctccccctccagggccagccccacctcccgctacaagccacccaagggttatcaggatttctcaccaaagcgtggagccggtggtgatgatgcatatgaacattcaggacagcggaacgcaacccggaggcgtcccttccgctcccacgggtccactgggcccaccaggccatgggcagacgttaggtcagcaggtccccggttttccaaccgcgcctactcgcgtcgtgatcgcacgacctactcctccgcaggcaaggccttcacacccaggagggcctcccgtctcgggcaccctgcaaggcgcaggcctcggaacaaacgcctccttagcccaaatggtgtcagggctcgtcgggcaactcctgatgcagcccgtgctcgtggcgcaggggaccccaggcatggctcctcctccagcgcctgcaacagcttcagcatctgccggaacaactaacacggccaccaccgccggtcctgccccaggaggcccagcacagccaccccctacccctcagccatcgatggcagacctgcagttcagtcagctcctgggaaatctgctaggacctgctgggcctggagccggaggacccggagttgcttcccccaccatcactgtagccatgccaggcgtgccagcctttctgcaggggatgacagactttctgcaagctacgcagaccgcacctccacccccacctccccctcccccaccccctcccgctcccgagcaacaaaccatgccaccaccgggatcgccttcaggtggagcaggatcacccggaggattagggctggagagcctctctcccgagttttttacatctgttgtacaaggagtccttagctcactgttgggatccctaggcgctcgcgcaggctcctctgagagtatcgccgcatttatccagcgactgtcaggtagctccaatattttcgaacccggagcagatggggctctggggttttttggggcactgctgagtctgctgtgtcagaacttttcaatggtggacgtcgtgatgctgctccacggacactttcagccactgcaacgactgcagcctcagctgcgatctttcttccaccagcactacctgggcggacaggagcctacccccagtaatatccgcatggccacccataccctgatcactggcctggaggagtacgtgagggagagtttcagtctggttcaggtacagccaggcgtggacatcatccgcacgaacctggaatttttgcaggagcagttcaactccattgccgctcacgtgctccactgtacagattccggattcggagcccgattgctggagctttgtaaccaaggactcttcgagtgtctcgctctgaacctgcattgcctcggaggccagcagatggaactagcggctgtaattaatgggagaattaggcgtatgtcaagaggcgtgaatccctccctggtgagctggctgacaacgatgatggggttgcgccttcaggtcgtcctggaacacatgccagtgggaccagatgcaattttaaggtatgtcaggagggtcggggatccccctcagcctctgccagaggaaccaatggaggttcaaggagctgagagggccagccccgagccccagagagagaatgcatcccccgcacctggcactactgcagaggaggctatgtcacggggacctccccctgcgcctgagggcggatccagggacgaacaagatggggcttccgctgaaaccgagccctgggccgctgcggtccccccagaatgggtgcccatcatacaacaggacatacagagccagagaaaagtgaaaccccagcctcccctgtccgacgcctacttatccggaatgccagccaaacgcaggaaactgcggtccgacatacagaaaaggctccaggaggatccaaattattccccacaacgctttcccaacgcacagagagcgtttgcagacgatccatag

SEQ ID NO: 215868 - DNA, 3234 bp, Artificial Sequence
  Description of Artificial Sequence: Synthetic coding sequence
atggagcctaatgattctacatcgacagccgtcgaggagcctgactccctggaagtgctggtgaagacactggacagccagacaaggacattcatagtgggcgcacagatgaacgttaaggaattcaaggagcacatagctgcttcagtcagcattcccagtgagaaacagagactgatttatcaggggagagtattgcaggacgacaaaaaacttcaagaatacaacgtgggcggaaaagtgatacacctcgtcgaacgcgcaccccctcagacgcacctgccctcaggcgcaagttctggcacggggtctgcctcggcaacccacggcggaggttccccccctggcacccgaggaccgggtgcttctgtccacgatcggaacgccaacagctacgtgatggtgggaactttcaatctcccctcagatggatcagcggtcgatgtgcatatcaatatggaacaagccccaatccagtcagagccacgtgttagactggttatggcacaacatatgattcgcgatatccagaccctgctctcccgcatggaatgcagggggggaccccagccacagcactcacagcccccaccacagccccctgcagtgacgcccgagcccgtggccctgtctagtcaaacatccgaaccggtggaaagcgaggcccctccgagggagccgatggaggcggaagaagtcgaagagcgggcaccagcgcagaatcccgaattaacacccggaccagcacccgctggtccgactcctgccccagaaactaatgcccctaatcacccttcccctgccgaatacgtagaggtcttgcaagagctacagaggctagagagtagactccagcccttcctccagaggtactacgaagtactgggagccgctgctactaccgactacaacaacaaccacgagggcagagaggaggatcagaggctgatcaatttagttggagagagcctacgtctgctgggcaacacatttgtggcgctgtctgacctacgatgtaatctagcatgcacccctccaaggcacctccatgtggttcgcccaatgtcccattacacaactcccatggtcttgcagcaggccgcaattccaattcagattaacgtggggaccacagttaccatgaccggaaacggtaccaggccaccccctacccccaatgcagaagccccacctcccggaccgggacaggcctcatcagtcgccccatccagcactaacgtagagtcgtccgcggaaggggctccccctcccggacctgccccaccccctgccacaagccatcccagggtaattcgcatctctcaccagagcgttgaaccagtggtcatgatgcacatgaacattcaggattctggaacccaacctggaggggtgccaagcgcacccacgggacccttgggtccccctggacatggacagaccctgggtcagcaggtgccgggtttccccaccgccccaactagagttgtcatcgccaggcctactccaccccaagcccgtccatctcaccctggcggaccacctgtctctggtactttgcaaggtgccggtttgggcaccaacgctagcctggcacagatggtctcagggctggtgggacagctcctgatgcagccggtcctggtggcccaagggacaccgggaatggcaccacctccagcgccagcaactgcttcagcaagtgctggcacaactaatactgccacgaccgcgggtcctgcacctgggggtccagcgcaaccaccgcctaccccccaacccagcatggccgacttacagttttcacagttgctggggaacctgctcggacccgctgggccaggggctgggggatctggagtggcgagtccaaccatcactgttgccatgcccggagtccctgccttcctccaggggatgaccgattttctgcaagcaacccagaccgcgccaccacctcccccaccgccacctcccccaccccctgctccagagcagcagaccatgccccctcctggttccccatcgggcggagcaggcagccctggtggcctgggcttggagtcattgtccccggagttcttcactagtgtcgtccagggcgtcctttcctctctcctgggctcacttggcgctagagcaggaagtagtgaatcgatagccgcatttatccagagactgtccggctcaagcaacatttttgaaccgggagcagatggtgcccttggattcttcggggctttactgagtctgctgtgccaaaatttctctatggtggatgtagtgatgctgctacatgggcactttcaacctttacaacgcctccaacctcagctgagaagcttcttccatcagcactaccttggaggacaggagcccaccccaagtaacatccgcatggccactcatactctgatcaccgggcttgaagagtatgtgcgggaatcattttccctggtgcaggtacaacccggtgtggatataattaggacaaatttagagttcctccaagaacagttcaattccattgccgctcatgttctgcactgtaccgatagcggattcggagctcgactcctggaactctgcaaccagggccttttcgagtgcctcgctcttaacctccactgtctggggggtcaacagatggagcttgcggcagttattaatggcaggatcagacgaatgagccgcggagtgaatccctctttagtaagctggcttacaaccatgatgggcctcaggcttcaggtggtcctggaacacatgcctgtcgggccagatgctatcctaaggtacgtacggagagtgggggatccacctcaaccactgccagaggaacccatggaggttcagggggctgaaagagcatcccccgaacctcagagggaaaacgccagtccagcccctggcaccacagccgaagaagcaatgagtagaggccctcccccagcacctgaggggggttcacgggacgaacaagatggagcatcagcagaaaccgaaccctgggcagccgcagttcctccagaatgggtaccgatcatacaacaggatattcagagtcaacgcaaggtcaagccccagccacctctttcagacgcttacctgtctggtatgcccgcaaaaagacgcaagctcaggtcagacattcagaagcgcctgcaggaggatccaaactacagtcctcagcgtttccccaatgcacagcgggcatttgcagacgatccatag

SEQ ID NO: 215869 - DNA, 2712 bp, Artificial Sequence
  Description of Artificial Sequence: Synthetic coding sequence
atggaaccaaacgacagtactagtacggctgtcgaggagcctgatagtcttgaagtgctagttaagaccctggactctcagacgcgcacctttatagtaggggctcagatgaacgtgaaagagtttaaagagcacatcgctgctagcgttagtattccgtcagaaaagcagaggctgatttatcagggccgagttctacaggatgacaaaaagctccaggagtacaacgtgggcggaaaggtcatccaccttgtggagagggctccgcctcagactcatttacctagcggggcttcttctggtacagggagcgcctctgccacccacggcggaggcagcccacctggtacccgaggacccggagcatcagtccatgaccggaatgcaaatagttatgttatggtagggacttttaacctccctagcgatggcagcgcggttgacgtgcacatcaacatggaacaggctccaatccagagtgagccaagggtgagactggtgatggcccaacacatgatccgtgacattcagactcttctgagtaggatggaatgtagggggggtccgcagcctcaacattcccaaccacctcctcagccgcctgctgtgacacctgagcccgtggccttaagttctcagacgagcgagccggttgagtcagaggctccacctagggagcctatggaggccgaggaagtcgaagaacgggcacccgctcaaaaccctgagcttactccagggcctgcccctgccggtcctaccccggcaccggaaaccaatgcgcctaaccacccctcccccgctgagtatgttgaggttctgcaggagctgcagcgtttggagagccgcctacagccttttttgcagcggtactacgaagttctgggcgcagccgcaaccactgattataacaataaccatgaaggaagggaggaagatcagcgactcattaatttggtgggggaaagcctccgactacttggaaataccttcgtggccctgtcagacttgcgctgcaatctcgcctgtacacctccaagacacctgcacgtggttaggcctatgtctcactacactacacccatggtcctgcagcaggcagccatccctatccagatcaatgttggcactaccgtgaccatgacagggaacggaactagacctccacccacccccaacgcagaggcccctcctcccggtccaggtcaggccagcagcgtcgcacccagctctacaaatgttgaatccagcgctgagggggcaccaccacccggtcccgcacctccacctgcaacttctcaccccagagtgatcagaatctctcaccagtctgtggagccggtagtcatgatgcatatgaatatccaggatagcggaacacaaccgggaggggtcccctcagcgcctacgggacctctgggacccccaggtcacggacaaacactgggccagcaggtacctggattccctactgctcccacgagggtcgttatcgcccgtcctacaccaccccaggctcggccatcacaccctggaggcccaccggtctcaggtactttaggtgctggactggggaccaatgcgtccttagcgcagatggtttcagggctggtgggccaactacttatgcaaccagtcctggtcgcccagggtactcccggtagccccggaggcctcgggttggagagtctctcccctgagttttttacatcagttgttcagggcgtcttgagctccttgttgggctccctcggagcaagagccggaagctccgaatccattgccgcttttatccagcgcctgagtgggagctcgaacatctttgagccaggagcggacggtgctctcggtttctttggggcactgctctccctgctttgtcagaactttagcatggttgatgtagtaatgctgttgcacggccactttcagccgttacagcggttgcagcctcagctgcgaagtttcttccaccagcattaccttggaggccaggagcccacgcctagcaatatcaggatggccactcataccctcatcacaggacttgaggagtatgtgcgcgagagcttttctctggtgcaagtgcagccgggtgtagacataattagaaccaaccttgaattcctgcaggaacaattcaacagtattgctgcgcatgtgctgcactgcaccgactccggcttcggggcacgattgctggagttatgcaatcagggcctatttgaatgtctggcactcaaccttcattgcctaggtgggcagcagatggagctggctgccgttattaatgggaggattaggcggatgtccagaggcgtgaatccctcgctggtgagttggttaacaactatgatgggactccgtctgcaggtcgttttagaacacatgcccgtcggcccagatgcaatactgagatatgtgcgcagagtcggggacccccctcagcctctgcccgaggagcctatggaagtgcagggcgcagaaagggctagtccagaaccccaggaatgggtgccgatcatacagcaggacattcaaagtcaacggaaggtgaagccccaaccgccattatcagatgcttacctgtcgggcatgcccgcaaagcggagaaagctgagaagtgacatccagaagaggctgcaggaggaccccaattatagccctcaacggttccctaacgcgcagagagcatttgcagacgacccctag

SEQ ID NO: 215870 - DNA, 417 bp, Artificial Sequence
  Description of Artificial Sequence: Synthetic coding sequence
atgaaggagtatagcggattcgcaggagtgtccaggccgcgtggcacttttttccggattcggggtcgaggcagggcacgtggggtgttcgctggaacaaataccggaccaaataactctaacacaactttccagaagagaccgaaagaagaagagtgggacccagaatacacccccaagtctaagaagtactttctgcacgacgatcgggatgatggtgtggactattgggcgaaacgagggaggggacgcggaacgttccaaaggggcaggggccgtttcaattttaaaaagagcggctccagccccaaatggacgcacgataaataccaaggggacggaatagtcgaggatgaggaagagaccatggaaaataatgaagaaaaaaaagataggaggaaagaggaaaaggagtag

SEQ ID NO: 215871 - DNA, 2610 bp, Artificial Sequence
  Description of Artificial Sequence: Synthetic coding sequence
atgggcagatctaactcccgcagtcactcctcgcggagtaagtctcgttcacaaagctcctcgcggagtcggagtagatcccatagcaggaaaaaaagataccgtagtcgatctagaacctactcgcggtcccgatctcgcgatcggatgtatagccgcgactaccgtagggattaccgaaataatagaggtatgaggcggccatacggctatcgtggcaggggacggggttattaccaggggggaggcggtcgctatcataggggaggttataggcccgtatggaacaggcggcattccaggagcccacgcaggggcaggtcccggtctcggagtcctaaacgacgtagcgtgagttcacagcggtcacggtctagatctcgtaggtcctacaggtcatcaaggtcccctaggtccagcagtagcaggtcaagttccccttactctaaaagccctgttagcaaaaggcggggttcacaagagaagcaaacaaaaaaagctgaaggggaaccgcaagaagagtctcctctcaaaagcaaatcccaagaggagcccaaagacacctttgaacacgatccttccgagtccattgacgagtttaacaagagcagtgcaacaagtggagacatatggcctggactgagcgcctacgacaattcccccagatctcctcattccccttctcccattgccactcctccctctcagtctagttcttgtagtgacgcccctatgttgagcaccgtgcattcagccaaaaacactccgagccaacattcccactcaattcagcacagtcctgagcggagtggttccgggtcagtgggcaatgggtcgagtcgatacagtccctcccagaactcccctattcatcacatcccaagtaggcgctctcccgctaagaccattgcgcctcagaacgcccctcgggacgaaagtcgcggacgttcctcattttatcctgacggtggcgaccaggagactgctaagaccggaaagttcctgaaacgctttactgacgaagaaagtcgcgtgttcttgctcgatagaggcaatacgagagacaaggaagcaagcaaagagaagggcagcgagaaggggcgtgctgaaggcgaatgggaggaccaagaagcactggattatttttcagacaaagagtctgggaaacagaagttcaatgatagcgagggcgatgacactgaggaaactgaagactaccgccaattccgtaaaagtgtgttggccgaccaaggtaagagttttgccacagcgtcccatagaaacacggaggaagaaggcctcaaatacaaatccaaggtgtcattgaaggggaatcgtgagagcgacggctttcgtgaggagaaaaattataagctcaaggagacagggtatgtcgttgagcgtcctagtactacgaaagataaacacaaggaagaagacaagaacagcgaaaggattaccgtgaagaaagagacacagtctcctgaacaggtaaagtctgaaaaattgaaggacctcttcgattatagtcccccactacacaaaaatttagatgctcgggaaaagtccacatttcgggaggaatcaccactccgcatcaagatgatcgcatctgactcacacaggcctgaagtgaaactgaagatggcccctgttccgctcgacgactcaaatcgccctgccagtctcaccaaagatcgattactggcctcaacactggttcactcggttaaaaaggagcaggagtttaggtcaatttttgaccacataaaattgccgcaggcgtctaaaagcacctctgagtcatttattcagcacattgttagcctcgtccatcacgtgaaggaacagtacttcaagtccgctgccatgacacttaacgagagattcacgtcttaccaaaaggcaaccgaagagcatagcacacgccagaaaagccccgagatccacagacgtatcgatatatcaccttctacactccgtaaacatacgagactagccggagaagaacgcgttttcaaagaagaaaaccagaagggggataagaagctgcgatgtgacagcgcagacttgaggcacgacatcgaccggcgacgaaaagagagaagcaaggaacggggagacagcaaggggtcacgggagtcaagtggctctagaaagcaggagaagactcctaaggactacaaggagtataagtcttataaagatgactctaaacataagcgggagcaggatcacagccgctcatcctcctcatcagcgagcccctcttcacccagttcacgggaagagaaagagagcaaaaaagagagagaagaggagtttaagacacaccacgagatgaaagagtattccggctttgccggtgtgagtaggccgagagggacatttcatgatgaccgcgatgatggggtggattactgggctaaaagggggagagggaggggcacatttcagcgaggcagggggagattcaacttcaaaaaaagtggaagcagcccgaaatggacccacgataaatatcagggggacggtattgtggaggacgaggaagaaacaatggaaaataacgaggagaaaaaagataggcggaaagaggagaaggagtag

SEQ ID NO: 215872 - DNA, 2610 bp, Artificial Sequence
  Description of Artificial Sequence: Synthetic coding sequence
atggggaggagcaattcgcggagccactccagcaggtcaaagagcagatcgcagagttccagccgcagccgttcacgaagccacagcaggaaaaagagatacagatccagatcccgcacctactcccggtctcgctctagggaccgcatgtactctcgcgactatcgtagggattaccgcaacaacagaggaatgcggagaccgtacggatacagggggaggggaaggggttattaccaaggcggtgggggacggtaccaccgaggaggctatcggccagtgtggaataggagacacagtcgtagtccacgcaggggtagaagcagaagccgcagccccaagagacgctccgtgagttctcagagatctagatccagatcccggcgtagttacagaagctccagaagccctcgcagctcttcctctcgttcctctagtccatatagcaaatccccggtgtctaagagacgaggctcccaggagaaacagacaaagaaagccgagggtgagccccaagaggagagtcccctcaaatctaagtcacaggaagaacctaaggatacattcgaacacgacccatcagagagcatagatgaattcaacaagagcagcgccacctctggcgatatttggccgggactgtctgcgtacgacaattcccccagaagccctcactctccgtcccccatagctaccccaccttcacagtcctcttcctgtagcgacgcacccatgctctcaactgtccactccgcgaagaatacccccagccagcattcacacagtatacaacatagtccagagagaagtggctcgggctccgtgggcaatgggtccagtcggtactctccttcacaaaattcccccatacatcacatccctagcaggaggtcccctgctaagaccatcgcccctcagaatgccccacgggacgaatcacgaggaaggagttcattttacccagacgggggtgatcaggaaacggccaagaccggaaaatttttgaagagattcaccgacgaggaatctagggtgttccttctcgacagggggaacacaagggataaagaagcctctaaggaaaaaggcagtgaaaaagggagggcggagggcgagtgggaggatcaggaggctctggattacttctcagataaggagtccggtaaacaaaaatttaacgactcggagggcgatgacactgaagagaccgaagattatcggcagttccgcaaaagcgtccttgcagaccagggaaagagttttgcaacggcaagccatcgaaacacagaagaggaggggctgaaatataagagtaaagtgtctctcaaaggcaatcgggaatctgacgggtttagggaggaaaagaattacaagttgaaagaaacaggatacgtggtcgaacgaccatctaccacaaaggacaaacataaggaggaggacaagaattccgagagaatcacagtgaagaaggagactcaatcccctgaacaggttaaatcggagaagctgaaggacttgttcgactattctcccccactccataagaatttggatgcccgtgaaaaaagtacctttagggaagaatcgccactacgaataaaaatgattgcgtccgactcccataggcccgaggtcaagctgaagatggcacccgtgccactagatgatagcaatcgtcctgccagcttaactaaagatcgcctgctcgcatcgacactcgtgcacagtgtgaaaaaggagcaagaatttcggtcgatctttgatcatatcaaattgccccaggcctcaaaatctacctctgagtccttcatacaacatatagtctcactggtccaccatgtgaaggaacagtacttcaagtctgcggctatgacactgaatgagagattcaccagctaccagaaagctacagaggagcactccacacgccaaaagtcgccagagatacatcgccgaattgatatttctcccagcactcttagaaaacacacacgcttggcaggcgaggagagggtgtttaaggaggagaaccagaaaggggacaaaaaactgaggtgcgatagcgcagacctgcgccacgatatcgatcgcagacgaaaggagaggtcaaaggaacgcggagatagcaagggaagccgcgagtcatccgggtcccgaaagcaagaaaagacaccgaaggactacaaggagtacaaatcatacaaagacgactcgaagcataaacgggagcaagatcacagcaggtctagctccagctcagcatctccatccagcccatcgtctagggaagagaaggagagcaaaaaagagcgtgaagaagaatttaaaacgcatcacgagatgaaggaatatagcgggttcgctggcgtgagtagacccaggggtacatttcacgacgaccgagacgatggtgtggattactgggcaaagcgtggcaggggacgcggtactttccaaaggggcagggggagattcaactttaagaaaagcggttcctcccccaagtggactcatgataagtatcagggcgacggcattgtggaggatgaggaagaaacgatggaaaataatgaagaaaaaaaagatcgtcgcaaagaagaaaaggaatag

SEQ ID NO: 215873 - DNA, 2757 bp, Artificial Sequence
  Description of Artificial Sequence: Synthetic coding sequence
atgggacgctctaatagtcgatcccacagctcccgatcaaaatcacgttcacagtcttcatcccggtccagaagccggtcccatagtcggaagaagaggtatagaagccggtcccgcacctactctcgctcacggagccgggaccggatgtactcacgggattatagacgagattaccgaaataacagaggtatgagacgcccatacggttacaggggtcggggtagaggctattaccaggggggaggaggacgctaccataggggagggtacagaccagtgtggaaccgccgacacagtagatcccccagacgtggccgttcacggtctcgcagccccaagcggcgttccgtctcttctcaaagatcacggtcacgctctcggagatcttacagaagtagcagatcaccaagaagtagctcctcccgttcgtcctcaccatattcaaagtcccctgtgtcaaaacgacgcggatcccaggaaaagcaaaccaagaaggctgaaggcgagccccaggaggaatctcccctgaaatctaaaagtcaggaggaaccaaaagacacatttgaacatgatccttctgagtccatcgatgagttcaacaagtcctccgcgacaagtggtgatatctggccgggtctgtctgcctatgataattcaccacgcagcccacattcaccaagcccaatcgcaacccccccatcccagagcagctcttgtagcgacgccccaatgctgtcaaccgtgcattccgcaaagaacactccgtcccagcattcccacagcatccaacacagccccgagcgctcagggtccggctcggtgggaaatggcagctccaggtattcccctagccagaacagcccaattcaccacatccctagcaggagatctcctgctaaaacaattgcgccacaaaacgcccctcgcgacgaaagccgcggtcgctcatccttttacccggacgggggtgaccaagagacagctaaaaccggcaagtttctgaagcgcttcactgacgaggagtcgagagtgttcctgcttgaccgcggaaacacacgggacaaggaagccagcaaagagaaaggctcagagaaggggagggccgagggagagtgggaggaccaggaagctttggactacttcagcgataaggagtccggcaagcagaagtttaacgacagcgagggtgacgataccgaagagacagaggattacaggcagttcagaaagagcgttttagcagaccagggtaaaagtttcgccacagcctcccacagaaacacagaggaagaaggcctgaaatataaatctaaggttagtttgaaaggaaacagagagtctgatggcttccgggaagaaaaaaactataaactgaaagaaacagggtatgtggtggaacggccttcaactaccaaggacaagcataaggaggaggataaaaactctgaacggatcacagtcaagaaagaaactcagagccctgaacaggtcaagagtgagaagttaaaagaccttttcgattactccccccctcttcacaaaaacctggacgcacgggagaaatccacatttcgagaagagagtcccctgcgcattaaaatgatcgcctcagatagccatcgacctgaagtgaagctgaagatggcgcctgtgcccctggatgactccaacagacctgccagcctcacaaaggatcggctactggccagtactttagtgcatagcgtgaaaaaggagcaggagttcagaagcatattcgatcacatcaagctcccacaagcgtcgaagagcacatccgagagctttattcagcacatcgttagtctggtacatcatgtcaaagagcaatactttaagtccgccgctatgacgctcaatgagaggtttacctcgtaccagaaggctacggaggagcattcgacccggcagaagagccctgaaattcataggcgaatcgatatctctcctagcaccctgaggaagcataccagactagctggcgaggaaagggtcttcaaggaggaaaaccagaagggcgacaagaagttgcgctgtgatagtgctgacctacgtcatgacattgataggagacgcaaagagaggtccaaagagcgcggtgattctaaggggtcacgggagagcagcgggtctaggaagcaggagaaaacccccaaggattacaaggagtacaaaagctataaagacgatagcaagcataagagagagcaggatcacagccgaagcagcagttccagcgcatcaccaagctccccaagctcgcgcgaggagaaagagtccaagaaagaacgcgaggaagagtttaagactcaccatgagatgaaagagtactccggcttcgcaggtgtgtcccgccctagggggaccttcttccggattagaggacgaggaagagccagaggcgtctttgcagggacgaacacgggaccaaataacagtaacactacattccagaagcggcctaaggaggaagagtgggatccggaatataccccaaaaagcaagaaatacttcctgcacgacgacagagatgacggcgtggactactgggcaaagagggggagggggcgaggcaccttccagagaggaagaggacggtttaattttaaaaaatcggggagctctccaaaatggacccacgataaataccaaggggatggtattgttgaagacgaggaagagacaatggaaaacaatgaagagaagaaagaccgcagaaaggaggaaaaagagtag

SEQ ID NO: 215874 - DNA, 2244 bp, Artificial Sequence
  Description of Artificial Sequence: Synthetic coding sequence
atgggccgttccaacagcaggagccatagtagtcgctcaaagtccagatcacagtctagcagtagatcgcgcagtcgttcgcactcacgcaaaaagaggtacagctcacggtctagaagtagaacttactctcgatctagatcgagagatcgcatgtattctcgcgactacaggcgggattaccgaaataaccgtggaatgcgtcgaccttatgggtacagaggtaggggacggggatactaccaaggcggtggtggcagatatcatcgtggaggatatcggccagtgtggaacagacggcacagccggagccctaggcggggtcgaagcagaagcagaagtcctaagaggcggtctgtttcttcacagcgatccaggtctagatctaggcgttcctaccgttcctcgaggagccctcgctcttctagcagcaggagttcttccccctactccaagagccccgtttccaaaagaagaggcagccaagaaaaacaaactaaaaaagccgagggagagccccaggaggagtctccactcaagtcaaaatcacaagaagaaccaaaagacactttcgagcacgatccatctgagagcatagatgagtttaataaatcttccgccaccagcggagatatctggccgggtttgtccgcctacgacaatagcccacgctccccccatagccctagcccaatcgccaccccaccaagccaatcctcgtcttgcagcgacgcaccaatgctttccaccgtgcattctgctaaaaacactcccagtcagcatagccattcaatacagcattccccggaaaggagtggtagcggttcggtgggaaacggtagtagtagatactccccatctcagaacagcccaatccatcacattccctcccgcagatcgcccgctaaaaccatcgccccacaaaacgcacccagggacgagtctaggggtcggagttcattctatcctgacggtggcgatcaggagaccgctaaaaccggcaaattcctcaagtctccacctctgcacaaaaatttggacgcacgcgaaaagtccacatttcgggaagagagtcccctcagaatcaaaatgattgcctccgactcgcaccgcccagaggttaaactgaaaatggctcccgttccgctcgacgatagcaatcggcctgcttcgctcacgaaagaccggctgctggcctctaccctcgtccattcagtaaaaaaagagcaagaatttaggagcattttcgaccacatcaagctcccccaggcctctaaatctacatccgagtctttcatccagcacattgtatcgttggtacaccatgtcaaggaacaatattttaagtccgccgctatgacgttgaatgaacgatttacgagttaccaaaaagcaactgaggagcactcaacacgacagaagtctcctgagatccacagaaggatcgatatttctcctagcaccctgagaaaacacaccaggcttgccggtgaagagcgtgtgttcaaggaagaaaaccagaaaggcgataaaaaactgcgctgcgacagtgcagacctccgccatgacatcgataggagaagaaaagaaagaagtaaagagcggggtgatagcaaggggtcccgcgaaagcagcggctccaggaagcaggagaagacccctaaagactacaaagaatataagtcgtacaaggatgattccaaacacaagcgagaacaagatcactcaaggagcagcagtagcagtgcttctccttccagcccgtcctctagagaggagaaggagtcaaagaaggagcgagaggaggaattcaagacacatcacgagatgaaggagtattccggattcgctggggtgtccagaccgagaggaactttcttccgtatccggggaaggggcagagcccgaggagttttcgctggcaccaacactggccctaataattccaataccacctttcagaagaggcccaaggaggaggaatgggacccagagtacaccccgaagtcaaaaaagtacttcctccacgatgaccgagacgatggcgtggactattgggcgaagcgtgggcgaggacggggaactttccaacggggaagaggcagatttaactttaagaagagtgggtcctccccgaaatggacccacgacaagtatcaaggcgatggaatcgtggaagatgaggaggaaactatggagaacaacgaggagaagaaggatagaaggaaggaggaaaaagaatag

SEQ ID NO: 215875 - DNA, 2763 bp, Artificial Sequence
  Description of Artificial Sequence: Synthetic coding sequence
atggggcgttctaacagccgttcgcattcttctcgttccaagtcccgcagccagagctcaagtcgctctagatccaggagccactcccggaagaagaggtactcctccaggagccggtcccgaacgtacagtagaagtagatcacgagatcggatgtactctcgcgattatcggcgtgactacaggaataatcgagggatgcggaggccctacggctacagaggcaggggacgcggatactaccagggagggggtgggagatatcataggggtggctacaggcctgtctggaaccggaggcactcccgttcccctcgcagggggaggagccggtcaaggtcacctaagagacgctcagtctcatcccagaggagtcggtcacgatcccggcgaagctaccgctccagcaggagcccacggtcctcttcatcacggagtagcagcccgtattctaaaagtcctgtgagcaagcgtcgcggatcccaggagaagcagacgaagaaggccgaaggcgaaccccaggaagagtcacccttgaagtccaaaagccaggaagagcccaaagacacttttgagcatgacccaagcgaaagcattgatgagtttaacaaatcgagcgcgaccagcggcgatatttggccgggacttagcgcctatgacaattctccaaggtcaccccattctccaagtcccatagctacccctccatctcaatccagcagctgttcagatgcccctatgctgtcgacggtgcactcagcaaaaaatacacctagccaacacagccattcaatccagcattcccccgagcgatcgggttcggggtcggtgggcaacggaagcagtcgttactccccaagtcaaaactccccaatacatcacatccccagcaggcgatcaccagccaagacgattgctcctcagaatgctccgagggacgagagtcggggtaggagcagtttttatcctgacgggggagatcaagagacagccaagacaggcaagttccttaaacgcttcaccgacgaggaaagccgtgtgtttttgctagacagggggaatacgcgagataaggaagctagcaaagaaaaaggaagcgaaaaagggagggctgagggcgagtgggaggaccaggaagctctggattatttctccgacaaggagtcaggaaagcaaaaattcaacgacagtgaaggggacgataccgaggaaaccgaggactatcgccagttccgtaaaagtgttctggcagatcagggcaagtcatttgctaccgcctcccaccggaacacagaagaggaggggcttaagtacaaatcaaaagtctcactgaaaggtaatcgagagtccgatggtttcagagaggaaaaaaattacaaactgaaggaaacaggatatgtggtggaacgcccttcaacgacaaaagacaaacacaaggaggaggacaagaactccgaacgaattactgtcaagaaggaaacgcagagcccagagcaggtgaaatctgaaaaactcaaggatctgtttgactattcaccccctctgcacaagaatctggatgccagggaaaaatcaacctttcgagaggagagccctctgagaataaaaatgatagcctccgattcacatcgccctgaagtaaagctgaaaatggccccagtgcccttggatgacagcaacagacccgctagtctgacaaaggataggcttctggcctcaactcttgtgcattccgtgaagaaagagcaggaattccgctctatcttcgaccatatcaagcttccacaggcctcaaaatccacttctgagagcttcatccagcatatcgtctccctggttcaccatgtcaaggagcagtactttaaatctgcggctatgaccctgaacgaaagattcaccagttatcagaaggccacggaggaacactcaaccaggcagaagtctccagaaatccaccggcgtattgacatcagcccatctaccttaaggaagcacaccaggcttgcgggtgaagaacgagtgtttaaagaggagaatcagaagggagacaagaagctacgctgcgattcagccgatcttagacacgatatagatagaagaagaaaagagcgaagcaaggaaaggggtgatagtaaagggtcaagggagagcagtggatctcgaaaacaagagaagacgccaaaagattataaggagtacaagtcgtataaggatgattcgaaacacaaaagagagcaggatcattctcgcagctcttcttctagcgcctctcctagcagtccatcgtcgcgggaggagaaggagtcgaaaaaagagagggaagaggaatttaagacacatcatgagatgaaggagtatagcggatttgccggtgtgagccggccaaggggcacatttttccgcattcggggaaggggtcgggcaaggggggtctttgcagggactaacaccggaccaaataattccaacacaacattccagaaaagaccgaaagaagaggaatgggaccccgagtacacgcctaaatcaaagaagtattttttacacgatgacagggatgacggagttgactactgggcaaagcgcggacggggtagggggacatttcagcgcggaaggggcaggttcaatttcaagaaaagcggctctagccctaaatggactcatgataaatatcagggagatggtatcgtagaagacgaagaggagaccatggagaacaacgaggaaaagaaagatcggcgtaaggaagagaaggaatag

SEQ ID NO: 215876 - DNA, 531 bp, Artificial Sequence
  Description of Artificial Sequence: Synthetic coding sequence
atgggtaggccagccggtctgttccctcccctatgcccatttctcggatttcggcctgaagcatgctgggaacggcacatgcagatcgagcgtgctccgtcagtgcctccgtttttgcgatgggccggatatcggcctggtccagtgagacgcaggggtaaggtggagctgattaagtttgttcgcgtgcagtggcgccgtccgcaggttgagtggcgtcggaggaggtggggcccaggacctggcgcttcaatggcaggctccgaagaattggggctgagagaagataccttgcgggtgctagccgcatttctgagacgcggagaggctgccggtagcccagttcccacgccgcctaggccgtcttactcccggctgctgtgcttcggaggacccgcagccggtactgcgggacctcgggctgctgagatatctgcccaaccacggataactggatcacctattgatagagaagggtcccacacggcagaggccggaggcccagccggtgggggaggaagaagccactag

SEQ ID NO: 215877 - DNA, 1005 bp, Artificial Sequence
  Description of Artificial Sequence: Synthetic coding sequence
atgggcagaccagcaggactctttccaccactgtgtccgttcttgggcttcagacctgaggcatgctgggaacgccacatgcagatcgagcgcgctcctagtgtgcctccatttttgcgttgggccggatacaggccgggacccgtgagaagacggggaaaggtagagcttataaaatttgtgagggtccagtggcggagacctcaggtggaatggcgcaggagacggtggggcccaggtcccggagcatcaatggcaggaagtgaagaactgggactgagagaggacactctgcgagtgcttgctgccttcctccgcaggggggaggccgctggctcgcccgtgcctacaccaccgaggtctccggctcaggaggagccgactgacttcctgagccgtctgagacggtgtctcccatgttcactggggaggggcgcagcccctagcgagtcccccagaccctgtagcctgcctatcaggccgtgctatggacttgagccaggaccggctacgcccgacttctatgctctcgtagctcagagactcgaacagctggtgcaagaacagctgaaaagtcctcccagtcctgaactgcaaggaccccctagcacagaaaaagaggctatcctgcggcgactggtggccttactcgaagaggaagccgaggttataaaccagaaactggcaagtgaccccgctcttcgatctaagcttgtgcggctgtcctccgactccttcgcgcgtcttgtggagttgttttgcagtagagatgattcttccagaccaagtagggcctgtcccggacccccaccaccatctcccgagcccctcgccaggctggcactcgctatggagctctctcggcgagtggctggcctgggtgggaccctcgcaggcctgagcgtggagcatgtccattccttcaccccttggatccaagcacatggcggatgggagggcattctcgccgtgtccccggttgatttgaatctgcctcttgactag

SEQ ID NO: 215878 - DNA, 1002 bp, Artificial Sequence
  Description of Artificial Sequence: Synthetic coding sequence
atgggtcggcctgccggattgttcccccctctgtgcccttttctaggcttccgcccagaagcctgctgggaaaggcacatgcagatcgaacgagctccgtccgtccctccctttcttaggtgggccggatatagaccaggacccgtaaggagaaggggcaaagtggaactaattaaatttgttagagtccagtggagacgcccacaggtggagtggcgacgccgtcggtgggggccaggcccaggcgctagtatggctggcagcgaagagctgggcctgagagaggacaccctgagggtcctggccgcattcctgaggagaggagaggcagcgggaagccctgttccaacaccgccatcaccagctcaagaagaaccaactgacttcctatcacgactcagaagatgtttaccttgtagtctgggcaggggagcagctccttctgagagtccaagaccttgtagtctgcctattcgaccatgctacggcctcgaacctggccctgctacgccagatttctacgccctcgtggcacagcgcctggaacagctggtccaagaacagctgaaatcgccaccctctccagaactgcaaggccctccatctacagaaaaggaggccatactgcggagactggtggcactactggaagaagaagcggaggtgatcaaccagaaattggcctcagaccctgctcttcgatcgaaacttgtcaggctgagctccgattcatttgcacggctcgtggaactgttttgttctagggatgactcatccaggcctagtcgagcctgtcctggcccaccaccaccctctcccgagccattggcgagactggctctagccatggaactgtcacgtagagtggccggactgggcggtactctcgctggcttatctgtggagcacgtgcacagcttcaccccgtggattcaggcacatgggggttgggaggggattttggccgtttctcccgtcgacttgaaccttcccctggattag

SEQ ID NO: 215879 - DNA, 5165 bp, Artificial Sequence
  Description of Artificial Sequence: Synthetic coding sequence
atgctctcagctaccccattatatggtaacgttcactcctggatgaactctgagcgcgtgagaatgtgcggggcaagtgaggaccgaaagatccttgttaatgacggagacgccagtaaggcacggcttgagctgcgagaggagaatcctctgaaccacaacgttgtggatgccagcactgcacatagaatcgatggactggctgccttgtccatggatcggaccggcttgatccgcgaaggacttagagtacctgggaacatcgtgtattccagcctgtgtggtcttggtagcgagaagggacgggaggcagcgacatctacactggggggtcttgggttttcctcggagcgcaaccctgaaatgcagtttaagcccaacactcccgagacagtggaagcttccgcagtgtctggtaagccgccaaacggattcagcgcaatttacaaaacacctccaggtatccagaaaagtgccgttgccactgctgaagcccttggtctagacagaccagcctcggataaacagtctccacttaatattaacggggcaagttacctgaggctgccctgggtaaatccatatatggaaggagcaacacccgctatatatcctttcttggattctcccaacaagtattctctaaatatgtataaagccctgctgccacaacagtcctatagcctggcccagcccctctactctcctgtctgcacaaatggcgaacgctttctgtatttgcctcccccacactacgtcggaccacacattcctagttctctcgctagtcccatgcggctgagtactccatcagcgtcacctgcgatcccgcctctcgtgcactgcgctgacaagtcactgccctggaaaatgggggtgagcccagggaatcccgttgacagtcatgcatacccacatatccaaaattccaaacagccaagagtgccctcagccaaggctgttacatctggccttcctggagatactgcattgttgcttccaccgtccccgagacctagcccacgcgtgcatttacctacacaacccgcagcagatacatactctgagttccacaagcactatgcaaggatcagtacgagccccagcgtggccctgagtaaaccttacatgaccgtatcaagcgaattcccagcagctcgcttgagcaatggcaaatatccaaaggcacccgagggtggggagggagcccaacctgtgcctggccacgctaggaagacagcagtacaagacagaaaggacggttcgtctccccctcttctcgaaaagcaaacggtgacaaaggacgtgaccgataaaccattagatctgtcgtctaaagttgtggacgtggacgcctcaaaggccgaccatatgaaaaaaatggcccctactgtcttggtgcacagcagggctgggagcgggctcgttctttccgggtccgaaattccgaaggagaccctttccccaccagggaatggatgcgcaatctacaggtcagagatcataagcactgctccttcaagttgggtcgtccccggtccttcccctaacgaggaaaacaatgggaaaagtatgtctctcaaaaacaaagcactggactgggcaattccgcaacagagaagctcctcttgtccgaggatgggcggaactgatgcggtgatcactaacgtctcaggctctgtaagttctgccggacgcccagctagcgccagccccgcaccaaacgccaacgcagatggtaccaagaccagcagatccagcgtcgaaactacgcctagcgtaattcaacacgtgggtcagcccccagctactcccgctaagcacagctcatcaaccagcagcaagggggcaaaggcatccaacccagaacctagctttaaagcgaatgagaatggtctgcctcctagttcaatatttttgtctccgaatgaggccttccggtctccccctattccatacccccgtagctacctcccttatcctgctccagaggggatcgctgtgtctccgctgtctctgcatggaaaaggcccagtgtacccccacccggtgctgctccctaacggttctttgtttccgggacacctggcccctaagcccggactgccgtatggcttgcctacaggcaggccggagttcgtgacttatcaggacgcactcggtttgggaatggtacatccgatgttgatccctcacaccccgatagaaattaccaaggaagagaaaccagaaagacgcagtaggtcccatgaacgcgctaggtacgaagaccccactctccgcaaccgcttttccgaaatcttagagacgagtagcaccaaattgcacccagacgttcctacggacaagaatctcaaacctaatcccaactggaaccaggggaagaccgttgtaaagtctgataaactggtgtatgtggacttactgagggaggagccagatgcaaaaacagacacaaacgtctctaagcctagctttgccgcagagtccgtgggtcagtccgccgagccgccaaaaccctccgtcgaacccgcactgcagcagcacagagactttatagcactgagggaggagctcggcagaatcagtgactttcacgaaacatatacattcaagcaacccgtgttcactgtcagcaaagatagcgtgctagctggaacaaataaagaaaaccttggcctccccgtttctaccccctttctggaaccccctctcggtagcgatgggccagcagtgacctttgggaaaacccaagaagacccaaagccattctgcgtgggcagcgcacctcccagtgtggatgtcactcctacatacaccaaagacggagccgatgaggccgagtccaacgatggaaaggtattaaagcccaaaccttccaagctagccaaaaggatcgccaactctgcaggctacgttggcgacaggttcaaatgcgtgactacagaactctacgccgatagctcacaactgagccgagaacagagagccctgcagatggaagggttgcaggaggattccatactgtgcttaccagcagcctactgcgaacgcgctatgatgaggttctcagagctggaaatgaaagaaagggagggcggacatccagcaacgaaggattctgaaatgtgcaagttctccccagccgactgggagagacttaaaggcaaccaagataaaaaacccaagtctgtgactctggaagaggcaatagccgagcagaatgaatctgaacgctgtgaatacagtgtcggaaacaagcatagagatccatttgaagccccagaggacaaggatctgcccgtggaaaagtattttgtagaaagacaacccgtttctgagccccctgccgaccaggtggcctcagatatgccgcattctcctacacttagagtcgatagaaagagaaaagtctctggcgattcgtctcacactgagaccactgcagaggaagtgccggaggacccgctgctgaaagctaagagacgcagggtgtcaaagggcctgcaccctaagaaacagcgccacctgctgcacctgagggagcgctgggagcagcaagttagtgccgcagatggcaaacctggcagacagtcaagaaaagaggtgacacaggccacacaacccgaagcgatacctcagggcaccaacatcacggaagaaaaacctgggcgaaagcgggcagaggccaaggggaaccggtcttggtcagaagaatcccttaagccttcggacaatgagcagggactccccgtcttctccgggtcacctccaatgaagtctctgagctcgacttcggctggaggcaaaaagcaggcacagccttcatgcgcgcctgcctcacgacctccggctaagcagcaaaaaatcaaagaaaaccagaaaaccgacgtgctgtgtgcggatgaagaagaggattgccaggccgctagcctgctgcagaaatacaccgataactcagagaagcctagcggaaagcggctgtgcaagacaaagcacctcattcctcaagaatcacggcgtggactgcctctcactggcgagtattacgtggagaatgcagacggtaaggtaaccgtgagacgttttaggaaaagacccgagcccagttctgattatgatctctcgccagcaaagcaggagccgaagccctttgatcggctgcagcagttactccccgctagccagtccacccagctgccatgttcatcgagcccacaagagaccacacagtcacggcctatgcctcctgaggctagacgcctcatcgtgaataagaatgctggcgaaactttactccagcgggcagccagattaggttacgaggaggtcgtgctctattgcctggagaataagatatgtgatgtcaaccaccgtgataacgccggttattgtgccctccacgaggcctgtgctaggggttggctcaacatcgtgaggcacctactcgaatacggagccgatgttaactgtagcgcccaggatggtacaagacctcttcacgatgctgtagagaatgatcacttggagatcgtgagactgctactctcctatggagcagatcccaccctggccacatacagcgggaggacaatcatgaagatgactcatagcgaactcatggagaagttcttgaccgattacctcaacgatttgcaggggaggaacgatgatgacgcatctgggacgtgggatttctacggcagctctgtgtgcgaacccgatgacgaaagcggctatgatgttctggccaatccgcctggccctgaggatcaagacgatgatgacgatgcttatagcgatgttttcgagttcgagttcagcgaaacccccttactgccttgttacaatatccaggtttcagtcgcccaggggcctagaaactggctcctgctgtctgatgtcctgaaaaagctcaagatgtctagcagaatatttagatgcaacttcccaaacgtagagatagtcactattgctgaagctgagttctataggcaggtttctgcaagcctgctgttcagttgttccaaggatctggaagcttttaacccagagtccaaggaacttttggatcttgtcgaatttactaacgagatccagacgctgctggggagttctgtcgaatggctgcatcctagtgatttggcttctgacaactattggta

SEQ ID NO: 215880 - DNA, 5267 bp, Artificial Sequence
  Description of Artificial Sequence: Synthetic coding sequence
atgctttctgccactcctttatatggaaatgtgcactcttggatgaattcagaaagggttcgcatgtgcggagcatccgaagaccggaaaatactcgtgaacgacggcgacgccagcaaggccagactagagctccgtgaggaaaaccctttaaatcataatgtggtggatgcttccaccgctcatcggattgacggtttggcagccttaagcatggaccgaactggactgatcagggaagggctccgagtgcccggtaacattgtgtattcttctctgtgcggtctcggttccgagaaagggagagaggctgctacctctaccctaggaggtctgggattctcgtccgagcggaatccagagatgcagttcaagcccaatactccagaaaccgtcgaggcctcagccgttagcggaaagccccctaacggcttttctgctatctataagactcctcctgggattcagaaatctgctgttgctaccgccgaggccttgggcctcgaccgaccagcatcagataagcagagtccacttaacattaacggagcctcttatctccggctgccctgggtgaacccctatatggaaggtgcaacacccgctatttatccatttctggattcacctaataagtacagcctgaatatgtataaggcactgttgcctcagcagtcatactcccttgcacagcctctttacagtcctgtctgcacgaacggtgaacggtttctgtacctgcctccaccacattacgtgggccctcacattccctcatctcttgctagtcccatgaggctcagcaccccgtccgcctcacccgctattccccctctggtgcactgcgccgataagtccctcccctggaaaatgggcgttagtcccggtaatccagttgatagccacgcttacccccacatccaaaattctaagcagccgagggtgccaagcgcgaaggctgtgacctccgggctgccaggagatacagccttgctgcttccaccctccccacgccctagccccagagtgcatttacccacacagcctgcagctgatacctacagcgaattccacaaacattacgctcggatctccacttctcctagtgtagccctttctaagccctatatgaccgtttcatccgagttcccggcagccaggttatccaatggcaagtacccaaaggctcctgaggggggagaaggtgcccaaccagtcccaggccatgctcgcaagactgcagtccaggacagaaaagacggctcctcacccccactactggaaaaacaaacagtcacaaaagacgtgaccgacaaaccactcgaccttagtagcaaagtcgtggacgtggacgcaagtaaggccgaccacatgaagaaaatggcacccacagtgctcgtccacagccgggctggctcggggctggtcctgagcggaagcgaaatccccaaagagacgctgagtccgcctggaaatggctgtgctatctacaggtccgagatcatctcaactgccccttcctcctgggtggttcccggaccgtcgccgaacgaagaaaacaatgggaagtctatgagcctgaaaaataaagccctcgactgggctatcccgcaacaacgatcctccagttgccccagaatgggtggtacagatgctgtgatcaccaatgtgagtgggtctgtcagctcagccggaagacctgcctccgcttctccagcacctaatgctaacgccgacggcacgaagacctctcggtcctccgttgagaccacaccttcagttatccagcacgtgggccagcctccggctacgcccgcaaagcacagttcttctactagttctaagggagcaaaggcgtccaacccggagcctagcttcaaagctaacgagaacggtctgcctccaagctcgattttcttgtctccaaatgaggcttttcgctccccccctataccatatccaaggtcatatctgccttatccagcccctgaaggaatcgctgtgtctccgctgagcctgcacgggaaaggcccagtctatccacacccagtgctgctccccaacggttctctgttcccaggacacctcgccccaaagccagggctgccgtatggcttgccaacaggcaggcccgaatttgttacatatcaggacgctcttggactcggaatggtgcacccgatgcttatccctcacacccctattgaaattaccaaagaggaaaagcccgagcggaggagtagatcccacgaacgcgctcgctacgaggacccaacactgcgaaaccggttttccgagatcctcgagacctcctcgactaaactgcatccagacgtgcccactgacaagaacctcaaacccaatcctaactggaaccagggtaaaactgtcgtcaagtccgacaagctggtgtatgtggatctgctcagggaggaacccgacgcgaagacggacaccaatgtcagcaagccgagttttgccgcagagagcgtaggacagtccgccgagccacccaagccttccgtggaaccagcattgcagcagcatagagacttcattgccctcagggaagaactaggcaggatttcagacttccatgaaacatatactttcaagcagcctgtctttacagtgagtaaagatagcgttctcgccggaacaaataaagagaatcttggcctgccagtgtccactcctttcctggagccccctctcggctccgatggacctgcggtgacatttgggaagactcaagaggatcccaagcctttttgtgtagggagtgctcccccatccgtggatgtgacgcctacgtataccaaggatggtgctgatgaagcagaaagcaatgacggaaaggtgctgaaaccaaaacctagcaaactggctaagaggatcgccaactctgcgggatacgtgggcgaccgcttcaagtgtgtcacaactgaactgtacgctgactcctctcaattgtccagagagcagagggctctccagatggagggcctccaagaagattctatcctgtgtttgcccgcagcctactgcgaacgtgcaatgatgaggttttcagagcttgagatgaaggagcgcgagggtggccacccagctaccaaggattcagagatgtgtaagtttagccccgcagactgggagagacttaagggaaaccaggataagaaaccgaagtccgtcactcttgaagaagcaatcgcagaacagaacgagagcgagagatgtgaatattcagtaggcaataaacacagggatccttttgaagccccagaagacaaggacttgcctgttgagaaatacttcgtggagcgccaaccagtgtccgaaccaccggcagatcaggtggcctccgatatgccacacagccctactctgcgggtggacagaaagagaaaagtctcaggggattcaagccacactgaaacgacggcggaagaagtgcccgaagatcctttgctcaaggctaaaagaaggagggtgagcaaggacgactggcctgagcgcgagatgaccaattcctctagcaaccatctggaggatccgcactatagtgagctgaccaatttaaaagtctgcatagagctgactggactgcacccaaagaagcagcgtcacctgctccatctcagagagcgttgggagcagcaggtctccgccgcagacggaaagccaggaagacagtcacggaaagaggttacgcaagctacccaacctgaggccatcccccagggtactaatattaccgaggagaaaccaggaagaaaaagggcagaggctaagggaaacagatcttggagtgaggaaagcctaaaaccgagcgataacgagcagggactgcctgtcttctccggtagccccccaatgaaatcactgtcttcaacatcagcgggtggaaaaaagcaagcgcagccatcttgcgccccagctagtcgcccaccggctaagcagcagaaaatcaaggaaaatcagaagactgacgtgctgtgcgccgatgaagaggaggactgccaagccgctagtctgcttcagaagtatacggataacagcgagaaaccaagtggcaagcggctttgcaagactaaacatctgattcctcaggagtcacgcagaggactcccgctgaccggcgagtattatgtagaaaatgctgacgggaaggttactgtccgcaggttcaggaagcgcccagaacccagcagcgattatgacttgtccccagccaagcaggaacccaagcccttcgacagactccagcagctgcttcccgcttctcagtccacacagctcccctgttcatcctctccacaagaaacaacacaaagccgacctatgccacctgaagcacggagactgatcgtgaataaaaacgcaggcgaaaccttgctgcaacgagcagcacgcctgggatacgaggaggttgtgttatactgtctcgagaacaagatctgtgacgtcaatcatagggacaatgccggatattgtgcgcttcatgaagcatgtgctagaggatggttaaacattgtgcgtcacctcctagagtatggtgcggatgtgaactgcagcgcccaagatggtacacggccacttcatgatgccgtggaaaacgatcatctcgagattgtccggctgctactgagttatggcgctgatccaaccctcgctacatatagcggtcgaaccataatgaagatgacacactctgaactgatggaaaagtttttgaccgattacctgaatgatctccaaggtcggaatgatgacgacgcaagtgggacatgggatttttacggcagttcagtttgcgagccagatgacgaaagcggttatgatgtgctggccaaccccccagggcctgaagatcaggacgacgatgacgatgcgtattccgacgtgtttgaattcgagttcagcgagacacctctgctcccatgctacaacattcaagtgagtgtggcccagggccctaggaattggctcctcctgtccgatgtgctgaagaagctgaaaatgtcaagtcggatcttcagatgcaattttccaaacgtagaaatagtgacgatcgctgaggctgaattttaccgacaagtttctgctagcttgttgttttcctgttccaaggacttggaagcctttaaccccgagtctaaggagctgcttgatctggttgagtttaccaatgagatccagactctgctgggcagctcagtggagtggctgcatccatctgacttggcttccgataattattggta

SEQ ID NO: 215881 - DNA, 5111 bp, Artificial Sequence
  Description of Artificial Sequence: Synthetic coding sequence
atgctgtcagcaacaccactctatgggaacgttcacagctggatgaacagcgagagagtgcgcatgtgcggcgcttctgaagatcggaagatcttggtcaatgacggagatgctagcaaggccaggttggagttgagagaagaaaatcccttgaatcacaacgtggtggatgcgtcaaccgcccatagaattgatggactagccgctctatcaatggatagaactgggctaatcagagaagggctgagagttccaggaaacattgtgtactcctccttatgtggcctgggcagcgaaaagggaagagaggctgctacaagcaccttgggcggtctgggttttagctctgaaaggaatcctgagatgcagttcaaaccaaacacaccggagacagtcgaggctagcgcagtgtctgggaagccgccaaacggctttagtgcaatatacaagacccccccagggatccaaaaatctgccgtcgccactgcggaggctctgggcctagataggcccgcaagtgacaagcagagccctctcaacatcaatggggcttcgtaccttaggctaccttgggttaatccatatatggagggggctacacctgcaatttatccctttttggatagccccaacaagtatagccttaatatgtataaagcgctgctgccccagcagtcatactctttggcacagcctctgtattcaccggtatgcacgaatggggagaggtttctctaccttcccccaccacattatgtgggacctcacattccgtcctctctggcctctccgatgaggttgtccacaccctctgcgagcccagcaattcccccactggttcattgcgctgacaaatcgctgccctggaagatgggagttagtcctggaaatcctgtggatagccacgcttacccgcacatccagaactctaagcaacccagagtaccttcagccaaggcagtaacatctgggctgcctggcgatactgccttgctgcttcccccatctcctcgcccttccccacgtgtgcatctgcctacacagccagccgcagatacttattctgaatttcacaaacactacgcgagaatttctacctcccctagtgtcgccctgagcaagccctacatgaccgtgagtagtgagtttcctgctgcaaggctgtccaatggaaaatatccaaaagctcccgaaggaggtgaaggcgcacagccagtacccggtcatgcacgaaagaccgccgtgcaagacagaaaagacggctccagccctccactgttagagaagcagaccgtaaccaaagatgtgaccgataaaccactggacctgtcatcaaaggtggtcgatgttgacgccagtaaagcagaccatatgaagaaaatggcaccaaccgtgttggtgcattcccgggctgggtccgggctcgttttgagcgggagcgaaattcccaaagagacgctgagccccccaggcaatggatgcgctatttaccgatctgagataatctccacagcacccagttcctgggtcgtgccgggtcctagtcctaatgaagagaataatggcaagagcatgagcttgaaaaataaggctctggattgggccattcctcagcagcgatcttcttcttgccccagaatgggaggtacagatgctgtgattactaatgtgagcgggagcgtgtctagcgcagggcgacccgcatctgcctcccctgcacctaacgctaacgccgacggtacgaagacctctcgcagcagcgttgagactaccccctccgtgatccaacacgtaggtcagcccccagccacacccgcaaaacacagttcctccactagctcgaaaggggcaaaggcaagtaaccccgagcccagcttcaaggccaacgaaaacggactcccgccttcttcaatctttctgtcccctaatgaggctttcaggtccccacccattccctaccctcggagttacctcccctaccctgccccagagggaattgccgtgagccccttatctctgcacgggaagggaccagtgtacccacatccagtgttgctgccgaatggcagcctctttcctggtcatctcgcacctaaacctggattaccctacggattaccgacaggtcggccagaattcgttacctaccaggatgccctcgggctgggcatggtgcaccccatgcttatcccccacacgcccatcgaaatcacgaaagaagaaaagccggagcggcgatcccggagccacgagcgagccagatatgaagatcctaccctacgaaatcggttctcagaaatcctagagacttcatccacgaagctacacccagacgtacccactgataagaacctgaagcctaacccgaattggaaccagggaaagactgttgtgaagagtgacaaactggtatatgtggatcttttgcgtgaagagcctgacgcaaagacagacactaacgtcagtaaaccatcttttgctgcggagagtgtgggccagagcgccgaacctccaaaaccctccgtcgagccagcgctgcagcaacaccgagatttcatcgccctgagggaagagttgggccgaatcagtgattttcacgagacctatactttcaagcaacccgtttttacggtgagcaaggattcagtactggctggcaccaataaagaaaacctggggctgccggtctccaccccctttttagaaccaccactgggctccgacggccctgcagtgacgtttgggaagacacaggaggatcctaagcctttttgtgtcggatcagccccaccaagtgtggatgtgactccaacttataccaaagacggggcagacgaggccgagagcaatgacggtaaggttctgaaacctaagccgagcaaattggccaaacgcattgccaatagtgcgggttacgtgggagaccgctttaagtgtgtgaccaccgagctttatgcggattcaagccagctctctcgcgaacagagagctctgcagagggccatgatgcgcttcagtgaacttgagatgaaggagagagagggaggacatcctgccacaaaggacagtgagatgtgtaagttctctccagcagactgggaacggctgaaagggaaccaagataaaaaacctaaaagcgttacattggaggaggcaattgcggagcagaacgaatctgagcggtgtgaatatagcgtgggaaataaacacagggatccattcgaggcacctgaagataaggacctgcccgtggagaagtactttgtggaaagacagcccgtgtccgagcctccagctgatcaagttgcctctgatatgccacacagtcccactctgagggtcgaccggaagcgcaaggtgagcggcgactcaagtcacacggaaacaactgctgaagaagtaccagaggaccctctcctcaaggccaaaaggcgccgagtatcaaagggtctccacccaaaaaagcagaggcacttactgcacttgagggagcggtgggagcagcaggtcagtgccgcagacggaaagccgggtaggcaatcgcgaaaggaagttactcaggcgactcagcccgaagcaattccgcaaggaaccaacattaccgaagagaagccaggaagaaaaagagcagaggctaaaggcaatagatcctggtctgaagaatcccttaaaccttccgataacgaacagggcctcccagtgtttagtggctcaccaccaatgaagtccctgtccagcactagcgccggtgggaagaagcaggcgcagccttcctgtgctcccgcatcccggcctcccgctaagcagcaaaagatcaaagaaaatcagaagacagatgtcttgtgcgcagacgaagaagaagactgccaggctgcatctttgctccagaagtatactgacaactccgagaaaccgagtggtaaaaggctatgtaaaactaagcacctgattccccaggagtctcgcaggggactgcctctcacaggggagtattacgtggagaatgccgacggtaaggttacagtcagacggttcaggaagaggcccgagcccagctcagactacgacctgagtccagcaaaacaggagcctaagcctttcgacagattacagcagctccttccagcttcccagtctactcagcttccatgtagcagctctccacaggagacaactcagagccggccaatgcctcctgaagcacgtcggctaattgtgaataaaaatgccggagaaaccttgttacagcgcgcagccagactgggctacgaggaggtggttttatactgccttgagaataagatctgcgacgtgaatcaccgtgataacgctggctactgtgcactccatgaagcatgcgccagaggatggttaaatatcgttcgccacctgctagagtacggggctgacgtcaattgttctgcccaagatggaacaaggcctctccacgacgctgtggaaaacgaccacctcgagatagttagattgctcctgagctatggagctgaccctactcttgcaacctacagcgggaggaccatcatgaaaatgacacattccgagctaatggagaagtttcttaccgactacctcaacgatctccagggaaggaatgatgacgacgcgagcggaacctgggacttctatggatcctcggtctgtgagcctgacgacgaatccgggtacgatgttttagccaatccacctggccctgaggatcaagatgatgatgatgatgcatacagcgatgtgtttgagtttgaattcagtgaaaccccattactgccgtgctacaatatccaggtatctgtagcccagggaccacgaaattggctgctcctgtccgacgttctcaagaagctgaagatgtctagccggatcttcagatgcaacttcccaaacgtagagatcgtcacaatcgcagaggcagagttctatcgccaggtctcagcttctcttctgtttagctgttccaaggacctcgaggcatttaatccagaatctaaagagctgctcgacttggttgagttcaccaatgaaattcagactttgttaggaagctctgtggagtggttgcaccccagtgacctagcatccgacaactactggta

SEQ ID NO: 215882 - DNA, 1869 bp, Artificial Sequence
  Description of Artificial Sequence: Synthetic coding sequence
atgccccattcaccaacattacgggtagaccgaaagcgcaaggtctccggtgattcatcccacacagagacaacagctgaagaggtgcccgaggaccccctgcttaaagcaaagcgcagacgagtgtcgaagggcctccatcccaagaagcagcgtcacctcctccacttgcgcgagcgttgggagcaacaggtgtccgcagccgacggaaagcccggacgccaatcccggaaggaggtgacacaagctacgcagcctgaggccattccccaggggactaacatcactgaggaaaagccgggtcggaaacgcgctgaagcaaagggcaatcggtcttggtccgaagagagtcttaagcctagcgacaacgagcagggcctacctgtttttagtggctccccgcctatgaaatctctttcctcaacatccgctggagggaagaagcaagcccagccctcctgcgcaccggctagcaggcctcccgctaagcagcagaagatcaaagagaaccagaagacggatgtgctctgcgctgatgaagaggaggattgtcaagccgcttctctcttgcagaagtacaccgataactctgagaagccatccggaaagcggttgtgtaagactaagcatctgatcccccaggagtcgaggcgcggactgcccttgactggggagtactacgttgaaaacgccgatggcaaagtcacagtgcggaggtttagaaaacgtcctgagcccagctccgattatgacctgtctccagcaaaacaggagcctaagccctttgacagactccagcagctgttaccggctagtcagtctacgcagctaccttgtagctcttctccacaggaaacaactcagtctaggccaatgcctcctgaagccagacggctcattgtgaacaagaacgcaggcgaaaccttgctgcagagggcagccagactcggctatgaggaagtagtattgtattgtttggagaacaagatatgcgacgtgaatcatcgtgacaacgccggatactgcgctttacacgaagcctgcgctcgcggttggttaaacatagttcgtcatttgctggagtacggcgctgacgtgaactgtagcgctcaggacggcacacgccctttgcatgatgccgtggagaatgatcatctggagatagtaagactgttgctgtcttatggagctgacccaacccttgcgacctactcaggcaggaccattatgaagatgacacatagtgagcttatggagaaatttctcacagattatctcaacgacctgcagggccgtaacgacgacgacgcctccggtacctgggatttttacggctcatccgtgtgcgaacccgacgacgagtccgggtacgatgtactggcgaatcctcctggccctgaagaccaggacgacgacgatgacgcatacagtgacgtcttcgagtttgaattctcagagacaccactgctgccatgctacaacatccaggtctctgtggcccagggccctcgtaattggctgttgttgtccgatgtactcaagaaactaaagatgagcagcagaattttcaggtgcaactttccaaatgtagagatagtgactatcgccgaggccgaattttatcgacaggtgtcagcctctctactattttcctgttcaaaagatctggaggcctttaacccagagtctaaggagctgctggatttagtggagtttaccaacgaaattcagacgctactgggctcgtctgtcgagtggcttcatccatccgacttggcttccgataattattggaagagccctcagattgcccgtggctccgtggagggtaaaaaaactgacgacaagacgtcgaaaaccgatttgtag

SEQ ID NO: 215883 - DNA, 5165 bp, Artificial Sequence
  Description of Artificial Sequence: Synthetic coding sequence
atgttgtcagcaacccctctgtatggcaatgtccatagctggatgaactcagagagagttaggatgtgtggagcgtcagaagaccgcaagatccttgtaaatgatggcgatgcaagtaaggcaagattggagctacgggaagagaatcctctaaaccacaacgtggtcgatgcatcgaccgctcataggatcgacggtctggccgcactctccatggacaggacaggtttaattcgcgaaggccttcgcgtgccgggaaacatcgtttactctagcctctgtggactgggctctgaaaagggcagagaggcagcaaccagtacgcttgggggattggggttctcatccgagcgcaacccagagatgcagttcaaacctaatacgcctgagaccgtcgaggcaagcgccgtgtcaggaaagccacctaatggcttcagcgctatatacaaaacaccacccggaatccagaagagcgcagtggccactgcagaggcgctggggctggaccgtcctgccagcgataagcaatcacctctgaacattaacggggcatcttaccttcggctgccgtgggtcaatccttacatggagggcgctacccctgcaatttacccattcctcgattcaccgaataaatactctctgaatatgtataaggctcttcttccacagcagagctacagtcttgcccagcctctctacagtcctgtctgtactaatggggaaaggtttctgtacttgcccccaccccactatgttggcccacatattccaagctctctggcaagccctatgcgccttagtacaccctctgcaagccccgcaatacctccacttgttcactgtgctgataaatccttgccctggaaaatgggagtttcgccaggcaaccctgtggactctcacgcctatccgcacatccagaacagtaagcagcccagggtcccatctgccaaagccgtcacttctggcctccctggtgatacagcactgttactgccaccgtctccaaggccctcacccagagtgcatctgcctactcagcccgctgctgacacgtattccgaatttcataagcattacgcacggatatctactagcccaagcgtcgctctctccaaaccttacatgactgtttcatcggaattcccggctgctaggctgagcaatgggaagtatccgaaagctccagaaggtggcgagggcgctcagccagtccccggtcacgcccgaaaaacagccgttcaggaccggaaagacgggagtagcccgccactgctagaaaagcagacagtcacgaaagatgtgaccgacaaacccttggacctgagcagcaaagtagtggacgtggatgcctccaaagccgatcacatgaagaagatggccccaacggtactggtccacagtcgtgccggatccggactggtcctgagcggcagcgagatacccaaggaaactctgtcccccccaggaaacggctgtgccatttaccgcagcgagattatctcgacggcccctagttcctgggtcgtgccaggcccttccccaaatgaggagaacaatggaaagagtatgagcttgaagaataaggccttagattgggccataccccagcagagatcatcaagctgtcctaggatgggtggaactgatgccgtgatcacaaacgtgagtggatcagtctcctccgcaggcaggcccgcttccgcctcccctgcacccaacgccaacgcggacggcacaaaaacgtctaggagctcagtggaaacgaccccttcggttatccagcacgtgggtcaaccaccagctactcctgcaaagcattccagcagcacttcaagtaaaggggctaaagcatcaaatcctgaaccatctttcaaggccaacgagaacgggctgcccccaagctccatattcctgtcccctaatgaagcgttccggagcccacctatcccctaccctagaagctacctgccttaccccgctcccgaagggatcgctgtttccccactctccttacacgggaagggccctgtctacccacatccagtgctgctccccaatggatccttatttccaggacacttggccccaaagccaggattaccatacgggctccctactggcaggccagaatttgttacatatcaggacgctctggggctggggatggtgcaccctatgctgattcctcacacacctattgagatcaccaaggaagaaaagccagagaggcgcagtcggagtcatgagagggcaaggtatgaagacccgactttacgaaaccgcttctccgaaatcttggagacaagctccaccaaattacacccggacgtgccgactgacaaaaacctcaagcccaacccgaattggaaccagggcaagacagtggttaagtcagacaagctcgtgtacgtcgacttgctgagggaggaacccgacgctaagacagacactaacgtaagtaaacccagttttgccgcagagagcgtcggccaatccgctgagcctcccaagcctagtgtggaacccgctctgcagcaacatagggatttcattgcccttcgggaagaactcgggcgtatttctgattttcacgaaacctatacttttaagcagcccgtttttacagtttcaaaagacagcgtgttggcaggtactaacaaagagaatctcggcctacctgtttccaccccttttctcgagcctccgctgggcagcgacggaccggcagttactttcggaaagactcaggaggaccccaagccattctgtgtgggttcggcgcctcctagtgttgacgtgacccctacctacaccaaagatggagcggacgaagcggaaagcaatgatgggaaggttcttaaacccaaaccctccaagctcgctaagcggatagccaattctgctgggtatgttggggatcgctttaaatgtgtgaccactgaactatacgctgatagctcacagctgagccgggagcaacgagccctccaaatggaggggttacaagaggattccatcctatgcttgccggctgcgtattgcgaacgtgccatgatgcggttctcagaactggagatgaaggagcgtgaagggggacaccccgcaactaaagattcggagatgtgtaaattctccccagcagattgggagagactcaaaggcaatcaagacaaaaagccaaaatccgtcactttggaagaggctatcgccgagcagaacgaatcagagaggtgcgagtatagtgtggggaataagcacagagacccctttgaggcgccagaagataaagatctccccgtcgaaaagtatttcgtggaaaggcagccagtgtccgagccccctgctgatcaggtcgcttctgatatgccccactccccaaccctccgcgtggatcgaaaaagaaaggtgagtggcgattcatctcacacggagaccaccgccgaggaggtcccagaagacccactcctgaaagcaaaacgccgacgtgtttctaaaggccttcatcctaagaaacagcgccatttactccatctgagagaacgctgggagcagcaagtgagtgcagccgatgggaaacccggtaggcaatccagaaaggaagtcacccaagcaacacagcccgaggctataccacagggaactaatatcacggaagagaaaccgggaagaaagcgtgcggaagcaaaagggaataggtcttggtctgaagagagcctgaaaccttctgacaatgaacagggacttcccgtgttctcggggtctccccctatgaagagtctttcctcgacgagtgccggaggcaagaaacaggcccagccaagttgtgctcctgcctcacgtcccccagccaagcagcagaaaattaaggagaatcaaaagactgacgttctgtgtgccgacgaggaagaggactgtcaagccgcaagcctgctgcaaaaatatacagataattcagaaaagcccagcggcaagagactgtgtaagacgaagcatttgatcccacaggaaagccggagaggcctgccactaacaggcgagtactacgtagagaatgctgatggtaaggtgacagtgagaaggttccggaaacgtccagagcctagttcggactacgacctgagcccagccaaacaagaacccaaaccctttgatcggttacagcagctgctgccagctagccagtccacccagttaccatgctcctcgtccccccaggagactacacaatcccgcccaatgccacccgaggctcggagactcatcgtcaataagaacgcaggcgagaccctgctgcaacgggcagcgaggctgggatacgaagaggtggttctctactgcctcgaaaacaagatttgtgatgtcaatcaccgtgataatgccggatactgtgcgcttcatgaagcgtgcgcccgtggctggctgaacattgttagacacctgctggagtacggggctgacgtcaactgcagtgcccaggatggcacccgaccactacacgatgccgtggaaaatgaccacctggaaattgtgagattgctcctgagttatggagcagacccgaccctggccacttacagtggccgaactattatgaagatgacacacagcgagctgatggaaaagttcttgacagattacctgaatgatctccagggtaggaatgacgacgacgccagtggaacgtgggacttttacggaagttccgtttgtgagcccgatgacgaaagtggctacgatgtgctcgccaatccccctggaccggaagatcaggatgatgatgatgacgcatattcagatgtgttcgagttcgaattcagtgagactcctctcctgccttgttataatatccaagtaagtgtggctcagggaccacggaattggctcctcttgagcgacgttcttaagaagcttaagatgagctctcggatctttaggtgtaacttccccaacgtggagatagtcacgattgccgaagctgaattctaccggcaggtcagcgcctcactgctttttagttgctctaaggatctggaggcattcaatccggaatccaaagagctgctggacctggtggagttcactaacgaaatccaaacacttcttggctctagtgtggagtggctgcatccctcagatttggccagcgacaactattggta

SEQ ID NO: 215884 - DNA, 87 bp, Artificial Sequence
  Description of Artificial Sequence: Synthetic coding sequence
atgctgagcgccacaccgctctatgggaatgtgcactcgtggatgaatagcgaacgcgtgcgcatgtgcggcgctagtgaagattag

SEQ ID NO: 215885 - DNA, 1236 bp, Artificial Sequence
  Description of Artificial Sequence: Synthetic coding sequence
atgacgcgccctgctttccaaccgccagccacccctgccaaacacagcagctctacctctagcaaaggcgcaaaagctagcaatccggagccatccttcaaggcaaatgagaatggactgccaccgagttcaattttcttatccccaaacgaagcatttagatccccacccataccctatcctaggagctacctgccctacccggctccggaaggaattgcggtgagcccacttagcctgcatggtaagggccctgtgtatccccaccccgtcctcctccccaacgggtcactttttcctgggcatctggcccctaagcccggtcttccgtatggcctccccaccggccgacccgaatttgtgacataccaggacgccctggggcttggcatggtgcaccccatgctgattccacatacccctattgaaatcaccaaggaggagaagccagaaaggcggtcacggagtcacgagcgggcaagatacgaagaccctacgctgcggaaccgcttctccgagatcctcgaaacctctagcacaaaactgcaccccgacgtgccaaccgacaaaaatttgaagccaaacccaaactggaaccaaggaaagacagtggttaagtccgataaactagtttacgtagatttactgagagaggaacccgacgccaaaacggataccaacgtatcaaagccgtcctttgcagcggaaagtgtcggacaatccgccgagccgcctaagccttccgtcgagcccgcactccagcagcacagagacttcattgccctcagagaggaactgggaaggatttccgacttccacgaaacatatactttcaaacagccagtgtttacggttagtaaagattccgtgttggcgggtactaataaggagaatctggggcttcctgtcagtacacctttcttggaaccacccctggggtctgacggccctgctgtgacatttggtaaaacacaggaggaccctaaacctttctgcgtgggatctgctcccccttccgtggacgttaccccaacctatacaaaagacggcgctgacgaagccgagagcaacgacggcaaggtgcttaagcccaagccatccaagctagctaaaagaatcgcgaattccgcgggttatgttggggatagatttaagtgcgttacgactgaattatatgctgatagttctcaactgagtagagagcaacgggcactccaggtgtctccacccacatag

SEQ ID NO: 215886 - DNA, 2238 bp, Artificial Sequence
  Description of Artificial Sequence: Synthetic coding sequence
atgcctgttctttctcgaccacgtccctggagaggcaatacactcaaacggacagctgtactcctggcactggcagcctacggagcccacaaggtgtacccactggtgcggcagtgtctcgccccagcccgtggactccaggcccctgctggcgagccaactcaggaagccagcggcgtcgcggctgccaaagccggtatgaacagagtgtttctgcaacgactgctgtggcttctgcgccttttattcccaagagttctgtgccgggagaccggcctcctggccctccacagcgctgccttggtaagccggacttttctcagcgtatacgtggccagacttgacggacggcttgcacggtgtatcgtcagaaaggatccacgagcttttggttggcaattgttacagtggctgctcatcgcgctgcctgccaccttcgtgaactccgcaataaggtacctagagggtcagctggccctcagtttcaggagccggttagtcgcccatgcttataggctttacttttcgcaacaaacatactatcgtgtgtcaaatatggatggaaggttgagaaaccccgatcagtcactgaccgaggacgtggtcgcctttgcagctagtgttgctcacttgtacagtaacctcactaagccattacttgacgtggcagtgacatcatacactcttctgagagccgcacggtcccgcggagccggtacggcttggcccagcgctatcgccggactggttgtattcttgaccgccaatgtacttcgggcattttccccgaaatttggggagctcgttgcagaggaggctcggagaaaaggtgaactgcgctacatgcacagtcgggtggtcgccaactctgaagaaattgcattctacggtgggcatgaggttgagctggccctccttcagcgttcttaccaagatctggctagccagatcaatctgatccttctcgagcgcctatggtatgtgatgctagaacagtttctgatgaagtacgtttggagtgcaagcggcctgttgatggtggccgtgccaatcattactgccacggggtactcagagagtgacgctgaggcagtgaaaaaggcagccctggagaagaaagaagaggagctagtgagtgaacggactgaagcttttaccatagcccgaaacctgcttaccgctgccgctgacgccatagaacgaatcatgagctcttataaggaggtcacagaactagctgggtataccgctagagttcatgagatgttccaagtcttcgaggatgtgcagcgctgccatttcaaacgtccgagagaattagaggacgcccaggcagggagtgggactattgggaggagtggagttagggtcgaaggacctctgaaaatcagagggcaggtcgtggatgtggagcaaggtatcatttgtgagaatattccaatcgtgacaccttccggagaagtcgtcgttgccagccttaatatccgggtggaagagggaatgcatctcctgattactgggcctaatggctgcggaaagtcctccctttttcggattcttggaggcctttggccaacatacggtggtgtgttgtacaagcctcctccccagaggatgttttacattcctcagagaccctacatgtccgtgggcagtctacgcgaccaagtcatctatcctgatagcgtggaagatatgcagcggaagggctactccgaacaggacttggaggcaatccttgacgtcgttcacctgcaccacatactccagcgggagggtgggtgggaggccatgtgcgactggaaagacgtgctgtctggaggtgagaaacagaggatcggcatggccagaatgttctatcatcgcccaaagtatgcactgttagacgagtgcacgagcgccgtgagcatcgatgtggaaggtaagatttttcaagctgctaaggatgccggaatcgccctgctgagtattacacacagaccatctctgtggaaataccatacccacttattgcagttcgacggggaaggcggatggaagttcgagaaactagacagtgccgctcgtctttccctgactgaagaaaaacagcgattggaacagcaactggcgggaattcctaaaatgcagcggagactccaagagttatgtcaaatcttgggagaggccgttgctccagcccacgtgcccgctccatctccccaaggacctggcggattgcaaggtgcctctacatag

SEQ ID NO: 215887 - DNA, 5358 bp, Artificial Sequence
  Description of Artificial Sequence: Synthetic coding sequence
atgatctccactgcacccctctattcaggggttcacaactggacatcatcagatagaattcgcatgtgtgggataaacgaagaaaggcgcgcacctctgtctgacgaggagagcaccactggggactgtcagcattttggttcccaggagttctgcgtaagctcatcattttccaaggttgaactgaccgccgtgggcagtggatctaatgcaaggggggcagacccagacggctccgctacagagaagctgggacacaagagcgaagacaagccggacgacccacagcccaagatggattatgccggaaacgtggcagaagccgagggtttccttgtgcctttgtcttcaccgggagacggactcaagttaccagcttccgactccgccgaggcaagcaatagcagagcagattgctcgtggacccctctcaatactcagatgtctaaacaggttgactgtagcccggcaggagtgaaagcattggactcccgtcagggtgttggagaaaagaacacgttcatcctggctaccctagggacaggcgtgcccgtggagggaacattacccctagtgactacaaacttctctcctttgccagcccctatctgtccccctgctccgggatcggccagtgtgccccattctgtacccgatgcatttcaggtaccactgtctgttccggctcctgttcctcattcaggtcttgtgcccgtgcaggtggcaacgagtgtccccgcaccatctccccctttggccccagtgccagcactcgctcccgcaccccctagcgttcctacactcatctccgacagtaatccgctttcagtgtccgccagcgtgctcgttccagttcccgctagcgccccaccatctggacctgtacccctcagtgcgcctgccccagccccactctccgttcccgttagcgcaccacccctcgccctgattcaggctcctgtgccaccatccgcaccaactcttgttctggcccctgtgcccacccctgtgctggctcctatgccagcctcaacacccccagcggcaccggctcccccttccgtccccatgccgacaccaactccctcttccggccctcctagtaccccaacgctcattcctgccttcgccccaacaccggtgcctgctcctactccagcccctatctttacccctgcccctacacccatgcctgctgctacccctgccgctataccaacttcagcccctatccccgcaagcttttcgctaagtagggtttgtttcccggcagcccaggcccctgccatgcagaaagtacctttgtcgttccagccaggcacagtgctgactcctagtcagcccctggtctatattccgccaccgtcttgcggtcagcccctgagcgttgctactctccccactactttaggagtgagttcgacacttacattgcctgtcctgccttcttatttgcaagacaggtgcctcccgggagtcttagcctccccagagcttaggtcatacccttatgcttttagcgtggcaaggcccttgacatcggattctaaactagtgtcgttagaagtcaatcggctgccctgcaccagtccaagcggatctaccacgacgcagcccgcacctgacggcgtccccggtccgcttgccgatacatccctagtcactgcatccgccaaagtgcttccaaccccacagcctctcttaccagcgcctagcggatcatctgccccaccccacccagcaaaaatgccaagtggcactgagcagcagacagaaggaacaagtgtaacctttagtcctctgaagagccccccacagctggagcgtgaaatggctagcccccctgaatgttccgaaatgccattagacctatcttctaaatccaaccgccagaaactcccactgccaaaccagcgcaagacgcccccaatgcctgtcctgacccctgtgcatacgagcagcaaggccctgctgtcaaccgtattatcccgctcccagcgtaccacacaagctgcgggtggtaacgtgacatcgtgtttaggctctacttcctctcctttcgtgatcttccccgaaatagtaagaaacggcgatcctagcacatgggttaagaattctaccgctctcatctctacaatccccggaacctacgtcggggtcgccaacccggtccctgcgtccctgctgctgaacaaagatcctaatctgggtctaaaccgcgaccctcgtcacctgcctaagcaggagcccatctccattatcgaccagggcgaacccaagggaactggagccacgtgcggaaagaaggggagtcaggctggcgcagaaggccagcccagtactgtgaagcgctatactccagccaggattgcgccaggcctccctggctgccagaccaaggagctgtccttgtggaagcccactggtcccgctaatatctacccaagatgctcagtcaatggtaagccgacctccacccaggttctgcccgtgggatggtctccttatcatcaagcaagcctgttaagtatcggaatcagttctgctgggcagctgactccatcgcaaggggcaccgattcgacctacatcagtggtgtccgagtttagcggagtgccctccctaagctctagcgaagccgtccatgggctgcccgagggacagccacgaccaggaggatcctttgtgcctgagcaggatcccgtcaccaagaacaagacatgccgtattgctgccaagccctatgaggaacaggttaatcccgtattactgactctttcaccccagacagggactcttgccttgagtgtccaaccttccgggggtgacattaggatgaaccaagggcctgaggaatcagagtcccacctgtgtagcgactctacccctaaaatggagggaccccaaggcgcatgtggcctgaagctagccggagacaccaaacctaaaaatcaggtcctggccacctatatgtcccacgaactggttctcgccaccccacaaaacctcccaaagatgccagaattgccactgttacctcatgactcccatcccaaagaattgattctggacgtggtcccatcttcccgcagagggtcatctaccgagcgccctcagctgggctcccaggtggatctcgggcgagtaaagatggaaaaggtagacggagacgttgttttcaacctggcaacatgtttccgtgccgatggcctgccggtcgcccctcagagggggcaggccgaagttcgcgcaaaggccggtcaagctcgcgttaagcaggaatcagtcggtgtcttcgcttgtaagaataaatggcagcccgatgatgtaactgagtccctaccgccaaagaagatgaaatgcggaaaagaaaaagactctgaggaacagcagctgcagccacaggccaaggcagtcgtgagatccagccataggccaaagtgccggaaactgcccagtgaccctcaggaatctactaagaagtcccctagaggagcctctgattctggcaaagagcacaacggcgttagggggaagcacaaacacagaaagcccacaaagcctgagtcccagtcaccagggaaaagagcggatagccatgaagaagggtctctggagaagaaggctaagtccagcttcagagacttcatccccgtggtgctcagtacacggacccgctctcaatcgggatcaatttgttctagcttcgctggaatggccgattctgacatgggttcccaagaagttttccccacagaagaggaagaagaggtaacgcctaccccagcgaaacgacgcaaagtccgtaagacccagcgagatacacagtatcgtagtcatcatgctcaagacaaaagcctgctctctcagggccgtaggcacctgtggcgggcacgggagatgccctggcggacagaagcggcaagacagatgtgggacacaaacgaggaagaggaggaggaggaagaagaagggctgctcaaacgcaagaaacggaggaggcagaaaagtagaaagtatcagactggcgagtatcttactgagcaggaggatgaacaaagacgcaagggtagagccgacctaaaggctcggaagcagaagacatccagcagccagtccctggagcatcgcttgcgcaaccgtaatttgttgttgcccaacaaggtccaggggatcagcgacagtcctaatggtttcctgcctaacaacctggaggaacctgcttgcctagaaaattccgaaaagcctagcgggaaaagaaagtgcaagaccaaacacatggcaacggtgagcgaagaggccaaggggaaaggacggtggtcccagcagaagactcggtcccctaaaagtcctacgcctgtgaagccaactgaaccatgcacgcctagcaaaagcagatctgccagcagcgaagaagcaagcgagtcaccaacggctagacagatccctccggaggctcgacgactgatcgtaaacaagaacgctggagagactctgctccagcgtgcagcgaggttaggatataaggatgtggttctctactgtttacagaaggactcagaggacgttaatcatcgggataacgctggctacacagcgttgcacgaagcatgctcccgaggatggactgacatccttaatatcctgctcgagcatggcgctaatgtgaattgcagtgcacaggacggcacccggccagtccacgatgccgtcgtgaacgacaacttggagaccatatggctcttgctttcttacggcgcagaccccactttggccacatacagtggacagactgccatgaagctggcttctagcgataccatgaaaagattcctatccgatcacctttcagatttacaggggagggccgagggcgacccgggagtatcctgggacttttactcgtcgtcagtgctcgaggaaaaagacgggttcgcttgtgacctcctgcacaatccacccggttcctctgatcaggagggtgatgaccccatggaagaagatgacttcatgttcgagctctccgacaaaccccttttaccgtgctacaacctgcaggtttcggtgtctcgcggtccctgcaattggtttttattctcagatgtgcttaagcgcttgaaactcagttcgcggattttccaggcccgatttccacacttcgagatcacgacaatgccgaaggccgagttttatcgtcaggtggcttcttctcagcttctcactccagccgagcgtcctggtggcttggacgaccgaagtcccccaggcagttctgagaccgtggaactcgtgagatacgagcctgacctgctccgactcctgggatccgaggtggagtttcaatcctgtaattcatac

SEQ ID NO: 215888 - DNA, 4746 bp, Artificial Sequence
  Description of Artificial Sequence: Synthetic coding sequence
atgatttctacagcccctctctattccggagtacacaattggactagttcagacagaatcaggatgtgcggcatcaacgaggaaagaagggcacctttgtctgatgaggagagtaccacgggagattgccaacactttggcagccaggagttctgtgtctcaagctctttctccaaggtagaactgacagctgtgggatcagggtcgaatgccaggggcgcagatccggacgggagcgccaccgaaaagctgggtcacaaatctgaagataaacccgacgatcctcagcctaagatggattatgccggaaatgttgccgaggcagagggcttcctcgtgcctctgagttctcccggtgatggactcaagctcccggctagtgacagtgctgaagcctctaacagcagagccgactgctcatggaccccgctaaacacacagatgtctaaacaggtcgactgctccccagccggagttaaggccttagattctcgccagggcgtaggagaaaaaaacactttcatcttagcgactctgggcacaggagtgccagtggaagggaccctgccattggttaccacgaattttagccctcttccggcacccatttgtccccctgcgcctggatcagcaagcgtgccacactctgtgccagacgcttttcaggtcccactgagcgtccccgctccagtgccacactctggcctagtccctgtccaggtagcgactagcgtgccggcaccatccccgccactagctcctgttcccgctctcgctcccgctccaccctctgttccgaccctcatttcggattccaatcctttgtccgtgtcagcctcagttttggtgcctgttccagcctccgcaccgccttcgggccctgtacctctgtcggcccctgcaccagcgcctctcagtgttccagtgtcagcccctccgctcgctctaatccaagctccagtcccaccctccgcccctaccctggtcttagctcccgtgcccacccccgtactcgcccctatgcctgcatccaccccaccagccgcacccgcacccccatccgttccaatgcccaccccaactccttcgagcgggcctcctagcacccccactctgataccagcttttgccccaacgccggtgccagcaccgacaccagcgcctattttcacccctgccccaacgcctatgcccgcagcaactccagcggctatccctacttctgccccaattcctgcctctttctcactcagccgcgtatgttttccagcagcacaggcccctgcgatgcagaaggtgcctttgagcttccaacccggtactgtgctcacaccgagccaaccactggtatatattccacctccatcatgcggacaacctctcagcgttgctacactgcccactaccctcggggtcagcagtactctgaccctgcctgtgcttccgtcttatttgcaagaccgctgtctgccaggcgtcctcgcctcgcccgagctgcgctcgtatccttacgcttttagcgtagcgaggccactcaccagtgattccaagctcgtttctctggaggtgaataggctgccgtgtacctctccctccggctccaccaccactcagcccgcacccgacggggtgccgggaccactggcagacacgagccttgtgactgcaagcgctaaggtcctgccgacaccacagccacttctgcctgcccctagcggcagctccgcccctcctcatccagccaagatgccgtcagggacagagcaacagaccgaagggacttccgtcactttcagccccttgaaaagtccaccgcagcttgaacgcgaaatggcctcacccccagagtgctcagaaatgccacttgatttgtcgtcaaaatccaaccggcagaaactgcctcttccaaaccagaggaagactccacctatgcctgttctgacgccagtgcacactagcagcaaggctcttctctcaaccgtgctatcgaggagtcagcgaaccacccaagctgccggaggtaatgtaacatcatgtctggggtctacaagttcaccctttgttatatttcccgagatagtgagaaatggggaccccagtacctgggttaagaattctaccgctctcatttccactatcccaggaacgtacgtcggcgtggctaacccagtgccagctagcttgctgttgaataaggaccccaacttggggcttaatcgcgacccacggcacttgccaaagcaagaaccgatctccataattgaccagggagaacctaaggggacaggcgctacttgtgggaagaagggatctcaggcaggagccgaagggcagcctagtactgtgaagaggtatacacccgctcgcatagctcctggactgccaggatgtcagaccaaagaattgagcctgtggaagccaactggacctgccaacatataccccagatgttccgtcaacgggaaacccacctcaactcaagtacttccggtgggctggagtccatatcaccaggccagcctgctgagtatcggtataagcagtgcagggcaattaactccgagtcagggtgcgccaattcgtcccacatcggtggtctctgagtttagtggcgtgccttccctctcttcttcggaggccgttcacggactgccagagggccagccaagaccaggcggttcatttgtgccagagcaggacccagtgaccaaaaataagacatgcaggattgccgcaaagccttacgaagagcaggtgaatcccgtgctacttactctgtccccgcagacggggacactggccctgtccgtgcagccatccggcggagatatccgaatgaatcaaggacccgaagaatcggagtcacacctctgcagcgacagcacccctaaaatggaaggccctcaaggcgcttgtggactcaagctcgccggagacaccaagccaaagaatcaggtccttgcgacgtacatgtctcatgagctggtgctggccaccccacagaacctccccaagatgccggaacttcctctcctcccccacgattctcatcctaaggagttaatcctcgacgttgtgccaagctcacggagaggcagctcaacagagagaccccagctagggagtcaagttgatttgggcagggtgaagatggagaaggttgacggggacgtggtgtttaatctggcaacatgtttccgggcagacggcctcccagtcgctccccagcggggtcaggccgaagtgcgggctaaagcagggcaagctagagtcaaacaggaatctgtgggcgtgtttgcctgtaaaaataaatggcagccagacgatgtgactgaatcactgcctccaaaaaaaatgaagtgtggtaaggagaaggattcagaagaacagcaactccagccccaggccaaggccgtggttcggagtagtcataggccaaaatgtcgaaaacttccttccgacccacaggaaagcacaaaaaaatctcccagaggtgccagtgactccgggaaggagcacaatggcgtccgcggaaaacataagcacagaaagcctacgaagcccgaatcccagtccccagggaaacgggcagactcacacgaagaagggtctctcgaaaaaaaggctaagtcttcatttcgagacttcatcccggttgtgctgtctacgagaacaagaagccaaagcgacctaaaggcacggaagcaaaaaacgtcttcgtcccaaagcctcgaacacaggctgagaaatcgcaacctgttactccccaacaaggtccagggaatctccgactccccgaacggcttcttacccaacaatcttgaggagccagcttgcttagaaaactcggagaagcctagtggcaaaaggaaatgtaaaacaaagcatatggctacagtttcagaagaagctaaagacgtggtactgtattgcttacagaaagattccgaggatgtgaatcacagagacaatgccggatacacagccctgcatgaggcgtgtagtcgcggatggaccgacatcttgaacatcctgctggagcacggcgcaaacgtcaattgttccgctcaggatggtactcgcccagtgcatgacgcggtggttaacgacaatctcgaaacgatatggctactgctgtcttacggagccgaccccacactggcaacgtactccggtcaaacagcaatgaaactcgcctcctcagatacgatgaagaggttcctctccgaccacctttccgacttgcagggcagagctgaaggcgaccccggtgtctcctgggacttttattctagcagcgtgcttgaggagaaagatggattcgcctgtgatctacttcataacccgcctgggagttctgaccaggaaggggatgaccctatggaagaggatgactttatgttcgagctttcagacaaacctctcttgccatgttacaacctgcaagtgtccgttagcagaggtccctgtaattggtttttgtttagtgatgtgctcaagcgacttaagctcagctcgcgtatattccaagccaggtttcctcatttcgaaatcaccaccatgccaaaagctgaattctacaggcaggtcgccagctctcagctgctgacccccgctgaacgtcctggcggactggatgaccggtctccccctggaagcagtgagacagtcgagctggtgcgttacgagccggatctcctccgccttttaggttcagaggtagaattccagagttgcaatagctag

SEQ ID NO: 215889 - DNA, 2226 bp, Artificial Sequence
  Description of Artificial Sequence: Synthetic coding sequence
tagccactgctgcccgctcccagtggaagctccgcaccgcctcaccccgcaaagatgccctctggaactgaacagcagacagagggaaccagcgtgaccttctcacccctcaagtctccaccacagctagaacgcgagatggcatcccccccagaatgtagcgagatgcctttggacttatctagcaaaagcaaccggcaaaaattgcctctccctaaccaacggaaaacccccccaatgccagtcttgacgccagttcatacgagcagtaaagcactgctgtcgacggtcctgagccgctctcagaggaccacacaggctgctggaggcaacgtgacgtcgtgcttaggtagcaccagcagcccgttcgtgatcttccctgaaatagtgcgaaacggggaccctagcacatgggtgaaaaattccactgcattgatttccactatccccggaacatacgtcggagtggctaacccagtcccagcatccctgcttttaaacaaggatccaaaccttggtctgaatcgtgaccccaggcatctacccaagcaagaaccgatttctattattgatcagggagagccaaaaggaacaggcgctacatgcgggaagaaggggtctcaggcgggagccgaaggacagccctcaacagtaaagcgatacactcccgcacgcatcgccccaggcctcccagggtgtcaaactaaggagttgagtctgtggaaacctacaggaccggctaacatttatccgagatgctctgtgaatggtaaacctacatctactcaagtgctgcccgtgggatggagcccatatcaccaagccagtctgctaagcataggtatcagcagcgctgggcagcttaccccgtcacagggagccccaatcagaccgactagcgtggtttctgaattcagtggtgtgcctagtctgtcctccagcgaggcagtgcatgggcttcctgaaggacagccacgccctggagggagctttgtgccagaacaggatccagtcacaaaaaataaaacttgccgcatcgcagccaagccttacgaagagcaagtaaatcctgtgctgttgactcttagtcctcagacaggtactctggcgctgagcgttcagccgagcgggggtgatattcgtatgaaccaggggccagaggagtccgaaagccacctgtgcagcgattctactcccaagatggaagggccacagggggcatgtggccttaagctggcaggcgatacaaagccaaagaaccaggttctggcaacttacatgtcgcatgaactcgtacttgcaactccacagaatctgcccaagatgccggagctccctctgttgccacacgattcgcacccaaaggaacttattctggacgttgtgccgagttcccggcgaggaagctctaccgagcggccacagctgggctcccaggtggacctgggccgagtaaaaatggagaaggtggatggagatgtcgtgtttaacctggctacttgctttagagctgacggactccccgtggcgcctcaacgcggtcaggcagaagtgagggccaaggctgggcaggctagggtcaagcaagagagcgtaggggtgttcgcctgtaagaacaaatggcagcctgacgacgtgaccgagagcctgcccccaaagaaaatgaagtgtggtaaggagaaagatagcgaggagcaacagctgcagccccaggccaaggctgtcgtgaggtcaagccatcgtcccaaatgtcggaaactgccatcggacccacaggaaagtaccaaaaaatcgcctaggggcgcttcagattcaggtaaggaacacaacggagttagaggtaagcataaacacagaaagcccactaaacccgagtcccaatcaccgggtaagagagctgacagccatgaagaaggttccctagaaaaaaaagccaagagtagcttccgggactttatcccagtggtgctttccacaagaacacggagccagtccgacctaaaggccagaaaacagaaaaccagctcaagccagagcctggaacatcgattgagaaataggaacctcttattgcccaacaaggtccaaggaattagcgattccccaaacggcttcttgccaaataacctggaggagcccgcttgtctagagaactccgagaagcctagcggtaagcgcaagtgtaaaaccaagcatatggccaccgtttcagaagaggccaagtag

SEQ ID NO: 215890 - DNA, 4158 bp, Artificial Sequence
  Description of Artificial Sequence: Synthetic coding sequence
acccccgcagctatccccacctcagcacctatacccgctagcttctcgctgagcagggtctgcttccccgctgctcaggctccagccatgcagaaggtgcctttatccttccagcccggaaccgtcctcactcccagtcagcctttggtgtatattccaccaccttcctgtgggcagcccttgtccgtggcaacattgccaacaacactgggagtaagcagcaccctcacccttcctgtcctgccgagctatctgcaggacagatgtctgcccggagtgttggcttctcccgaactgcgctcttacccgtacgcctttagcgtggctcggcctttaactagcgattctaagttagtgtccctggaggtcaaccggctgccctgtacaagcccgtccggttctacgacgacacagccagcccctgacggtgtgcctggtcccctggccgatacttccctcgtgaccgccagcgccaaggttttacctacgccccaacctctgcttcctgcaccatctggatctagcgctccgcctcaccccgctaagatgccctcgggaactgaacagcagactgagggaacttccgtcaccttctcaccacttaaaagccccccacagctggagcgggaaatggccagtccaccggaatgctccgaaatgcccctggatttatccagcaaatctaatagacagaaactgcccctgcccaatcaaagaaagacccccccaatgcccgtgctgactccagtacatacatcctcgaaagcgctgctaagtacagttctgagcagaagccagcgcactacccaggcagccggaggtaacgtcacctcgtgtctgggtagcaccagtagtccgttcgtgatattccctgagatagtgcggaatggcgaccccagtacctgggtgaagaacagtacagctctgataagtaccatcccaggaacgtatgtgggagtcgcgaaccccgtacccgcatctctcctgcttaacaaggatcctaacctgggattgaaccgcgatcccaggcatttacccaagcaggagccgatttccatcatcgatcagggagaacctaagggaaccggagccacctgcggaaagaaggggagtcaggccggtgctgagggacagccttcgaccgtgaaacgctatactccagcaaggatcgcccctggattgccagggtgtcagacgaaggagctgtctctctggaaaccgactggccctgctaacatctatcctcggtgctcagtcaatggaaagcctactagtacccaggtgctcccagtggggtggagcccctaccaccaagctagcctgttgtcaatcggtatcagctctgcgggacagctgaccccatcacagggtgcacccattcgccctacctcagttgtgtcagaattctcaggtgtgccctcgttatctagttctgaagcagtgcatggactccccgaagggcagcccagacccggtggctctttcgtccctgagcaagatcccgtgacaaaaaataagacttgtaggatcgctgctaaaccctacgaggagcaagttaaccccgtgctgctgacactgagcccacagaccggcacactagccttatccgttcagccctctggaggagatataagaatgaaccagggacccgaagagagtgagtctcacctgtgttcagatagtacaccaaagatggaaggccctcagggggcttgtggacttaagcttgccggtgatacgaaacctaagaatcaggttcttgcaacctacatgagccacgagttggtgctggctacccctcagaaccttcccaagatgcctgagctcccattgctgcctcacgactcgcatcctaaagagctaatcctcgatgttgtcccctcctcccgaaggggctcatctacagaaagaccgcagctgggctcccaggtagatcttgggagagttaaaatggaaaaggtggacggcgatgtcgttttcaacttggccacatgcttccgagctgacgggctccccgtggcccctcagagagggcaggctgaggtcagagctaaagctggacaggcccgtgtgaagcaggaatcagtgggtgtctttgcctgtaaaaacaaatggcagcctgatgatgtgactgagtccttgcccccaaagaaaatgaagtgcgggaaagaaaaagattccgaagagcaacaattgcagcctcaggccaaggctgtcgttaggagtagtcacagacctaaatgcaggaagctgccctccgatcctcaggaaagcactaaaaagagtcccagaggggcaagcgattcaggcaaagaacataacggggtgcgcggaaagcacaaacacaggaaaccaactaaaccggaatcccaatctccgggtaagcgcgctgattctcatgaagagggatccctcgagaagaaagcgaagtcttcgttcagggattttattcccgtggtgctcagtactcgcacacgaagccagtctggcagcatttgctcctcttttgcaggaatggccgactccgacatgggctcacaagaagtttttccaactgaagaagaagaggaagtcacaccgacacctgcgaagcgcaggaaggtgcggaagacccagagggacacccaataccggtcacaccatgcccaggataaaagtctcctctctcaaggcaggcgtcatctgtggcgcgctagagagatgccatggcggacggaagccgctcggcaaatgtgggacactaatgaggaggaggaagaagaggaggaagagggtctgcttaaaagaaagaagcgaaggcgccagaaatcccgaaaataccaaaccggagaatatcttactgagcaggaagatgagcagaggagaaagggaagggcggatcttaaggcgagaaagcagaagaccagcagttcacagtcactggagcatcggctgcgcaaccgtaatctgttactgcctaataaagtgcaggggatcagcgattcccccaatggctttctgcccaataacttggaggagccggcttgcctggagaactctgaaaaaccgagcgggaaaagaaagtgtaaaaccaagcatatggccactgtatccgaagaagcaaaagggaaaggccgttggagccagcaaaaaacccgaagccctaaatcccctacccccgtgaagcccaccgaaccttgtacaccttccaaaagtcggagcgcctcctcagaggaggccagtgagagtccaacagctagacagatccctccagaggctcggcgtctcattgtgaacaagaatgccggtgaaactcttctgcagcgcgctgccaggcttggctacaaagatgtagtgctctattgcctgcagaaggattctgaagacgtgaatcaccgtgataacgctgggtacaccgctcttcatgaggcctgctctagaggctggaccgatatattaaatatcctgctggaacacggtgcaaatgtcaactgtagtgcgcaggatgggacgaggcccgtacacgatgccgtcgtcaatgacaacctcgaaacaatctggctacttctcagctacggtgccgatcccactttagccacgtactctgggcagacagccatgaagttggcgtctagcgatacaatgaaacggtttctcagtgatcatctcagcgatctgcagggtagggcagagggggatcctggtgtcagctgggatttctactcttcctcagtcctagaagagaaggacggctttgcctgtgatctgcttcataacccccctggctcttccgaccaggagggggacgatccgatggaggaagacgacttcatgttcgaactaagcgacaagccacttctgccgtgctacaatctgcaggtcagcgtgagtcgcggaccatgcaactggtttttattcagcgacgtccttaagagattgaaactgagctcaaggatttttcaggccaggtttcctcatttcgaaatcactactatgccaaaggcagagttctacaggcaggtggcttcctcacagctcctgacccctgctgaaagaccaggaggcttagatgatcggagccctcccggaagttcagagactgttgaactggtacggtacgagccagacctgctcagattgctgggtagtgaagtcgagttccaatcttgtaattcgtag

SEQ ID NO: 215891 - DNA, 5135 bp, Artificial Sequence
  Description of Artificial Sequence: Synthetic coding sequence
atgatttccaccgctccgctgtactccggcgtgcataactggacctcctccgatcgaatccggatgtgcggtattaacgaggaacggagagcccctctttcagatgaggaatcaaccacaggtgactgccagcacttcgggagccaggaattttgcgttagttcgtctttctccaaggtggaattgactgctgttgggagcggctctaatgccaggggcgcagaccctgatgggagtgctactgaaaaacttgggcacaagtctgaggataaaccagatgatcctcagccgaaaatggactacgccggaaacgtggcggaggctgagggctttctagtgcctctgagcagccccggagacggcctgaagctgcccgcttcagattccgcagaagcctccaatagccgggcagattgttcttggactcctttaaatacacagatgtccaagcaagtggattgctctcccgctggagtcaaggccctggactcccgccagggagtaggggagaaaaatacatttatcctggcgacactggggacaggggtcccagtggagggaacgctgcccttagtgactactaacttctcaccccttccagccccaatctgcccccctgcacctggatctgcgtctgttccccattccgtaccagacgctttccaggtgcccctttctgtgcctgcacccgtccctcactcaggcctcgttccggtacaggttgctacaagcgtaccggctccttctcctcctttggcaccagtgccagctctggctcctgcgcctccgagtgtacctacattgatcagcgatagcaatccactctctgtgtccgcaagcgtgctggttcccgttcctgcttccgctccgccatcagggcctgtcccactgtcagcgcctgcaccagcacctctttccgtcccagtgtcagcccctcctctggcgttaatccaagctcccgtacctcccagcgcaccgactctcgtcctcgcgccagtcccaacgccagtcttggcccctatgcctgcatcaactcctccggctgccccagccccacctagcgtgccaatgcctaccccaaccccaagttctggccctccatcgacacctaccttgattccagctttcgcaccaactcctgtgccagcccctacgcccgcacccatctttactcccgctcctacaccaatgcctgccgcaacgccagcagccattccgacctccgcaccaatacccgctagtttcagcctttcacgggtgtgcttccccgcagcacaggctccagccatgcagaaagtccctttatcgtttcagcccggaacagttttgacgccaagtcagccactggtgtatataccccctccttcatgcggacagccattatctgtagcaacattgcccaccaccctgggtgtatcctctaccctcaccttacctgttcttcctagttacctacaggacaggtgtctaccaggcgtcctggcatcccctgagctgaggagctacccatatgccttctcagtagcacgccctctgacatccgacagcaagctggtatccctggaagttaacagactgccgtgcacaagtccttctggaagcacaactacccagccagcgcctgacggagttccgggaccgctggcggacactagcctggtgacagccagcgccaaagtgttgcccacaccacagcctctgctgcctgcgccttctggcagcagtgcgccaccacaccccgcaaaaatgccctccgggaccgaacaacagacagaaggcacttctgtcaccttttcacccctgaagtccccgcctcagctcgagagagaaatggcttctccgccagagtgcagtgaaatgccactggacctgtcctcgaagtcaaaccgccagaagcttcctttacctaatcagcggaaaacacctccaatgccagtattaaccccagtgcacacgtctagcaaggcactgcttagtactgtacttagcaggagtcagcgtacgacgcaggcggcaggtggtaacgtcacatcatgcctgggatctacttcatcccccttcgtgatttttccggagattgtgcgcaacggggaccctagcacctgggtgaagaattccaccgctctgatctctacgatccctggcacttatgtgggcgtcgcgaaccctgtcccagcctcactgcttctgaataaggaccccaatctgggactgaacagggacccacgccacttacccaagcaggaaccaatttctatcatcgatcaaggagagccgaagggcaccggggctacctgtggaaagaaagggtcacaggccggtgccgaaggccagccctcgacagttaaacgatacactccggctcggatcgcccctggcctgcctggctgtcagacaaaagagctgtccctgtggaaaccaaccggccctgcgaatatttaccccaggtgctccgtgaatggaaaacccacatccacccaggtgctacccgtcggctggtccccatatcatcaggctagcttactatccatcggcatcagctcagctgggcagttaactccttctcagggcgctcccatcaggcccactagtgtggtgagcgagttttcaggagttcccagcctttcctcttctgaggctgtgcacgggctgccggaggggcagcctcgcccaggcggatcgttcgttccagaacaagacccggtcaccaagaacaaaacatgtcgcatcgctgccaagccttacgaggagcaagtgaatccagtgttgcttaccctcagcccccagactggaacactggctctgtccgtgcagccctctggtggggatatccggatgaaccagggaccagaggaaagtgagtcacacctgtgcagcgattctacccctaaaatggaaggccctcagggcgcttgtgggctgaaactcgcaggggacaccaagccaaaaaaccaggttctggcaacgtacatgtcacacgaactggtgctggcaacaccacagaacttgccgaaaatgcccgagctgcccttacttccccacgactcacaccctaaagaattgatcctggacgtcgtgccgtcatcgagaaggggttcctctaccgaacggccacagcttggatcacaggtcgaccttggcagggtcaaaatggaaaaagtcgatggagatgtcgttttcaacctagcaacgtgtttccgcgcagacggtctccctgtggcaccacagcgaggtcaggccgaggtgagggctaaggccggtcaggcacgtgttaagcaggagtccgtgggggtctttgcctgtaagaacaaatggcagcctgacgacgtgacagagagtctccctccaaaaaagatgaagtgcggcaaggaaaaggattccgaagagcagcagctccagccccaagccaaggctgttgtgcggtcaagtcaccgcccaaagtgcaggaaactgcccagtgacccacaggagagcaccaaaaagagcccacgaggagcatcggattcaggcaaggagcataacggcgtgagaggcaagcacaaacaccggaagccgaccaaaccagagtctcaatcccccggtaagagggcagatagccacgaggaggggagtctggagaagaaagctaagagctctttcagggactttattccagtggtgctgtccacacgaacccggtcacaaagtgggtccatctgttcctccttcgctgggatggctgattcagatatggggtctcaggaggtgttccccaccgaggaagaagaggaggtcactcctacccccgcaaagcggaggaaggtgcgaaagacccagcgagacactcagtatcgctcacaccatgctcaggataaaagcctgctcagccaggggagacgacacctgtggcgcgcacgtgagatgccatggcgtacggaagcggctcggcagatgtgggatacaaatgaggaggaagaggaggaggaggaggaaggcctgctcaaacgaaaaaagcgtcggaggcaaaagagtaggaaatatcagacaggtgaatatctcaccgagcaggaggacgaacagcgaagaaagggcagagccgacctgaaggctcgaaaacagaagacctcatcatcccagagtctggagcaccggctgcgcaacagaaacctcctgctgcctaataaggtgcaaggaatctcagattcaccgaatgggttcctccccaataacctggaggagcctgcgtgcttggaaaattctgagaaaccctccgggaaaagaaagtgtaaaaccaaacacatggcaactgttagtgaggaagccaaggatgttgttctgtactgtctccaaaaggacagtgaagatgtcaaccaccgagacaatgcaggctacacagctcttcatgaggcctgcagcagagggtggaccgatatcctgaacattctgcttgaacatggggctaacgtaaactgtagcgctcaggatggcacacgtccagtccatgatgcagtcgtgaatgataatcttgaaacaatctggcttctgttatcttatggggctgacccaactctggccacctacagcgggcagacggccatgaagctggcgagcagcgacactatgaagaggtttctctccgatcatctaagcgaccttcagggtcgtgctgagggggaccccggtgtgtcttgggatttttactcgagctcagtgttagaggaaaaagacggctttgcatgtgaccttctccataatccacctggctctagcgatcaggagggggacgatccgatggaggaggacgattttatgtttgaactttctgacaagcctttgctcccttgttataatttgcaggtgtctgtctcacgcggaccgtgtaattggttcttgttttcggacgtcctcaagcgcctgaaactcagcagtaggattttccaggctcgattcccacatttcgaaataactaccatgccgaaggccgaattttatcgccaggttgcgtcatctcagctcttgacccccgctgaacgtcccggtggtttggatgatcggagcccacctggatcgtcagagaccgtggaactggtgaggtacgaacccgatctcctccggctgctgggaagcgaggtggagttccagtcctgcaatagcta

SEQ ID NO: 215892 - DNA, 1260 bp, Artificial Sequence
  Description of Artificial Sequence: Synthetic coding sequence
atgccgctgagtgactttatcctggctctgaaggacaacccctattttggcgcagggttcggcctcgtcggggtgggtactgctctggcactggcacgtaagggagtccagctgggcctggtggcatttcgacgccactacatgattacgctggaagtgccggctagagaccgatcatatgcttggctactgtcctggctgacgcgacattccacccgaacccaacatctgtccgtggaaacttcctatttacagcacgagtctggcaggatcagcactaagtttgaattcgtgccgtcgcccggaaaccattttatatggtaccgcggaaagtggatccgggttgagcggtcccgcgagatgcagatgatcgacctccagactggaaccccttgggagagcgtcaccttcaccgccctggggaccgatcgcaaagtgtttttcaatatcctggaagaggccagagagctcgcattacaacaagaagaggggaagaccgtgatgtacaccgctgttggcagtgagtggcggccttttgggtatccgaggaggcgtcgccctctcaattctgttgtgctacagcaggggttggcagaccggatcgtgcgggacgtccaggagttcatcgacaatcccaagtggtatacggacaggggaatcccatatagaagaggatacctcctgtatggaccacctgggtgcgggaaatcgtcctttattactgcactggccggagagctggagcacagcatttgtctcctgagcctgacagactcatctctgtcagacgatagattaaatcaccttctctccgttgcacctcagcagtccctcgtgcttctcgaagatgtcgacgctgcgttcctaagtcgggatctggctgtcgagaatcctgttaaataccaaggactcgggagattgacattttctggcctcctgaatgctctcgatggagttgcatcaactgaggccaggatcgtgtttatgaccaccaaccacgtcgatcggctggacccagccttgatccggccagggagagtggatctcaaagagtacgtcgggtactgcagccattggcaactgacccaaatgttccagaggttttaccccggacaggctccaagcctggcagagaactttgcagagcacgtactgcgggcaaccaatcagatcagccctgctcaggtgcagggctattttatgttatacaaaaacgatcccgtgggcgctattcacaatgctgaaagcttgcgacggtag

SEQ ID NO: 215893 - DNA, 1260 bp, Artificial Sequence
  Description of Artificial Sequence: Synthetic coding sequence
atgccactcagtgatttcatcctggcactgaaggataacccatatttcggagcaggctttgggctcgtcggtgtcggcaccgctctcgccctagccaggaagggggtccagctgggactggtggccttccgcagacactatatgattactcttgaagtgcctgctcgcgatagatcctacgcttggctcctctcctggctcaccagacacagcactcgcactcagcatcttagcgttgagaccagctatttgcagcacgagtccggacgtatatcaacgaaattcgagttcgtcccttcaccagggaatcatttcatttggtatagaggtaaatggattcgggtcgaacgtagcagggagatgcagatgatagatttacagaccgggactccctgggaaagtgtgactttcaccgccctgggcacagatcggaaggttttttttaatatcctggaggaggcccgagaactggccctacagcaggaagagggaaaaacagtgatgtacactgcagtggggtccgagtggagaccctttggataccctcggaggagaaggcccctgaattctgtcgtattacaacaagggctggctgaccgcattgtgcgggatgtgcaggaatttatagacaaccccaagtggtacactgatcgcggaatcccctatcggaggggctacctgctctacggccctcctggctgcggcaaatcaagttttatcacagccctggctggtgaattagaacacagtatctgccttctcagcctcaccgattcctctttgtctgacgatcggctgaatcatctcctgagtgtcgcaccacagcagtccttggttctgctggaggacgttgacgcagccttcctctccagggacttagcagttgagaacccggttaagtatcagggccttggtcggctgaccttctctgggctccttaatgccctcgacggtgtagccagtacagaagctcgtatcgtcttcatgacaactaatcacgtggacaggctggaccctgctcttattagaccgggtcgtgtggatctaaaagaatacgtgggctattgctctcactggcagttgacccagatgttccagaggttttaccctggacaagcgccaagcctggcagagaatttcgccgagcatgttctccgtgcaactaatcagattagccccgcacaggttcagggttatttcatgctgtataaaaacgatcccgtgggagcgattcacaacgctgagtctctgagaaggtag

SEQ ID NO: 215894 - DNA, 1260 bp, Artificial Sequence
  Description of Artificial Sequence: Synthetic coding sequence
atgcctttatccgatttcattctggcgctgaaagataatccgtatttcggggctggattcgggttggtgggagtgggcacggcacttgccttggcccgaaagggtgtgcaactggggctggttgcattcagacgacattacatgataacactcgaagtgcctgcccgagatcgatcttatgcctggttgctgtcctggcttacccggcactccaccaggacacagcatctgtctgtggaaacctcctaccttcagcacgagagtggacgtatatctactaaattcgagttcgtccctagccctggtaaccactttatatggtaccgcggaaagtggattcgtgtcgagcgtagtagagaaatgcagatgatcgatctccagactggcacaccttgggaatccgtgacattcacggctctgggaacggaccggaaagtgttcttcaacattcttgaggaggccagggaactcgccctacagcaggaggaaggtaaaactgtgatgtataccgccgtgggaagcgagtggcggcctttcggctacccaagacggagacgaccactgaatagtgtggtattacaacagggcctagcagataggatcgtacgcgacgtgcaggagtttatcgacaatcctaaatggtataccgaccgtggaatcccgtacaggcgtggctatctgttatacggcccacccggatgtggtaaatccagcttcattaccgctctagccggagagctggaacacagtatctgcttactgtctcttaccgatagctcactgagcgacgacagactaaatcatctactatcagtcgcccctcagcagtcactggtactactggaggacgtcgatgctgcctttctgtcaagagatctggctgtcgagaatccagtgaagtatcaaggtcttggacggttgacattctcaggactcctgaacgccctggatggagtggcgtcaactgaggcccgtattgtgtttatgacaacaaatcatgtggaccgacttgacccagccttgattaggccaggcagagtggatctgaaggagtacgtaggctactgctcccattggcaactcactcaaatgtttcagcgcttttaccccggacaggctccatcacttgccgagaatttcgccgagcacgtgctccgcgcaaccaaccagatttcaccagcccaggtacagggttacttcatgctgtacaaaaacgaccccgtaggcgctatccacaacgccgaaagcctcagacgatag

SEQ ID NO: 215895 - DNA, 1260 bp, Artificial Sequence
  Description of Artificial Sequence: Synthetic coding sequence
atgccattgtctgattttattctggcactgaaagacaacccttatttcggcgctgggttcggccttgtgggagtgggaacagccctcgccctggcacgaaaaggggtccaattaggcctggttgcattccgcagacactatatgataactctggaagttccagcgagagaccgcagttatgcatggttacttagctggctcacaagacacagtactaggacacagcacctgtccgtcgagacatcttatctgcagcacgagtccggcagaatcagcaccaagttcgagtttgtcccaagccctgggaatcatttcatttggtacagaggcaagtggattcgggtggagcgcagtagagaaatgcagatgatcgatctgcagacgggtactccttgggagtctgtaacatttacagcgcttgggactgacaggaaggttttcttcaacattcttgaagaagcgagagaactggctctgcaacaggaggaagggaaaacggttatgtatacagcagtgggctctgaatggcgacccttcggatacccgaggcgcagacgccctctgaactccgtggtcctccagcagggactggctgatcgaatagtccgggatgtccaggagtttatcgacaatcccaaatggtacaccgataggggaatcccataccgacgcggatacttactctatggccctccaggctgcggaaagtcaagctttatcaccgctcttgctggcgaactggaacactctatttgcctgctgtccctgaccgattctagtctgagcgacgatcgtctcaaccacctcttgagcgtggcaccacaacagagcctcgtccttttggaggacgtcgacgccgcattcttaagcagagatctggctgttgaaaatcctgtcaagtatcaaggacttggcaggctaacattcagcgggttgctcaacgccctcgacggggtagcaagtactgaagccaggatcgtgtttatgacgactaaccacgtggaccggctggatcccgctctcattcgcccaggcagggtggatctcaaagagtacgtggggtactgcagccattggcagctgacccaaatgttccaacgcttctatcccggacaggcaccctccctcgcagaaaattttgccgaacatgtacttcgggcaaccaatcagatctcccctgcccaagtgcagggatatttcatgttgtataaaaatgaccccgtcggagcgattcacaatgcagaaagcctccgacggtag

SEQ ID NO: 215896 - DNA, 1260 bp, Artificial Sequence
  Description of Artificial Sequence: Synthetic coding sequence
atgcccctgagcgatttcatccttgccctgaaagacaatccctatttcggagccggtttcggactggtgggagtgggcaccgcccttgctctggcgaggaagggagtgcaactaggtctggtggcttttcggcgtcactacatgatcacccttgaagtgcccgctcgggatcggtcttacgcttggcttctctcctggctaacaagacattctacaaggacgcagcatttatctgtggagacctcctatctgcagcatgagagcggacggatctcaaccaaatttgagtttgtgcccagcccagggaatcatttcatctggtaccgcggaaagtggatcagggtcgagaggtctagagaaatgcagatgatagaccttcagacgggcaccccatgggagtcggtgactttcaccgcactgggcaccgaccggaaagtgttttttaacatcttggaagaagcacgcgagctcgcgcttcagcaagaggagggcaaaacagtgatgtacacggctgtaggatccgagtggaggccatttgggtatccaagacgccgaaggccactgaactccgtggttctgcagcagggcctggccgatcgaatagtacgcgatgtgcaggagttcatagataacccaaagtggtatactgatcgcggaattccttatcgacgcggttatctgttgtatggcccaccaggctgcgggaagtcttctttcattaccgccctggccggagaactggagcattccatttgtctgctgagtcttactgacagcagcttgtcagatgatcggctgaatcatctgctgtccgtggctccccaacagtcccttgtgctgcttgaagatgtggacgccgcttttctcagtagagatctcgcagtggaaaacccggtcaagtatcagggattgggaagactaacgtttagtgggttgcttaacgctctagacggggtggcctctacggaggccagaatcgtgtttatgaccacaaatcacgtggacagactcgaccccgcactgatcaggcccggacgggttgatcttaaggagtatgtcggatattgttctcattggcagcttacgcagatgttccagcggttttaccctggccaggctccttccctagccgaaaatttcgcagaacacgtattgcgtgctaccaaccagataagtcccgcacaagtgcagggatatttcatgctatataaaaacgacccggtaggagcaattcataacgctgaatctttgagaagatag

SEQ ID NO: 215897 - DNA, 333 bp, Artificial Sequence
  Description of Artificial Sequence: Synthetic coding sequence
atgccccttagcgactttattctggcactgaaggataatccttactttggagccggatttggactcgtgggcgtgggtactgccttagccctagccagaaagggtgtgcagctgggattggttgcattccggagacactatatgattacactcgaggtaccagccagagaccgcagctatgcttggctgctctcctggcttactcgccacagcaccagaacccagcatctctccgttgaaacgagctacctgcaacatgagagcggccgaataagcactaagttcgaattcgtaccctcccccggaaaccactttatttggtacaggggatag

SEQ ID NO: 215898 - DNA, 234 bp, Artificial Sequence
  Description of Artificial Sequence: Synthetic coding sequence
atgcccttgtctgacttcattctggcactgaaggataatccctattttggcgctggattcggcttagttggcgtgggaaccgccctagcactcgctcgaaagggtgttcagctggggttggtggcgttccggcgtcactatatgattacgctggaagtgccagctagagataggtcttacgcctggctactttcctggctgacacggcactcgacccggactcagcacctgtag

SEQ ID NO: 215899 - DNA, 621 bp, Artificial Sequence
  Description of Artificial Sequence: Synthetic coding sequence
atgcccctgagtgacttcattcttgcactcaaggacaacccttacttcggggcaggcttcggtctggtgggcgtcggaactgcattagccttagctcggaagggagttcagctgggactcgtggccttccggagacattatatgataaccctagaggttccagcacgggaccgcagttacgcttggctgctttcctggctgacacgccattcaactcgtactcagcatctctctgtggagacctcgtatctccaacacgagagcggcaggatttccacaaaatttgagttcgttcctagccccggaaaccattttatttggtaccgaggcaagtggattcgcgttgaaagatccagagagatgcagatgatcgatctgcaaacaggcactccgtgggaaagcgtgacattcactgcgctaggcacagaccgaaaggtattctttaacattctcgaagaggctagagaattggcgttgcagcaggaagaggggaaaactgtcatgtacacagctgtagggtcagaatggcggccattcggataccctagaaggcgcaggcctctcaacagcgtggtgctacagcagggcctggcagacagaattgtgagagatgtacagtag

SEQ ID NO: 215900 - DNA, 1260 bp, Artificial Sequence
  Description of Artificial Sequence: Synthetic coding sequence
atgcccctgtccgacttcatactagcactcaaggacaacccttatttcggagcaggattcgggttagtcggagtgggcactgcacttgcgttggcgagaaaaggagtccagttagggctggtcgcttttcgccgacattatatgattacattagaggtcccggcacgggatcggagctacgcttggctacttagttggctcacccgacactctactagaacccagcatctgtcagtcgagacctcttacctccaacacgagagcggacgcataagcacgaaatttgaatttgtcccctccccgggtaaccacttcatctggtatcggggtaaatggataagggtcgagaggtcgagggagatgcagatgatcgacctccagactggaactccttgggaaagtgtcactttcactgccttgggcaccgatagaaaagtgttctttaacattttagaagaagcaagagagctcgcccttcagcaagaagaggggaagacggtgatgtacacagcagtgggcagcgagtggaggccctttggctatcccagaagaagacgccctttaaattcagtggtcctgcagcaaggtctggccgaccgtatagtcagagatgtgcaagagttcatcgacaaccccaagtggtacaccgatagaggaataccgtatcgccgaggatatctgctttacggtcccccagggtgcggaaagagctcatttatcaccgctctggcgggtgagttagagcattccatttgtctgttgtcactaacagattcatccctgtccgatgacaggttgaaccatcttctgtccgtggcaccgcagcagagcttggtgctcctcgaagatgtggatgcagccttcttgtcacgtgacctggctgtcgaaaaccctgtgaagtaccagggtttggggagactcacatttagcggcctcctgaatgccctggatggtgtcgcctcaacggaagctagaattgtgtttatgactacgaaccatgtggacaggctggatcctgccctcataagacctggccgtgtggatctgaaagagtacgtgggctactgcagccactggcagctgacccaaatgttccaacggttctatcctggccaggcccctagccttgccgagaacttcgctgagcatgttcttagagcaactaaccaaatctcgcccgctcaggtccagggatatttcatgctctacaaaaacgacccggtgggagccatacacaacgcagaaagcttgaggcggtag

SEQ ID NO: 215901 - DNA, 1260 bp, Artificial Sequence
  Description of Artificial Sequence: Synthetic coding sequence
atgcctctgtctgactttatacttgcactgaaggacaatccttacttcggggcaggctttggcctcgtcggagtgggcaccgctttggccctggcgcgaaaaggtgtgcagctgggattggttgcattccggagacactacatgatcacactggaggtgccagccagggataggtcttatgcctggctgcttagttggttgacccgccactccactaggactcagcatcttagtgtggaaacgagctacctgcagcacgagtctggaaggatctctaccaagtttgaatttgtaccttcaccaggcaaccattttatatggtacagggggaagtggattcgggtagaaaggtcaagagagatgcagatgatcgatctgcaaacgggaacgccgtgggaatcagttaccttcaccgctctcggcacagataggaaagttttcttcaatatccttgaggaagcacgcgagctagcattacaacaggaagagggcaaaaccgtgatgtatacagccgtcggatccgagtggcggcctttcggatatcccagacggcgacggcctctgaattctgttgtactccagcaaggccttgccgaccggatcgtacgggacgtgcaggagttcatagataacccaaagtggtacacggatagaggaattccctacagacgcggatatttgctatacggccctccgggttgcgggaaaagtagtttcatcactgccctcgctggagagctggagcactctatttgcctgttgagcctcaccgatagctccctcagcgacgacagacttaatcatctgctgtcagtcgctccccagcagtctcttgttctgctggaggatgtagatgctgcgtttctgtcacgtgacctggcagtcgagaatccggttaagtatcagggacttggcaggctgacattctcgggacttcttaacgctctggacggggtagcatcaactgaggctaggatcgtatttatgaccaccaaccacgtcgacagactggatcctgcgctgatcaggccaggtcgagtggatctgaaggaatacgtgggctattgttcacactggcagcttactcaaatgttccagcggttttacccaggacaagctccgtccctcgccgagaactttgccgagcatgtgttgcgagccaccaaccagataagtcccgctcaagtccaaggatatttcatgctgtataaaaatgaccccgttggcgctatccacaatgctgagtcattacggcgttag

SEQ ID NO: 215902 - DNA, 621 bp, Artificial Sequence
  Description of Artificial Sequence: Synthetic coding sequence
atgccgctatctgactttatactcgccttgaaggataatccatattttggggctggattcgggctggtcggggtaggaactgctctcgctctcgcgagaaaaggggtccaactgggactggttgctttccggagacactacatgatcacgttggaagtacccgctcgcgaccgttcgtacgcatggcttttaagctggttgacgagacatagtaccaggacccagcatttgagcgtcgagacatcctatctgcagcacgagagcggacggattagtactaagttcgagttcgtcccatcgcccggaaaccatttcatctggtacagaggtaaatggattagggtcgaaaggagcagagaaatgcagatgatcgacttacaaacaggtaccccatgggaaagcgtgacctttacagctctgggaactgatcgcaaagtgtttttcaacatcctggaagaagcccgtgaattggccctgcagcaggaagaagggaagaccgttatgtacacagccgtcggatccgagtggagaccctttgggtacccacgtcggcgaagacctcttaattctgttgtactacaacagggtctggccgatcggatcgtccgggacgtgcagtag

SEQ ID NO: 215903 - DNA, 1623 bp, Artificial Sequence
  Description of Artificial Sequence: Synthetic coding sequence
atgtatgaaaacgagtgtgaatgtcagttgttactgaaagaaatgctcgagcgccttaataaggaggccgacgaggcgctcctgcacaaccttcgacttcagttggaagcgcagttcttacaggatgacataagcgcagcaaaagatcggcacaaaaagaatctcttagaggtccaaacgtatattagcatcctccagcagattatacataccacaccccctgcatctatcgttacttccgggatgcgcgaagagaaattactaaccgaacgcgaagtggcggctctacgtagccagctggaagagggcagggaggttttatcccacctgcaagcgcagagggtggaactgcaggcgcagacaacgactctggagcaggctattaagagtgctcatgagtgttatgacgatgagattcagctctataatgagcagattgaaacgcttcgaaaggaaattgaggagacagagcgcgtcctggaaaaatcttcatacgactgccgccagttagctgtggcgcaacaaaccctgaagaacgaacttgatcgttaccacagaatcattgagatcgaggggaatcggctgacaagcgcttttatcgaaacacctattccactgtttactcaaagccacggcgtgtccttgtcaacgggctctggaggtaaggatctcacgcgcgctcttcaggacatcacggccgctaagcccaggcagaaagcactccctaaaaatgtgcccaggaggaaagagatcataaccaaagataaaaccaatggcgctctcgaggatgctcctctaaagggactagaggacaccaagttggtgcaggttgtgctgaaggaggagagtgagtccaagttcgagtcagagtccaaagaggtctcaccactcacgcaggaaggcgctcccgaggatgtgcccgatggcggtcagatcagcaagggtttcgggaagctgtatcggaaggtgaaagagaaagttcggtccccaaaggagccggaaacccctaccgaactttacaccaaagagcgccatgttttggtgacaggggatgcaaactatgtggaccctaggttctacgtttcttccattacggccaaggggggagtggctgtgagcgtggccgaagatagtgtgctctacgatgggcaggtggagcctagcccagagtccccaaaaccccctctcgagaacggccaggtgggccttcaagaaaaggaggatggccagcctattgaccagcagccaattgacaaggaaatagagccagacggtgccgaacttgagggtcccgaggaaaaacgagagggtgaggaacgagacgaagagtcccgtcgcccatgcgctatggtcacccctggcgcagaggaacccagcattccggagcctcccaaaccagccgcagaccaggacggcgcagaagtcctcggcactcgctcccggagcttgcccgagaaagggccaccgaaggcactcgcatacaaaacggttgaggtggttgagtctatagaaaaaatcagtactgagtctattcaaacatatgaagagaccgccgtgattgtcgaaacaatgattggaaagaccaaatctgacaagaagaaatccggagagaaatcatcctag

SEQ ID NO: 215904 - DNA, 1998 bp, Artificial Sequence
  Description of Artificial Sequence: Synthetic coding sequence
atgtaccgcaggagctatgtgttccagactaggaaagagcagtatgaacacgccgacgaggcctcaagggccgcagagcctgagaggccggctgacgagggttgggccggagcaacctctcttgccgctttgcagggattaggagagagggttgcggctcatgtgcagcgggctcgcgctttggaacaaaggcatgccggactgcgaaggcagctcgatgcatttcagcgactaggcgagctggccggacctgaggatgccctggccagacaggtcgagtccaatagacagcgagtgcgagatctggaagccgagcgtgccaggttggagcgtcagggcaccgaagctcaaagagccctggacgaatttaggtccaagtatgaaaatgagtgcgagtgtcagctgctcctgaaggagatgctagaaaggcttaacaaagaagccgacgaggccctgcttcacaaccttagactgcagctcgaagctcaatttttgcaggatgatatatccgcggcaaaagatcggcacaagaaaaacctgctcgaggttcagacgtacatttcaatcctccagcagataatccatacaactccccctgccagtattgtcacttcagggatgcgagaagagaaacttctcaccgaacgcgaagtggccgcactgaggagccaactggaggagggcagggaggtgttatcccatctgcaagcacagcgcgttgagctgcaagcccagaccacgaccttggaacaggccataaaaagtgcccacgagtgctatgacgatgagatccagttgtacaatgagcagatagagacacttcggaaagagatagaagagaccgagcgagtgcttgagaagtcgtcatacgactgccgtcagctcgcggtcgcccaacagactctgaagaatgagctggacaggtaccacaggataatcgaaatagagggcaatcggctgaccagcgcttttatagagactcccatccctttgtttacccagtcacacggagtctcactgagcacagggtcgggcggaaaagacttgacccgggctttgcaagacatcactgccgcaaaaccccgacagaaggctctaccaaagaacgtcccaaggcggaaagagatcattaccaaggacaaaaccaacggagctctggaggacgctccactgaagggcctggaggataccaagcttgtgcaggtggtgctgaaagaagaatctgagagcaagttcgaatctgagtctaaggaagtttcccctctgacccaggaaggggcacctgaggacgtgcccgacggcggacagatttcgaagggttttggcaagttgtaccggaaagtcaaagagaaggtgagaagtcccaaggaaccggaaacccctacagaactctacacaaaggagagacacgtcctcgtgaccggcgacgccaattacgttgacccacggttctatgtctcctctattacagccaagggaggagtagcagtgagcgtggctgaggattctgttctgtatgacggtcaggtggagcccagtccagaatcccctaagcctcccctcgaaaacgggcaggtaggattacaagagaaagaagacgggcaacccattgatcagcagcccatcgataaagagatcgaacctgacggagctgaactggaaggccctgaagaaaaaagggagggagaagagagagacgaggagtcccgtagaccctgtgcaatggtaacacccggagccgaggagccctcaattccagagcctcccaagcctgcagcagaccaagacggtgctgaggtgctgggaactagaagtaggtcgctgcccgaaaaaggaccacctaaagctctggcgtacaagactgtggaagtggtggagtctatcgaaaagattagcactgagtccattcagacctatgaggaaaccgcggttattgttgaaacaatgattggtaaaacaaaatccgacaaaaagaagtcgggcgaaaaaagcagttag

SEQ ID NO: 215905 - DNA, 1581 bp, Artificial Sequence
  Description of Artificial Sequence: Synthetic coding sequence
atgctcgagcgcctaaataaggaggctgacgaagctctactgcacaacctgaggctgcagctagaggcccagttccttcaggatgatatctctgcagccaaagacaggcacaaaaagaacctgttagaggttcagacgtacatttcaatactacagcagatcatccatacaacccctccggcttctatcgtgactagtggcatgcgagaggagaagctgttgactgagcgggaagtcgctgccctgagatcacaattagaggagggcagggaggtcttgtcccatttgcaggctcagcgtgtggaactgcaggcacagacgactactctggagcaggcgattaaatccgcccacgagtgctatgatgatgagatccagctgtacaacgaacaaatcgagacgttgaggaaggagatcgaagagacagagcgggtgctggagaaaagctcttacgactgccgtcagctcgccgttgctcagcagaccctgaaaaacgagctagacagatatcatagaatcattgagattgaagggaaccggttgactagtgccttcattgaaactccaatccccctatttacacagtctcacggcgtatctctatctactggatcagggggaaaagacctgaccagagctctgcaggatatcactgctgcaaagcccaggcagaaggcccttcccaagaatgttcctaggagaaaggaaatcatcaccaaagacaaaactaatggcgctctggaagacgcccctctgaaggggcttgaggataccaaattagtgcaggtcgttctaaaggaagaaagcgagagcaaatttgaaagtgagtcaaaggaggtgtccccactcacccaggagggtgcccctgaggatgtgcctgacgggggtcagataagcaaggggttcggaaaactgtaccgcaaggtaaaagagaaggtgcgctcccccaaggagcctgagacccctacagaactatatacaaaggaaagacatgtattggtcacaggcgacgctaattatgtcgaccctcgtttctatgtttcttctatcactgccaagggcggtgtcgccgtctccgtcgccgaggacagtgttctttatgacggacaggtggagccttcccccgaaagtcccaagccaccactggagaatggacaagttggtctccaagagaaggaggacggccagcccattgaccaacagcctattgacaaggaaatcgagccagacggggcagagctggagggccctgaggaaaaaagggagggtgaagagcgtgatgaagaaagtcggaggccgtgtgctatggtgaccccaggagccgaggaacctagcatcccagagcctcccaaacccgcagccgaccaggacggggctgaagtgctggggacaagatcccgaagccttcccgaaaagggccctcctaaagcgctggcttacaagacagtagaagtcgtggaatccatagagaagatttccaccgagtcaattcagacttacgaggaaacagccgtaatagtcgagactatgattggcaagactaagtcagataaaaagaagagtggtgagaagtcctcctag

SEQ ID NO: 215906 - DNA, 1581 bp, Artificial Sequence
  Description of Artificial Sequence: Synthetic coding sequence
atgctagaaagactgaataaagaagccgatgaagccttgttgcacaatttgcggttacagctggaagcgcagttcctgcaagatgacatttctgcagccaaagaccgccacaagaagaatctgctggaggttcagacttatatctctatattacaacagatcatccacaccaccccccctgccagtatcgtgacctccggaatgcgagaggagaagctcttgacggagcgtgaagtggctgccctccggtcccagcttgaagagggacgagaagtgctgtcacacctgcaagcacagcgggttgagctgcaagcgcagacaacgacactcgagcaggccataaaatccgcacacgagtgttatgacgacgagatccagctgtacaatgaacaaattgagacactcagaaaagaaattgaggagaccgaaagagtccttgagaaaagctcgtacgactgcaggcaattggctgtggcacagcaaaccttaaaaaatgagcttgatcgataccacagaatcatagaaatcgagggaaatcgtctgaccagcgcattcatagaaaccccgatccccctgttcacccagtcccatggagtgagtctgtctacaggtagtggcggaaaggacctcacccgagcgctgcaggacatcacggctgctaagccacgccaaaaggcactgcccaagaatgtgcccagacgcaaagagatcatcaccaaggacaagacaaatggcgctctcgaagacgcccctctcaagggtctcgaagataccaaattagttcaagtcgtgcttaaagaagagagcgagagtaaatttgaatccgagtccaaagaagtgagccccttgacacaagagggagcgccagaggatgtccctgatggcggacaaataagtaagggattcggcaagctctaccggaaggtgaaggaaaaagtgcggagccccaaggaacctgagacacctactgaactatacacaaaagagcggcacgtgctggtgactggggatgctaactatgtcgaccccagattctatgtgtccagcatcactgccaagggaggggtagccgtatctgtggcagaagacagcgtcctctatgatggacaggtggagcccagccctgagagcccaaagccccctctggagaacgggcaagtcggactccaagagaaggaagatgggcagccaattgaccagcagcctatcgataaggagattgagcccgatggagcggagctcgaaggacctgaggaaaagagggaaggagaagagcgggatgaggagtcccgacgaccatgtgcaatggtgacgcccggagccgaagaaccctccatacccgaaccgccaaagcccgctgcagaccaagacggggcagaagtgctaggaacgcgtagccggtccttaccagaaaagggacccccaaaagctctggcctacaaaacagtggaggtcgtagagagcatcgaaaagatctccacagagtccattcagacctacgaagagaccgccgtaatcgtcgagacaatgataggaaagactaagtctgacaaaaagaagagtggtgagaagagtagctag

SEQ ID NO: 215907 - DNA, 1248 bp, Artificial Sequence
  Description of Artificial Sequence: Synthetic coding sequence
atgtctgagagacgcgttgttgtcgacctgcctactagtgcatctagttccatgccgttacagcgcagacgggcaagttttcgtggcccacgctcctccagttcactcgaatccccacccgcatctcgaacaaatgctatgtccggattggttcgcgctccaggtgtgtacgtgggaactgccccttctggctgcattggcggattgggagcacgggttactcggagggccctcggaattagctcagttttcctgcagggcctcagaagctctgggctggcaacggtgcctgcacccggtctggagcgagaccatggggcagtggaagatctcggtgggtgtctggtggaatacatggccaaggtccacgcgctagagcaggtctcacaggaactggagactcagttgcgcatgcatctggagagtaaagccacaagaagcggtaactggggagccctgcgagcgtcctgggccagctcttgccagcaagtgggggaagcagtgctggagaatgcccgtctgatgttacagactgagactatccaagcaggggctgatgactttaaagagcgctacgaaaatgagcagcctttcaggaaggcagcagaggaagaaatcaatagcctgtacaaggtcatcgacgaagcgaaccttacaaagatggatctggagtctcagattgagagtctgaaagaagagcttggcagcctaagccggaactacgaagaagacgttaagttgctccacaaacagctagcgggttgcgagcttgagcagatggatgcaccaattgggaccggactggatgatatcctagaaactatacgtatccagtgggaaagggacgtggagaagaaccgggttgaggcaggtgctctactgcaggctaagcagcaagccgaagtcgcccacatgtcccagacccaggaggagaagctcgcagccgcactccgtgtggagctccacaataccagctgtcaagtacagagtctgcaggcggagacggagtccctgcgagcactaaaacgaggtctggagaacactctgcacgatgcaaaacactggcacgatatggagttgcagaaccttggggcagtggtgggtaggctcgaagcggagctgcgagagatcagagctgaagccgagcagcagcaacaggagagagcacacctcctcgctagaaagtgccagctgcagaaggacgtcgccagctaccacgccctgctcgaccgggaggagtcaggatag

SEQ ID NO: 215908 - DNA, 1353 bp, Artificial Sequence
  Description of Artificial Sequence: Synthetic coding sequence
atggaaggttcaaaaacttctaacaactcaacaatgcaggtgtctttcgtatgtcaacggtgttcacagcctttgaaactcgacacgtcttttaagattttggatcgggtgaccattcaggaactaacagcaccactgctaaccaccgcgcaggcaaaaccaggcgagacacaggaggaggaaacaaattcaggcgaggagcctttcattgagactcccaggcaagacggcgtgagccggaggtttattccacctgccagaatgatgtctactgaatccgctaatagctttacactcattggcgaggcatctgacggaggcacgatggagaatctttccagaagactaaaagtgaccggggatctgttcgacatcatgtccggccagacggatgttgatcacccgctgtgcgaggagtgcactgatactctcttagatcaactggacacccaattaaatgtgaccgaaaacgagtgtcagaactacaagaggtgtctggagattttggaacaaatgaatgaagatgacagcgagcagctccaaatggaactgaaagaattggccctggaggaagagcggttaatccaggagcttgaagatgtggaaaagaatcgaaagatcgtcgccgagaatctggagaaggtccaggccgaagccgaacggcttgatcaggaggaggcccagtaccagcgggagtactctgaatttaaacgccagcagttggagttagacgatgagctgaagtccgtcgaaaaccagatgcgatatgcacagacccagctcgacaagctgaaaaagacaaacgtgttcaatgcaacttttcacatttggcactctggccagtttggcacaatcaacaacttccgcctgggtaggcttcccagtgtgcctgttgaatggaatgaaatcaatgcagcttgggggcaaacagtgctgctgcttcacgcccttgcaaataagatgggactcaagttccagaggtacaggctagtaccctatgggaaccattcatacctggagagcttaactgataagtccaaagaactcccgctgtactgcagcgggggactgaggttcttctgggacaataaattcgatcacgcgatggtggcgttcttagactgcgtacaacagttcaaggaagaggtggagaagggagagacccgcttttgtctaccataccgcatggatgtcgagaagggaaagatcgaggatacgggcggatccgggggatcatactccatcaaaacccagttcaattccgaagaacagtggaccaaagccctaaagtttatgcttaccaacctcaaatggggacttgcatgggtttccagccagttttacaataagtag

SEQ ID NO: 215909 - DNA, 840 bp, Artificial Sequence
  Description of Artificial Sequence: Synthetic coding sequence
atggaaggctctaaaacatctaacaattctactatgcaggtctctttcgtatgtcaacggtgtagccaacccctcaagctggacacatcttttaagatactggaccgggtgacgatccaagagctcacagccccattgctgacaaccgcacaggccaagcctggcgagacgcaggaagaggagaccaacagcggggaagagccattcattgaaacccctcgccaggacggcgtgtcacggcgattcattccgccagcacggagatgtctggagatactagaacagatgaatgaagacgattcagaacagcttcagatggagctcaaggaactagccctggaagaggagaggttaatccaggagctggaggacgtcgagaaaaaccggaagatcgttgcagagaatctggagaaggtacaggccgaagctgagagattagaccaggaggaggcccagtaccagcgcgagtatagtgaatttaaacgacaacagctggagttagatgatgagctgaaaagcgtggagaatcagatgaggtatgctcagactcagctggataaactgaagaaaacaaacgtgtttaacgccacttttcacatttggcacagcggccagttcgggactatcaacaactttcgattaggtaggctccctagcgtgcccgtcgaatggaacgagattaatgcagcttggggacaaacagtcctcttgctccatgctctggccaataagatgggactcaaatttcagagatataggctagtgccttacggtaatcattcttaccttgagtccctgactgataaaagtaaagacggctgcggtgaacggcaggactag

SEQ ID NO: 215910 - DNA, 1092 bp, Artificial Sequence
  Description of Artificial Sequence: Synthetic coding sequence
atgatgtccacagagagcgcaaattcattcacactgataggcgaggcaagcgacggcggaaccatggagaatttgtccagacgcctgaaagtgaccggcgacctctttgatatcatgagcggtcagaccgacgtggaccaccctctatgtgaggagtgtacggataccctcctggatcagttagacacccagctgaatgtgacggagaacgagtgccagaactataagcggtgcctggaaattctggagcaaatgaacgaggatgatagcgagcagctgcagatggaattaaaagagctcgctctggaggaggaacgcttaatccaagagcttgaagacgtcgaaaaaaacagaaagattgttgctgagaacttggagaaggtgcaggccgaggctgagagactcgaccaggaggaagctcagtaccagcgggagtacagtgagtttaaacggcaacaacttgagttggatgacgagttaaaatctgtcgagaatcagatgcggtacgcccagacacagttagataaactcaaaaaaacgaatgtgtttaatgccactttccacatctggcactctggacagtttggcactatcaataatttccgccttggcaggttacctagtgttccggttgagtggaacgaaattaatgcagcttggggccagacagtgctcctcctgcacgccctggcgaataagatgggcttaaaatttcagcggtataggctcgtaccctatgggaaccactcatatttggagtccctcacagataaaagcaaggagcttcctctttactgttccggcggtctgcggttcttttgggacaacaagtttgaccacgccatggtggcttttttagattgcgtgcagcagtttaaagaggaagtggaaaagggggaaacacggttttgtctgccgtataggatggacgttgaaaaaggcaagatagaggatacggggggtagtggagggtcctactccatcaagacgcagttcaattctgaggaacagtggactaaggccttgaagttcatgctgaccaacctgaagtggggtctggcatgggtgtcgtcgcagttctacaataagtag

SEQ ID NO: 215911 - DNA, 5393 bp, Artificial Sequence
  Description of Artificial Sequence: Synthetic coding sequence
atggaacagctaacaactctgccacggccaggggatccaggcgcaatggaaccgtgggcactgcctacatggcatagctggacccctgggcgaggcggagagcctagctcagcggctccctccatcgctgacacacctcccgcagcactgcaactgcaggaactgcgatctgaggagtcttctaaaccaaagggtgatggatccagcagacccgtgggcggtactgacccagagggcgcagaggcttgtctccccagcttaggacagcaagccagcagcagtggaccagcatgccagcggcctgaagatgaagaggtggaggctttcctaaaagctaagctaaacatgtcctttggagacaggcccaacctcgagctgttgcgtgctctgggtgagctgcggcaaagatgcgctattctgaaggaagaaaaccagatgctgagaaaaagctctttcccagagacagaggagaaggtgcggaggctgaaacgcaagaacgccgagctggccgtgatcgctaagaggctggaggaacgggctcggaaacttcaggagacaaacctacgcgtggaaggcccacaatggctgcacgtaagagactttgaccggctcctccgggagtctcagagggaggtgctccggcttcagcgtcaaatcgctttacgcaaccagcgcgaaactttacctctaccaccatcctggccaccgggacccgcactgcaggctcgggcaggtgctccagccccaggcgcacctggcgaggcgactccccaggaagatgctgataatcttccggtgattctaggcgaaccggaaaaagagcagcgggtccaacaactcgaatccgagctgagtaagaagcgcaaaaagtgtgaaagtcttgagcaggaagccagaaaaaaacaacggagatgcgaagaactagaactgcagttgcggcaggcacagaatgaaaacgcccgactcgttgaggagaattccagactgtccggacgtgccactgaaaaggaacaggttgagtgggagaatgccgagctccggggacaactgctaggggtaacgcaggagagagattccgctctacgcaaatcccagggcctgcaatcaaagctggagagcttagagcaggtcctgaagcacatgcgagaggtcgctcagcgcagacagcaactggaagtggagcacgagcaagcaagactgagcctgcgcgagaagcaagaagaagttagaagattgcaacaggctcaggcagaagcccagagagaacacgagggcgctgttcagttgttggagtccacattggacagcatgcaggcacgagtacgtgaacttgaagaacaatgtaggagtcagacagaacagttctccttactggcccaggaattacaggcttttcggctgcatccgggaccccttgacctgttgacctctgccctggactgcggtagtctcggggattgtcctccccctccctgctgttgttccattccacagccttgcagaggttctggccctaaggatctagatcttccgcctggatcccccggacgctgtaccccaaagtctagtgagccagcacctgccactttgacaggcgtgcctaggcggacagcaaaaaaagccgaaagtctatccaactctagccattctgaatctattcataactcacctaagtcatgtcctacccctgaggttgataccgctagcgaagtcgaagagctggaggccgactcggtgtccttgctccccgctgccccagaaggttcacgcggtggcgctagaatccaggtgtttttagcccgatatagctataatccgttcgagggcccaaatgagaaccccgaagcagaactaccgttgacagccggagagtacatttatatctatggcaacatggacgaggatggattctttgaaggtgagctcatggacggccgacgtgggctggtcccttcaaattttgttgagcgcgtgtccgacgacgacctgctcacctcacttccacctgagttggcggatctttcccatagttcaggacccgagctgagcttcctgagcgtcggaggcggagggtcctcgagcggcggtcagtcttcagtaggacgatcccagccacgtcccgaggaagaggacgcgggtgatgagctgagtttatcaccgagtccagagggcctcggcgaacccccagccgtgccgtatcctcgcaggctcgtggtgctaaagcagcttgctcactcagtggttctggcatgggagccacccccagagcaggtcgaacttcatggattccatatatgtgtcaatggcgagttaaggcaggcactggggcctggggctccacctaaggccgtgctggagaacctggatttgtgggccggtcctcttcacatctccgttcaggccttgacttcgcgaggatcttcagaccctctccggtgctgtctggccgttggtgcacgcgctggggtggtgccgtcacagttgcgtgttcatcgactgacggcaacaagtgctgagatcacttgggtgcctggaaacagcaacctggcgcatgccatttacctcaacggcgaggaatgcccacctgcgtccccttctacctactgggccactttttgtcaccttaggcccggtaccccatatcaggcccaggttgaggcccagttgcctcctcaggggccttgggaacctggttgggagcggttggagcagcgggctgctactttgcaattcactacactcccagcagggccacccgacgctccgctcgacgtgcagatagagcccggacccagccctggaatcctgatcatctcctggctccccgtaactatcgatgcagccggaacctcaaacggcgtacgggtgaccggatatgcaatttacgcagacggtcaaaagataatggaggttgctagccccaccgctggctccgtgctggtggagctctcacagctgcaactgctgcaggtgtgccgggaagttgtggtgaggactatgtctccacatggggagtcagccgattccatcccagcccctattacccctgccctggcacctgcttcgctgcctgcccgtgtatcttgcccgagtcctcacccaagtcccgaggcgagggccccactcgccagcgcttccccaggtcccggagatcctagcagccctctacaacatcccgctcccctggggacgcaggagccgcctggagctccacccgctagtccctctcgtgagatggccaaagggtcacatgaagatccacctgcaccctgttctcaggaggaggccggagccgcagtgttggggacctcagaagaaaggaccgcctctacctccacccttggcgagaaggatcccggaccggcagccccttcactagcaaagcaggaggcagagtggactgccggagaggcctgtcctgcctcatcttcgactcaaggggctagggctcagcaggcacctaacaccgagatgtgtcagggcggagatccaggctctggtctgagacctcgcgcagagaaagaagacaccgcagagctcggtgtccacctggtgaatagtctcgtcgatcatggtaggaactctgacctgtcagatattcaggaggaggaagaagaagaagaggaggaggaggaggaggagttaggatcgcgtacctgcagcttccagaagcaagtggcagggaactctatacgtgagaatggagccaaaagccagcctgatccattttgtgagacagatagcgacgaggagatcctggagcagatactcgagctccctctgcagcaattctgctctaaaaaactgttttccattccagaagaagaggaagaggaagaggaagacgaggaggaagagaaatctggcgcaggttgtagcagtagggatccaggtccacctgagcccgcactactgggactgggatgcgacagcggccagcctcggaggcctggccagtgtcctttatcacccgagagctcgcgggcaggcgattgtttggaagacatgcctggcttagtgggaggatcttctagaagacggggtggaggcagtccagagaaacctccatcacgcagaaggccccctgacccgagggaacactgtagtcggttgctatctaataatggcccacaagcttcaggtcgactgggccctacgagggagcggggaggcctccccgtgatcgaagggccacggactggtttggaggctagcggccgtgggcgtttgggtcctagccgacgatgttctcgcggacgggctcttgagccgggtctcgcctcgtgtctgagtcctaaatgtctggaaatcagtatcgagtatgacagtgaagacgagcaggaggctggatctggaggtattagtattacctcttcatgctaccctggtgacggcgaggcctggggaaccgcgacagtgggacgccctcggggaccgccaaaagcgaacagtggaccgaagccctacccccgactgccggcatgggagaagggagaaccagagaggagagggcgtagtgccacaggacgagctaaggaacctctgagccgtgcgaccgaaaccggcgaagctcggggacaggatgggtcaggaaggcggggaccacagaagaggggagtgagagtcctgcggccttcgactgctgagctggtgccagcgcgatccccctctgaaactctggcataccagcacctcccagtgcgtattttcgttgccctctttgactacgatccagtgagcatgtctcccaacccagacgcaggcgaggaggagcttccatttagggaagggcagatactgaaagtgttcggggacaaggacgctgatggattctatcaaggagaaggcggaggccgaaccggatatattccatgcaatatggttgctgaggtcgccgtggactctccggctggtcgtcagcagttgcttcagcggggttatctcagcccagacattctgctcgagggtagcggaaacggcccatttgtttacagtaccgcccacactaccgggcctccgcctaagccaaggaggtctaaaaaagccgagtccgaaggccctgctcagccttgtcccggtcctccaaagttggtgccctctgccgatctgaaggcaccacattcgatggtggccgcttttgactacaacccgcaagagtctagccctaacatggacgtggaagcggaattgccctttcgggctggcgatgtcataaccgtttttggcggaatggacgacgatggtttttactacggggagctgaatggtcagcgtggccttgtacccagcaatttcctggaaggcccagggcctgaggctggcggactggatcgggagcctagaactcctcaggctgaatcccagaggacacggaggcggagggtgcaatgtta

SEQ ID NO: 215912 - DNA, 5573 bp, Artificial Sequence
  Description of Artificial Sequence: Synthetic coding sequence
atggagcagctgacaaccctgcctcgaccaggcgaccctggagccatggaaccttgggctctgcccacttggcacagttggacacctggcaggggaggcgagcctagttccgctgcgccatcgatcgctgatacaccacccgctgccttgcaacttcaggagctgagatccgaagaaagcagtaagcccaagggggatggctctagccggcctgtcggtggcaccgatcccgaaggagccgaagcgtgcttgcctagtttgggacagcaagctagtagctccggccctgcctgccagcgcccagaagatgaagaggtggaagctttcctgaaagcaaagctgaacatgtcgttcggcgacaggcccaacctcgagctgcttcgtgcccttggggagctgcgtcaacgttgtgccatcctgaaagaagagaatcagatgctcagaaaatcatcctttcccgagaccgaagaaaaagtgaggcggctgaaaaggaagaacgcagagctggcggtcatagcaaaaagactggaggagagagctcgtaagttgcaggaaacaaacctgcgtgtggtctcagcccctctgcccaggcccggtacatctctggaactttgtcgtaaggcactcgctaggcagcgggcacgcgacttaagcgagactgcttccgctctgctagcgaaagacaaacagattgctgcactgcagcgcgaatgcagggagcttcaggctcgactcacactggttggaaaggaaggccctcagtggctgcatgtccgcgattttgatagactcctacgggaaagtcagcgggaggttttacgactgcagcgccagatcgcgctgcggaatcagagagaaaccctccccctgccaccatcttggccgcctgggcctgcactccaggcaagagctggagcccctgctccaggggcacctggtgaggctacaccccaggaagacgcagacaacttaccagtaattctgggcgagcccgaaaaggagcagcgcgtgcagcaactggagtcggaactgagcaaaaaacggaaaaaatgtgaatcattggagcaggaggctagaaagaagcaaaggcgttgcgaagagctggagctgcagcttagacaggctcaaaacgagaatgccaggctagtcgaggaaaattccaggctaagtgggcgagctaccgagaaggagcaggtcgaatgggaaaacgccgaactgcggggtcagcttctcggcgtgactcaggagagggactccgctctccgcaagagccaaggcctacaatcaaaactcgaaagcttggagcaggtgttaaaacacatgagagaggttgcacaaaggcggcagcaacttgaggtcgaacatgagcaggccagactgtctctgcgagaaaaacaggaagaagtacggcgtctgcagcaggcgcaagccgaggctcagagagagcacgaaggcgctgtgcagctgctggagagcactctcgatagcatgcaggctcgtgtaagggagctggaagaacaatgccgaagccaaactgagcagttttctctgctcgcccaagagttacaggcgtttaggctgcatccaggtcctcttgatctgctgacctccgccctggattgcggttcgttaggggactgcccacctccaccttgctgctgctcaatccctcagccctgtagaggatcaggtcccaaggatctggacctaccacctggaagtccaggtaggtgcacccccaagagcagcgagcccgctccagccacactgactggagttcctaggcgcacagccaaaaaggcagaatccctgagtaatagcagtcattctgagtccatccacaattcaccaaagagctgccctactcccgaggtcgacaccgcctcagaagtcgaggaactggaggccgactccgtaagtttgctaccagccgctcctgaaggcagtcgtggtggagcccgaattcaggtgtttctggccaggtactcctataaccctttcgagggaccgaatgagaaccccgaagctgagttgccgcttacagcaggagaatacatatacatttatgggaacatggacgaggacggcttctttgaaggcgagcttatggatggaagacgcggtctcgttccctctaatttcgtggaacgcgtgagcgatgacgacttgctcaccagtttgccaccagaactagcagacctctctcactctagcggtccagagctgtcctttctttccgtggggggaggcggtagctcgtctggcggacagtcatctgtgggtcgctcccagcccagaccggaggaggaggatgctggtgatgaactaagcctgtcgccatcccctgagggtctgggcgaaccacccgctgttccctatcccagaagactcgtcgtgctgaaacagctggctcactccgtggtcctcgcttgggagcctcctcccgaacaggtggaactgcatggtttccacatctgtgtgaacggcgagctcagacaggcattaggtcccggtgcccctcctaaagcagttctcgaaaatttggatctgtgggcaggacctctacacatctcggtgcaggccctaactagtagaggctccagcgaccctttaagatgttgcctagcggtgggggcacgcgcaggtgtggtgccgagccagctcagagttcacaggctgacagctacttctgctgaaataacctgggtgccaggcaattctaacctcgctcacgcgatttacctgaacggggaagagtgcccaccagcttctccatctacgtattgggccacattctgccacctgcgtcctgggacaccctaccaggcccaagtggaggctcaactgccccctcagggaccgtgggagcccggatgggaacgtctggagcagcgggctgctacccttcagttcactactctccctgcgggaccaccagacgcccctttggatgtgcagattgagcccggaccaagccccggaattctcataattagttggctgcctgtaaccattgatgcagctggcacctctaacggggtgcgagttaccggctatgcaatttatgctgacgggcagaagatcatggaagtcgcgagtcccacggccggatctgtcctggtagaactgagtcagctccagctgctgcaagtgtgcagagaggtcgtggttcggaccatgagcccccacggcgagtcggccgattccatccctgcccctatcacaccagcactggcaccagcttccctgcccgctagggtgagctgtccgagtcctcacccctccccagaggcaagggccccattagcctccgctagtccgggaccaggggacccctcatcacccctgcagcatcccgctcctcttggcacccaggagccccctggggctcccccagcgtctcccagcagagagatggctaagggaagccacgaggatccccctgcaccctgctctcaagaggaggcgggtgccgctgtcctaggaaccagtgaagaacggactgcatctacttcgacacttggggaaaaagacccagggccagcggctccgtctcttgccaagcaggaggcagagtggactgcaggtgaggcttgtcccgcttcctcttctactcagggagcacgggcacaacaggcccctaatacggagatgtgtcaaggtggcgatccagggagtgggcttcgtccaagggctgagaaggaagatactgctgagctcggggtgcatctggtcaacagcctggttgaccacggtcggaattctgatcttagcgatatccaggaggaagaagaagaggaggaagaggaagaggaagaagagctgggttctcgcacctgctctttccagaagcaggtggcaggtaattccatacgcgagaacggtgccaaatcccagccagatccattttgtgagactgacagtgacgaggaaatcctggaacagattctagaactacctcttcagcagttttgctcaaagaagctgttctccatccctgaagaagaggaggaggaagaggaggatgaggaggaagagaagagcggagccggttgcagctctagagacccagggccaccagagcccgcactcctgggcctcggctgcgatagtggccagccaagaaggcccggtcagtgtccactgtcgcctgagtcgtcgagagccggtgattgccttgaggacatgccagggctcgtgggtggctcttctcgcagacggggtggcggaagccctgagaaaccacctagccgcagaagaccaccagatccacgggaacactgctctcggctactgagtaacaatggccctcaagcttccggcaggctcggaccaacacgcgaaagaggcggtctccctgtgatagagggaccgagaactgggctggaagctagcggcaggggcaggcttggccctagccgccgatgcagccgagggagagcgctagagcctgggctcgcttcatgtcttagtccgaagtgccttgaaattagtatcgaatatgattcagaggatgagcaggaggccggtagtggagggatctcaatcacttcatcctgctaccctggcgatggagaagcctggggtactgccaccgtcggtcgacctaggggcccaccaaaagccaacagcggaccaaagccttacccaaggctcccagcctgggaaaagggcgaaccagagaggagaggcagaagcgcaaccgggagagccaaagaacccttatcacgggctacagaaacgggggaagcacgtggccaagacggtagtgggcgacgtggtccccagaagaggggtgtgagagtgcttcgaccgtctacggcagagctcgtaccagctcgcagcccaagcgaaacactggcttaccagcatctgcctgtgcggatcttcgtcgcacttttcgactacgatccagtgtcaatgtcacccaatcctgacgccggagaagaggaacttccattcagagaaggccaaatactgaaagtgttcggagacaaggatgcggacggcttctatcaaggcgaggggggaggtaggactggatacattccttgtaacatggtcgctgaagttgccgttgattctcctgctgggcgacagcagctactgcagcgaggatatttgtcacccgacatcttattagagggaagtggtaatggtccgtttgtttactctaccgcacataccaccggtcctccgccaaaacctaggcgaagcaagaaggcagaaagtgaaggcccagctcagccctgcccgggtcccccaaagctagtccctagcgctgacctgaaggcgcctcattctatggtggcggcattcgactataatccacaagaatccagcccaaacatggacgtggaggcagagctaccttttagagcaggcgacgtgatcacagtgttcgggggaatggacgatgatgggttctactatggggagctgaatggccagagggggctggtcccaagcaattttctggaaggacccggtccagaagccggaggactggaccgggaaccaaggaccccccaggctgagtcacagcggaccaggcgacgccgtgtacagtgcta

SEQ ID NO: 215913 - DNA, 5723 bp, Artificial Sequence
  Description of Artificial Sequence: Synthetic coding sequence
atggaacagctgacaacactcccccgacctggcgatcccggagcaatggaaccttgggccttgccgacgtggcattcatggacacctggcagaggcggtgaacccagctccgcagccccatcaatcgctgataccccgccagctgctctccaactacaggaactacggtcagaagagtcctcgaaacccaaaggagacggcagctcccggccagttggcggtacagatccggaaggcgctgaggcatgccttccatcactcgggcagcaagcatcgtcgagtggtcccgcatgtcagcggccagaggatgaagaagtggaggcattcttaaaagcaaaactgaatatgtcctttggggaccgcccaaatctggagttgttgagagccctcggggaactgaggcagaggtgtgccatcctaaaggaggaaaatcagatgctcagaaagagcagcttcccagaaactgaggagaaagtccgacgcctcaagaggaagaatgccgagctggccgtgatcgctaagaggctcgaagagcgggctaggaagctgcaagaaaccaacctgcgagtcgtgtctgctcccctcccaagacccggtacctccctggagctctgtagaaaggccctggcccgacaacgcgctagggatctgagtgagacagccagcgctctcctcgctaaggacaaacagatagcagcactccagcgggaatgcagagaattgcaggctcgactgacacttgtaggcaaagaaggaccccagtggctccacgtgcgcgattttgatagactattaagagagagccagcgggaggtactcaggcttcagcggcagatcgcactacgaaaccagagggagacactacccctgcccccatcctggccaccgggtccagcgttgcaggctagagccggagccccagctcccggagcgccaggggaggcaacaccacaagaagacgctgacaatctgcccgtcatacttggagagccagaaaaagaacagagagttcagcagctcgagtccgaactcagtaagaagaggaaaaagtgtgaatctctcgaacaagaagctcgcaagaagcagagaagatgtgaagaactggagctgcagctgcgtcaggcacagaacgaaaacgcccgactcgttgaagaaaatagccggctgtccggcagggccaccgagaaggagcaggtcgagtgggaaaacgctgagctgaggggacaactgctcggtgtaacccaggagcgagactcggccttgcgcaaaagccaaggcttgcaatctaaattagaaagcctggaacaagttctgaagcacatgcgggaggtcgcgcagagaaggcaacagctggaggtagaacacgagcaggcgcgattgtcactccgagagaaacaggaagaggtgcggaggttgcagcaggcgcaagccgaagctcagagggaacatgagggcgctgttcagctgctggagagtacattggattcaatgcaggccagggtgcgggaactcgaagagcagtgccggtcccaaaccgagcagttcagtctcttggcacaagaattacaggcgtttcgcttgcaccccggaccgctcgacctgttgacgagcgccctcgactgcgggtctctcggcgactgcccaccccctccgtgttgttgcagcattccccagccctgccgcggttcagggccaaaagatctggacttgccgcctggtagtccaggtagatgcacaccaaaaagcagcgaacccgctcctgcgactctgactggtgttcctcggagaaccgctaaaaaggctgagtccctttcaaactccagtcactctgagagcatacataattcccccaagtcctgtcccactccagaagtggatacagcctccgaagtggaagaactggaggctgactcggtttctctgctccccgctgctcccgagggaagccgcggtggagcacgcatccaagttttcctcgcaaggtattcctataatcccttcgagggccctaacgaaaatcccgaagccgaactacctctgactgcgggagagtatatctacatatacggcaacatggacgaggacggtttctttgaaggcgagctgatggacgggaggcggggactggtgcctagcaacttcgtggagcgcgtctcagatgatgatctactcacttccctcccgccagagctggcggacctctcacatagttccggccctgaactctcgtttctctctgtcggaggaggtgggtcatcctctggcggacaaagctctgtcgggaggtctcagccacgccctgaggaggaggacgcgggagacgagctgtctctctctccatccccagagggactcggtgaacctcctgccgtaccttacccgagaaggctggtcgtcctgaaacaactcgcccactctgttgttttagcctgggagcctccaccggaacaggtggagctgcacggctttcatatttgcgtcaacggagaactgcgccaggccctggggccaggcgcaccccctaaagccgtgcttgaaaatctcgacttgtgggccggtccccttcatatctctgtgcaggcccttacgtcgcggggtagcagcgaccccctaaggtgctgtctggccgtaggggctagggccggagtggtgccatcccagctgcgcgtacatcgattaacagccacaagcgctgagatcacatgggtgcccggaaacagcaatttagcccatgccatttacctcaatggggaagagtgtcccccagcgtcccccagcacttactgggctacattctgccatctgcgcccaggcaccccatatcaagctcaggtcgaggctcaactccctcctcagggtccatgggaacccggatgggagagactggagcagagggcggctacactccaattcaccacacttcctgcgggaccacccgatgcccctctggacgtacagatagagcccggtccttccccaggtattctgattatctcttggctgcccgtgaccattgatgctgcaggaacaagcaatggtgtccgggtgaccggatatgcaatatacgccgatggccaaaagataatggaggttgcaagcccaactgcaggaagtgtgctggtggagctgagtcagcttcagcttctacaagtgtgtcgagaggtggtagtccggaccatgtccccacacggtgagagcgctgactccattccagcaccaataaccccagctctcgcacccgcaagcttgccagcgagggtgtcctgcccctctccacatcccagcccggaggctcgggctccattggcaagtgcctctcctggcccaggagatccgtcctctcctctccaacatcctgcccctttgggcacacaggaacctccaggcgcaccaccggctagcccctcccgagaaatggctaaagggtcccacgaggatccacctgcaccatgctcacaggaggaagccggtgctgctgtgctgggtacttccgaagaacgaacggccagcacatcaactctgggggagaaggacccgggtcccgcagctcccagcctggctaagcaggaagcagagtggaccgcaggtgaggcctgtccggcttcatcttccacccagggagcgagagcacagcaagccccaaacacggaaatgtgccaggggggagatccaggcagcggcctgagaccaagggctgaaaaagaagacaccgccgagctcggcgttcacctggtcaattccctcgtggatcacggccgaaatagtgacctgtctgacattcaggaggaggaggaggaggaggaggaagaggaagaagaagagctcggatcacggacttgttcttttcagaagcaagtggcaggcaacagcattagggagaatggagctaagagccagcctgaccccttctgcgagactgattccgacgaggagatactcgagcagatcttagagctacctttgcaacagttttgttccaagaaactatttagcattccagaggaggaagaggaggaagaggaggacgaggaggaggagaagtccggggctggctgctcttctcgtgatcccggaccccctgaacccgcactattgggacttggctgcgacagtggacagccgaggagacccggacagtgtcccctgagccccgaaagctcaagagcaggggactgcctggaagacatgcccggtctcgtagggggatcaagccggaggaggggaggcggttcccccgagaagccgccaagccgcaggagaccgccagaccccagggaacactgtagcaggctccttagcaataacggacctcaggcatcaggccgtcttggacccacccgtgaacgcggaggtcttccagtcatagaaggaccacgtactggcctggaggcgtcgggtagaggaagactaggcccaagtcgcagatgctcacgcggtagagcgttagagcccggtctcgctagttgcctgagccctaaatgcctggaaatcagtatcgaatacgactcagaggacgaacaagaagccggtagtggagggatttctattactagttcatgttaccccggagatggagaagcatggggaacggcaactgtcggacggcctagaggacctcctaaagccaatagcggaccgaagccttatccgaggctccccgcatgggagaagggggagcccgagcgcagagggagaagcgccacggggagggctaaagagccgttgtcccgagccaccgaaaccggcgaagcccgtgggcaggacggcagcgggagaagaggccctcagaagagaggggtacgggtgctgcgcccttccactgctgaactcgtccctgctagatccccaagcgagacgcttgcatatcagcatctgccggtgcgaatttttgtggccctgttcgactatgaccccgtctcaatgagccccaatccagacgctggggaagaagagttaccttttagggaagggcagatcctgaaagttttcggagataaggacgcggacggtttttaccagggcgagggcggaggccgaactggctatataccatgtaacatggtcgcagaggtcgccgttgacagtccagctgggcgacagcagttgcttcagcgtggttacctgtccccggacattctgttggagggttccgggaatgggccatttgtctacagcaccgctcataccacaggcccaccaccaaaacctagaagaagcaaaaaggctgagagcgaggggccagcgcagccctgccccggaccccctaagctcgtcccctccgcagatctgaaggctccgcacagcatggtcgctgctttcgactataacccgcaagagtcctcccctaacatggacgtggaggcagagcttccctttcgagccggtgacgtcattacagtgtttgggggaatggacgacgacggcttctattatggtgagctgaatggtcagagagggctggtgccatccaacttcctggaaggtccaggacctgaggcgggtggccttgatagggagcccagaacaccccaggcagagtctcaggattggggctgtacaacgcagggcagcccgggaccacctggagggccttgtacaccctcctcagggtcagcgccacgtatcgagcgaggcgagccacaggggaggtccgaaaaagtttgggggttttttagcaagggtaaacagttgttacggcgtttaggaagcgggaaaaaggagta

SEQ ID NO: 215914 - DNA, 864 bp, Artificial Sequence
  Description of Artificial Sequence: Synthetic coding sequence
atggtcaacgacccacccgttccagctttgctttgggcccaggaggtgggtcaagtgcttgcaggcagggctagacgcctcctgctacaattcggcgtactgttctgcaccatcctgctgttactgtgggtctccgtctttctgtacgggtccttttattattcctacatgccaaccgtttcacatctttcgcccgttcatttctactatcggacagactgcgacagttccaccacaagcctctgcagctttcctgttgctaatgtgagccttacaaaaggaggacgggacagggtgcttatgtacggtcagccatatagagtgacgctggagctcgaactgcctgaaagcccggtgaaccaagacctgggcatgttcttggttacaatctcctgttacacccggggtggccgaattatctctaccagctcacggtctgtaatgctgcactatcggtctgacttgctgcagatgctggataccctcgtgttcagctcccttcttctgtttgggttcgcagaacagaagcaactgctcgaggtagaactctacgccgattatagagagaactcgtatgtgcccaccacaggggctatcatcgaaatccactccaaacgcatacagctctacggcgcttatctccgaatccacgcccattttaccgggctgaggcttactagtgagaaggagaccattcccggacgaaagtcgaatgaaggctctcttttgattagccaggggctcaaggcccgtcgctctcagctccggaatcagatgctccagagaatggtgagagcgctgaagatcccccaggggcagagagtcagttgccccagacgacgaaaccagattagctctccttag

SEQ ID NO: 215915 - DNA, 1389 bp, Artificial Sequence
  Description of Artificial Sequence: Synthetic coding sequence
atgtctacggaaaaagttgatcagaaagaggaggccggagaaaaagaggtgtgcggagatcagataaaggggcctgataaagaagaagaaccaccagccgctgcctcccacgggcaaggctggcgaccaggtggccgagcggcacggaatgccagacccgagccaggtgcccgtcaccctgcattgcctgccatggtgaacgatcctcccgtgcccgcactgctgtgggcccaggaggtaggtcaagtgctggcaggcagagctcgcaggctcctattgcagttcggcgtgttattttgtactattctcctcctgctgtgggtttctgtgttcctctatggctcgttttactattcatatatgcctactgtctctcacctgtctccggtgcacttctattatcgaactgactgcgattcttcaacaacttccctgtgcagtttccctgttgcaaatgtgtctctcactaagggcggtagggatcgtgtgctgatgtatggtcagccgtatagggtaacactggaattggagcttccggaatccccagtgaatcaggatctggggatgttcttggttaccatttcgtgctacactcgtggaggcaggattatttctacttcatctcgctcagttatgttgcattaccggtcagacttgctacagatgctggatacacttgtgttcagctcactgctgctcttcggatttgcagaacagaagcaacttctagaggtggaactatacgcagactatagagaaaactcctatgtgcccaccacaggggctattatcgaaatacattctaagcgaatccagctgtacggggcatacctcaggatccacgcccactttacaggactgaggtacctgctgtataacttcccaatgacctgtgccttcattggtgtcgcctccaatttcacctttctgtccgttattgtgctgttctcctatatgcagtgggtgtggggaggaatatggcctcggcacagattctctttgcaggttaacattcggaagcgggacaactcccgcaaggaagtccagaggagaattagcgcgcaccagccagggcctgaaggacaggaggagagcaccccgcagagcgacgtaacagaggacggcgagtctccggaggaccctagtggcaccgaaggccagttgtccgaggaggagaaacccgaccagcagcctttatcaggcgaagaggaactggagcctgaggcgtcagatggctcgggctcatgggaagatgccgcattgttgactgaggcaaacctgcccgctccggcacctgcaagcgctagcgcccctgttcttgaaactttagggtcaagcgaacctgcgggaggagcactccgccaaaggccaacatgtagttcatcttag

SEQ ID NO: 215916 - DNA, 1197 bp, Artificial Sequence
  Description of Artificial Sequence: Synthetic coding sequence
atggtgaatgaccctccagtccccgctctcttatgggcccaggaggtgggacaagttctggcaggtcgggctcgcaggctgctactgcagttcggtgtgctcttttgtacaatactgttgcttctctgggtatcagtgttcttgtacggctccttttattattcctacatgcctactgtcagtcacctgtccccagtgcacttctactacagaacagactgcgactcctccaccacgagcctttgctcttttcctgtggcaaacgtatcactcacaaagggtggacgtgatcgagtgctgatgtatggccaaccatatcgagtgacacttgagctggagctgccagaatccccagtaaatcaagatttagggatgtttctagttaccatctcatgttacacaaggggcggaaggatcattagtacctctagccggagcgtcatgctgcattaccgttcagacctgcttcaaatgctggacacgcttgtcttttctagtctgctcctgttcgggttcgctgagcagaaacaacttctagaggttgaactctacgcggactatcgtgaaaactcatatgtgcctacaactggcgcaattatcgagatccatagtaagcggatccagctgtatggtgcctatctgcgtatccatgcgcattttacagggctccgctacctgctgtacaattttcccatgacgtgcgccttcattggagtggcttccaatttcacattcctttccgtcatcgtgctatttagctatatgcagtgggtttggggagggatttggcctcggcataggttctccttgcaggtgaacatcagaaaacgcgataacagtaggaaggaagttcagaggcgcataagtgcacaccaacctggcccagagggtcaggaggagtctaccccccagtctgacgtcacagaggatggagagagccccgaagatccttccggtacggagggacaattatctgaggaagaaaagcctgaccagcagcccttgtccggggaggaagaactcgagcctgaggcaagtgatggatccggcagctgggaagacgcagcactcctgactgaggctaatctaccagccccagccccagcttctgcctcagccccagtgttggagactctgggctcctccgagccagccggtggcgcactgcgacagcggcctacatgtagcagcagctag

SEQ ID NO: 215917 - DNA, 1197 bp, Artificial Sequence
  Description of Artificial Sequence: Synthetic coding sequence
atggttaacgacccacctgtgcccgctctgctctgggcacaggaggtcgggcaggttcttgccggaagagctagacgccttctgctccagtttggagtgttgttctgtactatacttctgctcctgtgggtgtccgtgtttttgtacggatctttctattatagctacatgcccaccgtcagccatctgtcccccgtacatttttactatcgcacagattgtgactcctctacaacatctctctgctcatttccagtagctaatgtgtcacttacaaaaggcggacgagatcgagtgctgatgtatggtcagccctatagagtgaccctggaattagagctgccagagagtcctgttaaccaggacctcgggatgttcctggtaacaattagttgctacacacgcggaggacgaataattagcacatcctccaggtcagttatgcttcactaccggtcagatctccttcaaatgctggacaccctagtgtttagttccctactactgttcggttttgccgagcagaagcaactgctagaggtcgagctgtatgcagattaccgagagaattcatacgttcctaccaccggcgcaattattgagattcattcaaagcgtatacagctctacggagcctatctaagaattcatgcacattttacggggctcagatacttactgtacaacttccccatgacttgtgcctttatcggagtggcctccaatttcaccttcctatccgttatcgtgctgtttagctatatgcagtgggtgtggggagggatctggcctcggcatagattttcactgcaggtcaatattagaaagagggataattcccggaaagaggttcagaggagaatcagtgcacaccagccaggccctgaaggtcaggaggaatcaacccctcaatcagacgtgaccgaggacggggagtctcctgaagacccttcaggtacagaaggacagctctctgaagaggaaaagccagatcagcagccgctgtcgggcgaagaggaactcgagcctgaagcttctgacggctctgggtcctgggaggacgccgcactgctaactgaggccaaccttccagcacctgcacccgcttctgcaagcgctccagttcttgaaactctgggctcttctgagcccgctggcggagcccttcgacagcgtccaacttgctcatctagctag

SEQ ID NO: 215918 - DNA, 1197 bp, Artificial Sequence
  Description of Artificial Sequence: Synthetic coding sequence
atggtgaatgaccccccagtgccagcacttctgtgggcgcaggaggtggggcaggtgctggctggcagagccaggcggctgctgttacagttcggcgtccttttctgcacaatactgttactcttgtgggtgagcgtgtttctgtatgggagcttttactacagctacatgccgaccgtctcacatctttctccagtacacttttactaccgtacagactgcgactcctctaccacgagcctttgctcattccctgtggccaacgtgagtctgaccaaggggggaagagacagagtgctgatgtatggccagccttaccgcgtcacattggagctggagctgccggagagtcccgtgaaccaggatttagggatgttcttggtgaccatctcttgctatacaagaggtggcagaatcatctccaccagttcccggtcggtaatgctccattacagaagcgatttgctacaaatgcttgacacactcgtcttttctagcctgcttctatttggctttgccgagcagaagcagttgttagaagttgaactctacgcagattacagagaaaattcgtatgtccctacaactggggctattattgagatccactctaaacggattcagttgtacggagcatacctgcgcatccacgcccatttcaccggcctacggtatctcctctataacttccccatgacctgcgcattcattggcgtagcatccaatttcactttcctgtcagtcatcgtactgttctcatacatgcaatgggtttggggcggaatctggccacggcatcgcttcagccttcaggttaacattcgaaaacgcgacaattcaagaaaagaagtgcagcgacgcattagtgcccaccaacctgggcctgaaggccaggaagaatctaccccccagtcagatgtgactgaagacggggagtcacccgaggatcccagtggaaccgaaggccaactgtcagaagaagaaaagccggaccagcagcccctgtctggtgaggaagagcttgaacccgaggcctctgacggttcgggctcatgggaggacgcagccctgctgactgaggctaacctaccagctcctgccccagccagcgcctcagcgcctgtcttggagactctgggttcttctgaacccgctggaggggcactgcgccagagacccacttgttcaagctcctag

SEQ ID NO: 215919 - DNA, 1389 bp, Artificial Sequence
  Description of Artificial Sequence: Synthetic coding sequence
atgtctaccgaaaaggtcgatcagaaagaggaggcaggagaaaaagaggtgtgtggagaccagatcaagggcccagataaggaagaagagccccctgctgcagcatcccacggccagggatggcgacctggaggcagggccgctcggaatgccagacctgaacctggcgctcgccaccctgcattgcccgctatggtcaacgatccaccagtccccgcactcttgtgggcacaagaagttggacaggtgctggcaggcagagccaggcgactcctgctccagttcggcgttctgttttgtactatcctgttactactgtgggtttcagtgttcttgtatggatctttctattactcttacatgcccactgtgagccacctgtctcccgtgcacttctactacagaaccgattgcgactcttcgacgacaagcttgtgtagtttccccgtggcaaatgtgtctctcaccaagggaggaagagatcgggttctgatgtatggccagccctacagggtcactctggaattagagttgcccgaatccccagtaaatcaggacctgggaatgtttctagtgactatttcctgctatacacgtggcggtcgaattatttctacttcctcccgcagtgtgatgctgcattacagatccgatctgctccaaatgttggacaccctggtctttagtagtctactgctgttcgggttcgccgagcagaaacagctccttgaggtggaattatacgctgattacagagagaactcttatgttcccactactggagcaatcatcgaaatccacagcaaaagaattcagctttatggggcatatttgaggatccatgctcatttcaccggcctccgctacttgttatacaacttccccatgacatgcgcttttataggcgtcgcctcgaactttactttcctgtcagtgatcgtcctattctcatacatgcagtgggtctggggtggcatatggccgcgacatcggtttagtctgcaggttaatatcagaaaaagggacaattccagaaaagaggtgcaacgcagaatctccgcccatcaacctggcccagaggggcaagaggagtcaacaccccagtccgacgtgaccgaggatggcgaatcaccagaggatccctccgggacagaggggcagttgtcggaggaagagaagcccgaccaacagccactgagcggggaagaagagctcgaacccgaggcctccgatggttccgggagctgggaagatgcagcccttctaaccgaggcgaaccttcctgcccctgcaccagcctcagcgtccgcacctgtgttggagaccttgggaagctccgaacccgcaggtggagccctgcggcaaaggccaacatgtagtagcagctag

SEQ ID NO: 215920 - DNA, 672 bp, Artificial Sequence
  Description of Artificial Sequence: Synthetic coding sequence
atggttaacgatcctcctgttcccgcactcctatgggctcaagaagtagggcaggtactggcgggacgtgccagacgcctcttactgcaattcggggtgctgttttgcaccatattgctgctgctctgggtctctgtgttcctctacgggtccttctactattcctacatgcctacggtttcacacctgtcccctgtacatttctactaccgcaccgattgcgactcgagcaccacctccctgtgttccttcccggtcgcaaacgttagtctcaccaaggggggtagggaccgcgttctgatgtacggacagccatatagggttaccctggaactcgagctccccgaatcaccagtgaaccaggacctcgggatgtttctcgtaactatctcttgctacactcgcggagggaggatcattagcacgagcagccgatccgtgatgctccactatcggtctgacctcctccaaatgctcgacactctggtgttcagctctttgctcttgttcggcttcgcagagcaaaaacagctgctagaagtggagctctacgcggactaccgagaaaactcctatgtcccaaccaccggggcaatcatagagattcatagcaaaaggattcagctgtacggagcatacctgcgcattcatgcacactttactggtctgtag

SEQ ID NO: 215921 - DNA, 282 bp, Artificial Sequence
  Description of Artificial Sequence: Synthetic coding sequence
atgagcaccgagaaggtggaccagaaggaagaagccggtgaaaaggaagtttgtggcgatcaaataaagggccctgataaagaggaagaaccacctgccgcagcttcccatggacaaggatggagacccggtggcagagccgcacgcaacgctaggcctgagccaggcgcacgccaccctgcactccctgccatggttaatgaccccccagttcccgcactgctgtgggcgcaggaagtgggccaagtgctggctgggcgagcgagaaggctcctcctctag

SEQ ID NO: 215922 - DNA, 681 bp, Artificial Sequence
  Description of Artificial Sequence: Synthetic coding sequence
atgtcaaccgaaaaggtggaccaaaaagaagaagctggtgagaaggaggtctgcggggatcagattaaagggcctgacaaagaggaagaacctcccgctgctgctagccatggacaaggttggcggccaggcggtagggctgcccgtaacgctcggccagagccaggtgcccgacatcccgcattgcccgctatggtgaacgaccccccagtgcccgcacttctgtgggctcaagaagttggacaggtgctcgctggaagggccagacggctgttattacagtttggagtgctgttttgcactattctgcttctactctgggtctctgtgtttctctacggatctttttactatagctatatgcccactgtctctcatctatcacccgtgcatttctattacagaacggattgcgacagctccaccaccagcctctgctccttcccagtagccaatgtgagcctcaccaaaggcggaagagaccgggtacttatgtatggacaaccctaccgcgttaccttggagttagagttgccagaatcaccagttaatcaggacctggggatgtttctggttactatctcctgctatacacggggagggagaattatatccacatcgtccaggtctgtgatgttgcactatcggtctgacctgctacagatgctcgacactttgtag

SEQ ID NO: 215923 - DNA, 72 bp, Artificial Sequence
  Description of Artificial Sequence: Synthetic coding sequence
atgtctacggaaaaagtggaccagaaggaggaggccggagaaaaagaggtctgcggtgaccagattaagtag

SEQ ID NO: 215924 - DNA, 87 bp, Artificial Sequence
  Description of Artificial Sequence: Synthetic coding sequence
atgagtacagagaaagttgatcagaaggaggaggctggggagaaggaggtttgcggggatcagataaaaggccctgacaaggagtag

SEQ ID NO: 215925 - DNA, 372 bp, Artificial Sequence
  Description of Artificial Sequence: Synthetic coding sequence
atgtcaactgagaaagttgatcaaaaagaggaggcgggagaaaaagaggtgtgcggcgaccagattaaaggtccagacaaagaggaagaacctcctgcagcagcaagtcacggacagggatggcggcctggtggacgagctgctcgcaacgcacggcctgaacccggagcaaggcatccagcactaccagccatggttaacgatccaccggttccggcactgttatgggctcaggaggttgggcaggtcctggcaggccgagcgaggcgcctgctgcttcaattcggtgtgctgttttgcaccatacttctgcttctgtgggtatcagtctttctgtacggtagcttctattatagctatatgcctacgtag

SEQ ID NO: 215926 - DNA, 300 bp, Artificial Sequence
  Description of Artificial Sequence: Synthetic coding sequence
atggttaacgacccaccggtgccagcactcctgtgggcccaagaagttggtcaggttctagccggacgcgctaggaggctgctgctgcagttcggagtattgttctgcactattctgcttctgctgtgggtgtccgttttcctttacggctctttctactatagctatatgccaaccgtttcacatctgtccccagtgcatttctattaccggacagactgcgattctagtactacgtctctttgcagttttcccgtggcgaatgtgtcccttactaaagggggtcgtgaccgagtgtag

SEQ ID NO: 215927 - DNA, 879 bp, Artificial Sequence
  Description of Artificial Sequence: Synthetic coding sequence
atggaattccagccaaaccaggaggatgaggaagacgcgcatgcaggaatcataggcagatttctgggattacagagccatgatcatcaccccccaagggcgaactcgagaactaagctgctgtggccaaagcgcgaatctctgttacacgagggactgcccaagaatcacaaggccgcaaagcaaaatgtcaggggccaagaggataacaaggcttggaagttaaaggcagtagacgcctttaaatctgcgcctctgtaccaaaggcccggttactattcagctccccagacacccctgtcccctactcccatgtttttccccctcgaaccaagtgccccttccaagctgcattcagtgaccggaatagacacaaaagacaagagcctgaaaaccgtaagtagcggtgccaaaaaatcttttgagctgctgagtgagagcgatggggctctgatggaacaccctgaggtctcccaggtgcgacggaagacagtagaattcaacttaaccgatatgccggaaataccagaaaatcacctaaaggagcccctcgagcaatcaccaacgaacatccataccaccctgaaagatcatatggatccgtattgggccctggagaatcgaagcgtgctgcatctgaatcaaggtcactgcatcgcactctgcccgaccccggcaagcctggccttgagtctgccattccttcacaacttcctggggtttcaccattgccagagtacactcgatcttcgccctgcattagcatggggtatttaccttgctacatttaccgggatactcggaaaatgtagcggccctttcctaacctccccatggtatcacccagaggatttcctgggaccaggcgagggcagatag

SEQ ID NO: 215928 - DNA, 1497 bp, Artificial Sequence
  Description of Artificial Sequence: Synthetic coding sequence
atgttcgagaaactgaccctgtactgtgactcatacatacaactcatccctatcagtttcgtcctggggttttacgtcacgctagtggtcacccgctggtggaaccagtacgagaatcttccatggcccgacaggctaatgagcctggtgtcaggctttgtggaaggaaaagatgagcagggtagactgctcaggcggactctcatcagatacgctaacctcggcaacgttctgattttacgcagtgtgtctaccgcagtttataagcggttcccatccgcacagcatcttgttcaggccggatttatgactccagccgagcataagcagctcgaaaaactctccctccctcataatatgttttgggttccatgggtctggttcgctaacttaagcatgaaagcttggctgggcggtaggatcagggaccccatccttctccagtctctactcaatgaaatgaacactctgagaacccaatgcggtcacttatatgcatatgactggatatcaataccgctggtatatacgcaggttgtcacagtggctgtgtactcattcttcctgacttgcctcgttggtaggcagtttctcaaccccgcaaaggcgtatcctgggcatgaactggacctggttgtccccgtcttcaccttccttcaattttttttctacgtcggctggctgaaggtgagcctcctggccgtggatgagatgcatcaggacctgccgcgtatggagcctgacatgtactggaacaaaccagaaccccagccaccatataccgctgcaagcgcccagttccggagggcttcctttatgggttcaacatttaacatctcactgaataaggaggaaatggaatttcaacctaatcaggaggacgaggaggacgcacatgccggaatcatcgggaggttccttggcctccaatcccacgaccaccatccccctagggccaactctcgcaccaagttgctgtggcctaagcgggagtcactacttcacgagggcctacctaagaatcacaaggcggcaaagcagaatgtgaggggtcaggaggacaataaggcttggaaactaaaggctgtggacgcctttaagagtgcgcctctctaccaaagacccggatactacagtgcaccacagacgcccctgtcccccaccccgatgttcttccctctggagccatctgccccatccaaactgcactctgtgacgggcatagataccaaggacaaaagtctgaaaacggtgagtagtggcgcaaaaaaatccttcgagctgctgtccgagtcagacggagcgttaatggaacaccccgaggtgtcacaagttcgaaggaaaacagtggagttcaacttgacagatatgcccgagatcccagaaaaccatttaaaggagccgctggagcagagtccaacgaatattcacactacactgaaggaccatatggacccctattgggcactggagaatagagatgaggcccactcatag

SEQ ID NO: 215929 - DNA, 1758 bp, Artificial Sequence
  Description of Artificial Sequence: Synthetic coding sequence
atgacgatcacatatacttctcaggtggcaaacgctagactggggagtttcagtcgcctgttgctgtgctggcgtggatccatatataaactcttgtacggggagttccttatctttctcttatgctactatattatccgcttcatctacaggttggccctcactgaagaacagcagctgatgtttgaaaagctgactctctattgtgatagctatattcagctcattccgatctcatttgtcctagggttttacgtaacacttgtggtgacacgatggtggaaccagtacgaaaacctcccgtggcctgatagactcatgagtttggtgagcggattcgttgagggcaaagacgagcagggaaggctgctccgtagaacccttatccggtatgcaaatctgggaaacgtgctcatattaaggtccgtcagtaccgcagtatacaagagatttccctcggcccaacatctggttcaggccggattcatgacacctgccgagcataaacagttggaaaaactgagtttaccacataatatgttttgggtgccctgggtctggttcgcaaacctctctatgaaagcatggctgggcggaaggattcgcgaccctatccttttacaatcactccttaacgagatgaacactctcagaactcagtgtggacatctgtatgcctatgattggatcagtatacccttggtctacacccaggtggtcacagtcgccgtgtattcctttttcctgacttgtctggtgggccgacaatttttgaaccccgctaaagcctacccgggtcatgaactggacctggtcgtgcctgtctttaccttcttgcagttttttttttacgtcgggtggttgaaggtcgcagagcaactgattaacccgttcggagaggacgatgatgattttgagactaattggattgtggatcggaatttgcaagtgagcctgctggccgtcgacgaaatgcatcaggacctgccaaggatggaacctgacatgtactggaacaagcccgagccgcagccgccttacacagccgcatctgctcaatttaggcgagctagctttatgggcagtacattcaacatttctctcaataaggaggagatggaatttcagccaaaccaggaggacgaggaggatgcgcatgccggaattatcgggagattcctcggtctccagtcccacgaccaccacccccctagagctaatagtagaactaagctgctttggcccaaaagggaatctctgctccacgagggactgccaaaaaatcacaaggctgccaagcagaacgtgcgcggacaggaagataacaaagcatggaaactgaaggcagtggacgccttcaagtctgctcccctgtaccaacggcctggctactactcagccccacaaaccccactgagtccaacacctatgttctttccactcgaacctagcgccccttccaaattgcactctgtaacaggcatagataccaaagacaagtctctgaaaaccgtgtccagtggggctaagaagagttttgaactcctgagtgagagtgacggtgcactgatggaacaccctgaggtaagtcaggtacgcagaaagacggtcgagttcaacttgaccgatatgcccgagatccctgaaaaccacctgaaggaacccctggagcagagccccacaaacatccatactacactgaaggaccacatggatccttactgggcgcttgaaaatcgcgatgaggcacatagctag

SEQ ID NO: 215930 - DNA, 813 bp, Artificial Sequence
  Description of Artificial Sequence: Synthetic coding sequence
atgaccatcacttatactagtcaggtcgctaacgcgaggctgggatccttcagtagactgctgctgtgctggcgcggtagtatttacaagttactctatggcgaattcttgatcttcctgttgtgttattacattatccgcttcatctatcggcttgcactgacagaggaacaacagctgatgttcgaaaaactgaccctgtactgcgactcgtacatccagctcatcccaatctcctttgtactgggcttttacgtcactctggtggttactaggtggtggaaccaatacgaaaatctgccgtggcccgaccgattgatgtctctggttagtggatttgtggagggaaaggatgagcagggcagattgctccgccgaacattaatacgctacgctaacctcggaaacgtgctcatcctgagatctgtgtcgacggccgtgtacaaaagattccccagcgctcagcacctcgtccaggccggttttatgacacccgctgagcacaagcagttagagaagttgtccttaccccataacatgttttgggtgccctgggtgtggtttgccaatctgtctatgaaggcgtggctgggtgggcgtattagagacccgatcctgctgcaaagtctgctgaacgaaatgaatactctccggactcagtgcgggcatctgtatgcctacgactggattagcatccccctcgtctacactcagccagagcagaggggcgacggagtgccagcacagagtgggggacgcggtggctgtagccggtggcaccactggccacttccccgacccgctgtgccctag

SEQ ID NO: 215931 - DNA, 1815 bp, Artificial Sequence
  Description of Artificial Sequence: Synthetic coding sequence
atgtttgagaagctcacgctctactgcgactcatatatccagttaatacccattagctttgtgctcggtttctacgtgaccctggtcgtgacgcggtggtggaatcagtacgagaacttaccatggccagacaggctgatgagcctcgtctccggctttgtggaagggaaggacgaacagggcagattgctgcggaggacattaattcggtatgctaatctgggcaacgttctgattttgcgcagcgtgtctacggccgtgtacaaaagatttcctagtgcccagcatctagttcaggcaggctttatgacacctgccgaacataagcagcttgagaagcttagtttgccccataacatgttctgggttccatgggtctggttcgctaatctgagtatgaaggcctggttaggaggccgtattcgggatcctattctgctgcaaagccttctaaatgaaatgaacacacttcgaacccagtgcggacacctatatgcatatgactggatttcaatacccctggtatacacccaagtcgttaccgtggccgtctactcattttttctgacctgcctggttggccgacagttcctaaatcctgctaaagcataccccggacacgagctcgacctggtggttccggtgttcaccttcttgcaattttttttttacgtgggatggctcaaagtggccgaacagttgatcaacccttttggcgaagacgacgacgactttgaaacaaactggatcgttgacaggaacctccaggtgtctctgcttgctgtcgacgaaatgcaccaggacttgcctagaatggaaccagatatgtactggaataaaccagagccccagcccccttacacagctgcttccgcccaatttagacgtgctagcttcatgggaagcacttttaatatctccctgaacaaagaagaaatggagtttcagcctaaccaggaagacgaagaagatgcccatgccggaatcatcggacgattcctgggactccagtctcacgaccatcacccaccaagggcaaactcaaggacgaaattgttgtggcctaaaagagagtcactgctgcacgaaggcctgcccaaaaatcacaaggccgctaagcaaaatgtcagaggacaagaagataacaaggcttggaaactgaaagccgtcgacgccttcaaatcggcccctttatatcagaggccaggatattatagcgctccccagacacccttgtcccccactcccatgttcttccctctggagcctagcgcaccatctaagctccactccgtcacaggcattgataccaaggataagtcactgaaaacagtgagctccggggctaaaaagtcctttgagttactctcggagtcagacggggctctgatggagcatccggaagtcagccaggtacgcagaaaaaccgttgagtttaatttgacagatatgcctgagattcctgagaatcatcttaaggagcccctcgagcagtccccaacgaatatccacacgaccctaaaagatcatatggatccctactgggcactggagaataggtccgtcctccacctgaaccagggccattgcatagccctctgccctacccccgcttcgctcgctctgtcattgcccttccttcacaacttcctcggatttcatcattgtcagtcaactttggacttgagaccggcactcgcttggggtatttacctggcgacattcaccgggatactcggtaagtgtagcgggccattccttaccagtccctggtatcaccccgaggatttcttgggtccaggcgaaggcagatag

SEQ ID NO: 215932 - DNA, 1530 bp, Artificial Sequence
  Description of Artificial Sequence: Synthetic coding sequence
atgacagttacttacaccgcaagggtggcaaacgctagattcggcggttttagccagttgctcctgctgtggcgaggctctatctataaactgctgtggcgggaattgctgtgcttcctcggtttctacatggctctgagcgcagcctaccggtttgtcctgaccgaagggcagaagcgatatttcgagaagctcgtgatctactgtgaccagtacgccagcttgattccagtgagttttgtgctcggattttacgtgaccctggtggtgaaccggtggtggtcacagtacctctgcatgcctctgcctgacgctctaatgtgtgtcgtggctggcacggtgcatggccgtgatgatcgcggtcgcctgtatcgcagaacattgatgcgatatgccggtctgtcagcagtgttgattctgagatctgtttctacggccgtgttcaaacggttccccactatcgatcacgtggtcgaagccggtttcatgactcgcgaggagcggaagaagttcgagaacttgaatagcagttataacaaatactgggtaccttgtgtttggtttagtaacctcgccgcacaagcccgtcgcgagggtcgaattagagacaattccgctttgaaactgctgctcgaagaactgaatgtcttcaggggtaagtgcggcatgctcttccattacgattggatatccgttcccctcgtatacacgcaggttgtgaccatcgccttgtattcatattttttggcatgccttatcggaaggcaatttcttgaccccgctcaggggtacaaggaccacgatctggacttgtgcgtccccatctttacgttgctgcagttcttcttttatgcgggttggcttaaagtagcggagcaactgatcaaccctttcggagaagacgatgacgatttcgagaccaatttccttattgatcggaatttccaagtctcgatgttggccgttgatgagatgtacgacgacttggctgtcctggaaaaggatctgtattgggacgcagctgaggccagagctccatatactgccgctacagtttttcaactgcgccagccatccttccagggttcaacttttgacatcactctggcaaaagaggatatgcagtttcagagattggatgggctggacgggcctatgggcgaagcgcctggagattttctgcagcgcctcctgccggcaggtgcaggcatggtagcaggtgggccactaggacgcagactttctttcctgctgagaaagaacagctgtgtgtcggaggcatcaaccggagcttcctgctcctgtgctgtggttcctgagggtgccgctccagaatgctcctgcggagacccactcctggaccccggtctcccagagcccgaagctccgcctcccgctggtcccgagccactgactctcattccagggccagtggaacccttcagcatcgtgaccatgccgggtcctagaggccctgcccctccctggctacctagcccaatcggtgaagaggaagagaacctcgcatag

SEQ ID NO: 215933 - DNA, 1530 bp, Artificial Sequence
  Description of Artificial Sequence: Synthetic coding sequence
atgaccgtgacttacacagccagggtggccaatgcgagatttgggggatttagtcagctgctgctactttggaggggctctatttataagctgctgtggagagaactgttgtgcttcttaggcttctacatggcgttgtctgccgcttaccgctttgtgctgacggagggccagaagcgctacttcgaaaaactggtaatatattgcgaccaatatgcctcgctcattcccgtgtcttttgtgttgggattctatgtcacgttagtcgtgaatagatggtggtctcaatacctttgcatgcccttaccggacgccctgatgtgtgtcgtggctggtaccgtgcacggcagggacgatcgcggtaggttgtaccgcaggacactgatgcgctacgctggtctgagcgccgtgttaatcctccgcagcgttagtaccgctgtatttaaaagatttcctaccattgatcatgtggtcgaggcgggttttatgaccagggaagagcggaaaaagttcgaaaacctgaacagttcctataataagtattgggttccttgcgtgtggttttctaatctggcagcccaggctcgcagggaagggaggatacgtgataacagcgctctgaaactgctcttggaggagctgaacgtgtttcgcggtaaatgcggaatgcttttccactatgattggatctccgtaccactcgtttacactcaggtggtgaccatcgctctgtattcctatttcctggcttgcctgatcggccgacagttcttagaccctgcacaggggtataaggaccacgacctcgacctttgtgttcctatctttacactcctgcagttctttttctacgcaggttggttaaaagtggccgaacaactgataaatccttttggagaagatgacgacgattttgaaacaaacttcctgatcgaccgcaatttccaagtatcaatgctggctgttgacgaaatgtatgacgatctcgccgtgctcgagaaggatctttattgggatgcagcagaagccagggcgccttacaccgcagccactgtgtttcagttaagacaaccatcctttcagggatccacttttgacatcaccttggcaaaagaggacatgcaattccagagactcgacgggctggacggccctatgggggaggcccctggcgatttcctccagcgcttgctgcctgctggcgcagggatggtggcagggggacccctagggaggcggttaagtttcttgctgcgcaaaaatagctgcgtcagcgaggcctctactggcgcaagctgctcctgcgcagttgtgcctgagggggctgctcctgagtgttcgtgtggagatccactgctagaccccggactgcctgagcccgaagccccacccccagctggacctgagccacttaccctaatcccaggcccagtggaacccttctcaattgtgacaatgccagggcctagaggccctgctccaccttggctcccctctccaattggggaagaagaggagaacctggcctag

SEQ ID NO: 215934 - DNA, 1530 bp, Artificial Sequence
  Description of Artificial Sequence: Synthetic coding sequence
atgacagtgacttacacagccagggtggcaaatgctcggttcggcggtttcagccagttgttgttattatggagaggctctatatacaaacttctgtggcgcgaacttctctgttttttggggttctacatggcgctttcagcagcctatcgctttgttctgactgaaggccagaaacgatattttgagaagttagttatttactgtgaccaatatgccagcctcatccctgtgtctttcgtcctcggcttctacgtaacgctcgtggtgaatagatggtggagtcaatatttatgtatgccacttcccgacgcgctgatgtgcgtggtggcaggaactgtccatggcagggacgaccggggaagactgtatagaaggaccctaatgagatatgctggcctgagtgctgttctgatcctgcgttcagtaagtaccgctgtgttcaaaaggtttcctactattgatcacgtggtagaagcaggctttatgaccagggaggaaaggaaaaaattcgagaatctgaatagctcctataataagtattgggtgccttgtgtgtggtttagtaatctggctgcacaggcccgtcgcgagggacgaatccgggacaactctgcccttaagttgctgctagaggaactaaacgtgttccggggtaagtgtggcatgctattccactacgattggatttcggtgccattggtgtacacccaggtggttaccatcgcactatatagttacttcctggcctgcctgatcggcagacagttcctggaccccgcacaaggttataaggaccacgatttagacctgtgtgttcccatcttcacacttctgcagttcttcttctacgccggttggctgaaagtcgcagagcaactgattaacccattcggtgaggatgatgacgattttgaaacgaactttttgatcgaccgaaattttcaggtgagcatgttggcagtcgacgagatgtacgatgacttagctgtgctagagaaagatctgtattgggacgctgccgaggcgagagcaccatacacagccgcaacggtgttccagctcaggcaaccgagcttccaaggaagcaccttcgacattaccctggcgaaggaggacatgcagtttcagaggttggatggactggacggacctatgggagaagcccctggagacttcctgcaaagactccttcctgccggagcaggaatggtggcaggtggcccattggggaggcgactaagttttcttcttcgcaagaatagctgcgtaagtgaggcaagcacaggagcctcctgttcatgtgcagtcgtcccagaaggagctgcccctgagtgcagctgtggtgaccccctgctggaccctggtctgcccgaacccgaggctccaccgccagccggacccgaacctctgacactcatccccggtcccgtagagcccttcagcatcgtaactatgcctggacctagaggtccggctcctccgtggctccccagccccattggtgaagaagaagagaaccttgcatag

SEQ ID NO: 215935 - DNA, 219 bp, Artificial Sequence
  Description of Artificial Sequence: Synthetic coding sequence
atgttcctaatatccagctcggtacacggctccgacgaacatggaaggctgctgcggaggacactgatgagatatgttaatcttaccagcctcctgatatttcgtagtgtgagtaccgcagtgtacaagaggttcccaaccatggaccacgtggtggaggcagagcgcactggaatgaagcccattttacctagttcattcgagatgcagagcttttag

SEQ ID NO: 215936 - DNA, 2007 bp, Artificial Sequence
  Description of Artificial Sequence: Synthetic coding sequence
atgacagttacttattcaagtaaggttgccaatgcaaccttttttggtttccatcgtctgcttctcaagtggagaggcagtatctataaactgttgtaccgcgagttcatcgtattcgctgtgctgtatacggcaattagtctcgtgtatcggctgttgctcacgggtgtgcagaaaaggtacttcgaaaagctgagcatctattgtgacaggtatgctgagcagatcccggtgacattcgtgctgggattctacgtgacgcttgtggtgaaccgatggtggaaccaattcgtgaatctgccttggccggaccgcttgatgttcttaatctcctcctccgtccacggcagcgacgaacacggacgcctcctcaggaggacacttatgagatacgttaacctgacctctctgctcatatttcggagcgtttccacagctgtgtataagcggttcccaacaatggatcatgtggtcgaggctgggtttatgaccacggacgaacgaaaactttttaaccatttgaagtctcctcacctgaagtactgggtcccatttatctggttcggaaatctggctacaaaggctagaaacgaaggcagaatcagggatagtgtggaccttcagtcactaatgacggagatgaacagatatagatcatggtgtagtttgctcttcggttatgactgggtcggaattccgttagtctacacgcaggtggtgacgcttgccgtctacacttttttctttgcttgtctgatcggaagacagtttctggaccctactaaagggtacgctgggcacgatctcgacttgtatattccaatatttaccctactgcagtttttcttctacgctggatggctgaaggtggccgaacagctgataaaccccttcggcgaagatgatgacgacttcgaaacaaactggtgcattgacagaaacctccaagtctctctgcttgcagtggacgagatgcacatgtcactcccaaagatgaagaaggacatttattgggatgactcggctgcgaggcccccttacaccctggccgcagccgattattgcatccccagtttcttaggatctactgttcaaatgggcctgtcaggatcagatttcccggatgaggaatggctgtgggattacgagaagcacgggcatcgtcactcgatgatcagaagggtgaagcgctttttatctgcacacgaacatccaagctctccgagacggagaagctatcgcaggcagacctctgacagtagtatgttcctgccgagagatgatctatcacccgctagagacctcctagatgtaccaagtaggaatccaccgagggcctctcccacctggaaaaagtcctgcttccctgagggatcccctacccttcatttctctatgggagagttgtcaactatcagggagacctcacagacttcgacactgcagagtctgacccctcaaagctcagtccggactagtccaatcaaaatgcctctcgttccagaagtgctcattacagccgcagaggcgccagtgcccacttctgggggttatcaccacgatagcgctacttccatactgtcttcagagtttactggagtccagccatcgaaaaccgaacagcagcagggccctatgggttcaatcctgtcccccagtgagaaggaaacgccgcctggagggccttccccccaaacggtgagtgcctctgccgaggaaaacatctttaattgcgaggaggaccctggcgatacattcctgaaacgttggtcattgcccggattcctgggtagctctcacacctctttgggcaatctgtcgcccgatccaatgtcctcacaacctgcgctgctcatcgacaccgaaacctcctctgaaatctctggaattaatatcgtggccggatcaagggtcagttccgatatgctttatctgatggagaatttggatacaaaagaaaccgacattattgagctcaataaagaaaccgaggagagccctaaatag

SEQ ID NO: 215937 - DNA, 1197 bp, Artificial Sequence
  Description of Artificial Sequence: Synthetic coding sequence
atgaccgtgacgtattcgtcaaaggttgccaatgccactttttttggcttccatagactgttactgaagtggcgtggcagcatctacaaacttctttaccgagagttcattgtgttcgctgtcctctacacagcgatttctctggtatacagactgctcctgaccggtgtccaaaagaggtattttgagaagctgtccatttactgtgaccggtacgctgagcagatccccgtgacctttgtgctgggtttctacgtgacactggtggtcaacagatggtggaatcagttcgtcaacttaccttggcctgatcgcctgatgtttctgatcagctcatctgttcatggatccgacgaacacggacggctgttgagacgaactttgatgcgatatgtcaacctcacctctctcttaatcttccggtctgtgtctactgcagtgtacaagagattccctactatggaccatgtggtggaagccggtttcatgaccacggacgagcgcaagctttttaatcacctgaagtcaccccaccttaagtattgggttcctttcatctggttcgggaacctggcaaccaaagcacggaatgaggggagaatcagggactctgtggatctgcagtctttgatgacagagatgaaccgctaccggtcttggtgtagcctgctgttcggttatgattgggtagggattcccctcgtgtatactcaagtggtgacacttgctgtctacaccttcttctttgcctgtttgattgggaggcaatttctggatcctaccaaaggatacgctgggcacgacctggatctgtatatccctattttcactctgctgcagttcttcttctatgcagggtggcttaaagtggcagagcagctcatcaatcctttcggcgaggacgacgacgactttgaaacaaattggtgcatcgatcgcaatctgcaagtgtcactgctggccgtggatgagatgcacatgagcctgccaaagatgaaaaaagatatatattgggatgactctgcagcccgacccccttacacattggctgctgccgactactgcatcccatccttccttgggtcaacggtccagatgggcaagcagatgccgaaaaacgaatggaagatggaagatattaaaattccgctcccacagccacagtttcagtgtgccaaatccgatcccggaggttag

SEQ ID NO: 215938 - DNA, 219 bp, Artificial Sequence
  Description of Artificial Sequence: Synthetic coding sequence
atgttcctgatttctagcagtgtgcatggaagcgacgaacacggtaggctgctgcgcagaactctcatgagatacgtcaacttaacatcactgcttatattccgctcagtatctacggccgtgtataagaggtttccaaccatggatcatgtggtcgaggctgaaaggactgggatgaagccgattctgcccagcagtttcgagatgcagtccttctag

SEQ ID NO: 215939 - DNA, 1368 bp, Artificial Sequence
  Description of Artificial Sequence: Synthetic coding sequence
atgaccactgacgaaagaaagcttttcaaccatttgaaaagtccgcacctaaagtattgggttcctttcatatggtttggtaacctggccacaaaggcaaggaatgagggccgtatcagagacagcgtggacttgcaaagcctcatgaccgagatgaaccgctacagaagctggtgctccttgctgtttgggtacgactgggtcggtattccactggtgtacactcaggtcgcggaacaattgattaatccttttggtgaagacgacgacgattttgaaactaactggtgcatcgatagaaatctgcaggtgagcctacttgctgtcgacgagatgcatatgagcctgccgaagatgaagaaggacatttactgggacgactctgccgcacgcccaccttataccctcgcagccgcagactactgtattccgagtttcttaggttccacagtgcagatgggactgtctgggtctgattttcccgacgaggaatggctgtgggattacgaaaagcatggccatcggcattccatgatccggagagttaagagatttctgagcgcacatgagcacccgagttcccctcgtagaagatcttaccgacgacagactagtgattctagcatgtttctcccgagggatgacctcagccctgcacgggacctgctagatgtgcccagtcgcaatcctccgagggcaagcccaacatggaagaaatcttgtttccctgaaggctcaccgaccctgcacttctctatgggcgagttgtcgaccatccgggagacctcccagacatccacactgcagagtctcactccccaaagttctgtgaggaccagcccaatcaagatgcccctggtcccggaggtgctgatcacagccgctgaagcccctgttcccacttccgggggttatcaccacgactctgccacatccattctgagttccgaattcacgggggtgcagccttctaaaactgagcagcaacagggtcccatgggtagcatccttagtccctcggagaaggaaacacccccaggagggccaagtccccagaccgtttctgccagtgccgaagagaatattttcaactgcgaggaggatccaggcgatactttcttaaaacggtggtccttgccaggattcctgggctcgagtcatacgtctctgggcaatcttagccctgaccccatgtcatctcagcctgctctgctgatagatacggaaacttcttccgagatttccggaataaatatcgtagccggttcgagggtgtccagtgacatgttatacctcatggagaatctggacacaaaggaaacagatatcattgaacttaacaaagagacagaagagtcaccaaagtag

SEQ ID NO: 215940 - DNA, 219 bp, Artificial Sequence
  Description of Artificial Sequence: Synthetic coding sequence
atgttccttatcagctcctccgtgcatggttcagatgaacacggacgcctcctccggcgtactctcatgagatatgtgaacttaaccagcctgctgatatttagaagcgtcagcactgctgtgtataagcggttccctactatggaccacgttgttgaagccgagcgcactggaatgaagcctatcctcccatcctcatttgagatgcagtctttttag

SEQ ID NO: 215941 - DNA, 1422 bp, Artificial Sequence
  Description of Artificial Sequence: Synthetic coding sequence
atgactgtgagttacacccttaaggtggccgaagcccgatttggcggattcagtggcttactgttgaggtggcgtggaagcatttacaagctgctgtacaaggaattcctgctgtttggcgctctttatgcagtgctcagcataacttataggctcctcctcacccaggagcagaggtatgtatatgctcaggtggcccgttactgcaaccgatcagccgacttgatccctctctctttcgtgctgggattttatgttaccctggtggttaaccgttggtggagtcagtatactagcataccactgccagaccagctgatgtgtgtgatctcagccagcgtccatggcgtggatcagagaggaaggcttctgcgtcggacgctgatccggtacgccaatctcgccagcgtcctggtactcagatctgtaagcacccgcgtgcttaaacgcttcccaactatggaacacgtggtcgatgcaggctttatgagccaggaggaaagaaagaagttcgagtctcttaagagtgattttaataaatactgggtgccctgcgtgtggttcaccaatttggccgctcaggctagaagggacggacggatccgcgacgacatcgctttgtgtctgttgctggaagagctgaacaaatacagggcaaaatgctcaatgctatttcactacgattggattagcattccactggtgtacactcaggtcgttaccatcgccgtctattccttcttcgccctttctctcgtcggccgtcagtttgtagagcccgaagccggagccgcaaagcctcagaaattgctcaagcccggacaggaacctgctccagcgctcggcgatcccgatatgtacgtgccactaactacattattacagttcttcttttatgctggctggttaaaggtggcggagcagataataaatcccttcggggaggatgatgacgatttcgagaccaaccagctaattgacagaaatttgcaggtgtcactgctttctgtggacgagatgtaccagaacctgccacctgcagagaaggatcagtattgggatgaggatcagccccagcccccttataccgtggctaccgctgccgaaagcctgcggccaagttttctcggctctacctttaacctgagaatgtccgatgatccagagcagagtttgcaggtcgaagcatctccgggatctgggagacctgcaccggctgctcagacgccactcctgggccgtttcctcggggtcggtgctccatctccagccataagcctccgtaactttggtagggtgcgtgggacacccaggccccctcatctcctgaggttccgtgcagaagaggggggtgaccccgaggctgcagcccgaatcgaagaagaatcggctgagagtggcgacgaagcgctggagccctag

SEQ ID NO: 215942 - DNA, 294 bp, Artificial Sequence
  Description of Artificial Sequence: Synthetic coding sequence
atgtatctcggtattacgccttcagtaacatgcaataactcttctaagaacgaattctccttgatcttggagaaaaatccactggtggagttcgttgaggaattacccgcaggtaggtccagcttgtgctattgtaacctgttgtgcggtatcatcaggggagccttagaaatggtccatctggcagctgatgtcaccttccttcaggatcgactcaagggggattcagtgactgagatcggaatcacatttttaaaaaagcgggacgaaaagaaataccgcggtaagaaatag

SEQ ID NO: 215943 - DNA, 546 bp, Artificial Sequence
  Description of Artificial Sequence: Synthetic coding sequence
atgtcacggcctgcccaccgaagacctgagtaccacaaaataaacaaagatctctttgttctgacttatggcgcactggtagcccagctctgcaaagactacgagaaggatgaagatgtaaatcagtacctggacaagatggggtatggaataggcacccgacttgttgaagactttctggccaggagctgcgttggacgctgccattcttattccgaaattatagacattatcgcgcaggttgcctttaagatgtacctggggatcactccatcagtcacttgtaacaacagctctaagaacgagttttcgttaattctggagaagaatcctctagtggagtttgtggaggagctgccagcgggacgatccagtctgtgctattgcaatctgctctgcggcataataaggggagcactggagatggtacacctggctgcggatgtcactttccttcaggaccggttaaagggggactccgtcactgaaatcggcatcacgttcctgaaaaaacgcgacgagaaaaaatacaggggtaaaaagtag

SEQ ID NO: 215944 - DNA, 504 bp, Artificial Sequence
  Description of Artificial Sequence: Synthetic coding sequence
aataaggatctcttcgtgctgacttacggcgcactggtggcccagttatgcaaggattatgaaaaggatgaggacgtcaatcagtatctcgacaagatgggctatggtataggcacacggctagtagaagatttcctagctcgaagttgcgtgggaaggtgccacagctattcagagatcatcgatatcatagcccaggttgctttcaagatgtatctcgggatcacaccaagcgtgacttgcaataatagttccaaaaatgagttttctctcatcctcgaaaagaatccgttagttgagtttgtggaagagctgccagccggaagaagttccctgtgttattgcaatttgctctgtggaattataaggggagccttagagatggtgcacctggctgccgatgtgacatttttgcaggacaggctgaagggtgattctgtgaccgaaattggaatcacatttctgaaaaagagagacgagaagaaatatagaggcaaaaagtag

SEQ ID NO: 215945 - DNA, 1497 bp, Artificial Sequence
  Description of Artificial Sequence: Synthetic coding sequence
atgcgcccaccggcatgttggtggcttctggcccctcccgcactactggcactacttacgtgttccctcgcctttggcctcgcatccgaggataccaaaaaggaagtgaagcaaagccaggatctggagaaaagtggcatttccaggaaaaacgacattgatctcaaagggatcgtgtttgtgattcaatcccagtccaatagctttcatgctaaacgcgctgaacaactgaaaaaaagcatccttaagcaggccgctgatttgacacaggagctgccctctgtccttctgctccatcagttagcgaagcaggagggagcatggacaatcctgccactcctgccacacttcagtgttacatatagcagaaattcttcatggatctttttttgcgaagaagagacacgcatccagatccctaaattgctagaaacactcagacgctatgacccaagtaaggagtggtttctaggaaaggcgctccacgatgaggaggctaccattatccaccactacgctttctccgaaaaccccaccgtgtttaaatatcccgatttcgccgctggatgggcactgtctatcccccttgtcaataaactgaccaaacgattaaagtccgagagtctgaaatccgattttaccatagacctgaagcacgagattgctctgtacatctgggacaagggtggtggaccccctctcacgcctgttccagagttttgtacgaacgacgtggacttctattgtgctactaccttccactctttccttcccctgtgccgaaaacccgtgaaaaaaaaggatatcttcgtggccgttaagacgtgtaagaagttccatggcgaccgcattcccattgtcaaacaaacctgggagagtcaggcatcattgatcgagtattattcggactataccgagaactctatccccaccgtagatctggggatccccaatacagatcggggacattgcggaaaaactttcgcaatactcgagaggttcctgaacaggtcacaggacaagaccgcatggcttgttattgttgatgacgacactttaattagcatttcacgactgcagcaccttctttcttgttatgatagcggggagcctgtctttctgggagaacggtacggttacggtctgggcacgggcggatactcatatataacaggcggaggaggaatggtcttcagccgcgaagccgtgaggcgcctcctcgccagtaagtgtcgatgctacagtaacgatgcgcctgatgacatggttctcggcatgtgcttttcgggtttaggcatccctgtgacccattcacccctgtttcaccaagccaggccagtagattaccctaaggactacttatcacaccaggtccccatttccttccacaaacattggaatattgatccagtcaaagtgtattttacatggttggccccatcagatgaagacaaggcccgtcaggagactcaaaagggcttccgggaggagctgtag

SEQ ID NO: 215946 - DNA, 1005 bp, Artificial Sequence
  Description of Artificial Sequence: Synthetic coding sequence
atgccgaaacgccgagacattctggcaatcgtacttattgtgctcccttggaccttgctgatcacagtctggcatcagtcgaccttggcccctctgcttgctgtccataaagacgagggcagtgacccacggcgagaaacccctcctggcgctgaccctcgtgaatattgcacaagcgatcgggatattgtggaggttgtccgcacagaatacgtctatacgcggccacctccatggagcgatacgttgcctacaatccacgtcgtcactcccacctattcgagacctgtgcagaaagccgaactgaccagaatggccaacacattgctgcatgtcccgaacctgcactggctggtggtcgaggacgccccaagacgaactccgctgacagccaggctcctgagagatacaggtctgaactacacccatctgcacgtggaaaccccgagaaattataagcttaggggcgacgcaagggatccacggataccaagaggcacgatgcaacggaacttagctttgcgctggttgcgcgagacctttccgagaaatagtagtcagccaggggttgtgtactttgctgacgatgacaacacatactccctggagctcttcgaggaaatgcggagtactaggcgggtgagcgtgtggcctgtcgcctttgtaggagggttgcggtacgaagccccaagagtgaatggcgctggcaaagttgtcggatggaagacagtgttcgatccacacaggccattcgctatcgatatggcaggctttgctgttaacctgcggttgatacttcagaggtcccaggcctactttaagctcagaggtgtcaaaggtggctaccaggagagctctctcctacgtgagttggtaaccctgaatgatctcgaacctaaggctgccaattgtacgaaaatcttggtctggcacactcgtaccgagaagccagttctcgttaatgagggcaaaaaaggtttcaccgatccaagtgttgagatttag

SEQ ID NO: 215947 - DNA, 1005 bp, Artificial Sequence
  Description of Artificial Sequence: Synthetic coding sequence
atgcccaaaagaagggacattctggctatcgtattaattgtcctgccgtggacacttctgataaccgtgtggcatcaatctaccctcgctcccctactcgccgttcacaaagatgagggctctgatcccagacgcgagacccctcccggagccgaccctcgcgagtactgcacgtcagatcgagacattgttgaggtcgttcggacggaatatgtatatacacgacctcctccgtggtctgatactctgccaactatccacgtggtgacccctacctacagcagacctgttcagaaagctgaactgacaagaatggctaatactctgctgcacgttcccaacctgcactggctcgttgtcgaagatgcacctcgccgaacacccctgacagccaggctgctgagggacaccgggctcaattatactcacctgcacgtggagacccccagaaactataaattacgcggtgatgcacgggaccctcgtattccccgtggcacaatgcagcggaacctggctttgagatggcttagggaaacttttccacgaaacagttctcaacccggagtagtctattttgcagatgacgataatacctattctttggagctcttcgaggagatgagaagcaccagacgcgtttctgtctggcccgtggcattcgtgggcggactcagatatgaggctccacgcgtgaacggagcagggaaggtggtcggatggaaaaccgtgttcgatcctcacagaccattcgccatagacatggccggattcgcagttaacctccgcctcatcttgcagagatctcaggcgtactttaagcttcgcggagttaagggcggatatcaggaaagctcacttctgcgtgagcttgtcactctcaacgacctggagcctaaggcagctaactgcacaaagatcttagtgtggcacacaagaaccgaaaaacccgtcttagtcaacgaagggaaaaaaggatttacagatccatcagtcgaaatttag

SEQ ID NO: 215948 - DNA, 1005 bp, Artificial Sequence
  Description of Artificial Sequence: Synthetic coding sequence
atgcctaagaggagggatattcttgccattgtcctcattgtcctgccgtggactctgctgatcacagtgtggcatcagagtacactggccccactgctcgcggtccacaaggatgaaggatctgaccctagacgtgagacccccccaggtgccgatcccagggagtattgcacgtccgacagagatatagtcgaggtggttcgcactgagtacgtttatacacgtccacctccttggtctgacacactgccaaccatacacgtggtgacccccacctatagccgtcctgtccagaaggctgagcttacaagaatggcaaacacactgttacacgttcccaacttgcattggctggtggtagaagatgctcctcggagaactcctctcaccgccaggctgttgagagatactggcctgaattatacgcacctccacgtcgaaacccccaggaactataaactgaggggcgacgctcgggatcccaggatcccacgaggtacgatgcagcgcaatttggcgctgcgctggctgcgagagacgtttcctcgcaacagcagtcagcccggagtggtgtatttcgccgatgacgacaacacatactccctcgagctattcgaggaaatgagaagtacccgcagagtgtctgtgtggcccgttgcattcgtgggaggacttagatatgaagccccacgcgtcaacggggcaggtaaggtcgttggctggaaaactgtgtttgatccccaccggccatttgcaatcgacatggccggatttgccgtgaacctccgtctgatactgcagcgctctcaggcatattttaagctgcggggagtgaaaggaggctatcaggagagtagtctgctgcgagagcttgtcaccctcaacgacttggagcctaaagctgcaaactgcacaaagattctggtctggcatactcgcaccgagaaacctgtactggtgaacgagggcaagaagggcttcacagacccaagcgttgagatctag

SEQ ID NO: 215949 - DNA, 1044 bp, Artificial Sequence
  Description of Artificial Sequence: Synthetic coding sequence
atgggcaatgaggagccatgggtgcagccagctctcgaaatgcccaagcggagggacattctggcaattgtcctcatcgtgttgccttggacccttctgattaccgtgtggcatcagtccactctggccccactgctcgcagtgcataaagatgaggggagtgatccacgaagagagaccccacccggtgccgatcctcgggaatattgcacatccgatagagatattgtagaggtagtgcggaccgagtacgtctatacacgccctcctccttggtcggatacactcccaacgattcacgtggtgacacccacctacagtagacccgtacagaaggccgaactaacccggatggctaataccctgttgcatgtgccaaacctgcattggttagtagtcgaggatgcacccagacgtactcctttgacagccagacttctccgcgacactggccttaattatacccacctccatgttgaaacccctcggaattacaaactccggggtgatgccagggatccgaggattcctcgaggcaccatgcagcgaaacctggctctcagatggctcagggaaacattccctcgaaactcttctcagcctggagtggtttattttgctgatgatgacaacacgtattctctggagcttttcgaagagatgaggagcacacggcgagtgtctgtttggcctgtcgcatttgttggcggactgaggtacgaggcgcctagggtgaatggtgcagggaaggtggtgggttggaagacggtgtttgacccccacaggccattcgccattgacatggctggttttgcggtaaacctccggctgatattgcagcgtagtcaagcttatttcaaactgcggggtgttaaaggcggttaccaggaatcttcgctgttgagggagctggtgacacttaatgacctcgaacccaaggcagctaattgcacaaaaattctggtttggcacaccaggactgagaagccggtcctggtaaacgagggaaagaagggattcacggacccatccgtggagatttag

SEQ ID NO: 215950 - DNA, 1008 bp, Artificial Sequence
  Description of Artificial Sequence: Synthetic coding sequence
atgaagctaaagctgaaaaatgtgttcctggcgtacttcctcgttagtatcgctggcctcctgtacgccctggtacaactgggccagccatgtgattgtctccccccactacgggctgctgccgagcagttaaggcaaaaggatctgcggattagccagctacaagctgagctccgaaggcccccacctgccccagcacagcctcccgagcccgaagcactgcctacaatttacgtggttaccccaacatacgccaggctggtccagaaggcagagctggtccgcctttcacagacactctctcttgtgccacggttacattggctgctcgtggaagatgctgaggggcctacccctcttgtaagtggtcttctcgccgctagcgggctgctgtttacacatttagtggtgctgacacctaaggcacagaggctacgtgagggggaacccggttgggtccacccgagaggggtggagcagagaaacaaagcgctggattggttgagaggaagaggcggagctgttgggggagagaaggacccccctccaccaggtactcagggggtcgtgtacttcgcagacgacgacaacacttattctcgcgagctgttcgaagagatgcgttggacacgaggggtctctgtatggcctgttggactggtcgggggactgcggtttgagggccctcaagtccaagatggccgagtcgtcggtttccacacagcttgggaacccagtcgccctttcccagtggacatggctggatttgcagttgctctgccgcttctgctcgacaagcctaacgctcaatttgattctacggccccaagaggacacctcgagagctctttactgagtcacctggttgaccctaaggaccttgagccacgggcagctaactgcactagggtcttggtctggcacacgaggaccgagaaacccaagatgaagcaggaggaacagctgcagcgtcaggggagggggagcgatcccgcaattgaggtgtag

SEQ ID NO: 215951 - DNA, 948 bp, Artificial Sequence
  Description of Artificial Sequence: Synthetic coding sequence
atgaaactcaagctcaagaacgtcttcttagcgtattttttggttagtatcgctgggcttctatatgccctggtgcagctgggacagccatgtgattgcttgccccctctgcgcgctgcagcagaacagttgcgtcaaaaagatttgaggatcagccagctacaggctgaactaaggagaccccctcccgctccggctcaacccccagagcccgaggcgctcccgaccatttacgtggttaccccgacatatgcgagactggtgcaaaaggcagaactggtccgcctgtctcagacactatccctcgtgcctaggctccattggttgctggtggaagatgccgaagggccaacccctctggtgagcggcctgttggcagccagtggcctgttgttcactcatctcgtggttcttaccccaaaagcgcagcgactgcgggagggcgagcctgggtgggtacatccaaggggggtcgagcaacgcaataaagctctagactggctgcgtgggagggggggagctgtcggtggcgagaaggacccccctccgcctgggacacaaggggttgtatacttcgctgacgatgataatacttactcacgagaactgttcgaggaaatgcggtggactaggggcgtgtccgtgtggcctgtggggctggtaggaggactgcgctttgaaggacctcaagttcaggatgggcgagtggtgggattccacaccgcctgggagcccagtcgtccttttcccgtggacatggccggtttcgccgtggctctgcccctgctattggacaagcccaacgctcagtttgattctacagctcccaggggacacctggaatcctccctgttgtcccatctggtggacccgaaagatctcgagccgagggctgccaattgcaccaggactgaaagcaggtgcgtgactcaggccggagtacagtag

SEQ ID NO: 215952 - DNA, 2997 bp, Artificial Sequence
  Description of Artificial Sequence: Synthetic coding sequence
atgggcagtcctcgggcagcccgtccgccactactgctgcgcccagttaagttgctgaggaggagattcagattactgctggctctggctgtggtaagcgttgggttgtggacactatacctcgagctcgtcgccagcgcacaggtcggaggtaatcccctaaaccgcagatacgggtcctggagagagcttgccaaagccctggcaagtcgcaatattcccgcagtggatccacacctacagttctaccaccctcaacgcctaagcctcgaggaccatgacattgaccagggtgtgagttcaaactcctcatatctaaagtggaacaaacctgtgccatggctgtctgagttccgaggcagggccaacttacacgtgttcgaagactggtgcgggagttccattcagcagctacgcaggaatctccacttccccctgtaccctcatattcgaactaccctgaggaaacttgccgtctctccaaagtggacaaattatggactccggatttttggatacttgcatccattcactgacggcaaaatccagtttgcaatcgcggcagacgacaatgcggaattttggctgtccctggatgatcaggtctcagggctgcagttgctcgctagcgtaggaaaaacaggaaaggagtggaccgccccaggtgaatttggcaaattcagatctcagataagcaaaccggtgtccctgagcgcctcgcaccggtactatttcgaagttctccataagcagaacgaggaaggcacagatcacgtcgaagtggcctggagacgaaatgaccctggagcgaaattcacgataatcgatagcctcagcctgtcgctgttcactaatgaaaccttcctgcagatggatgaagttggccatatcccccagaccgctgcttcacacgttgacagctctaacgcattgcccagagacgagcagcctccagcagacatgctgaggccagaccccagggatactctctatcgagtccctctgatccccaaaagtcatctgagacacgtcttacccgactgcccttataaaccttcttacttagtagacggtctccccctgcagcgataccaggggctcaggttcgtccatctgtctttcgtgtacccaaatgattacacccgattgtcccacatggagacacataataagtgcttttatcaggaaaacgcgtactatcaagacagattttcattccaagagtatattaaaatcgatcagcctgagaaacaagggctggaacagccaggcttcgaagaaaatctcctggaagagagccaatatggtgaagtggccgaagagaccccagcttctaacaaccagaatgctaggatgctcgagggcaggcagacacccgcaagtacactcgagcaagacgcaacggattatcgcttaagaagccttaggaagcttctggcccagccaagagagggactcctcgcacccttttctaagcgtaatagcacagcttcattccctggtcgcaccagtcatattcccgtgcagcagcccgagaaacgtaagcaaaagccgtctcctgagcccagccaagactcccctcattctgacaaatggcctccaggacacccagtgaaaaacctgccccaaatgcgtggcccaaggcctaggccagccggagattcaccacgaaagactcaatggctaaaccaggtcgaaagctatatagccgagcaacgtaggggcgataggatgagaccgcaggcacctggcagggggtggcatggggaggaagaagttgtcgcagctgcgggacaggagggccaggtggagggagaagaggagggagaggaagaggaggaagaagaagatatgagcgaggtgttcgaatacgtcccagtgttcgatcccgtggttaactgggaccaaactttctcagcacgcaatctggattttcaggctctccgaaccgactggattgacctgagctgtaacacttcgggaaacctactgttgcctgagcaggaagccctggaagtaacccgggtcttcctcaaaaagctcaaccagaggagcagaggcaggtaccaacttcaacggattgtgaacgtagaaaagcggcaggaccagctgcgtgggggtcgctacctactcgaattagagctgttggagcaaggccagcgcgttgttcggctaagtgagtatgtgtcggcaagaggatggcaaggcatcgatcccgcaggcggagaggaagttgaagccaggaatctgcaaggccttgtgtgggatccccataatcggaggcgccaagttttgaatacaagggctcaagaacctaaactgtgctggccacaggggttcagctggtcgcacagagccgtggttcacttcgtggtcccggtcaagaatcaagcgaggtgggtgcagcagttcataaaagatatggagaatttattccaagtgaccggggacccccattttaacatcgtgatcaccgattactccagcgaagatatggatgtggaaatggcactgaagcgatccaagctgagatcttatcagtatgtgaagctgagtgggaatttcgaaagatcagcagggctccaggcaggaatcgatctcgtgaaggaccctcattccataattttcttgtgcgacctgcatatacacttccctgcaggcgtcatcgacgccattaggaaacactgtgtggagggtaaaatggcatttgcaccaatggttatgaggcttcactgtggcgctaccccccagtggccggagggctattgggaagtgaatggcttcggattattaggcatttataagagtgacttggaccgaattgggggaatgaatacgaaagagtttagggacagatggggcggagaagattgggagctgctcgaccgcattctacaggcagggttggacgtggagcggctttctctgaggaactttttccatcacttccactcaaagcggggaatgtggagcaggcgccagatgaagacactttag

SEQ ID NO: 215953 - DNA, 306 bp, Artificial Sequence
  Description of Artificial Sequence: Synthetic coding sequence
atgagcaggagtgtcgccttggccgttcttgcactgctttctctgtctggactcgaagccattcaacgaacaccaaaaattcaggtgtacagccgtcaccctgccgaaaacggtaagagcaactttctcaactgttacgtgtcaggattccatccatctgacatcgaagtggatctcttaaagaatggagaacgaattgagaaggtggaacactcagatctcagtttctccaaggactggtcattctacctgctctattacacagagtttacgcccacagagaaaatgagcatgcccgctgtttag

SEQ ID NO: 215954 - DNA, 369 bp, Artificial Sequence
  Description of Artificial Sequence: Synthetic coding sequence
atgtctaggtcagtggcactggcagtgcttgcattattaagcctgagcgggctggaggccatccagcggacaccaaagattcaagtttattccaggcaccccgctgagaacggtaaatctaacttccttaattgttacgtatcaggtttccacccctccgatattgaagtggatctactcaaaaatggggaaagaattgaaaaggttgaacatagcgatctgtcgttcagcaaagattggtccttttacttattgtattacaccgagttcactccaaccgagaaagacgagtacgcctgcagggtcaaccatgtcaccctctctcagcctaagattgtaaagtggggaaaaagttatatccttttatag

SEQ ID NO: 215955 - DNA, 360 bp, Artificial Sequence
  Description of Artificial Sequence: Synthetic coding sequence
atgtcccgctctgtcgcactggcggttctcgccctcttgagtctgtccggactggaagctatccagaggacgccaaagatacaggtctactcccgacatcccgcagagaacgggaagagtaacttcctcaattgctacgtgagtggctttcacccctcagacatcgaggtagacctgctcaagaatggagagaggattgagaaagtcgaacacagtgacctgtccttctccaaggactggagcttctaccttctgtattatacagagtttacacccacagagaaagacgagtatgcttgtagggtcaaccacgtgacactttcacagcccaagattgtgaaatgggatcgcgacatgtag

SEQ ID NO: 215956 - DNA, 369 bp, Artificial Sequence
  Description of Artificial Sequence: Synthetic coding sequence
atgtctcgatccgtagcacttgcggtactcgccttactttctcttagtggcttggaggcgatacagcggaccccgaagattcaggtgtacagcagacatcctgctgagaacgggaagagcaactttcttaattgttacgtctccggctttcaccccagcgacatcgaagtggatctcttgaagaatggagaaagaatcgaaaaggtagaacattcggatctcagtttctcaaaagattggtcattctacctgctgtactatactgaatttacgccgaccgagaaggatgaatacgcctgtagagtgaatcacgtgacgctgagtcagccaaagattgtcaagtggggcaaatcctatatcctgttatag

SEQ ID NO: 215957 - DNA, 360 bp, Artificial Sequence
  Description of Artificial Sequence: Synthetic coding sequence
atgagccgttctgtggcattagccgtccttgcattgctctctttgtcaggcctagaagcaatccagcggacacccaagatccaagtttactcaagacaccccgctgaaaatgggaaaagcaacttcctgaactgctatgtgtccggcttccacccctctgacatagaagtggacctgctgaaaaacggcgagcgtatagagaaagtagagcactcagacctcagcttctccaaggactggagtttttacctactttactacacggaatttactcctacagagaaggatgagtatgcgtgtcgggtcaatcacgtgactctatcccagcccaagatagtgaaatgggatagagacatgtag
